United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 98

SEQ ID NO: 4147033 - DNA, 19 bp, Homo sapiens
ggcacacagcagcccccca

SEQ ID NO: 4147034 - DNA, 22 bp, Homo sapiens
ggcacacagcagccccccagca

SEQ ID NO: 4147035 - DNA, 18 bp, Homo sapiens
ggcacacgcacaaacaca

SEQ ID NO: 4147036 - DNA, 17 bp, Homo sapiens
ggcacactacagagcag

SEQ ID NO: 4147037 - DNA, 19 bp, Homo sapiens
ggcacactacagagcagct

SEQ ID NO: 4147038 - DNA, 23 bp, Homo sapiens
ggcacagacacgctcgcgggcag

SEQ ID NO: 4147039 - DNA, 14 bp, Homo sapiens
ggcacagccctccg

SEQ ID NO: 4147040 - DNA, 15 bp, Homo sapiens
ggcacagcctagggt

SEQ ID NO: 4147041 - DNA, 19 bp, Homo sapiens
ggcacaggagtgtcctctt

SEQ ID NO: 4147042 - DNA, 20 bp, Homo sapiens
ggcacaggagtgtcctcttc

SEQ ID NO: 4147043 - DNA, 14 bp, Homo sapiens
ggcacaggccccct

SEQ ID NO: 4147044 - DNA, 14 bp, Homo sapiens
ggcacagggagaag

SEQ ID NO: 4147045 - DNA, 13 bp, Homo sapiens
ggcacagggagag

SEQ ID NO: 4147046 - DNA, 17 bp, Homo sapiens
ggcacagggcaccagag

SEQ ID NO: 4147047 - DNA, 18 bp, Homo sapiens
ggcacagggcaccagagg

SEQ ID NO: 4147048 - DNA, 22 bp, Homo sapiens
ggcacagggcaccagaggccga

SEQ ID NO: 4147049 - DNA, 14 bp, Homo sapiens
ggcaccagaggccg

SEQ ID NO: 4147050 - DNA, 15 bp, Homo sapiens
ggcaccagaggccga

SEQ ID NO: 4147051 - DNA, 20 bp, Homo sapiens
ggcacccacaagtgccactg

SEQ ID NO: 4147052 - DNA, 19 bp, Homo sapiens
ggcaccccctggagagaag

SEQ ID NO: 4147053 - DNA, 16 bp, Homo sapiens
ggcaccctcagggagc

SEQ ID NO: 4147054 - DNA, 15 bp, Homo sapiens
ggcaccgagaatgtt

SEQ ID NO: 4147055 - DNA, 19 bp, Homo sapiens
ggcaccgccacgtcccagc

SEQ ID NO: 4147056 - DNA, 16 bp, Homo sapiens
ggcacctaatccaggc

SEQ ID NO: 4147057 - DNA, 13 bp, Homo sapiens
ggcacctgtctgc

SEQ ID NO: 4147058 - DNA, 22 bp, Homo sapiens
ggcacctgtctgctccagctct

SEQ ID NO: 4147059 - DNA, 20 bp, Homo sapiens
ggcacggtcacacggccacc

SEQ ID NO: 4147060 - DNA, 23 bp, Homo sapiens
ggcacggtcacacggccacccgc

SEQ ID NO: 4147061 - DNA, 13 bp, Homo sapiens
ggcactggcccag

SEQ ID NO: 4147062 - DNA, 17 bp, Homo sapiens
ggcactgggaggcaggg

SEQ ID NO: 4147063 - DNA, 20 bp, Homo sapiens
ggcactgggatgagccgctg

SEQ ID NO: 4147064 - DNA, 12 bp, Homo sapiens
ggcactgggctg

SEQ ID NO: 4147065 - DNA, 15 bp, Homo sapiens
ggcacttaagcacaa

SEQ ID NO: 4147066 - DNA, 20 bp, Homo sapiens
ggcacttactggtccttacc

SEQ ID NO: 4147067 - DNA, 21 bp, Homo sapiens
ggcacttactggtccttacca

SEQ ID NO: 4147068 - DNA, 23 bp, Homo sapiens
ggcacttactggtccttaccaga

SEQ ID NO: 4147069 - DNA, 17 bp, Homo sapiens
ggcacttagtaggtcct

SEQ ID NO: 4147070 - DNA, 18 bp, Homo sapiens
ggcacttagtaggtcctc

SEQ ID NO: 4147071 - DNA, 23 bp, Homo sapiens
ggcacttagtaggtcctcaataa

SEQ ID NO: 4147072 - DNA, 17 bp, Homo sapiens
ggcactttttcgtgtgg

SEQ ID NO: 4147073 - DNA, 14 bp, Homo sapiens
ggcagaaaggaaaa

SEQ ID NO: 4147074 - DNA, 22 bp, Homo sapiens
ggcagaaaggaaaacctgaaga

SEQ ID NO: 4147075 - DNA, 20 bp, Homo sapiens
ggcagaaaggttctgcccgg

SEQ ID NO: 4147076 - DNA, 21 bp, Homo sapiens
ggcagaactcccacaaccaca

SEQ ID NO: 4147077 - DNA, 12 bp, Homo sapiens
ggcagaagacac

SEQ ID NO: 4147078 - DNA, 14 bp, Homo sapiens
ggcagaagggaatt

SEQ ID NO: 4147079 - DNA, 15 bp, Homo sapiens
ggcagaagggagaag

SEQ ID NO: 4147080 - DNA, 23 bp, Homo sapiens
ggcagacagcaggcagcgccaag

SEQ ID NO: 4147081 - DNA, 16 bp, Homo sapiens
ggcagacgggagggga

SEQ ID NO: 4147082 - DNA, 17 bp, Homo sapiens
ggcagagaaagaagaga

SEQ ID NO: 4147083 - DNA, 18 bp, Homo sapiens
ggcagagaaagaagagac

SEQ ID NO: 4147084 - DNA, 13 bp, Homo sapiens
ggcagagcacagc

SEQ ID NO: 4147085 - DNA, 14 bp, Homo sapiens
ggcagagccctgct

SEQ ID NO: 4147086 - DNA, 20 bp, Homo sapiens
ggcagagccctgctccctcc

SEQ ID NO: 4147087 - DNA, 14 bp, Homo sapiens
ggcagagctgcatc

SEQ ID NO: 4147088 - DNA, 20 bp, Homo sapiens
ggcagagctggagcccccag

SEQ ID NO: 4147089 - DNA, 24 bp, Homo sapiens
ggcagagctggagcccccagcaga

SEQ ID NO: 4147090 - DNA, 14 bp, Homo sapiens
ggcagagggctgga

SEQ ID NO: 4147091 - DNA, 20 bp, Homo sapiens
ggcagatctgtgccccatgc

SEQ ID NO: 4147092 - DNA, 17 bp, Homo sapiens
ggcagatgtcttccctg

SEQ ID NO: 4147093 - DNA, 18 bp, Homo sapiens
ggcagatgtcttccctgg

SEQ ID NO: 4147094 - DNA, 22 bp, Homo sapiens
ggcagatgtcttccctgggctg

SEQ ID NO: 4147095 - DNA, 20 bp, Homo sapiens
ggcagcacagtgtgtgaact

SEQ ID NO: 4147096 - DNA, 13 bp, Homo sapiens
ggcagcaccctcc

SEQ ID NO: 4147097 - DNA, 16 bp, Homo sapiens
ggcagcaccctccccc

SEQ ID NO: 4147098 - DNA, 19 bp, Homo sapiens
ggcagcaccctcccccgca

SEQ ID NO: 4147099 - DNA, 17 bp, Homo sapiens
ggcagcatagcaagaca

SEQ ID NO: 4147100 - DNA, 16 bp, Homo sapiens
ggcagccaaacccatg

SEQ ID NO: 4147101 - DNA, 13 bp, Homo sapiens
ggcagccaggctg

SEQ ID NO: 4147102 - DNA, 21 bp, Homo sapiens
ggcagcccactgcaccgcctc

SEQ ID NO: 4147103 - DNA, 14 bp, Homo sapiens
ggcagccccagaga

SEQ ID NO: 4147104 - DNA, 19 bp, Homo sapiens
ggcagccgcggtgcccaac

SEQ ID NO: 4147105 - DNA, 19 bp, Homo sapiens
ggcagccgtgccttcagct

SEQ ID NO: 4147106 - DNA, 21 bp, Homo sapiens
ggcagccgtgccttcagctct

SEQ ID NO: 4147107 - DNA, 22 bp, Homo sapiens
ggcagccgtgccttcagctcta

SEQ ID NO: 4147108 - DNA, 16 bp, Homo sapiens
ggcagcctccagcctg

SEQ ID NO: 4147109 - DNA, 22 bp, Homo sapiens
ggcagcctcccatccagggccc

SEQ ID NO: 4147110 - DNA, 19 bp, Homo sapiens
ggcagcgggatctcgtatc

SEQ ID NO: 4147111 - DNA, 18 bp, Homo sapiens
ggcagctcacccctgggc

SEQ ID NO: 4147112 - DNA, 19 bp, Homo sapiens
ggcagctcacccctgggca

SEQ ID NO: 4147113 - DNA, 22 bp, Homo sapiens
ggcagctcacccctgggcaggc

SEQ ID NO: 4147114 - DNA, 15 bp, Homo sapiens
ggcagctctggacag

SEQ ID NO: 4147115 - DNA, 23 bp, Homo sapiens
ggcagctgaggacacaccccaca

SEQ ID NO: 4147116 - DNA, 16 bp, Homo sapiens
ggcagctggatgagac

SEQ ID NO: 4147117 - DNA, 14 bp, Homo sapiens
ggcagctgtttctc

SEQ ID NO: 4147118 - DNA, 22 bp, Homo sapiens
ggcagctgtttctcatgaagct

SEQ ID NO: 4147119 - DNA, 18 bp, Homo sapiens
ggcagcttcaagtgcctt

SEQ ID NO: 4147120 - DNA, 14 bp, Homo sapiens
ggcaggaccaggac

SEQ ID NO: 4147121 - DNA, 14 bp, Homo sapiens
ggcaggagggaggt

SEQ ID NO: 4147122 - DNA, 14 bp, Homo sapiens
ggcaggatggcctt

SEQ ID NO: 4147123 - DNA, 20 bp, Homo sapiens
ggcaggcacacagcagcccc

SEQ ID NO: 4147124 - DNA, 10 bp, Homo sapiens
ggcaggcagg

SEQ ID NO: 4147125 - DNA, 13 bp, Homo sapiens
ggcaggccagtgt

SEQ ID NO: 4147126 - DNA, 20 bp, Homo sapiens
ggcaggccagtgtctgggtt

SEQ ID NO: 4147127 - DNA, 15 bp, Homo sapiens
ggcaggctcactgcc

SEQ ID NO: 4147128 - DNA, 19 bp, Homo sapiens
ggcaggctcactgccaggc

SEQ ID NO: 4147129 - DNA, 22 bp, Homo sapiens
ggcaggctcactgccaggccag

SEQ ID NO: 4147130 - DNA, 12 bp, Homo sapiens
ggcaggctgggc

SEQ ID NO: 4147131 - DNA, 14 bp, Homo sapiens
ggcaggctgggcca

SEQ ID NO: 4147132 - DNA, 22 bp, Homo sapiens
ggcagggagcggccggccagcc

SEQ ID NO: 4147133 - DNA, 20 bp, Homo sapiens
ggcagggcccttggggctgg

SEQ ID NO: 4147134 - DNA, 19 bp, Homo sapiens
ggcagggcgggcagagggc

SEQ ID NO: 4147135 - DNA, 16 bp, Homo sapiens
ggcagggctgtgcttg

SEQ ID NO: 4147136 - DNA, 19 bp, Homo sapiens
ggcaggggagacaggagcc

SEQ ID NO: 4147137 - DNA, 21 bp, Homo sapiens
ggcaggggccctgcagctctc

SEQ ID NO: 4147138 - DNA, 13 bp, Homo sapiens
ggcaggggtgggg

SEQ ID NO: 4147139 - DNA, 19 bp, Homo sapiens
ggcagggtgtctgccccct

SEQ ID NO: 4147140 - DNA, 16 bp, Homo sapiens
ggcaggtcctgcccat

SEQ ID NO: 4147141 - DNA, 19 bp, Homo sapiens
ggcaggtcctgcccatgtg

SEQ ID NO: 4147142 - DNA, 16 bp, Homo sapiens
ggcaggttggatggga

SEQ ID NO: 4147143 - DNA, 20 bp, Homo sapiens
ggcagtcattggctgtctcc

SEQ ID NO: 4147144 - DNA, 11 bp, Homo sapiens
ggcagtccctt

SEQ ID NO: 4147145 - DNA, 21 bp, Homo sapiens
ggcagtgatggttgccaggac

SEQ ID NO: 4147146 - DNA, 17 bp, Homo sapiens
ggcagtgccccagggag

SEQ ID NO: 4147147 - DNA, 21 bp, Homo sapiens
ggcagtgccccagggagtcca

SEQ ID NO: 4147148 - DNA, 21 bp, Homo sapiens
ggcagtgggacagggcatggc

SEQ ID NO: 4147149 - DNA, 20 bp, Homo sapiens
ggcagtggtaagctctggct

SEQ ID NO: 4147150 - DNA, 14 bp, Homo sapiens
ggcagttggccaga

SEQ ID NO: 4147151 - DNA, 21 bp, Homo sapiens
ggcatacgcctgtagtcctag

SEQ ID NO: 4147152 - DNA, 22 bp, Homo sapiens
ggcatagaggcttctccgccag

SEQ ID NO: 4147153 - DNA, 15 bp, Homo sapiens
ggcataggcctgggt

SEQ ID NO: 4147154 - DNA, 23 bp, Homo sapiens
ggcatatcttctatatctgaaga

SEQ ID NO: 4147155 - DNA, 13 bp, Homo sapiens
ggcatcaaccacc

SEQ ID NO: 4147156 - DNA, 21 bp, Homo sapiens
ggcatcaagaggtgggagggc

SEQ ID NO: 4147157 - DNA, 14 bp, Homo sapiens
ggcatcatggtgga

SEQ ID NO: 4147158 - DNA, 15 bp, Homo sapiens
ggcatcccagcctgg

SEQ ID NO: 4147159 - DNA, 18 bp, Homo sapiens
ggcatctacacagcctgg

SEQ ID NO: 4147160 - DNA, 22 bp, Homo sapiens
ggcatctacacagcctggactt

SEQ ID NO: 4147161 - DNA, 16 bp, Homo sapiens
ggcatctcctgtgcat

SEQ ID NO: 4147162 - DNA, 21 bp, Homo sapiens
ggcatctcttccccagagagg

SEQ ID NO: 4147163 - DNA, 18 bp, Homo sapiens
ggcatctgcccctccccc

SEQ ID NO: 4147164 - DNA, 15 bp, Homo sapiens
ggcatcttgctggct

SEQ ID NO: 4147165 - DNA, 15 bp, Homo sapiens
ggcatcttggaaaag

SEQ ID NO: 4147166 - DNA, 16 bp, Homo sapiens
ggcatctttgccttgg

SEQ ID NO: 4147167 - DNA, 19 bp, Homo sapiens
ggcatctttgccttgggct

SEQ ID NO: 4147168 - DNA, 22 bp, Homo sapiens
ggcatctttgccttgggctgct

SEQ ID NO: 4147169 - DNA, 13 bp, Homo sapiens
ggcatgccttgtg

SEQ ID NO: 4147170 - DNA, 18 bp, Homo sapiens
ggcatggccaggtggcca

SEQ ID NO: 4147171 - DNA, 16 bp, Homo sapiens
ggcatgggtccagggc

SEQ ID NO: 4147172 - DNA, 16 bp, Homo sapiens
ggcatgtctgcctgga

SEQ ID NO: 4147173 - DNA, 12 bp, Homo sapiens
ggcatgttttga

SEQ ID NO: 4147174 - DNA, 17 bp, Homo sapiens
ggcattaatgtttctat

SEQ ID NO: 4147175 - DNA, 17 bp, Homo sapiens
ggcattagaattattta

SEQ ID NO: 4147176 - DNA, 12 bp, Homo sapiens
ggcattccttct

SEQ ID NO: 4147177 - DNA, 16 bp, Homo sapiens
ggcattcgggccacag

SEQ ID NO: 4147178 - DNA, 19 bp, Homo sapiens
ggcattgaggaagagtctt

SEQ ID NO: 4147179 - DNA, 12 bp, Homo sapiens
ggcattgctttc

SEQ ID NO: 4147180 - DNA, 20 bp, Homo sapiens
ggcatttgcagggtcctctt

SEQ ID NO: 4147181 - DNA, 15 bp, Homo sapiens
ggcatttttatttta

SEQ ID NO: 4147182 - DNA, 15 bp, Homo sapiens
ggccaaaagcttccc

SEQ ID NO: 4147183 - DNA, 14 bp, Homo sapiens
ggccaacaaagaac

SEQ ID NO: 4147184 - DNA, 22 bp, Homo sapiens
ggccaacttgagggcccagagc

SEQ ID NO: 4147185 - DNA, 13 bp, Homo sapiens
ggccaagagaagg

SEQ ID NO: 4147186 - DNA, 23 bp, Homo sapiens
ggccaagaggtttggctcctgcc

SEQ ID NO: 4147187 - DNA, 16 bp, Homo sapiens
ggccaaggccttctcc

SEQ ID NO: 4147188 - DNA, 23 bp, Homo sapiens
ggccaaggggtgggcctgtgaat

SEQ ID NO: 4147189 - DNA, 23 bp, Homo sapiens
ggccaagtccgcagaagccctga

SEQ ID NO: 4147190 - DNA, 12 bp, Homo sapiens
ggccaataaaaa

SEQ ID NO: 4147191 - DNA, 16 bp, Homo sapiens
ggccacactcagcaca

SEQ ID NO: 4147192 - DNA, 19 bp, Homo sapiens
ggccaccccctatcctctg

SEQ ID NO: 4147193 - DNA, 21 bp, Homo sapiens
ggccacccgttctgctggcct

SEQ ID NO: 4147194 - DNA, 24 bp, Homo sapiens
ggccacccgttctgctggcctgga

SEQ ID NO: 4147195 - DNA, 18 bp, Homo sapiens
ggccaccctgtgcagaag

SEQ ID NO: 4147196 - DNA, 14 bp, Homo sapiens
ggccacctgtagcc

SEQ ID NO: 4147197 - DNA, 18 bp, Homo sapiens
ggccacgcactgggccac

SEQ ID NO: 4147198 - DNA, 17 bp, Homo sapiens
ggccacgccccagcccg

SEQ ID NO: 4147199 - DNA, 18 bp, Homo sapiens
ggccacgctccagctgcc

SEQ ID NO: 4147200 - DNA, 18 bp, Homo sapiens
ggccactaaagcttcaga

SEQ ID NO: 4147201 - DNA, 20 bp, Homo sapiens
ggccactggggactttattt

SEQ ID NO: 4147202 - DNA, 21 bp, Homo sapiens
ggccagagagcctggtgctgc

SEQ ID NO: 4147203 - DNA, 11 bp, Homo sapiens
ggccagagcca

SEQ ID NO: 4147204 - DNA, 21 bp, Homo sapiens
ggccagagctgggaggcatgg

SEQ ID NO: 4147205 - DNA, 22 bp, Homo sapiens
ggccagaggaactgtccagaga

SEQ ID NO: 4147206 - DNA, 13 bp, Homo sapiens
ggccagagggagc

SEQ ID NO: 4147207 - DNA, 18 bp, Homo sapiens
ggccagagggagctggaa

SEQ ID NO: 4147208 - DNA, 15 bp, Homo sapiens
ggccagagggcagtg

SEQ ID NO: 4147209 - DNA, 18 bp, Homo sapiens
ggccagagggcagtggcc

SEQ ID NO: 4147210 - DNA, 18 bp, Homo sapiens
ggccagagtggcctggcc

SEQ ID NO: 4147211 - DNA, 18 bp, Homo sapiens
ggccagatccagcctggg

SEQ ID NO: 4147212 - DNA, 21 bp, Homo sapiens
ggccagatgcacatccctgga

SEQ ID NO: 4147213 - DNA, 16 bp, Homo sapiens
ggccagcaaggcaggt

SEQ ID NO: 4147214 - DNA, 15 bp, Homo sapiens
ggccagcccagccag

SEQ ID NO: 4147215 - DNA, 14 bp, Homo sapiens
ggccagccccaccc

SEQ ID NO: 4147216 - DNA, 11 bp, Homo sapiens
ggccagccccg

SEQ ID NO: 4147217 - DNA, 13 bp, Homo sapiens
ggccagcccctgg

SEQ ID NO: 4147218 - DNA, 20 bp, Homo sapiens
ggccagcccctggggcccag

SEQ ID NO: 4147219 - DNA, 23 bp, Homo sapiens
ggccagcccctggggcccagccc

SEQ ID NO: 4147220 - DNA, 16 bp, Homo sapiens
ggccagccctgcagcc

SEQ ID NO: 4147221 - DNA, 16 bp, Homo sapiens
ggccagcctccgagag

SEQ ID NO: 4147222 - DNA, 22 bp, Homo sapiens
ggccagcctccgagagggagag

SEQ ID NO: 4147223 - DNA, 15 bp, Homo sapiens
ggccagcgggcacag

SEQ ID NO: 4147224 - DNA, 16 bp, Homo sapiens
ggccagcgggcacagg

SEQ ID NO: 4147225 - DNA, 17 bp, Homo sapiens
ggccagcgggcacaggg

SEQ ID NO: 4147226 - DNA, 19 bp, Homo sapiens
ggccagcggggctgctcac

SEQ ID NO: 4147227 - DNA, 14 bp, Homo sapiens
ggccagcgtcccag

SEQ ID NO: 4147228 - DNA, 17 bp, Homo sapiens
ggccagcgtcccagggt

SEQ ID NO: 4147229 - DNA, 19 bp, Homo sapiens
ggccagcgtcccagggtac

SEQ ID NO: 4147230 - DNA, 11 bp, Homo sapiens
ggccagctccg

SEQ ID NO: 4147231 - DNA, 19 bp, Homo sapiens
ggccaggacaccagtccag

SEQ ID NO: 4147232 - DNA, 16 bp, Homo sapiens
ggccaggcacagggcc

SEQ ID NO: 4147233 - DNA, 17 bp, Homo sapiens
ggccaggcacagggccc

SEQ ID NO: 4147234 - DNA, 16 bp, Homo sapiens
ggccaggccaccagga

SEQ ID NO: 4147235 - DNA, 16 bp, Homo sapiens
ggccaggccctgagag

SEQ ID NO: 4147236 - DNA, 15 bp, Homo sapiens
ggccagggagaagct

SEQ ID NO: 4147237 - DNA, 18 bp, Homo sapiens
ggccagggagaagctcct

SEQ ID NO: 4147238 - DNA, 16 bp, Homo sapiens
ggccagggcatgtgta

SEQ ID NO: 4147239 - DNA, 19 bp, Homo sapiens
ggccagggcatgtgtatgt

SEQ ID NO: 4147240 - DNA, 21 bp, Homo sapiens
ggccagggccacgctccagct

SEQ ID NO: 4147241 - DNA, 14 bp, Homo sapiens
ggccagggctgccc

SEQ ID NO: 4147242 - DNA, 17 bp, Homo sapiens
ggccagggctgccctga

SEQ ID NO: 4147243 - DNA, 18 bp, Homo sapiens
ggccagggctgccctgag

SEQ ID NO: 4147244 - DNA, 19 bp, Homo sapiens
ggccagggctgccctgaga

SEQ ID NO: 4147245 - DNA, 23 bp, Homo sapiens
ggccagggtctgtgtgaatgtgg

SEQ ID NO: 4147246 - DNA, 16 bp, Homo sapiens
ggccagggtgagagct

SEQ ID NO: 4147247 - DNA, 19 bp, Homo sapiens
ggccaggtggccactccag

SEQ ID NO: 4147248 - DNA, 19 bp, Homo sapiens
ggccagtcctcctgggagc

SEQ ID NO: 4147249 - DNA, 18 bp, Homo sapiens
ggccagtcctgcctggcc

SEQ ID NO: 4147250 - DNA, 19 bp, Homo sapiens
ggccagtcctgcctggcca

SEQ ID NO: 4147251 - DNA, 22 bp, Homo sapiens
ggccagtcctgcctggccaggc

SEQ ID NO: 4147252 - DNA, 17 bp, Homo sapiens
ggccagtgggcgggcca

SEQ ID NO: 4147253 - DNA, 13 bp, Homo sapiens
ggccagtgtctgg

SEQ ID NO: 4147254 - DNA, 18 bp, Homo sapiens
ggccagtttgaagcctgt

SEQ ID NO: 4147255 - DNA, 22 bp, Homo sapiens
ggccagtttgaagcctgtgcct

SEQ ID NO: 4147256 - DNA, 17 bp, Homo sapiens
ggccatccctgggcccc

SEQ ID NO: 4147257 - DNA, 20 bp, Homo sapiens
ggccatccttccgccaatct

SEQ ID NO: 4147258 - DNA, 18 bp, Homo sapiens
ggccatgatggcaacaga

SEQ ID NO: 4147259 - DNA, 13 bp, Homo sapiens
ggccatgcctgcc

SEQ ID NO: 4147260 - DNA, 15 bp, Homo sapiens
ggccatgtgagccac

SEQ ID NO: 4147261 - DNA, 20 bp, Homo sapiens
ggccattctccacagcaacc

SEQ ID NO: 4147262 - DNA, 21 bp, Homo sapiens
ggccatttccaagaggctgta

SEQ ID NO: 4147263 - DNA, 20 bp, Homo sapiens
ggccatttccttttctctgc

SEQ ID NO: 4147264 - DNA, 19 bp, Homo sapiens
ggcccaacaggggctccat

SEQ ID NO: 4147265 - DNA, 13 bp, Homo sapiens
ggcccaaggcggc

SEQ ID NO: 4147266 - DNA, 17 bp, Homo sapiens
ggcccaaggcggcccct

SEQ ID NO: 4147267 - DNA, 21 bp, Homo sapiens
ggcccaaggcggcccctcccg

SEQ ID NO: 4147268 - DNA, 17 bp, Homo sapiens
ggcccaaggtcccctcc

SEQ ID NO: 4147269 - DNA, 19 bp, Homo sapiens
ggcccaaggtcccctccac

SEQ ID NO: 4147270 - DNA, 20 bp, Homo sapiens
ggcccaaggtcccctccaca

SEQ ID NO: 4147271 - DNA, 18 bp, Homo sapiens
ggcccaccaggcccccct

SEQ ID NO: 4147272 - DNA, 16 bp, Homo sapiens
ggcccaccccagcctc

SEQ ID NO: 4147273 - DNA, 18 bp, Homo sapiens
ggcccaccccagcctcgc

SEQ ID NO: 4147274 - DNA, 22 bp, Homo sapiens
ggcccacgcctgtaatcccagc

SEQ ID NO: 4147275 - DNA, 17 bp, Homo sapiens
ggcccacgtggttgggg

SEQ ID NO: 4147276 - DNA, 12 bp, Homo sapiens
ggcccagaactg

SEQ ID NO: 4147277 - DNA, 19 bp, Homo sapiens
ggcccagagcccagctcca

SEQ ID NO: 4147278 - DNA, 22 bp, Homo sapiens
ggcccagatctggtcccttgca

SEQ ID NO: 4147279 - DNA, 13 bp, Homo sapiens
ggcccagccagga

SEQ ID NO: 4147280 - DNA, 14 bp, Homo sapiens
ggcccagcccagag

SEQ ID NO: 4147281 - DNA, 16 bp, Homo sapiens
ggcccagcccagagcc

SEQ ID NO: 4147282 - DNA, 13 bp, Homo sapiens
ggcccagccttgt

SEQ ID NO: 4147283 - DNA, 17 bp, Homo sapiens
ggcccagcgcggccagc

SEQ ID NO: 4147284 - DNA, 12 bp, Homo sapiens
ggcccaggaatc

SEQ ID NO: 4147285 - DNA, 17 bp, Homo sapiens
ggcccaggagaccacgg

SEQ ID NO: 4147286 - DNA, 21 bp, Homo sapiens
ggcccagggagggaagtgtga

SEQ ID NO: 4147287 - DNA, 16 bp, Homo sapiens
ggcccagggcccagag

SEQ ID NO: 4147288 - DNA, 18 bp, Homo sapiens
ggcccagggcccagagcc

SEQ ID NO: 4147289 - DNA, 22 bp, Homo sapiens
ggcccagggcccagagcccagc

SEQ ID NO: 4147290 - DNA, 20 bp, Homo sapiens
ggcccaggttcgagacccaa

SEQ ID NO: 4147291 - DNA, 13 bp, Homo sapiens
ggcccatctcagc

SEQ ID NO: 4147292 - DNA, 15 bp, Homo sapiens
ggcccatctcagcct

SEQ ID NO: 4147293 - DNA, 16 bp, Homo sapiens
ggcccatgccaaggcc

SEQ ID NO: 4147294 - DNA, 19 bp, Homo sapiens
ggccccacctgcagctccc

SEQ ID NO: 4147295 - DNA, 13 bp, Homo sapiens
ggccccactgatg

SEQ ID NO: 4147296 - DNA, 19 bp, Homo sapiens
ggccccaggccccagacag

SEQ ID NO: 4147297 - DNA, 19 bp, Homo sapiens
ggccccagtgcggttcctc

SEQ ID NO: 4147298 - DNA, 20 bp, Homo sapiens
ggccccagtgcggttcctca

SEQ ID NO: 4147299 - DNA, 12 bp, Homo sapiens
ggccccatccca

SEQ ID NO: 4147300 - DNA, 20 bp, Homo sapiens
ggccccatcctcatccctga

SEQ ID NO: 4147301 - DNA, 23 bp, Homo sapiens
ggcccccaaacatagcccctgcc

SEQ ID NO: 4147302 - DNA, 16 bp, Homo sapiens
ggcccccaacctcagg

SEQ ID NO: 4147303 - DNA, 20 bp, Homo sapiens
ggcccccaacctcagggctc

SEQ ID NO: 4147304 - DNA, 23 bp, Homo sapiens
ggcccccaacctcagggctccca

SEQ ID NO: 4147305 - DNA, 14 bp, Homo sapiens
ggcccccaggggca

SEQ ID NO: 4147306 - DNA, 18 bp, Homo sapiens
ggcccccaggggcaggac

SEQ ID NO: 4147307 - DNA, 20 bp, Homo sapiens
ggcccccaggggcaggactg

SEQ ID NO: 4147308 - DNA, 14 bp, Homo sapiens
ggcccccatctcat

SEQ ID NO: 4147309 - DNA, 22 bp, Homo sapiens
ggccccccgcgctcgcccagca

SEQ ID NO: 4147310 - DNA, 23 bp, Homo sapiens
ggccccccgcgctcgcccagcag

SEQ ID NO: 4147311 - DNA, 13 bp, Homo sapiens
ggccccctgcatc

SEQ ID NO: 4147312 - DNA, 18 bp, Homo sapiens
ggccccctggtctctggt

SEQ ID NO: 4147313 - DNA, 16 bp, Homo sapiens
ggccccgccagggctg

SEQ ID NO: 4147314 - DNA, 19 bp, Homo sapiens
ggccccgccagggctgggg

SEQ ID NO: 4147315 - DNA, 20 bp, Homo sapiens
ggccccgccagggctgggga

SEQ ID NO: 4147316 - DNA, 21 bp, Homo sapiens
ggccccgccagggctggggac

SEQ ID NO: 4147317 - DNA, 12 bp, Homo sapiens
ggcccctccacg

SEQ ID NO: 4147318 - DNA, 13 bp, Homo sapiens
ggcccctccacgc

SEQ ID NO: 4147319 - DNA, 17 bp, Homo sapiens
ggcccctccatccaccc

SEQ ID NO: 4147320 - DNA, 19 bp, Homo sapiens
ggcccctcctagacccagg

SEQ ID NO: 4147321 - DNA, 14 bp, Homo sapiens
ggcccctctgacct

SEQ ID NO: 4147322 - DNA, 17 bp, Homo sapiens
ggcccctgcgtgggggc

SEQ ID NO: 4147323 - DNA, 20 bp, Homo sapiens
ggcccctgggcttggcctgc

SEQ ID NO: 4147324 - DNA, 23 bp, Homo sapiens
ggcccctgggcttggcctgctgt

SEQ ID NO: 4147325 - DNA, 13 bp, Homo sapiens
ggcccctggggct

SEQ ID NO: 4147326 - DNA, 17 bp, Homo sapiens
ggcccgacagcctggca

SEQ ID NO: 4147327 - DNA, 20 bp, Homo sapiens
ggcccgcaccccggcctcag

SEQ ID NO: 4147328 - DNA, 23 bp, Homo sapiens
ggcccgcagtgctgggaccagag

SEQ ID NO: 4147329 - DNA, 14 bp, Homo sapiens
ggcccggcagggcg

SEQ ID NO: 4147330 - DNA, 21 bp, Homo sapiens
ggcccggccagcgggcacagg

SEQ ID NO: 4147331 - DNA, 13 bp, Homo sapiens
ggcccggccggcc

SEQ ID NO: 4147332 - DNA, 17 bp, Homo sapiens
ggcccggccggcctggc

SEQ ID NO: 4147333 - DNA, 21 bp, Homo sapiens
ggcccggccggcctggcaccg

SEQ ID NO: 4147334 - DNA, 21 bp, Homo sapiens
ggccctcccagaacctcagca

SEQ ID NO: 4147335 - DNA, 19 bp, Homo sapiens
ggccctccctgactccctg

SEQ ID NO: 4147336 - DNA, 21 bp, Homo sapiens
ggccctccctgactccctgtg

SEQ ID NO: 4147337 - DNA, 22 bp, Homo sapiens
ggccctccctgactccctgtgg

SEQ ID NO: 4147338 - DNA, 23 bp, Homo sapiens
ggccctccctgttccccagagaa

SEQ ID NO: 4147339 - DNA, 15 bp, Homo sapiens
ggccctcgacactca

SEQ ID NO: 4147340 - DNA, 16 bp, Homo sapiens
ggccctctctctgggc

SEQ ID NO: 4147341 - DNA, 12 bp, Homo sapiens
ggccctctcttc

SEQ ID NO: 4147342 - DNA, 20 bp, Homo sapiens
ggccctctcttctcaccttt

SEQ ID NO: 4147343 - DNA, 20 bp, Homo sapiens
ggccctctttccctgcgaga

SEQ ID NO: 4147344 - DNA, 16 bp, Homo sapiens
ggccctgactcctctg

SEQ ID NO: 4147345 - DNA, 14 bp, Homo sapiens
ggccctgaggcgga

SEQ ID NO: 4147346 - DNA, 21 bp, Homo sapiens
ggccctgaggcggaggctgtg

SEQ ID NO: 4147347 - DNA, 23 bp, Homo sapiens
ggccctgaggcggaggctgtgct

SEQ ID NO: 4147348 - DNA, 18 bp, Homo sapiens
ggccctgcacctgtgcag

SEQ ID NO: 4147349 - DNA, 17 bp, Homo sapiens
ggccctgcctcctggga

SEQ ID NO: 4147350 - DNA, 11 bp, Homo sapiens
ggccctgcctg

SEQ ID NO: 4147351 - DNA, 15 bp, Homo sapiens
ggccctgctcctgca

SEQ ID NO: 4147352 - DNA, 21 bp, Homo sapiens
ggccctgctcctgcagcatgg

SEQ ID NO: 4147353 - DNA, 14 bp, Homo sapiens
ggccctgctgccca

SEQ ID NO: 4147354 - DNA, 15 bp, Homo sapiens
ggccctggccagccg

SEQ ID NO: 4147355 - DNA, 13 bp, Homo sapiens
ggccctggctccc

SEQ ID NO: 4147356 - DNA, 16 bp, Homo sapiens
ggccctgggcctcagt

SEQ ID NO: 4147357 - DNA, 21 bp, Homo sapiens
ggccctgggctgggtgctggg

SEQ ID NO: 4147358 - DNA, 15 bp, Homo sapiens
ggccctggggtccca

SEQ ID NO: 4147359 - DNA, 15 bp, Homo sapiens
ggcccttcctctcca

SEQ ID NO: 4147360 - DNA, 18 bp, Homo sapiens
ggcccttcctctccactg

SEQ ID NO: 4147361 - DNA, 22 bp, Homo sapiens
ggcccttcctctccactgcctt

SEQ ID NO: 4147362 - DNA, 21 bp, Homo sapiens
ggcccttgcagttcagcacca

SEQ ID NO: 4147363 - DNA, 14 bp, Homo sapiens
ggcccttgggacag

SEQ ID NO: 4147364 - DNA, 16 bp, Homo sapiens
ggcccttggggctggg

SEQ ID NO: 4147365 - DNA, 19 bp, Homo sapiens
ggccctttgaagcctcagc

SEQ ID NO: 4147366 - DNA, 17 bp, Homo sapiens
ggccgaaggtgcctcag

SEQ ID NO: 4147367 - DNA, 20 bp, Homo sapiens
ggccgaaggtgcctcagact

SEQ ID NO: 4147368 - DNA, 19 bp, Homo sapiens
ggccgaatcccctccctgt

SEQ ID NO: 4147369 - DNA, 13 bp, Homo sapiens
ggccgaatgggca

SEQ ID NO: 4147370 - DNA, 15 bp, Homo sapiens
ggccgagctggtttc

SEQ ID NO: 4147371 - DNA, 13 bp, Homo sapiens
ggccgaggcccag

SEQ ID NO: 4147372 - DNA, 14 bp, Homo sapiens
ggccgatggagaca

SEQ ID NO: 4147373 - DNA, 22 bp, Homo sapiens
ggccgccccctgccccccagcc

SEQ ID NO: 4147374 - DNA, 18 bp, Homo sapiens
ggccggaaccacagggcc

SEQ ID NO: 4147375 - DNA, 19 bp, Homo sapiens
ggccggaaccacagggcca

SEQ ID NO: 4147376 - DNA, 20 bp, Homo sapiens
ggccggaaccacagggccag

SEQ ID NO: 4147377 - DNA, 23 bp, Homo sapiens
ggccggaaccacagggccagagg

SEQ ID NO: 4147378 - DNA, 14 bp, Homo sapiens
ggccggcccagatg

SEQ ID NO: 4147379 - DNA, 22 bp, Homo sapiens
ggccggcttcatgccagctact

SEQ ID NO: 4147380 - DNA, 22 bp, Homo sapiens
ggccggggaagctgccagccca

SEQ ID NO: 4147381 - DNA, 17 bp, Homo sapiens
ggccgtctcctccctca

SEQ ID NO: 4147382 - DNA, 18 bp, Homo sapiens
ggccgtggtccagctctt

SEQ ID NO: 4147383 - DNA, 18 bp, Homo sapiens
ggccgtgtctctgaggac

SEQ ID NO: 4147384 - DNA, 20 bp, Homo sapiens
ggcctaaaactggcctgact

SEQ ID NO: 4147385 - DNA, 17 bp, Homo sapiens
ggcctaaaagtaaacat

SEQ ID NO: 4147386 - DNA, 20 bp, Homo sapiens
ggcctacagctttgatccct

SEQ ID NO: 4147387 - DNA, 23 bp, Homo sapiens
ggcctacagctttgatccctgac

SEQ ID NO: 4147388 - DNA, 16 bp, Homo sapiens
ggcctattccaggaat

SEQ ID NO: 4147389 - DNA, 18 bp, Homo sapiens
ggcctcaaaggcccgctc

SEQ ID NO: 4147390 - DNA, 22 bp, Homo sapiens
ggcctcaagaacaaacactgca

SEQ ID NO: 4147391 - DNA, 12 bp, Homo sapiens
ggcctcaccacc

SEQ ID NO: 4147392 - DNA, 13 bp, Homo sapiens
ggcctcacccacc

SEQ ID NO: 4147393 - DNA, 18 bp, Homo sapiens
ggcctcaccgagtggggg

SEQ ID NO: 4147394 - DNA, 23 bp, Homo sapiens
ggcctcagaccaactctctcctg

SEQ ID NO: 4147395 - DNA, 13 bp, Homo sapiens
ggcctcagccctc

SEQ ID NO: 4147396 - DNA, 15 bp, Homo sapiens
ggcctcagccctcag

SEQ ID NO: 4147397 - DNA, 13 bp, Homo sapiens
ggcctcagggcgc

SEQ ID NO: 4147398 - DNA, 14 bp, Homo sapiens
ggcctcagggcgct

SEQ ID NO: 4147399 - DNA, 19 bp, Homo sapiens
ggcctcagggcgctcagac

SEQ ID NO: 4147400 - DNA, 22 bp, Homo sapiens
ggcctcagggcgctcagacggc

SEQ ID NO: 4147401 - DNA, 18 bp, Homo sapiens
ggcctcaggtgctgtcca

SEQ ID NO: 4147402 - DNA, 20 bp, Homo sapiens
ggcctccagaactcactggg

SEQ ID NO: 4147403 - DNA, 13 bp, Homo sapiens
ggcctccagggcc

SEQ ID NO: 4147404 - DNA, 15 bp, Homo sapiens
ggcctccagggccca

SEQ ID NO: 4147405 - DNA, 13 bp, Homo sapiens
ggcctccctcctt

SEQ ID NO: 4147406 - DNA, 15 bp, Homo sapiens
ggcctccctctctct

SEQ ID NO: 4147407 - DNA, 16 bp, Homo sapiens
ggcctccctgctgtgc

SEQ ID NO: 4147408 - DNA, 17 bp, Homo sapiens
ggcctcccttgggctgg

SEQ ID NO: 4147409 - DNA, 19 bp, Homo sapiens
ggcctcctcggagagcagc

SEQ ID NO: 4147410 - DNA, 16 bp, Homo sapiens
ggcctcgggacacctg

SEQ ID NO: 4147411 - DNA, 16 bp, Homo sapiens
ggcctcgggacctcag

SEQ ID NO: 4147412 - DNA, 19 bp, Homo sapiens
ggcctctaccacaagggct

SEQ ID NO: 4147413 - DNA, 18 bp, Homo sapiens
ggcctctctgccccaccc

SEQ ID NO: 4147414 - DNA, 22 bp, Homo sapiens
ggcctctgcctccaccctcctc

SEQ ID NO: 4147415 - DNA, 14 bp, Homo sapiens
ggcctctgtgtcct

SEQ ID NO: 4147416 - DNA, 18 bp, Homo sapiens
ggcctcttgagcagtggc

SEQ ID NO: 4147417 - DNA, 18 bp, Homo sapiens
ggcctgaaccacaggaga

SEQ ID NO: 4147418 - DNA, 17 bp, Homo sapiens
ggcctgaactgaggaga

SEQ ID NO: 4147419 - DNA, 14 bp, Homo sapiens
ggcctgacaccccc

SEQ ID NO: 4147420 - DNA, 16 bp, Homo sapiens
ggcctgacaccccctc

SEQ ID NO: 4147421 - DNA, 20 bp, Homo sapiens
ggcctgaccaaacagccaac

SEQ ID NO: 4147422 - DNA, 13 bp, Homo sapiens
ggcctgagagaat

SEQ ID NO: 4147423 - DNA, 14 bp, Homo sapiens
ggcctgaggtcaat

SEQ ID NO: 4147424 - DNA, 14 bp, Homo sapiens
ggcctgatgacaga

SEQ ID NO: 4147425 - DNA, 15 bp, Homo sapiens
ggcctgatgctccct

SEQ ID NO: 4147426 - DNA, 17 bp, Homo sapiens
ggcctgatgctccctcc

SEQ ID NO: 4147427 - DNA, 18 bp, Homo sapiens
ggcctgatgctccctccc

SEQ ID NO: 4147428 - DNA, 22 bp, Homo sapiens
ggcctgatgctccctcccctgc

SEQ ID NO: 4147429 - DNA, 14 bp, Homo sapiens
ggcctgcacagtga

SEQ ID NO: 4147430 - DNA, 13 bp, Homo sapiens
ggcctgcactaat

SEQ ID NO: 4147431 - DNA, 19 bp, Homo sapiens
ggcctgcccgtgccctggt

SEQ ID NO: 4147432 - DNA, 18 bp, Homo sapiens
ggcctgcgccagtcctgc

SEQ ID NO: 4147433 - DNA, 20 bp, Homo sapiens
ggcctgctaaggctcctcct

SEQ ID NO: 4147434 - DNA, 20 bp, Homo sapiens
ggcctgctgccagtgcagcc

SEQ ID NO: 4147435 - DNA, 16 bp, Homo sapiens
ggcctgctggaggcct

SEQ ID NO: 4147436 - DNA, 17 bp, Homo sapiens
ggcctgctggaggcctc

SEQ ID NO: 4147437 - DNA, 23 bp, Homo sapiens
ggcctggagccccatcggccaag

SEQ ID NO: 4147438 - DNA, 13 bp, Homo sapiens
ggcctggcaggcc

SEQ ID NO: 4147439 - DNA, 15 bp, Homo sapiens
ggcctggccaggagc

SEQ ID NO: 4147440 - DNA, 16 bp, Homo sapiens
ggcctggccaggagct

SEQ ID NO: 4147441 - DNA, 13 bp, Homo sapiens
ggcctggccaggc

SEQ ID NO: 4147442 - DNA, 15 bp, Homo sapiens
ggcctggccatttcc

SEQ ID NO: 4147443 - DNA, 14 bp, Homo sapiens
ggcctggctgcagc

SEQ ID NO: 4147444 - DNA, 17 bp, Homo sapiens
ggcctggctgcagctgg

SEQ ID NO: 4147445 - DNA, 20 bp, Homo sapiens
ggcctggctgcagctgggca

SEQ ID NO: 4147446 - DNA, 17 bp, Homo sapiens
ggcctggggcctgagag

SEQ ID NO: 4147447 - DNA, 16 bp, Homo sapiens
ggcctggggctccttt

SEQ ID NO: 4147448 - DNA, 18 bp, Homo sapiens
ggcctggggctcctttct

SEQ ID NO: 4147449 - DNA, 18 bp, Homo sapiens
ggcctggggtgcatctcc

SEQ ID NO: 4147450 - DNA, 14 bp, Homo sapiens
ggcctgggtctgtg

SEQ ID NO: 4147451 - DNA, 19 bp, Homo sapiens
ggcctgggtctgtgtctct

SEQ ID NO: 4147452 - DNA, 11 bp, Homo sapiens
ggcctggtccc

SEQ ID NO: 4147453 - DNA, 14 bp, Homo sapiens
ggcctggtccctgt

SEQ ID NO: 4147454 - DNA, 19 bp, Homo sapiens
ggcctgtcccttgcctctg

SEQ ID NO: 4147455 - DNA, 17 bp, Homo sapiens
ggcctgtctcatcccca

SEQ ID NO: 4147456 - DNA, 18 bp, Homo sapiens
ggcctgtctcatccccag

SEQ ID NO: 4147457 - DNA, 19 bp, Homo sapiens
ggcctgtctcatccccagg

SEQ ID NO: 4147458 - DNA, 20 bp, Homo sapiens
ggcctgtctcatccccaggg

SEQ ID NO: 4147459 - DNA, 13 bp, Homo sapiens
ggcctgtctgtga

SEQ ID NO: 4147460 - DNA, 16 bp, Homo sapiens
ggcctgtggaatgagt

SEQ ID NO: 4147461 - DNA, 19 bp, Homo sapiens
ggcctgtggaatgagtgtg

SEQ ID NO: 4147462 - DNA, 21 bp, Homo sapiens
ggcctgttgctatagagccta

SEQ ID NO: 4147463 - DNA, 19 bp, Homo sapiens
ggcctgtttctgcagccct

SEQ ID NO: 4147464 - DNA, 21 bp, Homo sapiens
ggcctgtttctgcagcccttg

SEQ ID NO: 4147465 - DNA, 16 bp, Homo sapiens
ggccttaatttccttt

SEQ ID NO: 4147466 - DNA, 20 bp, Homo sapiens
ggccttaatttcctttttga

SEQ ID NO: 4147467 - DNA, 20 bp, Homo sapiens
ggccttagggcactgggctg

SEQ ID NO: 4147468 - DNA, 15 bp, Homo sapiens
ggccttgctgctgct

SEQ ID NO: 4147469 - DNA, 19 bp, Homo sapiens
ggccttgctgctgctgcac

SEQ ID NO: 4147470 - DNA, 23 bp, Homo sapiens
ggccttgctgctgctgcacccaa

SEQ ID NO: 4147471 - DNA, 22 bp, Homo sapiens
ggccttgtcctacgtccaaggt

SEQ ID NO: 4147472 - DNA, 19 bp, Homo sapiens
ggcctttccttccctctct

SEQ ID NO: 4147473 - DNA, 21 bp, Homo sapiens
ggcctttccttccctctctga

SEQ ID NO: 4147474 - DNA, 23 bp, Homo sapiens
ggcctttgcaagatgcttggttg

SEQ ID NO: 4147475 - DNA, 18 bp, Homo sapiens
ggcctttgtgctgcgcct

SEQ ID NO: 4147476 - DNA, 16 bp, Homo sapiens
ggcctttttctgagat

SEQ ID NO: 4147477 - DNA, 14 bp, Homo sapiens
ggcgagtctgggga

SEQ ID NO: 4147478 - DNA, 23 bp, Homo sapiens
ggcgagtctggggacctggcact

SEQ ID NO: 4147479 - DNA, 15 bp, Homo sapiens
ggcgagtgccaggac

SEQ ID NO: 4147480 - DNA, 17 bp, Homo sapiens
ggcgatccacctgtctc

SEQ ID NO: 4147481 - DNA, 12 bp, Homo sapiens
ggcgcactgtga

SEQ ID NO: 4147482 - DNA, 14 bp, Homo sapiens
ggcgcaggtgggct

SEQ ID NO: 4147483 - DNA, 15 bp, Homo sapiens
ggcgcaggtgggctg

SEQ ID NO: 4147484 - DNA, 20 bp, Homo sapiens
ggcgcaggtgggctggactt

SEQ ID NO: 4147485 - DNA, 14 bp, Homo sapiens
ggcgcccccagtgt

SEQ ID NO: 4147486 - DNA, 15 bp, Homo sapiens
ggcgcccccagtgtg

SEQ ID NO: 4147487 - DNA, 20 bp, Homo sapiens
ggcgcctgtagtcccagcca

SEQ ID NO: 4147488 - DNA, 22 bp, Homo sapiens
ggcgcgcacctgtaatcccagc

SEQ ID NO: 4147489 - DNA, 16 bp, Homo sapiens
ggcgcggccagccccg

SEQ ID NO: 4147490 - DNA, 21 bp, Homo sapiens
ggcgctcagacggcggccagg

SEQ ID NO: 4147491 - DNA, 22 bp, Homo sapiens
ggcgctcagacggcggccaggc

SEQ ID NO: 4147492 - DNA, 18 bp, Homo sapiens
ggcgctgccacctgcccc

SEQ ID NO: 4147493 - DNA, 14 bp, Homo sapiens
ggcgctgcttccag

SEQ ID NO: 4147494 - DNA, 15 bp, Homo sapiens
ggcgctgcttccagg

SEQ ID NO: 4147495 - DNA, 20 bp, Homo sapiens
ggcggagcttgcagtgagcc

SEQ ID NO: 4147496 - DNA, 12 bp, Homo sapiens
ggcggaggctgt

SEQ ID NO: 4147497 - DNA, 20 bp, Homo sapiens
ggcggcacaggtcgggcgca

SEQ ID NO: 4147498 - DNA, 13 bp, Homo sapiens
ggcggccaggcac

SEQ ID NO: 4147499 - DNA, 22 bp, Homo sapiens
ggcggccaggcacagggcccgc

SEQ ID NO: 4147500 - DNA, 20 bp, Homo sapiens
ggcggcccggccagcgggca

SEQ ID NO: 4147501 - DNA, 22 bp, Homo sapiens
ggcggcccggccagcgggcaca

SEQ ID NO: 4147502 - DNA, 23 bp, Homo sapiens
ggcggcccggccagcgggcacag

SEQ ID NO: 4147503 - DNA, 14 bp, Homo sapiens
ggcggcggccacgc

SEQ ID NO: 4147504 - DNA, 20 bp, Homo sapiens
ggcgggtgatggccagcccc

SEQ ID NO: 4147505 - DNA, 16 bp, Homo sapiens
ggcggtccccatcccc

SEQ ID NO: 4147506 - DNA, 20 bp, Homo sapiens
ggcggtccccatccccacca

SEQ ID NO: 4147507 - DNA, 21 bp, Homo sapiens
ggcggtccccatccccaccag

SEQ ID NO: 4147508 - DNA, 20 bp, Homo sapiens
ggcggtcttcaacatcctgc

SEQ ID NO: 4147509 - DNA, 16 bp, Homo sapiens
ggcggtggacaataaa

SEQ ID NO: 4147510 - DNA, 14 bp, Homo sapiens
ggcggtggctgccc

SEQ ID NO: 4147511 - DNA, 17 bp, Homo sapiens
ggctaactatatttgct

SEQ ID NO: 4147512 - DNA, 16 bp, Homo sapiens
ggctaatgtactgcat

SEQ ID NO: 4147513 - DNA, 15 bp, Homo sapiens
ggctaattaaataaa

SEQ ID NO: 4147514 - DNA, 23 bp, Homo sapiens
ggctaattcccagagtgtgaaac

SEQ ID NO: 4147515 - DNA, 19 bp, Homo sapiens
ggctacatcccagcctgtg

SEQ ID NO: 4147516 - DNA, 14 bp, Homo sapiens
ggctacattataaa

SEQ ID NO: 4147517 - DNA, 18 bp, Homo sapiens
ggctagagtcctcactcc

SEQ ID NO: 4147518 - DNA, 13 bp, Homo sapiens
ggctatttgaaat

SEQ ID NO: 4147519 - DNA, 14 bp, Homo sapiens
ggctatttgaaata

SEQ ID NO: 4147520 - DNA, 16 bp, Homo sapiens
ggctatttgtaaatct

SEQ ID NO: 4147521 - DNA, 19 bp, Homo sapiens
ggctcacccaagcaaggcc

SEQ ID NO: 4147522 - DNA, 13 bp, Homo sapiens
ggctcacgcctgt

SEQ ID NO: 4147523 - DNA, 18 bp, Homo sapiens
ggctcacgcctgtaatcc

SEQ ID NO: 4147524 - DNA, 19 bp, Homo sapiens
ggctcacggggcctccaac

SEQ ID NO: 4147525 - DNA, 13 bp, Homo sapiens
ggctcactgccag

SEQ ID NO: 4147526 - DNA, 16 bp, Homo sapiens
ggctcactgccaggcc

SEQ ID NO: 4147527 - DNA, 19 bp, Homo sapiens
ggctcactgccaggccagc

SEQ ID NO: 4147528 - DNA, 22 bp, Homo sapiens
ggctcagagactgcaagctgct

SEQ ID NO: 4147529 - DNA, 15 bp, Homo sapiens
ggctcagatggactg

SEQ ID NO: 4147530 - DNA, 22 bp, Homo sapiens
ggctcagatggactgggaggag

SEQ ID NO: 4147531 - DNA, 16 bp, Homo sapiens
ggctcaggctctgctg

SEQ ID NO: 4147532 - DNA, 21 bp, Homo sapiens
ggctcatgcctgtaatctcag

SEQ ID NO: 4147533 - DNA, 19 bp, Homo sapiens
ggctccagatgcagggcag

SEQ ID NO: 4147534 - DNA, 18 bp, Homo sapiens
ggctccagccatctcatg

SEQ ID NO: 4147535 - DNA, 14 bp, Homo sapiens
ggctccaggcagca

SEQ ID NO: 4147536 - DNA, 15 bp, Homo sapiens
ggctccagtccccag

SEQ ID NO: 4147537 - DNA, 12 bp, Homo sapiens
ggctccatgcca

SEQ ID NO: 4147538 - DNA, 20 bp, Homo sapiens
ggctcccaagtcacacccac

SEQ ID NO: 4147539 - DNA, 17 bp, Homo sapiens
ggctcccacaggccctt

SEQ ID NO: 4147540 - DNA, 18 bp, Homo sapiens
ggctcccacaggcccttc

SEQ ID NO: 4147541 - DNA, 22 bp, Homo sapiens
ggctcccaggggtctccctggc

SEQ ID NO: 4147542 - DNA, 23 bp, Homo sapiens
ggctccccctccccaggctggag

SEQ ID NO: 4147543 - DNA, 22 bp, Homo sapiens
ggctcccggagagggagtcagt

SEQ ID NO: 4147544 - DNA, 23 bp, Homo sapiens
ggctccctgatgacacccaccct

SEQ ID NO: 4147545 - DNA, 12 bp, Homo sapiens
ggctcctgaggg

SEQ ID NO: 4147546 - DNA, 17 bp, Homo sapiens
ggctcctttctccagcc

SEQ ID NO: 4147547 - DNA, 20 bp, Homo sapiens
ggctcctttctccagccagc

SEQ ID NO: 4147548 - DNA, 16 bp, Homo sapiens
ggctcggaggctgccc

SEQ ID NO: 4147549 - DNA, 14 bp, Homo sapiens
ggctctaccttcct

SEQ ID NO: 4147550 - DNA, 19 bp, Homo sapiens
ggctctaccttcctgtccc

SEQ ID NO: 4147551 - DNA, 21 bp, Homo sapiens
ggctctaccttcctgtccctg

SEQ ID NO: 4147552 - DNA, 21 bp, Homo sapiens
ggctctcacccccatccctgg

SEQ ID NO: 4147553 - DNA, 12 bp, Homo sapiens
ggctctcagctc

SEQ ID NO: 4147554 - DNA, 20 bp, Homo sapiens
ggctctcctcagaagaaaga

SEQ ID NO: 4147555 - DNA, 17 bp, Homo sapiens
ggctctcctctggctag

SEQ ID NO: 4147556 - DNA, 17 bp, Homo sapiens
ggctctgaggtgcctgt

SEQ ID NO: 4147557 - DNA, 19 bp, Homo sapiens
ggctctgcaattcccctct

SEQ ID NO: 4147558 - DNA, 18 bp, Homo sapiens
ggctctgcacccacgtgc

SEQ ID NO: 4147559 - DNA, 16 bp, Homo sapiens
ggctctgcacccctct

SEQ ID NO: 4147560 - DNA, 13 bp, Homo sapiens
ggctctgccagtg

SEQ ID NO: 4147561 - DNA, 15 bp, Homo sapiens
ggctctgctggtgga

SEQ ID NO: 4147562 - DNA, 16 bp, Homo sapiens
ggctctgtttgatgct

SEQ ID NO: 4147563 - DNA, 23 bp, Homo sapiens
ggctcttaagcagcatggaaaaa

SEQ ID NO: 4147564 - DNA, 19 bp, Homo sapiens
ggctcttagcagcttccag

SEQ ID NO: 4147565 - DNA, 11 bp, Homo sapiens
ggctcttccaa

SEQ ID NO: 4147566 - DNA, 13 bp, Homo sapiens
ggctcttctcctt

SEQ ID NO: 4147567 - DNA, 15 bp, Homo sapiens
ggctcttctcctttc

SEQ ID NO: 4147568 - DNA, 23 bp, Homo sapiens
ggctcttctcctttcacaacctt

SEQ ID NO: 4147569 - DNA, 20 bp, Homo sapiens
ggctcttgatacccccctct

SEQ ID NO: 4147570 - DNA, 24 bp, Homo sapiens
ggctgaaagaacatggacttgtat

SEQ ID NO: 4147571 - DNA, 15 bp, Homo sapiens
ggctgaccacagcac

SEQ ID NO: 4147572 - DNA, 16 bp, Homo sapiens
ggctgaccacagcaca

SEQ ID NO: 4147573 - DNA, 19 bp, Homo sapiens
ggctgaccacagcacagcc

SEQ ID NO: 4147574 - DNA, 20 bp, Homo sapiens
ggctgaccccaaagagcctg

SEQ ID NO: 4147575 - DNA, 22 bp, Homo sapiens
ggctgaccccaaagagcctgga

SEQ ID NO: 4147576 - DNA, 22 bp, Homo sapiens
ggctgacccctctggtgtgtgg

SEQ ID NO: 4147577 - DNA, 14 bp, Homo sapiens
ggctgactgggcca

SEQ ID NO: 4147578 - DNA, 14 bp, Homo sapiens
ggctgactggggct

SEQ ID NO: 4147579 - DNA, 17 bp, Homo sapiens
ggctgactggggctggg

SEQ ID NO: 4147580 - DNA, 15 bp, Homo sapiens
ggctgacttcatctg

SEQ ID NO: 4147581 - DNA, 16 bp, Homo sapiens
ggctgacttcatctgg

SEQ ID NO: 4147582 - DNA, 20 bp, Homo sapiens
ggctgacttcatctggggtt

SEQ ID NO: 4147583 - DNA, 15 bp, Homo sapiens
ggctgagctgagctt

SEQ ID NO: 4147584 - DNA, 19 bp, Homo sapiens
ggctgaggaggcctccatc

SEQ ID NO: 4147585 - DNA, 20 bp, Homo sapiens
ggctgaggaggcctccatct

SEQ ID NO: 4147586 - DNA, 14 bp, Homo sapiens
ggctgaggcaggag

SEQ ID NO: 4147587 - DNA, 16 bp, Homo sapiens
ggctgaggcaggagaa

SEQ ID NO: 4147588 - DNA, 14 bp, Homo sapiens
ggctgaggccagag

SEQ ID NO: 4147589 - DNA, 16 bp, Homo sapiens
ggctgaggcctggact

SEQ ID NO: 4147590 - DNA, 14 bp, Homo sapiens
ggctgaggctggca

SEQ ID NO: 4147591 - DNA, 14 bp, Homo sapiens
ggctgagggcagct

SEQ ID NO: 4147592 - DNA, 15 bp, Homo sapiens
ggctgagggcctgct

SEQ ID NO: 4147593 - DNA, 14 bp, Homo sapiens
ggctgagggctgcc

SEQ ID NO: 4147594 - DNA, 23 bp, Homo sapiens
ggctgagggctgccagcagcccc

SEQ ID NO: 4147595 - DNA, 17 bp, Homo sapiens
ggctgaggggcttggga

SEQ ID NO: 4147596 - DNA, 16 bp, Homo sapiens
ggctgaggttcctctg

SEQ ID NO: 4147597 - DNA, 17 bp, Homo sapiens
ggctgaggttcctctgc

SEQ ID NO: 4147598 - DNA, 18 bp, Homo sapiens
ggctgatggaggaaaaag

SEQ ID NO: 4147599 - DNA, 15 bp, Homo sapiens
ggctgccacacccag

SEQ ID NO: 4147600 - DNA, 18 bp, Homo sapiens
ggctgccatgtgaagagg

SEQ ID NO: 4147601 - DNA, 13 bp, Homo sapiens
ggctgcccaggag

SEQ ID NO: 4147602 - DNA, 20 bp, Homo sapiens
ggctgcccccggccccctgg

SEQ ID NO: 4147603 - DNA, 20 bp, Homo sapiens
ggctgcccctaatctctgta

SEQ ID NO: 4147604 - DNA, 13 bp, Homo sapiens
ggctgccctggtg

SEQ ID NO: 4147605 - DNA, 14 bp, Homo sapiens
ggctgccctggtgc

SEQ ID NO: 4147606 - DNA, 13 bp, Homo sapiens
ggctgccttcttt

SEQ ID NO: 4147607 - DNA, 18 bp, Homo sapiens
ggctgccttctttccatc

SEQ ID NO: 4147608 - DNA, 16 bp, Homo sapiens
ggctggacctatgtcc

SEQ ID NO: 4147609 - DNA, 12 bp, Homo sapiens
ggctggactgga

SEQ ID NO: 4147610 - DNA, 14 bp, Homo sapiens
ggctggactggagg

SEQ ID NO: 4147611 - DNA, 13 bp, Homo sapiens
ggctggagacccc

SEQ ID NO: 4147612 - DNA, 19 bp, Homo sapiens
ggctggagtggagtggcgt

SEQ ID NO: 4147613 - DNA, 15 bp, Homo sapiens
ggctggatgtggtgg

SEQ ID NO: 4147614 - DNA, 17 bp, Homo sapiens
ggctggccccagggcac

SEQ ID NO: 4147615 - DNA, 11 bp, Homo sapiens
ggctggctcct

SEQ ID NO: 4147616 - DNA, 10 bp, Homo sapiens
ggctggctgg

SEQ ID NO: 4147617 - DNA, 15 bp, Homo sapiens
ggctggctggcctca

SEQ ID NO: 4147618 - DNA, 23 bp, Homo sapiens
ggctgggacgtggctcagccagc

SEQ ID NO: 4147619 - DNA, 23 bp, Homo sapiens
ggctgggagtagttgtctttcct

SEQ ID NO: 4147620 - DNA, 17 bp, Homo sapiens
ggctgggcacagaggtc

SEQ ID NO: 4147621 - DNA, 15 bp, Homo sapiens
ggctgggcagcccca

SEQ ID NO: 4147622 - DNA, 16 bp, Homo sapiens
ggctgggcagccccag

SEQ ID NO: 4147623 - DNA, 20 bp, Homo sapiens
ggctgggccatgtccaaaga

SEQ ID NO: 4147624 - DNA, 15 bp, Homo sapiens
ggctgggcccctggg

SEQ ID NO: 4147625 - DNA, 17 bp, Homo sapiens
ggctgggcccctgggat

SEQ ID NO: 4147626 - DNA, 21 bp, Homo sapiens
ggctgggcccctgggatggga

SEQ ID NO: 4147627 - DNA, 22 bp, Homo sapiens
ggctgggccctctttccctgcg

SEQ ID NO: 4147628 - DNA, 16 bp, Homo sapiens
ggctggggaggacctg

SEQ ID NO: 4147629 - DNA, 12 bp, Homo sapiens
ggctggggcagc

SEQ ID NO: 4147630 - DNA, 14 bp, Homo sapiens
ggctggggcagcct

SEQ ID NO: 4147631 - DNA, 15 bp, Homo sapiens
ggctggggcggggcc

SEQ ID NO: 4147632 - DNA, 14 bp, Homo sapiens
ggctgggggactgg

SEQ ID NO: 4147633 - DNA, 21 bp, Homo sapiens
ggctgggggactggggggcca

SEQ ID NO: 4147634 - DNA, 15 bp, Homo sapiens
ggctgggggagagcc

SEQ ID NO: 4147635 - DNA, 19 bp, Homo sapiens
ggctgggggaggtccaagc

SEQ ID NO: 4147636 - DNA, 20 bp, Homo sapiens
ggctgggggaggtccaagca

SEQ ID NO: 4147637 - DNA, 14 bp, Homo sapiens
ggctgggggcagga

SEQ ID NO: 4147638 - DNA, 14 bp, Homo sapiens
ggctggggtgagag

SEQ ID NO: 4147639 - DNA, 18 bp, Homo sapiens
ggctgggtcggccctgcc

SEQ ID NO: 4147640 - DNA, 17 bp, Homo sapiens
ggctgggtgggcccaga

SEQ ID NO: 4147641 - DNA, 15 bp, Homo sapiens
ggctggtaagagaag

SEQ ID NO: 4147642 - DNA, 13 bp, Homo sapiens
ggctggtccaggg

SEQ ID NO: 4147643 - DNA, 14 bp, Homo sapiens
ggctggtggcaagt

SEQ ID NO: 4147644 - DNA, 22 bp, Homo sapiens
ggctgtcctgtacattgtggga

SEQ ID NO: 4147645 - DNA, 13 bp, Homo sapiens
ggctgtctgtcac

SEQ ID NO: 4147646 - DNA, 14 bp, Homo sapiens
ggctgtctgtcacc

SEQ ID NO: 4147647 - DNA, 21 bp, Homo sapiens
ggctgtgcttgaaggccctgc

SEQ ID NO: 4147648 - DNA, 19 bp, Homo sapiens
ggctgtggaccgtggacag

SEQ ID NO: 4147649 - DNA, 21 bp, Homo sapiens
ggctgtggagcaaaaggcagc

SEQ ID NO: 4147650 - DNA, 21 bp, Homo sapiens
ggctgtggccgtctcctccct

SEQ ID NO: 4147651 - DNA, 17 bp, Homo sapiens
ggctgttctccaggctt

SEQ ID NO: 4147652 - DNA, 18 bp, Homo sapiens
ggctgttctccaggcttc

SEQ ID NO: 4147653 - DNA, 21 bp, Homo sapiens
ggctgttctgtggttcctctg

SEQ ID NO: 4147654 - DNA, 14 bp, Homo sapiens
ggcttaatgtttat

SEQ ID NO: 4147655 - DNA, 14 bp, Homo sapiens
ggcttacaaagcct

SEQ ID NO: 4147656 - DNA, 19 bp, Homo sapiens
ggcttacctgacctcttgc

SEQ ID NO: 4147657 - DNA, 14 bp, Homo sapiens
ggcttagagagagg

SEQ ID NO: 4147658 - DNA, 16 bp, Homo sapiens
ggcttatatttgtgta

SEQ ID NO: 4147659 - DNA, 18 bp, Homo sapiens
ggcttcactgtataaata

SEQ ID NO: 4147660 - DNA, 19 bp, Homo sapiens
ggcttcactgtataaatag

SEQ ID NO: 4147661 - DNA, 20 bp, Homo sapiens
ggcttcagcatatttatagc

SEQ ID NO: 4147662 - DNA, 22 bp, Homo sapiens
ggcttcagggtgggagtagttg

SEQ ID NO: 4147663 - DNA, 14 bp, Homo sapiens
ggcttccagcttca

SEQ ID NO: 4147664 - DNA, 21 bp, Homo sapiens
ggcttccaggtatctccagga

SEQ ID NO: 4147665 - DNA, 14 bp, Homo sapiens
ggcttcccgctcag

SEQ ID NO: 4147666 - DNA, 16 bp, Homo sapiens
ggcttcccgctcagcc

SEQ ID NO: 4147667 - DNA, 21 bp, Homo sapiens
ggcttcctctagaagccaagg

SEQ ID NO: 4147668 - DNA, 12 bp, Homo sapiens
ggcttcctgccc

SEQ ID NO: 4147669 - DNA, 19 bp, Homo sapiens
ggcttcctgcgtcctcctc

SEQ ID NO: 4147670 - DNA, 20 bp, Homo sapiens
ggcttcctgtggctttgttt

SEQ ID NO: 4147671 - DNA, 18 bp, Homo sapiens
ggcttctccgccagcctc

SEQ ID NO: 4147672 - DNA, 15 bp, Homo sapiens
ggcttgaagccaaag

SEQ ID NO: 4147673 - DNA, 15 bp, Homo sapiens
ggcttgactttggct

SEQ ID NO: 4147674 - DNA, 20 bp, Homo sapiens
ggcttgagcccccgcgccca

SEQ ID NO: 4147675 - DNA, 12 bp, Homo sapiens
ggcttggcctgc

SEQ ID NO: 4147676 - DNA, 13 bp, Homo sapiens
ggcttggcctgct

SEQ ID NO: 4147677 - DNA, 16 bp, Homo sapiens
ggcttggcctgctgtg

SEQ ID NO: 4147678 - DNA, 22 bp, Homo sapiens
ggcttgggaaaaaaacttggca

SEQ ID NO: 4147679 - DNA, 12 bp, Homo sapiens
ggcttgggattt

SEQ ID NO: 4147680 - DNA, 16 bp, Homo sapiens
ggcttgggccctgcac

SEQ ID NO: 4147681 - DNA, 18 bp, Homo sapiens
ggcttgggccctgcacag

SEQ ID NO: 4147682 - DNA, 14 bp, Homo sapiens
ggcttgtgggctgg

SEQ ID NO: 4147683 - DNA, 14 bp, Homo sapiens
ggctttctggggcc

SEQ ID NO: 4147684 - DNA, 15 bp, Homo sapiens
ggctttgcccacccc

SEQ ID NO: 4147685 - DNA, 12 bp, Homo sapiens
ggctttgcctct

SEQ ID NO: 4147686 - DNA, 15 bp, Homo sapiens
ggctttgcctcttct

SEQ ID NO: 4147687 - DNA, 17 bp, Homo sapiens
ggctttgcctcttcttt

SEQ ID NO: 4147688 - DNA, 22 bp, Homo sapiens
ggctttgccttgcagccacatg

SEQ ID NO: 4147689 - DNA, 11 bp, Homo sapiens
ggctttgtgtt

SEQ ID NO: 4147690 - DNA, 17 bp, Homo sapiens
ggcttttcactgctggc

SEQ ID NO: 4147691 - DNA, 22 bp, Homo sapiens
ggcttttcactgctggctgcct

SEQ ID NO: 4147692 - DNA, 16 bp, Homo sapiens
gggaaaaaaaaaaaag

SEQ ID NO: 4147693 - DNA, 20 bp, Homo sapiens
gggaaaaaaacttggcactt

SEQ ID NO: 4147694 - DNA, 10 bp, Homo sapiens
gggaaaaagc

SEQ ID NO: 4147695 - DNA, 22 bp, Homo sapiens
gggaaaataaaaaaagaaaaaa

SEQ ID NO: 4147696 - DNA, 20 bp, Homo sapiens
gggaaaggggttggggtgac

SEQ ID NO: 4147697 - DNA, 23 bp, Homo sapiens
gggaaagtgtgagctcttccctt

SEQ ID NO: 4147698 - DNA, 12 bp, Homo sapiens
gggaaatgtaat

SEQ ID NO: 4147699 - DNA, 11 bp, Homo sapiens
gggaaatgtgg

SEQ ID NO: 4147700 - DNA, 19 bp, Homo sapiens
gggaacagacaacagaagt

SEQ ID NO: 4147701 - DNA, 13 bp, Homo sapiens
gggaacagaccag

SEQ ID NO: 4147702 - DNA, 16 bp, Homo sapiens
gggaactcagatccag

SEQ ID NO: 4147703 - DNA, 14 bp, Homo sapiens
gggaactgagtcac

SEQ ID NO: 4147704 - DNA, 14 bp, Homo sapiens
gggaagctgccagc

SEQ ID NO: 4147705 - DNA, 18 bp, Homo sapiens
gggaagctgccagcccag

SEQ ID NO: 4147706 - DNA, 15 bp, Homo sapiens
gggaagctggcctga

SEQ ID NO: 4147707 - DNA, 14 bp, Homo sapiens
gggaaggccctgag

SEQ ID NO: 4147708 - DNA, 18 bp, Homo sapiens
gggaaggccctgaggcgg

SEQ ID NO: 4147709 - DNA, 16 bp, Homo sapiens
gggaagtagtccttgg

SEQ ID NO: 4147710 - DNA, 20 bp, Homo sapiens
gggaagtcgggcatggtggc

SEQ ID NO: 4147711 - DNA, 23 bp, Homo sapiens
gggaagtgaagactggaagctaa

SEQ ID NO: 4147712 - DNA, 14 bp, Homo sapiens
gggaataaccttcc

SEQ ID NO: 4147713 - DNA, 17 bp, Homo sapiens
gggaatagggagacagg

SEQ ID NO: 4147714 - DNA, 12 bp, Homo sapiens
gggaatatttta

SEQ ID NO: 4147715 - DNA, 16 bp, Homo sapiens
gggaatgagcccagag

SEQ ID NO: 4147716 - DNA, 17 bp, Homo sapiens
gggaatgagcccagaga

SEQ ID NO: 4147717 - DNA, 18 bp, Homo sapiens
gggaatgagcccagagaa

SEQ ID NO: 4147718 - DNA, 21 bp, Homo sapiens
gggaatgagcccagagaacag

SEQ ID NO: 4147719 - DNA, 22 bp, Homo sapiens
gggaatgagcccagagaacagc

SEQ ID NO: 4147720 - DNA, 17 bp, Homo sapiens
gggacaccagggaagaa

SEQ ID NO: 4147721 - DNA, 17 bp, Homo sapiens
gggacacctgccctgcc

SEQ ID NO: 4147722 - DNA, 17 bp, Homo sapiens
gggacagaggccccagc

SEQ ID NO: 4147723 - DNA, 18 bp, Homo sapiens
gggacagaggccccagcc

SEQ ID NO: 4147724 - DNA, 19 bp, Homo sapiens
gggacagaggccccagcct

SEQ ID NO: 4147725 - DNA, 18 bp, Homo sapiens
gggacagccagagctggg

SEQ ID NO: 4147726 - DNA, 16 bp, Homo sapiens
gggacagcccagagcc

SEQ ID NO: 4147727 - DNA, 20 bp, Homo sapiens
gggacagcttcctcacaccc

SEQ ID NO: 4147728 - DNA, 23 bp, Homo sapiens
gggacagggaggtgtgaggcagg

SEQ ID NO: 4147729 - DNA, 13 bp, Homo sapiens
gggaccacatgcc

SEQ ID NO: 4147730 - DNA, 12 bp, Homo sapiens
gggaccagagcc

SEQ ID NO: 4147731 - DNA, 13 bp, Homo sapiens
gggaccagagcca

SEQ ID NO: 4147732 - DNA, 14 bp, Homo sapiens
gggaccagagccag

SEQ ID NO: 4147733 - DNA, 15 bp, Homo sapiens
gggaccagagccaga

SEQ ID NO: 4147734 - DNA, 16 bp, Homo sapiens
gggaccagagccagat

SEQ ID NO: 4147735 - DNA, 20 bp, Homo sapiens
gggaccagagccagatgcag

SEQ ID NO: 4147736 - DNA, 12 bp, Homo sapiens
gggaccaggata

SEQ ID NO: 4147737 - DNA, 21 bp, Homo sapiens
gggaccaggatactggacgct

SEQ ID NO: 4147738 - DNA, 22 bp, Homo sapiens
gggacccctgctcccagcctgc

SEQ ID NO: 4147739 - DNA, 23 bp, Homo sapiens
gggacccctgctcccagcctgct

SEQ ID NO: 4147740 - DNA, 18 bp, Homo sapiens
gggacctggtaccctcct

SEQ ID NO: 4147741 - DNA, 18 bp, Homo sapiens
gggacgtggctcagccag

SEQ ID NO: 4147742 - DNA, 16 bp, Homo sapiens
gggactcagccctgag

SEQ ID NO: 4147743 - DNA, 17 bp, Homo sapiens
gggactcagccctgagg

SEQ ID NO: 4147744 - DNA, 19 bp, Homo sapiens
gggactctgagcgggaggc

SEQ ID NO: 4147745 - DNA, 22 bp, Homo sapiens
gggactctgagcgggaggcaga

SEQ ID NO: 4147746 - DNA, 23 bp, Homo sapiens
gggactctgagcgggaggcagag

SEQ ID NO: 4147747 - DNA, 19 bp, Homo sapiens
gggactggaaccagggaga

SEQ ID NO: 4147748 - DNA, 15 bp, Homo sapiens
gggactgggagtcag

SEQ ID NO: 4147749 - DNA, 20 bp, Homo sapiens
gggactggggatgtgggagg

SEQ ID NO: 4147750 - DNA, 19 bp, Homo sapiens
gggacttggacaggagtca

SEQ ID NO: 4147751 - DNA, 19 bp, Homo sapiens
gggagaaaaagaaacacaa

SEQ ID NO: 4147752 - DNA, 20 bp, Homo sapiens
gggagaaaaagaaacacaag

SEQ ID NO: 4147753 - DNA, 15 bp, Homo sapiens
gggagaaaattcaat

SEQ ID NO: 4147754 - DNA, 23 bp, Homo sapiens
gggagaatgtcaaggaagacttt

SEQ ID NO: 4147755 - DNA, 18 bp, Homo sapiens
gggagacaggagcctagc

SEQ ID NO: 4147756 - DNA, 14 bp, Homo sapiens
gggagagagagaga

SEQ ID NO: 4147757 - DNA, 23 bp, Homo sapiens
gggagagagagagagagaggaca

SEQ ID NO: 4147758 - DNA, 17 bp, Homo sapiens
gggagagggaggtcact

SEQ ID NO: 4147759 - DNA, 16 bp, Homo sapiens
gggagagtcaggcagg

SEQ ID NO: 4147760 - DNA, 16 bp, Homo sapiens
gggagatgcttctctc

SEQ ID NO: 4147761 - DNA, 14 bp, Homo sapiens
gggagatggggagg

SEQ ID NO: 4147762 - DNA, 14 bp, Homo sapiens
gggagcaagacaga

SEQ ID NO: 4147763 - DNA, 19 bp, Homo sapiens
gggagcagaaacagccatt

SEQ ID NO: 4147764 - DNA, 13 bp, Homo sapiens
gggagcagagaca

SEQ ID NO: 4147765 - DNA, 20 bp, Homo sapiens
gggagcaggaggccaataaa

SEQ ID NO: 4147766 - DNA, 12 bp, Homo sapiens
gggagcagggct

SEQ ID NO: 4147767 - DNA, 22 bp, Homo sapiens
gggagcatttaatggcagctag

SEQ ID NO: 4147768 - DNA, 11 bp, Homo sapiens
gggagccagcc

SEQ ID NO: 4147769 - DNA, 13 bp, Homo sapiens
gggagccaggagg

SEQ ID NO: 4147770 - DNA, 20 bp, Homo sapiens
gggagcccactgtcctgggc

SEQ ID NO: 4147771 - DNA, 21 bp, Homo sapiens
gggagcccactgtcctgggcc

SEQ ID NO: 4147772 - DNA, 12 bp, Homo sapiens
gggagccccagg

SEQ ID NO: 4147773 - DNA, 18 bp, Homo sapiens
gggagcctagctcctgcc

SEQ ID NO: 4147774 - DNA, 21 bp, Homo sapiens
gggagcctagctcctgccaca

SEQ ID NO: 4147775 - DNA, 23 bp, Homo sapiens
gggagcctccccatctgtccagc

SEQ ID NO: 4147776 - DNA, 21 bp, Homo sapiens
gggagctcctctcctggagga

SEQ ID NO: 4147777 - DNA, 22 bp, Homo sapiens
gggagctcctctcctggaggat

SEQ ID NO: 4147778 - DNA, 14 bp, Homo sapiens
gggagctctgggga

SEQ ID NO: 4147779 - DNA, 16 bp, Homo sapiens
gggaggcaagaaaagg

SEQ ID NO: 4147780 - DNA, 17 bp, Homo sapiens
gggaggcaagaaaagga

SEQ ID NO: 4147781 - DNA, 19 bp, Homo sapiens
gggaggcagatggagccca

SEQ ID NO: 4147782 - DNA, 17 bp, Homo sapiens
gggaggcatggccctgg

SEQ ID NO: 4147783 - DNA, 13 bp, Homo sapiens
gggaggctcaggt

SEQ ID NO: 4147784 - DNA, 15 bp, Homo sapiens
gggaggctcaggtcc

SEQ ID NO: 4147785 - DNA, 19 bp, Homo sapiens
gggaggctgaggcaggaga

SEQ ID NO: 4147786 - DNA, 16 bp, Homo sapiens
gggaggctgggcacag

SEQ ID NO: 4147787 - DNA, 20 bp, Homo sapiens
gggagggaaaagggaagtag

SEQ ID NO: 4147788 - DNA, 16 bp, Homo sapiens
gggagggaagtgtgag

SEQ ID NO: 4147789 - DNA, 19 bp, Homo sapiens
gggagggcaggatggcctt

SEQ ID NO: 4147790 - DNA, 16 bp, Homo sapiens
gggaggggaaaagcat

SEQ ID NO: 4147791 - DNA, 17 bp, Homo sapiens
gggaggggaaaggctgc

SEQ ID NO: 4147792 - DNA, 17 bp, Homo sapiens
gggagggttggggaggg

SEQ ID NO: 4147793 - DNA, 14 bp, Homo sapiens
gggaggtcattttg

SEQ ID NO: 4147794 - DNA, 13 bp, Homo sapiens
gggaggtccaagc

SEQ ID NO: 4147795 - DNA, 15 bp, Homo sapiens
gggaggtccaagcag

SEQ ID NO: 4147796 - DNA, 19 bp, Homo sapiens
gggaggtgggtgtgggtgg

SEQ ID NO: 4147797 - DNA, 20 bp, Homo sapiens
gggagtccagggctcccgga

SEQ ID NO: 4147798 - DNA, 17 bp, Homo sapiens
gggagtccctacctgct

SEQ ID NO: 4147799 - DNA, 20 bp, Homo sapiens
gggagtccctacctgcttca

SEQ ID NO: 4147800 - DNA, 16 bp, Homo sapiens
gggagtgctggctcac

SEQ ID NO: 4147801 - DNA, 23 bp, Homo sapiens
gggagtgctggctcacagtacag

SEQ ID NO: 4147802 - DNA, 16 bp, Homo sapiens
gggagttaagacctgg

SEQ ID NO: 4147803 - DNA, 17 bp, Homo sapiens
gggagttaagacctggc

SEQ ID NO: 4147804 - DNA, 23 bp, Homo sapiens
gggagttaagacctggcagctct

SEQ ID NO: 4147805 - DNA, 20 bp, Homo sapiens
gggatacaggcccctgggtt

SEQ ID NO: 4147806 - DNA, 19 bp, Homo sapiens
gggatagtgttctgctcct

SEQ ID NO: 4147807 - DNA, 21 bp, Homo sapiens
gggatagtgttctgctcctgc

SEQ ID NO: 4147808 - DNA, 12 bp, Homo sapiens
gggatcactggc

SEQ ID NO: 4147809 - DNA, 14 bp, Homo sapiens
gggatcccaccctg

SEQ ID NO: 4147810 - DNA, 16 bp, Homo sapiens
gggatgctgggctggg

SEQ ID NO: 4147811 - DNA, 21 bp, Homo sapiens
gggatggggcctccctccttg

SEQ ID NO: 4147812 - DNA, 15 bp, Homo sapiens
gggatgtcagcagac

SEQ ID NO: 4147813 - DNA, 14 bp, Homo sapiens
gggatgtgggaggg

SEQ ID NO: 4147814 - DNA, 22 bp, Homo sapiens
gggatgtgtgtgtgcagagctg

SEQ ID NO: 4147815 - DNA, 16 bp, Homo sapiens
gggattaacctctgca

SEQ ID NO: 4147816 - DNA, 15 bp, Homo sapiens
gggattcaggctgct

SEQ ID NO: 4147817 - DNA, 22 bp, Homo sapiens
gggattctctattggaggtgag

SEQ ID NO: 4147818 - DNA, 15 bp, Homo sapiens
gggattctgagcagt

SEQ ID NO: 4147819 - DNA, 16 bp, Homo sapiens
gggattctgagcagtg

SEQ ID NO: 4147820 - DNA, 15 bp, Homo sapiens
gggatttaatttcca

SEQ ID NO: 4147821 - DNA, 15 bp, Homo sapiens
gggattttagtaagt

SEQ ID NO: 4147822 - DNA, 23 bp, Homo sapiens
gggatttttcttttgaggcatgc

SEQ ID NO: 4147823 - DNA, 21 bp, Homo sapiens
gggcaaagccacaaggctggc

SEQ ID NO: 4147824 - DNA, 22 bp, Homo sapiens
gggcaacagagcaagatcctgt

SEQ ID NO: 4147825 - DNA, 21 bp, Homo sapiens
gggcaagacagaaaagtgcct

SEQ ID NO: 4147826 - DNA, 13 bp, Homo sapiens
gggcacagccctc

SEQ ID NO: 4147827 - DNA, 13 bp, Homo sapiens
gggcacagggcac

SEQ ID NO: 4147828 - DNA, 18 bp, Homo sapiens
gggcacagggcaccagag

SEQ ID NO: 4147829 - DNA, 13 bp, Homo sapiens
gggcacagtccag

SEQ ID NO: 4147830 - DNA, 13 bp, Homo sapiens
gggcaccagaggc

SEQ ID NO: 4147831 - DNA, 14 bp, Homo sapiens
gggcaccagaggcc

SEQ ID NO: 4147832 - DNA, 14 bp, Homo sapiens
gggcacgcctgctg

SEQ ID NO: 4147833 - DNA, 16 bp, Homo sapiens
gggcacggtcacacgg

SEQ ID NO: 4147834 - DNA, 17 bp, Homo sapiens
gggcacggtcacacggc

SEQ ID NO: 4147835 - DNA, 16 bp, Homo sapiens
gggcactggtggcccg

SEQ ID NO: 4147836 - DNA, 15 bp, Homo sapiens
gggcagaaagtggcc

SEQ ID NO: 4147837 - DNA, 14 bp, Homo sapiens
gggcagaagggaga

SEQ ID NO: 4147838 - DNA, 18 bp, Homo sapiens
gggcagactgtgaacttg

SEQ ID NO: 4147839 - DNA, 14 bp, Homo sapiens
gggcagagggctgg

SEQ ID NO: 4147840 - DNA, 22 bp, Homo sapiens
gggcagagggctggaggcccag

SEQ ID NO: 4147841 - DNA, 17 bp, Homo sapiens
gggcagcaccctccccc

SEQ ID NO: 4147842 - DNA, 14 bp, Homo sapiens
gggcagccccagag

SEQ ID NO: 4147843 - DNA, 16 bp, Homo sapiens
gggcagccccagagag

SEQ ID NO: 4147844 - DNA, 14 bp, Homo sapiens
gggcagcctgcctt

SEQ ID NO: 4147845 - DNA, 16 bp, Homo sapiens
gggcagcgccaggctg

SEQ ID NO: 4147846 - DNA, 12 bp, Homo sapiens
gggcagctgagg

SEQ ID NO: 4147847 - DNA, 14 bp, Homo sapiens
gggcagctgaggac

SEQ ID NO: 4147848 - DNA, 21 bp, Homo sapiens
gggcaggaaggagagcctgct

SEQ ID NO: 4147849 - DNA, 12 bp, Homo sapiens
gggcaggctggg

SEQ ID NO: 4147850 - DNA, 20 bp, Homo sapiens
gggcagggaaggggaggcag

SEQ ID NO: 4147851 - DNA, 12 bp, Homo sapiens
gggcagggagcg

SEQ ID NO: 4147852 - DNA, 14 bp, Homo sapiens
gggcagggagtgat

SEQ ID NO: 4147853 - DNA, 16 bp, Homo sapiens
gggcagggagtgatga

SEQ ID NO: 4147854 - DNA, 20 bp, Homo sapiens
gggcagggcatctcctgtgc

SEQ ID NO: 4147855 - DNA, 11 bp, Homo sapiens
gggcagggctg

SEQ ID NO: 4147856 - DNA, 16 bp, Homo sapiens
gggcaggtcctgccca

SEQ ID NO: 4147857 - DNA, 17 bp, Homo sapiens
gggcaggtcctgcccat

SEQ ID NO: 4147858 - DNA, 18 bp, Homo sapiens
gggcaggtcctgcccatg

SEQ ID NO: 4147859 - DNA, 21 bp, Homo sapiens
gggcaggttctgcctgctttg

SEQ ID NO: 4147860 - DNA, 15 bp, Homo sapiens
gggcagtgccccagg

SEQ ID NO: 4147861 - DNA, 22 bp, Homo sapiens
gggcagttctcactcctaggag

SEQ ID NO: 4147862 - DNA, 14 bp, Homo sapiens
gggcatcgcaggag

SEQ ID NO: 4147863 - DNA, 18 bp, Homo sapiens
gggcatctcttccccaga

SEQ ID NO: 4147864 - DNA, 14 bp, Homo sapiens
gggcatctgcccct

SEQ ID NO: 4147865 - DNA, 19 bp, Homo sapiens
gggcatctgcccctccccc

SEQ ID NO: 4147866 - DNA, 14 bp, Homo sapiens
gggcatgccaccct

SEQ ID NO: 4147867 - DNA, 15 bp, Homo sapiens
gggcatgccaccctc

SEQ ID NO: 4147868 - DNA, 16 bp, Homo sapiens
gggcatgccaccctca

SEQ ID NO: 4147869 - DNA, 19 bp, Homo sapiens
gggcatgccaccctcacac

SEQ ID NO: 4147870 - DNA, 13 bp, Homo sapiens
gggcatgccttgt

SEQ ID NO: 4147871 - DNA, 17 bp, Homo sapiens
gggcatggccaggtggc

SEQ ID NO: 4147872 - DNA, 17 bp, Homo sapiens
gggcatgtctgcctgga

SEQ ID NO: 4147873 - DNA, 14 bp, Homo sapiens
gggcattcgggcca

SEQ ID NO: 4147874 - DNA, 17 bp, Homo sapiens
gggcattcgggccacag

SEQ ID NO: 4147875 - DNA, 17 bp, Homo sapiens
gggcattttacccttgc

SEQ ID NO: 4147876 - DNA, 13 bp, Homo sapiens
gggcattttcctc

SEQ ID NO: 4147877 - DNA, 20 bp, Homo sapiens
gggcattttcctcctctgcc

SEQ ID NO: 4147878 - DNA, 20 bp, Homo sapiens
gggccaaaagcttccctccc

SEQ ID NO: 4147879 - DNA, 23 bp, Homo sapiens
gggccaacttgagggcccagagc

SEQ ID NO: 4147880 - DNA, 13 bp, Homo sapiens
gggccaagaaaga

SEQ ID NO: 4147881 - DNA, 12 bp, Homo sapiens
gggccacagggc

SEQ ID NO: 4147882 - DNA, 22 bp, Homo sapiens
gggccacagggcggtgctagct

SEQ ID NO: 4147883 - DNA, 15 bp, Homo sapiens
gggccacgccccagc

SEQ ID NO: 4147884 - DNA, 16 bp, Homo sapiens
gggccacgctccagct

SEQ ID NO: 4147885 - DNA, 15 bp, Homo sapiens
gggccacggctgagc

SEQ ID NO: 4147886 - DNA, 11 bp, Homo sapiens
gggccactggg

SEQ ID NO: 4147887 - DNA, 20 bp, Homo sapiens
gggccactgtggtggcagtg

SEQ ID NO: 4147888 - DNA, 11 bp, Homo sapiens
gggccagagcc

SEQ ID NO: 4147889 - DNA, 16 bp, Homo sapiens
gggccagaggctggga

SEQ ID NO: 4147890 - DNA, 14 bp, Homo sapiens
gggccagatccagc

SEQ ID NO: 4147891 - DNA, 11 bp, Homo sapiens
gggccagctcc

SEQ ID NO: 4147892 - DNA, 18 bp, Homo sapiens
gggccaggacaccagtcc

SEQ ID NO: 4147893 - DNA, 13 bp, Homo sapiens
gggccaggcactg

SEQ ID NO: 4147894 - DNA, 14 bp, Homo sapiens
gggccaggcccgca

SEQ ID NO: 4147895 - DNA, 20 bp, Homo sapiens
gggccagggctgccctgaga

SEQ ID NO: 4147896 - DNA, 13 bp, Homo sapiens
gggccagtcctcc

SEQ ID NO: 4147897 - DNA, 15 bp, Homo sapiens
gggccagtcctgcct

SEQ ID NO: 4147898 - DNA, 19 bp, Homo sapiens
gggccagtcctgcctggcc

SEQ ID NO: 4147899 - DNA, 20 bp, Homo sapiens
gggccagtcctgcctggcca

SEQ ID NO: 4147900 - DNA, 21 bp, Homo sapiens
gggccagtcctgcctggccag

SEQ ID NO: 4147901 - DNA, 16 bp, Homo sapiens
gggccagtctgggctg

SEQ ID NO: 4147902 - DNA, 20 bp, Homo sapiens
gggccagtctgggctgccgg

SEQ ID NO: 4147903 - DNA, 13 bp, Homo sapiens
gggccagtgggga

SEQ ID NO: 4147904 - DNA, 17 bp, Homo sapiens
gggccagtggggaactg

SEQ ID NO: 4147905 - DNA, 16 bp, Homo sapiens
gggccagtggggcctg

SEQ ID NO: 4147906 - DNA, 17 bp, Homo sapiens
gggccagtggggcctgt

SEQ ID NO: 4147907 - DNA, 15 bp, Homo sapiens
gggccatgctgaagg

SEQ ID NO: 4147908 - DNA, 17 bp, Homo sapiens
gggccatgtccaaagag

SEQ ID NO: 4147909 - DNA, 22 bp, Homo sapiens
gggccatttccttttctctgcc

SEQ ID NO: 4147910 - DNA, 18 bp, Homo sapiens
gggcccaagacagatgcc

SEQ ID NO: 4147911 - DNA, 18 bp, Homo sapiens
gggcccaaggcggcccct

SEQ ID NO: 4147912 - DNA, 18 bp, Homo sapiens
gggcccacccatgtcacc

SEQ ID NO: 4147913 - DNA, 19 bp, Homo sapiens
gggcccacgtggttggggc

SEQ ID NO: 4147914 - DNA, 12 bp, Homo sapiens
gggcccagagca

SEQ ID NO: 4147915 - DNA, 14 bp, Homo sapiens
gggcccagagcagg

SEQ ID NO: 4147916 - DNA, 12 bp, Homo sapiens
gggcccagagcc

SEQ ID NO: 4147917 - DNA, 13 bp, Homo sapiens
gggcccagagccc

SEQ ID NO: 4147918 - DNA, 19 bp, Homo sapiens
gggcccagagcccagctcc

SEQ ID NO: 4147919 - DNA, 16 bp, Homo sapiens
gggcccagccaggagc

SEQ ID NO: 4147920 - DNA, 21 bp, Homo sapiens
gggcccagccaggagcagatg

SEQ ID NO: 4147921 - DNA, 12 bp, Homo sapiens
gggcccagcccc

SEQ ID NO: 4147922 - DNA, 12 bp, Homo sapiens
gggcccaggttc

SEQ ID NO: 4147923 - DNA, 15 bp, Homo sapiens
gggccccgccagggc

SEQ ID NO: 4147924 - DNA, 17 bp, Homo sapiens
gggccccgccagggctg

SEQ ID NO: 4147925 - DNA, 20 bp, Homo sapiens
gggccccgccagggctgggg

SEQ ID NO: 4147926 - DNA, 15 bp, Homo sapiens
gggccccgggttcag

SEQ ID NO: 4147927 - DNA, 23 bp, Homo sapiens
gggccccgggttcagcctggcct

SEQ ID NO: 4147928 - DNA, 17 bp, Homo sapiens
gggcccctcaccctgcc

SEQ ID NO: 4147929 - DNA, 17 bp, Homo sapiens
gggcccctccacgcctc

SEQ ID NO: 4147930 - DNA, 22 bp, Homo sapiens
gggcccctcttattcctctagg

SEQ ID NO: 4147931 - DNA, 22 bp, Homo sapiens
gggcccgcagtgctgggaccag

SEQ ID NO: 4147932 - DNA, 13 bp, Homo sapiens
gggccctctttcc

SEQ ID NO: 4147933 - DNA, 17 bp, Homo sapiens
gggccctctttccctgc

SEQ ID NO: 4147934 - DNA, 19 bp, Homo sapiens
gggccctgccctggcaggg

SEQ ID NO: 4147935 - DNA, 12 bp, Homo sapiens
gggccctgggcc

SEQ ID NO: 4147936 - DNA, 13 bp, Homo sapiens
gggccctgggcct

SEQ ID NO: 4147937 - DNA, 18 bp, Homo sapiens
gggccctgggcctcagtt

SEQ ID NO: 4147938 - DNA, 13 bp, Homo sapiens
gggccgaggccca

SEQ ID NO: 4147939 - DNA, 21 bp, Homo sapiens
gggccggggaagctgccagcc

SEQ ID NO: 4147940 - DNA, 17 bp, Homo sapiens
gggccgtgcccaggggc

SEQ ID NO: 4147941 - DNA, 21 bp, Homo sapiens
gggcctagcgatctctcctgg

SEQ ID NO: 4147942 - DNA, 14 bp, Homo sapiens
gggcctccagaact

SEQ ID NO: 4147943 - DNA, 11 bp, Homo sapiens
gggcctccagg

SEQ ID NO: 4147944 - DNA, 17 bp, Homo sapiens
gggcctcccttgggctg

SEQ ID NO: 4147945 - DNA, 14 bp, Homo sapiens
gggcctgactgctc

SEQ ID NO: 4147946 - DNA, 17 bp, Homo sapiens
gggcctgactgctcaga

SEQ ID NO: 4147947 - DNA, 19 bp, Homo sapiens
gggcctgcgccagtcctgc

SEQ ID NO: 4147948 - DNA, 13 bp, Homo sapiens
gggcctgctccag

SEQ ID NO: 4147949 - DNA, 15 bp, Homo sapiens
gggcctgctccagac

SEQ ID NO: 4147950 - DNA, 17 bp, Homo sapiens
gggcctgctccagacct

SEQ ID NO: 4147951 - DNA, 18 bp, Homo sapiens
gggcctgctccagacctg

SEQ ID NO: 4147952 - DNA, 22 bp, Homo sapiens
gggcctggcaggccagtgtctg

SEQ ID NO: 4147953 - DNA, 13 bp, Homo sapiens
gggcctggggcct

SEQ ID NO: 4147954 - DNA, 17 bp, Homo sapiens
gggcctggggcctgaga

SEQ ID NO: 4147955 - DNA, 20 bp, Homo sapiens
gggcctgtcgtgccagtcct

SEQ ID NO: 4147956 - DNA, 22 bp, Homo sapiens
gggcctgtggaatgagtgtgca

SEQ ID NO: 4147957 - DNA, 17 bp, Homo sapiens
gggccttagggcactgg

SEQ ID NO: 4147958 - DNA, 20 bp, Homo sapiens
gggccttagtgggccagggc

SEQ ID NO: 4147959 - DNA, 23 bp, Homo sapiens
gggccttatcgggctccagccat

SEQ ID NO: 4147960 - DNA, 15 bp, Homo sapiens
gggccttggatcgct

SEQ ID NO: 4147961 - DNA, 23 bp, Homo sapiens
gggccttggatcgctaagctggc

SEQ ID NO: 4147962 - DNA, 20 bp, Homo sapiens
gggcgagactccgtctcaaa

SEQ ID NO: 4147963 - DNA, 15 bp, Homo sapiens
gggcgcggccagccc

SEQ ID NO: 4147964 - DNA, 18 bp, Homo sapiens
gggcgcggccagccccgg

SEQ ID NO: 4147965 - DNA, 23 bp, Homo sapiens
gggcgctcagacggcggccaggc

SEQ ID NO: 4147966 - DNA, 17 bp, Homo sapiens
gggcgggcagagggctg

SEQ ID NO: 4147967 - DNA, 13 bp, Homo sapiens
gggcggggcccag

SEQ ID NO: 4147968 - DNA, 14 bp, Homo sapiens
gggcgttgggagcc

SEQ ID NO: 4147969 - DNA, 17 bp, Homo sapiens
gggctaacgggaggctg

SEQ ID NO: 4147970 - DNA, 18 bp, Homo sapiens
gggctcagatggactggg

SEQ ID NO: 4147971 - DNA, 21 bp, Homo sapiens
gggctcagatggactgggagg

SEQ ID NO: 4147972 - DNA, 22 bp, Homo sapiens
gggctcagatggactgggagga

SEQ ID NO: 4147973 - DNA, 13 bp, Homo sapiens
gggctccagccat

SEQ ID NO: 4147974 - DNA, 11 bp, Homo sapiens
gggctcccagg

SEQ ID NO: 4147975 - DNA, 13 bp, Homo sapiens
gggctcccagggg

SEQ ID NO: 4147976 - DNA, 22 bp, Homo sapiens
gggctcccaggggtctccctgg

SEQ ID NO: 4147977 - DNA, 23 bp, Homo sapiens
gggctcccggagagggagtcagt

SEQ ID NO: 4147978 - DNA, 22 bp, Homo sapiens
gggctccctaaactttggcctt

SEQ ID NO: 4147979 - DNA, 14 bp, Homo sapiens
gggctcctggaacc

SEQ ID NO: 4147980 - DNA, 22 bp, Homo sapiens
gggctcctttctccagccagca

SEQ ID NO: 4147981 - DNA, 18 bp, Homo sapiens
gggctcgaggggtgggct

SEQ ID NO: 4147982 - DNA, 14 bp, Homo sapiens
gggctcggaggctg

SEQ ID NO: 4147983 - DNA, 19 bp, Homo sapiens
gggctctctgctgtacata

SEQ ID NO: 4147984 - DNA, 20 bp, Homo sapiens
gggctctgcaattcccctct

SEQ ID NO: 4147985 - DNA, 21 bp, Homo sapiens
gggctctgcaattcccctctg

SEQ ID NO: 4147986 - DNA, 16 bp, Homo sapiens
gggctgactgggccag

SEQ ID NO: 4147987 - DNA, 14 bp, Homo sapiens
gggctgagggcctg

SEQ ID NO: 4147988 - DNA, 16 bp, Homo sapiens
gggctgagggcctgct

SEQ ID NO: 4147989 - DNA, 12 bp, Homo sapiens
gggctgaggggc

SEQ ID NO: 4147990 - DNA, 22 bp, Homo sapiens
gggctgcagggccactggaagg

SEQ ID NO: 4147991 - DNA, 11 bp, Homo sapiens
gggctgctcct

SEQ ID NO: 4147992 - DNA, 19 bp, Homo sapiens
gggctggaggcccaggctg

SEQ ID NO: 4147993 - DNA, 15 bp, Homo sapiens
gggctggcggggcga

SEQ ID NO: 4147994 - DNA, 10 bp, Homo sapiens
gggctggctc

SEQ ID NO: 4147995 - DNA, 11 bp, Homo sapiens
gggctggctct

SEQ ID NO: 4147996 - DNA, 12 bp, Homo sapiens
gggctggctctg

SEQ ID NO: 4147997 - DNA, 13 bp, Homo sapiens
gggctggctctgc

SEQ ID NO: 4147998 - DNA, 11 bp, Homo sapiens
gggctggctgg

SEQ ID NO: 4147999 - DNA, 23 bp, Homo sapiens
gggctgggccctctttccctgcg

SEQ ID NO: 4148000 - DNA, 19 bp, Homo sapiens
gggctggggacagagggtg

SEQ ID NO: 4148001 - DNA, 21 bp, Homo sapiens
gggctggggccaccatccctg

SEQ ID NO: 4148002 - DNA, 11 bp, Homo sapiens
gggctggggga

SEQ ID NO: 4148003 - DNA, 18 bp, Homo sapiens
gggctggggtgagagagg

SEQ ID NO: 4148004 - DNA, 13 bp, Homo sapiens
gggctgggtgctg

SEQ ID NO: 4148005 - DNA, 15 bp, Homo sapiens
gggctgggtttgctg

SEQ ID NO: 4148006 - DNA, 16 bp, Homo sapiens
gggctggtgccccaca

SEQ ID NO: 4148007 - DNA, 19 bp, Homo sapiens
gggctgtaacgtggcactg

SEQ ID NO: 4148008 - DNA, 21 bp, Homo sapiens
gggcttatatgtacttttatt

SEQ ID NO: 4148009 - DNA, 12 bp, Homo sapiens
gggcttcctgcc

SEQ ID NO: 4148010 - DNA, 15 bp, Homo sapiens
gggcttcctgccctt

SEQ ID NO: 4148011 - DNA, 19 bp, Homo sapiens
gggcttcctgcccttccct

SEQ ID NO: 4148012 - DNA, 12 bp, Homo sapiens
gggcttggccca

SEQ ID NO: 4148013 - DNA, 16 bp, Homo sapiens
gggcttgggccctgca

SEQ ID NO: 4148014 - DNA, 13 bp, Homo sapiens
gggcttgtgaaca

SEQ ID NO: 4148015 - DNA, 12 bp, Homo sapiens
ggggaaaaaagc

SEQ ID NO: 4148016 - DNA, 15 bp, Homo sapiens
ggggaaatgtggaga

SEQ ID NO: 4148017 - DNA, 14 bp, Homo sapiens
ggggaagctggctt

SEQ ID NO: 4148018 - DNA, 13 bp, Homo sapiens
ggggaaggagcca

SEQ ID NO: 4148019 - DNA, 21 bp, Homo sapiens
ggggaaggagggtacagctgg

SEQ ID NO: 4148020 - DNA, 22 bp, Homo sapiens
ggggaaggagggtacagctggg

SEQ ID NO: 4148021 - DNA, 19 bp, Homo sapiens
ggggaatgagcccagagaa

SEQ ID NO: 4148022 - DNA, 23 bp, Homo sapiens
ggggaatgagcccagagaacagc

SEQ ID NO: 4148023 - DNA, 13 bp, Homo sapiens
ggggactcagccc

SEQ ID NO: 4148024 - DNA, 20 bp, Homo sapiens
ggggactgttccaaagccag

SEQ ID NO: 4148025 - DNA, 22 bp, Homo sapiens
ggggactgttccaaagccagtg

SEQ ID NO: 4148026 - DNA, 23 bp, Homo sapiens
ggggactgttccaaagccagtga

SEQ ID NO: 4148027 - DNA, 14 bp, Homo sapiens
ggggacttctcttc

SEQ ID NO: 4148028 - DNA, 12 bp, Homo sapiens
ggggagacctgg

SEQ ID NO: 4148029 - DNA, 13 bp, Homo sapiens
ggggagacctggt

SEQ ID NO: 4148030 - DNA, 14 bp, Homo sapiens
ggggagcagagaca

SEQ ID NO: 4148031 - DNA, 22 bp, Homo sapiens
ggggagcaggaggccaataaaa

SEQ ID NO: 4148032 - DNA, 14 bp, Homo sapiens
ggggagcccagtga

SEQ ID NO: 4148033 - DNA, 12 bp, Homo sapiens
ggggagctggac

SEQ ID NO: 4148034 - DNA, 14 bp, Homo sapiens
ggggaggagggggc

SEQ ID NO: 4148035 - DNA, 14 bp, Homo sapiens
ggggaggcagccgg

SEQ ID NO: 4148036 - DNA, 12 bp, Homo sapiens
ggggagggcagg

SEQ ID NO: 4148037 - DNA, 14 bp, Homo sapiens
ggggagtagagaag

SEQ ID NO: 4148038 - DNA, 18 bp, Homo sapiens
ggggagtggttaggcagc

SEQ ID NO: 4148039 - DNA, 12 bp, Homo sapiens
ggggcaagacag

SEQ ID NO: 4148040 - DNA, 19 bp, Homo sapiens
ggggcagcctgccttgccc

SEQ ID NO: 4148041 - DNA, 16 bp, Homo sapiens
ggggcaggagggccct

SEQ ID NO: 4148042 - DNA, 17 bp, Homo sapiens
ggggcagggccttcctg

SEQ ID NO: 4148043 - DNA, 12 bp, Homo sapiens
ggggcagggctg

SEQ ID NO: 4148044 - DNA, 14 bp, Homo sapiens
ggggcatctgcccc

SEQ ID NO: 4148045 - DNA, 16 bp, Homo sapiens
ggggccaccatccctg

SEQ ID NO: 4148046 - DNA, 13 bp, Homo sapiens
ggggccagatcca

SEQ ID NO: 4148047 - DNA, 14 bp, Homo sapiens
ggggccaggacacc

SEQ ID NO: 4148048 - DNA, 20 bp, Homo sapiens
ggggcccaggagaccacggg

SEQ ID NO: 4148049 - DNA, 15 bp, Homo sapiens
ggggccccgccaggg

SEQ ID NO: 4148050 - DNA, 22 bp, Homo sapiens
ggggccccgccagggctgggga

SEQ ID NO: 4148051 - DNA, 18 bp, Homo sapiens
ggggccccgggttcagcc

SEQ ID NO: 4148052 - DNA, 23 bp, Homo sapiens
ggggccccgggttcagcctggcc

SEQ ID NO: 4148053 - DNA, 18 bp, Homo sapiens
ggggccctgggcctcagt

SEQ ID NO: 4148054 - DNA, 22 bp, Homo sapiens
ggggcccttgggacagccagag

SEQ ID NO: 4148055 - DNA, 13 bp, Homo sapiens
ggggccgggcaca

SEQ ID NO: 4148056 - DNA, 21 bp, Homo sapiens
ggggccgggcaggtcctgccc

SEQ ID NO: 4148057 - DNA, 21 bp, Homo sapiens
ggggcctagcgatctctcctg

SEQ ID NO: 4148058 - DNA, 12 bp, Homo sapiens
ggggcctccctg

SEQ ID NO: 4148059 - DNA, 14 bp, Homo sapiens
ggggcctgactgct

SEQ ID NO: 4148060 - DNA, 12 bp, Homo sapiens
ggggcctgagag

SEQ ID NO: 4148061 - DNA, 16 bp, Homo sapiens
ggggcctgaggctcct

SEQ ID NO: 4148062 - DNA, 17 bp, Homo sapiens
ggggcgtgaggtcccag

SEQ ID NO: 4148063 - DNA, 17 bp, Homo sapiens
ggggctcagatggactg

SEQ ID NO: 4148064 - DNA, 19 bp, Homo sapiens
ggggctcagatggactggg

SEQ ID NO: 4148065 - DNA, 16 bp, Homo sapiens
ggggctctcagctcag

SEQ ID NO: 4148066 - DNA, 14 bp, Homo sapiens
ggggctctctgaga

SEQ ID NO: 4148067 - DNA, 12 bp, Homo sapiens
ggggctctggga

SEQ ID NO: 4148068 - DNA, 17 bp, Homo sapiens
ggggctggcactgactg

SEQ ID NO: 4148069 - DNA, 17 bp, Homo sapiens
ggggcttgaagccaaag

SEQ ID NO: 4148070 - DNA, 13 bp, Homo sapiens
ggggctttctctt

SEQ ID NO: 4148071 - DNA, 21 bp, Homo sapiens
ggggctttctcttccccttcc

SEQ ID NO: 4148072 - DNA, 16 bp, Homo sapiens
gggggaacagatgcta

SEQ ID NO: 4148073 - DNA, 22 bp, Homo sapiens
gggggacactccatgagtgtct

SEQ ID NO: 4148074 - DNA, 20 bp, Homo sapiens
gggggactgggagtcagagc

SEQ ID NO: 4148075 - DNA, 21 bp, Homo sapiens
gggggagcccagtgaagcctc

SEQ ID NO: 4148076 - DNA, 22 bp, Homo sapiens
gggggagccccttctgctcagc

SEQ ID NO: 4148077 - DNA, 21 bp, Homo sapiens
gggggatgccactcctccctc

SEQ ID NO: 4148078 - DNA, 22 bp, Homo sapiens
gggggatgccactcctccctcc

SEQ ID NO: 4148079 - DNA, 17 bp, Homo sapiens
gggggccaaggtcctgc

SEQ ID NO: 4148080 - DNA, 18 bp, Homo sapiens
gggggccccgccagggct

SEQ ID NO: 4148081 - DNA, 23 bp, Homo sapiens
gggggccgggcaggtcctgccca

SEQ ID NO: 4148082 - DNA, 11 bp, Homo sapiens
ggggggcagag

SEQ ID NO: 4148083 - DNA, 12 bp, Homo sapiens
gggggtggccat

SEQ ID NO: 4148084 - DNA, 22 bp, Homo sapiens
gggggtttcacctgggccctgg

SEQ ID NO: 4148085 - DNA, 16 bp, Homo sapiens
ggggtaaggtgcatct

SEQ ID NO: 4148086 - DNA, 15 bp, Homo sapiens
ggggtcaggctccat

SEQ ID NO: 4148087 - DNA, 21 bp, Homo sapiens
ggggtctcatgtcctgctggc

SEQ ID NO: 4148088 - DNA, 13 bp, Homo sapiens
ggggtctccctgg

SEQ ID NO: 4148089 - DNA, 14 bp, Homo sapiens
ggggtctccctggc

SEQ ID NO: 4148090 - DNA, 19 bp, Homo sapiens
ggggtctcttttgtaaatt

SEQ ID NO: 4148091 - DNA, 20 bp, Homo sapiens
ggggtctggagttgatctgg

SEQ ID NO: 4148092 - DNA, 21 bp, Homo sapiens
ggggtgacagtcatcatcagg

SEQ ID NO: 4148093 - DNA, 17 bp, Homo sapiens
ggggtggaggcttcctg

SEQ ID NO: 4148094 - DNA, 14 bp, Homo sapiens
ggggtggggagatg

SEQ ID NO: 4148095 - DNA, 13 bp, Homo sapiens
ggggttacaaact

SEQ ID NO: 4148096 - DNA, 18 bp, Homo sapiens
ggggttcctcaaattttt

SEQ ID NO: 4148097 - DNA, 23 bp, Homo sapiens
ggggtttgggcccctcagagccc

SEQ ID NO: 4148098 - DNA, 13 bp, Homo sapiens
gggtaagagagga

SEQ ID NO: 4148099 - DNA, 15 bp, Homo sapiens
gggtacagctgggct

SEQ ID NO: 4148100 - DNA, 15 bp, Homo sapiens
gggtacatttataat

SEQ ID NO: 4148101 - DNA, 12 bp, Homo sapiens
gggtactaaatt

SEQ ID NO: 4148102 - DNA, 19 bp, Homo sapiens
gggtactcttgatgtgaag

SEQ ID NO: 4148103 - DNA, 10 bp, Homo sapiens
gggtatcctg

SEQ ID NO: 4148104 - DNA, 22 bp, Homo sapiens
gggtatgtttaatctgttatgt

SEQ ID NO: 4148105 - DNA, 13 bp, Homo sapiens
gggtcagccaggg

SEQ ID NO: 4148106 - DNA, 21 bp, Homo sapiens
gggtcaggaacagtggctggg

SEQ ID NO: 4148107 - DNA, 17 bp, Homo sapiens
gggtcaggccgggcaga

SEQ ID NO: 4148108 - DNA, 12 bp, Homo sapiens
gggtcaggctcc

SEQ ID NO: 4148109 - DNA, 18 bp, Homo sapiens
gggtcaggttgacaggag

SEQ ID NO: 4148110 - DNA, 20 bp, Homo sapiens
gggtcaggttgacaggaggt

SEQ ID NO: 4148111 - DNA, 21 bp, Homo sapiens
gggtcatcctgtgctcggagg

SEQ ID NO: 4148112 - DNA, 20 bp, Homo sapiens
gggtcatgtttgcaggggtg

SEQ ID NO: 4148113 - DNA, 16 bp, Homo sapiens
gggtcctagcccttcc

SEQ ID NO: 4148114 - DNA, 21 bp, Homo sapiens
gggtcctagcccttccctgag

SEQ ID NO: 4148115 - DNA, 13 bp, Homo sapiens
gggtcctgcaatt

SEQ ID NO: 4148116 - DNA, 21 bp, Homo sapiens
gggtctccctggctccctcct

SEQ ID NO: 4148117 - DNA, 17 bp, Homo sapiens
gggtctctccctcaggt

SEQ ID NO: 4148118 - DNA, 17 bp, Homo sapiens
gggtctcttttgtaaat

SEQ ID NO: 4148119 - DNA, 20 bp, Homo sapiens
gggtctggagttgatctgga

SEQ ID NO: 4148120 - DNA, 22 bp, Homo sapiens
gggtctggagttgatctggaac

SEQ ID NO: 4148121 - DNA, 15 bp, Homo sapiens
gggtctggctgagct

SEQ ID NO: 4148122 - DNA, 16 bp, Homo sapiens
gggtctgtctgctttg

SEQ ID NO: 4148123 - DNA, 17 bp, Homo sapiens
gggtctgtgtgaatgtg

SEQ ID NO: 4148124 - DNA, 24 bp, Homo sapiens
gggtctgtgtgaatgtgggcactg

SEQ ID NO: 4148125 - DNA, 23 bp, Homo sapiens
gggtcttccctacctcaggcagg

SEQ ID NO: 4148126 - DNA, 21 bp, Homo sapiens
gggtcttgctctgtcccccag

SEQ ID NO: 4148127 - DNA, 20 bp, Homo sapiens
gggtgaacaaagcagccacg

SEQ ID NO: 4148128 - DNA, 19 bp, Homo sapiens
gggtgaagagaaccgagca

SEQ ID NO: 4148129 - DNA, 18 bp, Homo sapiens
gggtgacagagtgagtga

SEQ ID NO: 4148130 - DNA, 12 bp, Homo sapiens
gggtgagagagg

SEQ ID NO: 4148131 - DNA, 22 bp, Homo sapiens
gggtgatttcagagagggcaga

SEQ ID NO: 4148132 - DNA, 13 bp, Homo sapiens
gggtgctcagaat

SEQ ID NO: 4148133 - DNA, 20 bp, Homo sapiens
gggtgctgctggtaacagtg

SEQ ID NO: 4148134 - DNA, 18 bp, Homo sapiens
gggtgctgggaggaggga

SEQ ID NO: 4148135 - DNA, 20 bp, Homo sapiens
gggtgcttttatagaggcta

SEQ ID NO: 4148136 - DNA, 22 bp, Homo sapiens
gggtgcttttatagaggctagc

SEQ ID NO: 4148137 - DNA, 11 bp, Homo sapiens
gggtggcctcg

SEQ ID NO: 4148138 - DNA, 18 bp, Homo sapiens
gggtggcgctagaggcca

SEQ ID NO: 4148139 - DNA, 17 bp, Homo sapiens
gggtgggcagcctatgg

SEQ ID NO: 4148140 - DNA, 14 bp, Homo sapiens
gggtgggcccagaa

SEQ ID NO: 4148141 - DNA, 21 bp, Homo sapiens
gggtgggggacgatcaggagg

SEQ ID NO: 4148142 - DNA, 17 bp, Homo sapiens
gggtgtcctgcctgtct

SEQ ID NO: 4148143 - DNA, 22 bp, Homo sapiens
gggtgtcctgcctgtctgcccc

SEQ ID NO: 4148144 - DNA, 12 bp, Homo sapiens
gggtgtggcctc

SEQ ID NO: 4148145 - DNA, 22 bp, Homo sapiens
gggttaacccttcatcttcctg

SEQ ID NO: 4148146 - DNA, 14 bp, Homo sapiens
gggttaaggcctga

SEQ ID NO: 4148147 - DNA, 18 bp, Homo sapiens
gggttaagtctcctgtct

SEQ ID NO: 4148148 - DNA, 13 bp, Homo sapiens
gggttcagcctgg

SEQ ID NO: 4148149 - DNA, 16 bp, Homo sapiens
gggttcagcctggcct

SEQ ID NO: 4148150 - DNA, 13 bp, Homo sapiens
gggttcaggggac

SEQ ID NO: 4148151 - DNA, 13 bp, Homo sapiens
gggttcattattg

SEQ ID NO: 4148152 - DNA, 16 bp, Homo sapiens
gggttccgcactttcc

SEQ ID NO: 4148153 - DNA, 17 bp, Homo sapiens
gggttcctcaaattttt

SEQ ID NO: 4148154 - DNA, 22 bp, Homo sapiens
gggttctaggcatctctgtact

SEQ ID NO: 4148155 - DNA, 18 bp, Homo sapiens
gggttgcagtggagaggg

SEQ ID NO: 4148156 - DNA, 19 bp, Homo sapiens
gggttgcagtggagaggga

SEQ ID NO: 4148157 - DNA, 20 bp, Homo sapiens
gggttgctgtataagttatt

SEQ ID NO: 4148158 - DNA, 14 bp, Homo sapiens
gggttgggcccaga

SEQ ID NO: 4148159 - DNA, 15 bp, Homo sapiens
gggttggggtgacag

SEQ ID NO: 4148160 - DNA, 20 bp, Homo sapiens
gggtttacccagtgggacag

SEQ ID NO: 4148161 - DNA, 20 bp, Homo sapiens
gggtttcaccatgttggcca

SEQ ID NO: 4148162 - DNA, 14 bp, Homo sapiens
gggtttgaattgtt

SEQ ID NO: 4148163 - DNA, 21 bp, Homo sapiens
gggttttgcaataacttctat

SEQ ID NO: 4148164 - DNA, 19 bp, Homo sapiens
gggtttttattatttttac

SEQ ID NO: 4148165 - DNA, 23 bp, Homo sapiens
gggtttttattatttttacctaa

SEQ ID NO: 4148166 - DNA, 18 bp, Homo sapiens
ggtaaaaagtattttttc

SEQ ID NO: 4148167 - DNA, 20 bp, Homo sapiens
ggtaaataccaagtatttat

SEQ ID NO: 4148168 - DNA, 14 bp, Homo sapiens
ggtaataacaaacg

SEQ ID NO: 4148169 - DNA, 22 bp, Homo sapiens
ggtaatcaatgaatattgaagt

SEQ ID NO: 4148170 - DNA, 20 bp, Homo sapiens
ggtaatttttaccctaatgt

SEQ ID NO: 4148171 - DNA, 22 bp, Homo sapiens
ggtaccacccttcagaccccag

SEQ ID NO: 4148172 - DNA, 20 bp, Homo sapiens
ggtaccctttggggagcagg

SEQ ID NO: 4148173 - DNA, 22 bp, Homo sapiens
ggtacctcaagccccatttcct

SEQ ID NO: 4148174 - DNA, 16 bp, Homo sapiens
ggtactcttgatgtga

SEQ ID NO: 4148175 - DNA, 18 bp, Homo sapiens
ggtactgactttgcttgc

SEQ ID NO: 4148176 - DNA, 15 bp, Homo sapiens
ggtacttcttgaagg

SEQ ID NO: 4148177 - DNA, 22 bp, Homo sapiens
ggtagaaatatctgaaaatgta

SEQ ID NO: 4148178 - DNA, 18 bp, Homo sapiens
ggtagaaatgcaaggggg

SEQ ID NO: 4148179 - DNA, 17 bp, Homo sapiens
ggtagaatgattaatca

SEQ ID NO: 4148180 - DNA, 18 bp, Homo sapiens
ggtagagaggggactggg

SEQ ID NO: 4148181 - DNA, 21 bp, Homo sapiens
ggtagagaggggactggggga

SEQ ID NO: 4148182 - DNA, 19 bp, Homo sapiens
ggtagagattcattatttt

SEQ ID NO: 4148183 - DNA, 23 bp, Homo sapiens
ggtagagtttgaaggaggtgagg

SEQ ID NO: 4148184 - DNA, 15 bp, Homo sapiens
ggtagcataaataaa

SEQ ID NO: 4148185 - DNA, 13 bp, Homo sapiens
ggtagccagcaca

SEQ ID NO: 4148186 - DNA, 15 bp, Homo sapiens
ggtagcccagcactg

SEQ ID NO: 4148187 - DNA, 18 bp, Homo sapiens
ggtagccttgtgttctga

SEQ ID NO: 4148188 - DNA, 14 bp, Homo sapiens
ggtaggcagagcct

SEQ ID NO: 4148189 - DNA, 15 bp, Homo sapiens
ggtagggaggcagcc

SEQ ID NO: 4148190 - DNA, 18 bp, Homo sapiens
ggtaggttgggacaccag

SEQ ID NO: 4148191 - DNA, 22 bp, Homo sapiens
ggtagtactcctgcaaaatttt

SEQ ID NO: 4148192 - DNA, 13 bp, Homo sapiens
ggtatatactttg

SEQ ID NO: 4148193 - DNA, 15 bp, Homo sapiens
ggtatcctgcccagt

SEQ ID NO: 4148194 - DNA, 20 bp, Homo sapiens
ggtatctcagaaagtgcctg

SEQ ID NO: 4148195 - DNA, 16 bp, Homo sapiens
ggtatctccaggattg

SEQ ID NO: 4148196 - DNA, 14 bp, Homo sapiens
ggtatgagctgagg

SEQ ID NO: 4148197 - DNA, 16 bp, Homo sapiens
ggtatgagctgagggg

SEQ ID NO: 4148198 - DNA, 13 bp, Homo sapiens
ggtatgctggcca

SEQ ID NO: 4148199 - DNA, 14 bp, Homo sapiens
ggtatgctggccag

SEQ ID NO: 4148200 - DNA, 15 bp, Homo sapiens
ggtatgctggccagc

SEQ ID NO: 4148201 - DNA, 20 bp, Homo sapiens
ggtatgctggccagcaccct

SEQ ID NO: 4148202 - DNA, 21 bp, Homo sapiens
ggtatggaagggtttgtggct

SEQ ID NO: 4148203 - DNA, 18 bp, Homo sapiens
ggtatggtggggatattt

SEQ ID NO: 4148204 - DNA, 14 bp, Homo sapiens
ggtatgtctgccat

SEQ ID NO: 4148205 - DNA, 18 bp, Homo sapiens
ggtatgtttaatctgtta

SEQ ID NO: 4148206 - DNA, 20 bp, Homo sapiens
ggtattttcccccttttctg

SEQ ID NO: 4148207 - DNA, 21 bp, Homo sapiens
ggtatttttttgtaattgctt

SEQ ID NO: 4148208 - DNA, 22 bp, Homo sapiens
ggtcaaaccgcactcacccatg

SEQ ID NO: 4148209 - DNA, 23 bp, Homo sapiens
ggtcaacatcttttacattctgc

SEQ ID NO: 4148210 - DNA, 18 bp, Homo sapiens
ggtcaagaaacagccagc

SEQ ID NO: 4148211 - DNA, 17 bp, Homo sapiens
ggtcacagccaggcgct

SEQ ID NO: 4148212 - DNA, 13 bp, Homo sapiens
ggtcacagcctcc

SEQ ID NO: 4148213 - DNA, 13 bp, Homo sapiens
ggtcacagctgga

SEQ ID NO: 4148214 - DNA, 15 bp, Homo sapiens
ggtcacagctggatc

SEQ ID NO: 4148215 - DNA, 17 bp, Homo sapiens
ggtcactaaccaacaag

SEQ ID NO: 4148216 - DNA, 13 bp, Homo sapiens
ggtcactggaaag

SEQ ID NO: 4148217 - DNA, 15 bp, Homo sapiens
ggtcactggaaaggg

SEQ ID NO: 4148218 - DNA, 21 bp, Homo sapiens
ggtcactgtgcactgccctgt

SEQ ID NO: 4148219 - DNA, 11 bp, Homo sapiens
ggtcagatgca

SEQ ID NO: 4148220 - DNA, 18 bp, Homo sapiens
ggtcagccagggccaggg

SEQ ID NO: 4148221 - DNA, 20 bp, Homo sapiens
ggtcaggacggctcctcaga

SEQ ID NO: 4148222 - DNA, 22 bp, Homo sapiens
ggtcaggcggggtgctgtggtg

SEQ ID NO: 4148223 - DNA, 21 bp, Homo sapiens
ggtcagggacttggacaggag

SEQ ID NO: 4148224 - DNA, 16 bp, Homo sapiens
ggtcagtctggtggga

SEQ ID NO: 4148225 - DNA, 13 bp, Homo sapiens
ggtcagtgccttt

SEQ ID NO: 4148226 - DNA, 18 bp, Homo sapiens
ggtcattgacctctcagg

SEQ ID NO: 4148227 - DNA, 20 bp, Homo sapiens
ggtcattgacctctcagggc

SEQ ID NO: 4148228 - DNA, 18 bp, Homo sapiens
ggtcatttcccccaaagg

SEQ ID NO: 4148229 - DNA, 14 bp, Homo sapiens
ggtcatttcttcag

SEQ ID NO: 4148230 - DNA, 18 bp, Homo sapiens
ggtccaaaaaaaggaaaa

SEQ ID NO: 4148231 - DNA, 20 bp, Homo sapiens
ggtccaaaaaaaggaaaaat

SEQ ID NO: 4148232 - DNA, 17 bp, Homo sapiens
ggtccaacaagaatgca

SEQ ID NO: 4148233 - DNA, 16 bp, Homo sapiens
ggtccacccagcaaag

SEQ ID NO: 4148234 - DNA, 12 bp, Homo sapiens
ggtccagctctt

SEQ ID NO: 4148235 - DNA, 21 bp, Homo sapiens
ggtccagctcttggcccctgt

SEQ ID NO: 4148236 - DNA, 16 bp, Homo sapiens
ggtccagggcctgaca

SEQ ID NO: 4148237 - DNA, 13 bp, Homo sapiens
ggtccatatttac

SEQ ID NO: 4148238 - DNA, 18 bp, Homo sapiens
ggtccatatttacattct

SEQ ID NO: 4148239 - DNA, 16 bp, Homo sapiens
ggtccatcagcccctc

SEQ ID NO: 4148240 - DNA, 10 bp, Homo sapiens
ggtccatgcc

SEQ ID NO: 4148241 - DNA, 21 bp, Homo sapiens
ggtcccattgttggcgctgag

SEQ ID NO: 4148242 - DNA, 16 bp, Homo sapiens
ggtccccacctgggac

SEQ ID NO: 4148243 - DNA, 14 bp, Homo sapiens
ggtccccatcccca

SEQ ID NO: 4148244 - DNA, 22 bp, Homo sapiens
ggtccccgagacacaggcacgg

SEQ ID NO: 4148245 - DNA, 16 bp, Homo sapiens
ggtcccctccaggagt

SEQ ID NO: 4148246 - DNA, 13 bp, Homo sapiens
ggtcccctccctc

SEQ ID NO: 4148247 - DNA, 14 bp, Homo sapiens
ggtccctccacccc

SEQ ID NO: 4148248 - DNA, 14 bp, Homo sapiens
ggtccctgccttag

SEQ ID NO: 4148249 - DNA, 20 bp, Homo sapiens
ggtccggacactcctagaga

SEQ ID NO: 4148250 - DNA, 21 bp, Homo sapiens
ggtccggacactcctagagaa

SEQ ID NO: 4148251 - DNA, 23 bp, Homo sapiens
ggtcctccatcccaacagccatg

SEQ ID NO: 4148252 - DNA, 19 bp, Homo sapiens
ggtcctcttctgggcctga

SEQ ID NO: 4148253 - DNA, 18 bp, Homo sapiens
ggtcctgaagaattaaga

SEQ ID NO: 4148254 - DNA, 15 bp, Homo sapiens
ggtcctggctcctga

SEQ ID NO: 4148255 - DNA, 16 bp, Homo sapiens
ggtcctggctcctgag

SEQ ID NO: 4148256 - DNA, 14 bp, Homo sapiens
ggtccttctccaca

SEQ ID NO: 4148257 - DNA, 20 bp, Homo sapiens
ggtccttggtgtgaccctct

SEQ ID NO: 4148258 - DNA, 13 bp, Homo sapiens
ggtcgcccaggag

SEQ ID NO: 4148259 - DNA, 15 bp, Homo sapiens
ggtcggaacccaagc

SEQ ID NO: 4148260 - DNA, 15 bp, Homo sapiens
ggtcgggcagccagc

SEQ ID NO: 4148261 - DNA, 15 bp, Homo sapiens
ggtctatgttcccca

SEQ ID NO: 4148262 - DNA, 21 bp, Homo sapiens
ggtctcacagtgttgcccagg

SEQ ID NO: 4148263 - DNA, 21 bp, Homo sapiens
ggtctcaggatatccttatca

SEQ ID NO: 4148264 - DNA, 19 bp, Homo sapiens
ggtctcatgtcctgctggc

SEQ ID NO: 4148265 - DNA, 24 bp, Homo sapiens
ggtctccctggctccctcctccag

SEQ ID NO: 4148266 - DNA, 18 bp, Homo sapiens
ggtctcctcagggtgggg

SEQ ID NO: 4148267 - DNA, 21 bp, Homo sapiens
ggtctcctcagggtggggggt

SEQ ID NO: 4148268 - DNA, 16 bp, Homo sapiens
ggtctcgatctcctga

SEQ ID NO: 4148269 - DNA, 17 bp, Homo sapiens
ggtctctccctcaggtg

SEQ ID NO: 4148270 - DNA, 15 bp, Homo sapiens
ggtctcttgagggag

SEQ ID NO: 4148271 - DNA, 14 bp, Homo sapiens
ggtctgaatgttct

SEQ ID NO: 4148272 - DNA, 15 bp, Homo sapiens
ggtctgacagtcctt

SEQ ID NO: 4148273 - DNA, 20 bp, Homo sapiens
ggtctgctctttctctgcca

SEQ ID NO: 4148274 - DNA, 19 bp, Homo sapiens
ggtctggaggacctgcccg

SEQ ID NO: 4148275 - DNA, 15 bp, Homo sapiens
ggtctggcagcctcc

SEQ ID NO: 4148276 - DNA, 22 bp, Homo sapiens
ggtctgggcggcgggcggctgg

SEQ ID NO: 4148277 - DNA, 17 bp, Homo sapiens
ggtctgtgtgaatgtgg

SEQ ID NO: 4148278 - DNA, 15 bp, Homo sapiens
ggtctgtttaaagtg

SEQ ID NO: 4148279 - DNA, 23 bp, Homo sapiens
ggtcttaaatgctcattttctgg

SEQ ID NO: 4148280 - DNA, 20 bp, Homo sapiens
ggtcttccctacctcaggca

SEQ ID NO: 4148281 - DNA, 18 bp, Homo sapiens
ggtcttcctactcttctc

SEQ ID NO: 4148282 - DNA, 19 bp, Homo sapiens
ggtcttgactcatggcagc

SEQ ID NO: 4148283 - DNA, 13 bp, Homo sapiens
ggtcttgctctgt

SEQ ID NO: 4148284 - DNA, 15 bp, Homo sapiens
ggtcttgctctgtcc

SEQ ID NO: 4148285 - DNA, 23 bp, Homo sapiens
ggtcttttttcatttcttcctca

SEQ ID NO: 4148286 - DNA, 13 bp, Homo sapiens
ggtgaaagggagc

SEQ ID NO: 4148287 - DNA, 18 bp, Homo sapiens
ggtgaacaaagcagccac

SEQ ID NO: 4148288 - DNA, 21 bp, Homo sapiens
ggtgaactgagctgggcagga

SEQ ID NO: 4148289 - DNA, 17 bp, Homo sapiens
ggtgaagaaccctctgt

SEQ ID NO: 4148290 - DNA, 17 bp, Homo sapiens
ggtgaagctatttatct

SEQ ID NO: 4148291 - DNA, 14 bp, Homo sapiens
ggtgaaggaggctc

SEQ ID NO: 4148292 - DNA, 17 bp, Homo sapiens
ggtgaaggcctggctgg

SEQ ID NO: 4148293 - DNA, 19 bp, Homo sapiens
ggtgaaggcctggctggaa

SEQ ID NO: 4148294 - DNA, 16 bp, Homo sapiens
ggtgaagggagagcca

SEQ ID NO: 4148295 - DNA, 15 bp, Homo sapiens
ggtgaagtaaattag

SEQ ID NO: 4148296 - DNA, 18 bp, Homo sapiens
ggtgacagtcatcatcag

SEQ ID NO: 4148297 - DNA, 20 bp, Homo sapiens
ggtgacagtcatcatcaggg

SEQ ID NO: 4148298 - DNA, 21 bp, Homo sapiens
ggtgacagtcatcatcagggc

SEQ ID NO: 4148299 - DNA, 14 bp, Homo sapiens
ggtgacatgtgaaa

SEQ ID NO: 4148300 - DNA, 16 bp, Homo sapiens
ggtgactgtcccaccg

SEQ ID NO: 4148301 - DNA, 16 bp, Homo sapiens
ggtgagagaggaaaga

SEQ ID NO: 4148302 - DNA, 12 bp, Homo sapiens
ggtgagagctgc

SEQ ID NO: 4148303 - DNA, 17 bp, Homo sapiens
ggtgagagtgggaggga

SEQ ID NO: 4148304 - DNA, 19 bp, Homo sapiens
ggtgagcattacaggcaag

SEQ ID NO: 4148305 - DNA, 18 bp, Homo sapiens
ggtgagctgcacctgatt

SEQ ID NO: 4148306 - DNA, 12 bp, Homo sapiens
ggtgagggatgt

SEQ ID NO: 4148307 - DNA, 16 bp, Homo sapiens
ggtgagggttggcgct

SEQ ID NO: 4148308 - DNA, 18 bp, Homo sapiens
ggtgagtccattctccca

SEQ ID NO: 4148309 - DNA, 16 bp, Homo sapiens
ggtgataggtaaattt

SEQ ID NO: 4148310 - DNA, 19 bp, Homo sapiens
ggtgatcaattaaatgtag

SEQ ID NO: 4148311 - DNA, 16 bp, Homo sapiens
ggtgatcctctatttt

SEQ ID NO: 4148312 - DNA, 22 bp, Homo sapiens
ggtgcaacccaaggactgaggg

SEQ ID NO: 4148313 - DNA, 23 bp, Homo sapiens
ggtgcaacccaaggactgaggga

SEQ ID NO: 4148314 - DNA, 17 bp, Homo sapiens
ggtgcagagaagctgga

SEQ ID NO: 4148315 - DNA, 19 bp, Homo sapiens
ggtgcagagaagctggact

SEQ ID NO: 4148316 - DNA, 20 bp, Homo sapiens
ggtgcagagaagctggactt

SEQ ID NO: 4148317 - DNA, 14 bp, Homo sapiens
ggtgcaggtgggca

SEQ ID NO: 4148318 - DNA, 18 bp, Homo sapiens
ggtgcagttgacagcagg

SEQ ID NO: 4148319 - DNA, 20 bp, Homo sapiens
ggtgcatgcatgccctctct

SEQ ID NO: 4148320 - DNA, 13 bp, Homo sapiens
ggtgccagcctga

SEQ ID NO: 4148321 - DNA, 20 bp, Homo sapiens
ggtgccagggcccaccccag

SEQ ID NO: 4148322 - DNA, 16 bp, Homo sapiens
ggtgccatcagtgccc

SEQ ID NO: 4148323 - DNA, 13 bp, Homo sapiens
ggtgcccacaggc

SEQ ID NO: 4148324 - DNA, 13 bp, Homo sapiens
ggtgccccacagc

SEQ ID NO: 4148325 - DNA, 13 bp, Homo sapiens
ggtgccccaggac

SEQ ID NO: 4148326 - DNA, 14 bp, Homo sapiens
ggtgccccaggacc

SEQ ID NO: 4148327 - DNA, 15 bp, Homo sapiens
ggtgccccaggacca

SEQ ID NO: 4148328 - DNA, 17 bp, Homo sapiens
ggtgccccaggaccagc

SEQ ID NO: 4148329 - DNA, 20 bp, Homo sapiens
ggtgctaaatggtcgcccag

SEQ ID NO: 4148330 - DNA, 23 bp, Homo sapiens
ggtgctagtgggccctctctctg

SEQ ID NO: 4148331 - DNA, 21 bp, Homo sapiens
ggtgctataggctggagaagc

SEQ ID NO: 4148332 - DNA, 23 bp, Homo sapiens
ggtgctcagaataaggcaggcat

SEQ ID NO: 4148333 - DNA, 23 bp, Homo sapiens
ggtgctctgtgttcccagaggca

SEQ ID NO: 4148334 - DNA, 21 bp, Homo sapiens
ggtgctgacttcatctcccac

SEQ ID NO: 4148335 - DNA, 23 bp, Homo sapiens
ggtgctgcagatttgatatttgc

SEQ ID NO: 4148336 - DNA, 12 bp, Homo sapiens
ggtgctgcagga

SEQ ID NO: 4148337 - DNA, 14 bp, Homo sapiens
ggtgctgcaggagt

SEQ ID NO: 4148338 - DNA, 22 bp, Homo sapiens
ggtgctgccatgacagaggctg

SEQ ID NO: 4148339 - DNA, 23 bp, Homo sapiens
ggtgctgccatgacagaggctgc

SEQ ID NO: 4148340 - DNA, 16 bp, Homo sapiens
ggtgctgccctgtgta

SEQ ID NO: 4148341 - DNA, 21 bp, Homo sapiens
ggtgctggaagtctccatgaa

SEQ ID NO: 4148342 - DNA, 15 bp, Homo sapiens
ggtgctgggaggagg

SEQ ID NO: 4148343 - DNA, 13 bp, Homo sapiens
ggtgctggtcccg

SEQ ID NO: 4148344 - DNA, 17 bp, Homo sapiens
ggtgctgtgagggaggg

SEQ ID NO: 4148345 - DNA, 16 bp, Homo sapiens
ggtgctgtggccaggg

SEQ ID NO: 4148346 - DNA, 17 bp, Homo sapiens
ggtgctgtggtggggag

SEQ ID NO: 4148347 - DNA, 15 bp, Homo sapiens
ggtggaacaagcaca

SEQ ID NO: 4148348 - DNA, 14 bp, Homo sapiens
ggtggaagggctgg

SEQ ID NO: 4148349 - DNA, 15 bp, Homo sapiens
ggtggaagggctggg

SEQ ID NO: 4148350 - DNA, 13 bp, Homo sapiens
ggtggacacacaa

SEQ ID NO: 4148351 - DNA, 15 bp, Homo sapiens
ggtggaggcttcctg

SEQ ID NO: 4148352 - DNA, 20 bp, Homo sapiens
ggtggagggcacagccctcc

SEQ ID NO: 4148353 - DNA, 15 bp, Homo sapiens
ggtggagttgaaaga

SEQ ID NO: 4148354 - DNA, 19 bp, Homo sapiens
ggtggcaatgcttaaacta

SEQ ID NO: 4148355 - DNA, 20 bp, Homo sapiens
ggtggcaccagatgcaacct

SEQ ID NO: 4148356 - DNA, 21 bp, Homo sapiens
ggtggcagatgtcttccctgg

SEQ ID NO: 4148357 - DNA, 16 bp, Homo sapiens
ggtggcccgacagcct

SEQ ID NO: 4148358 - DNA, 18 bp, Homo sapiens
ggtggcccgacagcctgg

SEQ ID NO: 4148359 - DNA, 20 bp, Homo sapiens
ggtggcccgacagcctggca

SEQ ID NO: 4148360 - DNA, 12 bp, Homo sapiens
ggtggcctcagc

SEQ ID NO: 4148361 - DNA, 12 bp, Homo sapiens
ggtggcctcggg

SEQ ID NO: 4148362 - DNA, 21 bp, Homo sapiens
ggtggcgactctatagactct

SEQ ID NO: 4148363 - DNA, 20 bp, Homo sapiens
ggtggctgccccggcctcct

SEQ ID NO: 4148364 - DNA, 13 bp, Homo sapiens
ggtgggctctgtg

SEQ ID NO: 4148365 - DNA, 23 bp, Homo sapiens
ggtgggcttcctgcccttccctc

SEQ ID NO: 4148366 - DNA, 13 bp, Homo sapiens
ggtggggactggg

SEQ ID NO: 4148367 - DNA, 14 bp, Homo sapiens
ggtggggactgggc

SEQ ID NO: 4148368 - DNA, 14 bp, Homo sapiens
ggtggggagacctg

SEQ ID NO: 4148369 - DNA, 16 bp, Homo sapiens
ggtggggcgaggcagg

SEQ ID NO: 4148370 - DNA, 12 bp, Homo sapiens
ggtgggggagga

SEQ ID NO: 4148371 - DNA, 23 bp, Homo sapiens
ggtggggtcctggagcagaccac

SEQ ID NO: 4148372 - DNA, 22 bp, Homo sapiens
ggtgggtctatgttccccagga

SEQ ID NO: 4148373 - DNA, 21 bp, Homo sapiens
ggtgggtgaaggcctggctgg

SEQ ID NO: 4148374 - DNA, 19 bp, Homo sapiens
ggtggtcctgactcaacat

SEQ ID NO: 4148375 - DNA, 15 bp, Homo sapiens
ggtggtctgaatgtt

SEQ ID NO: 4148376 - DNA, 17 bp, Homo sapiens
ggtgtaaagctggccct

SEQ ID NO: 4148377 - DNA, 14 bp, Homo sapiens
ggtgtaataagaca

SEQ ID NO: 4148378 - DNA, 16 bp, Homo sapiens
ggtgtaataagacata

SEQ ID NO: 4148379 - DNA, 15 bp, Homo sapiens
ggtgtacactaacat

SEQ ID NO: 4148380 - DNA, 19 bp, Homo sapiens
ggtgtacactaacatttcc

SEQ ID NO: 4148381 - DNA, 23 bp, Homo sapiens
ggtgtcaaacattcgtgagctgg

SEQ ID NO: 4148382 - DNA, 13 bp, Homo sapiens
ggtgtcaactaaa

SEQ ID NO: 4148383 - DNA, 23 bp, Homo sapiens
ggtgtccatgtgcacccggcctg

SEQ ID NO: 4148384 - DNA, 18 bp, Homo sapiens
ggtgtcctgcctgtctgc

SEQ ID NO: 4148385 - DNA, 16 bp, Homo sapiens
ggtgtctgcacccagg

SEQ ID NO: 4148386 - DNA, 16 bp, Homo sapiens
ggtgtctggcctgagg

SEQ ID NO: 4148387 - DNA, 15 bp, Homo sapiens
ggtgtgaacatgttc

SEQ ID NO: 4148388 - DNA, 15 bp, Homo sapiens
ggtgtgaacccggga

SEQ ID NO: 4148389 - DNA, 18 bp, Homo sapiens
ggtgtgagaagtgccttc

SEQ ID NO: 4148390 - DNA, 19 bp, Homo sapiens
ggtgtgagaagtgccttct

SEQ ID NO: 4148391 - DNA, 21 bp, Homo sapiens
ggtgtgagaatgatcaaggat

SEQ ID NO: 4148392 - DNA, 13 bp, Homo sapiens
ggtgtggcctcag

SEQ ID NO: 4148393 - DNA, 18 bp, Homo sapiens
ggtgtggcctcagccctc

SEQ ID NO: 4148394 - DNA, 22 bp, Homo sapiens
ggtgtgggtgtcctgcctgtct

SEQ ID NO: 4148395 - DNA, 17 bp, Homo sapiens
ggtgtggtgcagtgtga

SEQ ID NO: 4148396 - DNA, 21 bp, Homo sapiens
ggtgttgactggactgcttgg

SEQ ID NO: 4148397 - DNA, 13 bp, Homo sapiens
ggtgtttattgca

SEQ ID NO: 4148398 - DNA, 13 bp, Homo sapiens
ggtgtttggcacc

SEQ ID NO: 4148399 - DNA, 22 bp, Homo sapiens
ggttaaaactgtacatttaaaa

SEQ ID NO: 4148400 - DNA, 16 bp, Homo sapiens
ggttaaagcagacagt

SEQ ID NO: 4148401 - DNA, 22 bp, Homo sapiens
ggttaacccttcatcttcctgt

SEQ ID NO: 4148402 - DNA, 14 bp, Homo sapiens
ggttaaggcctgaa

SEQ ID NO: 4148403 - DNA, 12 bp, Homo sapiens
ggttataatttt

SEQ ID NO: 4148404 - DNA, 12 bp, Homo sapiens
ggttatgaaaga

SEQ ID NO: 4148405 - DNA, 20 bp, Homo sapiens
ggttattagcaaggctgggt

SEQ ID NO: 4148406 - DNA, 12 bp, Homo sapiens
ggttatttaaaa

SEQ ID NO: 4148407 - DNA, 16 bp, Homo sapiens
ggttcactgagctccc

SEQ ID NO: 4148408 - DNA, 16 bp, Homo sapiens
ggttcagacccctgcc

SEQ ID NO: 4148409 - DNA, 17 bp, Homo sapiens
ggttcattattggaatt

SEQ ID NO: 4148410 - DNA, 13 bp, Homo sapiens
ggttccatgcctg

SEQ ID NO: 4148411 - DNA, 18 bp, Homo sapiens
ggttcccaataaaagtga

SEQ ID NO: 4148412 - DNA, 12 bp, Homo sapiens
ggttccccaccg

SEQ ID NO: 4148413 - DNA, 17 bp, Homo sapiens
ggttcccgtttctccac

SEQ ID NO: 4148414 - DNA, 21 bp, Homo sapiens
ggttccctcctagctctccca

SEQ ID NO: 4148415 - DNA, 13 bp, Homo sapiens
ggttccctgttct

SEQ ID NO: 4148416 - DNA, 18 bp, Homo sapiens
ggttccctgttcttcctc

SEQ ID NO: 4148417 - DNA, 19 bp, Homo sapiens
ggttcctcaaattttttga

SEQ ID NO: 4148418 - DNA, 23 bp, Homo sapiens
ggttctacagccttgtccccctc

SEQ ID NO: 4148419 - DNA, 11 bp, Homo sapiens
ggttctatttt

SEQ ID NO: 4148420 - DNA, 22 bp, Homo sapiens
ggttctattttactttgtactt

SEQ ID NO: 4148421 - DNA, 13 bp, Homo sapiens
ggttctcagagcc

SEQ ID NO: 4148422 - DNA, 17 bp, Homo sapiens
ggttctcagagccaagt

SEQ ID NO: 4148423 - DNA, 13 bp, Homo sapiens
ggttctcatttgg

SEQ ID NO: 4148424 - DNA, 14 bp, Homo sapiens
ggttctgagaccag

SEQ ID NO: 4148425 - DNA, 17 bp, Homo sapiens
ggttcttaaaaaggaac

SEQ ID NO: 4148426 - DNA, 16 bp, Homo sapiens
ggttcttagtgtcact

SEQ ID NO: 4148427 - DNA, 21 bp, Homo sapiens
ggttgaagaaaggaacctggg

SEQ ID NO: 4148428 - DNA, 16 bp, Homo sapiens
ggttgatggaaaataa

SEQ ID NO: 4148429 - DNA, 17 bp, Homo sapiens
ggttgatggaaaataaa

SEQ ID NO: 4148430 - DNA, 20 bp, Homo sapiens
ggttgcagcatgagactttc

SEQ ID NO: 4148431 - DNA, 21 bp, Homo sapiens
ggttgcgtcctgacggcgccc

SEQ ID NO: 4148432 - DNA, 21 bp, Homo sapiens
ggttggagcccagggcatctt

SEQ ID NO: 4148433 - DNA, 14 bp, Homo sapiens
ggttggatggatgg

SEQ ID NO: 4148434 - DNA, 17 bp, Homo sapiens
ggttggatgggagtggg

SEQ ID NO: 4148435 - DNA, 15 bp, Homo sapiens
ggttggcaccccagc

SEQ ID NO: 4148436 - DNA, 14 bp, Homo sapiens
ggttggcacctgca

SEQ ID NO: 4148437 - DNA, 13 bp, Homo sapiens
ggttggcagccca

SEQ ID NO: 4148438 - DNA, 14 bp, Homo sapiens
ggttgtcttattgc

SEQ ID NO: 4148439 - DNA, 22 bp, Homo sapiens
ggttgtgactctaagctcagtg

SEQ ID NO: 4148440 - DNA, 13 bp, Homo sapiens
ggttgtgaggcct

SEQ ID NO: 4148441 - DNA, 22 bp, Homo sapiens
ggttgtgaggcctggccaggca

SEQ ID NO: 4148442 - DNA, 16 bp, Homo sapiens
ggttgtgcacatttct

SEQ ID NO: 4148443 - DNA, 13 bp, Homo sapiens
ggttgttatgtga

SEQ ID NO: 4148444 - DNA, 12 bp, Homo sapiens
ggttgtttctgt

SEQ ID NO: 4148445 - DNA, 19 bp, Homo sapiens
ggttgtttctgttccaaat

SEQ ID NO: 4148446 - DNA, 19 bp, Homo sapiens
ggtttacattcatctcatt

SEQ ID NO: 4148447 - DNA, 18 bp, Homo sapiens
ggtttacatttaaagcat

SEQ ID NO: 4148448 - DNA, 14 bp, Homo sapiens
ggtttacccagtgg

SEQ ID NO: 4148449 - DNA, 15 bp, Homo sapiens
ggtttacccagtggg

SEQ ID NO: 4148450 - DNA, 23 bp, Homo sapiens
ggtttatcgccctggcaggcagg

SEQ ID NO: 4148451 - DNA, 16 bp, Homo sapiens
ggtttatttttgtaat

SEQ ID NO: 4148452 - DNA, 17 bp, Homo sapiens
ggtttatttttgtaatg

SEQ ID NO: 4148453 - DNA, 20 bp, Homo sapiens
ggtttcctgcccagcctggg

SEQ ID NO: 4148454 - DNA, 20 bp, Homo sapiens
ggtttctctattaaaatgca

SEQ ID NO: 4148455 - DNA, 13 bp, Homo sapiens
ggtttctctccct

SEQ ID NO: 4148456 - DNA, 20 bp, Homo sapiens
ggtttctctctacagtgcca

SEQ ID NO: 4148457 - DNA, 18 bp, Homo sapiens
ggtttcttttttctttct

SEQ ID NO: 4148458 - DNA, 23 bp, Homo sapiens
ggtttcttttttctttcttcctt

SEQ ID NO: 4148459 - DNA, 12 bp, Homo sapiens
ggtttgagaaat

SEQ ID NO: 4148460 - DNA, 18 bp, Homo sapiens
ggtttgcaaaagggcttc

SEQ ID NO: 4148461 - DNA, 16 bp, Homo sapiens
ggtttgctgtcttggg

SEQ ID NO: 4148462 - DNA, 17 bp, Homo sapiens
ggtttggctcctgccca

SEQ ID NO: 4148463 - DNA, 14 bp, Homo sapiens
ggtttgtgttcttc

SEQ ID NO: 4148464 - DNA, 23 bp, Homo sapiens
ggttttatggttacttcttctct

SEQ ID NO: 4148465 - DNA, 23 bp, Homo sapiens
ggttttattactctcacccataa

SEQ ID NO: 4148466 - DNA, 17 bp, Homo sapiens
ggttttgcaataacttc

SEQ ID NO: 4148467 - DNA, 21 bp, Homo sapiens
ggttttggcaaacgctaaaga

SEQ ID NO: 4148468 - DNA, 18 bp, Homo sapiens
ggttttggggaaatgtgg

SEQ ID NO: 4148469 - DNA, 18 bp, Homo sapiens
ggttttgtacactgctgt

SEQ ID NO: 4148470 - DNA, 19 bp, Homo sapiens
ggttttgtacactgctgta

SEQ ID NO: 4148471 - DNA, 20 bp, Homo sapiens
ggtttttaaatatatatttt

SEQ ID NO: 4148472 - DNA, 20 bp, Homo sapiens
ggtttttacctgtcacattg

SEQ ID NO: 4148473 - DNA, 12 bp, Homo sapiens
ggtttttgctct

SEQ ID NO: 4148474 - DNA, 19 bp, Homo sapiens
gtaaaaaaaaatgcctttg

SEQ ID NO: 4148475 - DNA, 18 bp, Homo sapiens
gtaaaaacagcattgctt

SEQ ID NO: 4148476 - DNA, 19 bp, Homo sapiens
gtaaaaagtattttttcaa

SEQ ID NO: 4148477 - DNA, 13 bp, Homo sapiens
gtaaaatactttt

SEQ ID NO: 4148478 - DNA, 19 bp, Homo sapiens
gtaaaattgctgtgcttta

SEQ ID NO: 4148479 - DNA, 20 bp, Homo sapiens
gtaaacagtttttattaaaa

SEQ ID NO: 4148480 - DNA, 13 bp, Homo sapiens
gtaaaccaaagcc

SEQ ID NO: 4148481 - DNA, 15 bp, Homo sapiens
gtaaactatttatct

SEQ ID NO: 4148482 - DNA, 16 bp, Homo sapiens
gtaaactatttatctg

SEQ ID NO: 4148483 - DNA, 18 bp, Homo sapiens
gtgaaaccttttttaaga

SEQ ID NO: 4148484 - DNA, 19 bp, Homo sapiens
gtgaaaccttttttaagat

SEQ ID NO: 4148485 - DNA, 20 bp, Homo sapiens
gtgaaagctgagaactcctg

SEQ ID NO: 4148486 - DNA, 17 bp, Homo sapiens
gtgaaaggcagggccct

SEQ ID NO: 4148487 - DNA, 19 bp, Homo sapiens
gtgaaataaattctgattc

SEQ ID NO: 4148488 - DNA, 19 bp, Homo sapiens
gtgaaatggatactacatc

SEQ ID NO: 4148489 - DNA, 18 bp, Homo sapiens
gtgaacaaagcagccacg

SEQ ID NO: 4148490 - DNA, 19 bp, Homo sapiens
gtgaacaggctgggctgct

SEQ ID NO: 4148491 - DNA, 13 bp, Homo sapiens
gtgaaccagaggg

SEQ ID NO: 4148492 - DNA, 18 bp, Homo sapiens
gtgaaccctggggcctga

SEQ ID NO: 4148493 - DNA, 14 bp, Homo sapiens
gtgaactctggtgc

SEQ ID NO: 4148494 - DNA, 16 bp, Homo sapiens
gtgaacttgactgggt

SEQ ID NO: 4148495 - DNA, 15 bp, Homo sapiens
gtgaactttattaaa

SEQ ID NO: 4148496 - DNA, 14 bp, Homo sapiens
gtgaactttttgta

SEQ ID NO: 4148497 - DNA, 21 bp, Homo sapiens
gtgaagaatgcacaagaatgg

SEQ ID NO: 4148498 - DNA, 19 bp, Homo sapiens
gtgaagaccagagcagttt

SEQ ID NO: 4148499 - DNA, 14 bp, Homo sapiens
gtgaagataatttg

SEQ ID NO: 4148500 - DNA, 22 bp, Homo sapiens
gtgaagatgcaatcagacaagt

SEQ ID NO: 4148501 - DNA, 21 bp, Homo sapiens
gtgaaggaggctccaggcagc

SEQ ID NO: 4148502 - DNA, 13 bp, Homo sapiens
gtgaataaatgtc

SEQ ID NO: 4148503 - DNA, 19 bp, Homo sapiens
gtgaatactgctacagcaa

SEQ ID NO: 4148504 - DNA, 21 bp, Homo sapiens
gtgaatactgctacagcaatt

SEQ ID NO: 4148505 - DNA, 17 bp, Homo sapiens
gtgaatacttactataa

SEQ ID NO: 4148506 - DNA, 21 bp, Homo sapiens
gtgaatctaaggataatgaaa

SEQ ID NO: 4148507 - DNA, 16 bp, Homo sapiens
gtgaatcttgtctaac

SEQ ID NO: 4148508 - DNA, 14 bp, Homo sapiens
gtgaatggattgga

SEQ ID NO: 4148509 - DNA, 20 bp, Homo sapiens
gtgaattgcctgcagagaga

SEQ ID NO: 4148510 - DNA, 14 bp, Homo sapiens
gtgaatttgaatga

SEQ ID NO: 4148511 - DNA, 16 bp, Homo sapiens
gtgaatttgaatgaaa

SEQ ID NO: 4148512 - DNA, 13 bp, Homo sapiens
gtgaatttttatt

SEQ ID NO: 4148513 - DNA, 23 bp, Homo sapiens
gtgacaaaccatccagtggaggt

SEQ ID NO: 4148514 - DNA, 19 bp, Homo sapiens
gtgacacagcagcttcacc

SEQ ID NO: 4148515 - DNA, 15 bp, Homo sapiens
gtgacagacaggctc

SEQ ID NO: 4148516 - DNA, 16 bp, Homo sapiens
gtgacagtcatcatca

SEQ ID NO: 4148517 - DNA, 17 bp, Homo sapiens
gtgacagtgcctgggaa

SEQ ID NO: 4148518 - DNA, 18 bp, Homo sapiens
gtgacagtggattgcatt

SEQ ID NO: 4148519 - DNA, 23 bp, Homo sapiens
gtgacataatatattctattttt

SEQ ID NO: 4148520 - DNA, 15 bp, Homo sapiens
gtgacatggtgcctg

SEQ ID NO: 4148521 - DNA, 23 bp, Homo sapiens
gtgacatggtgcctgagaggcag

SEQ ID NO: 4148522 - DNA, 13 bp, Homo sapiens
gtgacatgtaaca

SEQ ID NO: 4148523 - DNA, 19 bp, Homo sapiens
gtgacatgtgaaacctttt

SEQ ID NO: 4148524 - DNA, 22 bp, Homo sapiens
gtgacatgtgaaacctttttta

SEQ ID NO: 4148525 - DNA, 19 bp, Homo sapiens
gtgaccaagttataaatca

SEQ ID NO: 4148526 - DNA, 13 bp, Homo sapiens
gtgaccaccttct

SEQ ID NO: 4148527 - DNA, 15 bp, Homo sapiens
gtgaccaccttctgt

SEQ ID NO: 4148528 - DNA, 22 bp, Homo sapiens
gtgaccaccttctgtccccagc

SEQ ID NO: 4148529 - DNA, 17 bp, Homo sapiens
gtgaccaggcatcctcc

SEQ ID NO: 4148530 - DNA, 16 bp, Homo sapiens
gtgacccccagctccg

SEQ ID NO: 4148531 - DNA, 13 bp, Homo sapiens
gtgaccctctgaa

SEQ ID NO: 4148532 - DNA, 20 bp, Homo sapiens
gtgacctatcagttattaat

SEQ ID NO: 4148533 - DNA, 16 bp, Homo sapiens
gtgaccttttcttcat

SEQ ID NO: 4148534 - DNA, 19 bp, Homo sapiens
gtgacggtcccacactggt

SEQ ID NO: 4148535 - DNA, 22 bp, Homo sapiens
gtgacggtcccacactggtgac

SEQ ID NO: 4148536 - DNA, 20 bp, Homo sapiens
gtgactctttttagggccag

SEQ ID NO: 4148537 - DNA, 21 bp, Homo sapiens
gtgactgtcccaccgggagcc

SEQ ID NO: 4148538 - DNA, 23 bp, Homo sapiens
gtgactgtcccaccgggagcctc

SEQ ID NO: 4148539 - DNA, 16 bp, Homo sapiens
gtgactgtttggctta

SEQ ID NO: 4148540 - DNA, 17 bp, Homo sapiens
gtgacttgtgtcccatg

SEQ ID NO: 4148541 - DNA, 23 bp, Homo sapiens
gtgacttgtgtcccatgatccct

SEQ ID NO: 4148542 - DNA, 18 bp, Homo sapiens
gtgactttgtctctcctg

SEQ ID NO: 4148543 - DNA, 19 bp, Homo sapiens
gtgactttgtctctcctgg

SEQ ID NO: 4148544 - DNA, 22 bp, Homo sapiens
gtgactttgtctctcctggctg

SEQ ID NO: 4148545 - DNA, 24 bp, Homo sapiens
gtgactttgtctctcctggctggg

SEQ ID NO: 4148546 - DNA, 16 bp, Homo sapiens
gtgactttttttggta

SEQ ID NO: 4148547 - DNA, 17 bp, Homo sapiens
gtgagaaaaagctcctg

SEQ ID NO: 4148548 - DNA, 17 bp, Homo sapiens
gtgagacccccacacct

SEQ ID NO: 4148549 - DNA, 23 bp, Homo sapiens
gtgagactgggaaggcttgggat

SEQ ID NO: 4148550 - DNA, 11 bp, Homo sapiens
gtgagagagga

SEQ ID NO: 4148551 - DNA, 18 bp, Homo sapiens
gtgagagcgaggctgagc

SEQ ID NO: 4148552 - DNA, 13 bp, Homo sapiens
gtgagaggcagct

SEQ ID NO: 4148553 - DNA, 18 bp, Homo sapiens
gtgagattttttattgct

SEQ ID NO: 4148554 - DNA, 21 bp, Homo sapiens
gtgagcaaaatatgccccttc

SEQ ID NO: 4148555 - DNA, 19 bp, Homo sapiens
gtgagcagaagtggagctg

SEQ ID NO: 4148556 - DNA, 20 bp, Homo sapiens
gtgagcagaagtggagctgg

SEQ ID NO: 4148557 - DNA, 21 bp, Homo sapiens
gtgagccacagaccacctgct

SEQ ID NO: 4148558 - DNA, 15 bp, Homo sapiens
gtgagccaccgctgc

SEQ ID NO: 4148559 - DNA, 14 bp, Homo sapiens
gtgagcccctggtc

SEQ ID NO: 4148560 - DNA, 18 bp, Homo sapiens
gtgagcctcctgtgcctg

SEQ ID NO: 4148561 - DNA, 14 bp, Homo sapiens
gtgagcgccttggt

SEQ ID NO: 4148562 - DNA, 15 bp, Homo sapiens
gtgagctacagagcc

SEQ ID NO: 4148563 - DNA, 17 bp, Homo sapiens
gtgagctgctgccatga

SEQ ID NO: 4148564 - DNA, 18 bp, Homo sapiens
gtgaggaaatccattgtt

SEQ ID NO: 4148565 - DNA, 21 bp, Homo sapiens
gtgaggaaatccattgtttaa

SEQ ID NO: 4148566 - DNA, 22 bp, Homo sapiens
gtgaggaaatccattgtttaaa

SEQ ID NO: 4148567 - DNA, 16 bp, Homo sapiens
gtgaggaccactcctg

SEQ ID NO: 4148568 - DNA, 15 bp, Homo sapiens
gtgaggagctgctgg

SEQ ID NO: 4148569 - DNA, 21 bp, Homo sapiens
gtgaggattatgggtcctgca

SEQ ID NO: 4148570 - DNA, 23 bp, Homo sapiens
gtgaggcaatgggagctgaggcc

SEQ ID NO: 4148571 - DNA, 11 bp, Homo sapiens
gtgaggcctgg

SEQ ID NO: 4148572 - DNA, 14 bp, Homo sapiens
gtgaggcctggcca

SEQ ID NO: 4148573 - DNA, 19 bp, Homo sapiens
gtgaggggctttctcttcc

SEQ ID NO: 4148574 - DNA, 13 bp, Homo sapiens
gtgagtaaatatt

SEQ ID NO: 4148575 - DNA, 14 bp, Homo sapiens
gtgagtaagagctg

SEQ ID NO: 4148576 - DNA, 17 bp, Homo sapiens
gtgagtcacctgctcca

SEQ ID NO: 4148577 - DNA, 20 bp, Homo sapiens
gtgagtcacctgctccagaa

SEQ ID NO: 4148578 - DNA, 17 bp, Homo sapiens
gtgagtcatttaaatgt

SEQ ID NO: 4148579 - DNA, 13 bp, Homo sapiens
gtgagtgcctttt

SEQ ID NO: 4148580 - DNA, 16 bp, Homo sapiens
gtgagtgtaagtgtga

SEQ ID NO: 4148581 - DNA, 17 bp, Homo sapiens
gtgagtgtgacagggcc

SEQ ID NO: 4148582 - DNA, 13 bp, Homo sapiens
gtgagttctccct

SEQ ID NO: 4148583 - DNA, 18 bp, Homo sapiens
gtgagtttgagctgcctt

SEQ ID NO: 4148584 - DNA, 23 bp, Homo sapiens
gtgatatataagtgtacatatgt

SEQ ID NO: 4148585 - DNA, 13 bp, Homo sapiens
gtgatatatttaa

SEQ ID NO: 4148586 - DNA, 18 bp, Homo sapiens
gtgatcaataaaatgtga

SEQ ID NO: 4148587 - DNA, 17 bp, Homo sapiens
gtgatcatgtgtggaag

SEQ ID NO: 4148588 - DNA, 18 bp, Homo sapiens
gtgatcatgtgtggaagt

SEQ ID NO: 4148589 - DNA, 19 bp, Homo sapiens
gtgatccatccatctccag

SEQ ID NO: 4148590 - DNA, 20 bp, Homo sapiens
gtgatccatccatctccagg

SEQ ID NO: 4148591 - DNA, 15 bp, Homo sapiens
gtgatcctctatttt

SEQ ID NO: 4148592 - DNA, 19 bp, Homo sapiens
gtgatcctctattttgtga

SEQ ID NO: 4148593 - DNA, 13 bp, Homo sapiens
gtgatctccatat

SEQ ID NO: 4148594 - DNA, 13 bp, Homo sapiens
gtgatctgggcat

SEQ ID NO: 4148595 - DNA, 21 bp, Homo sapiens
gtgatcttaatatatttgaaa

SEQ ID NO: 4148596 - DNA, 14 bp, Homo sapiens
gtgatcttggctca

SEQ ID NO: 4148597 - DNA, 21 bp, Homo sapiens
gtgatgaatcaatgaaaaatg

SEQ ID NO: 4148598 - DNA, 12 bp, Homo sapiens
gtgatgatgctg

SEQ ID NO: 4148599 - DNA, 19 bp, Homo sapiens
gtgatgccacacagagtgg

SEQ ID NO: 4148600 - DNA, 16 bp, Homo sapiens
gtgatgctcaggcttg

SEQ ID NO: 4148601 - DNA, 17 bp, Homo sapiens
gtgatgcttataataaa

SEQ ID NO: 4148602 - DNA, 15 bp, Homo sapiens
gtgatggccagcccc

SEQ ID NO: 4148603 - DNA, 16 bp, Homo sapiens
gtgatggccagcccct

SEQ ID NO: 4148604 - DNA, 22 bp, Homo sapiens
gtgatgggactcattgtagaaa

SEQ ID NO: 4148605 - DNA, 15 bp, Homo sapiens
gtgatggggctcaga

SEQ ID NO: 4148606 - DNA, 22 bp, Homo sapiens
gtgatggggctcagatggactg

SEQ ID NO: 4148607 - DNA, 16 bp, Homo sapiens
gtgatggttcccctgt

SEQ ID NO: 4148608 - DNA, 21 bp, Homo sapiens
gtgattcagaaaatgttctgt

SEQ ID NO: 4148609 - DNA, 18 bp, Homo sapiens
gtgattgacacacagcac

SEQ ID NO: 4148610 - DNA, 22 bp, Homo sapiens
gtgattgcagctttatgttcat

SEQ ID NO: 4148611 - DNA, 24 bp, Homo sapiens
gtgattggcctgtagagttgctga

SEQ ID NO: 4148612 - DNA, 23 bp, Homo sapiens
gtgattgtggaatggagattcag

SEQ ID NO: 4148613 - DNA, 21 bp, Homo sapiens
gtgatttctttaaaagaatga

SEQ ID NO: 4148614 - DNA, 13 bp, Homo sapiens
gtgcaacccaagg

SEQ ID NO: 4148615 - DNA, 22 bp, Homo sapiens
gtgcaacccaaggactgaggga

SEQ ID NO: 4148616 - DNA, 23 bp, Homo sapiens
gtgcaacctcttggcctgatcag

SEQ ID NO: 4148617 - DNA, 22 bp, Homo sapiens
gtgcaaggtggcctttgtgctg

SEQ ID NO: 4148618 - DNA, 16 bp, Homo sapiens
gtgcaattgtgaggga

SEQ ID NO: 4148619 - DNA, 12 bp, Homo sapiens
gtgcacagctgt

SEQ ID NO: 4148620 - DNA, 13 bp, Homo sapiens
gtgcacagctgtc

SEQ ID NO: 4148621 - DNA, 13 bp, Homo sapiens
gtgcacaggcaga

SEQ ID NO: 4148622 - DNA, 19 bp, Homo sapiens
gtgcacccatgggctctga

SEQ ID NO: 4148623 - DNA, 14 bp, Homo sapiens
gtgcacccggcctg

SEQ ID NO: 4148624 - DNA, 23 bp, Homo sapiens
gtgcacctgggacagggagcagc

SEQ ID NO: 4148625 - DNA, 18 bp, Homo sapiens
gtgcacgtggagagctgg

SEQ ID NO: 4148626 - DNA, 15 bp, Homo sapiens
gtgcactgcccatgg

SEQ ID NO: 4148627 - DNA, 19 bp, Homo sapiens
gtgcactgcccatggacag

SEQ ID NO: 4148628 - DNA, 21 bp, Homo sapiens
gtgcactgcccatggacaggc

SEQ ID NO: 4148629 - DNA, 23 bp, Homo sapiens
gtgcactgtcactttgctctggg

SEQ ID NO: 4148630 - DNA, 17 bp, Homo sapiens
gtgcactttctaatgtt

SEQ ID NO: 4148631 - DNA, 21 bp, Homo sapiens
gtgcagaataatggaaacatt

SEQ ID NO: 4148632 - DNA, 14 bp, Homo sapiens
gtgcagagaagctg

SEQ ID NO: 4148633 - DNA, 16 bp, Homo sapiens
gtgcagagaagctgga

SEQ ID NO: 4148634 - DNA, 18 bp, Homo sapiens
gtgcagagaagctggact

SEQ ID NO: 4148635 - DNA, 16 bp, Homo sapiens
gtgcagagccttctca

SEQ ID NO: 4148636 - DNA, 22 bp, Homo sapiens
gtgcagaggtcagactaagaaa

SEQ ID NO: 4148637 - DNA, 14 bp, Homo sapiens
gtgcagcagggcag

SEQ ID NO: 4148638 - DNA, 13 bp, Homo sapiens
gtgcagccttctc

SEQ ID NO: 4148639 - DNA, 13 bp, Homo sapiens
gtgcagctgattt

SEQ ID NO: 4148640 - DNA, 14 bp, Homo sapiens
gtgcagctgatttt

SEQ ID NO: 4148641 - DNA, 23 bp, Homo sapiens
gtgcagctgattttaacaataac

SEQ ID NO: 4148642 - DNA, 15 bp, Homo sapiens
gtgcaggagcgctcc

SEQ ID NO: 4148643 - DNA, 20 bp, Homo sapiens
gtgcagggagggcagttttc

SEQ ID NO: 4148644 - DNA, 12 bp, Homo sapiens
gtgcagggctgg

SEQ ID NO: 4148645 - DNA, 24 bp, Homo sapiens
gtgcagttcccccaacctcagact

SEQ ID NO: 4148646 - DNA, 14 bp, Homo sapiens
gtgcatagtgctgg

SEQ ID NO: 4148647 - DNA, 14 bp, Homo sapiens
gtgcatctcagccc

SEQ ID NO: 4148648 - DNA, 14 bp, Homo sapiens
gtgcatctcctccc

SEQ ID NO: 4148649 - DNA, 21 bp, Homo sapiens
gtgcatgcatgccctctctga

SEQ ID NO: 4148650 - DNA, 22 bp, Homo sapiens
gtgcatgcatgccctctctgag

SEQ ID NO: 4148651 - DNA, 13 bp, Homo sapiens
gtgcatgggtgaa

SEQ ID NO: 4148652 - DNA, 17 bp, Homo sapiens
gtgcatgtctgttcttc

SEQ ID NO: 4148653 - DNA, 14 bp, Homo sapiens
gtgcattacagaga

SEQ ID NO: 4148654 - DNA, 14 bp, Homo sapiens
gtgcatttctgaat

SEQ ID NO: 4148655 - DNA, 22 bp, Homo sapiens
gtgcatttgagagaagccacgc

SEQ ID NO: 4148656 - DNA, 24 bp, Homo sapiens
gtgcatttgagagaagccacgctg

SEQ ID NO: 4148657 - DNA, 18 bp, Homo sapiens
gtgcatttgttcagctcc

SEQ ID NO: 4148658 - DNA, 17 bp, Homo sapiens
gtgccaaaaccaggcct

SEQ ID NO: 4148659 - DNA, 22 bp, Homo sapiens
gtgccaaacaaaaaggttctca

SEQ ID NO: 4148660 - DNA, 15 bp, Homo sapiens
gtgccaataaccaag

SEQ ID NO: 4148661 - DNA, 20 bp, Homo sapiens
gtgccaataaccaagtttat

SEQ ID NO: 4148662 - DNA, 18 bp, Homo sapiens
gtgccactgcccgagctg

SEQ ID NO: 4148663 - DNA, 15 bp, Homo sapiens
gtgccagcctgaggc

SEQ ID NO: 4148664 - DNA, 16 bp, Homo sapiens
gtgccaggagcaatgg

SEQ ID NO: 4148665 - DNA, 19 bp, Homo sapiens
gtgccaggagcaatgggac

SEQ ID NO: 4148666 - DNA, 14 bp, Homo sapiens
gtgccagggcagca

SEQ ID NO: 4148667 - DNA, 16 bp, Homo sapiens
gtgccagggcccaccc

SEQ ID NO: 4148668 - DNA, 14 bp, Homo sapiens
gtgccagggtgggt

SEQ ID NO: 4148669 - DNA, 17 bp, Homo sapiens
gtgccagtcaagaagaa

SEQ ID NO: 4148670 - DNA, 14 bp, Homo sapiens
gtgccagttcctgt

SEQ ID NO: 4148671 - DNA, 21 bp, Homo sapiens
gtgccatcaccataacctctg

SEQ ID NO: 4148672 - DNA, 14 bp, Homo sapiens
gtgccatcagtgcc

SEQ ID NO: 4148673 - DNA, 23 bp, Homo sapiens
gtgccatctgtacatattactgt

SEQ ID NO: 4148674 - DNA, 13 bp, Homo sapiens
gtgccatgctggg

SEQ ID NO: 4148675 - DNA, 12 bp, Homo sapiens
gtgccatgtctg

SEQ ID NO: 4148676 - DNA, 21 bp, Homo sapiens
gtgcccacaccggggacaggc

SEQ ID NO: 4148677 - DNA, 13 bp, Homo sapiens
gtgcccactccct

SEQ ID NO: 4148678 - DNA, 17 bp, Homo sapiens
gtgcccagaacttccct

SEQ ID NO: 4148679 - DNA, 20 bp, Homo sapiens
gtgcccagaacttccctgat

SEQ ID NO: 4148680 - DNA, 19 bp, Homo sapiens
gtgcccaggggcccacagg

SEQ ID NO: 4148681 - DNA, 16 bp, Homo sapiens
gtgcccatcctgccat

SEQ ID NO: 4148682 - DNA, 17 bp, Homo sapiens
gtgccccacagctacct

SEQ ID NO: 4148683 - DNA, 14 bp, Homo sapiens
gtgccccaggacca

SEQ ID NO: 4148684 - DNA, 21 bp, Homo sapiens
gtgccccatgcctgtccagcc

SEQ ID NO: 4148685 - DNA, 18 bp, Homo sapiens
gtgcccccactgaccaga

SEQ ID NO: 4148686 - DNA, 13 bp, Homo sapiens
gtgccggctgtgg

SEQ ID NO: 4148687 - DNA, 13 bp, Homo sapiens
gtgccgtgtgagt

SEQ ID NO: 4148688 - DNA, 21 bp, Homo sapiens
gtgccgtgtgagtgtgacagg

SEQ ID NO: 4148689 - DNA, 23 bp, Homo sapiens
gtgccgtgtgagtgtgacagggc

SEQ ID NO: 4148690 - DNA, 22 bp, Homo sapiens
gtgcctagattaggtagacttt

SEQ ID NO: 4148691 - DNA, 13 bp, Homo sapiens
gtgcctcagactc

SEQ ID NO: 4148692 - DNA, 14 bp, Homo sapiens
gtgcctcagactcc

SEQ ID NO: 4148693 - DNA, 20 bp, Homo sapiens
gtgcctcccacacttgctgg

SEQ ID NO: 4148694 - DNA, 13 bp, Homo sapiens
gtgcctccttcca

SEQ ID NO: 4148695 - DNA, 18 bp, Homo sapiens
gtgcctccttccacctcc

SEQ ID NO: 4148696 - DNA, 22 bp, Homo sapiens
gtgcctctgcggggcagggcct

SEQ ID NO: 4148697 - DNA, 12 bp, Homo sapiens
gtgcctggaaga

SEQ ID NO: 4148698 - DNA, 19 bp, Homo sapiens
gtgcctggccagatttttc

SEQ ID NO: 4148699 - DNA, 17 bp, Homo sapiens
gtgcctggccccagcct

SEQ ID NO: 4148700 - DNA, 22 bp, Homo sapiens
gtgcctggccccagcctgggcc

SEQ ID NO: 4148701 - DNA, 15 bp, Homo sapiens
gtgcctgggaatgta

SEQ ID NO: 4148702 - DNA, 16 bp, Homo sapiens
gtgcctgggaatgtat

SEQ ID NO: 4148703 - DNA, 14 bp, Homo sapiens
gtgcctgggggagt

SEQ ID NO: 4148704 - DNA, 15 bp, Homo sapiens
gtgcctgtcccaccc

SEQ ID NO: 4148705 - DNA, 17 bp, Homo sapiens
gtgccttccataattat

SEQ ID NO: 4148706 - DNA, 21 bp, Homo sapiens
gtgccttctccttccccagga

SEQ ID NO: 4148707 - DNA, 11 bp, Homo sapiens
gtgccttctct

SEQ ID NO: 4148708 - DNA, 13 bp, Homo sapiens
gtgccttgttttt

SEQ ID NO: 4148709 - DNA, 14 bp, Homo sapiens
gtgcctttctttgc

SEQ ID NO: 4148710 - DNA, 16 bp, Homo sapiens
gtgcctttctttgcct

SEQ ID NO: 4148711 - DNA, 19 bp, Homo sapiens
gtgcctttctttgcctctg

SEQ ID NO: 4148712 - DNA, 13 bp, Homo sapiens
gtgcctttggcct

SEQ ID NO: 4148713 - DNA, 16 bp, Homo sapiens
gtgccttttgctgcgc

SEQ ID NO: 4148714 - DNA, 20 bp, Homo sapiens
gtgccttttgctgcgcacca

SEQ ID NO: 4148715 - DNA, 14 bp, Homo sapiens
gtgccttttggaac

SEQ ID NO: 4148716 - DNA, 23 bp, Homo sapiens
gtgcgcgccaccgtgcctggcta

SEQ ID NO: 4148717 - DNA, 13 bp, Homo sapiens
gtgcggttcctca

SEQ ID NO: 4148718 - DNA, 14 bp, Homo sapiens
gtgcggttcctcat

SEQ ID NO: 4148719 - DNA, 15 bp, Homo sapiens
gtgcgtgaaacacac

SEQ ID NO: 4148720 - DNA, 22 bp, Homo sapiens
gtgcgtgccgtgtgagtgtgac

SEQ ID NO: 4148721 - DNA, 16 bp, Homo sapiens
gtgcgtggaaaaagac

SEQ ID NO: 4148722 - DNA, 13 bp, Homo sapiens
gtgctaaattttc

SEQ ID NO: 4148723 - DNA, 16 bp, Homo sapiens
gtgctactgattgttt

SEQ ID NO: 4148724 - DNA, 19 bp, Homo sapiens
gtgctataggctggagaag

SEQ ID NO: 4148725 - DNA, 21 bp, Homo sapiens
gtgctataggctggagaagct

SEQ ID NO: 4148726 - DNA, 15 bp, Homo sapiens
gtgctcaccagccct

SEQ ID NO: 4148727 - DNA, 22 bp, Homo sapiens
gtgctcagaataaggcaggcat

SEQ ID NO: 4148728 - DNA, 13 bp, Homo sapiens
gtgctcatttaag

SEQ ID NO: 4148729 - DNA, 16 bp, Homo sapiens
gtgctcgccccagcag

SEQ ID NO: 4148730 - DNA, 13 bp, Homo sapiens
gtgctctgtgttc

SEQ ID NO: 4148731 - DNA, 19 bp, Homo sapiens
gtgctgaatggttttcaaa

SEQ ID NO: 4148732 - DNA, 15 bp, Homo sapiens
gtgctgcagatttga

SEQ ID NO: 4148733 - DNA, 12 bp, Homo sapiens
gtgctgccacac

SEQ ID NO: 4148734 - DNA, 11 bp, Homo sapiens
gtgctgccctg

SEQ ID NO: 4148735 - DNA, 14 bp, Homo sapiens
gtgctgccctgtgt

SEQ ID NO: 4148736 - DNA, 15 bp, Homo sapiens
gtgctgccctgtgta

SEQ ID NO: 4148737 - DNA, 16 bp, Homo sapiens
gtgctgccttgcttct

SEQ ID NO: 4148738 - DNA, 13 bp, Homo sapiens
gtgctggaagtct

SEQ ID NO: 4148739 - DNA, 21 bp, Homo sapiens
gtgctggaagtctccatgaag

SEQ ID NO: 4148740 - DNA, 23 bp, Homo sapiens
gtgctggcacttagtaggtcctc

SEQ ID NO: 4148741 - DNA, 21 bp, Homo sapiens
gtgctggctcacagtacagca

SEQ ID NO: 4148742 - DNA, 22 bp, Homo sapiens
gtgctggctcacagtacagcat

SEQ ID NO: 4148743 - DNA, 15 bp, Homo sapiens
gtgctggctgcccag

SEQ ID NO: 4148744 - DNA, 18 bp, Homo sapiens
gtgctggctgcccagacc

SEQ ID NO: 4148745 - DNA, 17 bp, Homo sapiens
gtgctgggaccagagcc

SEQ ID NO: 4148746 - DNA, 18 bp, Homo sapiens
gtgctgggaggagggaga

SEQ ID NO: 4148747 - DNA, 21 bp, Homo sapiens
gtgctgggggaatgagcccag

SEQ ID NO: 4148748 - DNA, 20 bp, Homo sapiens
gtgctggtcccggggccagc

SEQ ID NO: 4148749 - DNA, 22 bp, Homo sapiens
gtgctggtgcggatggacacta

SEQ ID NO: 4148750 - DNA, 13 bp, Homo sapiens
gtgctgtgaggga

SEQ ID NO: 4148751 - DNA, 13 bp, Homo sapiens
gtgctgtggaagc

SEQ ID NO: 4148752 - DNA, 16 bp, Homo sapiens
gtgctgtggccagggt

SEQ ID NO: 4148753 - DNA, 17 bp, Homo sapiens
gtgctgtggccagggtg

SEQ ID NO: 4148754 - DNA, 12 bp, Homo sapiens
gtgctgtgggca

SEQ ID NO: 4148755 - DNA, 13 bp, Homo sapiens
gtgctgtgggcag

SEQ ID NO: 4148756 - DNA, 15 bp, Homo sapiens
gtgctgtgggcagca

SEQ ID NO: 4148757 - DNA, 18 bp, Homo sapiens
gtgctgtgggcagcaccc

SEQ ID NO: 4148758 - DNA, 19 bp, Homo sapiens
gtgcttattctcaaagcag

SEQ ID NO: 4148759 - DNA, 21 bp, Homo sapiens
gtgcttattctcaaagcagga

SEQ ID NO: 4148760 - DNA, 21 bp, Homo sapiens
gtgcttgaaggccctgctgag

SEQ ID NO: 4148761 - DNA, 20 bp, Homo sapiens
gtgcttgggagagtcaggca

SEQ ID NO: 4148762 - DNA, 19 bp, Homo sapiens
gtgcttgtcattccagagt

SEQ ID NO: 4148763 - DNA, 20 bp, Homo sapiens
gtgcttgttttataaaattt

SEQ ID NO: 4148764 - DNA, 17 bp, Homo sapiens
gtggaacctctgtctca

SEQ ID NO: 4148765 - DNA, 16 bp, Homo sapiens
gtggaagaagggagaa

SEQ ID NO: 4148766 - DNA, 15 bp, Homo sapiens
gtggaaggcagacag

SEQ ID NO: 4148767 - DNA, 14 bp, Homo sapiens
gtggaaggcctccc

SEQ ID NO: 4148768 - DNA, 18 bp, Homo sapiens
gtggaatgagtgtgcatg

SEQ ID NO: 4148769 - DNA, 20 bp, Homo sapiens
gtggacaaactggagtctgg

SEQ ID NO: 4148770 - DNA, 19 bp, Homo sapiens
gtggacccagcgggcaggt

SEQ ID NO: 4148771 - DNA, 17 bp, Homo sapiens
gtggaccgtggacaggc

SEQ ID NO: 4148772 - DNA, 21 bp, Homo sapiens
gtggaccttttaaagtgtttc

SEQ ID NO: 4148773 - DNA, 14 bp, Homo sapiens
gtggactcagggca

SEQ ID NO: 4148774 - DNA, 15 bp, Homo sapiens
gtggactggcccctg

SEQ ID NO: 4148775 - DNA, 17 bp, Homo sapiens
gtggactggcccctggg

SEQ ID NO: 4148776 - DNA, 22 bp, Homo sapiens
gtggagaccctgccacagccag

SEQ ID NO: 4148777 - DNA, 23 bp, Homo sapiens
gtggagaccctgccacagccaga

SEQ ID NO: 4148778 - DNA, 19 bp, Homo sapiens
gtggagactgatggccagg

SEQ ID NO: 4148779 - DNA, 14 bp, Homo sapiens
gtggagagcccggc

SEQ ID NO: 4148780 - DNA, 17 bp, Homo sapiens
gtggagagctggtgccc

SEQ ID NO: 4148781 - DNA, 17 bp, Homo sapiens
gtggagcaaaaggcagc

SEQ ID NO: 4148782 - DNA, 19 bp, Homo sapiens
gtggagcaaaaggcagctc

SEQ ID NO: 4148783 - DNA, 21 bp, Homo sapiens
gtggagcaaaaggcagctcac

SEQ ID NO: 4148784 - DNA, 21 bp, Homo sapiens
gtggagcctgacagccagaac

SEQ ID NO: 4148785 - DNA, 23 bp, Homo sapiens
gtggagcctgacagccagaactc

SEQ ID NO: 4148786 - DNA, 16 bp, Homo sapiens
gtggagcgttcaccag

SEQ ID NO: 4148787 - DNA, 13 bp, Homo sapiens
gtggaggaaggat

SEQ ID NO: 4148788 - DNA, 14 bp, Homo sapiens
gtggaggaaggatt

SEQ ID NO: 4148789 - DNA, 16 bp, Homo sapiens
gtggaggaaggattgt

SEQ ID NO: 4148790 - DNA, 19 bp, Homo sapiens
gtggaggaaggattgtaaa

SEQ ID NO: 4148791 - DNA, 17 bp, Homo sapiens
gtggaggaggaaggcaa

SEQ ID NO: 4148792 - DNA, 19 bp, Homo sapiens
gtggaggaggaaggcaaga

SEQ ID NO: 4148793 - DNA, 13 bp, Homo sapiens
gtggaggcttcct

SEQ ID NO: 4148794 - DNA, 15 bp, Homo sapiens
gtggagtttctctgt

SEQ ID NO: 4148795 - DNA, 17 bp, Homo sapiens
gtggatataaaatgtgc

SEQ ID NO: 4148796 - DNA, 24 bp, Homo sapiens
gtggatatggtgcagagaagctgg

SEQ ID NO: 4148797 - DNA, 22 bp, Homo sapiens
gtggatcacgaggtcaggagat

SEQ ID NO: 4148798 - DNA, 17 bp, Homo sapiens
gtggatctccaaggacc

SEQ ID NO: 4148799 - DNA, 23 bp, Homo sapiens
gtggatctccaaggaccaggtta

SEQ ID NO: 4148800 - DNA, 17 bp, Homo sapiens
gtggatctgtccaagga

SEQ ID NO: 4148801 - DNA, 18 bp, Homo sapiens
gtggatctgtccaaggaa

SEQ ID NO: 4148802 - DNA, 22 bp, Homo sapiens
gtggatgggaatttgtcagcgt

SEQ ID NO: 4148803 - DNA, 18 bp, Homo sapiens
gtggatttgattcatttt

SEQ ID NO: 4148804 - DNA, 20 bp, Homo sapiens
gtggattttctactgtaaga

SEQ ID NO: 4148805 - DNA, 22 bp, Homo sapiens
gtggcaaagctgttcttcctgg

SEQ ID NO: 4148806 - DNA, 19 bp, Homo sapiens
gtggcaccagaggtgcttc

SEQ ID NO: 4148807 - DNA, 23 bp, Homo sapiens
gtggcactcaactctgagcccat

SEQ ID NO: 4148808 - DNA, 13 bp, Homo sapiens
gtggcagagagag

SEQ ID NO: 4148809 - DNA, 19 bp, Homo sapiens
gtggcagatgtcttccctg

SEQ ID NO: 4148810 - DNA, 19 bp, Homo sapiens
gtggcaggcacacagcagc

SEQ ID NO: 4148811 - DNA, 20 bp, Homo sapiens
gtggcaggcacacagcagcc

SEQ ID NO: 4148812 - DNA, 23 bp, Homo sapiens
gtggcaggcacacagcagccccc

SEQ ID NO: 4148813 - DNA, 23 bp, Homo sapiens
gtggcagggggccccgccagggc

SEQ ID NO: 4148814 - DNA, 21 bp, Homo sapiens
gtggcagtggttttggcaaac

SEQ ID NO: 4148815 - DNA, 18 bp, Homo sapiens
gtggcatctttgccttgg

SEQ ID NO: 4148816 - DNA, 14 bp, Homo sapiens
gtggcattgaaatg

SEQ ID NO: 4148817 - DNA, 13 bp, Homo sapiens
gtggccactcagc

SEQ ID NO: 4148818 - DNA, 17 bp, Homo sapiens
gtggccagccagtgcca

SEQ ID NO: 4148819 - DNA, 13 bp, Homo sapiens
gtggccagggtga

SEQ ID NO: 4148820 - DNA, 15 bp, Homo sapiens
gtggccatccctggg

SEQ ID NO: 4148821 - DNA, 18 bp, Homo sapiens
gtggccatccctgggccc

SEQ ID NO: 4148822 - DNA, 20 bp, Homo sapiens
gtggccatccctgggcccct

SEQ ID NO: 4148823 - DNA, 22 bp, Homo sapiens
gtggccatccctgggcccctcc

SEQ ID NO: 4148824 - DNA, 17 bp, Homo sapiens
gtggcccgacagcctgg

SEQ ID NO: 4148825 - DNA, 9 bp, Homo sapiens
gtggcctca

SEQ ID NO: 4148826 - DNA, 15 bp, Homo sapiens
gtggcctcagccctc

SEQ ID NO: 4148827 - DNA, 16 bp, Homo sapiens
gtggcctcagccctca

SEQ ID NO: 4148828 - DNA, 22 bp, Homo sapiens
gtggcctccctgctgtgccatg

SEQ ID NO: 4148829 - DNA, 23 bp, Homo sapiens
gtggcctcgaactcctggcacta

SEQ ID NO: 4148830 - DNA, 22 bp, Homo sapiens
gtggcctcgggacacctgccct

SEQ ID NO: 4148831 - DNA, 12 bp, Homo sapiens
gtggcctggcca

SEQ ID NO: 4148832 - DNA, 13 bp, Homo sapiens
gtggcctggccag

SEQ ID NO: 4148833 - DNA, 18 bp, Homo sapiens
gtggcctggccaggagct

SEQ ID NO: 4148834 - DNA, 21 bp, Homo sapiens
gtggcctggccaggagctctt

SEQ ID NO: 4148835 - DNA, 14 bp, Homo sapiens
gtggcctggtccct

SEQ ID NO: 4148836 - DNA, 23 bp, Homo sapiens
gtggcgggtgatggccagcccct

SEQ ID NO: 4148837 - DNA, 14 bp, Homo sapiens
gtggcgtctccctc

SEQ ID NO: 4148838 - DNA, 21 bp, Homo sapiens
gtggcgttctgctgcccctgc

SEQ ID NO: 4148839 - DNA, 22 bp, Homo sapiens
gtggctaaatgcctaataaaca

SEQ ID NO: 4148840 - DNA, 21 bp, Homo sapiens
gtggctctgaggtgcctgtcc

SEQ ID NO: 4148841 - DNA, 18 bp, Homo sapiens
gtggctgccacacccagg

SEQ ID NO: 4148842 - DNA, 22 bp, Homo sapiens
gtggctgggggcaggagggccc

SEQ ID NO: 4148843 - DNA, 20 bp, Homo sapiens
gtggctgggtgggcccagaa

SEQ ID NO: 4148844 - DNA, 19 bp, Homo sapiens
gtggcttcccgctcagccc

SEQ ID NO: 4148845 - DNA, 21 bp, Homo sapiens
gtggcttcccgctcagccctc

SEQ ID NO: 4148846 - DNA, 22 bp, Homo sapiens
gtggcttgagaaatatggacac

SEQ ID NO: 4148847 - DNA, 23 bp, Homo sapiens
gtggctttccaggcaccctcagg

SEQ ID NO: 4148848 - DNA, 16 bp, Homo sapiens
gtggctttggcagtgt

SEQ ID NO: 4148849 - DNA, 15 bp, Homo sapiens
gtgggaaggacttgg

SEQ ID NO: 4148850 - DNA, 17 bp, Homo sapiens
gtgggacagaggagcaa

SEQ ID NO: 4148851 - DNA, 15 bp, Homo sapiens
gtgggagaaggcagt

SEQ ID NO: 4148852 - DNA, 12 bp, Homo sapiens
gtgggagccctg

SEQ ID NO: 4148853 - DNA, 14 bp, Homo sapiens
gtgggagggagcag

SEQ ID NO: 4148854 - DNA, 16 bp, Homo sapiens
gtgggaggtcttgcta

SEQ ID NO: 4148855 - DNA, 17 bp, Homo sapiens
gtgggatgaaccagccg

SEQ ID NO: 4148856 - DNA, 19 bp, Homo sapiens
gtgggatgggacagggagg

SEQ ID NO: 4148857 - DNA, 24 bp, Homo sapiens
gtgggatgttcagcactgtccctt

SEQ ID NO: 4148858 - DNA, 13 bp, Homo sapiens
gtgggcacctcag

SEQ ID NO: 4148859 - DNA, 16 bp, Homo sapiens
gtgggcactggcccag

SEQ ID NO: 4148860 - DNA, 21 bp, Homo sapiens
gtgggcccagaactgccccca

SEQ ID NO: 4148861 - DNA, 14 bp, Homo sapiens
gtgggcccctcaac

SEQ ID NO: 4148862 - DNA, 21 bp, Homo sapiens
gtgggcccctcaacagccaag

SEQ ID NO: 4148863 - DNA, 18 bp, Homo sapiens
gtgggctgaccaggcttc

SEQ ID NO: 4148864 - DNA, 19 bp, Homo sapiens
gtgggctggacttctacct

SEQ ID NO: 4148865 - DNA, 12 bp, Homo sapiens
gtgggctggtgc

SEQ ID NO: 4148866 - DNA, 13 bp, Homo sapiens
gtgggctggtgcc

SEQ ID NO: 4148867 - DNA, 18 bp, Homo sapiens
gtgggctggtgccccaca

SEQ ID NO: 4148868 - DNA, 21 bp, Homo sapiens
gtgggcttcctgcccttccct

SEQ ID NO: 4148869 - DNA, 13 bp, Homo sapiens
gtggggagacctg

SEQ ID NO: 4148870 - DNA, 14 bp, Homo sapiens
gtggggagacctgg

SEQ ID NO: 4148871 - DNA, 17 bp, Homo sapiens
gtggggagacctggttg

SEQ ID NO: 4148872 - DNA, 21 bp, Homo sapiens
gtggggagatgcttctctcct

SEQ ID NO: 4148873 - DNA, 22 bp, Homo sapiens
gtggggagtccagggctcccgg

SEQ ID NO: 4148874 - DNA, 19 bp, Homo sapiens
gtggggcctgtggaatgag

SEQ ID NO: 4148875 - DNA, 14 bp, Homo sapiens
gtgggggagggagg

SEQ ID NO: 4148876 - DNA, 17 bp, Homo sapiens
gtggggggtgcaggtgg

SEQ ID NO: 4148877 - DNA, 19 bp, Homo sapiens
gtggggggtgcaggtgggc

SEQ ID NO: 4148878 - DNA, 12 bp, Homo sapiens
gtgggggtggcc

SEQ ID NO: 4148879 - DNA, 17 bp, Homo sapiens
gtggggtgaggaccact

SEQ ID NO: 4148880 - DNA, 22 bp, Homo sapiens
gtgggtaatccaggcacagctg

SEQ ID NO: 4148881 - DNA, 14 bp, Homo sapiens
gtgggtagatgtgc

SEQ ID NO: 4148882 - DNA, 15 bp, Homo sapiens
gtgggtagatgtgca

SEQ ID NO: 4148883 - DNA, 12 bp, Homo sapiens
gtgggtgagcca

SEQ ID NO: 4148884 - DNA, 13 bp, Homo sapiens
gtgggtgagccag

SEQ ID NO: 4148885 - DNA, 14 bp, Homo sapiens
gtgggtgctcagaa

SEQ ID NO: 4148886 - DNA, 12 bp, Homo sapiens
gtgggtgctgcc

SEQ ID NO: 4148887 - DNA, 15 bp, Homo sapiens
gtgggtgctgccctg

SEQ ID NO: 4148888 - DNA, 22 bp, Homo sapiens
gtgggtgtcctgcctgtctgcc

SEQ ID NO: 4148889 - DNA, 21 bp, Homo sapiens
gtgggtgttctttcctgccct

SEQ ID NO: 4148890 - DNA, 14 bp, Homo sapiens
gtggtaccctctgg

SEQ ID NO: 4148891 - DNA, 22 bp, Homo sapiens
gtggtcaaaccgcactcaccca

SEQ ID NO: 4148892 - DNA, 11 bp, Homo sapiens
gtggtccatgc

SEQ ID NO: 4148893 - DNA, 12 bp, Homo sapiens
gtggtcctgact

SEQ ID NO: 4148894 - DNA, 11 bp, Homo sapiens
gtggtctcagg

SEQ ID NO: 4148895 - DNA, 14 bp, Homo sapiens
gtggtctgaatgtt

SEQ ID NO: 4148896 - DNA, 16 bp, Homo sapiens
gtggtctttctggaga

SEQ ID NO: 4148897 - DNA, 14 bp, Homo sapiens
gtggtgaggggctt

SEQ ID NO: 4148898 - DNA, 19 bp, Homo sapiens
gtggtgatcaattaaatgt

SEQ ID NO: 4148899 - DNA, 14 bp, Homo sapiens
gtggtgcagacaga

SEQ ID NO: 4148900 - DNA, 23 bp, Homo sapiens
gtggtggcatacgcctgtagtcc

SEQ ID NO: 4148901 - DNA, 18 bp, Homo sapiens
gtggtggcccacgcctgt

SEQ ID NO: 4148902 - DNA, 13 bp, Homo sapiens
gtggtggcctcag

SEQ ID NO: 4148903 - DNA, 18 bp, Homo sapiens
gtggtggcgggcgcctgt

SEQ ID NO: 4148904 - DNA, 15 bp, Homo sapiens
gtggtgtaaagctgg

SEQ ID NO: 4148905 - DNA, 18 bp, Homo sapiens
gtggtgtaaagctggccc

SEQ ID NO: 4148906 - DNA, 20 bp, Homo sapiens
gtggtgtaaagctggccctg

SEQ ID NO: 4148907 - DNA, 22 bp, Homo sapiens
gtggtgtaaagctggccctgcc

SEQ ID NO: 4148908 - DNA, 15 bp, Homo sapiens
gtggtgtttattgca

SEQ ID NO: 4148909 - DNA, 22 bp, Homo sapiens
gtggttattagcaaggctgggt

SEQ ID NO: 4148910 - DNA, 13 bp, Homo sapiens
gtggttctatttt

SEQ ID NO: 4148911 - DNA, 19 bp, Homo sapiens
gtggttctattttactttg

SEQ ID NO: 4148912 - DNA, 23 bp, Homo sapiens
gtggttctattttactttgtact

SEQ ID NO: 4148913 - DNA, 15 bp, Homo sapiens
gtgtaaaaaatggaa

SEQ ID NO: 4148914 - DNA, 19 bp, Homo sapiens
gtgtaaaaaatggaaaaaa

SEQ ID NO: 4148915 - DNA, 20 bp, Homo sapiens
gtgtaaaaaatggaaaaaaa

SEQ ID NO: 4148916 - DNA, 14 bp, Homo sapiens
gtgtaaagctggcc

SEQ ID NO: 4148917 - DNA, 15 bp, Homo sapiens
gtgtaaagctggccc

SEQ ID NO: 4148918 - DNA, 22 bp, Homo sapiens
gtgtaaatatatgtctgataat

SEQ ID NO: 4148919 - DNA, 12 bp, Homo sapiens
gtgtaaatatgt

SEQ ID NO: 4148920 - DNA, 17 bp, Homo sapiens
gtgtaacaattgtgtag

SEQ ID NO: 4148921 - DNA, 18 bp, Homo sapiens
gtgtaacttcctgctgca

SEQ ID NO: 4148922 - DNA, 20 bp, Homo sapiens
gtgtaacttgcttaaatttc

SEQ ID NO: 4148923 - DNA, 21 bp, Homo sapiens
gtgtaacttgcttaaatttct

SEQ ID NO: 4148924 - DNA, 14 bp, Homo sapiens
gtgtaataagacat

SEQ ID NO: 4148925 - DNA, 22 bp, Homo sapiens
gtgtaataagacttagattgtg

SEQ ID NO: 4148926 - DNA, 13 bp, Homo sapiens
gtgtaattcaaaa

SEQ ID NO: 4148927 - DNA, 16 bp, Homo sapiens
gtgtaattcaaaagat

SEQ ID NO: 4148928 - DNA, 18 bp, Homo sapiens
gtgtaattcaaaagatta

SEQ ID NO: 4148929 - DNA, 15 bp, Homo sapiens
gtgtaatttgaagat

SEQ ID NO: 4148930 - DNA, 14 bp, Homo sapiens
gtgtacaatgtaca

SEQ ID NO: 4148931 - DNA, 18 bp, Homo sapiens
gtgtacactaacatttcc

SEQ ID NO: 4148932 - DNA, 12 bp, Homo sapiens
gtgtacagtgtg

SEQ ID NO: 4148933 - DNA, 21 bp, Homo sapiens
gtgtacctcctctcagtgttt

SEQ ID NO: 4148934 - DNA, 20 bp, Homo sapiens
gtgtacctgtgtacataact

SEQ ID NO: 4148935 - DNA, 18 bp, Homo sapiens
gtgtactcactgaagcct

SEQ ID NO: 4148936 - DNA, 15 bp, Homo sapiens
gtgtacttaactatt

SEQ ID NO: 4148937 - DNA, 23 bp, Homo sapiens
gtgtagccaggtatggctctgca

SEQ ID NO: 4148938 - DNA, 14 bp, Homo sapiens
gtgtatataatttt

SEQ ID NO: 4148939 - DNA, 15 bp, Homo sapiens
gtgtatgactaaaga

SEQ ID NO: 4148940 - DNA, 16 bp, Homo sapiens
gtgtatgactaaagag

SEQ ID NO: 4148941 - DNA, 14 bp, Homo sapiens
gtgtatgcacagta

SEQ ID NO: 4148942 - DNA, 21 bp, Homo sapiens
gtgtatggaaaaaccatttga

SEQ ID NO: 4148943 - DNA, 16 bp, Homo sapiens
gtgtcaagctgctctg

SEQ ID NO: 4148944 - DNA, 17 bp, Homo sapiens
gtgtcaagctgctctga

SEQ ID NO: 4148945 - DNA, 14 bp, Homo sapiens
gtgtcaagtggcaa

SEQ ID NO: 4148946 - DNA, 23 bp, Homo sapiens
gtgtcacagttcttggtgactgt

SEQ ID NO: 4148947 - DNA, 17 bp, Homo sapiens
gtgtcagctgaggctgg

SEQ ID NO: 4148948 - DNA, 16 bp, Homo sapiens
gtgtcagtatccaggc

SEQ ID NO: 4148949 - DNA, 17 bp, Homo sapiens
gtgtcatttcattccat

SEQ ID NO: 4148950 - DNA, 17 bp, Homo sapiens
gtgtcatttcttcactt

SEQ ID NO: 4148951 - DNA, 15 bp, Homo sapiens
gtgtccacctgtggg

SEQ ID NO: 4148952 - DNA, 17 bp, Homo sapiens
gtgtccacctgtgggtg

SEQ ID NO: 4148953 - DNA, 12 bp, Homo sapiens
gtgtccagcaca

SEQ ID NO: 4148954 - DNA, 13 bp, Homo sapiens
gtgtcccctcact

SEQ ID NO: 4148955 - DNA, 13 bp, Homo sapiens
gtgtcccctccac

SEQ ID NO: 4148956 - DNA, 16 bp, Homo sapiens
gtgtcctccaggagct

SEQ ID NO: 4148957 - DNA, 18 bp, Homo sapiens
gtgtcctcttccctctct

SEQ ID NO: 4148958 - DNA, 21 bp, Homo sapiens
gtgtcctgaaacgctcctttg

SEQ ID NO: 4148959 - DNA, 16 bp, Homo sapiens
gtgtcctgtcctttct

SEQ ID NO: 4148960 - DNA, 21 bp, Homo sapiens
gtgtctcggagggattcccct

SEQ ID NO: 4148961 - DNA, 19 bp, Homo sapiens
gtgtctcttttctctttct

SEQ ID NO: 4148962 - DNA, 12 bp, Homo sapiens
gtgtctggcttt

SEQ ID NO: 4148963 - DNA, 23 bp, Homo sapiens
gtgtctggctttttcctctgagc

SEQ ID NO: 4148964 - DNA, 19 bp, Homo sapiens
gtgtcttaattattatttg

SEQ ID NO: 4148965 - DNA, 17 bp, Homo sapiens
gtgtcttccactttgca

SEQ ID NO: 4148966 - DNA, 12 bp, Homo sapiens
gtgtcttccata

SEQ ID NO: 4148967 - DNA, 18 bp, Homo sapiens
gtgtctttcacagctcct

SEQ ID NO: 4148968 - DNA, 20 bp, Homo sapiens
gtgtgaaactttcattcctt

SEQ ID NO: 4148969 - DNA, 23 bp, Homo sapiens
gtgtgaacctacctgccttggag

SEQ ID NO: 4148970 - DNA, 15 bp, Homo sapiens
gtgtgaatagcctgg

SEQ ID NO: 4148971 - DNA, 13 bp, Homo sapiens
gtgtgaatgaaca

SEQ ID NO: 4148972 - DNA, 21 bp, Homo sapiens
gtgtgaatgtgggcactggcc

SEQ ID NO: 4148973 - DNA, 15 bp, Homo sapiens
gtgtgacattccagg

SEQ ID NO: 4148974 - DNA, 18 bp, Homo sapiens
gtgtgacatttggagagg

SEQ ID NO: 4148975 - DNA, 19 bp, Homo sapiens
gtgtgacatttggagaggg

SEQ ID NO: 4148976 - DNA, 14 bp, Homo sapiens
gtgtgagcgccttg

SEQ ID NO: 4148977 - DNA, 15 bp, Homo sapiens
gtgtgagcgccttgg

SEQ ID NO: 4148978 - DNA, 19 bp, Homo sapiens
gtgtgattgcacagaattt

SEQ ID NO: 4148979 - DNA, 19 bp, Homo sapiens
gtgtgcaatgtctgagtga

SEQ ID NO: 4148980 - DNA, 11 bp, Homo sapiens
gtgtgcctggc

SEQ ID NO: 4148981 - DNA, 13 bp, Homo sapiens
gtgtgcctggcct

SEQ ID NO: 4148982 - DNA, 14 bp, Homo sapiens
gtgtgcctggcctc

SEQ ID NO: 4148983 - DNA, 23 bp, Homo sapiens
gtgtgcctgggggagttttcctc

SEQ ID NO: 4148984 - DNA, 16 bp, Homo sapiens
gtgtgctgaggtgtta

SEQ ID NO: 4148985 - DNA, 20 bp, Homo sapiens
gtgtggacccccaccctgca

SEQ ID NO: 4148986 - DNA, 18 bp, Homo sapiens
gtgtggactcaagtcctt

SEQ ID NO: 4148987 - DNA, 14 bp, Homo sapiens
gtgtggcagtggtt

SEQ ID NO: 4148988 - DNA, 11 bp, Homo sapiens
gtgtggcctca

SEQ ID NO: 4148989 - DNA, 17 bp, Homo sapiens
gtgtggcctcagccctc

SEQ ID NO: 4148990 - DNA, 13 bp, Homo sapiens
gtgtggctgagga

SEQ ID NO: 4148991 - DNA, 12 bp, Homo sapiens
gtgtggctttcc

SEQ ID NO: 4148992 - DNA, 14 bp, Homo sapiens
gtgtggggtggggt

SEQ ID NO: 4148993 - DNA, 17 bp, Homo sapiens
gtgtgggtggaagggct

SEQ ID NO: 4148994 - DNA, 20 bp, Homo sapiens
gtgtggtccatgcccactgc

SEQ ID NO: 4148995 - DNA, 12 bp, Homo sapiens
gtgtggtggcct

SEQ ID NO: 4148996 - DNA, 17 bp, Homo sapiens
gtgtgtactctgtccag

SEQ ID NO: 4148997 - DNA, 13 bp, Homo sapiens
gtgtgtagagtta

SEQ ID NO: 4148998 - DNA, 16 bp, Homo sapiens
gtgtgtagagttaaga

SEQ ID NO: 4148999 - DNA, 17 bp, Homo sapiens
gtgtgtagagttaagaa

SEQ ID NO: 4149000 - DNA, 13 bp, Homo sapiens
gtgtgtaggctgg

SEQ ID NO: 4149001 - DNA, 16 bp, Homo sapiens
gtgtgtcagctgaggc

SEQ ID NO: 4149002 - DNA, 21 bp, Homo sapiens
gtgtgtcttaattattatttg

SEQ ID NO: 4149003 - DNA, 14 bp, Homo sapiens
gtgtgtgcagagct

SEQ ID NO: 4149004 - DNA, 14 bp, Homo sapiens
gtgtgtggcagggg

SEQ ID NO: 4149005 - DNA, 16 bp, Homo sapiens
gtgtgtgtggtccatg

SEQ ID NO: 4149006 - DNA, 11 bp, Homo sapiens
gtgtgtgtgtg

SEQ ID NO: 4149007 - DNA, 16 bp, Homo sapiens
gtgtgtgtgtgtatgt

SEQ ID NO: 4149008 - DNA, 13 bp, Homo sapiens
gtgtgtgtgtgtg

SEQ ID NO: 4149009 - DNA, 15 bp, Homo sapiens
gtgtgtgtgtgtgta

SEQ ID NO: 4149010 - DNA, 18 bp, Homo sapiens
gtgtgttctgattagaaa

SEQ ID NO: 4149011 - DNA, 16 bp, Homo sapiens
gtgttacctgtgtgct

SEQ ID NO: 4149012 - DNA, 16 bp, Homo sapiens
gtgttacttatggaag

SEQ ID NO: 4149013 - DNA, 13 bp, Homo sapiens
gtgttagagaaat

SEQ ID NO: 4149014 - DNA, 16 bp, Homo sapiens
gtgttattctttgcgt

SEQ ID NO: 4149015 - DNA, 14 bp, Homo sapiens
gtgttcagaaaaaa

SEQ ID NO: 4149016 - DNA, 20 bp, Homo sapiens
gtgttcctttttaaatgtga

SEQ ID NO: 4149017 - DNA, 16 bp, Homo sapiens
gtgttctcacagtgtg

SEQ ID NO: 4149018 - DNA, 14 bp, Homo sapiens
gtgttctgctcctg

SEQ ID NO: 4149019 - DNA, 16 bp, Homo sapiens
gtgttctgctcctgct

SEQ ID NO: 4149020 - DNA, 18 bp, Homo sapiens
gtgttctgctcctgcttt

SEQ ID NO: 4149021 - DNA, 20 bp, Homo sapiens
gtgttctttcctgccctgtc

SEQ ID NO: 4149022 - DNA, 14 bp, Homo sapiens
gtgttgaggttttt

SEQ ID NO: 4149023 - DNA, 12 bp, Homo sapiens
gtgttgatctta

SEQ ID NO: 4149024 - DNA, 20 bp, Homo sapiens
gtgttgccaaatatgtcctg

SEQ ID NO: 4149025 - DNA, 21 bp, Homo sapiens
gtgttggctaatgaagggaaa

SEQ ID NO: 4149026 - DNA, 23 bp, Homo sapiens
gtgttggggaaaccttcatctga

SEQ ID NO: 4149027 - DNA, 12 bp, Homo sapiens
gtgttgtctcta

SEQ ID NO: 4149028 - DNA, 15 bp, Homo sapiens
gtgttgtgttcctgg

SEQ ID NO: 4149029 - DNA, 16 bp, Homo sapiens
gtgttgtgttcctggc

SEQ ID NO: 4149030 - DNA, 18 bp, Homo sapiens
gtgtttaaagagaggtta

SEQ ID NO: 4149031 - DNA, 18 bp, Homo sapiens
gtgtttactatgtgccag

SEQ ID NO: 4149032 - DNA, 15 bp, Homo sapiens
gtgtttagttgcaga

SEQ ID NO: 4149033 - DNA, 13 bp, Homo sapiens
gtgtttattgcaa

SEQ ID NO: 4149034 - DNA, 19 bp, Homo sapiens
gtgtttgctccccttcccc

SEQ ID NO: 4149035 - DNA, 16 bp, Homo sapiens
gtgtttggtttacatt

SEQ ID NO: 4149036 - DNA, 17 bp, Homo sapiens
gtgtttggtttacattt

SEQ ID NO: 4149037 - DNA, 12 bp, Homo sapiens
gtgtttgttcct

SEQ ID NO: 4149038 - DNA, 15 bp, Homo sapiens
gtgttttaatttaaa

SEQ ID NO: 4149039 - DNA, 13 bp, Homo sapiens
gtgttttcataat

SEQ ID NO: 4149040 - DNA, 13 bp, Homo sapiens
gtgttttttaaga

SEQ ID NO: 4149041 - DNA, 14 bp, Homo sapiens
gtgttttttaagat

SEQ ID NO: 4149042 - DNA, 15 bp, Homo sapiens
gtgttttttaagata

SEQ ID NO: 4149043 - DNA, 19 bp, Homo sapiens
gtgtttttttatgaatggg

SEQ ID NO: 4149044 - DNA, 18 bp, Homo sapiens
gttaaaactgtacattta

SEQ ID NO: 4149045 - DNA, 20 bp, Homo sapiens
gttaaaactgtacatttaaa

SEQ ID NO: 4149046 - DNA, 22 bp, Homo sapiens
gttaaaactgtacatttaaaat

SEQ ID NO: 4149047 - DNA, 11 bp, Homo sapiens
gttaaagcaga

SEQ ID NO: 4149048 - DNA, 21 bp, Homo sapiens
gttaaatagagtatatgcact

SEQ ID NO: 4149049 - DNA, 15 bp, Homo sapiens
gttaaatttgtaagt

SEQ ID NO: 4149050 - DNA, 16 bp, Homo sapiens
gttaaatttgtaagtt

SEQ ID NO: 4149051 - DNA, 17 bp, Homo sapiens
gttaaatttgtaagttt

SEQ ID NO: 4149052 - DNA, 18 bp, Homo sapiens
gttaaatttgtaagtttc

SEQ ID NO: 4149053 - DNA, 23 bp, Homo sapiens
gttaacaaggaatgcctgtgcca

SEQ ID NO: 4149054 - DNA, 18 bp, Homo sapiens
gttaacattgaccaagaa

SEQ ID NO: 4149055 - DNA, 23 bp, Homo sapiens
gttaacattgaccaagaactgca

SEQ ID NO: 4149056 - DNA, 15 bp, Homo sapiens
gttaacctgcagaaa

SEQ ID NO: 4149057 - DNA, 17 bp, Homo sapiens
gttaacctgcagaaaca

SEQ ID NO: 4149058 - DNA, 22 bp, Homo sapiens
gttaactatgacagatatattt

SEQ ID NO: 4149059 - DNA, 13 bp, Homo sapiens
gttaagaagctgt

SEQ ID NO: 4149060 - DNA, 17 bp, Homo sapiens
gttaagaagctgttgta

SEQ ID NO: 4149061 - DNA, 14 bp, Homo sapiens
gttaagacctggca

SEQ ID NO: 4149062 - DNA, 15 bp, Homo sapiens
gttaagagaaacttt

SEQ ID NO: 4149063 - DNA, 17 bp, Homo sapiens
gttaagagaaactttat

SEQ ID NO: 4149064 - DNA, 22 bp, Homo sapiens
gttaagagaaactttatacatt

SEQ ID NO: 4149065 - DNA, 16 bp, Homo sapiens
gttaagcattaccact

SEQ ID NO: 4149066 - DNA, 21 bp, Homo sapiens
gttaagcattaccactcaggc

SEQ ID NO: 4149067 - DNA, 12 bp, Homo sapiens
gttaaggaaact

SEQ ID NO: 4149068 - DNA, 12 bp, Homo sapiens
gttaaggcctga

SEQ ID NO: 4149069 - DNA, 14 bp, Homo sapiens
gttaaggttgaact

SEQ ID NO: 4149070 - DNA, 16 bp, Homo sapiens
gttaagtctcctgtct

SEQ ID NO: 4149071 - DNA, 13 bp, Homo sapiens
gttaatgagccat

SEQ ID NO: 4149072 - DNA, 23 bp, Homo sapiens
gttaatgatggttgatgggttct

SEQ ID NO: 4149073 - DNA, 23 bp, Homo sapiens
gttaatgttatatcatatgtata

SEQ ID NO: 4149074 - DNA, 16 bp, Homo sapiens
gttaattaatgtcatg

SEQ ID NO: 4149075 - DNA, 20 bp, Homo sapiens
gttaattaatgtcatgttgc

SEQ ID NO: 4149076 - DNA, 18 bp, Homo sapiens
gttaattcagcactgatt

SEQ ID NO: 4149077 - DNA, 21 bp, Homo sapiens
gttaatttatctaaattaaag

SEQ ID NO: 4149078 - DNA, 14 bp, Homo sapiens
gttaatttttccta

SEQ ID NO: 4149079 - DNA, 9 bp, Homo sapiens
gttacaaac

SEQ ID NO: 4149080 - DNA, 15 bp, Homo sapiens
gttacaaactgcaat

SEQ ID NO: 4149081 - DNA, 21 bp, Homo sapiens
gttacacactttttaagaaat

SEQ ID NO: 4149082 - DNA, 22 bp, Homo sapiens
gttacacagaaatgctgctggc

SEQ ID NO: 4149083 - DNA, 13 bp, Homo sapiens
gttacagagacct

SEQ ID NO: 4149084 - DNA, 17 bp, Homo sapiens
gttacagagacctatgt

SEQ ID NO: 4149085 - DNA, 16 bp, Homo sapiens
gttacagccaagtgcc

SEQ ID NO: 4149086 - DNA, 18 bp, Homo sapiens
gttacagcctgttagtaa

SEQ ID NO: 4149087 - DNA, 15 bp, Homo sapiens
gttacagcttcgctg

SEQ ID NO: 4149088 - DNA, 22 bp, Homo sapiens
gttacagggaagtggtctcccc

SEQ ID NO: 4149089 - DNA, 19 bp, Homo sapiens
gttacataagataaatgtg

SEQ ID NO: 4149090 - DNA, 13 bp, Homo sapiens
gttacattaatgt

SEQ ID NO: 4149091 - DNA, 18 bp, Homo sapiens
gttaccatgtcactgtgg

SEQ ID NO: 4149092 - DNA, 16 bp, Homo sapiens
gttaccatttacatgt

SEQ ID NO: 4149093 - DNA, 13 bp, Homo sapiens
gttacccagagaa

SEQ ID NO: 4149094 - DNA, 15 bp, Homo sapiens
gttacccaggctgga

SEQ ID NO: 4149095 - DNA, 20 bp, Homo sapiens
gttacctaaagtatttttat

SEQ ID NO: 4149096 - DNA, 22 bp, Homo sapiens
gttacctccaacagaactaaat

SEQ ID NO: 4149097 - DNA, 23 bp, Homo sapiens
gttacctccaacagaactaaatg

SEQ ID NO: 4149098 - DNA, 13 bp, Homo sapiens
gttacctgtgtgc

SEQ ID NO: 4149099 - DNA, 20 bp, Homo sapiens
gttactaggtaacttcatat

SEQ ID NO: 4149100 - DNA, 12 bp, Homo sapiens
gttactattttc

SEQ ID NO: 4149101 - DNA, 20 bp, Homo sapiens
gttactcagggttcatctgt

SEQ ID NO: 4149102 - DNA, 18 bp, Homo sapiens
gttactgatcatgcattg

SEQ ID NO: 4149103 - DNA, 19 bp, Homo sapiens
gttactgatcatgcattgt

SEQ ID NO: 4149104 - DNA, 13 bp, Homo sapiens
gttacttcctatc

SEQ ID NO: 4149105 - DNA, 13 bp, Homo sapiens
gttacttccttat

SEQ ID NO: 4149106 - DNA, 14 bp, Homo sapiens
gttacttcttctct

SEQ ID NO: 4149107 - DNA, 20 bp, Homo sapiens
gttactttccaattctcctt

SEQ ID NO: 4149108 - DNA, 21 bp, Homo sapiens
gttactttccaattctccttt

SEQ ID NO: 4149109 - DNA, 13 bp, Homo sapiens
gttactttgtaat

SEQ ID NO: 4149110 - DNA, 22 bp, Homo sapiens
gttagaaaatgacttatttctg

SEQ ID NO: 4149111 - DNA, 13 bp, Homo sapiens
gttagcagacagg

SEQ ID NO: 4149112 - DNA, 21 bp, Homo sapiens
gttagtagcatgttgagccag

SEQ ID NO: 4149113 - DNA, 19 bp, Homo sapiens
gttagtattttaatcctgt

SEQ ID NO: 4149114 - DNA, 12 bp, Homo sapiens
gttagtcatttg

SEQ ID NO: 4149115 - DNA, 15 bp, Homo sapiens
gttataaaaaatggt

SEQ ID NO: 4149116 - DNA, 20 bp, Homo sapiens
gttataaatagccttcaaaa

SEQ ID NO: 4149117 - DNA, 23 bp, Homo sapiens
gttataattttttttaaaataga

SEQ ID NO: 4149118 - DNA, 19 bp, Homo sapiens
gttatactgtcggtttttt

SEQ ID NO: 4149119 - DNA, 16 bp, Homo sapiens
gttatatatctctttt

SEQ ID NO: 4149120 - DNA, 14 bp, Homo sapiens
gttatatcaacaga

SEQ ID NO: 4149121 - DNA, 16 bp, Homo sapiens
gttatatcatatgtat

SEQ ID NO: 4149122 - DNA, 23 bp, Homo sapiens
gttatcaaacttcagctgtactt

SEQ ID NO: 4149123 - DNA, 15 bp, Homo sapiens
gttatcgaaataaca

SEQ ID NO: 4149124 - DNA, 15 bp, Homo sapiens
gttatctaaaagaaa

SEQ ID NO: 4149125 - DNA, 13 bp, Homo sapiens
gttatgaatcagt

SEQ ID NO: 4149126 - DNA, 22 bp, Homo sapiens
gttatgtactagtgttctgttt

SEQ ID NO: 4149127 - DNA, 11 bp, Homo sapiens
gttatgtatga

SEQ ID NO: 4149128 - DNA, 20 bp, Homo sapiens
gttatgtatgaaggaatcat

SEQ ID NO: 4149129 - DNA, 13 bp, Homo sapiens
gttattataaatg

SEQ ID NO: 4149130 - DNA, 15 bp, Homo sapiens
gttattataaatgtt

SEQ ID NO: 4149131 - DNA, 17 bp, Homo sapiens
gttattataaatgttag

SEQ ID NO: 4149132 - DNA, 13 bp, Homo sapiens
gttattccatcaa

SEQ ID NO: 4149133 - DNA, 13 bp, Homo sapiens
gttatttaaagaa

SEQ ID NO: 4149134 - DNA, 20 bp, Homo sapiens
gttatttatacaagattgaa

SEQ ID NO: 4149135 - DNA, 13 bp, Homo sapiens
gttatttcttccc

SEQ ID NO: 4149136 - DNA, 22 bp, Homo sapiens
gttatttcttccctgctttgca

SEQ ID NO: 4149137 - DNA, 15 bp, Homo sapiens
gttattttctacagt

SEQ ID NO: 4149138 - DNA, 14 bp, Homo sapiens
gttattttggatat

SEQ ID NO: 4149139 - DNA, 23 bp, Homo sapiens
gttatttttatatcagcctgagt

SEQ ID NO: 4149140 - DNA, 23 bp, Homo sapiens
gttatttttatttatttaaattt

SEQ ID NO: 4149141 - DNA, 21 bp, Homo sapiens
gttattttttaattattattt

SEQ ID NO: 4149142 - DNA, 16 bp, Homo sapiens
gttcaaacaatatcat

SEQ ID NO: 4149143 - DNA, 13 bp, Homo sapiens
gttcaattagaat

SEQ ID NO: 4149144 - DNA, 14 bp, Homo sapiens
gttcacagaaaaag

SEQ ID NO: 4149145 - DNA, 17 bp, Homo sapiens
gttcacagaaaaagcat

SEQ ID NO: 4149146 - DNA, 19 bp, Homo sapiens
gttcacatagtgaaataaa

SEQ ID NO: 4149147 - DNA, 16 bp, Homo sapiens
gttcacattagaatta

SEQ ID NO: 4149148 - DNA, 19 bp, Homo sapiens
gttcacccatcttatcaag

SEQ ID NO: 4149149 - DNA, 18 bp, Homo sapiens
gttcacgctcacccagtc

SEQ ID NO: 4149150 - DNA, 21 bp, Homo sapiens
gttcacgtaagatacaagttt

SEQ ID NO: 4149151 - DNA, 24 bp, Homo sapiens
gttcactctacttagcatgtccct

SEQ ID NO: 4149152 - DNA, 20 bp, Homo sapiens
gttcagaattaaacttttaa

SEQ ID NO: 4149153 - DNA, 22 bp, Homo sapiens
gttcagaatttagtgtatccat

SEQ ID NO: 4149154 - DNA, 15 bp, Homo sapiens
gttcagacccctgcc

SEQ ID NO: 4149155 - DNA, 17 bp, Homo sapiens
gttcagacccctgcctg

SEQ ID NO: 4149156 - DNA, 16 bp, Homo sapiens
gttcagcaccacccta

SEQ ID NO: 4149157 - DNA, 17 bp, Homo sapiens
gttcagcaccaccctag

SEQ ID NO: 4149158 - DNA, 15 bp, Homo sapiens
gttcagcactgtccc

SEQ ID NO: 4149159 - DNA, 14 bp, Homo sapiens
gttcagcctggcct

SEQ ID NO: 4149160 - DNA, 18 bp, Homo sapiens
gttcagcctggcctgccc

SEQ ID NO: 4149161 - DNA, 23 bp, Homo sapiens
gttcagctcccccaggctgttct

SEQ ID NO: 4149162 - DNA, 15 bp, Homo sapiens
gttcaggagtcccaa

SEQ ID NO: 4149163 - DNA, 15 bp, Homo sapiens
gttcaggggactcag

SEQ ID NO: 4149164 - DNA, 19 bp, Homo sapiens
gttcaggggactcagccct

SEQ ID NO: 4149165 - DNA, 12 bp, Homo sapiens
gttcataaatga

SEQ ID NO: 4149166 - DNA, 13 bp, Homo sapiens
gttcataaccaac

SEQ ID NO: 4149167 - DNA, 19 bp, Homo sapiens
gttcatatgtaccatgtac

SEQ ID NO: 4149168 - DNA, 22 bp, Homo sapiens
gttcatatgtaccatgtacatg

SEQ ID NO: 4149169 - DNA, 17 bp, Homo sapiens
gttcatcatcctaagct

SEQ ID NO: 4149170 - DNA, 18 bp, Homo sapiens
gttcatccaatcctcact

SEQ ID NO: 4149171 - DNA, 20 bp, Homo sapiens
gttcatccaatcctcactgg

SEQ ID NO: 4149172 - DNA, 19 bp, Homo sapiens
gttcatcccttctcttcca

SEQ ID NO: 4149173 - DNA, 20 bp, Homo sapiens
gttcatctgagcaagagctg

SEQ ID NO: 4149174 - DNA, 21 bp, Homo sapiens
gttcatctgtccatggccttt

SEQ ID NO: 4149175 - DNA, 16 bp, Homo sapiens
gttcatgccaccatgg

SEQ ID NO: 4149176 - DNA, 12 bp, Homo sapiens
gttcatgtagag

SEQ ID NO: 4149177 - DNA, 19 bp, Homo sapiens
gttcatgtagagaaaagca

SEQ ID NO: 4149178 - DNA, 16 bp, Homo sapiens
gttcatgtgcctctgc

SEQ ID NO: 4149179 - DNA, 24 bp, Homo sapiens
gttcatgtttgcttcataaatgaa

SEQ ID NO: 4149180 - DNA, 16 bp, Homo sapiens
gttcattaaagcatga

SEQ ID NO: 4149181 - DNA, 18 bp, Homo sapiens
gttcattattttgtggtt

SEQ ID NO: 4149182 - DNA, 20 bp, Homo sapiens
gttcattgtaatgttactga

SEQ ID NO: 4149183 - DNA, 15 bp, Homo sapiens
gttccaaagccagtg

SEQ ID NO: 4149184 - DNA, 13 bp, Homo sapiens
gttccaagacatt

SEQ ID NO: 4149185 - DNA, 16 bp, Homo sapiens
gttccaagacattgtc

SEQ ID NO: 4149186 - DNA, 19 bp, Homo sapiens
gttccaagacattgtcaat

SEQ ID NO: 4149187 - DNA, 19 bp, Homo sapiens
gttccagaggtattcctct

SEQ ID NO: 4149188 - DNA, 12 bp, Homo sapiens
gttccagctctt

SEQ ID NO: 4149189 - DNA, 23 bp, Homo sapiens
gttccaggcctgatcttgcctgt

SEQ ID NO: 4149190 - DNA, 21 bp, Homo sapiens
gttccattgaagccgactctg

SEQ ID NO: 4149191 - DNA, 14 bp, Homo sapiens
gttcccaataaaag

SEQ ID NO: 4149192 - DNA, 14 bp, Homo sapiens
gttcccacttggag

SEQ ID NO: 4149193 - DNA, 11 bp, Homo sapiens
gttcccagcag

SEQ ID NO: 4149194 - DNA, 22 bp, Homo sapiens
gttcccagtgacacttcagaga

SEQ ID NO: 4149195 - DNA, 19 bp, Homo sapiens
gttccccatctgggtcctt

SEQ ID NO: 4149196 - DNA, 13 bp, Homo sapiens
gttcccctcactg

SEQ ID NO: 4149197 - DNA, 14 bp, Homo sapiens
gttccctctgagaa

SEQ ID NO: 4149198 - DNA, 22 bp, Homo sapiens
gttccctctgagaattccaagg

SEQ ID NO: 4149199 - DNA, 15 bp, Homo sapiens
gttccctgttcttcc

SEQ ID NO: 4149200 - DNA, 17 bp, Homo sapiens
gttccctgttcttcctc

SEQ ID NO: 4149201 - DNA, 18 bp, Homo sapiens
gttccctgttcttcctcc

SEQ ID NO: 4149202 - DNA, 12 bp, Homo sapiens
gttcccttggcc

SEQ ID NO: 4149203 - DNA, 13 bp, Homo sapiens
gttcccttggcct

SEQ ID NO: 4149204 - DNA, 22 bp, Homo sapiens
gttccctttccttccatcccta

SEQ ID NO: 4149205 - DNA, 17 bp, Homo sapiens
gttcctaacaggatgaa

SEQ ID NO: 4149206 - DNA, 17 bp, Homo sapiens
gttcctactcacacttc

SEQ ID NO: 4149207 - DNA, 14 bp, Homo sapiens
gttcctattgtcat

SEQ ID NO: 4149208 - DNA, 15 bp, Homo sapiens
gttcctctgcctgcc

SEQ ID NO: 4149209 - DNA, 13 bp, Homo sapiens
gttcctctgctca

SEQ ID NO: 4149210 - DNA, 16 bp, Homo sapiens
gttcctggagttttga

SEQ ID NO: 4149211 - DNA, 13 bp, Homo sapiens
gttcctggcaata

SEQ ID NO: 4149212 - DNA, 12 bp, Homo sapiens
gttcctggctga

SEQ ID NO: 4149213 - DNA, 15 bp, Homo sapiens
gttcctggctgatga

SEQ ID NO: 4149214 - DNA, 23 bp, Homo sapiens
gttccttcatttccaccaggccg

SEQ ID NO: 4149215 - DNA, 19 bp, Homo sapiens
gttccttcctatgcccagg

SEQ ID NO: 4149216 - DNA, 14 bp, Homo sapiens
gttccttctctggg

SEQ ID NO: 4149217 - DNA, 17 bp, Homo sapiens
gttcgatacctggagca

SEQ ID NO: 4149218 - DNA, 19 bp, Homo sapiens
gttcgcaccattctcctgc

SEQ ID NO: 4149219 - DNA, 16 bp, Homo sapiens
gttctacactcatctt

SEQ ID NO: 4149220 - DNA, 13 bp, Homo sapiens
gttctagaaccac

SEQ ID NO: 4149221 - DNA, 21 bp, Homo sapiens
gttctagaaccacttcctgct

SEQ ID NO: 4149222 - DNA, 22 bp, Homo sapiens
gttctaggggagaagagccctg

SEQ ID NO: 4149223 - DNA, 21 bp, Homo sapiens
gttctagtctcctttgcactg

SEQ ID NO: 4149224 - DNA, 14 bp, Homo sapiens
gttctagtttttta

SEQ ID NO: 4149225 - DNA, 17 bp, Homo sapiens
gttctatggttatgaaa

SEQ ID NO: 4149226 - DNA, 15 bp, Homo sapiens
gttctattttacttt

SEQ ID NO: 4149227 - DNA, 17 bp, Homo sapiens
gttctattttcttaaac

SEQ ID NO: 4149228 - DNA, 21 bp, Homo sapiens
gttctcactcctaggagagcc

SEQ ID NO: 4149229 - DNA, 12 bp, Homo sapiens
gttctcactgtt

SEQ ID NO: 4149230 - DNA, 19 bp, Homo sapiens
gttctcactgttccctctg

SEQ ID NO: 4149231 - DNA, 23 bp, Homo sapiens
gttctcatttggtctgccagaat

SEQ ID NO: 4149232 - DNA, 19 bp, Homo sapiens
gttctccagaatgtaagaa

SEQ ID NO: 4149233 - DNA, 19 bp, Homo sapiens
gttctccaggcttcacagt

SEQ ID NO: 4149234 - DNA, 20 bp, Homo sapiens
gttctccctcccaccttaaa

SEQ ID NO: 4149235 - DNA, 20 bp, Homo sapiens
gttctccctgtacagtgtta

SEQ ID NO: 4149236 - DNA, 18 bp, Homo sapiens
gttctccgggtgtggcct

SEQ ID NO: 4149237 - DNA, 23 bp, Homo sapiens
gttctccgggtgtggcctcagcc

SEQ ID NO: 4149238 - DNA, 18 bp, Homo sapiens
gttctccttttcctctct

SEQ ID NO: 4149239 - DNA, 22 bp, Homo sapiens
gttctccttttcctctctcccg

SEQ ID NO: 4149240 - DNA, 13 bp, Homo sapiens
gttctgagaccag

SEQ ID NO: 4149241 - DNA, 23 bp, Homo sapiens
gttctgagtagagcttgtaataa

SEQ ID NO: 4149242 - DNA, 14 bp, Homo sapiens
gttctgagtgtttt

SEQ ID NO: 4149243 - DNA, 13 bp, Homo sapiens
gttctgattagaa

SEQ ID NO: 4149244 - DNA, 16 bp, Homo sapiens
gttctgattagaaatg

SEQ ID NO: 4149245 - DNA, 15 bp, Homo sapiens
gttctgcctgccagc

SEQ ID NO: 4149246 - DNA, 17 bp, Homo sapiens
gttctgcctgccagctg

SEQ ID NO: 4149247 - DNA, 19 bp, Homo sapiens
gttctgcctgccagctgca

SEQ ID NO: 4149248 - DNA, 13 bp, Homo sapiens
gttctgctcctgc

SEQ ID NO: 4149249 - DNA, 14 bp, Homo sapiens
gttctgctggcctg

SEQ ID NO: 4149250 - DNA, 23 bp, Homo sapiens
gttctgcttcaaggcttccactg

SEQ ID NO: 4149251 - DNA, 12 bp, Homo sapiens
gttctggccaga

SEQ ID NO: 4149252 - DNA, 16 bp, Homo sapiens
gttctggccagaatgc

SEQ ID NO: 4149253 - DNA, 14 bp, Homo sapiens
gttctgggctcagg

SEQ ID NO: 4149254 - DNA, 14 bp, Homo sapiens
gttctgggctcttt

SEQ ID NO: 4149255 - DNA, 18 bp, Homo sapiens
gttctgggctctttcctc

SEQ ID NO: 4149256 - DNA, 17 bp, Homo sapiens
gttctggtcctttttgg

SEQ ID NO: 4149257 - DNA, 11 bp, Homo sapiens
gttctgtgcac

SEQ ID NO: 4149258 - DNA, 13 bp, Homo sapiens
gttctgtgtcttt

SEQ ID NO: 4149259 - DNA, 15 bp, Homo sapiens
gttctgttctgctgg

SEQ ID NO: 4149260 - DNA, 16 bp, Homo sapiens
gttctgttctggggga

SEQ ID NO: 4149261 - DNA, 17 bp, Homo sapiens
gttcttagttctcactg

SEQ ID NO: 4149262 - DNA, 14 bp, Homo sapiens
gttcttatagaata

SEQ ID NO: 4149263 - DNA, 15 bp, Homo sapiens
gttcttatagaataa

SEQ ID NO: 4149264 - DNA, 22 bp, Homo sapiens
gttcttattaccctgattgaat

SEQ ID NO: 4149265 - DNA, 22 bp, Homo sapiens
gttcttattttgcattccagaa

SEQ ID NO: 4149266 - DNA, 23 bp, Homo sapiens
gttcttattttgcattccagaat

SEQ ID NO: 4149267 - DNA, 18 bp, Homo sapiens
gttcttcacctctatcca

SEQ ID NO: 4149268 - DNA, 15 bp, Homo sapiens
gttcttccaaagcag

SEQ ID NO: 4149269 - DNA, 15 bp, Homo sapiens
gttctttaggagatt

SEQ ID NO: 4149270 - DNA, 11 bp, Homo sapiens
gttctttggaa

SEQ ID NO: 4149271 - DNA, 12 bp, Homo sapiens
gttctttgtgta

SEQ ID NO: 4149272 - DNA, 20 bp, Homo sapiens
gttgaaaggttttttttcag

SEQ ID NO: 4149273 - DNA, 20 bp, Homo sapiens
gttgaaattatgtatgttta

SEQ ID NO: 4149274 - DNA, 15 bp, Homo sapiens
gttgaactttgccaa

SEQ ID NO: 4149275 - DNA, 18 bp, Homo sapiens
gttgacaacctagaatgt

SEQ ID NO: 4149276 - DNA, 16 bp, Homo sapiens
gttgacaactgtgact

SEQ ID NO: 4149277 - DNA, 12 bp, Homo sapiens
gttgacagcagg

SEQ ID NO: 4149278 - DNA, 19 bp, Homo sapiens
gttgacttatagtacatga

SEQ ID NO: 4149279 - DNA, 20 bp, Homo sapiens
gttgacttattttctctgtg

SEQ ID NO: 4149280 - DNA, 21 bp, Homo sapiens
gttgacttattttctctgtgt

SEQ ID NO: 4149281 - DNA, 22 bp, Homo sapiens
gttgacttccaggcacggtttg

SEQ ID NO: 4149282 - DNA, 12 bp, Homo sapiens
gttgagaaatga

SEQ ID NO: 4149283 - DNA, 12 bp, Homo sapiens
gttgagagccag

SEQ ID NO: 4149284 - DNA, 14 bp, Homo sapiens
gttgagaggacact

SEQ ID NO: 4149285 - DNA, 14 bp, Homo sapiens
gttgagccttttcc

SEQ ID NO: 4149286 - DNA, 20 bp, Homo sapiens
gttgaggaaagcacagaggc

SEQ ID NO: 4149287 - DNA, 16 bp, Homo sapiens
gttgaggtggtctgaa

SEQ ID NO: 4149288 - DNA, 20 bp, Homo sapiens
gttgatcactggcaatgaaa

SEQ ID NO: 4149289 - DNA, 22 bp, Homo sapiens
gttgatctggaacccagactca

SEQ ID NO: 4149290 - DNA, 17 bp, Homo sapiens
gttgatgggttctaatt

SEQ ID NO: 4149291 - DNA, 13 bp, Homo sapiens
gttgattctctcc

SEQ ID NO: 4149292 - DNA, 23 bp, Homo sapiens
gttgatttttttttttttttcct

SEQ ID NO: 4149293 - DNA, 14 bp, Homo sapiens
gttgcaaccactgc

SEQ ID NO: 4149294 - DNA, 15 bp, Homo sapiens
gttgcaagatgtgaa

SEQ ID NO: 4149295 - DNA, 19 bp, Homo sapiens
gttgcacatgattgtataa

SEQ ID NO: 4149296 - DNA, 22 bp, Homo sapiens
gttgcacatgattgtataagca

SEQ ID NO: 4149297 - DNA, 17 bp, Homo sapiens
gttgcagatgaaatgtt

SEQ ID NO: 4149298 - DNA, 16 bp, Homo sapiens
gttgcagatgtattga

SEQ ID NO: 4149299 - DNA, 21 bp, Homo sapiens
gttgcagcatgagactttctg

SEQ ID NO: 4149300 - DNA, 19 bp, Homo sapiens
gttgcatactgagccaagt

SEQ ID NO: 4149301 - DNA, 22 bp, Homo sapiens
gttgcattagtaactttgaaag

SEQ ID NO: 4149302 - DNA, 18 bp, Homo sapiens
gttgcattcctttgtctt

SEQ ID NO: 4149303 - DNA, 16 bp, Homo sapiens
gttgcatttccagctg

SEQ ID NO: 4149304 - DNA, 16 bp, Homo sapiens
gttgccaaagctggtc

SEQ ID NO: 4149305 - DNA, 20 bp, Homo sapiens
gttgccaccacctctgtggc

SEQ ID NO: 4149306 - DNA, 21 bp, Homo sapiens
gttgccaccacctctgtggca

SEQ ID NO: 4149307 - DNA, 22 bp, Homo sapiens
gttgcccagcctctttcccttc

SEQ ID NO: 4149308 - DNA, 20 bp, Homo sapiens
gttgcggatggatggaaggt

SEQ ID NO: 4149309 - DNA, 19 bp, Homo sapiens
gttgctgaaacttgctgag

SEQ ID NO: 4149310 - DNA, 15 bp, Homo sapiens
gttgctgtttcacaa

SEQ ID NO: 4149311 - DNA, 21 bp, Homo sapiens
gttgcttctcaggctatatgc

SEQ ID NO: 4149312 - DNA, 17 bp, Homo sapiens
gttgcttgaaattactg

SEQ ID NO: 4149313 - DNA, 23 bp, Homo sapiens
gttggaaccgtgtccagcacaga

SEQ ID NO: 4149314 - DNA, 15 bp, Homo sapiens
gttggaagaggaaca

SEQ ID NO: 4149315 - DNA, 18 bp, Homo sapiens
gttggaaggggccttgct

SEQ ID NO: 4149316 - DNA, 22 bp, Homo sapiens
gttggaaggggccttgctgagt

SEQ ID NO: 4149317 - DNA, 22 bp, Homo sapiens
gttggatggatgggtggatggc

SEQ ID NO: 4149318 - DNA, 15 bp, Homo sapiens
gttggcaacaggaca

SEQ ID NO: 4149319 - DNA, 16 bp, Homo sapiens
gttggcaacaggacag

SEQ ID NO: 4149320 - DNA, 15 bp, Homo sapiens
gttggcaccccagct

SEQ ID NO: 4149321 - DNA, 12 bp, Homo sapiens
gttggcacctgc

SEQ ID NO: 4149322 - DNA, 15 bp, Homo sapiens
gttggcagcccactg

SEQ ID NO: 4149323 - DNA, 15 bp, Homo sapiens
gttgggagcctagct

SEQ ID NO: 4149324 - DNA, 19 bp, Homo sapiens
gttgggggggaccctgcct

SEQ ID NO: 4149325 - DNA, 14 bp, Homo sapiens
gttggggtgacagt

SEQ ID NO: 4149326 - DNA, 19 bp, Homo sapiens
gttggggtgacagtcatca

SEQ ID NO: 4149327 - DNA, 13 bp, Homo sapiens
gttggtagtttct

SEQ ID NO: 4149328 - DNA, 20 bp, Homo sapiens
gttgtaaatatttatgtaaa

SEQ ID NO: 4149329 - DNA, 17 bp, Homo sapiens
gttgtaacctgctgtga

SEQ ID NO: 4149330 - DNA, 13 bp, Homo sapiens
gttgtaactaggc

SEQ ID NO: 4149331 - DNA, 15 bp, Homo sapiens
gttgtaacttatatt

SEQ ID NO: 4149332 - DNA, 17 bp, Homo sapiens
gttgtacaaatgtattt

SEQ ID NO: 4149333 - DNA, 18 bp, Homo sapiens
gttgtacatttatgattt

SEQ ID NO: 4149334 - DNA, 12 bp, Homo sapiens
gttgtataattt

SEQ ID NO: 4149335 - DNA, 16 bp, Homo sapiens
gttgtcaatattaaat

SEQ ID NO: 4149336 - DNA, 17 bp, Homo sapiens
gttgtcaatattaaata

SEQ ID NO: 4149337 - DNA, 23 bp, Homo sapiens
gttgtcaatattaaatacagaca

SEQ ID NO: 4149338 - DNA, 20 bp, Homo sapiens
gttgtcattgctgttgtccc

SEQ ID NO: 4149339 - DNA, 19 bp, Homo sapiens
gttgtcctatggacaactt

SEQ ID NO: 4149340 - DNA, 17 bp, Homo sapiens
gttgtcgtaaagatttg

SEQ ID NO: 4149341 - DNA, 22 bp, Homo sapiens
gttgtctgaagtcactgcacag

SEQ ID NO: 4149342 - DNA, 14 bp, Homo sapiens
gttgtcttattgca

SEQ ID NO: 4149343 - DNA, 22 bp, Homo sapiens
gttgtgactctaagctcagtgc

SEQ ID NO: 4149344 - DNA, 20 bp, Homo sapiens
gttgtgagtttaccttgtat

SEQ ID NO: 4149345 - DNA, 16 bp, Homo sapiens
gttgtgatcttgcatt

SEQ ID NO: 4149346 - DNA, 14 bp, Homo sapiens
gttgtgtatagatg

SEQ ID NO: 4149347 - DNA, 12 bp, Homo sapiens
gttgtgtctttt

SEQ ID NO: 4149348 - DNA, 17 bp, Homo sapiens
gttgttaatgaaaatgt

SEQ ID NO: 4149349 - DNA, 10 bp, Homo sapiens
gttgttcttt

SEQ ID NO: 4149350 - DNA, 14 bp, Homo sapiens
gttgttgcatgttt

SEQ ID NO: 4149351 - DNA, 17 bp, Homo sapiens
gttgtttctgttccaaa

SEQ ID NO: 4149352 - DNA, 11 bp, Homo sapiens
gttgtttcttt

SEQ ID NO: 4149353 - DNA, 14 bp, Homo sapiens
gttgtttctttcta

SEQ ID NO: 4149354 - DNA, 15 bp, Homo sapiens
gttgtttctttctag

SEQ ID NO: 4149355 - DNA, 15 bp, Homo sapiens
gttgtttgtaaataa

SEQ ID NO: 4149356 - DNA, 23 bp, Homo sapiens
gtttaaaaagtaagttaataatg

SEQ ID NO: 4149357 - DNA, 19 bp, Homo sapiens
gtttaaaacagtatttatt

SEQ ID NO: 4149358 - DNA, 22 bp, Homo sapiens
gtttaaaataaaatgaaaattg

SEQ ID NO: 4149359 - DNA, 16 bp, Homo sapiens
gtttaaagagaggtta

SEQ ID NO: 4149360 - DNA, 13 bp, Homo sapiens
gtttaaagttgca

SEQ ID NO: 4149361 - DNA, 23 bp, Homo sapiens
gtttaagaaaaaataacacacat

SEQ ID NO: 4149362 - DNA, 22 bp, Homo sapiens
gtttaagaaaagtattttgaag

SEQ ID NO: 4149363 - DNA, 14 bp, Homo sapiens
gtttaatctgttat

SEQ ID NO: 4149364 - DNA, 15 bp, Homo sapiens
gtttaattgtttgtc

SEQ ID NO: 4149365 - DNA, 16 bp, Homo sapiens
gtttacactctttgta

SEQ ID NO: 4149366 - DNA, 18 bp, Homo sapiens
gtttacaggccctgctcc

SEQ ID NO: 4149367 - DNA, 17 bp, Homo sapiens
gtttacaggtggacaca

SEQ ID NO: 4149368 - DNA, 11 bp, Homo sapiens
gtttacatgta

SEQ ID NO: 4149369 - DNA, 22 bp, Homo sapiens
gtttacatgtgtagcctatgtt

SEQ ID NO: 4149370 - DNA, 17 bp, Homo sapiens
gtttacatttaaagcat

SEQ ID NO: 4149371 - DNA, 18 bp, Homo sapiens
gtttacatttaaagcatt

SEQ ID NO: 4149372 - DNA, 23 bp, Homo sapiens
gtttacatttaaagcattgctgt

SEQ ID NO: 4149373 - DNA, 12 bp, Homo sapiens
gtttacattttt

SEQ ID NO: 4149374 - DNA, 20 bp, Homo sapiens
gtttacatttttatttatga

SEQ ID NO: 4149375 - DNA, 23 bp, Homo sapiens
gtttacatttttatttatgaagt

SEQ ID NO: 4149376 - DNA, 15 bp, Homo sapiens
gtttaccagttgcct

SEQ ID NO: 4149377 - DNA, 12 bp, Homo sapiens
gtttaccttgta

SEQ ID NO: 4149378 - DNA, 22 bp, Homo sapiens
gtttactatgtgccagttcctg

SEQ ID NO: 4149379 - DNA, 23 bp, Homo sapiens
gtttactgttttgaaatcaatgc

SEQ ID NO: 4149380 - DNA, 17 bp, Homo sapiens
gtttacttttcagggca

SEQ ID NO: 4149381 - DNA, 15 bp, Homo sapiens
gtttagcagaactca

SEQ ID NO: 4149382 - DNA, 15 bp, Homo sapiens
gtttaggtgaattaa

SEQ ID NO: 4149383 - DNA, 16 bp, Homo sapiens
gtttataatctgaaga

SEQ ID NO: 4149384 - DNA, 20 bp, Homo sapiens
gtttatagcaaacttggaat

SEQ ID NO: 4149385 - DNA, 16 bp, Homo sapiens
gtttatcagatacatc

SEQ ID NO: 4149386 - DNA, 18 bp, Homo sapiens
gtttatcagatacatcac

SEQ ID NO: 4149387 - DNA, 22 bp, Homo sapiens
gtttatcgccctggcaggcagg

SEQ ID NO: 4149388 - DNA, 21 bp, Homo sapiens
gtttatgagatgctggttttc

SEQ ID NO: 4149389 - DNA, 14 bp, Homo sapiens
gtttatggcagaag

SEQ ID NO: 4149390 - DNA, 16 bp, Homo sapiens
gtttatggcagaaggg

SEQ ID NO: 4149391 - DNA, 18 bp, Homo sapiens
gtttatggccacatttaa

SEQ ID NO: 4149392 - DNA, 13 bp, Homo sapiens
gtttatggcctca

SEQ ID NO: 4149393 - DNA, 14 bp, Homo sapiens
gtttatggcctcag

SEQ ID NO: 4149394 - DNA, 18 bp, Homo sapiens
gtttatggcctcagctgc

SEQ ID NO: 4149395 - DNA, 15 bp, Homo sapiens
gtttatgttcttata

SEQ ID NO: 4149396 - DNA, 22 bp, Homo sapiens
gtttattaatgcctctcccgca

SEQ ID NO: 4149397 - DNA, 18 bp, Homo sapiens
gtttattataaactgtat

SEQ ID NO: 4149398 - DNA, 20 bp, Homo sapiens
gtttattcatccagcagtgt

SEQ ID NO: 4149399 - DNA, 20 bp, Homo sapiens
gtttattccagagctgccag

SEQ ID NO: 4149400 - DNA, 17 bp, Homo sapiens
gtttattcttccagaat

SEQ ID NO: 4149401 - DNA, 19 bp, Homo sapiens
gtttattcttccagaatgc

SEQ ID NO: 4149402 - DNA, 16 bp, Homo sapiens
gtttatttcacttgat

SEQ ID NO: 4149403 - DNA, 16 bp, Homo sapiens
gtttatttttgtaatg

SEQ ID NO: 4149404 - DNA, 22 bp, Homo sapiens
gtttcagacagggtctgaagga

SEQ ID NO: 4149405 - DNA, 16 bp, Homo sapiens
gtttcaggtgacatgt

SEQ ID NO: 4149406 - DNA, 17 bp, Homo sapiens
gtttcatccttcccact

SEQ ID NO: 4149407 - DNA, 19 bp, Homo sapiens
gtttcattctcctgcctgt

SEQ ID NO: 4149408 - DNA, 20 bp, Homo sapiens
gtttcattgcgaatcttttt

SEQ ID NO: 4149409 - DNA, 20 bp, Homo sapiens
gtttcatttagtcatgtgac

SEQ ID NO: 4149410 - DNA, 21 bp, Homo sapiens
gtttcatttagtcatgtgacc

SEQ ID NO: 4149411 - DNA, 22 bp, Homo sapiens
gtttccacgatgaaaaacttcc

SEQ ID NO: 4149412 - DNA, 21 bp, Homo sapiens
gtttccatagcaacaggaaaa

SEQ ID NO: 4149413 - DNA, 13 bp, Homo sapiens
gtttcccctctgg

SEQ ID NO: 4149414 - DNA, 18 bp, Homo sapiens
gtttcccttgctttgttt

SEQ ID NO: 4149415 - DNA, 20 bp, Homo sapiens
gtttccttgttggtcagagg

SEQ ID NO: 4149416 - DNA, 13 bp, Homo sapiens
gtttctaaaacta

SEQ ID NO: 4149417 - DNA, 18 bp, Homo sapiens
gtttctaataaacttgga

SEQ ID NO: 4149418 - DNA, 23 bp, Homo sapiens
gtttctagctagaaatatgattt

SEQ ID NO: 4149419 - DNA, 18 bp, Homo sapiens
gtttctatgcaaagttct

SEQ ID NO: 4149420 - DNA, 14 bp, Homo sapiens
gtttctattctgtc

SEQ ID NO: 4149421 - DNA, 20 bp, Homo sapiens
gtttctccaagtacttttgt

SEQ ID NO: 4149422 - DNA, 15 bp, Homo sapiens
gtttctctgctgttg

SEQ ID NO: 4149423 - DNA, 18 bp, Homo sapiens
gtttctgaaaatgtttaa

SEQ ID NO: 4149424 - DNA, 19 bp, Homo sapiens
gtttctgaaaattccagaa

SEQ ID NO: 4149425 - DNA, 20 bp, Homo sapiens
gtttctgcattcatttttat

SEQ ID NO: 4149426 - DNA, 23 bp, Homo sapiens
gtttctgggtcctgaagaattaa

SEQ ID NO: 4149427 - DNA, 13 bp, Homo sapiens
gtttctgttccaa

SEQ ID NO: 4149428 - DNA, 18 bp, Homo sapiens
gtttctgtttgattcttt

SEQ ID NO: 4149429 - DNA, 13 bp, Homo sapiens
gtttcttccaaag

SEQ ID NO: 4149430 - DNA, 23 bp, Homo sapiens
gtttctttctagtggtctttgta

SEQ ID NO: 4149431 - DNA, 17 bp, Homo sapiens
gtttctttgtgtttgct

SEQ ID NO: 4149432 - DNA, 22 bp, Homo sapiens
gtttcttttttctttcttcctt

SEQ ID NO: 4149433 - DNA, 23 bp, Homo sapiens
gtttcttttttctttcttccttt

SEQ ID NO: 4149434 - DNA, 20 bp, Homo sapiens
gtttgaaatgaggtctgttt

SEQ ID NO: 4149435 - DNA, 22 bp, Homo sapiens
gtttgaaatgaggtctgtttaa

SEQ ID NO: 4149436 - DNA, 14 bp, Homo sapiens
gtttgaatatggac

SEQ ID NO: 4149437 - DNA, 18 bp, Homo sapiens
gtttgactagatgatgga

SEQ ID NO: 4149438 - DNA, 18 bp, Homo sapiens
gtttgagctgccttccct

SEQ ID NO: 4149439 - DNA, 18 bp, Homo sapiens
gtttgagtttttcctccc

SEQ ID NO: 4149440 - DNA, 16 bp, Homo sapiens
gtttgattgaggagct

SEQ ID NO: 4149441 - DNA, 21 bp, Homo sapiens
gtttgatttgtcactgcttca

SEQ ID NO: 4149442 - DNA, 19 bp, Homo sapiens
gtttgccccgttctgtttg

SEQ ID NO: 4149443 - DNA, 19 bp, Homo sapiens
gtttgctcttttaagcagt

SEQ ID NO: 4149444 - DNA, 13 bp, Homo sapiens
gtttgcttaaaca

SEQ ID NO: 4149445 - DNA, 21 bp, Homo sapiens
gtttgcttaaacaaagtgact

SEQ ID NO: 4149446 - DNA, 17 bp, Homo sapiens
gtttgcttcataaatga

SEQ ID NO: 4149447 - DNA, 20 bp, Homo sapiens
gtttgctttgtatgcacttt

SEQ ID NO: 4149448 - DNA, 14 bp, Homo sapiens
gtttggacagctga

SEQ ID NO: 4149449 - DNA, 21 bp, Homo sapiens
gtttggatttcctttatactg

SEQ ID NO: 4149450 - DNA, 21 bp, Homo sapiens
gtttggcatggtgagtgttgg

SEQ ID NO: 4149451 - DNA, 16 bp, Homo sapiens
gtttggcttataaaca

SEQ ID NO: 4149452 - DNA, 18 bp, Homo sapiens
gtttggcttataaacaca

SEQ ID NO: 4149453 - DNA, 16 bp, Homo sapiens
gtttgggaaagatgga

SEQ ID NO: 4149454 - DNA, 20 bp, Homo sapiens
gtttggggagcagagacact

SEQ ID NO: 4149455 - DNA, 20 bp, Homo sapiens
gtttgggtaaaatactttta

SEQ ID NO: 4149456 - DNA, 15 bp, Homo sapiens
gtttggtttacattt

SEQ ID NO: 4149457 - DNA, 11 bp, Homo sapiens
gtttgtaaatt

SEQ ID NO: 4149458 - DNA, 17 bp, Homo sapiens
gtttgtaaattatttgc

SEQ ID NO: 4149459 - DNA, 18 bp, Homo sapiens
gtttgtaaattatttgct

SEQ ID NO: 4149460 - DNA, 14 bp, Homo sapiens
gtttgtctatttta

SEQ ID NO: 4149461 - DNA, 16 bp, Homo sapiens
gtttgtctgtttgttt

SEQ ID NO: 4149462 - DNA, 17 bp, Homo sapiens
gtttgtggcgtctccct

SEQ ID NO: 4149463 - DNA, 13 bp, Homo sapiens
gtttgtgtgtctt

SEQ ID NO: 4149464 - DNA, 14 bp, Homo sapiens
gtttgtgtgtctta

SEQ ID NO: 4149465 - DNA, 13 bp, Homo sapiens
gtttgttccctgt

SEQ ID NO: 4149466 - DNA, 22 bp, Homo sapiens
gtttgttctacatggctttgat

SEQ ID NO: 4149467 - DNA, 23 bp, Homo sapiens
gtttgttctccgggtgtggcctc

SEQ ID NO: 4149468 - DNA, 14 bp, Homo sapiens
gtttgttctgttct

SEQ ID NO: 4149469 - DNA, 15 bp, Homo sapiens
gtttgttctgttctg

SEQ ID NO: 4149470 - DNA, 17 bp, Homo sapiens
gtttgttctgttctggg

SEQ ID NO: 4149471 - DNA, 15 bp, Homo sapiens
gtttgtttctttgtg

SEQ ID NO: 4149472 - DNA, 15 bp, Homo sapiens
gtttgtttgtctgtt

SEQ ID NO: 4149473 - DNA, 13 bp, Homo sapiens
gtttgtttgttgc

SEQ ID NO: 4149474 - DNA, 16 bp, Homo sapiens
gtttgtttttgcttgt

SEQ ID NO: 4149475 - DNA, 16 bp, Homo sapiens
gtttgtttttgctttc

SEQ ID NO: 4149476 - DNA, 21 bp, Homo sapiens
gttttaaaataaaaattctga

SEQ ID NO: 4149477 - DNA, 19 bp, Homo sapiens
gttttaaacatagaaagtt

SEQ ID NO: 4149478 - DNA, 14 bp, Homo sapiens
gttttaaactcatt

SEQ ID NO: 4149479 - DNA, 16 bp, Homo sapiens
gttttaaactttcaat

SEQ ID NO: 4149480 - DNA, 16 bp, Homo sapiens
gttttaaattctgaga

SEQ ID NO: 4149481 - DNA, 20 bp, Homo sapiens
gttttaagcaaatgcattct

SEQ ID NO: 4149482 - DNA, 21 bp, Homo sapiens
gttttaatctgaaattctaaa

SEQ ID NO: 4149483 - DNA, 13 bp, Homo sapiens
gttttagaaaaca

SEQ ID NO: 4149484 - DNA, 16 bp, Homo sapiens
gttttaggtagaaaaa

SEQ ID NO: 4149485 - DNA, 21 bp, Homo sapiens
gttttatactgaaggaaaaac

SEQ ID NO: 4149486 - DNA, 13 bp, Homo sapiens
gttttatatacct

SEQ ID NO: 4149487 - DNA, 18 bp, Homo sapiens
gttttatgccccattgga

SEQ ID NO: 4149488 - DNA, 15 bp, Homo sapiens
gttttattactctca

SEQ ID NO: 4149489 - DNA, 13 bp, Homo sapiens
gttttattgtgtt

SEQ ID NO: 4149490 - DNA, 21 bp, Homo sapiens
gttttattttcaaatctggtc

SEQ ID NO: 4149491 - DNA, 15 bp, Homo sapiens
gttttcaagtcaaat

SEQ ID NO: 4149492 - DNA, 18 bp, Homo sapiens
gttttcaagtcaaattaa

SEQ ID NO: 4149493 - DNA, 12 bp, Homo sapiens
gttttcagaaaa

SEQ ID NO: 4149494 - DNA, 20 bp, Homo sapiens
gttttcagaacctcttcccc

SEQ ID NO: 4149495 - DNA, 19 bp, Homo sapiens
gttttcagctatacctgca

SEQ ID NO: 4149496 - DNA, 14 bp, Homo sapiens
gttttcataataaa

SEQ ID NO: 4149497 - DNA, 22 bp, Homo sapiens
gttttcatttactctaaaaact

SEQ ID NO: 4149498 - DNA, 16 bp, Homo sapiens
gttttcatttggttca

SEQ ID NO: 4149499 - DNA, 23 bp, Homo sapiens
gttttccacccataatcctttct

SEQ ID NO: 4149500 - DNA, 14 bp, Homo sapiens
gttttccatgaaaa

SEQ ID NO: 4149501 - DNA, 16 bp, Homo sapiens
gttttcctaaatgcag

SEQ ID NO: 4149502 - DNA, 22 bp, Homo sapiens
gttttcctataatataataaat

SEQ ID NO: 4149503 - DNA, 24 bp, Homo sapiens
gttttcctctatacatctctcccc

SEQ ID NO: 4149504 - DNA, 23 bp, Homo sapiens
gttttcgcacctaccatcaggga

SEQ ID NO: 4149505 - DNA, 19 bp, Homo sapiens
gttttctctcggctcccca

SEQ ID NO: 4149506 - DNA, 16 bp, Homo sapiens
gttttctgtaaataac

SEQ ID NO: 4149507 - DNA, 17 bp, Homo sapiens
gttttctgtagtcattt

SEQ ID NO: 4149508 - DNA, 23 bp, Homo sapiens
gttttctgtagtcatttactaaa

SEQ ID NO: 4149509 - DNA, 17 bp, Homo sapiens
gttttctgtttgtaaat

SEQ ID NO: 4149510 - DNA, 19 bp, Homo sapiens
gttttctgtttgtaaatta

SEQ ID NO: 4149511 - DNA, 16 bp, Homo sapiens
gttttctttctttaaa

SEQ ID NO: 4149512 - DNA, 13 bp, Homo sapiens
gttttgaaaagct

SEQ ID NO: 4149513 - DNA, 14 bp, Homo sapiens
gttttgaaaagcta

SEQ ID NO: 4149514 - DNA, 22 bp, Homo sapiens
gttttgaactaataaaagcata

SEQ ID NO: 4149515 - DNA, 19 bp, Homo sapiens
gttttgaagctactgtgtg

SEQ ID NO: 4149516 - DNA, 21 bp, Homo sapiens
gttttgaaggcaaaattgcaa

SEQ ID NO: 4149517 - DNA, 21 bp, Homo sapiens
gttttgaattttgtttttatt

SEQ ID NO: 4149518 - DNA, 14 bp, Homo sapiens
gttttgctgagagc

SEQ ID NO: 4149519 - DNA, 16 bp, Homo sapiens
gttttggaagctctga

SEQ ID NO: 4149520 - DNA, 17 bp, Homo sapiens
gttttggacagtttacc

SEQ ID NO: 4149521 - DNA, 18 bp, Homo sapiens
gttttggatcttgaatgt

SEQ ID NO: 4149522 - DNA, 15 bp, Homo sapiens
gttttgggtatgttt

SEQ ID NO: 4149523 - DNA, 17 bp, Homo sapiens
gttttggtagattaaat

SEQ ID NO: 4149524 - DNA, 17 bp, Homo sapiens
gttttgtacactgctgt

SEQ ID NO: 4149525 - DNA, 16 bp, Homo sapiens
gttttgtatatacagt

SEQ ID NO: 4149526 - DNA, 16 bp, Homo sapiens
gttttgttttttaagg

SEQ ID NO: 4149527 - DNA, 15 bp, Homo sapiens
gtttttaagctgttt

SEQ ID NO: 4149528 - DNA, 21 bp, Homo sapiens
gtttttacctaccacagtgtc

SEQ ID NO: 4149529 - DNA, 14 bp, Homo sapiens
gtttttactccagt

SEQ ID NO: 4149530 - DNA, 18 bp, Homo sapiens
gtttttagaatgttgaaa

SEQ ID NO: 4149531 - DNA, 16 bp, Homo sapiens
gtttttattaaaacat

SEQ ID NO: 4149532 - DNA, 16 bp, Homo sapiens
gtttttattttcaaga

SEQ ID NO: 4149533 - DNA, 20 bp, Homo sapiens
gtttttcagcacccccaccc

SEQ ID NO: 4149534 - DNA, 13 bp, Homo sapiens
gtttttccctccc

SEQ ID NO: 4149535 - DNA, 18 bp, Homo sapiens
gtttttccctccccagaa

SEQ ID NO: 4149536 - DNA, 17 bp, Homo sapiens
gtttttccttatttgct

SEQ ID NO: 4149537 - DNA, 16 bp, Homo sapiens
gtttttctgggtggcc

SEQ ID NO: 4149538 - DNA, 22 bp, Homo sapiens
gtttttcttcaacatcaatgtt

SEQ ID NO: 4149539 - DNA, 22 bp, Homo sapiens
gtttttcttggggtactcttga

SEQ ID NO: 4149540 - DNA, 18 bp, Homo sapiens
gtttttgatagctttatt

SEQ ID NO: 4149541 - DNA, 23 bp, Homo sapiens
gtttttgatcaaaaactatttgg

SEQ ID NO: 4149542 - DNA, 15 bp, Homo sapiens
gtttttgctttctga

SEQ ID NO: 4149543 - DNA, 13 bp, Homo sapiens
gtttttgtatctt

SEQ ID NO: 4149544 - DNA, 14 bp, Homo sapiens
gtttttgtatcttg

SEQ ID NO: 4149545 - DNA, 22 bp, Homo sapiens
gtttttgtatttattaatttga

SEQ ID NO: 4149546 - DNA, 21 bp, Homo sapiens
gttttttaaaatatttatctg

SEQ ID NO: 4149547 - DNA, 15 bp, Homo sapiens
gttttttatgctaat

SEQ ID NO: 4149548 - DNA, 18 bp, Homo sapiens
gttttttttaaataaaag

SEQ ID NO: 4149549 - DNA, 14 bp, Homo sapiens
gttttttttttgtt

SEQ ID NO: 4149550 - DNA, 19 bp, Homo sapiens
gtttttttttttcttaaat

SEQ ID NO: 4149551 - DNA, 19 bp, Homo sapiens
taaaaaaaaagatctgttt

SEQ ID NO: 4149552 - DNA, 22 bp, Homo sapiens
taaaaaaaaaggcatattgctt

SEQ ID NO: 4149553 - DNA, 17 bp, Homo sapiens
taaaaaaaaatgccttt

SEQ ID NO: 4149554 - DNA, 11 bp, Homo sapiens
taaaaaaagaa

SEQ ID NO: 4149555 - DNA, 14 bp, Homo sapiens
taaaaaaagaaaaa

SEQ ID NO: 4149556 - DNA, 15 bp, Homo sapiens
taaaaaaagaaagca

SEQ ID NO: 4149557 - DNA, 18 bp, Homo sapiens
taaaaaacactaaacatt

SEQ ID NO: 4149558 - DNA, 19 bp, Homo sapiens
taaaaaacactaaacattc

SEQ ID NO: 4149559 - DNA, 13 bp, Homo sapiens
taaaaaacagaaa

SEQ ID NO: 4149560 - DNA, 13 bp, Homo sapiens
taaaaaacatttt

SEQ ID NO: 4149561 - DNA, 12 bp, Homo sapiens
taaaaaatggtt

SEQ ID NO: 4149562 - DNA, 13 bp, Homo sapiens
taaaaaatgtcca

SEQ ID NO: 4149563 - DNA, 15 bp, Homo sapiens
taaaaacaaaaggca

SEQ ID NO: 4149564 - DNA, 20 bp, Homo sapiens
taaaaacagcattgctttct

SEQ ID NO: 4149565 - DNA, 19 bp, Homo sapiens
taaaaaccatgctggtata

SEQ ID NO: 4149566 - DNA, 23 bp, Homo sapiens
taaaaagaaaaaaaaagaattac

SEQ ID NO: 4149567 - DNA, 17 bp, Homo sapiens
taaaaagaaaagataaa

SEQ ID NO: 4149568 - DNA, 16 bp, Homo sapiens
taaaaagaaatctggt

SEQ ID NO: 4149569 - DNA, 15 bp, Homo sapiens
taaaaagcagaattt

SEQ ID NO: 4149570 - DNA, 18 bp, Homo sapiens
taaaaagcagaattttaa

SEQ ID NO: 4149571 - DNA, 19 bp, Homo sapiens
taaaaagcctgcaatttca

SEQ ID NO: 4149572 - DNA, 22 bp, Homo sapiens
taaaaagcctgcaatttcatat

SEQ ID NO: 4149573 - DNA, 11 bp, Homo sapiens
taaaaaggaca

SEQ ID NO: 4149574 - DNA, 19 bp, Homo sapiens
taaaaaggacatcagcaaa

SEQ ID NO: 4149575 - DNA, 21 bp, Homo sapiens
taaaaaggacatcagcaaaca

SEQ ID NO: 4149576 - DNA, 14 bp, Homo sapiens
taaaaagtattttt

SEQ ID NO: 4149577 - DNA, 17 bp, Homo sapiens
taaaaagtgagaaagaa

SEQ ID NO: 4149578 - DNA, 19 bp, Homo sapiens
taaaaataaatcccatgga

SEQ ID NO: 4149579 - DNA, 14 bp, Homo sapiens
taaaaatacatatc

SEQ ID NO: 4149580 - DNA, 13 bp, Homo sapiens
taaaaatattcct

SEQ ID NO: 4149581 - DNA, 14 bp, Homo sapiens
taaaaatattgtgt

SEQ ID NO: 4149582 - DNA, 13 bp, Homo sapiens
taaaaatatttca

SEQ ID NO: 4149583 - DNA, 15 bp, Homo sapiens
taaaaatcacactgt

SEQ ID NO: 4149584 - DNA, 22 bp, Homo sapiens
taaaaatgaggtactctcctgg

SEQ ID NO: 4149585 - DNA, 22 bp, Homo sapiens
taaaaattgaatgtggctgaag

SEQ ID NO: 4149586 - DNA, 22 bp, Homo sapiens
taaaaattgccattggacagtt

SEQ ID NO: 4149587 - DNA, 21 bp, Homo sapiens
taaaacaattctgtgacatac

SEQ ID NO: 4149588 - DNA, 14 bp, Homo sapiens
taaaacactaaaag

SEQ ID NO: 4149589 - DNA, 13 bp, Homo sapiens
taaaacagaaaaa

SEQ ID NO: 4149590 - DNA, 14 bp, Homo sapiens
taaaacagaagcct

SEQ ID NO: 4149591 - DNA, 13 bp, Homo sapiens
taaaacagtattt

SEQ ID NO: 4149592 - DNA, 17 bp, Homo sapiens
taaaacagtatttattt

SEQ ID NO: 4149593 - DNA, 21 bp, Homo sapiens
taaaacagtatttattttgta

SEQ ID NO: 4149594 - DNA, 13 bp, Homo sapiens
taaaaccaaagag

SEQ ID NO: 4149595 - DNA, 23 bp, Homo sapiens
taaaactgggattaagaaacctt

SEQ ID NO: 4149596 - DNA, 18 bp, Homo sapiens
taaaacttcttaaatatc

SEQ ID NO: 4149597 - DNA, 20 bp, Homo sapiens
taaaacttcttaaatatctt

SEQ ID NO: 4149598 - DNA, 15 bp, Homo sapiens
taaaactttcctcgc

SEQ ID NO: 4149599 - DNA, 17 bp, Homo sapiens
taaaagaacagtaaaca

SEQ ID NO: 4149600 - DNA, 18 bp, Homo sapiens
taaaagaacagtaaacat

SEQ ID NO: 4149601 - DNA, 15 bp, Homo sapiens
taaaagaatgactat

SEQ ID NO: 4149602 - DNA, 13 bp, Homo sapiens
taaaagaattttt

SEQ ID NO: 4149603 - DNA, 20 bp, Homo sapiens
taaaagaatttttttgtctt

SEQ ID NO: 4149604 - DNA, 11 bp, Homo sapiens
taaaagcagca

SEQ ID NO: 4149605 - DNA, 21 bp, Homo sapiens
taaaagcagcatctgctaata

SEQ ID NO: 4149606 - DNA, 18 bp, Homo sapiens
taaaagcataaatgcaaa

SEQ ID NO: 4149607 - DNA, 20 bp, Homo sapiens
taaaagcgttggatgtagca

SEQ ID NO: 4149608 - DNA, 14 bp, Homo sapiens
taaaaggaagccaa

SEQ ID NO: 4149609 - DNA, 17 bp, Homo sapiens
taaaagggtcaaacctg

SEQ ID NO: 4149610 - DNA, 19 bp, Homo sapiens
taaaagtgaatgaaagatt

SEQ ID NO: 4149611 - DNA, 23 bp, Homo sapiens
taaaagtgaatgaaagattaaac

SEQ ID NO: 4149612 - DNA, 15 bp, Homo sapiens
taaaagtgatcaata

SEQ ID NO: 4149613 - DNA, 12 bp, Homo sapiens
taaaagttactt

SEQ ID NO: 4149614 - DNA, 12 bp, Homo sapiens
taaaagttcttt

SEQ ID NO: 4149615 - DNA, 16 bp, Homo sapiens
taaaagttttctccaa

SEQ ID NO: 4149616 - DNA, 21 bp, Homo sapiens
taaaataaaaattctgaatgt

SEQ ID NO: 4149617 - DNA, 22 bp, Homo sapiens
taaaataaaatgaaaattgtat

SEQ ID NO: 4149618 - DNA, 15 bp, Homo sapiens
taaaataaacagttg

SEQ ID NO: 4149619 - DNA, 17 bp, Homo sapiens
taaaataaacagttgtg

SEQ ID NO: 4149620 - DNA, 15 bp, Homo sapiens
taaaataaataattt

SEQ ID NO: 4149621 - DNA, 22 bp, Homo sapiens
taaaataattttatctctttct

SEQ ID NO: 4149622 - DNA, 13 bp, Homo sapiens
taaaatacattta

SEQ ID NO: 4149623 - DNA, 19 bp, Homo sapiens
taaaatagaaattttgtaa

SEQ ID NO: 4149624 - DNA, 12 bp, Homo sapiens
taaaatataatt

SEQ ID NO: 4149625 - DNA, 18 bp, Homo sapiens
taaaatataatttttaat

SEQ ID NO: 4149626 - DNA, 19 bp, Homo sapiens
taaaatatgaagacataaa

SEQ ID NO: 4149627 - DNA, 11 bp, Homo sapiens
taaaatattta

SEQ ID NO: 4149628 - DNA, 23 bp, Homo sapiens
taaaatatttaaacctttttctt

SEQ ID NO: 4149629 - DNA, 14 bp, Homo sapiens
taaaatatttgaat

SEQ ID NO: 4149630 - DNA, 22 bp, Homo sapiens
taaaatatttgaatgaaaacat

SEQ ID NO: 4149631 - DNA, 19 bp, Homo sapiens
taaaatcaatttttaggaa

SEQ ID NO: 4149632 - DNA, 18 bp, Homo sapiens
taaaatcactctcagtgc

SEQ ID NO: 4149633 - DNA, 19 bp, Homo sapiens
taaaatcttggcacagaaa

SEQ ID NO: 4149634 - DNA, 19 bp, Homo sapiens
taaaatgactacttagcat

SEQ ID NO: 4149635 - DNA, 17 bp, Homo sapiens
taaaatgatttgtagtg

SEQ ID NO: 4149636 - DNA, 19 bp, Homo sapiens
taaaatgcatgattttgta

SEQ ID NO: 4149637 - DNA, 11 bp, Homo sapiens
taaaatgtgaa

SEQ ID NO: 4149638 - DNA, 18 bp, Homo sapiens
taaaatgtgatttttctg

SEQ ID NO: 4149639 - DNA, 16 bp, Homo sapiens
taaaattacgtttgtt

SEQ ID NO: 4149640 - DNA, 20 bp, Homo sapiens
taaaattcagtttttgtatc

SEQ ID NO: 4149641 - DNA, 22 bp, Homo sapiens
taaaattcagtttttgtatctt

SEQ ID NO: 4149642 - DNA, 17 bp, Homo sapiens
taaaattcgctttctaa

SEQ ID NO: 4149643 - DNA, 18 bp, Homo sapiens
taaaattgctatgttact

SEQ ID NO: 4149644 - DNA, 14 bp, Homo sapiens
taaaattgtcacct

SEQ ID NO: 4149645 - DNA, 17 bp, Homo sapiens
taaaatttatcttaagt

SEQ ID NO: 4149646 - DNA, 19 bp, Homo sapiens
taaaattttgcttttaatt

SEQ ID NO: 4149647 - DNA, 21 bp, Homo sapiens
taaaattttgcttttaattaa

SEQ ID NO: 4149648 - DNA, 19 bp, Homo sapiens
taaacaaaattgcaatttc

SEQ ID NO: 4149649 - DNA, 17 bp, Homo sapiens
taaacaaattcatattc

SEQ ID NO: 4149650 - DNA, 15 bp, Homo sapiens
taaacaacagctgaa

SEQ ID NO: 4149651 - DNA, 18 bp, Homo sapiens
taaacaacagctgaagca

SEQ ID NO: 4149652 - DNA, 22 bp, Homo sapiens
taaacacacagatacacacaca

SEQ ID NO: 4149653 - DNA, 17 bp, Homo sapiens
taaacacaggctgtcct

SEQ ID NO: 4149654 - DNA, 18 bp, Homo sapiens
taaacacatgccttaaat

SEQ ID NO: 4149655 - DNA, 13 bp, Homo sapiens
taaacacctgaca

SEQ ID NO: 4149656 - DNA, 14 bp, Homo sapiens
taaacacctgacac

SEQ ID NO: 4149657 - DNA, 14 bp, Homo sapiens
taaacactcacctt

SEQ ID NO: 4149658 - DNA, 16 bp, Homo sapiens
taaacagatataaatg

SEQ ID NO: 4149659 - DNA, 18 bp, Homo sapiens
taaacagatgatgagaat

SEQ ID NO: 4149660 - DNA, 13 bp, Homo sapiens
taaacagcagtgt

SEQ ID NO: 4149661 - DNA, 17 bp, Homo sapiens
taaacagtagttgtatt

SEQ ID NO: 4149662 - DNA, 16 bp, Homo sapiens
taaacagtatattctt

SEQ ID NO: 4149663 - DNA, 21 bp, Homo sapiens
taaacagtatattctttggtt

SEQ ID NO: 4149664 - DNA, 15 bp, Homo sapiens
taaacagtatttcat

SEQ ID NO: 4149665 - DNA, 16 bp, Homo sapiens
taaacataagctaaat

SEQ ID NO: 4149666 - DNA, 15 bp, Homo sapiens
taaacataatgaaaa

SEQ ID NO: 4149667 - DNA, 15 bp, Homo sapiens
taaacatatgatttc

SEQ ID NO: 4149668 - DNA, 21 bp, Homo sapiens
taaacattcaattccagagaa

SEQ ID NO: 4149669 - DNA, 18 bp, Homo sapiens
taaacattgaagtaatga

SEQ ID NO: 4149670 - DNA, 17 bp, Homo sapiens
taaacatttgttcctgg

SEQ ID NO: 4149671 - DNA, 18 bp, Homo sapiens
taaacatttgttcctgga

SEQ ID NO: 4149672 - DNA, 13 bp, Homo sapiens
taaaccaaccttt

SEQ ID NO: 4149673 - DNA, 15 bp, Homo sapiens
taaacccctgtccca

SEQ ID NO: 4149674 - DNA, 15 bp, Homo sapiens
taaaccgataatgca

SEQ ID NO: 4149675 - DNA, 21 bp, Homo sapiens
taaaccgataatgcatgaagc

SEQ ID NO: 4149676 - DNA, 20 bp, Homo sapiens
taaacctgtttttttttcat

SEQ ID NO: 4149677 - DNA, 21 bp, Homo sapiens
taaacctgtttttttttcatt

SEQ ID NO: 4149678 - DNA, 14 bp, Homo sapiens
taaacctttttctt

SEQ ID NO: 4149679 - DNA, 17 bp, Homo sapiens
taaacctttttcttgat

SEQ ID NO: 4149680 - DNA, 20 bp, Homo sapiens
taaacctttttcttgatctt

SEQ ID NO: 4149681 - DNA, 21 bp, Homo sapiens
taaacctttttcttgatctta

SEQ ID NO: 4149682 - DNA, 15 bp, Homo sapiens
taaacggattccaaa

SEQ ID NO: 4149683 - DNA, 13 bp, Homo sapiens
taaactaaataat

SEQ ID NO: 4149684 - DNA, 15 bp, Homo sapiens
taaactaaataatga

SEQ ID NO: 4149685 - DNA, 16 bp, Homo sapiens
taaactactctttgat

SEQ ID NO: 4149686 - DNA, 14 bp, Homo sapiens
taaactagagaagg

SEQ ID NO: 4149687 - DNA, 20 bp, Homo sapiens
taaactcagggacagagcca

SEQ ID NO: 4149688 - DNA, 16 bp, Homo sapiens
taaactccttcctggc

SEQ ID NO: 4149689 - DNA, 15 bp, Homo sapiens
taaactgactatcat

SEQ ID NO: 4149690 - DNA, 14 bp, Homo sapiens
taaactgactttat

SEQ ID NO: 4149691 - DNA, 18 bp, Homo sapiens
taaactgcaaacagaaat

SEQ ID NO: 4149692 - DNA, 20 bp, Homo sapiens
taaactgcaaacagaaatca

SEQ ID NO: 4149693 - DNA, 16 bp, Homo sapiens
taaactgcattagaaa

SEQ ID NO: 4149694 - DNA, 20 bp, Homo sapiens
taaactgtgtggactgtgat

SEQ ID NO: 4149695 - DNA, 12 bp, Homo sapiens
taaactgtgttt

SEQ ID NO: 4149696 - DNA, 15 bp, Homo sapiens
taaacttacaaactt

SEQ ID NO: 4149697 - DNA, 15 bp, Homo sapiens
taaacttagaggaaa

SEQ ID NO: 4149698 - DNA, 17 bp, Homo sapiens
taaacttagaggaaaat

SEQ ID NO: 4149699 - DNA, 22 bp, Homo sapiens
taaacttagtgcggacaagttt

SEQ ID NO: 4149700 - DNA, 15 bp, Homo sapiens
taaactttggccttt

SEQ ID NO: 4149701 - DNA, 15 bp, Homo sapiens
taaacttttaattca

SEQ ID NO: 4149702 - DNA, 12 bp, Homo sapiens
taaactttttgt

SEQ ID NO: 4149703 - DNA, 13 bp, Homo sapiens
taaagaaatattt

SEQ ID NO: 4149704 - DNA, 14 bp, Homo sapiens
taaagaaatattta

SEQ ID NO: 4149705 - DNA, 15 bp, Homo sapiens
taaagaaatgtctta

SEQ ID NO: 4149706 - DNA, 19 bp, Homo sapiens
taaagaacaccctatattt

SEQ ID NO: 4149707 - DNA, 14 bp, Homo sapiens
taaagaacttaaat

SEQ ID NO: 4149708 - DNA, 17 bp, Homo sapiens
taaagaattaatgactt

SEQ ID NO: 4149709 - DNA, 15 bp, Homo sapiens
taaagacacctactg

SEQ ID NO: 4149710 - DNA, 21 bp, Homo sapiens
taaagacagggaagagcagaa

SEQ ID NO: 4149711 - DNA, 13 bp, Homo sapiens
taaagagaggtta

SEQ ID NO: 4149712 - DNA, 19 bp, Homo sapiens
taaagagcccttgcctccc

SEQ ID NO: 4149713 - DNA, 21 bp, Homo sapiens
taaagagcccttgcctcccca

SEQ ID NO: 4149714 - DNA, 15 bp, Homo sapiens
taaagataatattac

SEQ ID NO: 4149715 - DNA, 18 bp, Homo sapiens
taaagataattgctattt

SEQ ID NO: 4149716 - DNA, 17 bp, Homo sapiens
taaagatgaactctgaa

SEQ ID NO: 4149717 - DNA, 22 bp, Homo sapiens
taaagatgcaaggaccaggact

SEQ ID NO: 4149718 - DNA, 21 bp, Homo sapiens
taaagattttgttttgttgga

SEQ ID NO: 4149719 - DNA, 16 bp, Homo sapiens
taaagcaatctgattc

SEQ ID NO: 4149720 - DNA, 22 bp, Homo sapiens
taaagcaatctgattcagcatc

SEQ ID NO: 4149721 - DNA, 17 bp, Homo sapiens
taaagcacgtgcaagga

SEQ ID NO: 4149722 - DNA, 18 bp, Homo sapiens
taaagcacgtgcaaggac

SEQ ID NO: 4149723 - DNA, 14 bp, Homo sapiens
taaagcactgagca

SEQ ID NO: 4149724 - DNA, 13 bp, Homo sapiens
taaagcagacagt

SEQ ID NO: 4149725 - DNA, 20 bp, Homo sapiens
taaagcagagggactttgta

SEQ ID NO: 4149726 - DNA, 16 bp, Homo sapiens
taaagcataagtatac

SEQ ID NO: 4149727 - DNA, 21 bp, Homo sapiens
taaagcattgcttttattttg

SEQ ID NO: 4149728 - DNA, 20 bp, Homo sapiens
taaagctaaaatgattttat

SEQ ID NO: 4149729 - DNA, 14 bp, Homo sapiens
taaagctggccctg

SEQ ID NO: 4149730 - DNA, 23 bp, Homo sapiens
taaagcttgtggccccttttact

SEQ ID NO: 4149731 - DNA, 16 bp, Homo sapiens
taaaggatgtgattgt

SEQ ID NO: 4149732 - DNA, 21 bp, Homo sapiens
taaaggcagctgttgtctctt

SEQ ID NO: 4149733 - DNA, 16 bp, Homo sapiens
taaaggctaactatga

SEQ ID NO: 4149734 - DNA, 15 bp, Homo sapiens
taaagggcctgcctg

SEQ ID NO: 4149735 - DNA, 16 bp, Homo sapiens
taaagggcctgcctgg

SEQ ID NO: 4149736 - DNA, 14 bp, Homo sapiens
taaaggtgtattta

SEQ ID NO: 4149737 - DNA, 20 bp, Homo sapiens
taaaggttgacaataaatgt

SEQ ID NO: 4149738 - DNA, 14 bp, Homo sapiens
taaagtaaagctaa

SEQ ID NO: 4149739 - DNA, 20 bp, Homo sapiens
taaagtacacaattgtttta

SEQ ID NO: 4149740 - DNA, 13 bp, Homo sapiens
taaagtagaagag

SEQ ID NO: 4149741 - DNA, 19 bp, Homo sapiens
taaagtatatatagaatct

SEQ ID NO: 4149742 - DNA, 18 bp, Homo sapiens
taaagtcaggtccaattt

SEQ ID NO: 4149743 - DNA, 15 bp, Homo sapiens
taaagtccaaagtca

SEQ ID NO: 4149744 - DNA, 15 bp, Homo sapiens
taaagtctattcaaa

SEQ ID NO: 4149745 - DNA, 19 bp, Homo sapiens
taaagtgcttgctttttgc

SEQ ID NO: 4149746 - DNA, 19 bp, Homo sapiens
taaagtgtaacaattgtgt

SEQ ID NO: 4149747 - DNA, 11 bp, Homo sapiens
taaagtgtttc

SEQ ID NO: 4149748 - DNA, 22 bp, Homo sapiens
taaagttgcacatgattgtata

SEQ ID NO: 4149749 - DNA, 17 bp, Homo sapiens
taaagtttaaagttgca

SEQ ID NO: 4149750 - DNA, 14 bp, Homo sapiens
taaagtttgcttag

SEQ ID NO: 4149751 - DNA, 14 bp, Homo sapiens
taaagttttagggt

SEQ ID NO: 4149752 - DNA, 12 bp, Homo sapiens
taaataaaactg

SEQ ID NO: 4149753 - DNA, 20 bp, Homo sapiens
taaataaaagcagcatctgc

SEQ ID NO: 4149754 - DNA, 19 bp, Homo sapiens
taaataaaagtgatcaata

SEQ ID NO: 4149755 - DNA, 17 bp, Homo sapiens
taaataaaattcatttc

SEQ ID NO: 4149756 - DNA, 16 bp, Homo sapiens
taaataaatcattaat

SEQ ID NO: 4149757 - DNA, 16 bp, Homo sapiens
taaataaatgggtgta

SEQ ID NO: 4149758 - DNA, 20 bp, Homo sapiens
taaataaatgggtgtatata

SEQ ID NO: 4149759 - DNA, 22 bp, Homo sapiens
taaataacaggcatttgttcac

SEQ ID NO: 4149760 - DNA, 23 bp, Homo sapiens
taaataacctatttttttctcta

SEQ ID NO: 4149761 - DNA, 15 bp, Homo sapiens
taaataagagatttg

SEQ ID NO: 4149762 - DNA, 18 bp, Homo sapiens
taaataatgcttcagata

SEQ ID NO: 4149763 - DNA, 13 bp, Homo sapiens
taaataattttaa

SEQ ID NO: 4149764 - DNA, 13 bp, Homo sapiens
taaatacaaatct

SEQ ID NO: 4149765 - DNA, 16 bp, Homo sapiens
taaatacaaatctgta

SEQ ID NO: 4149766 - DNA, 15 bp, Homo sapiens
taaatacaagactgt

SEQ ID NO: 4149767 - DNA, 16 bp, Homo sapiens
taaatacagacactaa

SEQ ID NO: 4149768 - DNA, 18 bp, Homo sapiens
taaatacagacactaagt

SEQ ID NO: 4149769 - DNA, 17 bp, Homo sapiens
taaataccagacacgta

SEQ ID NO: 4149770 - DNA, 15 bp, Homo sapiens
taaatactgtgcaga

SEQ ID NO: 4149771 - DNA, 21 bp, Homo sapiens
taaatactgtgcagaataatg

SEQ ID NO: 4149772 - DNA, 20 bp, Homo sapiens
taaatagaactatctgcatt

SEQ ID NO: 4149773 - DNA, 18 bp, Homo sapiens
taaatagagtatatgcac

SEQ ID NO: 4149774 - DNA, 18 bp, Homo sapiens
taaatagctatatccatg

SEQ ID NO: 4149775 - DNA, 20 bp, Homo sapiens
taaatagctatatccatgta

SEQ ID NO: 4149776 - DNA, 14 bp, Homo sapiens
taaatatataaaaa

SEQ ID NO: 4149777 - DNA, 20 bp, Homo sapiens
taaatatatgtctgataatg

SEQ ID NO: 4149778 - DNA, 17 bp, Homo sapiens
taaatatatttaagata

SEQ ID NO: 4149779 - DNA, 22 bp, Homo sapiens
taaatatcaatcaagccatgta

SEQ ID NO: 4149780 - DNA, 17 bp, Homo sapiens
taaatatcacagtatta

SEQ ID NO: 4149781 - DNA, 18 bp, Homo sapiens
taaatatcttttatgttt

SEQ ID NO: 4149782 - DNA, 16 bp, Homo sapiens
taaatatgcagtgata

SEQ ID NO: 4149783 - DNA, 14 bp, Homo sapiens
taaatatgtacatt

SEQ ID NO: 4149784 - DNA, 18 bp, Homo sapiens
taaatattagttaatgga

SEQ ID NO: 4149785 - DNA, 20 bp, Homo sapiens
taaatattagttaatggatt

SEQ ID NO: 4149786 - DNA, 13 bp, Homo sapiens
taaatattctata

SEQ ID NO: 4149787 - DNA, 15 bp, Homo sapiens
taaatattctatatg

SEQ ID NO: 4149788 - DNA, 20 bp, Homo sapiens
taaatattgaggctttgtgt

SEQ ID NO: 4149789 - DNA, 10 bp, Homo sapiens
taaatattta

SEQ ID NO: 4149790 - DNA, 16 bp, Homo sapiens
taaatatttatgtaga

SEQ ID NO: 4149791 - DNA, 18 bp, Homo sapiens
taaatatttgacttgcat

SEQ ID NO: 4149792 - DNA, 17 bp, Homo sapiens
taaatcacacattcagt

SEQ ID NO: 4149793 - DNA, 17 bp, Homo sapiens
taaatcagaataaatta

SEQ ID NO: 4149794 - DNA, 17 bp, Homo sapiens
taaatcagtaagaggtg

SEQ ID NO: 4149795 - DNA, 14 bp, Homo sapiens
taaatcatattgat

SEQ ID NO: 4149796 - DNA, 19 bp, Homo sapiens
taaatcatattgatgaaaa

SEQ ID NO: 4149797 - DNA, 15 bp, Homo sapiens
taaatcatgtatgtt

SEQ ID NO: 4149798 - DNA, 19 bp, Homo sapiens
taaatcatgtatgttatga

SEQ ID NO: 4149799 - DNA, 14 bp, Homo sapiens
taaatccagttcta

SEQ ID NO: 4149800 - DNA, 17 bp, Homo sapiens
taaatcctgccatttaa

SEQ ID NO: 4149801 - DNA, 18 bp, Homo sapiens
taaatcctgccatttaaa

SEQ ID NO: 4149802 - DNA, 17 bp, Homo sapiens
taaatcctttactgtta

SEQ ID NO: 4149803 - DNA, 18 bp, Homo sapiens
taaatctcttctgtgttt

SEQ ID NO: 4149804 - DNA, 14 bp, Homo sapiens
taaatctgacccag

SEQ ID NO: 4149805 - DNA, 15 bp, Homo sapiens
taaatctgacccagt

SEQ ID NO: 4149806 - DNA, 21 bp, Homo sapiens
taaatctgttctgggctcttt

SEQ ID NO: 4149807 - DNA, 18 bp, Homo sapiens
taaatcttccttgtgagg

SEQ ID NO: 4149808 - DNA, 13 bp, Homo sapiens
taaatctttcaaa

SEQ ID NO: 4149809 - DNA, 13 bp, Homo sapiens
taaatgaatgttt

SEQ ID NO: 4149810 - DNA, 19 bp, Homo sapiens
taaatgagaagtacttggt

SEQ ID NO: 4149811 - DNA, 15 bp, Homo sapiens
taaatgagctcctgc

SEQ ID NO: 4149812 - DNA, 14 bp, Homo sapiens
taaatgatctgcct

SEQ ID NO: 4149813 - DNA, 21 bp, Homo sapiens
taaatgatgtggtgcctgagg

SEQ ID NO: 4149814 - DNA, 17 bp, Homo sapiens
taaatgattcttagtga

SEQ ID NO: 4149815 - DNA, 14 bp, Homo sapiens
taaatgattttaat

SEQ ID NO: 4149816 - DNA, 20 bp, Homo sapiens
taaatgattttaattttata

SEQ ID NO: 4149817 - DNA, 18 bp, Homo sapiens
taaatgcagttttaagaa

SEQ ID NO: 4149818 - DNA, 20 bp, Homo sapiens
taaatgcatatcctgagcca

SEQ ID NO: 4149819 - DNA, 14 bp, Homo sapiens
taaatgcctaataa

SEQ ID NO: 4149820 - DNA, 23 bp, Homo sapiens
taaatgggtgtatataattttat

SEQ ID NO: 4149821 - DNA, 14 bp, Homo sapiens
taaatgtaacttat

SEQ ID NO: 4149822 - DNA, 16 bp, Homo sapiens
taaatgtaggtatgaa

SEQ ID NO: 4149823 - DNA, 20 bp, Homo sapiens
taaatgtatactatagtacc

SEQ ID NO: 4149824 - DNA, 19 bp, Homo sapiens
taaatgtatcttattcaca

SEQ ID NO: 4149825 - DNA, 17 bp, Homo sapiens
taaatgtatttaattaa

SEQ ID NO: 4149826 - DNA, 19 bp, Homo sapiens
taaatgtatttaattaaat

SEQ ID NO: 4149827 - DNA, 13 bp, Homo sapiens
taaatgtatttta

SEQ ID NO: 4149828 - DNA, 15 bp, Homo sapiens
taaatgtctattatt

SEQ ID NO: 4149829 - DNA, 13 bp, Homo sapiens
taaatgtctttgt

SEQ ID NO: 4149830 - DNA, 15 bp, Homo sapiens
taaatgtctttgtaa

SEQ ID NO: 4149831 - DNA, 16 bp, Homo sapiens
taaatgtctttgtaag

SEQ ID NO: 4149832 - DNA, 21 bp, Homo sapiens
taaatgtctttgtaagtcagt

SEQ ID NO: 4149833 - DNA, 22 bp, Homo sapiens
taaatgtctttgtaagtcagtg

SEQ ID NO: 4149834 - DNA, 21 bp, Homo sapiens
taaatgttatgactatgtaaa

SEQ ID NO: 4149835 - DNA, 16 bp, Homo sapiens
taaatgttttataagt

SEQ ID NO: 4149836 - DNA, 17 bp, Homo sapiens
taaatgttttataagtt

SEQ ID NO: 4149837 - DNA, 19 bp, Homo sapiens
taaattaaagcctttagta

SEQ ID NO: 4149838 - DNA, 22 bp, Homo sapiens
taaattataacttaaaatattt

SEQ ID NO: 4149839 - DNA, 15 bp, Homo sapiens
taaattatgtataaa

SEQ ID NO: 4149840 - DNA, 14 bp, Homo sapiens
taaattatttgcta

SEQ ID NO: 4149841 - DNA, 20 bp, Homo sapiens
taaattcagatatatttttc

SEQ ID NO: 4149842 - DNA, 17 bp, Homo sapiens
taaattcccaacttctc

SEQ ID NO: 4149843 - DNA, 13 bp, Homo sapiens
taaattctatgtt

SEQ ID NO: 4149844 - DNA, 14 bp, Homo sapiens
taaattctatgtta

SEQ ID NO: 4149845 - DNA, 20 bp, Homo sapiens
taaattctatgttaaatact

SEQ ID NO: 4149846 - DNA, 23 bp, Homo sapiens
taaattctatgttaaatactgtg

SEQ ID NO: 4149847 - DNA, 15 bp, Homo sapiens
taaattctgagacat

SEQ ID NO: 4149848 - DNA, 19 bp, Homo sapiens
taaattctgagacatgtgt

SEQ ID NO: 4149849 - DNA, 12 bp, Homo sapiens
taaattctgatt

SEQ ID NO: 4149850 - DNA, 14 bp, Homo sapiens
taaattctgattct

SEQ ID NO: 4149851 - DNA, 20 bp, Homo sapiens
taaattcttaatgttcacat

SEQ ID NO: 4149852 - DNA, 18 bp, Homo sapiens
taaattgcataaagcata

SEQ ID NO: 4149853 - DNA, 15 bp, Homo sapiens
taaattgcctgattt

SEQ ID NO: 4149854 - DNA, 17 bp, Homo sapiens
taaattgctctgttccc

SEQ ID NO: 4149855 - DNA, 12 bp, Homo sapiens
taaattgtcatt

SEQ ID NO: 4149856 - DNA, 21 bp, Homo sapiens
taaattgttagcttccttaag

SEQ ID NO: 4149857 - DNA, 14 bp, Homo sapiens
taaattgtttcata

SEQ ID NO: 4149858 - DNA, 20 bp, Homo sapiens
taaatttaaagatattgttc

SEQ ID NO: 4149859 - DNA, 22 bp, Homo sapiens
taaatttaaagatattgttcaa

SEQ ID NO: 4149860 - DNA, 13 bp, Homo sapiens
taaatttaaattt

SEQ ID NO: 4149861 - DNA, 22 bp, Homo sapiens
taaatttaatccttctttgtaa

SEQ ID NO: 4149862 - DNA, 17 bp, Homo sapiens
taaatttactttacaca

SEQ ID NO: 4149863 - DNA, 14 bp, Homo sapiens
taaatttgaatgtt

SEQ ID NO: 4149864 - DNA, 22 bp, Homo sapiens
taaatttgaatgttaagcagat

SEQ ID NO: 4149865 - DNA, 13 bp, Homo sapiens
taaatttgattta

SEQ ID NO: 4149866 - DNA, 13 bp, Homo sapiens
taaatttgctagc

SEQ ID NO: 4149867 - DNA, 16 bp, Homo sapiens
taaatttgtaagtttc

SEQ ID NO: 4149868 - DNA, 17 bp, Homo sapiens
taaatttgtaagtttca

SEQ ID NO: 4149869 - DNA, 19 bp, Homo sapiens
taaatttgtaagtttcagg

SEQ ID NO: 4149870 - DNA, 20 bp, Homo sapiens
taaatttgtaagtttcaggt

SEQ ID NO: 4149871 - DNA, 19 bp, Homo sapiens
taaatttgtttaattaaat

SEQ ID NO: 4149872 - DNA, 16 bp, Homo sapiens
taaattttgagttcta

SEQ ID NO: 4149873 - DNA, 18 bp, Homo sapiens
taaattttgagttctaca

SEQ ID NO: 4149874 - DNA, 19 bp, Homo sapiens
taaattttgagttctacat

SEQ ID NO: 4149875 - DNA, 18 bp, Homo sapiens
taaatttttaggcaaaga

SEQ ID NO: 4149876 - DNA, 18 bp, Homo sapiens
taacaaaaactacacata

SEQ ID NO: 4149877 - DNA, 12 bp, Homo sapiens
taacaaaagatg

SEQ ID NO: 4149878 - DNA, 18 bp, Homo sapiens
taacaaaccaacatcttt

SEQ ID NO: 4149879 - DNA, 21 bp, Homo sapiens
taacaaataaaaaagctcttt

SEQ ID NO: 4149880 - DNA, 12 bp, Homo sapiens
taacaagaatgt

SEQ ID NO: 4149881 - DNA, 11 bp, Homo sapiens
taacaaggaat

SEQ ID NO: 4149882 - DNA, 22 bp, Homo sapiens
taacaagggttttaatgtaatt

SEQ ID NO: 4149883 - DNA, 19 bp, Homo sapiens
taacaataactactgtgtt

SEQ ID NO: 4149884 - DNA, 17 bp, Homo sapiens
taacaatacaaatggat

SEQ ID NO: 4149885 - DNA, 17 bp, Homo sapiens
taacaatgaagataaaa

SEQ ID NO: 4149886 - DNA, 19 bp, Homo sapiens
taacaatgttaaggaaact

SEQ ID NO: 4149887 - DNA, 23 bp, Homo sapiens
taacaatgttaaggaaactctta

SEQ ID NO: 4149888 - DNA, 20 bp, Homo sapiens
taacaattgtgtagcctttt

SEQ ID NO: 4149889 - DNA, 14 bp, Homo sapiens
taacacaaaggaag

SEQ ID NO: 4149890 - DNA, 14 bp, Homo sapiens
taacacataaacaa

SEQ ID NO: 4149891 - DNA, 13 bp, Homo sapiens
taacaccagtggg

SEQ ID NO: 4149892 - DNA, 19 bp, Homo sapiens
taacagaacagcttcaggt

SEQ ID NO: 4149893 - DNA, 18 bp, Homo sapiens
taacagataagcaagaga

SEQ ID NO: 4149894 - DNA, 15 bp, Homo sapiens
taacagatgcaatgt

SEQ ID NO: 4149895 - DNA, 19 bp, Homo sapiens
taacagccaggagtgttaa

SEQ ID NO: 4149896 - DNA, 16 bp, Homo sapiens
taacagccgctccaga

SEQ ID NO: 4149897 - DNA, 15 bp, Homo sapiens
taacagctgaattat

SEQ ID NO: 4149898 - DNA, 15 bp, Homo sapiens
taacaggatgaaagt

SEQ ID NO: 4149899 - DNA, 20 bp, Homo sapiens
taacaggcatttgttcactg

SEQ ID NO: 4149900 - DNA, 22 bp, Homo sapiens
taacaggctcaatattcctgaa

SEQ ID NO: 4149901 - DNA, 24 bp, Homo sapiens
taacaggtgtggggacacagcagt

SEQ ID NO: 4149902 - DNA, 18 bp, Homo sapiens
taacagtcatttaaaaaa

SEQ ID NO: 4149903 - DNA, 12 bp, Homo sapiens
taacagtggctg

SEQ ID NO: 4149904 - DNA, 16 bp, Homo sapiens
taacagttttccatga

SEQ ID NO: 4149905 - DNA, 17 bp, Homo sapiens
taacagttttccatgaa

SEQ ID NO: 4149906 - DNA, 23 bp, Homo sapiens
taacatataatgttgttatttaa

SEQ ID NO: 4149907 - DNA, 20 bp, Homo sapiens
taacatatgtacataaattg

SEQ ID NO: 4149908 - DNA, 20 bp, Homo sapiens
taacatctaaaaatagactt

SEQ ID NO: 4149909 - DNA, 22 bp, Homo sapiens
taacatctacaatcagttgact

SEQ ID NO: 4149910 - DNA, 23 bp, Homo sapiens
taacatgaggggacattttggtg

SEQ ID NO: 4149911 - DNA, 18 bp, Homo sapiens
taacatggacatgatctt

SEQ ID NO: 4149912 - DNA, 23 bp, Homo sapiens
taacatggacatgatcttcttta

SEQ ID NO: 4149913 - DNA, 12 bp, Homo sapiens
taacattacctt

SEQ ID NO: 4149914 - DNA, 12 bp, Homo sapiens
taacattattta

SEQ ID NO: 4149915 - DNA, 15 bp, Homo sapiens
taacattatttatat

SEQ ID NO: 4149916 - DNA, 15 bp, Homo sapiens
taacattgaccaaga

SEQ ID NO: 4149917 - DNA, 16 bp, Homo sapiens
taacattgaccaagaa

SEQ ID NO: 4149918 - DNA, 18 bp, Homo sapiens
taacattgaccaagaact

SEQ ID NO: 4149919 - DNA, 19 bp, Homo sapiens
taacattgaccaagaactg

SEQ ID NO: 4149920 - DNA, 20 bp, Homo sapiens
taacattgaccaagaactgc

SEQ ID NO: 4149921 - DNA, 21 bp, Homo sapiens
taacattgaccaagaactgca

SEQ ID NO: 4149922 - DNA, 13 bp, Homo sapiens
taacatttgctgt

SEQ ID NO: 4149923 - DNA, 16 bp, Homo sapiens
taaccaagtttattca

SEQ ID NO: 4149924 - DNA, 22 bp, Homo sapiens
taaccaagtttattcagtaaac

SEQ ID NO: 4149925 - DNA, 13 bp, Homo sapiens
taaccacagctcc

SEQ ID NO: 4149926 - DNA, 14 bp, Homo sapiens
taaccacagctcct

SEQ ID NO: 4149927 - DNA, 17 bp, Homo sapiens
taaccacagctcctttt

SEQ ID NO: 4149928 - DNA, 19 bp, Homo sapiens
taaccacagctccttttcc

SEQ ID NO: 4149929 - DNA, 16 bp, Homo sapiens
taaccagacacaaact

SEQ ID NO: 4149930 - DNA, 20 bp, Homo sapiens
taaccagccagatcctcttg

SEQ ID NO: 4149931 - DNA, 19 bp, Homo sapiens
taaccagtacctctgtata

SEQ ID NO: 4149932 - DNA, 13 bp, Homo sapiens
taaccatttaata

SEQ ID NO: 4149933 - DNA, 19 bp, Homo sapiens
taaccatttctcactagtg

SEQ ID NO: 4149934 - DNA, 21 bp, Homo sapiens
taaccatttctcactagtgtc

SEQ ID NO: 4149935 - DNA, 18 bp, Homo sapiens
taacccacctctcctgcc

SEQ ID NO: 4149936 - DNA, 14 bp, Homo sapiens
taaccccagcctga

SEQ ID NO: 4149937 - DNA, 23 bp, Homo sapiens
taacccgctcatcactggatgaa

SEQ ID NO: 4149938 - DNA, 14 bp, Homo sapiens
taaccctacaccca

SEQ ID NO: 4149939 - DNA, 19 bp, Homo sapiens
taacccttcatcttcctgt

SEQ ID NO: 4149940 - DNA, 21 bp, Homo sapiens
taaccggcatgtttccagcag

SEQ ID NO: 4149941 - DNA, 16 bp, Homo sapiens
taacctcagctctggg

SEQ ID NO: 4149942 - DNA, 19 bp, Homo sapiens
taacctcagtgtcatttat

SEQ ID NO: 4149943 - DNA, 12 bp, Homo sapiens
taacctggtgct

SEQ ID NO: 4149944 - DNA, 19 bp, Homo sapiens
taacctggtgctggatatt

SEQ ID NO: 4149945 - DNA, 23 bp, Homo sapiens
taacctggtgctggatattttca

SEQ ID NO: 4149946 - DNA, 19 bp, Homo sapiens
taacctgtacttcaagtta

SEQ ID NO: 4149947 - DNA, 22 bp, Homo sapiens
taaccttatatttacaataaat

SEQ ID NO: 4149948 - DNA, 16 bp, Homo sapiens
taaccttatcaggatg

SEQ ID NO: 4149949 - DNA, 17 bp, Homo sapiens
taaccttgaatgctgcc

SEQ ID NO: 4149950 - DNA, 20 bp, Homo sapiens
taacctttttgtaaatactg

SEQ ID NO: 4149951 - DNA, 17 bp, Homo sapiens
taacgcgtcttcctgag

SEQ ID NO: 4149952 - DNA, 22 bp, Homo sapiens
taacggaaagtttttagaatgt

SEQ ID NO: 4149953 - DNA, 13 bp, Homo sapiens
taacggctccagg

SEQ ID NO: 4149954 - DNA, 14 bp, Homo sapiens
taacgggaggctgg

SEQ ID NO: 4149955 - DNA, 16 bp, Homo sapiens
taacgttgagcccctg

SEQ ID NO: 4149956 - DNA, 18 bp, Homo sapiens
taacgtttttcctttaaa

SEQ ID NO: 4149957 - DNA, 19 bp, Homo sapiens
taactaatctattgggttc

SEQ ID NO: 4149958 - DNA, 14 bp, Homo sapiens
taactactgtgttc

SEQ ID NO: 4149959 - DNA, 15 bp, Homo sapiens
taactagaatttatt

SEQ ID NO: 4149960 - DNA, 17 bp, Homo sapiens
taactagaatttattca

SEQ ID NO: 4149961 - DNA, 21 bp, Homo sapiens
taactagacacagataataat

SEQ ID NO: 4149962 - DNA, 19 bp, Homo sapiens
taactcatacctttaaagg

SEQ ID NO: 4149963 - DNA, 14 bp, Homo sapiens
taactcatcataaa

SEQ ID NO: 4149964 - DNA, 12 bp, Homo sapiens
taactcatttgt

SEQ ID NO: 4149965 - DNA, 19 bp, Homo sapiens
taactcctgagaaatgtta

SEQ ID NO: 4149966 - DNA, 14 bp, Homo sapiens
taactccttcttgt

SEQ ID NO: 4149967 - DNA, 14 bp, Homo sapiens
taactcttgtctat

SEQ ID NO: 4149968 - DNA, 12 bp, Homo sapiens
taactgccttga

SEQ ID NO: 4149969 - DNA, 21 bp, Homo sapiens
taactgctttctgttccaaat

SEQ ID NO: 4149970 - DNA, 17 bp, Homo sapiens
taactgtcctgtcctgc

SEQ ID NO: 4149971 - DNA, 17 bp, Homo sapiens
taactgtgaagtttaca

SEQ ID NO: 4149972 - DNA, 11 bp, Homo sapiens
taactgtgtat

SEQ ID NO: 4149973 - DNA, 13 bp, Homo sapiens
taactgtgtatgt

SEQ ID NO: 4149974 - DNA, 19 bp, Homo sapiens
taactgtgtatgtacatat

SEQ ID NO: 4149975 - DNA, 20 bp, Homo sapiens
taacttaaaaatgtaaatat

SEQ ID NO: 4149976 - DNA, 21 bp, Homo sapiens
taacttaaaaatgtaaatatt

SEQ ID NO: 4149977 - DNA, 16 bp, Homo sapiens
taacttaaaatatttt

SEQ ID NO: 4149978 - DNA, 15 bp, Homo sapiens
taacttatttagaga

SEQ ID NO: 4149979 - DNA, 17 bp, Homo sapiens
taacttccaatttacat

SEQ ID NO: 4149980 - DNA, 10 bp, Homo sapiens
taacttcctg

SEQ ID NO: 4149981 - DNA, 12 bp, Homo sapiens
taacttcctgct

SEQ ID NO: 4149982 - DNA, 14 bp, Homo sapiens
taacttcctgctgc

SEQ ID NO: 4149983 - DNA, 19 bp, Homo sapiens
taacttcctgctgcaccct

SEQ ID NO: 4149984 - DNA, 21 bp, Homo sapiens
taacttcctgctgcaccctgc

SEQ ID NO: 4149985 - DNA, 23 bp, Homo sapiens
taacttctatattttaatagaaa

SEQ ID NO: 4149986 - DNA, 12 bp, Homo sapiens
taactttaagtt

SEQ ID NO: 4149987 - DNA, 16 bp, Homo sapiens
taactttaagtttcag

SEQ ID NO: 4149988 - DNA, 20 bp, Homo sapiens
taactttgaaaggtatatga

SEQ ID NO: 4149989 - DNA, 20 bp, Homo sapiens
taacttttgtaaatacacat

SEQ ID NO: 4149990 - DNA, 19 bp, Homo sapiens
taagaaaaagcaaaaggca

SEQ ID NO: 4149991 - DNA, 23 bp, Homo sapiens
taagaaaacaaaatctaaaacaa

SEQ ID NO: 4149992 - DNA, 14 bp, Homo sapiens
taagaaaagagata

SEQ ID NO: 4149993 - DNA, 19 bp, Homo sapiens
taagaaaagattttaatca

SEQ ID NO: 4149994 - DNA, 12 bp, Homo sapiens
taagaaaagcac

SEQ ID NO: 4149995 - DNA, 16 bp, Homo sapiens
taagaaaagcactttt

SEQ ID NO: 4149996 - DNA, 22 bp, Homo sapiens
taagaaaagtattttgaagttt

SEQ ID NO: 4149997 - DNA, 20 bp, Homo sapiens
taagaaaccttgctctcctc

SEQ ID NO: 4149998 - DNA, 20 bp, Homo sapiens
taagaaactatgaagatctg

SEQ ID NO: 4149999 - DNA, 24 bp, Homo sapiens
taagaaagactatctaaatgttga

SEQ ID NO: 4150000 - DNA, 22 bp, Homo sapiens
taagaaagtgaagcaaatcaga

SEQ ID NO: 4150001 - DNA, 17 bp, Homo sapiens
taagaaatatgtgagat

SEQ ID NO: 4150002 - DNA, 20 bp, Homo sapiens
taagaaatatgtgagatttt

SEQ ID NO: 4150003 - DNA, 19 bp, Homo sapiens
taagaaatcaaagagagaa

SEQ ID NO: 4150004 - DNA, 14 bp, Homo sapiens
taagaaatgaacaa

SEQ ID NO: 4150005 - DNA, 16 bp, Homo sapiens
taagaaatgaacaaaa

SEQ ID NO: 4150006 - DNA, 18 bp, Homo sapiens
taagaacaaaagcgaccc

SEQ ID NO: 4150007 - DNA, 22 bp, Homo sapiens
taagaacaaagagaaaaaatac

SEQ ID NO: 4150008 - DNA, 15 bp, Homo sapiens
taagaagacatgaac

SEQ ID NO: 4150009 - DNA, 12 bp, Homo sapiens
taagaagagact

SEQ ID NO: 4150010 - DNA, 14 bp, Homo sapiens
taagaagcaaataa

SEQ ID NO: 4150011 - DNA, 13 bp, Homo sapiens
taagaagctgttg

SEQ ID NO: 4150012 - DNA, 17 bp, Homo sapiens
taagaaggcaatattaa

SEQ ID NO: 4150013 - DNA, 15 bp, Homo sapiens
taagaagttttaaaa

SEQ ID NO: 4150014 - DNA, 19 bp, Homo sapiens
taagaatatgtttccttgt

SEQ ID NO: 4150015 - DNA, 17 bp, Homo sapiens
taagaatcagagtagaa

SEQ ID NO: 4150016 - DNA, 21 bp, Homo sapiens
taagaatgctggttttcctaa

SEQ ID NO: 4150017 - DNA, 22 bp, Homo sapiens
taagaattgaccatctgctttt

SEQ ID NO: 4150018 - DNA, 18 bp, Homo sapiens
taagaattgagtaatggt

SEQ ID NO: 4150019 - DNA, 22 bp, Homo sapiens
taagaattgagtaatggtgtag

SEQ ID NO: 4150020 - DNA, 20 bp, Homo sapiens
taagaattgtttttgaattt

SEQ ID NO: 4150021 - DNA, 19 bp, Homo sapiens
taagaatttttcagcactt

SEQ ID NO: 4150022 - DNA, 22 bp, Homo sapiens
taagacaatggaccctttttgt

SEQ ID NO: 4150023 - DNA, 20 bp, Homo sapiens
taagacactgaaaaatctaa

SEQ ID NO: 4150024 - DNA, 14 bp, Homo sapiens
taagacacttccgt

SEQ ID NO: 4150025 - DNA, 16 bp, Homo sapiens
taagacatgatttcct

SEQ ID NO: 4150026 - DNA, 21 bp, Homo sapiens
taagacatgatttccttgaat

SEQ ID NO: 4150027 - DNA, 11 bp, Homo sapiens
taagacctggc

SEQ ID NO: 4150028 - DNA, 16 bp, Homo sapiens
taagactcacttacat

SEQ ID NO: 4150029 - DNA, 21 bp, Homo sapiens
taagagaaaattgcactaaat

SEQ ID NO: 4150030 - DNA, 15 bp, Homo sapiens
taagagaaactttat

SEQ ID NO: 4150031 - DNA, 16 bp, Homo sapiens
taagagaaactttata

SEQ ID NO: 4150032 - DNA, 20 bp, Homo sapiens
taagagaaactttatacatt

SEQ ID NO: 4150033 - DNA, 16 bp, Homo sapiens
taagagataattctta

SEQ ID NO: 4150034 - DNA, 22 bp, Homo sapiens
taagagccatttaggggccact

SEQ ID NO: 4150035 - DNA, 14 bp, Homo sapiens
taagagctggtgtc

SEQ ID NO: 4150036 - DNA, 17 bp, Homo sapiens
taagagctggtgtctga

SEQ ID NO: 4150037 - DNA, 23 bp, Homo sapiens
taagagggcagactgtgaacttg

SEQ ID NO: 4150038 - DNA, 19 bp, Homo sapiens
taagagtgtagaagcattc

SEQ ID NO: 4150039 - DNA, 14 bp, Homo sapiens
taagataaatgtgc

SEQ ID NO: 4150040 - DNA, 20 bp, Homo sapiens
taagatatcccagctttaaa

SEQ ID NO: 4150041 - DNA, 14 bp, Homo sapiens
taagattcatattt

SEQ ID NO: 4150042 - DNA, 14 bp, Homo sapiens
taagattccagaga

SEQ ID NO: 4150043 - DNA, 16 bp, Homo sapiens
taagattttacaaaag

SEQ ID NO: 4150044 - DNA, 21 bp, Homo sapiens
taagatttttctcaaagtttt

SEQ ID NO: 4150045 - DNA, 15 bp, Homo sapiens
taagcaaaagaaaaa

SEQ ID NO: 4150046 - DNA, 17 bp, Homo sapiens
taagcaaaggggacagc

SEQ ID NO: 4150047 - DNA, 18 bp, Homo sapiens
taagcactcttaaagcaa

SEQ ID NO: 4150048 - DNA, 14 bp, Homo sapiens
taagcactgaaaaa

SEQ ID NO: 4150049 - DNA, 20 bp, Homo sapiens
taagcactgaaaaacaacaa

SEQ ID NO: 4150050 - DNA, 15 bp, Homo sapiens
taagcagaaatcctg

SEQ ID NO: 4150051 - DNA, 22 bp, Homo sapiens
taagcagatggaatgctgtgtt

SEQ ID NO: 4150052 - DNA, 21 bp, Homo sapiens
taagcagatttaacaattcca

SEQ ID NO: 4150053 - DNA, 16 bp, Homo sapiens
taagcagcatggaaaa

SEQ ID NO: 4150054 - DNA, 19 bp, Homo sapiens
taagcagcatggaaaaatg

SEQ ID NO: 4150055 - DNA, 16 bp, Homo sapiens
taagcagctaaatttt

SEQ ID NO: 4150056 - DNA, 21 bp, Homo sapiens
taagcaggtggatctatttca

SEQ ID NO: 4150057 - DNA, 24 bp, Homo sapiens
taagcatgctttctttgagtttta

SEQ ID NO: 4150058 - DNA, 19 bp, Homo sapiens
taagcattgtttgcttatt

SEQ ID NO: 4150059 - DNA, 20 bp, Homo sapiens
taagcattgtttgcttattg

SEQ ID NO: 4150060 - DNA, 21 bp, Homo sapiens
taagcattgtttgcttattgt

SEQ ID NO: 4150061 - DNA, 23 bp, Homo sapiens
taagcattgtttgcttattgttc

SEQ ID NO: 4150062 - DNA, 16 bp, Homo sapiens
taagccaggcctggct

SEQ ID NO: 4150063 - DNA, 20 bp, Homo sapiens
taagccatagaccctgaggc

SEQ ID NO: 4150064 - DNA, 16 bp, Homo sapiens
taagccataggcccag

SEQ ID NO: 4150065 - DNA, 22 bp, Homo sapiens
taagcccccagggcctccaggg

SEQ ID NO: 4150066 - DNA, 23 bp, Homo sapiens
taagcccccagggcctccagggc

SEQ ID NO: 4150067 - DNA, 11 bp, Homo sapiens
taagccctgtc

SEQ ID NO: 4150068 - DNA, 16 bp, Homo sapiens
taagccctgtcgagac

SEQ ID NO: 4150069 - DNA, 22 bp, Homo sapiens
taagccctgtcgagacacttgc

SEQ ID NO: 4150070 - DNA, 17 bp, Homo sapiens
taagcctacctgctctc

SEQ ID NO: 4150071 - DNA, 16 bp, Homo sapiens
taagcctcatatttaa

SEQ ID NO: 4150072 - DNA, 17 bp, Homo sapiens
taagcctcatatttaaa

SEQ ID NO: 4150073 - DNA, 17 bp, Homo sapiens
taagccttataaaccaa

SEQ ID NO: 4150074 - DNA, 20 bp, Homo sapiens
taagccttataaaccaatct

SEQ ID NO: 4150075 - DNA, 19 bp, Homo sapiens
taagctcagtgctctctcc

SEQ ID NO: 4150076 - DNA, 21 bp, Homo sapiens
taagctccttgagtaaaaagg

SEQ ID NO: 4150077 - DNA, 13 bp, Homo sapiens
taagctctggctt

SEQ ID NO: 4150078 - DNA, 16 bp, Homo sapiens
taagctctttgagaac

SEQ ID NO: 4150079 - DNA, 20 bp, Homo sapiens
taagctgtgccttcagctgt

SEQ ID NO: 4150080 - DNA, 16 bp, Homo sapiens
taagctgtttccatag

SEQ ID NO: 4150081 - DNA, 19 bp, Homo sapiens
taaggaaactcttatctca

SEQ ID NO: 4150082 - DNA, 21 bp, Homo sapiens
taaggaaagcaataaatgaat

SEQ ID NO: 4150083 - DNA, 15 bp, Homo sapiens
taaggaagagggctg

SEQ ID NO: 4150084 - DNA, 18 bp, Homo sapiens
taaggacaaaaatgaact

SEQ ID NO: 4150085 - DNA, 17 bp, Homo sapiens
taaggacgtgtgtaaat

SEQ ID NO: 4150086 - DNA, 17 bp, Homo sapiens
taaggacttctgcagct

SEQ ID NO: 4150087 - DNA, 16 bp, Homo sapiens
taaggagactgaggct

SEQ ID NO: 4150088 - DNA, 20 bp, Homo sapiens
taaggatggagccagctctg

SEQ ID NO: 4150089 - DNA, 14 bp, Homo sapiens
taaggcaggcattg

SEQ ID NO: 4150090 - DNA, 12 bp, Homo sapiens
taaggcatgtta

SEQ ID NO: 4150091 - DNA, 14 bp, Homo sapiens
taaggcctgaatca

SEQ ID NO: 4150092 - DNA, 20 bp, Homo sapiens
taaggctgagggctgccagc

SEQ ID NO: 4150093 - DNA, 17 bp, Homo sapiens
taagggaagacatttct

SEQ ID NO: 4150094 - DNA, 18 bp, Homo sapiens
taagggaagacatttctt

SEQ ID NO: 4150095 - DNA, 19 bp, Homo sapiens
taagggacttaacttgttt

SEQ ID NO: 4150096 - DNA, 19 bp, Homo sapiens
taaggggaggaaccagagt

SEQ ID NO: 4150097 - DNA, 18 bp, Homo sapiens
taagggtgggtgctcaga

SEQ ID NO: 4150098 - DNA, 19 bp, Homo sapiens
taagggtgggtgctcagaa

SEQ ID NO: 4150099 - DNA, 20 bp, Homo sapiens
taagggtgggtgctcagaat

SEQ ID NO: 4150100 - DNA, 23 bp, Homo sapiens
taaggtcaaactaattctcacat

SEQ ID NO: 4150101 - DNA, 18 bp, Homo sapiens
taaggtgatatatttaaa

SEQ ID NO: 4150102 - DNA, 12 bp, Homo sapiens
taaggtgcagtt

SEQ ID NO: 4150103 - DNA, 18 bp, Homo sapiens
taagtaaattgcctgatt

SEQ ID NO: 4150104 - DNA, 19 bp, Homo sapiens
taagtaacttaaggacctt

SEQ ID NO: 4150105 - DNA, 14 bp, Homo sapiens
taagtaatcaataa

SEQ ID NO: 4150106 - DNA, 18 bp, Homo sapiens
taagtaatcaataaagaa

SEQ ID NO: 4150107 - DNA, 18 bp, Homo sapiens
taagtacacaataagcaa

SEQ ID NO: 4150108 - DNA, 15 bp, Homo sapiens
taagtactagatgca

SEQ ID NO: 4150109 - DNA, 17 bp, Homo sapiens
taagtactatgtatcaa

SEQ ID NO: 4150110 - DNA, 14 bp, Homo sapiens
taagtatacagttc

SEQ ID NO: 4150111 - DNA, 18 bp, Homo sapiens
taagtatttatatattta

SEQ ID NO: 4150112 - DNA, 19 bp, Homo sapiens
taagtcagtatggtctaac

SEQ ID NO: 4150113 - DNA, 16 bp, Homo sapiens
taagtcagtgttgaga

SEQ ID NO: 4150114 - DNA, 19 bp, Homo sapiens
taagtcatctacttaataa

SEQ ID NO: 4150115 - DNA, 19 bp, Homo sapiens
taagtgatattcatttaaa

SEQ ID NO: 4150116 - DNA, 19 bp, Homo sapiens
taagtgcgtgtgtagagtt

SEQ ID NO: 4150117 - DNA, 16 bp, Homo sapiens
taagtggaggcacttt

SEQ ID NO: 4150118 - DNA, 17 bp, Homo sapiens
taagtggaggcacttta

SEQ ID NO: 4150119 - DNA, 13 bp, Homo sapiens
taagtggctgcct

SEQ ID NO: 4150120 - DNA, 19 bp, Homo sapiens
taagtgtgagtaagagctg

SEQ ID NO: 4150121 - DNA, 20 bp, Homo sapiens
taagtgtgtggtagaaacaa

SEQ ID NO: 4150122 - DNA, 14 bp, Homo sapiens
taagtgttgtaaat

SEQ ID NO: 4150123 - DNA, 14 bp, Homo sapiens
taagttaataatgt

SEQ ID NO: 4150124 - DNA, 20 bp, Homo sapiens
taagttatttcttgtttgtt

SEQ ID NO: 4150125 - DNA, 22 bp, Homo sapiens
taagttcatattccatatttat

SEQ ID NO: 4150126 - DNA, 13 bp, Homo sapiens
taagttgtacaaa

SEQ ID NO: 4150127 - DNA, 15 bp, Homo sapiens
taagttgtacaaatg

SEQ ID NO: 4150128 - DNA, 17 bp, Homo sapiens
taagttgtacaaatgta

SEQ ID NO: 4150129 - DNA, 12 bp, Homo sapiens
taagtttcccct

SEQ ID NO: 4150130 - DNA, 16 bp, Homo sapiens
taagtttcccctctgg

SEQ ID NO: 4150131 - DNA, 14 bp, Homo sapiens
taataaaaaatgga

SEQ ID NO: 4150132 - DNA, 21 bp, Homo sapiens
taataaaaaatggaaagaatc

SEQ ID NO: 4150133 - DNA, 15 bp, Homo sapiens
taataaaaaattatg

SEQ ID NO: 4150134 - DNA, 19 bp, Homo sapiens
taataaaacaatactcaaa

SEQ ID NO: 4150135 - DNA, 14 bp, Homo sapiens
taataaaaggaaaa

SEQ ID NO: 4150136 - DNA, 20 bp, Homo sapiens
taataaaaggaaaagcaaat

SEQ ID NO: 4150137 - DNA, 16 bp, Homo sapiens
taataaaataattcta

SEQ ID NO: 4150138 - DNA, 19 bp, Homo sapiens
taataaaataattctaaag

SEQ ID NO: 4150139 - DNA, 15 bp, Homo sapiens
taataaacataatga

SEQ ID NO: 4150140 - DNA, 14 bp, Homo sapiens
taataaactgtgtt

SEQ ID NO: 4150141 - DNA, 16 bp, Homo sapiens
taataaaggactgtaa

SEQ ID NO: 4150142 - DNA, 20 bp, Homo sapiens
taataaaggactgtaatctt

SEQ ID NO: 4150143 - DNA, 16 bp, Homo sapiens
taataaatatttatgt

SEQ ID NO: 4150144 - DNA, 19 bp, Homo sapiens
taataaatatttttgccat

SEQ ID NO: 4150145 - DNA, 18 bp, Homo sapiens
taataaatgccctcttct

SEQ ID NO: 4150146 - DNA, 17 bp, Homo sapiens
taataaattgaaattgt

SEQ ID NO: 4150147 - DNA, 20 bp, Homo sapiens
taataaattgaaattgtgaa

SEQ ID NO: 4150148 - DNA, 20 bp, Homo sapiens
taataacattaccttactgt

SEQ ID NO: 4150149 - DNA, 14 bp, Homo sapiens
taataaccagacac

SEQ ID NO: 4150150 - DNA, 15 bp, Homo sapiens
taataactgtgaagt

SEQ ID NO: 4150151 - DNA, 21 bp, Homo sapiens
taataactgtgaagtttacat

SEQ ID NO: 4150152 - DNA, 14 bp, Homo sapiens
taataagacataac

SEQ ID NO: 4150153 - DNA, 14 bp, Homo sapiens
taataataatgttt

SEQ ID NO: 4150154 - DNA, 20 bp, Homo sapiens
taataatcttattagggaga

SEQ ID NO: 4150155 - DNA, 13 bp, Homo sapiens
taataatgggttt

SEQ ID NO: 4150156 - DNA, 16 bp, Homo sapiens
taataattttatagaa

SEQ ID NO: 4150157 - DNA, 17 bp, Homo sapiens
taataattttatagaaa

SEQ ID NO: 4150158 - DNA, 20 bp, Homo sapiens
taatacctcttactttgctt

SEQ ID NO: 4150159 - DNA, 12 bp, Homo sapiens
taatactggaat

SEQ ID NO: 4150160 - DNA, 16 bp, Homo sapiens
taatactggaataatt

SEQ ID NO: 4150161 - DNA, 23 bp, Homo sapiens
taatactggaataatttgtaaat

SEQ ID NO: 4150162 - DNA, 21 bp, Homo sapiens
taatagaatataattatcgga

SEQ ID NO: 4150163 - DNA, 14 bp, Homo sapiens
taatagcagccttt

SEQ ID NO: 4150164 - DNA, 19 bp, Homo sapiens
taataggtagtttggatat

SEQ ID NO: 4150165 - DNA, 21 bp, Homo sapiens
taatagtgcttaaaaatcatt

SEQ ID NO: 4150166 - DNA, 16 bp, Homo sapiens
taatagttattattta

SEQ ID NO: 4150167 - DNA, 20 bp, Homo sapiens
taatagttattatttaattg

SEQ ID NO: 4150168 - DNA, 13 bp, Homo sapiens
taatagtttgtct

SEQ ID NO: 4150169 - DNA, 18 bp, Homo sapiens
taatagtttgtctatttt

SEQ ID NO: 4150170 - DNA, 19 bp, Homo sapiens
taatagtttgtctatttta

SEQ ID NO: 4150171 - DNA, 20 bp, Homo sapiens
taatataataatagttatta

SEQ ID NO: 4150172 - DNA, 14 bp, Homo sapiens
taatatatatgaat

SEQ ID NO: 4150173 - DNA, 16 bp, Homo sapiens
taatatatatgaataa

SEQ ID NO: 4150174 - DNA, 21 bp, Homo sapiens
taatatattctgaagcaacat

SEQ ID NO: 4150175 - DNA, 18 bp, Homo sapiens
taatatccctacatgtat

SEQ ID NO: 4150176 - DNA, 14 bp, Homo sapiens
taatatctttgtga

SEQ ID NO: 4150177 - DNA, 19 bp, Homo sapiens
taatatctttgtgataatt

SEQ ID NO: 4150178 - DNA, 20 bp, Homo sapiens
taatatctttgtgataattt

SEQ ID NO: 4150179 - DNA, 21 bp, Homo sapiens
taatatctttgtgataattta

SEQ ID NO: 4150180 - DNA, 14 bp, Homo sapiens
taatatgaaaactt

SEQ ID NO: 4150181 - DNA, 15 bp, Homo sapiens
taatatgaaaactta

SEQ ID NO: 4150182 - DNA, 16 bp, Homo sapiens
taatatgaaaacttat

SEQ ID NO: 4150183 - DNA, 10 bp, Homo sapiens
taatatgcat

SEQ ID NO: 4150184 - DNA, 16 bp, Homo sapiens
taatatgctgccaaat

SEQ ID NO: 4150185 - DNA, 18 bp, Homo sapiens
taatatgctgccaaattt

SEQ ID NO: 4150186 - DNA, 18 bp, Homo sapiens
taatatgcttaaaataag

SEQ ID NO: 4150187 - DNA, 22 bp, Homo sapiens
taatatggccacagtagtcttg

SEQ ID NO: 4150188 - DNA, 15 bp, Homo sapiens
taatatgggcattgt

SEQ ID NO: 4150189 - DNA, 22 bp, Homo sapiens
taatattcttttgtttccatgg

SEQ ID NO: 4150190 - DNA, 14 bp, Homo sapiens
taatattgagaaag

SEQ ID NO: 4150191 - DNA, 19 bp, Homo sapiens
taatattgagaaagaaact

SEQ ID NO: 4150192 - DNA, 21 bp, Homo sapiens
taatattgatatgcttataca

SEQ ID NO: 4150193 - DNA, 18 bp, Homo sapiens
taatattgttgtataatt

SEQ ID NO: 4150194 - DNA, 21 bp, Homo sapiens
taatatttaaacagcagtgtt

SEQ ID NO: 4150195 - DNA, 20 bp, Homo sapiens
taatatttagctgtaaactg

SEQ ID NO: 4150196 - DNA, 21 bp, Homo sapiens
taatatttatgtctatttaag

SEQ ID NO: 4150197 - DNA, 14 bp, Homo sapiens
taatcaaaattgtc

SEQ ID NO: 4150198 - DNA, 10 bp, Homo sapiens
taatcaagat

SEQ ID NO: 4150199 - DNA, 19 bp, Homo sapiens
taatcaagatttttttcct

SEQ ID NO: 4150200 - DNA, 21 bp, Homo sapiens
taatcaagtaaggatgtatgt

SEQ ID NO: 4150201 - DNA, 14 bp, Homo sapiens
taatcaataaagaa

SEQ ID NO: 4150202 - DNA, 19 bp, Homo sapiens
taatcaatgaatattgaag

SEQ ID NO: 4150203 - DNA, 15 bp, Homo sapiens
taatcaccatgtaag

SEQ ID NO: 4150204 - DNA, 20 bp, Homo sapiens
taatcagaaatttttatcag

SEQ ID NO: 4150205 - DNA, 17 bp, Homo sapiens
taatcagtgtgtctaaa

SEQ ID NO: 4150206 - DNA, 23 bp, Homo sapiens
taatcagtgtgtctaaatttgaa

SEQ ID NO: 4150207 - DNA, 15 bp, Homo sapiens
taatcatataataaa

SEQ ID NO: 4150208 - DNA, 13 bp, Homo sapiens
taatcatatgtgt

SEQ ID NO: 4150209 - DNA, 20 bp, Homo sapiens
taatcatccccatcctccag

SEQ ID NO: 4150210 - DNA, 21 bp, Homo sapiens
taatcatccccatcctccaga

SEQ ID NO: 4150211 - DNA, 19 bp, Homo sapiens
taatcatgtgggtgagcca

SEQ ID NO: 4150212 - DNA, 21 bp, Homo sapiens
taatcatgtgggtgagccagt

SEQ ID NO: 4150213 - DNA, 13 bp, Homo sapiens
taatccagctgat

SEQ ID NO: 4150214 - DNA, 19 bp, Homo sapiens
taatccaggcacagctgag

SEQ ID NO: 4150215 - DNA, 17 bp, Homo sapiens
taatccaggcagatcca

SEQ ID NO: 4150216 - DNA, 12 bp, Homo sapiens
taatccagtaaa

SEQ ID NO: 4150217 - DNA, 18 bp, Homo sapiens
taatccagtattgctgat

SEQ ID NO: 4150218 - DNA, 19 bp, Homo sapiens
taatcccagcactttggga

SEQ ID NO: 4150219 - DNA, 14 bp, Homo sapiens
taatccctgggcat

SEQ ID NO: 4150220 - DNA, 22 bp, Homo sapiens
taatcctattaaaacacagctt

SEQ ID NO: 4150221 - DNA, 14 bp, Homo sapiens
taatccttttcctt

SEQ ID NO: 4150222 - DNA, 23 bp, Homo sapiens
taatccttttccttatttgcctt

SEQ ID NO: 4150223 - DNA, 19 bp, Homo sapiens
taatctaaaagctctgttc

SEQ ID NO: 4150224 - DNA, 14 bp, Homo sapiens
taatctagacaata

SEQ ID NO: 4150225 - DNA, 17 bp, Homo sapiens
taatctctctgcagctg

SEQ ID NO: 4150226 - DNA, 14 bp, Homo sapiens
taatctgaaattct

SEQ ID NO: 4150227 - DNA, 15 bp, Homo sapiens
taatctgaaattcta

SEQ ID NO: 4150228 - DNA, 13 bp, Homo sapiens
taatctgaagata

SEQ ID NO: 4150229 - DNA, 13 bp, Homo sapiens
taatctgaataaa

SEQ ID NO: 4150230 - DNA, 17 bp, Homo sapiens
taatctgaataaagtgt

SEQ ID NO: 4150231 - DNA, 23 bp, Homo sapiens
taatctgaataaagtgtaacaat

SEQ ID NO: 4150232 - DNA, 18 bp, Homo sapiens
taatctgagctgcagcct

SEQ ID NO: 4150233 - DNA, 22 bp, Homo sapiens
taatctgagctgcagcctggct

SEQ ID NO: 4150234 - DNA, 16 bp, Homo sapiens
taatctgtagggctgg

SEQ ID NO: 4150235 - DNA, 20 bp, Homo sapiens
taatctgtagggctggacct

SEQ ID NO: 4150236 - DNA, 20 bp, Homo sapiens
taatctgttatgtactagtg

SEQ ID NO: 4150237 - DNA, 20 bp, Homo sapiens
taatcttaaatcagaataaa

SEQ ID NO: 4150238 - DNA, 21 bp, Homo sapiens
taatcttattagggagaaaat

SEQ ID NO: 4150239 - DNA, 13 bp, Homo sapiens
taatcttcagttt

SEQ ID NO: 4150240 - DNA, 19 bp, Homo sapiens
taatctttacctgtataca

SEQ ID NO: 4150241 - DNA, 17 bp, Homo sapiens
taatctttcacttgaaa

SEQ ID NO: 4150242 - DNA, 22 bp, Homo sapiens
taatctttcacttgaaagattt

SEQ ID NO: 4150243 - DNA, 12 bp, Homo sapiens
taatctttgggt

SEQ ID NO: 4150244 - DNA, 22 bp, Homo sapiens
taatctttgggtaacttcaaaa

SEQ ID NO: 4150245 - DNA, 18 bp, Homo sapiens
taatgaaaatgaatatct

SEQ ID NO: 4150246 - DNA, 22 bp, Homo sapiens
taatgaaagactgtacaaagta

SEQ ID NO: 4150247 - DNA, 17 bp, Homo sapiens
taatgaaataatcagtg

SEQ ID NO: 4150248 - DNA, 16 bp, Homo sapiens
taatgaataaactgaa

SEQ ID NO: 4150249 - DNA, 17 bp, Homo sapiens
taatgaataaactgaat

SEQ ID NO: 4150250 - DNA, 17 bp, Homo sapiens
taatgaatgaaacattt

SEQ ID NO: 4150251 - DNA, 16 bp, Homo sapiens
taatgaatttttatga

SEQ ID NO: 4150252 - DNA, 17 bp, Homo sapiens
taatgagcaatatctgc

SEQ ID NO: 4150253 - DNA, 11 bp, Homo sapiens
taatgagccat

SEQ ID NO: 4150254 - DNA, 12 bp, Homo sapiens
taatgagccatc

SEQ ID NO: 4150255 - DNA, 13 bp, Homo sapiens
taatgataaaata

SEQ ID NO: 4150256 - DNA, 15 bp, Homo sapiens
taatgataaaataaa

SEQ ID NO: 4150257 - DNA, 18 bp, Homo sapiens
taatgataaaataaataa

SEQ ID NO: 4150258 - DNA, 22 bp, Homo sapiens
taatgcagccacgattggagaa

SEQ ID NO: 4150259 - DNA, 19 bp, Homo sapiens
taatgcattcttctctgtt

SEQ ID NO: 4150260 - DNA, 16 bp, Homo sapiens
taatgcgatttcttcc

SEQ ID NO: 4150261 - DNA, 24 bp, Homo sapiens
taatgctgcaaacttaatgttctt

SEQ ID NO: 4150262 - DNA, 17 bp, Homo sapiens
taatgcttccaatcttg

SEQ ID NO: 4150263 - DNA, 14 bp, Homo sapiens
taatgcttttatat

SEQ ID NO: 4150264 - DNA, 12 bp, Homo sapiens
taatggaaacat

SEQ ID NO: 4150265 - DNA, 19 bp, Homo sapiens
taatggtactgactttgct

SEQ ID NO: 4150266 - DNA, 13 bp, Homo sapiens
taatggtgtagaa

SEQ ID NO: 4150267 - DNA, 19 bp, Homo sapiens
taatggtttttatttctcg

SEQ ID NO: 4150268 - DNA, 14 bp, Homo sapiens
taatgtaaaatgat

SEQ ID NO: 4150269 - DNA, 17 bp, Homo sapiens
taatgtcagtatttcaa

SEQ ID NO: 4150270 - DNA, 18 bp, Homo sapiens
taatgtccctttcagaga

SEQ ID NO: 4150271 - DNA, 14 bp, Homo sapiens
taatgtcttcataa

SEQ ID NO: 4150272 - DNA, 14 bp, Homo sapiens
taatgtgaaaagta

SEQ ID NO: 4150273 - DNA, 18 bp, Homo sapiens
taatgtgaagacattttt

SEQ ID NO: 4150274 - DNA, 16 bp, Homo sapiens
taatgtgaaggcccaa

SEQ ID NO: 4150275 - DNA, 13 bp, Homo sapiens
taatgtggcttct

SEQ ID NO: 4150276 - DNA, 16 bp, Homo sapiens
taatgtggttatttct

SEQ ID NO: 4150277 - DNA, 13 bp, Homo sapiens
taatgtgtgaaaa

SEQ ID NO: 4150278 - DNA, 18 bp, Homo sapiens
taatgtgtggtggcctca

SEQ ID NO: 4150279 - DNA, 19 bp, Homo sapiens
taatgtgtggtggcctcag

SEQ ID NO: 4150280 - DNA, 15 bp, Homo sapiens
taatgttaattcagc

SEQ ID NO: 4150281 - DNA, 22 bp, Homo sapiens
taatgttcttatgcaaaatgga

SEQ ID NO: 4150282 - DNA, 20 bp, Homo sapiens
taatgtttaaatcatgtatg

SEQ ID NO: 4150283 - DNA, 17 bp, Homo sapiens
taatgtttatgagccag

SEQ ID NO: 4150284 - DNA, 12 bp, Homo sapiens
taatgtttgcta

SEQ ID NO: 4150285 - DNA, 18 bp, Homo sapiens
taatgtttgttacctcca

SEQ ID NO: 4150286 - DNA, 20 bp, Homo sapiens
taatgttttgtatatacagt

SEQ ID NO: 4150287 - DNA, 22 bp, Homo sapiens
taatgttttttgccacagcttt

SEQ ID NO: 4150288 - DNA, 18 bp, Homo sapiens
taattaaaatttatctta

SEQ ID NO: 4150289 - DNA, 16 bp, Homo sapiens
taattaaatctcaaat

SEQ ID NO: 4150290 - DNA, 15 bp, Homo sapiens
taattaaatttaact

SEQ ID NO: 4150291 - DNA, 23 bp, Homo sapiens
taattaaattttgagttctacat

SEQ ID NO: 4150292 - DNA, 13 bp, Homo sapiens
taattaatggctt

SEQ ID NO: 4150293 - DNA, 16 bp, Homo sapiens
taattaatgtcatgtt

SEQ ID NO: 4150294 - DNA, 16 bp, Homo sapiens
taattacaatatttct

SEQ ID NO: 4150295 - DNA, 19 bp, Homo sapiens
taattacaatatttctgat

SEQ ID NO: 4150296 - DNA, 13 bp, Homo sapiens
taattactggaat

SEQ ID NO: 4150297 - DNA, 22 bp, Homo sapiens
taattacttattgtatttatgt

SEQ ID NO: 4150298 - DNA, 17 bp, Homo sapiens
taattaggcaaggctat

SEQ ID NO: 4150299 - DNA, 21 bp, Homo sapiens
taattaggcaaggctatgtga

SEQ ID NO: 4150300 - DNA, 18 bp, Homo sapiens
taattaggggttgctaag

SEQ ID NO: 4150301 - DNA, 22 bp, Homo sapiens
taattagggtacatttataatt

SEQ ID NO: 4150302 - DNA, 17 bp, Homo sapiens
taattatcggaagcagt

SEQ ID NO: 4150303 - DNA, 18 bp, Homo sapiens
taattatcggaagcagtg

SEQ ID NO: 4150304 - DNA, 21 bp, Homo sapiens
taattatcggaagcagtgcct

SEQ ID NO: 4150305 - DNA, 18 bp, Homo sapiens
taattatcgggaacagtg

SEQ ID NO: 4150306 - DNA, 14 bp, Homo sapiens
taattattatttat

SEQ ID NO: 4150307 - DNA, 22 bp, Homo sapiens
taattattatttatatatgtat

SEQ ID NO: 4150308 - DNA, 17 bp, Homo sapiens
taattattatttccagt

SEQ ID NO: 4150309 - DNA, 15 bp, Homo sapiens
taattatttaaataa

SEQ ID NO: 4150310 - DNA, 18 bp, Homo sapiens
taattatttaaataaaat

SEQ ID NO: 4150311 - DNA, 19 bp, Homo sapiens
taattcaaaagattaatgt

SEQ ID NO: 4150312 - DNA, 17 bp, Homo sapiens
taattcaaggagaatat

SEQ ID NO: 4150313 - DNA, 15 bp, Homo sapiens
taattcacctatgtt

SEQ ID NO: 4150314 - DNA, 21 bp, Homo sapiens
taattcagcactgatttcaca

SEQ ID NO: 4150315 - DNA, 15 bp, Homo sapiens
taattccacaccttt

SEQ ID NO: 4150316 - DNA, 20 bp, Homo sapiens
taattccctatcttttagtt

SEQ ID NO: 4150317 - DNA, 21 bp, Homo sapiens
taattcctatatcctgtgact

SEQ ID NO: 4150318 - DNA, 12 bp, Homo sapiens
taattctaaagg

SEQ ID NO: 4150319 - DNA, 11 bp, Homo sapiens
taattctaaat

SEQ ID NO: 4150320 - DNA, 19 bp, Homo sapiens
taattctaagttatttact

SEQ ID NO: 4150321 - DNA, 21 bp, Homo sapiens
taattctaagttatttacttt

SEQ ID NO: 4150322 - DNA, 18 bp, Homo sapiens
taattcttaaaagggaaa

SEQ ID NO: 4150323 - DNA, 19 bp, Homo sapiens
taattcttcagcgtaaaat

SEQ ID NO: 4150324 - DNA, 23 bp, Homo sapiens
taattcttcagcgtaaaatggtg

SEQ ID NO: 4150325 - DNA, 15 bp, Homo sapiens
taattcttgtatatt

SEQ ID NO: 4150326 - DNA, 22 bp, Homo sapiens
taattgatgcaaataacacaaa

SEQ ID NO: 4150327 - DNA, 15 bp, Homo sapiens
taattgcttacattt

SEQ ID NO: 4150328 - DNA, 13 bp, Homo sapiens
taattgtgtaaaa

SEQ ID NO: 4150329 - DNA, 20 bp, Homo sapiens
taattgtgtaaaaaatggaa

SEQ ID NO: 4150330 - DNA, 21 bp, Homo sapiens
taattgtgtaaaaaatggaaa

SEQ ID NO: 4150331 - DNA, 21 bp, Homo sapiens
taatttaaacatttgttcctg

SEQ ID NO: 4150332 - DNA, 13 bp, Homo sapiens
taatttaaagaga

SEQ ID NO: 4150333 - DNA, 22 bp, Homo sapiens
taatttacaaaaatataaaata

SEQ ID NO: 4150334 - DNA, 21 bp, Homo sapiens
taatttagagataggaaactg

SEQ ID NO: 4150335 - DNA, 21 bp, Homo sapiens
taatttagtgatcttagcata

SEQ ID NO: 4150336 - DNA, 12 bp, Homo sapiens
taatttatttat

SEQ ID NO: 4150337 - DNA, 17 bp, Homo sapiens
taatttatttattaaga

SEQ ID NO: 4150338 - DNA, 18 bp, Homo sapiens
taatttatttattaagat

SEQ ID NO: 4150339 - DNA, 19 bp, Homo sapiens
taatttcaaaaatataact

SEQ ID NO: 4150340 - DNA, 16 bp, Homo sapiens
taatttcaaaatgctt

SEQ ID NO: 4150341 - DNA, 13 bp, Homo sapiens
taatttccttttt

SEQ ID NO: 4150342 - DNA, 20 bp, Homo sapiens
taatttcctttttgacactg

SEQ ID NO: 4150343 - DNA, 17 bp, Homo sapiens
taatttctaaagataat

SEQ ID NO: 4150344 - DNA, 14 bp, Homo sapiens
taatttctcctccc

SEQ ID NO: 4150345 - DNA, 14 bp, Homo sapiens
taatttgaagattg

SEQ ID NO: 4150346 - DNA, 16 bp, Homo sapiens
taatttgatgaaagct

SEQ ID NO: 4150347 - DNA, 14 bp, Homo sapiens
taatttgattaaca

SEQ ID NO: 4150348 - DNA, 15 bp, Homo sapiens
taatttgattaacaa

SEQ ID NO: 4150349 - DNA, 22 bp, Homo sapiens
taatttggggaaacctagagaa

SEQ ID NO: 4150350 - DNA, 21 bp, Homo sapiens
taatttgtaaatgattttaat

SEQ ID NO: 4150351 - DNA, 13 bp, Homo sapiens
taattttaaataa

SEQ ID NO: 4150352 - DNA, 14 bp, Homo sapiens
taattttacacatt

SEQ ID NO: 4150353 - DNA, 21 bp, Homo sapiens
taattttaccaagagtaactt

SEQ ID NO: 4150354 - DNA, 15 bp, Homo sapiens
taattttatagaaaa

SEQ ID NO: 4150355 - DNA, 14 bp, Homo sapiens
taattttcacaaaa

SEQ ID NO: 4150356 - DNA, 19 bp, Homo sapiens
taattttcacaaaatgtct

SEQ ID NO: 4150357 - DNA, 22 bp, Homo sapiens
taattttctcaaaagcatttat

SEQ ID NO: 4150358 - DNA, 14 bp, Homo sapiens
taattttcttcatg

SEQ ID NO: 4150359 - DNA, 13 bp, Homo sapiens
taattttggattt

SEQ ID NO: 4150360 - DNA, 12 bp, Homo sapiens
taatttttaatt

SEQ ID NO: 4150361 - DNA, 14 bp, Homo sapiens
taatttttacccta

SEQ ID NO: 4150362 - DNA, 18 bp, Homo sapiens
taatttttaccctaatgt

SEQ ID NO: 4150363 - DNA, 21 bp, Homo sapiens
taatttttaccctaatgtctt

SEQ ID NO: 4150364 - DNA, 14 bp, Homo sapiens
taatttttttaatt

SEQ ID NO: 4150365 - DNA, 17 bp, Homo sapiens
taattttttttaaaata

SEQ ID NO: 4150366 - DNA, 20 bp, Homo sapiens
tacaaaaaaaaagttttatt

SEQ ID NO: 4150367 - DNA, 14 bp, Homo sapiens
tacaaaaatataaa

SEQ ID NO: 4150368 - DNA, 18 bp, Homo sapiens
tacaaaaatataaaatat

SEQ ID NO: 4150369 - DNA, 20 bp, Homo sapiens
tacaaaaatataaaatatga

SEQ ID NO: 4150370 - DNA, 15 bp, Homo sapiens
tacaaaataaaaaca

SEQ ID NO: 4150371 - DNA, 11 bp, Homo sapiens
tacaaactgca

SEQ ID NO: 4150372 - DNA, 12 bp, Homo sapiens
tacaaactgcaa

SEQ ID NO: 4150373 - DNA, 17 bp, Homo sapiens
tacaaactgcaatagag

SEQ ID NO: 4150374 - DNA, 21 bp, Homo sapiens
tacaaagaggtgtacaggtac

SEQ ID NO: 4150375 - DNA, 12 bp, Homo sapiens
tacaaagtaaat

SEQ ID NO: 4150376 - DNA, 14 bp, Homo sapiens
tacaaagtagaagt

SEQ ID NO: 4150377 - DNA, 23 bp, Homo sapiens
tacaaatactcttaggaagagaa

SEQ ID NO: 4150378 - DNA, 11 bp, Homo sapiens
tacaaatctgt

SEQ ID NO: 4150379 - DNA, 20 bp, Homo sapiens
tacaaatctgtataaatgtc

SEQ ID NO: 4150380 - DNA, 23 bp, Homo sapiens
tacaaatctgtataaatgtctat

SEQ ID NO: 4150381 - DNA, 19 bp, Homo sapiens
tacaaatgccttaaaatgg

SEQ ID NO: 4150382 - DNA, 21 bp, Homo sapiens
tacaaatgccttaaaatggaa

SEQ ID NO: 4150383 - DNA, 22 bp, Homo sapiens
tacaaatgccttaaaatggaat

SEQ ID NO: 4150384 - DNA, 13 bp, Homo sapiens
tacaaatggattt

SEQ ID NO: 4150385 - DNA, 13 bp, Homo sapiens
tacaaatgtattt

SEQ ID NO: 4150386 - DNA, 16 bp, Homo sapiens
tacaaatttgttattt

SEQ ID NO: 4150387 - DNA, 17 bp, Homo sapiens
tacaacattcaacttta

SEQ ID NO: 4150388 - DNA, 21 bp, Homo sapiens
tacaaccagagccccccacaa

SEQ ID NO: 4150389 - DNA, 22 bp, Homo sapiens
tacaaccagagccccccacaat

SEQ ID NO: 4150390 - DNA, 23 bp, Homo sapiens
tacaactgcctcgaaacacagaa

SEQ ID NO: 4150391 - DNA, 16 bp, Homo sapiens
tacaacttgatttttt

SEQ ID NO: 4150392 - DNA, 19 bp, Homo sapiens
tacaagactgttgtgatct

SEQ ID NO: 4150393 - DNA, 20 bp, Homo sapiens
tacaagactgttgtgatctt

SEQ ID NO: 4150394 - DNA, 16 bp, Homo sapiens
tacaagagcagcctgt

SEQ ID NO: 4150395 - DNA, 20 bp, Homo sapiens
tacaagagcagcctgtggca

SEQ ID NO: 4150396 - DNA, 15 bp, Homo sapiens
tacaagattgaaaat

SEQ ID NO: 4150397 - DNA, 13 bp, Homo sapiens
tacaagcaggcac

SEQ ID NO: 4150398 - DNA, 14 bp, Homo sapiens
tacaagcaggcact

SEQ ID NO: 4150399 - DNA, 22 bp, Homo sapiens
tacaagccaaagtggcatgttt

SEQ ID NO: 4150400 - DNA, 17 bp, Homo sapiens
tacaagtatatgtgaaa

SEQ ID NO: 4150401 - DNA, 22 bp, Homo sapiens
tacaagttgttattgttgaaca

SEQ ID NO: 4150402 - DNA, 21 bp, Homo sapiens
tacaataaaactttgctgcca

SEQ ID NO: 4150403 - DNA, 19 bp, Homo sapiens
tacaatattatgaaatttc

SEQ ID NO: 4150404 - DNA, 20 bp, Homo sapiens
tacaatcaaaggaaaatagt

SEQ ID NO: 4150405 - DNA, 17 bp, Homo sapiens
tacaatcattgctgaaa

SEQ ID NO: 4150406 - DNA, 23 bp, Homo sapiens
tacaatcattgctgaaaatggta

SEQ ID NO: 4150407 - DNA, 15 bp, Homo sapiens
tacaatcgcaaatca

SEQ ID NO: 4150408 - DNA, 22 bp, Homo sapiens
tacaatgtgaactttattaaat

SEQ ID NO: 4150409 - DNA, 21 bp, Homo sapiens
tacaattaatagtttgtctat

SEQ ID NO: 4150410 - DNA, 15 bp, Homo sapiens
tacacaattgtttta

SEQ ID NO: 4150411 - DNA, 18 bp, Homo sapiens
tacacacacactccctgc

SEQ ID NO: 4150412 - DNA, 10 bp, Homo sapiens
tacacacacc

SEQ ID NO: 4150413 - DNA, 13 bp, Homo sapiens
tacacacacccag

SEQ ID NO: 4150414 - DNA, 17 bp, Homo sapiens
tacacacacccaggccc

SEQ ID NO: 4150415 - DNA, 13 bp, Homo sapiens
tacacactcaggc

SEQ ID NO: 4150416 - DNA, 19 bp, Homo sapiens
tacacagaaatgctgctgg

SEQ ID NO: 4150417 - DNA, 21 bp, Homo sapiens
tacacagaaatgctgctggcc

SEQ ID NO: 4150418 - DNA, 22 bp, Homo sapiens
tacacagaaatgctgctggcca

SEQ ID NO: 4150419 - DNA, 15 bp, Homo sapiens
tacacagcctggact

SEQ ID NO: 4150420 - DNA, 23 bp, Homo sapiens
tacacaggatcctattctcacca

SEQ ID NO: 4150421 - DNA, 11 bp, Homo sapiens
tacacagttgc

SEQ ID NO: 4150422 - DNA, 18 bp, Homo sapiens
tacacattaagtaatcaa

SEQ ID NO: 4150423 - DNA, 19 bp, Homo sapiens
tacacatttttaaattgtt

SEQ ID NO: 4150424 - DNA, 20 bp, Homo sapiens
tacacatttttaaattgtta

SEQ ID NO: 4150425 - DNA, 20 bp, Homo sapiens
tacaccaactcctaatttta

SEQ ID NO: 4150426 - DNA, 18 bp, Homo sapiens
tacaccacctcactcctg

SEQ ID NO: 4150427 - DNA, 19 bp, Homo sapiens
tacaccacctcactcctgt

SEQ ID NO: 4150428 - DNA, 15 bp, Homo sapiens
tacacccagacccca

SEQ ID NO: 4150429 - DNA, 20 bp, Homo sapiens
tacacccagaccccaggctg

SEQ ID NO: 4150430 - DNA, 17 bp, Homo sapiens
tacaccgactagccagg

SEQ ID NO: 4150431 - DNA, 23 bp, Homo sapiens
tacacctaaaggtgtatttaaac

SEQ ID NO: 4150432 - DNA, 19 bp, Homo sapiens
tacacgttagatttgccgt

SEQ ID NO: 4150433 - DNA, 13 bp, Homo sapiens
tacactctgctgt

SEQ ID NO: 4150434 - DNA, 15 bp, Homo sapiens
tacactctgctgttt

SEQ ID NO: 4150435 - DNA, 17 bp, Homo sapiens
tacactgaatatttata

SEQ ID NO: 4150436 - DNA, 18 bp, Homo sapiens
tacactgaatatttatat

SEQ ID NO: 4150437 - DNA, 12 bp, Homo sapiens
tacactgctgta

SEQ ID NO: 4150438 - DNA, 18 bp, Homo sapiens
tacactgctgtacccaga

SEQ ID NO: 4150439 - DNA, 24 bp, Homo sapiens
tacactgctgtacccagatgccta

SEQ ID NO: 4150440 - DNA, 13 bp, Homo sapiens
tacactttgttgc

SEQ ID NO: 4150441 - DNA, 18 bp, Homo sapiens
tacactttgttgcaagat

SEQ ID NO: 4150442 - DNA, 21 bp, Homo sapiens
tacagaaagatggatgtgctt

SEQ ID NO: 4150443 - DNA, 14 bp, Homo sapiens
tacagaaatactat

SEQ ID NO: 4150444 - DNA, 23 bp, Homo sapiens
tacagaataatccagtattgctg

SEQ ID NO: 4150445 - DNA, 13 bp, Homo sapiens
tacagaatttcca

SEQ ID NO: 4150446 - DNA, 17 bp, Homo sapiens
tacagaatttccactgt

SEQ ID NO: 4150447 - DNA, 20 bp, Homo sapiens
tacagacaaggttctgccct

SEQ ID NO: 4150448 - DNA, 13 bp, Homo sapiens
tacagacactaag

SEQ ID NO: 4150449 - DNA, 19 bp, Homo sapiens
tacagacactaagttatag

SEQ ID NO: 4150450 - DNA, 23 bp, Homo sapiens
tacagactccatctcttctgcaa

SEQ ID NO: 4150451 - DNA, 22 bp, Homo sapiens
tacagagaggagaaacacatct

SEQ ID NO: 4150452 - DNA, 16 bp, Homo sapiens
tacagagcagctcccc

SEQ ID NO: 4150453 - DNA, 13 bp, Homo sapiens
tacagagctgtgg

SEQ ID NO: 4150454 - DNA, 18 bp, Homo sapiens
tacagatcctttttccat

SEQ ID NO: 4150455 - DNA, 13 bp, Homo sapiens
tacagatttaata

SEQ ID NO: 4150456 - DNA, 19 bp, Homo sapiens
tacagcactactgggtgtc

SEQ ID NO: 4150457 - DNA, 22 bp, Homo sapiens
tacagcactactgggtgtcatt

SEQ ID NO: 4150458 - DNA, 23 bp, Homo sapiens
tacagcactactgggtgtcattt

SEQ ID NO: 4150459 - DNA, 21 bp, Homo sapiens
tacagccaagtgccaaatgct

SEQ ID NO: 4150460 - DNA, 16 bp, Homo sapiens
tacagcgagaggcaga

SEQ ID NO: 4150461 - DNA, 16 bp, Homo sapiens
tacagcggctcccctc

SEQ ID NO: 4150462 - DNA, 20 bp, Homo sapiens
tacagcggctcccctctgct

SEQ ID NO: 4150463 - DNA, 18 bp, Homo sapiens
tacagctaatcagcattc

SEQ ID NO: 4150464 - DNA, 14 bp, Homo sapiens
tacagctcccccag

SEQ ID NO: 4150465 - DNA, 20 bp, Homo sapiens
tacagctcccccagctcccc

SEQ ID NO: 4150466 - DNA, 20 bp, Homo sapiens
tacagctgggctggggagga

SEQ ID NO: 4150467 - DNA, 15 bp, Homo sapiens
tacaggacttttaaa

SEQ ID NO: 4150468 - DNA, 20 bp, Homo sapiens
tacaggcaccgagaatgttg

SEQ ID NO: 4150469 - DNA, 21 bp, Homo sapiens
tacagggcatgcattttgcag

SEQ ID NO: 4150470 - DNA, 19 bp, Homo sapiens
tacagggtagataacctgt

SEQ ID NO: 4150471 - DNA, 16 bp, Homo sapiens
tacaggtaccagttct

SEQ ID NO: 4150472 - DNA, 19 bp, Homo sapiens
tacagtccttcaaaatcct

SEQ ID NO: 4150473 - DNA, 16 bp, Homo sapiens
tacagtgaccttttct

SEQ ID NO: 4150474 - DNA, 11 bp, Homo sapiens
tacagtggttt

SEQ ID NO: 4150475 - DNA, 19 bp, Homo sapiens
tacagtgttattttctttg

SEQ ID NO: 4150476 - DNA, 20 bp, Homo sapiens
tacagttaggcaccagaaga

SEQ ID NO: 4150477 - DNA, 23 bp, Homo sapiens
tacagttaggcaccagaagaaca

SEQ ID NO: 4150478 - DNA, 19 bp, Homo sapiens
tacagttagggttttgcaa

SEQ ID NO: 4150479 - DNA, 22 bp, Homo sapiens
tacagttagggttttgcaataa

SEQ ID NO: 4150480 - DNA, 13 bp, Homo sapiens
tacagttattttg

SEQ ID NO: 4150481 - DNA, 20 bp, Homo sapiens
tacagttctgctctggttgt

SEQ ID NO: 4150482 - DNA, 15 bp, Homo sapiens
tacataaaagaattt

SEQ ID NO: 4150483 - DNA, 17 bp, Homo sapiens
tacataaactgacttta

SEQ ID NO: 4150484 - DNA, 15 bp, Homo sapiens
tacataactcctgtc

SEQ ID NO: 4150485 - DNA, 18 bp, Homo sapiens
tacataactcctgtccct

SEQ ID NO: 4150486 - DNA, 20 bp, Homo sapiens
tacataactctgtaaaaaca

SEQ ID NO: 4150487 - DNA, 16 bp, Homo sapiens
tacataagataaatgt

SEQ ID NO: 4150488 - DNA, 17 bp, Homo sapiens
tacataagataaatgtg

SEQ ID NO: 4150489 - DNA, 19 bp, Homo sapiens
tacataagataaatgtgct

SEQ ID NO: 4150490 - DNA, 19 bp, Homo sapiens
tacataagtaattcaagaa

SEQ ID NO: 4150491 - DNA, 20 bp, Homo sapiens
tacataatgcttaatttcta

SEQ ID NO: 4150492 - DNA, 22 bp, Homo sapiens
tacataccctggccgccccctg

SEQ ID NO: 4150493 - DNA, 23 bp, Homo sapiens
tacatactttcatcctgactctg

SEQ ID NO: 4150494 - DNA, 22 bp, Homo sapiens
tacatatatttttaaaaaatga

SEQ ID NO: 4150495 - DNA, 17 bp, Homo sapiens
tacatatcgctgacttc

SEQ ID NO: 4150496 - DNA, 22 bp, Homo sapiens
tacatatcgctgacttcatgga

SEQ ID NO: 4150497 - DNA, 16 bp, Homo sapiens
tacatatctttattaa

SEQ ID NO: 4150498 - DNA, 16 bp, Homo sapiens
tacatatgagtgtgga

SEQ ID NO: 4150499 - DNA, 17 bp, Homo sapiens
tacatatgtaaacataa

SEQ ID NO: 4150500 - DNA, 15 bp, Homo sapiens
tacatattactgttg

SEQ ID NO: 4150501 - DNA, 19 bp, Homo sapiens
tacatattaggaaaatatg

SEQ ID NO: 4150502 - DNA, 23 bp, Homo sapiens
tacatattaggaaaatatgggtt

SEQ ID NO: 4150503 - DNA, 13 bp, Homo sapiens
tacatcactgctt

SEQ ID NO: 4150504 - DNA, 22 bp, Homo sapiens
tacatcactgcttgatgaagca

SEQ ID NO: 4150505 - DNA, 20 bp, Homo sapiens
tacatcagttattcattctg

SEQ ID NO: 4150506 - DNA, 23 bp, Homo sapiens
tacatcagttattcattctgtga

SEQ ID NO: 4150507 - DNA, 19 bp, Homo sapiens
tacatccaaagcagacagc

SEQ ID NO: 4150508 - DNA, 13 bp, Homo sapiens
tacatcccagcct

SEQ ID NO: 4150509 - DNA, 18 bp, Homo sapiens
tacatctattttggattg

SEQ ID NO: 4150510 - DNA, 20 bp, Homo sapiens
tacatgaagaatagaaacaa

SEQ ID NO: 4150511 - DNA, 13 bp, Homo sapiens
tacatgactgggc

SEQ ID NO: 4150512 - DNA, 17 bp, Homo sapiens
tacatgactgggcctcc

SEQ ID NO: 4150513 - DNA, 17 bp, Homo sapiens
tacatgagaacaaacag

SEQ ID NO: 4150514 - DNA, 18 bp, Homo sapiens
tacatgagaacaaacaga

SEQ ID NO: 4150515 - DNA, 14 bp, Homo sapiens
tacatgcagcccat

SEQ ID NO: 4150516 - DNA, 16 bp, Homo sapiens
tacatggaaaggattt

SEQ ID NO: 4150517 - DNA, 19 bp, Homo sapiens
tacatggaataacatgtaa

SEQ ID NO: 4150518 - DNA, 22 bp, Homo sapiens
tacatggaataacatgtaatta

SEQ ID NO: 4150519 - DNA, 15 bp, Homo sapiens
tacatgtattgcaca

SEQ ID NO: 4150520 - DNA, 17 bp, Homo sapiens
tacatgtgccgaatgtg

SEQ ID NO: 4150521 - DNA, 20 bp, Homo sapiens
tacatgtgccgaatgtgcag

SEQ ID NO: 4150522 - DNA, 22 bp, Homo sapiens
tacatgtgtttattcatccagc

SEQ ID NO: 4150523 - DNA, 17 bp, Homo sapiens
tacattaaaactaggta

SEQ ID NO: 4150524 - DNA, 21 bp, Homo sapiens
tacattaaaactaggtaatgt

SEQ ID NO: 4150525 - DNA, 12 bp, Homo sapiens
tacattaatgtt

SEQ ID NO: 4150526 - DNA, 19 bp, Homo sapiens
tacattagcagtttgcttt

SEQ ID NO: 4150527 - DNA, 13 bp, Homo sapiens
tacattagtaaat

SEQ ID NO: 4150528 - DNA, 15 bp, Homo sapiens
tacattagtaaatgt

SEQ ID NO: 4150529 - DNA, 17 bp, Homo sapiens
tacattagtaaatgtct

SEQ ID NO: 4150530 - DNA, 15 bp, Homo sapiens
tacattcatttagct

SEQ ID NO: 4150531 - DNA, 19 bp, Homo sapiens
tacattggctggtaacagt

SEQ ID NO: 4150532 - DNA, 15 bp, Homo sapiens
tacattgtatatatg

SEQ ID NO: 4150533 - DNA, 15 bp, Homo sapiens
tacatttaaaactta

SEQ ID NO: 4150534 - DNA, 17 bp, Homo sapiens
tacatttaaaattgcta

SEQ ID NO: 4150535 - DNA, 19 bp, Homo sapiens
tacatttaaagcattgctg

SEQ ID NO: 4150536 - DNA, 13 bp, Homo sapiens
tacatttaataca

SEQ ID NO: 4150537 - DNA, 15 bp, Homo sapiens
tacatttaatacagc

SEQ ID NO: 4150538 - DNA, 17 bp, Homo sapiens
tacatttatgatttaat

SEQ ID NO: 4150539 - DNA, 18 bp, Homo sapiens
tacatttatgatttaata

SEQ ID NO: 4150540 - DNA, 18 bp, Homo sapiens
tacatttatttattactg

SEQ ID NO: 4150541 - DNA, 21 bp, Homo sapiens
tacatttatttattactgtcc

SEQ ID NO: 4150542 - DNA, 22 bp, Homo sapiens
tacatttgagggcccagccagg

SEQ ID NO: 4150543 - DNA, 14 bp, Homo sapiens
tacatttttacaat

SEQ ID NO: 4150544 - DNA, 15 bp, Homo sapiens
tacatttttacaata

SEQ ID NO: 4150545 - DNA, 15 bp, Homo sapiens
taccaaagttttatc

SEQ ID NO: 4150546 - DNA, 18 bp, Homo sapiens
taccaaagttttatcaag

SEQ ID NO: 4150547 - DNA, 18 bp, Homo sapiens
taccaacctcatagagtt

SEQ ID NO: 4150548 - DNA, 14 bp, Homo sapiens
taccaagagaaggg

SEQ ID NO: 4150549 - DNA, 22 bp, Homo sapiens
taccaatcattttaattattat

SEQ ID NO: 4150550 - DNA, 13 bp, Homo sapiens
taccacaaggaaa

SEQ ID NO: 4150551 - DNA, 15 bp, Homo sapiens
taccacccttcagac

SEQ ID NO: 4150552 - DNA, 16 bp, Homo sapiens
taccaccgaatcccta

SEQ ID NO: 4150553 - DNA, 15 bp, Homo sapiens
taccactaactcctg

SEQ ID NO: 4150554 - DNA, 15 bp, Homo sapiens
taccactatttaagt

SEQ ID NO: 4150555 - DNA, 16 bp, Homo sapiens
taccactatttaagtt

SEQ ID NO: 4150556 - DNA, 22 bp, Homo sapiens
taccactggtacttcctttctc

SEQ ID NO: 4150557 - DNA, 20 bp, Homo sapiens
taccagctcatacaaaataa

SEQ ID NO: 4150558 - DNA, 14 bp, Homo sapiens
taccaggttgaaag

SEQ ID NO: 4150559 - DNA, 12 bp, Homo sapiens
taccagttgcct

SEQ ID NO: 4150560 - DNA, 16 bp, Homo sapiens
taccagttgcctttta

SEQ ID NO: 4150561 - DNA, 17 bp, Homo sapiens
taccatcatctctgaag

SEQ ID NO: 4150562 - DNA, 14 bp, Homo sapiens
taccatcattttat

SEQ ID NO: 4150563 - DNA, 17 bp, Homo sapiens
taccatcttacttgagc

SEQ ID NO: 4150564 - DNA, 17 bp, Homo sapiens
taccatttacatgtttt

SEQ ID NO: 4150565 - DNA, 14 bp, Homo sapiens
taccatttatacaa

SEQ ID NO: 4150566 - DNA, 17 bp, Homo sapiens
taccatttatacaaatt

SEQ ID NO: 4150567 - DNA, 18 bp, Homo sapiens
taccatttatacaaatta

SEQ ID NO: 4150568 - DNA, 21 bp, Homo sapiens
taccatttatacaaattagaa

SEQ ID NO: 4150569 - DNA, 17 bp, Homo sapiens
taccatttgtaataaag

SEQ ID NO: 4150570 - DNA, 18 bp, Homo sapiens
tacccacacctctgccag

SEQ ID NO: 4150571 - DNA, 21 bp, Homo sapiens
tacccaccgatggagccccca

SEQ ID NO: 4150572 - DNA, 21 bp, Homo sapiens
tacccaggaccaagccacagc

SEQ ID NO: 4150573 - DNA, 20 bp, Homo sapiens
tacccatctagtacttgaaa

SEQ ID NO: 4150574 - DNA, 13 bp, Homo sapiens
tacccatgagcct

SEQ ID NO: 4150575 - DNA, 17 bp, Homo sapiens
taccccacaccagcctt

SEQ ID NO: 4150576 - DNA, 16 bp, Homo sapiens
taccccactgggcaca

SEQ ID NO: 4150577 - DNA, 19 bp, Homo sapiens
taccccactgggcacacgc

SEQ ID NO: 4150578 - DNA, 13 bp, Homo sapiens
taccccagggccc

SEQ ID NO: 4150579 - DNA, 20 bp, Homo sapiens
taccccagggccctggccag

SEQ ID NO: 4150580 - DNA, 17 bp, Homo sapiens
taccccctccttcagac

SEQ ID NO: 4150581 - DNA, 22 bp, Homo sapiens
tacccccttttcagctgagccc

SEQ ID NO: 4150582 - DNA, 14 bp, Homo sapiens
tacccctgctccca

SEQ ID NO: 4150583 - DNA, 20 bp, Homo sapiens
tacccctgctcccattcctc

SEQ ID NO: 4150584 - DNA, 21 bp, Homo sapiens
taccctcaggcataggcctgg

SEQ ID NO: 4150585 - DNA, 15 bp, Homo sapiens
taccctcctggctct

SEQ ID NO: 4150586 - DNA, 15 bp, Homo sapiens
taccctcctgtaaat

SEQ ID NO: 4150587 - DNA, 21 bp, Homo sapiens
taccctctcactagtgccaat

SEQ ID NO: 4150588 - DNA, 16 bp, Homo sapiens
taccctctcagctcca

SEQ ID NO: 4150589 - DNA, 16 bp, Homo sapiens
taccctctttgctgca

SEQ ID NO: 4150590 - DNA, 19 bp, Homo sapiens
taccctctttgctgcagag

SEQ ID NO: 4150591 - DNA, 23 bp, Homo sapiens
taccctgagctgcagctgagcct

SEQ ID NO: 4150592 - DNA, 17 bp, Homo sapiens
taccctgtacatatgta

SEQ ID NO: 4150593 - DNA, 22 bp, Homo sapiens
tacccttcccgcctccctctca

SEQ ID NO: 4150594 - DNA, 23 bp, Homo sapiens
taccctttaagatatccatcttt

SEQ ID NO: 4150595 - DNA, 19 bp, Homo sapiens
tacccttttcccccttccc

SEQ ID NO: 4150596 - DNA, 17 bp, Homo sapiens
taccgagtctcttctcc

SEQ ID NO: 4150597 - DNA, 14 bp, Homo sapiens
taccgccctgggct

SEQ ID NO: 4150598 - DNA, 19 bp, Homo sapiens
tacctaaacagatataaat

SEQ ID NO: 4150599 - DNA, 22 bp, Homo sapiens
tacctaaacagatataaatggc

SEQ ID NO: 4150600 - DNA, 20 bp, Homo sapiens
tacctaagtgacatttgtag

SEQ ID NO: 4150601 - DNA, 15 bp, Homo sapiens
tacctactattggcc

SEQ ID NO: 4150602 - DNA, 13 bp, Homo sapiens
tacctagatttac

SEQ ID NO: 4150603 - DNA, 15 bp, Homo sapiens
tacctcaaactatct

SEQ ID NO: 4150604 - DNA, 22 bp, Homo sapiens
tacctcaacccccatttctatt

SEQ ID NO: 4150605 - DNA, 18 bp, Homo sapiens
tacctcaagccccatttc

SEQ ID NO: 4150606 - DNA, 21 bp, Homo sapiens
tacctcaagccccatttcctc

SEQ ID NO: 4150607 - DNA, 16 bp, Homo sapiens
tacctcaggcagctca

SEQ ID NO: 4150608 - DNA, 17 bp, Homo sapiens
tacctcaggcagctcaa

SEQ ID NO: 4150609 - DNA, 14 bp, Homo sapiens
tacctcaggcagga

SEQ ID NO: 4150610 - DNA, 17 bp, Homo sapiens
tacctcccacactccca

SEQ ID NO: 4150611 - DNA, 20 bp, Homo sapiens
tacctcccacactcccaagg

SEQ ID NO: 4150612 - DNA, 11 bp, Homo sapiens
tacctccctcc

SEQ ID NO: 4150613 - DNA, 11 bp, Homo sapiens
tacctcctcct

SEQ ID NO: 4150614 - DNA, 17 bp, Homo sapiens
tacctcctctcagtgtt

SEQ ID NO: 4150615 - DNA, 23 bp, Homo sapiens
tacctctcaagctagtgtttcta

SEQ ID NO: 4150616 - DNA, 12 bp, Homo sapiens
tacctctctgtc

SEQ ID NO: 4150617 - DNA, 15 bp, Homo sapiens
tacctctctgtccct

SEQ ID NO: 4150618 - DNA, 17 bp, Homo sapiens
tacctctcttatagaat

SEQ ID NO: 4150619 - DNA, 15 bp, Homo sapiens
tacctctgatacctc

SEQ ID NO: 4150620 - DNA, 14 bp, Homo sapiens
tacctctgtgccag

SEQ ID NO: 4150621 - DNA, 18 bp, Homo sapiens
tacctcttactttgcttg

SEQ ID NO: 4150622 - DNA, 19 bp, Homo sapiens
tacctcttcccatgactgc

SEQ ID NO: 4150623 - DNA, 21 bp, Homo sapiens
tacctgacctaaattagataa

SEQ ID NO: 4150624 - DNA, 22 bp, Homo sapiens
tacctgacctcttgctgtctct

SEQ ID NO: 4150625 - DNA, 13 bp, Homo sapiens
tacctgagaccag

SEQ ID NO: 4150626 - DNA, 16 bp, Homo sapiens
tacctgcacgttcata

SEQ ID NO: 4150627 - DNA, 17 bp, Homo sapiens
tacctgcacgttcataa

SEQ ID NO: 4150628 - DNA, 22 bp, Homo sapiens
tacctgcacgttcataaccaac

SEQ ID NO: 4150629 - DNA, 19 bp, Homo sapiens
tacctgccctaagggactt

SEQ ID NO: 4150630 - DNA, 16 bp, Homo sapiens
tacctgcgcttgtttt

SEQ ID NO: 4150631 - DNA, 15 bp, Homo sapiens
tacctggcagacttg

SEQ ID NO: 4150632 - DNA, 17 bp, Homo sapiens
tacctgggtccccagcc

SEQ ID NO: 4150633 - DNA, 20 bp, Homo sapiens
tacctgggtccccagccctt

SEQ ID NO: 4150634 - DNA, 14 bp, Homo sapiens
tacctgtcacattg

SEQ ID NO: 4150635 - DNA, 13 bp, Homo sapiens
tacctgtgtgctt

SEQ ID NO: 4150636 - DNA, 22 bp, Homo sapiens
taccttactgtggaggaaggat

SEQ ID NO: 4150637 - DNA, 15 bp, Homo sapiens
taccttgaaaggaag

SEQ ID NO: 4150638 - DNA, 18 bp, Homo sapiens
taccttgaaatgctgtta

SEQ ID NO: 4150639 - DNA, 20 bp, Homo sapiens
taccttgtatactgtaggca

SEQ ID NO: 4150640 - DNA, 12 bp, Homo sapiens
tacctttcatac

SEQ ID NO: 4150641 - DNA, 14 bp, Homo sapiens
tacgactaatcacc

SEQ ID NO: 4150642 - DNA, 14 bp, Homo sapiens
tacgactttatttt

SEQ ID NO: 4150643 - DNA, 15 bp, Homo sapiens
tacgactttattttc

SEQ ID NO: 4150644 - DNA, 19 bp, Homo sapiens
tacgagagcagaggtctcc

SEQ ID NO: 4150645 - DNA, 23 bp, Homo sapiens
tacgatacgctactataaagaga

SEQ ID NO: 4150646 - DNA, 13 bp, Homo sapiens
tacgatgcttcaa

SEQ ID NO: 4150647 - DNA, 18 bp, Homo sapiens
tacgcctcttctgtccct

SEQ ID NO: 4150648 - DNA, 15 bp, Homo sapiens
tacgctttgattcat

SEQ ID NO: 4150649 - DNA, 12 bp, Homo sapiens
tacgctttgtca

SEQ ID NO: 4150650 - DNA, 12 bp, Homo sapiens
tacgcttttctt

SEQ ID NO: 4150651 - DNA, 17 bp, Homo sapiens
tacggattttcagttac

SEQ ID NO: 4150652 - DNA, 15 bp, Homo sapiens
tacgtagctctctta

SEQ ID NO: 4150653 - DNA, 15 bp, Homo sapiens
tacgtcctgcctggc

SEQ ID NO: 4150654 - DNA, 15 bp, Homo sapiens
tacgttattgttgac

SEQ ID NO: 4150655 - DNA, 15 bp, Homo sapiens
tacgttcctattgtc

SEQ ID NO: 4150656 - DNA, 13 bp, Homo sapiens
tactaaatttaaa

SEQ ID NO: 4150657 - DNA, 21 bp, Homo sapiens
tactaaatttaaatttaaaga

SEQ ID NO: 4150658 - DNA, 23 bp, Homo sapiens
tactaaatttaaatttaaagata

SEQ ID NO: 4150659 - DNA, 15 bp, Homo sapiens
tactaagaaaagata

SEQ ID NO: 4150660 - DNA, 14 bp, Homo sapiens
tactaaggaatctt

SEQ ID NO: 4150661 - DNA, 22 bp, Homo sapiens
tactaagttcacattagaatta

SEQ ID NO: 4150662 - DNA, 20 bp, Homo sapiens
tactaatgtaaaatgatttg

SEQ ID NO: 4150663 - DNA, 13 bp, Homo sapiens
tactaattccaca

SEQ ID NO: 4150664 - DNA, 15 bp, Homo sapiens
tactacacattttta

SEQ ID NO: 4150665 - DNA, 23 bp, Homo sapiens
tactacagttgttttttgaaaac

SEQ ID NO: 4150666 - DNA, 17 bp, Homo sapiens
tactacctcctctcctg

SEQ ID NO: 4150667 - DNA, 22 bp, Homo sapiens
tactacctgtgtatatagtttt

SEQ ID NO: 4150668 - DNA, 14 bp, Homo sapiens
tactaccttgaaaa

SEQ ID NO: 4150669 - DNA, 18 bp, Homo sapiens
tactactagatgtcttta

SEQ ID NO: 4150670 - DNA, 13 bp, Homo sapiens
tactactcctgta

SEQ ID NO: 4150671 - DNA, 18 bp, Homo sapiens
tactagatgcatcactgg

SEQ ID NO: 4150672 - DNA, 16 bp, Homo sapiens
tactaggtaacttcat

SEQ ID NO: 4150673 - DNA, 14 bp, Homo sapiens
tactagtgttctgt

SEQ ID NO: 4150674 - DNA, 16 bp, Homo sapiens
tactagtgttctgttt

SEQ ID NO: 4150675 - DNA, 14 bp, Homo sapiens
tactataaagagaa

SEQ ID NO: 4150676 - DNA, 13 bp, Homo sapiens
tactataacatat

SEQ ID NO: 4150677 - DNA, 16 bp, Homo sapiens
tactatagtaccagta

SEQ ID NO: 4150678 - DNA, 14 bp, Homo sapiens
tactatatttatgg

SEQ ID NO: 4150679 - DNA, 21 bp, Homo sapiens
tactatcatactactgaaaca

SEQ ID NO: 4150680 - DNA, 13 bp, Homo sapiens
tactattgcctca

SEQ ID NO: 4150681 - DNA, 11 bp, Homo sapiens
tactatttaaa

SEQ ID NO: 4150682 - DNA, 22 bp, Homo sapiens
tactatttaaagcctcctcatc

SEQ ID NO: 4150683 - DNA, 18 bp, Homo sapiens
tactattttctacaatta

SEQ ID NO: 4150684 - DNA, 19 bp, Homo sapiens
tactattttctacaattaa

SEQ ID NO: 4150685 - DNA, 17 bp, Homo sapiens
tactattttgacagtta

SEQ ID NO: 4150686 - DNA, 23 bp, Homo sapiens
tactcaaatgagtaacatttgct

SEQ ID NO: 4150687 - DNA, 15 bp, Homo sapiens
tactcacagtctctt

SEQ ID NO: 4150688 - DNA, 13 bp, Homo sapiens
tactcagcctgct

SEQ ID NO: 4150689 - DNA, 17 bp, Homo sapiens
tactcagggttcatctg

SEQ ID NO: 4150690 - DNA, 21 bp, Homo sapiens
tactcagggttcatctgtcca

SEQ ID NO: 4150691 - DNA, 14 bp, Homo sapiens
tactccagtggtga

SEQ ID NO: 4150692 - DNA, 15 bp, Homo sapiens
tactccataaacaga

SEQ ID NO: 4150693 - DNA, 12 bp, Homo sapiens
tactcctgactc

SEQ ID NO: 4150694 - DNA, 13 bp, Homo sapiens
tactcctgcctca

SEQ ID NO: 4150695 - DNA, 14 bp, Homo sapiens
tactccttaagaac

SEQ ID NO: 4150696 - DNA, 19 bp, Homo sapiens
tactccttgcttcctgatg

SEQ ID NO: 4150697 - DNA, 14 bp, Homo sapiens
tactctagatgaag

SEQ ID NO: 4150698 - DNA, 22 bp, Homo sapiens
tactctcacccataaacagtaa

SEQ ID NO: 4150699 - DNA, 20 bp, Homo sapiens
tactctgaaacacactgaaa

SEQ ID NO: 4150700 - DNA, 19 bp, Homo sapiens
tactcttctctctgctctg

SEQ ID NO: 4150701 - DNA, 19 bp, Homo sapiens
tactcttgatgtgaagata

SEQ ID NO: 4150702 - DNA, 12 bp, Homo sapiens
tactctttccta

SEQ ID NO: 4150703 - DNA, 13 bp, Homo sapiens
tactctttcctat

SEQ ID NO: 4150704 - DNA, 17 bp, Homo sapiens
tactctttgaaagcttt

SEQ ID NO: 4150705 - DNA, 13 bp, Homo sapiens
tactgaaggaaaa

SEQ ID NO: 4150706 - DNA, 14 bp, Homo sapiens
tactgaaggaaaaa

SEQ ID NO: 4150707 - DNA, 19 bp, Homo sapiens
tactgaaggaaaaacacaa

SEQ ID NO: 4150708 - DNA, 20 bp, Homo sapiens
tactgaaggaaaaacacaag

SEQ ID NO: 4150709 - DNA, 20 bp, Homo sapiens
tactgacatgtggggccagg

SEQ ID NO: 4150710 - DNA, 16 bp, Homo sapiens
tactgactttgcttgc

SEQ ID NO: 4150711 - DNA, 18 bp, Homo sapiens
tactgagcttctctgtga

SEQ ID NO: 4150712 - DNA, 14 bp, Homo sapiens
tactgatgaaatct

SEQ ID NO: 4150713 - DNA, 18 bp, Homo sapiens
tactgcactccagcctgg

SEQ ID NO: 4150714 - DNA, 15 bp, Homo sapiens
tactgcagcacctcc

SEQ ID NO: 4150715 - DNA, 16 bp, Homo sapiens
tactgcagcacctcca

SEQ ID NO: 4150716 - DNA, 20 bp, Homo sapiens
tactgctacagcaatttcta

SEQ ID NO: 4150717 - DNA, 20 bp, Homo sapiens
tactgctactgtaattttat

SEQ ID NO: 4150718 - DNA, 17 bp, Homo sapiens
tactggaataatttgta

SEQ ID NO: 4150719 - DNA, 19 bp, Homo sapiens
tactggaataatttgtaaa

SEQ ID NO: 4150720 - DNA, 17 bp, Homo sapiens
tactggaattcttctgc

SEQ ID NO: 4150721 - DNA, 19 bp, Homo sapiens
tactggagtggaaggtcta

SEQ ID NO: 4150722 - DNA, 14 bp, Homo sapiens
tactggcaggaggg

SEQ ID NO: 4150723 - DNA, 12 bp, Homo sapiens
tactgggcctta

SEQ ID NO: 4150724 - DNA, 20 bp, Homo sapiens
tactgggtgtcatttcattc

SEQ ID NO: 4150725 - DNA, 15 bp, Homo sapiens
tactgggttcttgtt

SEQ ID NO: 4150726 - DNA, 21 bp, Homo sapiens
tactggtccttaccagagacg

SEQ ID NO: 4150727 - DNA, 19 bp, Homo sapiens
tactgtaacctgttgctgt

SEQ ID NO: 4150728 - DNA, 16 bp, Homo sapiens
tactgtaattcctcaa

SEQ ID NO: 4150729 - DNA, 12 bp, Homo sapiens
tactgtaatttt

SEQ ID NO: 4150730 - DNA, 23 bp, Homo sapiens
tactgtgtaaatatatgtctgat

SEQ ID NO: 4150731 - DNA, 13 bp, Homo sapiens
tactgtgtgccag

SEQ ID NO: 4150732 - DNA, 21 bp, Homo sapiens
tactgtgtgcttgttttataa

SEQ ID NO: 4150733 - DNA, 14 bp, Homo sapiens
tactgtgtgtgtga

SEQ ID NO: 4150734 - DNA, 18 bp, Homo sapiens
tactgtgtgtgtgaatga

SEQ ID NO: 4150735 - DNA, 23 bp, Homo sapiens
tactgtgtgtgtgaatgaacact

SEQ ID NO: 4150736 - DNA, 14 bp, Homo sapiens
tactgtgttcctgg

SEQ ID NO: 4150737 - DNA, 19 bp, Homo sapiens
tactgtgttcctggcaata

SEQ ID NO: 4150738 - DNA, 22 bp, Homo sapiens
tactgtgttcctggcaatagtg

SEQ ID NO: 4150739 - DNA, 18 bp, Homo sapiens
tactgttaggaacagcag

SEQ ID NO: 4150740 - DNA, 19 bp, Homo sapiens
tactgttaggaacagcagt

SEQ ID NO: 4150741 - DNA, 23 bp, Homo sapiens
tactgttcggaaggggttcctca

SEQ ID NO: 4150742 - DNA, 16 bp, Homo sapiens
tactgttctgtgtctt

SEQ ID NO: 4150743 - DNA, 17 bp, Homo sapiens
tactgttctgtgtcttt

SEQ ID NO: 4150744 - DNA, 23 bp, Homo sapiens
tactgttgcacaattttgataaa

SEQ ID NO: 4150745 - DNA, 21 bp, Homo sapiens
tactgttgcatttacttttaa

SEQ ID NO: 4150746 - DNA, 21 bp, Homo sapiens
tactgtttaagacacttccgt

SEQ ID NO: 4150747 - DNA, 16 bp, Homo sapiens
tacttacctaaacaga

SEQ ID NO: 4150748 - DNA, 21 bp, Homo sapiens
tacttagcacttggcctgaga

SEQ ID NO: 4150749 - DNA, 15 bp, Homo sapiens
tacttagcatcctaa

SEQ ID NO: 4150750 - DNA, 22 bp, Homo sapiens
tacttagcatcctaagaaatat

SEQ ID NO: 4150751 - DNA, 21 bp, Homo sapiens
tacttatatttccctaaaata

SEQ ID NO: 4150752 - DNA, 13 bp, Homo sapiens
tacttcaaaaata

SEQ ID NO: 4150753 - DNA, 21 bp, Homo sapiens
tacttcaagttaaagtgaata

SEQ ID NO: 4150754 - DNA, 18 bp, Homo sapiens
tacttcatagctccttgg

SEQ ID NO: 4150755 - DNA, 20 bp, Homo sapiens
tacttcccgggccagggctg

SEQ ID NO: 4150756 - DNA, 21 bp, Homo sapiens
tacttcccgggccagggctgc

SEQ ID NO: 4150757 - DNA, 14 bp, Homo sapiens
tacttcctcctccc

SEQ ID NO: 4150758 - DNA, 18 bp, Homo sapiens
tacttcgtcttctaattt

SEQ ID NO: 4150759 - DNA, 20 bp, Homo sapiens
tacttctgaaataaatgttc

SEQ ID NO: 4150760 - DNA, 23 bp, Homo sapiens
tacttctgaaataaatgttctct

SEQ ID NO: 4150761 - DNA, 20 bp, Homo sapiens
tacttcttttttcaaaagaa

SEQ ID NO: 4150762 - DNA, 20 bp, Homo sapiens
tacttgaaatctaggattat

SEQ ID NO: 4150763 - DNA, 11 bp, Homo sapiens
tacttgaaggg

SEQ ID NO: 4150764 - DNA, 14 bp, Homo sapiens
tacttgaagggcca

SEQ ID NO: 4150765 - DNA, 17 bp, Homo sapiens
tacttgaagggccagag

SEQ ID NO: 4150766 - DNA, 22 bp, Homo sapiens
tacttgaagtctaaaagcagaa

SEQ ID NO: 4150767 - DNA, 23 bp, Homo sapiens
tacttgaagtctaaaagcagaaa

SEQ ID NO: 4150768 - DNA, 18 bp, Homo sapiens
tacttgagtgtaatgttt

SEQ ID NO: 4150769 - DNA, 22 bp, Homo sapiens
tacttgatttgatgtgactttt

SEQ ID NO: 4150770 - DNA, 14 bp, Homo sapiens
tacttggatttagt

SEQ ID NO: 4150771 - DNA, 17 bp, Homo sapiens
tacttgggaagctgagg

SEQ ID NO: 4150772 - DNA, 19 bp, Homo sapiens
tacttgggaagctgaggcg

SEQ ID NO: 4150773 - DNA, 21 bp, Homo sapiens
tacttgggagacctgtaatca

SEQ ID NO: 4150774 - DNA, 15 bp, Homo sapiens
tacttggtcacagcc

SEQ ID NO: 4150775 - DNA, 19 bp, Homo sapiens
tacttggtcacagccaggc

SEQ ID NO: 4150776 - DNA, 14 bp, Homo sapiens
tacttggtttgtgt

SEQ ID NO: 4150777 - DNA, 11 bp, Homo sapiens
tacttgtcaat

SEQ ID NO: 4150778 - DNA, 18 bp, Homo sapiens
tacttgtggttttcaaat

SEQ ID NO: 4150779 - DNA, 12 bp, Homo sapiens
tacttgtttcat

SEQ ID NO: 4150780 - DNA, 19 bp, Homo sapiens
tacttgtttcatctggttt

SEQ ID NO: 4150781 - DNA, 16 bp, Homo sapiens
tacttgtttctctgtt

SEQ ID NO: 4150782 - DNA, 17 bp, Homo sapiens
tactttaaacttgtctt

SEQ ID NO: 4150783 - DNA, 22 bp, Homo sapiens
tactttaagcactacataaact

SEQ ID NO: 4150784 - DNA, 13 bp, Homo sapiens
tactttatttctg

SEQ ID NO: 4150785 - DNA, 16 bp, Homo sapiens
tactttctatgtgaca

SEQ ID NO: 4150786 - DNA, 13 bp, Homo sapiens
tactttgcttcat

SEQ ID NO: 4150787 - DNA, 12 bp, Homo sapiens
tactttgcttga

SEQ ID NO: 4150788 - DNA, 11 bp, Homo sapiens
tactttgtaat

SEQ ID NO: 4150789 - DNA, 13 bp, Homo sapiens
tactttgtaattt

SEQ ID NO: 4150790 - DNA, 21 bp, Homo sapiens
tactttgtacttgtgtttgct

SEQ ID NO: 4150791 - DNA, 11 bp, Homo sapiens
tactttgtcag

SEQ ID NO: 4150792 - DNA, 19 bp, Homo sapiens
tacttttatttgcaacatt

SEQ ID NO: 4150793 - DNA, 22 bp, Homo sapiens
tacttttcccctgttaaacagt

SEQ ID NO: 4150794 - DNA, 13 bp, Homo sapiens
tacttttggctcc

SEQ ID NO: 4150795 - DNA, 18 bp, Homo sapiens
tacttttttcttatttaa

SEQ ID NO: 4150796 - DNA, 19 bp, Homo sapiens
tagaaaacatttggcagaa

SEQ ID NO: 4150797 - DNA, 22 bp, Homo sapiens
tagaaaacttgacatgtagctt

SEQ ID NO: 4150798 - DNA, 21 bp, Homo sapiens
tagaaaagaaaaaaaaaatat

SEQ ID NO: 4150799 - DNA, 11 bp, Homo sapiens
tagaaaaggca

SEQ ID NO: 4150800 - DNA, 21 bp, Homo sapiens
tagaaaatttagccctttaaa

SEQ ID NO: 4150801 - DNA, 17 bp, Homo sapiens
tagaaacaaacatctaa

SEQ ID NO: 4150802 - DNA, 17 bp, Homo sapiens
tagaaacaccaaaaaaa

SEQ ID NO: 4150803 - DNA, 16 bp, Homo sapiens
tagaaagaagccatat

SEQ ID NO: 4150804 - DNA, 23 bp, Homo sapiens
tagaaagcctgttcccctcactg

SEQ ID NO: 4150805 - DNA, 16 bp, Homo sapiens
tagaaataaattccta

SEQ ID NO: 4150806 - DNA, 20 bp, Homo sapiens
tagaaatatctgaaaatgta

SEQ ID NO: 4150807 - DNA, 17 bp, Homo sapiens
tagaaatctaaaagaat

SEQ ID NO: 4150808 - DNA, 18 bp, Homo sapiens
tagaaattagctgtgtga

SEQ ID NO: 4150809 - DNA, 17 bp, Homo sapiens
tagaaattttacaatag

SEQ ID NO: 4150810 - DNA, 14 bp, Homo sapiens
tagaaattttgtaa

SEQ ID NO: 4150811 - DNA, 16 bp, Homo sapiens
tagaaattttgtaaga

SEQ ID NO: 4150812 - DNA, 12 bp, Homo sapiens
tagaacaaaaaa

SEQ ID NO: 4150813 - DNA, 19 bp, Homo sapiens
tagaacactaattcataat

SEQ ID NO: 4150814 - DNA, 20 bp, Homo sapiens
tagaacactaattcataatc

SEQ ID NO: 4150815 - DNA, 12 bp, Homo sapiens
tagaactatctg

SEQ ID NO: 4150816 - DNA, 21 bp, Homo sapiens
tagaactatctgcattatcta

SEQ ID NO: 4150817 - DNA, 17 bp, Homo sapiens
tagaactcactctgggc

SEQ ID NO: 4150818 - DNA, 16 bp, Homo sapiens
tagaacttgaccccct

SEQ ID NO: 4150819 - DNA, 18 bp, Homo sapiens
tagaagacaaaatgttca

SEQ ID NO: 4150820 - DNA, 14 bp, Homo sapiens
tagaagagagaggt

SEQ ID NO: 4150821 - DNA, 17 bp, Homo sapiens
tagaagattagaaacta

SEQ ID NO: 4150822 - DNA, 20 bp, Homo sapiens
tagaagcattccttctttga

SEQ ID NO: 4150823 - DNA, 21 bp, Homo sapiens
tagaagcatttgatattatct

SEQ ID NO: 4150824 - DNA, 17 bp, Homo sapiens
tagaagccgtgggaaga

SEQ ID NO: 4150825 - DNA, 23 bp, Homo sapiens
tagaaggaaaaaagttccttcct

SEQ ID NO: 4150826 - DNA, 19 bp, Homo sapiens
tagaaggttgacacagttg

SEQ ID NO: 4150827 - DNA, 18 bp, Homo sapiens
tagaagtcttagatgtat

SEQ ID NO: 4150828 - DNA, 15 bp, Homo sapiens
tagaagtgcatttct

SEQ ID NO: 4150829 - DNA, 18 bp, Homo sapiens
tagaagtgcatttctgaa

SEQ ID NO: 4150830 - DNA, 23 bp, Homo sapiens
tagaagtgcatttctgaatagaa

SEQ ID NO: 4150831 - DNA, 16 bp, Homo sapiens
tagaagtttcccttcc

SEQ ID NO: 4150832 - DNA, 15 bp, Homo sapiens
tagaataaaagctgt

SEQ ID NO: 4150833 - DNA, 18 bp, Homo sapiens
tagaataaaagctgtgga

SEQ ID NO: 4150834 - DNA, 22 bp, Homo sapiens
tagaataaaagctgtggaatga

SEQ ID NO: 4150835 - DNA, 15 bp, Homo sapiens
tagaatatatttcct

SEQ ID NO: 4150836 - DNA, 15 bp, Homo sapiens
tagaatccaaacttg

SEQ ID NO: 4150837 - DNA, 16 bp, Homo sapiens
tagaatgattaatcaa

SEQ ID NO: 4150838 - DNA, 22 bp, Homo sapiens
tagaatggataaaataatgctg

SEQ ID NO: 4150839 - DNA, 17 bp, Homo sapiens
tagaatgtcagatttct

SEQ ID NO: 4150840 - DNA, 10 bp, Homo sapiens
tagaatgtgg

SEQ ID NO: 4150841 - DNA, 19 bp, Homo sapiens
tagaatgtggccacttatt

SEQ ID NO: 4150842 - DNA, 13 bp, Homo sapiens
tagaatgtgtttt

SEQ ID NO: 4150843 - DNA, 22 bp, Homo sapiens
tagaatttattcaattcctctg

SEQ ID NO: 4150844 - DNA, 23 bp, Homo sapiens
tagacaaatgctacattaatgtt

SEQ ID NO: 4150845 - DNA, 19 bp, Homo sapiens
tagacaacctgaaatttat

SEQ ID NO: 4150846 - DNA, 19 bp, Homo sapiens
tagacaacgatgaatttct

SEQ ID NO: 4150847 - DNA, 16 bp, Homo sapiens
tagacacacaaagcag

SEQ ID NO: 4150848 - DNA, 13 bp, Homo sapiens
tagacacagataa

SEQ ID NO: 4150849 - DNA, 17 bp, Homo sapiens
tagaccaggatttctaa

SEQ ID NO: 4150850 - DNA, 16 bp, Homo sapiens
tagaccctcgggcccc

SEQ ID NO: 4150851 - DNA, 18 bp, Homo sapiens
tagaccctgaggccctgg

SEQ ID NO: 4150852 - DNA, 19 bp, Homo sapiens
tagaccctgaggccctggg

SEQ ID NO: 4150853 - DNA, 20 bp, Homo sapiens
tagaccctgggtgggctctg

SEQ ID NO: 4150854 - DNA, 21 bp, Homo sapiens
tagactagcaatctcttcatt

SEQ ID NO: 4150855 - DNA, 21 bp, Homo sapiens
tagactattccttttctgtat

SEQ ID NO: 4150856 - DNA, 12 bp, Homo sapiens
tagactcttcac

SEQ ID NO: 4150857 - DNA, 21 bp, Homo sapiens
tagactggatggaaagacaaa

SEQ ID NO: 4150858 - DNA, 18 bp, Homo sapiens
tagactgtgattcagaaa

SEQ ID NO: 4150859 - DNA, 21 bp, Homo sapiens
tagacttcagggagtcagctg

SEQ ID NO: 4150860 - DNA, 18 bp, Homo sapiens
tagacttcgactcaggat

SEQ ID NO: 4150861 - DNA, 18 bp, Homo sapiens
tagacttgtgctgatcgt

SEQ ID NO: 4150862 - DNA, 18 bp, Homo sapiens
tagactttagaaataaat

SEQ ID NO: 4150863 - DNA, 16 bp, Homo sapiens
tagagaacgcagccct

SEQ ID NO: 4150864 - DNA, 13 bp, Homo sapiens
tagagaagcaagt

SEQ ID NO: 4150865 - DNA, 16 bp, Homo sapiens
tagagaagcaagtaaa

SEQ ID NO: 4150866 - DNA, 13 bp, Homo sapiens
tagagaaggaccc

SEQ ID NO: 4150867 - DNA, 23 bp, Homo sapiens
tagagaagggagacattgtttgg

SEQ ID NO: 4150868 - DNA, 14 bp, Homo sapiens
tagagactgtagat

SEQ ID NO: 4150869 - DNA, 15 bp, Homo sapiens
tagagactgtagatt

SEQ ID NO: 4150870 - DNA, 22 bp, Homo sapiens
tagagaggacaatactggggtt

SEQ ID NO: 4150871 - DNA, 19 bp, Homo sapiens
tagagaggggactggggga

SEQ ID NO: 4150872 - DNA, 17 bp, Homo sapiens
tagagataggaaactga

SEQ ID NO: 4150873 - DNA, 20 bp, Homo sapiens
tagagattgcatttttatta

SEQ ID NO: 4150874 - DNA, 15 bp, Homo sapiens
tagagattgtacatt

SEQ ID NO: 4150875 - DNA, 21 bp, Homo sapiens
tagagcaaaattgatgtgttt

SEQ ID NO: 4150876 - DNA, 16 bp, Homo sapiens
tagagcagctttggga

SEQ ID NO: 4150877 - DNA, 12 bp, Homo sapiens
tagagcctgcct

SEQ ID NO: 4150878 - DNA, 16 bp, Homo sapiens
tagagcctgcctggag

SEQ ID NO: 4150879 - DNA, 17 bp, Homo sapiens
tagagcctgcctggagc

SEQ ID NO: 4150880 - DNA, 21 bp, Homo sapiens
tagagcttgtaataaatactg

SEQ ID NO: 4150881 - DNA, 22 bp, Homo sapiens
tagaggaaaaaaatgactaaaa

SEQ ID NO: 4150882 - DNA, 12 bp, Homo sapiens
tagaggaaaatg

SEQ ID NO: 4150883 - DNA, 18 bp, Homo sapiens
tagaggcttctccgccag

SEQ ID NO: 4150884 - DNA, 19 bp, Homo sapiens
tagaggcttctccgccagc

SEQ ID NO: 4150885 - DNA, 16 bp, Homo sapiens
tagaggggctgcaggg

SEQ ID NO: 4150886 - DNA, 17 bp, Homo sapiens
tagagggttcctgtaga

SEQ ID NO: 4150887 - DNA, 21 bp, Homo sapiens
tagagtagaagatttgatgct

SEQ ID NO: 4150888 - DNA, 22 bp, Homo sapiens
tagagtcatctccatcagctgt

SEQ ID NO: 4150889 - DNA, 22 bp, Homo sapiens
tagagtctcagaaactcccctg

SEQ ID NO: 4150890 - DNA, 23 bp, Homo sapiens
tagagttgattgtctagtgagga

SEQ ID NO: 4150891 - DNA, 12 bp, Homo sapiens
tagagttgctga

SEQ ID NO: 4150892 - DNA, 16 bp, Homo sapiens
tagataaatatttgac

SEQ ID NO: 4150893 - DNA, 13 bp, Homo sapiens
tagataaattgta

SEQ ID NO: 4150894 - DNA, 21 bp, Homo sapiens
tagataaattgtagggcttta

SEQ ID NO: 4150895 - DNA, 22 bp, Homo sapiens
tagataccctacgctgtccaga

SEQ ID NO: 4150896 - DNA, 23 bp, Homo sapiens
tagataccctacgctgtccagaa

SEQ ID NO: 4150897 - DNA, 21 bp, Homo sapiens
tagatagaaataaatagctat

SEQ ID NO: 4150898 - DNA, 23 bp, Homo sapiens
tagatagaaataaatagctatat

SEQ ID NO: 4150899 - DNA, 16 bp, Homo sapiens
tagataggtaaatacc

SEQ ID NO: 4150900 - DNA, 17 bp, Homo sapiens
tagatagttagaacctg

SEQ ID NO: 4150901 - DNA, 20 bp, Homo sapiens
tagatatcatgcaaatttca

SEQ ID NO: 4150902 - DNA, 24 bp, Homo sapiens
tagatattttcacaatgtcagtat

SEQ ID NO: 4150903 - DNA, 16 bp, Homo sapiens
tagatcacgagatcaa

SEQ ID NO: 4150904 - DNA, 17 bp, Homo sapiens
tagatcacgagatcaag

SEQ ID NO: 4150905 - DNA, 15 bp, Homo sapiens
tagatgaactcaact

SEQ ID NO: 4150906 - DNA, 12 bp, Homo sapiens
tagatgataaag

SEQ ID NO: 4150907 - DNA, 16 bp, Homo sapiens
tagatgcacttatgca

SEQ ID NO: 4150908 - DNA, 23 bp, Homo sapiens
tagatgctgactgtactcctccc

SEQ ID NO: 4150909 - DNA, 15 bp, Homo sapiens
tagatgctggcccag

SEQ ID NO: 4150910 - DNA, 18 bp, Homo sapiens
tagatgctggcccagggc

SEQ ID NO: 4150911 - DNA, 21 bp, Homo sapiens
tagatgtctttaggcagcagc

SEQ ID NO: 4150912 - DNA, 19 bp, Homo sapiens
tagatgtgccaataaccaa

SEQ ID NO: 4150913 - DNA, 20 bp, Homo sapiens
tagattaaatatagattaga

SEQ ID NO: 4150914 - DNA, 21 bp, Homo sapiens
tagattaccccctcattgttt

SEQ ID NO: 4150915 - DNA, 16 bp, Homo sapiens
tagattatggagcttt

SEQ ID NO: 4150916 - DNA, 23 bp, Homo sapiens
tagattgcagaaaattctgtgcc

SEQ ID NO: 4150917 - DNA, 18 bp, Homo sapiens
tagatttcatagttcaga

SEQ ID NO: 4150918 - DNA, 22 bp, Homo sapiens
tagatttcatagttcagaattt

SEQ ID NO: 4150919 - DNA, 16 bp, Homo sapiens
tagattttaaagacaa

SEQ ID NO: 4150920 - DNA, 16 bp, Homo sapiens
tagattttattttact

SEQ ID NO: 4150921 - DNA, 17 bp, Homo sapiens
tagattttattttacta

SEQ ID NO: 4150922 - DNA, 21 bp, Homo sapiens
tagcaaaattcttaagtatgt

SEQ ID NO: 4150923 - DNA, 17 bp, Homo sapiens
tagcaagacacatccct

SEQ ID NO: 4150924 - DNA, 18 bp, Homo sapiens
tagcaagacacatcccta

SEQ ID NO: 4150925 - DNA, 16 bp, Homo sapiens
tagcaagctggcctct

SEQ ID NO: 4150926 - DNA, 15 bp, Homo sapiens
tagcaagcttttgct

SEQ ID NO: 4150927 - DNA, 17 bp, Homo sapiens
tagcaaggtcatttctt

SEQ ID NO: 4150928 - DNA, 17 bp, Homo sapiens
tagcaagttctagagaa

SEQ ID NO: 4150929 - DNA, 21 bp, Homo sapiens
tagcaagttctagagaagagg

SEQ ID NO: 4150930 - DNA, 17 bp, Homo sapiens
tagcaatcacaacactg

SEQ ID NO: 4150931 - DNA, 17 bp, Homo sapiens
tagcacataaactttgg

SEQ ID NO: 4150932 - DNA, 20 bp, Homo sapiens
tagcagacagaaactggatt

SEQ ID NO: 4150933 - DNA, 11 bp, Homo sapiens
tagcagacagg

SEQ ID NO: 4150934 - DNA, 13 bp, Homo sapiens
tagcagacaggcc

SEQ ID NO: 4150935 - DNA, 18 bp, Homo sapiens
tagcagagtgctggcact

SEQ ID NO: 4150936 - DNA, 19 bp, Homo sapiens
tagcagagtgctggcactt

SEQ ID NO: 4150937 - DNA, 14 bp, Homo sapiens
tagcagatggtttc

SEQ ID NO: 4150938 - DNA, 18 bp, Homo sapiens
tagcagattttaattttg

SEQ ID NO: 4150939 - DNA, 19 bp, Homo sapiens
tagcagcaccgttctgtgc

SEQ ID NO: 4150940 - DNA, 12 bp, Homo sapiens
tagcagcctttc

SEQ ID NO: 4150941 - DNA, 16 bp, Homo sapiens
tagcagcctttctctc

SEQ ID NO: 4150942 - DNA, 22 bp, Homo sapiens
tagcagcggaacaaggagtcag

SEQ ID NO: 4150943 - DNA, 20 bp, Homo sapiens
tagcaggagagaggctctgg

SEQ ID NO: 4150944 - DNA, 15 bp, Homo sapiens
tagcaggctgttcca

SEQ ID NO: 4150945 - DNA, 16 bp, Homo sapiens
tagcaggctgttccat

SEQ ID NO: 4150946 - DNA, 14 bp, Homo sapiens
tagcaggggtgact

SEQ ID NO: 4150947 - DNA, 15 bp, Homo sapiens
tagcaggtggtcctg

SEQ ID NO: 4150948 - DNA, 23 bp, Homo sapiens
tagcaggtggtcctgagacctga

SEQ ID NO: 4150949 - DNA, 13 bp, Homo sapiens
tagcataaataaa

SEQ ID NO: 4150950 - DNA, 17 bp, Homo sapiens
tagcataaataaaactg

SEQ ID NO: 4150951 - DNA, 18 bp, Homo sapiens
tagcatacaggttaacct

SEQ ID NO: 4150952 - DNA, 15 bp, Homo sapiens
tagcatcctaagaaa

SEQ ID NO: 4150953 - DNA, 18 bp, Homo sapiens
tagcatcctaagaaatat

SEQ ID NO: 4150954 - DNA, 19 bp, Homo sapiens
tagcatcctaagaaatatg

SEQ ID NO: 4150955 - DNA, 23 bp, Homo sapiens
tagcatcctaagaaatatgtgag

SEQ ID NO: 4150956 - DNA, 22 bp, Homo sapiens
tagcatctcaggagatttcatg

SEQ ID NO: 4150957 - DNA, 12 bp, Homo sapiens
tagcattaacta

SEQ ID NO: 4150958 - DNA, 15 bp, Homo sapiens
tagcattatgcaatt

SEQ ID NO: 4150959 - DNA, 16 bp, Homo sapiens
tagcattatgcaatta

SEQ ID NO: 4150960 - DNA, 16 bp, Homo sapiens
tagccaaacccttgtc

SEQ ID NO: 4150961 - DNA, 23 bp, Homo sapiens
tagccaaatgactgaaagcactg

SEQ ID NO: 4150962 - DNA, 14 bp, Homo sapiens
tagccaacatagta

SEQ ID NO: 4150963 - DNA, 21 bp, Homo sapiens
tagccacatttggaatacttt

SEQ ID NO: 4150964 - DNA, 12 bp, Homo sapiens
tagccaccagtg

SEQ ID NO: 4150965 - DNA, 15 bp, Homo sapiens
tagccaccagtgtcc

SEQ ID NO: 4150966 - DNA, 14 bp, Homo sapiens
tagccactcaggag

SEQ ID NO: 4150967 - DNA, 18 bp, Homo sapiens
tagccagcacacagggca

SEQ ID NO: 4150968 - DNA, 13 bp, Homo sapiens
tagccaggatcat

SEQ ID NO: 4150969 - DNA, 16 bp, Homo sapiens
tagccaggatggtctc

SEQ ID NO: 4150970 - DNA, 12 bp, Homo sapiens
tagccatctgca

SEQ ID NO: 4150971 - DNA, 13 bp, Homo sapiens
tagcccagcactg

SEQ ID NO: 4150972 - DNA, 14 bp, Homo sapiens
tagcccagcactgt

SEQ ID NO: 4150973 - DNA, 15 bp, Homo sapiens
tagcccagcactgtg

SEQ ID NO: 4150974 - DNA, 19 bp, Homo sapiens
tagcccaggtcctctgata

SEQ ID NO: 4150975 - DNA, 15 bp, Homo sapiens
tagccccctggcctc

SEQ ID NO: 4150976 - DNA, 16 bp, Homo sapiens
tagccccctggcctct

SEQ ID NO: 4150977 - DNA, 18 bp, Homo sapiens
tagccccctggcctctgt

SEQ ID NO: 4150978 - DNA, 13 bp, Homo sapiens
tagcccttccctg

SEQ ID NO: 4150979 - DNA, 14 bp, Homo sapiens
tagcccttccctga

SEQ ID NO: 4150980 - DNA, 17 bp, Homo sapiens
tagcctggccaccagcc

SEQ ID NO: 4150981 - DNA, 20 bp, Homo sapiens
tagcctgtgcctctgggact

SEQ ID NO: 4150982 - DNA, 22 bp, Homo sapiens
tagcctttttgtataaaataga

SEQ ID NO: 4150983 - DNA, 16 bp, Homo sapiens
tagcgatctctcctgg

SEQ ID NO: 4150984 - DNA, 17 bp, Homo sapiens
tagcgatctctcctggc

SEQ ID NO: 4150985 - DNA, 16 bp, Homo sapiens
tagcggagcccagcct

SEQ ID NO: 4150986 - DNA, 19 bp, Homo sapiens
tagcgtgcccgtgtgcatg

SEQ ID NO: 4150987 - DNA, 16 bp, Homo sapiens
tagcgttttttaaatg

SEQ ID NO: 4150988 - DNA, 17 bp, Homo sapiens
tagcgttttttaaatgt

SEQ ID NO: 4150989 - DNA, 22 bp, Homo sapiens
tagcgttttttaaatgtatact

SEQ ID NO: 4150990 - DNA, 14 bp, Homo sapiens
tagctaagtacaca

SEQ ID NO: 4150991 - DNA, 18 bp, Homo sapiens
tagctacttttgcaggat

SEQ ID NO: 4150992 - DNA, 14 bp, Homo sapiens
tagctatatccatg

SEQ ID NO: 4150993 - DNA, 16 bp, Homo sapiens
tagctatatccatgta

SEQ ID NO: 4150994 - DNA, 22 bp, Homo sapiens
tagctatatccatgtactgtag

SEQ ID NO: 4150995 - DNA, 17 bp, Homo sapiens
tagctcactgcagcctc

SEQ ID NO: 4150996 - DNA, 12 bp, Homo sapiens
tagctcagttta

SEQ ID NO: 4150997 - DNA, 14 bp, Homo sapiens
tagctccttggagc

SEQ ID NO: 4150998 - DNA, 15 bp, Homo sapiens
tagctctatttactt

SEQ ID NO: 4150999 - DNA, 17 bp, Homo sapiens
tagctctattttaaagt

SEQ ID NO: 4151000 - DNA, 13 bp, Homo sapiens
tagctctctaggc

SEQ ID NO: 4151001 - DNA, 13 bp, Homo sapiens
tagctctttcctt

SEQ ID NO: 4151002 - DNA, 22 bp, Homo sapiens
tagctgaccccgagaagtgctc

SEQ ID NO: 4151003 - DNA, 10 bp, Homo sapiens
tagctgtggg

SEQ ID NO: 4151004 - DNA, 14 bp, Homo sapiens
tagctgtgtgaaat

SEQ ID NO: 4151005 - DNA, 15 bp, Homo sapiens
tagcttaactaattt

SEQ ID NO: 4151006 - DNA, 14 bp, Homo sapiens
tagcttaagaaaaa

SEQ ID NO: 4151007 - DNA, 15 bp, Homo sapiens
tagcttattattgaa

SEQ ID NO: 4151008 - DNA, 12 bp, Homo sapiens
tagcttccatga

SEQ ID NO: 4151009 - DNA, 12 bp, Homo sapiens
tagcttctttcc

SEQ ID NO: 4151010 - DNA, 15 bp, Homo sapiens
tagctttaccctcag

SEQ ID NO: 4151011 - DNA, 16 bp, Homo sapiens
tagctttagaccctgg

SEQ ID NO: 4151012 - DNA, 17 bp, Homo sapiens
tagctttagaccctggg

SEQ ID NO: 4151013 - DNA, 18 bp, Homo sapiens
tagctttagaccctgggt

SEQ ID NO: 4151014 - DNA, 13 bp, Homo sapiens
tagctttattctt

SEQ ID NO: 4151015 - DNA, 18 bp, Homo sapiens
tagctttattttttaagt

SEQ ID NO: 4151016 - DNA, 22 bp, Homo sapiens
tagctttattttttaagtattt

SEQ ID NO: 4151017 - DNA, 18 bp, Homo sapiens
tagctttccacatttgtc

SEQ ID NO: 4151018 - DNA, 14 bp, Homo sapiens
tagctttgtgtttg

SEQ ID NO: 4151019 - DNA, 22 bp, Homo sapiens
tagctttgtgtttggtttacat

SEQ ID NO: 4151020 - DNA, 14 bp, Homo sapiens
tagcttttaggaaa

SEQ ID NO: 4151021 - DNA, 20 bp, Homo sapiens
tagcttttaggaaaatcact

SEQ ID NO: 4151022 - DNA, 12 bp, Homo sapiens
tagcttttcctt

SEQ ID NO: 4151023 - DNA, 14 bp, Homo sapiens
tagcttttggggag

SEQ ID NO: 4151024 - DNA, 17 bp, Homo sapiens
taggaaaagtacattta

SEQ ID NO: 4151025 - DNA, 21 bp, Homo sapiens
taggaaaatcactttgtctaa

SEQ ID NO: 4151026 - DNA, 14 bp, Homo sapiens
taggaaactgaagc

SEQ ID NO: 4151027 - DNA, 15 bp, Homo sapiens
taggaacagcagtgt

SEQ ID NO: 4151028 - DNA, 16 bp, Homo sapiens
taggaacagcagtgtt

SEQ ID NO: 4151029 - DNA, 21 bp, Homo sapiens
taggaacagcagtgttctcac

SEQ ID NO: 4151030 - DNA, 16 bp, Homo sapiens
taggaacttcagagat

SEQ ID NO: 4151031 - DNA, 18 bp, Homo sapiens
taggaagagcaggactcc

SEQ ID NO: 4151032 - DNA, 18 bp, Homo sapiens
taggaaggtctcattctt

SEQ ID NO: 4151033 - DNA, 22 bp, Homo sapiens
taggaagtgtaacagctgaggt

SEQ ID NO: 4151034 - DNA, 22 bp, Homo sapiens
taggaagttttctgtagtcatt

SEQ ID NO: 4151035 - DNA, 12 bp, Homo sapiens
taggaataaata

SEQ ID NO: 4151036 - DNA, 20 bp, Homo sapiens
taggaatcccagaggtggga

SEQ ID NO: 4151037 - DNA, 21 bp, Homo sapiens
taggaatcccagaggtgggat

SEQ ID NO: 4151038 - DNA, 18 bp, Homo sapiens
taggaatgggataagaag

SEQ ID NO: 4151039 - DNA, 18 bp, Homo sapiens
taggaattaagttatctt

SEQ ID NO: 4151040 - DNA, 19 bp, Homo sapiens
taggacaaggtgcaggcag

SEQ ID NO: 4151041 - DNA, 23 bp, Homo sapiens
taggactagaagattagaaacta

SEQ ID NO: 4151042 - DNA, 14 bp, Homo sapiens
taggagaaacacat

SEQ ID NO: 4151043 - DNA, 21 bp, Homo sapiens
taggagaccaaggcgggagca

SEQ ID NO: 4151044 - DNA, 14 bp, Homo sapiens
taggagagaccgag

SEQ ID NO: 4151045 - DNA, 18 bp, Homo sapiens
taggagaggatgagagcc

SEQ ID NO: 4151046 - DNA, 11 bp, Homo sapiens
taggagcctgc

SEQ ID NO: 4151047 - DNA, 23 bp, Homo sapiens
taggagctgccttggctcagaca

SEQ ID NO: 4151048 - DNA, 20 bp, Homo sapiens
taggaggaccagagctactg

SEQ ID NO: 4151049 - DNA, 18 bp, Homo sapiens
taggagggagttatctaa

SEQ ID NO: 4151050 - DNA, 18 bp, Homo sapiens
taggagtgtgtgacattc

SEQ ID NO: 4151051 - DNA, 19 bp, Homo sapiens
taggatgtcatgtctgctt

SEQ ID NO: 4151052 - DNA, 19 bp, Homo sapiens
taggatgtttttcatgaaa

SEQ ID NO: 4151053 - DNA, 15 bp, Homo sapiens
taggatttttttcct

SEQ ID NO: 4151054 - DNA, 19 bp, Homo sapiens
taggcaaagataatttatt

SEQ ID NO: 4151055 - DNA, 20 bp, Homo sapiens
taggcaagcaggacctggca

SEQ ID NO: 4151056 - DNA, 24 bp, Homo sapiens
taggcaagcaggacctggcatcat

SEQ ID NO: 4151057 - DNA, 14 bp, Homo sapiens
taggcacaaggttg

SEQ ID NO: 4151058 - DNA, 12 bp, Homo sapiens
taggcagcaagc

SEQ ID NO: 4151059 - DNA, 17 bp, Homo sapiens
taggcagggtgtctgcc

SEQ ID NO: 4151060 - DNA, 15 bp, Homo sapiens
taggcatgttatgtt

SEQ ID NO: 4151061 - DNA, 12 bp, Homo sapiens
taggcatttcct

SEQ ID NO: 4151062 - DNA, 22 bp, Homo sapiens
taggccagggcatgtgtatgtg

SEQ ID NO: 4151063 - DNA, 13 bp, Homo sapiens
taggcctgggtgc

SEQ ID NO: 4151064 - DNA, 19 bp, Homo sapiens
taggcctgtcccttgcctc

SEQ ID NO: 4151065 - DNA, 18 bp, Homo sapiens
taggctatttgtaaatct

SEQ ID NO: 4151066 - DNA, 15 bp, Homo sapiens
taggctcttaagcag

SEQ ID NO: 4151067 - DNA, 19 bp, Homo sapiens
taggctcttaagcagcatg

SEQ ID NO: 4151068 - DNA, 21 bp, Homo sapiens
taggctcttaagcagcatgga

SEQ ID NO: 4151069 - DNA, 22 bp, Homo sapiens
taggctggggcggggcccagga

SEQ ID NO: 4151070 - DNA, 17 bp, Homo sapiens
tagggaaaggttttgta

SEQ ID NO: 4151071 - DNA, 19 bp, Homo sapiens
tagggaagctggcctgaga

SEQ ID NO: 4151072 - DNA, 13 bp, Homo sapiens
tagggacttaaaa

SEQ ID NO: 4151073 - DNA, 16 bp, Homo sapiens
tagggagacagggtag

SEQ ID NO: 4151074 - DNA, 13 bp, Homo sapiens
tagggaggcagcc

SEQ ID NO: 4151075 - DNA, 18 bp, Homo sapiens
tagggagtacctgctgcc

SEQ ID NO: 4151076 - DNA, 23 bp, Homo sapiens
tagggatcaaccagctaagaaaa

SEQ ID NO: 4151077 - DNA, 16 bp, Homo sapiens
tagggcactgggctgt

SEQ ID NO: 4151078 - DNA, 11 bp, Homo sapiens
tagggccaggc

SEQ ID NO: 4151079 - DNA, 21 bp, Homo sapiens
tagggccaggcaggtgcctgg

SEQ ID NO: 4151080 - DNA, 13 bp, Homo sapiens
tagggccttggtt

SEQ ID NO: 4151081 - DNA, 13 bp, Homo sapiens
tagggcttttatt

SEQ ID NO: 4151082 - DNA, 15 bp, Homo sapiens
taggggaacagacca

SEQ ID NO: 4151083 - DNA, 16 bp, Homo sapiens
taggggaacagaccag

SEQ ID NO: 4151084 - DNA, 21 bp, Homo sapiens
taggggcttataataaaggac

SEQ ID NO: 4151085 - DNA, 22 bp, Homo sapiens
taggggcttataataaaggact

SEQ ID NO: 4151086 - DNA, 19 bp, Homo sapiens
taggggttaaagcagacag

SEQ ID NO: 4151087 - DNA, 16 bp, Homo sapiens
tagggtaaatcagtaa

SEQ ID NO: 4151088 - DNA, 18 bp, Homo sapiens
tagggtacatttataatt

SEQ ID NO: 4151089 - DNA, 19 bp, Homo sapiens
tagggtactaaatttaaat

SEQ ID NO: 4151090 - DNA, 12 bp, Homo sapiens
taggtaaattct

SEQ ID NO: 4151091 - DNA, 18 bp, Homo sapiens
taggtaacttattagaaa

SEQ ID NO: 4151092 - DNA, 13 bp, Homo sapiens
taggtaagctgtg

SEQ ID NO: 4151093 - DNA, 15 bp, Homo sapiens
taggtaagctgtgcc

SEQ ID NO: 4151094 - DNA, 17 bp, Homo sapiens
taggtatgatctcttct

SEQ ID NO: 4151095 - DNA, 22 bp, Homo sapiens
taggtccaagccccccacacct

SEQ ID NO: 4151096 - DNA, 20 bp, Homo sapiens
taggtctcctcagggtgggg

SEQ ID NO: 4151097 - DNA, 19 bp, Homo sapiens
taggtctcggactaagcct

SEQ ID NO: 4151098 - DNA, 17 bp, Homo sapiens
taggttccctgttcttc

SEQ ID NO: 4151099 - DNA, 17 bp, Homo sapiens
taggtttctctccctcc

SEQ ID NO: 4151100 - DNA, 12 bp, Homo sapiens
tagtaaatgtct

SEQ ID NO: 4151101 - DNA, 15 bp, Homo sapiens
tagtaaatgtctttg

SEQ ID NO: 4151102 - DNA, 23 bp, Homo sapiens
tagtaaatgtctttgtaagtcag

SEQ ID NO: 4151103 - DNA, 19 bp, Homo sapiens
tagtaacttcttatggaat

SEQ ID NO: 4151104 - DNA, 14 bp, Homo sapiens
tagtaactttgaaa

SEQ ID NO: 4151105 - DNA, 23 bp, Homo sapiens
tagtaagcggctcaagcccagga

SEQ ID NO: 4151106 - DNA, 16 bp, Homo sapiens
tagtacaaattataaa

SEQ ID NO: 4151107 - DNA, 16 bp, Homo sapiens
tagtaccatttataca

SEQ ID NO: 4151108 - DNA, 20 bp, Homo sapiens
tagtactcctgcaaaatttt

SEQ ID NO: 4151109 - DNA, 22 bp, Homo sapiens
tagtacttgaaatctaggatta

SEQ ID NO: 4151110 - DNA, 19 bp, Homo sapiens
tagtagcgttttttaaatg

SEQ ID NO: 4151111 - DNA, 15 bp, Homo sapiens
tagtaggaatgtaca

SEQ ID NO: 4151112 - DNA, 17 bp, Homo sapiens
tagtaggtcctcaataa

SEQ ID NO: 4151113 - DNA, 14 bp, Homo sapiens
tagtagtttttaca

SEQ ID NO: 4151114 - DNA, 14 bp, Homo sapiens
tagtataaagaaaa

SEQ ID NO: 4151115 - DNA, 16 bp, Homo sapiens
tagtatatctggacaa

SEQ ID NO: 4151116 - DNA, 16 bp, Homo sapiens
tagtatcagtgtttta

SEQ ID NO: 4151117 - DNA, 17 bp, Homo sapiens
tagtatcagtgttttaa

SEQ ID NO: 4151118 - DNA, 19 bp, Homo sapiens
tagtatcagtgttttaaat

SEQ ID NO: 4151119 - DNA, 21 bp, Homo sapiens
tagtatcagtgttttaaattc

SEQ ID NO: 4151120 - DNA, 22 bp, Homo sapiens
tagtatcagtgttttaaattct

SEQ ID NO: 4151121 - DNA, 16 bp, Homo sapiens
tagtatctagcaatca

SEQ ID NO: 4151122 - DNA, 13 bp, Homo sapiens
tagtatttctcag

SEQ ID NO: 4151123 - DNA, 13 bp, Homo sapiens
tagtatttgaatt

SEQ ID NO: 4151124 - DNA, 14 bp, Homo sapiens
tagtatttgaatta

SEQ ID NO: 4151125 - DNA, 18 bp, Homo sapiens
tagtatttgaattaaaac

SEQ ID NO: 4151126 - DNA, 12 bp, Homo sapiens
tagtcaggtgct

SEQ ID NO: 4151127 - DNA, 14 bp, Homo sapiens
tagtcattcttccc

SEQ ID NO: 4151128 - DNA, 15 bp, Homo sapiens
tagtcccttcccctc

SEQ ID NO: 4151129 - DNA, 12 bp, Homo sapiens
tagtcctgtact

SEQ ID NO: 4151130 - DNA, 11 bp, Homo sapiens
tagtctcagtt

SEQ ID NO: 4151131 - DNA, 21 bp, Homo sapiens
tagtctcattacttttgaagt

SEQ ID NO: 4151132 - DNA, 19 bp, Homo sapiens
tagtctcctttgcactgag

SEQ ID NO: 4151133 - DNA, 20 bp, Homo sapiens
tagtctcctttgcactgagg

SEQ ID NO: 4151134 - DNA, 19 bp, Homo sapiens
tagtctctgccctcataga

SEQ ID NO: 4151135 - DNA, 16 bp, Homo sapiens
tagtctctttaaaagg

SEQ ID NO: 4151136 - DNA, 17 bp, Homo sapiens
tagtctgaaactggctt

SEQ ID NO: 4151137 - DNA, 12 bp, Homo sapiens
tagtctggtttc

SEQ ID NO: 4151138 - DNA, 22 bp, Homo sapiens
tagtgaaataaattctgattct

SEQ ID NO: 4151139 - DNA, 17 bp, Homo sapiens
tagtgaagactccagaa

SEQ ID NO: 4151140 - DNA, 17 bp, Homo sapiens
tagtgacaagtgaagaa

SEQ ID NO: 4151141 - DNA, 21 bp, Homo sapiens
tagtgacaagtgaagaacact

SEQ ID NO: 4151142 - DNA, 16 bp, Homo sapiens
tagtgacttgtgtccc

SEQ ID NO: 4151143 - DNA, 18 bp, Homo sapiens
tagtgagcagtgagcaga

SEQ ID NO: 4151144 - DNA, 20 bp, Homo sapiens
tagtgaggaagacaagcatt

SEQ ID NO: 4151145 - DNA, 14 bp, Homo sapiens
tagtgatggttccc

SEQ ID NO: 4151146 - DNA, 14 bp, Homo sapiens
tagtgcagctgatt

SEQ ID NO: 4151147 - DNA, 20 bp, Homo sapiens
tagtgcagctgattttaaca

SEQ ID NO: 4151148 - DNA, 20 bp, Homo sapiens
tagtgccagaattttaggaa

SEQ ID NO: 4151149 - DNA, 21 bp, Homo sapiens
tagtgccagaattttaggaac

SEQ ID NO: 4151150 - DNA, 21 bp, Homo sapiens
tagtgcgatgtttcaggaggc

SEQ ID NO: 4151151 - DNA, 17 bp, Homo sapiens
tagtgcggacaagtttt

SEQ ID NO: 4151152 - DNA, 21 bp, Homo sapiens
tagtggatgactgttgatgaa

SEQ ID NO: 4151153 - DNA, 20 bp, Homo sapiens
tagtgggccctctctctggg

SEQ ID NO: 4151154 - DNA, 19 bp, Homo sapiens
tagtggtctttgtaagagt

SEQ ID NO: 4151155 - DNA, 21 bp, Homo sapiens
tagtgtacctcctctcagtgt

SEQ ID NO: 4151156 - DNA, 22 bp, Homo sapiens
tagtgtacctcctctcagtgtt

SEQ ID NO: 4151157 - DNA, 23 bp, Homo sapiens
tagtgtacctcctctcagtgttt

SEQ ID NO: 4151158 - DNA, 20 bp, Homo sapiens
tagtgtgtgtgcagagtcca

SEQ ID NO: 4151159 - DNA, 23 bp, Homo sapiens
tagtgttagttataaatagcctt

SEQ ID NO: 4151160 - DNA, 16 bp, Homo sapiens
tagtgttcagaaaaaa

SEQ ID NO: 4151161 - DNA, 20 bp, Homo sapiens
tagtgttctgctcctgcttt

SEQ ID NO: 4151162 - DNA, 19 bp, Homo sapiens
tagttaagacatgatttcc

SEQ ID NO: 4151163 - DNA, 23 bp, Homo sapiens
tagttacatttctatcagtactt

SEQ ID NO: 4151164 - DNA, 16 bp, Homo sapiens
tagttataaatagcct

SEQ ID NO: 4151165 - DNA, 16 bp, Homo sapiens
tagttcagaatttagt

SEQ ID NO: 4151166 - DNA, 14 bp, Homo sapiens
tagttcatccaatc

SEQ ID NO: 4151167 - DNA, 20 bp, Homo sapiens
tagttcatccaatcctcact

SEQ ID NO: 4151168 - DNA, 20 bp, Homo sapiens
tagttcatcccttctcttcc

SEQ ID NO: 4151169 - DNA, 16 bp, Homo sapiens
tagttctgaggtccct

SEQ ID NO: 4151170 - DNA, 20 bp, Homo sapiens
tagttgaaaggcctcaagaa

SEQ ID NO: 4151171 - DNA, 17 bp, Homo sapiens
tagttgacaacctagaa

SEQ ID NO: 4151172 - DNA, 20 bp, Homo sapiens
tagttgacaacctagaatgt

SEQ ID NO: 4151173 - DNA, 21 bp, Homo sapiens
tagttgacaacctagaatgtc

SEQ ID NO: 4151174 - DNA, 17 bp, Homo sapiens
tagttgcagaaacattt

SEQ ID NO: 4151175 - DNA, 12 bp, Homo sapiens
tagttggacagt

SEQ ID NO: 4151176 - DNA, 12 bp, Homo sapiens
tagttggctgga

SEQ ID NO: 4151177 - DNA, 23 bp, Homo sapiens
tagttggtaatgcttggaatggc

SEQ ID NO: 4151178 - DNA, 17 bp, Homo sapiens
tagttgtctttcctggc

SEQ ID NO: 4151179 - DNA, 16 bp, Homo sapiens
tagttgttttaagtac

SEQ ID NO: 4151180 - DNA, 16 bp, Homo sapiens
tagtttaaaacacatt

SEQ ID NO: 4151181 - DNA, 11 bp, Homo sapiens
tagtttacaat

SEQ ID NO: 4151182 - DNA, 14 bp, Homo sapiens
tagtttactgtttt

SEQ ID NO: 4151183 - DNA, 22 bp, Homo sapiens
tagtttattattattaaagtct

SEQ ID NO: 4151184 - DNA, 21 bp, Homo sapiens
tagtttcagtagattgcagaa

SEQ ID NO: 4151185 - DNA, 13 bp, Homo sapiens
tagtttccttttt

SEQ ID NO: 4151186 - DNA, 19 bp, Homo sapiens
tagtttctccaagtacttt

SEQ ID NO: 4151187 - DNA, 12 bp, Homo sapiens
tagtttggatat

SEQ ID NO: 4151188 - DNA, 21 bp, Homo sapiens
tagtttggatatttttgtact

SEQ ID NO: 4151189 - DNA, 16 bp, Homo sapiens
tagttttaaactcatt

SEQ ID NO: 4151190 - DNA, 14 bp, Homo sapiens
tagttttagttgca

SEQ ID NO: 4151191 - DNA, 16 bp, Homo sapiens
tagttttagttgcaga

SEQ ID NO: 4151192 - DNA, 13 bp, Homo sapiens
tagttttgtcaaa

SEQ ID NO: 4151193 - DNA, 13 bp, Homo sapiens
tagttttgtttat

SEQ ID NO: 4151194 - DNA, 20 bp, Homo sapiens
tagtttttacagctgtgtta

SEQ ID NO: 4151195 - DNA, 17 bp, Homo sapiens
tagtttttcttcaacat

SEQ ID NO: 4151196 - DNA, 23 bp, Homo sapiens
tagttttttttttttttatgtga

SEQ ID NO: 4151197 - DNA, 15 bp, Homo sapiens
tataaaaaatggttc

SEQ ID NO: 4151198 - DNA, 21 bp, Homo sapiens
tataaaaaatggttcagaatt

SEQ ID NO: 4151199 - DNA, 21 bp, Homo sapiens
tataaaatatgaagacataaa

SEQ ID NO: 4151200 - DNA, 15 bp, Homo sapiens
tataaaattaagcaa

SEQ ID NO: 4151201 - DNA, 20 bp, Homo sapiens
tataaacataagttgcattt

SEQ ID NO: 4151202 - DNA, 21 bp, Homo sapiens
tataaacataagttgcattta

SEQ ID NO: 4151203 - DNA, 20 bp, Homo sapiens
tataaacatatacagaaaaa

SEQ ID NO: 4151204 - DNA, 13 bp, Homo sapiens
tataaactttaga

SEQ ID NO: 4151205 - DNA, 15 bp, Homo sapiens
tataaactttagagt

SEQ ID NO: 4151206 - DNA, 22 bp, Homo sapiens
tataaagcgatatacagatgaa

SEQ ID NO: 4151207 - DNA, 14 bp, Homo sapiens
tataaagcttaata

SEQ ID NO: 4151208 - DNA, 15 bp, Homo sapiens
tataaagtaaagcta

SEQ ID NO: 4151209 - DNA, 19 bp, Homo sapiens
tataaagtacccatctagt

SEQ ID NO: 4151210 - DNA, 18 bp, Homo sapiens
tataaatacaaatctgta

SEQ ID NO: 4151211 - DNA, 20 bp, Homo sapiens
tataaatacaaatctgtata

SEQ ID NO: 4151212 - DNA, 15 bp, Homo sapiens
tataaatatcattgt

SEQ ID NO: 4151213 - DNA, 17 bp, Homo sapiens
tataaatgaaatttgca

SEQ ID NO: 4151214 - DNA, 19 bp, Homo sapiens
tataaatgaaatttgcaaa

SEQ ID NO: 4151215 - DNA, 14 bp, Homo sapiens
tataaatgctattt

SEQ ID NO: 4151216 - DNA, 16 bp, Homo sapiens
tataaatggtgttttt

SEQ ID NO: 4151217 - DNA, 18 bp, Homo sapiens
tataaatgtctattatta

SEQ ID NO: 4151218 - DNA, 17 bp, Homo sapiens
tataaattctgtgggtc

SEQ ID NO: 4151219 - DNA, 17 bp, Homo sapiens
tataactcatcataaaa

SEQ ID NO: 4151220 - DNA, 19 bp, Homo sapiens
tataactcatcataaaata

SEQ ID NO: 4151221 - DNA, 22 bp, Homo sapiens
tataacttaaaaaaatgacaga

SEQ ID NO: 4151222 - DNA, 18 bp, Homo sapiens
tataacttaaaatatttt

SEQ ID NO: 4151223 - DNA, 16 bp, Homo sapiens
tataaggaaagcaata

SEQ ID NO: 4151224 - DNA, 16 bp, Homo sapiens
tataaggacttcctga

SEQ ID NO: 4151225 - DNA, 13 bp, Homo sapiens
tataagggagagc

SEQ ID NO: 4151226 - DNA, 17 bp, Homo sapiens
tataaggtttaaaaaga

SEQ ID NO: 4151227 - DNA, 15 bp, Homo sapiens
tataagtcacaaaga

SEQ ID NO: 4151228 - DNA, 15 bp, Homo sapiens
tataagtgtacatat

SEQ ID NO: 4151229 - DNA, 14 bp, Homo sapiens
tataataaaggact

SEQ ID NO: 4151230 - DNA, 22 bp, Homo sapiens
tataataatagttattatttaa

SEQ ID NO: 4151231 - DNA, 20 bp, Homo sapiens
tataatatactatatttatg

SEQ ID NO: 4151232 - DNA, 15 bp, Homo sapiens
tataatcaatgaatt

SEQ ID NO: 4151233 - DNA, 15 bp, Homo sapiens
tataatcattagttt

SEQ ID NO: 4151234 - DNA, 19 bp, Homo sapiens
tataatgtaagctctactg

SEQ ID NO: 4151235 - DNA, 20 bp, Homo sapiens
tataatgtaagctctactga

SEQ ID NO: 4151236 - DNA, 16 bp, Homo sapiens
tataatgttagtagaa

SEQ ID NO: 4151237 - DNA, 15 bp, Homo sapiens
tataatttaacttca

SEQ ID NO: 4151238 - DNA, 14 bp, Homo sapiens
tataatttgacttg

SEQ ID NO: 4151239 - DNA, 22 bp, Homo sapiens
tataattttatgaatgtctttg

SEQ ID NO: 4151240 - DNA, 19 bp, Homo sapiens
tataattttttgtaatgtg

SEQ ID NO: 4151241 - DNA, 22 bp, Homo sapiens
tataatttttttatgttttgtt

SEQ ID NO: 4151242 - DNA, 17 bp, Homo sapiens
tatacaaattagaaaat

SEQ ID NO: 4151243 - DNA, 20 bp, Homo sapiens
tatacaaattttcagaaggt

SEQ ID NO: 4151244 - DNA, 22 bp, Homo sapiens
tatacacttacactttatgcac

SEQ ID NO: 4151245 - DNA, 13 bp, Homo sapiens
tatacagatgaaa

SEQ ID NO: 4151246 - DNA, 14 bp, Homo sapiens
tatacagatgaaaa

SEQ ID NO: 4151247 - DNA, 18 bp, Homo sapiens
tatacagatgaaaatttg

SEQ ID NO: 4151248 - DNA, 21 bp, Homo sapiens
tatacagatgaaaatttgaga

SEQ ID NO: 4151249 - DNA, 16 bp, Homo sapiens
tatacagttcaataaa

SEQ ID NO: 4151250 - DNA, 18 bp, Homo sapiens
tatacatatctttattaa

SEQ ID NO: 4151251 - DNA, 21 bp, Homo sapiens
tatacatgaagaatagaaaca

SEQ ID NO: 4151252 - DNA, 22 bp, Homo sapiens
tatacatgaagaatagaaacaa

SEQ ID NO: 4151253 - DNA, 16 bp, Homo sapiens
tatacattagtaaatg

SEQ ID NO: 4151254 - DNA, 19 bp, Homo sapiens
tatacattagtaaatgtct

SEQ ID NO: 4151255 - DNA, 20 bp, Homo sapiens
tatacattagtaaatgtctt

SEQ ID NO: 4151256 - DNA, 22 bp, Homo sapiens
tatacattctttatcttgacat

SEQ ID NO: 4151257 - DNA, 15 bp, Homo sapiens
tatacctcaaactat

SEQ ID NO: 4151258 - DNA, 18 bp, Homo sapiens
tatacctgcacgttcata

SEQ ID NO: 4151259 - DNA, 19 bp, Homo sapiens
tatacctgcacgttcataa

SEQ ID NO: 4151260 - DNA, 23 bp, Homo sapiens
tatacctgttgcttaattacaat

SEQ ID NO: 4151261 - DNA, 15 bp, Homo sapiens
tatacgcttttcttt

SEQ ID NO: 4151262 - DNA, 18 bp, Homo sapiens
tatactctagatgaagtt

SEQ ID NO: 4151263 - DNA, 16 bp, Homo sapiens
tatactctttctgtat

SEQ ID NO: 4151264 - DNA, 20 bp, Homo sapiens
tatactgaaggaaaaacaca

SEQ ID NO: 4151265 - DNA, 22 bp, Homo sapiens
tatactgaagtcttttctgtca

SEQ ID NO: 4151266 - DNA, 17 bp, Homo sapiens
tatactgattctgtgta

SEQ ID NO: 4151267 - DNA, 18 bp, Homo sapiens
tatacttgtggttttcaa

SEQ ID NO: 4151268 - DNA, 23 bp, Homo sapiens
tatacttttcccctgttaaacag

SEQ ID NO: 4151269 - DNA, 14 bp, Homo sapiens
tatagaccaaagca

SEQ ID NO: 4151270 - DNA, 14 bp, Homo sapiens
tatagctaagtaca

SEQ ID NO: 4151271 - DNA, 18 bp, Homo sapiens
tataggagccttaatttt

SEQ ID NO: 4151272 - DNA, 14 bp, Homo sapiens
tataggccagggca

SEQ ID NO: 4151273 - DNA, 22 bp, Homo sapiens
tataggccagggcatgtgtatg

SEQ ID NO: 4151274 - DNA, 17 bp, Homo sapiens
tataggtgatgtttgct

SEQ ID NO: 4151275 - DNA, 20 bp, Homo sapiens
tataggtgatgtttgctctt

SEQ ID NO: 4151276 - DNA, 12 bp, Homo sapiens
tatagtacatga

SEQ ID NO: 4151277 - DNA, 16 bp, Homo sapiens
tatagtacatgataaa

SEQ ID NO: 4151278 - DNA, 18 bp, Homo sapiens
tatagtttaaaacacatt

SEQ ID NO: 4151279 - DNA, 19 bp, Homo sapiens
tatagtttaaaacacattg

SEQ ID NO: 4151280 - DNA, 23 bp, Homo sapiens
tatataaaaagaaaagataaaga

SEQ ID NO: 4151281 - DNA, 19 bp, Homo sapiens
tatataaaacggtgctgtg

SEQ ID NO: 4151282 - DNA, 22 bp, Homo sapiens
tatataaatgtaaaaataataa

SEQ ID NO: 4151283 - DNA, 16 bp, Homo sapiens
tatatacagaggaaat

SEQ ID NO: 4151284 - DNA, 19 bp, Homo sapiens
tatatactgggttcttgtt

SEQ ID NO: 4151285 - DNA, 13 bp, Homo sapiens
tatatagaatgct

SEQ ID NO: 4151286 - DNA, 22 bp, Homo sapiens
tatatagagattgtacatttat

SEQ ID NO: 4151287 - DNA, 13 bp, Homo sapiens
tatatatatatct

SEQ ID NO: 4151288 - DNA, 22 bp, Homo sapiens
tatatatgaaaactatacaaca

SEQ ID NO: 4151289 - DNA, 14 bp, Homo sapiens
tatatatgtgtgtg

SEQ ID NO: 4151290 - DNA, 17 bp, Homo sapiens
tatatattcttataaaa

SEQ ID NO: 4151291 - DNA, 20 bp, Homo sapiens
tatatattcttataaaaatg

SEQ ID NO: 4151292 - DNA, 13 bp, Homo sapiens
tatatatttataa

SEQ ID NO: 4151293 - DNA, 20 bp, Homo sapiens
tatatatttttggttgtcaa

SEQ ID NO: 4151294 - DNA, 11 bp, Homo sapiens
tatatcagcct

SEQ ID NO: 4151295 - DNA, 14 bp, Homo sapiens
tatatcatatgtat

SEQ ID NO: 4151296 - DNA, 13 bp, Homo sapiens
tatatcatgcaaa

SEQ ID NO: 4151297 - DNA, 18 bp, Homo sapiens
tatatcattctacagaat

SEQ ID NO: 4151298 - DNA, 22 bp, Homo sapiens
tatatcattggaacaactgata

SEQ ID NO: 4151299 - DNA, 17 bp, Homo sapiens
tatatccatgtactgta

SEQ ID NO: 4151300 - DNA, 17 bp, Homo sapiens
tatatcctttctaacaa

SEQ ID NO: 4151301 - DNA, 12 bp, Homo sapiens
tatatctgaaaa

SEQ ID NO: 4151302 - DNA, 23 bp, Homo sapiens
tatatctgaagagtatccttcct

SEQ ID NO: 4151303 - DNA, 13 bp, Homo sapiens
tatatctgcaaaa

SEQ ID NO: 4151304 - DNA, 14 bp, Homo sapiens
tatatctgtggtct

SEQ ID NO: 4151305 - DNA, 14 bp, Homo sapiens
tatatcttttggtt

SEQ ID NO: 4151306 - DNA, 20 bp, Homo sapiens
tatatcttttggttattcta

SEQ ID NO: 4151307 - DNA, 12 bp, Homo sapiens
tatatgaaaact

SEQ ID NO: 4151308 - DNA, 19 bp, Homo sapiens
tatatgaaaactatacaac

SEQ ID NO: 4151309 - DNA, 15 bp, Homo sapiens
tatatgaccagaagc

SEQ ID NO: 4151310 - DNA, 18 bp, Homo sapiens
tatatgagactttatgtg

SEQ ID NO: 4151311 - DNA, 15 bp, Homo sapiens
tatatgcaatgtcca

SEQ ID NO: 4151312 - DNA, 16 bp, Homo sapiens
tatatgccatgatgga

SEQ ID NO: 4151313 - DNA, 16 bp, Homo sapiens
tatatggcccagcctt

SEQ ID NO: 4151314 - DNA, 16 bp, Homo sapiens
tatatgtattatttat

SEQ ID NO: 4151315 - DNA, 19 bp, Homo sapiens
tatatgtattatttataat

SEQ ID NO: 4151316 - DNA, 14 bp, Homo sapiens
tatatgtgtatgca

SEQ ID NO: 4151317 - DNA, 17 bp, Homo sapiens
tatattaatgtacttgt

SEQ ID NO: 4151318 - DNA, 13 bp, Homo sapiens
tatattattgtaa

SEQ ID NO: 4151319 - DNA, 18 bp, Homo sapiens
tatattattgtaagttgt

SEQ ID NO: 4151320 - DNA, 14 bp, Homo sapiens
tatattatttacat

SEQ ID NO: 4151321 - DNA, 14 bp, Homo sapiens
tatattcatatatt

SEQ ID NO: 4151322 - DNA, 21 bp, Homo sapiens
tatattgaacttttgtactga

SEQ ID NO: 4151323 - DNA, 18 bp, Homo sapiens
tatattgaagacaatttg

SEQ ID NO: 4151324 - DNA, 20 bp, Homo sapiens
tatattgaagacaatttgat

SEQ ID NO: 4151325 - DNA, 22 bp, Homo sapiens
tatattgagaatcccttaaaat

SEQ ID NO: 4151326 - DNA, 18 bp, Homo sapiens
tatattgtgtttgtgtat

SEQ ID NO: 4151327 - DNA, 15 bp, Homo sapiens
tatatttaatgataa

SEQ ID NO: 4151328 - DNA, 14 bp, Homo sapiens
tatatttacaataa

SEQ ID NO: 4151329 - DNA, 12 bp, Homo sapiens
tatatttataac

SEQ ID NO: 4151330 - DNA, 14 bp, Homo sapiens
tatatttataactc

SEQ ID NO: 4151331 - DNA, 16 bp, Homo sapiens
tatatttcactatttt

SEQ ID NO: 4151332 - DNA, 11 bp, Homo sapiens
tatatttcctt

SEQ ID NO: 4151333 - DNA, 16 bp, Homo sapiens
tatatttcctttatgt

SEQ ID NO: 4151334 - DNA, 17 bp, Homo sapiens
tatatttcctttatgtg

SEQ ID NO: 4151335 - DNA, 20 bp, Homo sapiens
tatatttcctttatgtgaat

SEQ ID NO: 4151336 - DNA, 22 bp, Homo sapiens
tatatttgggcctgctccagac

SEQ ID NO: 4151337 - DNA, 13 bp, Homo sapiens
tatatttgtacaa

SEQ ID NO: 4151338 - DNA, 14 bp, Homo sapiens
tatatttgtacaaa

SEQ ID NO: 4151339 - DNA, 13 bp, Homo sapiens
tatattttaagaa

SEQ ID NO: 4151340 - DNA, 12 bp, Homo sapiens
tatattttaata

SEQ ID NO: 4151341 - DNA, 18 bp, Homo sapiens
tatattttgtactttgtg

SEQ ID NO: 4151342 - DNA, 15 bp, Homo sapiens
tatatttttcacagt

SEQ ID NO: 4151343 - DNA, 21 bp, Homo sapiens
tatcaaaatcactatctttct

SEQ ID NO: 4151344 - DNA, 13 bp, Homo sapiens
tatcaaaatgtag

SEQ ID NO: 4151345 - DNA, 17 bp, Homo sapiens
tatcaaaccctagcctt

SEQ ID NO: 4151346 - DNA, 20 bp, Homo sapiens
tatcaaaccctagccttgct

SEQ ID NO: 4151347 - DNA, 21 bp, Homo sapiens
tatcaaacttcagctgtactt

SEQ ID NO: 4151348 - DNA, 12 bp, Homo sapiens
tatcaaagcata

SEQ ID NO: 4151349 - DNA, 21 bp, Homo sapiens
tatcaacactgttactttcgt

SEQ ID NO: 4151350 - DNA, 15 bp, Homo sapiens
tatcaactttaatca

SEQ ID NO: 4151351 - DNA, 12 bp, Homo sapiens
tatcaactttag

SEQ ID NO: 4151352 - DNA, 12 bp, Homo sapiens
tatcaagaaagt

SEQ ID NO: 4151353 - DNA, 23 bp, Homo sapiens
tatcaagccagtacgtgctaaca

SEQ ID NO: 4151354 - DNA, 20 bp, Homo sapiens
tatcaagtcaatcatttctc

SEQ ID NO: 4151355 - DNA, 17 bp, Homo sapiens
tatcaatatctaatata

SEQ ID NO: 4151356 - DNA, 22 bp, Homo sapiens
tatcaatatctaatatatatga

SEQ ID NO: 4151357 - DNA, 17 bp, Homo sapiens
tatcacagtattatctg

SEQ ID NO: 4151358 - DNA, 21 bp, Homo sapiens
tatcacagtattatctgtgtt

SEQ ID NO: 4151359 - DNA, 23 bp, Homo sapiens
tatcaccccctccctacacacac

SEQ ID NO: 4151360 - DNA, 14 bp, Homo sapiens
tatcacctcatggc

SEQ ID NO: 4151361 - DNA, 14 bp, Homo sapiens
tatcactctaaaaa

SEQ ID NO: 4151362 - DNA, 20 bp, Homo sapiens
tatcacttccatgacataag

SEQ ID NO: 4151363 - DNA, 13 bp, Homo sapiens
tatcagatacatc

SEQ ID NO: 4151364 - DNA, 18 bp, Homo sapiens
tatcagatacatcactgc

SEQ ID NO: 4151365 - DNA, 19 bp, Homo sapiens
tatcagcctgagtctcctg

SEQ ID NO: 4151366 - DNA, 12 bp, Homo sapiens
tatcagtacctc

SEQ ID NO: 4151367 - DNA, 15 bp, Homo sapiens
tatcagtacttttat

SEQ ID NO: 4151368 - DNA, 20 bp, Homo sapiens
tatcagtgacagagttcact

SEQ ID NO: 4151369 - DNA, 22 bp, Homo sapiens
tatcagtgacagagttcactat

SEQ ID NO: 4151370 - DNA, 13 bp, Homo sapiens
tatcagtgtcctt

SEQ ID NO: 4151371 - DNA, 17 bp, Homo sapiens
tatcagtgtcctttcca

SEQ ID NO: 4151372 - DNA, 18 bp, Homo sapiens
tatcagtgtcctttccag

SEQ ID NO: 4151373 - DNA, 19 bp, Homo sapiens
tatcagtgttttaaattct

SEQ ID NO: 4151374 - DNA, 13 bp, Homo sapiens
tatcataagaatt

SEQ ID NO: 4151375 - DNA, 22 bp, Homo sapiens
tatcatcaagcaggaattatgt

SEQ ID NO: 4151376 - DNA, 19 bp, Homo sapiens
tatcatctggataggagcc

SEQ ID NO: 4151377 - DNA, 16 bp, Homo sapiens
tatcatgagtgaataa

SEQ ID NO: 4151378 - DNA, 15 bp, Homo sapiens
tatcatgcaaaatat

SEQ ID NO: 4151379 - DNA, 14 bp, Homo sapiens
tatcatgccctgtg

SEQ ID NO: 4151380 - DNA, 12 bp, Homo sapiens
tatcatgctaaa

SEQ ID NO: 4151381 - DNA, 16 bp, Homo sapiens
tatcatgtaaagaaat

SEQ ID NO: 4151382 - DNA, 21 bp, Homo sapiens
tatcatgtaaagaaatgtctt

SEQ ID NO: 4151383 - DNA, 14 bp, Homo sapiens
tatcattctacaga

SEQ ID NO: 4151384 - DNA, 19 bp, Homo sapiens
tatcattctacagaataat

SEQ ID NO: 4151385 - DNA, 19 bp, Homo sapiens
tatccaaaaatagccctgc

SEQ ID NO: 4151386 - DNA, 20 bp, Homo sapiens
tatccacaatagctgacggc

SEQ ID NO: 4151387 - DNA, 22 bp, Homo sapiens
tatccacaattattggcaaagt

SEQ ID NO: 4151388 - DNA, 11 bp, Homo sapiens
tatccaggact

SEQ ID NO: 4151389 - DNA, 22 bp, Homo sapiens
tatccatattgagtcaaatggt

SEQ ID NO: 4151390 - DNA, 22 bp, Homo sapiens
tatccatgtactgtagtttttc

SEQ ID NO: 4151391 - DNA, 20 bp, Homo sapiens
tatccattttttttactgtt

SEQ ID NO: 4151392 - DNA, 23 bp, Homo sapiens
tatccccaatcagctccttttcc

SEQ ID NO: 4151393 - DNA, 20 bp, Homo sapiens
tatccccatctccctgcctg

SEQ ID NO: 4151394 - DNA, 23 bp, Homo sapiens
tatccctctcttccccttccctt

SEQ ID NO: 4151395 - DNA, 19 bp, Homo sapiens
tatccctgcggcctccaca

SEQ ID NO: 4151396 - DNA, 14 bp, Homo sapiens
tatcctaaataaaa

SEQ ID NO: 4151397 - DNA, 16 bp, Homo sapiens
tatcctcactgccctc

SEQ ID NO: 4151398 - DNA, 19 bp, Homo sapiens
tatcctctccccctcctcc

SEQ ID NO: 4151399 - DNA, 13 bp, Homo sapiens
tatcctgagccat

SEQ ID NO: 4151400 - DNA, 18 bp, Homo sapiens
tatcctgccaaaatcatt

SEQ ID NO: 4151401 - DNA, 18 bp, Homo sapiens
tatcctgggcttttgttt

SEQ ID NO: 4151402 - DNA, 22 bp, Homo sapiens
tatcctgggggacccaatgtag

SEQ ID NO: 4151403 - DNA, 19 bp, Homo sapiens
tatcctgtgacatgtaaca

SEQ ID NO: 4151404 - DNA, 16 bp, Homo sapiens
tatcctgtgactgtct

SEQ ID NO: 4151405 - DNA, 23 bp, Homo sapiens
tatcctgtgactgtctcacttaa

SEQ ID NO: 4151406 - DNA, 22 bp, Homo sapiens
tatccttataggcctgtccctt

SEQ ID NO: 4151407 - DNA, 19 bp, Homo sapiens
tatccttgggggctcccag

SEQ ID NO: 4151408 - DNA, 14 bp, Homo sapiens
tatccttttctgtg

SEQ ID NO: 4151409 - DNA, 16 bp, Homo sapiens
tatccttttctgtgtt

SEQ ID NO: 4151410 - DNA, 17 bp, Homo sapiens
tatccttttctgtgttt

SEQ ID NO: 4151411 - DNA, 15 bp, Homo sapiens
tatcgaaataacaat

SEQ ID NO: 4151412 - DNA, 18 bp, Homo sapiens
tatcgaaataacaatgtt

SEQ ID NO: 4151413 - DNA, 15 bp, Homo sapiens
tatcggaagcagtgc

SEQ ID NO: 4151414 - DNA, 16 bp, Homo sapiens
tatcggagacagtgat

SEQ ID NO: 4151415 - DNA, 14 bp, Homo sapiens
tatcgggaacagtg

SEQ ID NO: 4151416 - DNA, 16 bp, Homo sapiens
tatcgggaacagtgtt

SEQ ID NO: 4151417 - DNA, 17 bp, Homo sapiens
tatcgggaacagtgttt

SEQ ID NO: 4151418 - DNA, 17 bp, Homo sapiens
tatcgggagcagtgtct

SEQ ID NO: 4151419 - DNA, 17 bp, Homo sapiens
tatcgttattataaatg

SEQ ID NO: 4151420 - DNA, 14 bp, Homo sapiens
tatctaaaagaaat

SEQ ID NO: 4151421 - DNA, 16 bp, Homo sapiens
tatctaaatgttgaaa

SEQ ID NO: 4151422 - DNA, 20 bp, Homo sapiens
tatctaatatatatgaataa

SEQ ID NO: 4151423 - DNA, 19 bp, Homo sapiens
tatctagtgcagctgattt

SEQ ID NO: 4151424 - DNA, 23 bp, Homo sapiens
tatctagtgcagctgattttaac

SEQ ID NO: 4151425 - DNA, 18 bp, Homo sapiens
tatctatacatatcttta

SEQ ID NO: 4151426 - DNA, 20 bp, Homo sapiens
tatctatacatatctttatt

SEQ ID NO: 4151427 - DNA, 14 bp, Homo sapiens
tatctatcttccaa

SEQ ID NO: 4151428 - DNA, 17 bp, Homo sapiens
tatctattaaagtgact

SEQ ID NO: 4151429 - DNA, 19 bp, Homo sapiens
tatctattaaagtgacttt

SEQ ID NO: 4151430 - DNA, 15 bp, Homo sapiens
tatctattaatatat

SEQ ID NO: 4151431 - DNA, 12 bp, Homo sapiens
tatctcagaaag

SEQ ID NO: 4151432 - DNA, 20 bp, Homo sapiens
tatctcagaaagtgcctgac

SEQ ID NO: 4151433 - DNA, 18 bp, Homo sapiens
tatctcagtcatgcataa

SEQ ID NO: 4151434 - DNA, 23 bp, Homo sapiens
tatctcatcaacaaagaaatatt

SEQ ID NO: 4151435 - DNA, 16 bp, Homo sapiens
tatctccgttccatct

SEQ ID NO: 4151436 - DNA, 19 bp, Homo sapiens
tatctccttcccaccccta

SEQ ID NO: 4151437 - DNA, 20 bp, Homo sapiens
tatctccttcccacccctac

SEQ ID NO: 4151438 - DNA, 23 bp, Homo sapiens
tatctccttcccacccctacaca

SEQ ID NO: 4151439 - DNA, 13 bp, Homo sapiens
tatctctctgtgc

SEQ ID NO: 4151440 - DNA, 19 bp, Homo sapiens
tatctgaagagtatccttc

SEQ ID NO: 4151441 - DNA, 13 bp, Homo sapiens
tatctgaggtcac

SEQ ID NO: 4151442 - DNA, 12 bp, Homo sapiens
tatctgcactct

SEQ ID NO: 4151443 - DNA, 12 bp, Homo sapiens
tatctgcagaac

SEQ ID NO: 4151444 - DNA, 19 bp, Homo sapiens
tatctggccatatttacta

SEQ ID NO: 4151445 - DNA, 19 bp, Homo sapiens
tatctggcctaaaatcttg

SEQ ID NO: 4151446 - DNA, 23 bp, Homo sapiens
tatctgggattatggttttgtga

SEQ ID NO: 4151447 - DNA, 22 bp, Homo sapiens
tatctgtaatggtactgacttt

SEQ ID NO: 4151448 - DNA, 21 bp, Homo sapiens
tatctgtagacggctcagtat

SEQ ID NO: 4151449 - DNA, 16 bp, Homo sapiens
tatctgtcatatagta

SEQ ID NO: 4151450 - DNA, 13 bp, Homo sapiens
tatctgtggtctt

SEQ ID NO: 4151451 - DNA, 19 bp, Homo sapiens
tatcttagatgtttcacac

SEQ ID NO: 4151452 - DNA, 13 bp, Homo sapiens
tatcttcaaactt

SEQ ID NO: 4151453 - DNA, 16 bp, Homo sapiens
tatcttcaaactttca

SEQ ID NO: 4151454 - DNA, 17 bp, Homo sapiens
tatcttcaaactttcac

SEQ ID NO: 4151455 - DNA, 13 bp, Homo sapiens
tatcttccaaatg

SEQ ID NO: 4151456 - DNA, 14 bp, Homo sapiens
tatcttctgatttg

SEQ ID NO: 4151457 - DNA, 21 bp, Homo sapiens
tatcttcttcaaatacaaagt

SEQ ID NO: 4151458 - DNA, 19 bp, Homo sapiens
tatcttggggcaagactgc

SEQ ID NO: 4151459 - DNA, 22 bp, Homo sapiens
tatcttggggcaagactgcaaa

SEQ ID NO: 4151460 - DNA, 14 bp, Homo sapiens
tatcttgtgaagtt

SEQ ID NO: 4151461 - DNA, 14 bp, Homo sapiens
tatctttattaatc

SEQ ID NO: 4151462 - DNA, 16 bp, Homo sapiens
tatcttttatgtttga

SEQ ID NO: 4151463 - DNA, 17 bp, Homo sapiens
tatcttttatgtttgaa

SEQ ID NO: 4151464 - DNA, 19 bp, Homo sapiens
tatcttttatgtttgaata

SEQ ID NO: 4151465 - DNA, 12 bp, Homo sapiens
tatcttttcata

SEQ ID NO: 4151466 - DNA, 15 bp, Homo sapiens
tatcttttttcaaaa

SEQ ID NO: 4151467 - DNA, 16 bp, Homo sapiens
tatgaaaactatacaa

SEQ ID NO: 4151468 - DNA, 13 bp, Homo sapiens
tatgaaaacttat

SEQ ID NO: 4151469 - DNA, 19 bp, Homo sapiens
tatgaagaattgccaatct

SEQ ID NO: 4151470 - DNA, 24 bp, Homo sapiens
tatgaagaattgccaatcttgttt

SEQ ID NO: 4151471 - DNA, 17 bp, Homo sapiens
tatgaagagtattaatg

SEQ ID NO: 4151472 - DNA, 21 bp, Homo sapiens
tatgaagtttaaaacagtatt

SEQ ID NO: 4151473 - DNA, 17 bp, Homo sapiens
tatgaataaagaatgcc

SEQ ID NO: 4151474 - DNA, 18 bp, Homo sapiens
tatgaataaagacaccta

SEQ ID NO: 4151475 - DNA, 12 bp, Homo sapiens
tatgaataaagt

SEQ ID NO: 4151476 - DNA, 16 bp, Homo sapiens
tatgaatacagggcat

SEQ ID NO: 4151477 - DNA, 23 bp, Homo sapiens
tatgaatctgctcactttaaacc

SEQ ID NO: 4151478 - DNA, 23 bp, Homo sapiens
tatgaatgtactgcatgttacca

SEQ ID NO: 4151479 - DNA, 13 bp, Homo sapiens
tatgaattgtaca

SEQ ID NO: 4151480 - DNA, 22 bp, Homo sapiens
tatgaattgtacagaatatttc

SEQ ID NO: 4151481 - DNA, 15 bp, Homo sapiens
tatgaatttaaatat

SEQ ID NO: 4151482 - DNA, 21 bp, Homo sapiens
tatgaatttaaatataattct

SEQ ID NO: 4151483 - DNA, 16 bp, Homo sapiens
tatgaccagaagcctt

SEQ ID NO: 4151484 - DNA, 23 bp, Homo sapiens
tatgacgcggctcaaaaggaaac

SEQ ID NO: 4151485 - DNA, 19 bp, Homo sapiens
tatgacggaagaacataga

SEQ ID NO: 4151486 - DNA, 14 bp, Homo sapiens
tatgactaaagaga

SEQ ID NO: 4151487 - DNA, 17 bp, Homo sapiens
tatgactatgtaaacta

SEQ ID NO: 4151488 - DNA, 18 bp, Homo sapiens
tatgactatgtaaactac

SEQ ID NO: 4151489 - DNA, 22 bp, Homo sapiens
tatgagacagggtcttgctctg

SEQ ID NO: 4151490 - DNA, 23 bp, Homo sapiens
tatgagacagggtcttgctctgt

SEQ ID NO: 4151491 - DNA, 15 bp, Homo sapiens
tatgagaggcaatga

SEQ ID NO: 4151492 - DNA, 21 bp, Homo sapiens
tatgagccgtgaactgtgcat

SEQ ID NO: 4151493 - DNA, 13 bp, Homo sapiens
tatgagctgaggg

SEQ ID NO: 4151494 - DNA, 21 bp, Homo sapiens
tatgagcttccttctgtgaaa

SEQ ID NO: 4151495 - DNA, 14 bp, Homo sapiens
tatgaggaggggag

SEQ ID NO: 4151496 - DNA, 16 bp, Homo sapiens
tatgagtacaaatgcc

SEQ ID NO: 4151497 - DNA, 17 bp, Homo sapiens
tatgagtacaaatgcct

SEQ ID NO: 4151498 - DNA, 15 bp, Homo sapiens
tatgagttactgaag

SEQ ID NO: 4151499 - DNA, 21 bp, Homo sapiens
tatgagtttttgatagcttta

SEQ ID NO: 4151500 - DNA, 15 bp, Homo sapiens
tatgatctgttttgt

SEQ ID NO: 4151501 - DNA, 16 bp, Homo sapiens
tatgatggttttaaac

SEQ ID NO: 4151502 - DNA, 17 bp, Homo sapiens
tatgatgtaatctctct

SEQ ID NO: 4151503 - DNA, 22 bp, Homo sapiens
tatgatgtaatctctctgcagc

SEQ ID NO: 4151504 - DNA, 21 bp, Homo sapiens
tatgattcagattgttatcta

SEQ ID NO: 4151505 - DNA, 21 bp, Homo sapiens
tatgatttcactagaaaagct

SEQ ID NO: 4151506 - DNA, 22 bp, Homo sapiens
tatgatttcactagaaaagctg

SEQ ID NO: 4151507 - DNA, 19 bp, Homo sapiens
tatgatttgttttgaattt

SEQ ID NO: 4151508 - DNA, 22 bp, Homo sapiens
tatgatttgttttgaattttgt

SEQ ID NO: 4151509 - DNA, 13 bp, Homo sapiens
tatgcaaaatgga

SEQ ID NO: 4151510 - DNA, 20 bp, Homo sapiens
tatgcagcatggggttttta

SEQ ID NO: 4151511 - DNA, 22 bp, Homo sapiens
tatgcatggtgccccaggacca

SEQ ID NO: 4151512 - DNA, 20 bp, Homo sapiens
tatgccacttccttttaact

SEQ ID NO: 4151513 - DNA, 20 bp, Homo sapiens
tatgccccttcttgggcccc

SEQ ID NO: 4151514 - DNA, 14 bp, Homo sapiens
tatgctatttctgt

SEQ ID NO: 4151515 - DNA, 14 bp, Homo sapiens
tatgctctgcatgt

SEQ ID NO: 4151516 - DNA, 19 bp, Homo sapiens
tatgctctgcatgttacat

SEQ ID NO: 4151517 - DNA, 22 bp, Homo sapiens
tatgctgatcatcgccagaggt

SEQ ID NO: 4151518 - DNA, 22 bp, Homo sapiens
tatgctgccaaattttggccaa

SEQ ID NO: 4151519 - DNA, 22 bp, Homo sapiens
tatgctggccagcaccctctcc

SEQ ID NO: 4151520 - DNA, 22 bp, Homo sapiens
tatgcttatacacttacacttt

SEQ ID NO: 4151521 - DNA, 14 bp, Homo sapiens
tatgcttccagaaa

SEQ ID NO: 4151522 - DNA, 18 bp, Homo sapiens
tatggaattgatttgcat

SEQ ID NO: 4151523 - DNA, 16 bp, Homo sapiens
tatggacaacttattt

SEQ ID NO: 4151524 - DNA, 13 bp, Homo sapiens
tatggcagaagac

SEQ ID NO: 4151525 - DNA, 15 bp, Homo sapiens
tatggcagaagacac

SEQ ID NO: 4151526 - DNA, 23 bp, Homo sapiens
tatggcagaagggaattgctcag

SEQ ID NO: 4151527 - DNA, 23 bp, Homo sapiens
tatggcccagaaacaacagggga

SEQ ID NO: 4151528 - DNA, 12 bp, Homo sapiens
tatggcctcagc

SEQ ID NO: 4151529 - DNA, 14 bp, Homo sapiens
tatggctgcccagg

SEQ ID NO: 4151530 - DNA, 15 bp, Homo sapiens
tatgggggcatctct

SEQ ID NO: 4151531 - DNA, 22 bp, Homo sapiens
tatggtatgctggccagcaccc

SEQ ID NO: 4151532 - DNA, 23 bp, Homo sapiens
tatggtatgctggccagcaccct

SEQ ID NO: 4151533 - DNA, 22 bp, Homo sapiens
tatggtcaacacttaagggttt

SEQ ID NO: 4151534 - DNA, 16 bp, Homo sapiens
tatggtccagaaactc

SEQ ID NO: 4151535 - DNA, 19 bp, Homo sapiens
tatggtgcagagaagctgg

SEQ ID NO: 4151536 - DNA, 21 bp, Homo sapiens
tatggttcccaataaaagtga

SEQ ID NO: 4151537 - DNA, 22 bp, Homo sapiens
tatgtaccatatgatctgtttt

SEQ ID NO: 4151538 - DNA, 23 bp, Homo sapiens
tatgtaggtaaaagtagaagcat

SEQ ID NO: 4151539 - DNA, 21 bp, Homo sapiens
tatgtatatcattctacagaa

SEQ ID NO: 4151540 - DNA, 22 bp, Homo sapiens
tatgtatatgacatttaaatgt

SEQ ID NO: 4151541 - DNA, 16 bp, Homo sapiens
tatgtatgtttacata

SEQ ID NO: 4151542 - DNA, 17 bp, Homo sapiens
tatgtatgtttacatat

SEQ ID NO: 4151543 - DNA, 21 bp, Homo sapiens
tatgtattatttataattcct

SEQ ID NO: 4151544 - DNA, 14 bp, Homo sapiens
tatgtctgccatgt

SEQ ID NO: 4151545 - DNA, 16 bp, Homo sapiens
tatgtctgtttaagaa

SEQ ID NO: 4151546 - DNA, 18 bp, Homo sapiens
tatgtctgtttaagaaaa

SEQ ID NO: 4151547 - DNA, 17 bp, Homo sapiens
tatgtcttttatatttg

SEQ ID NO: 4151548 - DNA, 18 bp, Homo sapiens
tatgtgaatttttaagct

SEQ ID NO: 4151549 - DNA, 14 bp, Homo sapiens
tatgtgacattaac

SEQ ID NO: 4151550 - DNA, 19 bp, Homo sapiens
tatgtgacatttctcttcc

SEQ ID NO: 4151551 - DNA, 21 bp, Homo sapiens
tatgtgagattttttattgct

SEQ ID NO: 4151552 - DNA, 19 bp, Homo sapiens
tatgtgattttcctttgta

SEQ ID NO: 4151553 - DNA, 20 bp, Homo sapiens
tatgtgcactgtcactttgc

SEQ ID NO: 4151554 - DNA, 17 bp, Homo sapiens
tatgtgccagttcctgt

SEQ ID NO: 4151555 - DNA, 16 bp, Homo sapiens
tatgtgtccatttcct

SEQ ID NO: 4151556 - DNA, 22 bp, Homo sapiens
tatgtgtccatttccttatgct

SEQ ID NO: 4151557 - DNA, 15 bp, Homo sapiens
tatgtgtctgctaat

SEQ ID NO: 4151558 - DNA, 18 bp, Homo sapiens
tatgtgtctgctaatgta

SEQ ID NO: 4151559 - DNA, 22 bp, Homo sapiens
tatgttaaatactgtgcagaat

SEQ ID NO: 4151560 - DNA, 20 bp, Homo sapiens
tatgttaacctcagtgtcat

SEQ ID NO: 4151561 - DNA, 19 bp, Homo sapiens
tatgttacatctgttttaa

SEQ ID NO: 4151562 - DNA, 22 bp, Homo sapiens
tatgttacatctgttttaaatt

SEQ ID NO: 4151563 - DNA, 15 bp, Homo sapiens
tatgttatgaacatg

SEQ ID NO: 4151564 - DNA, 13 bp, Homo sapiens
tatgttcatttgt

SEQ ID NO: 4151565 - DNA, 17 bp, Homo sapiens
tatgttcatttgtttgt

SEQ ID NO: 4151566 - DNA, 22 bp, Homo sapiens
tatgttcttagtggatgttctg

SEQ ID NO: 4151567 - DNA, 20 bp, Homo sapiens
tatgttgctcagtctccctt

SEQ ID NO: 4151568 - DNA, 20 bp, Homo sapiens
tatgttggtactttccacaa

SEQ ID NO: 4151569 - DNA, 13 bp, Homo sapiens
tatgtttaaaata

SEQ ID NO: 4151570 - DNA, 23 bp, Homo sapiens
tatgtttaaagtaattgttccag

SEQ ID NO: 4151571 - DNA, 18 bp, Homo sapiens
tatgtttatttactaatt

SEQ ID NO: 4151572 - DNA, 14 bp, Homo sapiens
tatgtttgaatatg

SEQ ID NO: 4151573 - DNA, 20 bp, Homo sapiens
tatgtttgtcttttaatgct

SEQ ID NO: 4151574 - DNA, 20 bp, Homo sapiens
tatgtttttatttatgaata

SEQ ID NO: 4151575 - DNA, 17 bp, Homo sapiens
tatgttttttagatcaa

SEQ ID NO: 4151576 - DNA, 19 bp, Homo sapiens
tatgttttttagatcaaat

SEQ ID NO: 4151577 - DNA, 22 bp, Homo sapiens
tattaaaacacattatgtatct

SEQ ID NO: 4151578 - DNA, 21 bp, Homo sapiens
tattaaacagatttttacaaa

SEQ ID NO: 4151579 - DNA, 12 bp, Homo sapiens
tattaaagacag

SEQ ID NO: 4151580 - DNA, 13 bp, Homo sapiens
tattaaagggggg

SEQ ID NO: 4151581 - DNA, 14 bp, Homo sapiens
tattaaagtgactt

SEQ ID NO: 4151582 - DNA, 14 bp, Homo sapiens
tattaaataaaatc

SEQ ID NO: 4151583 - DNA, 21 bp, Homo sapiens
tattaaatacagacactaagt

SEQ ID NO: 4151584 - DNA, 12 bp, Homo sapiens
tattaaatagtt

SEQ ID NO: 4151585 - DNA, 22 bp, Homo sapiens
tattaaatttgttgacaaaatt

SEQ ID NO: 4151586 - DNA, 12 bp, Homo sapiens
tattaactacat

SEQ ID NO: 4151587 - DNA, 18 bp, Homo sapiens
tattaactacatttatga

SEQ ID NO: 4151588 - DNA, 24 bp, Homo sapiens
tattaagaaagactatctaaatgt

SEQ ID NO: 4151589 - DNA, 15 bp, Homo sapiens
tattaagatggattc

SEQ ID NO: 4151590 - DNA, 14 bp, Homo sapiens
tattaagcagtaaa

SEQ ID NO: 4151591 - DNA, 17 bp, Homo sapiens
tattaatactacccata

SEQ ID NO: 4151592 - DNA, 15 bp, Homo sapiens
tattaatgcgatttc

SEQ ID NO: 4151593 - DNA, 19 bp, Homo sapiens
tattaatgcgatttcttcc

SEQ ID NO: 4151594 - DNA, 17 bp, Homo sapiens
tattaattcttcacctg

SEQ ID NO: 4151595 - DNA, 21 bp, Homo sapiens
tattaattgttttgcactttt

SEQ ID NO: 4151596 - DNA, 12 bp, Homo sapiens
tattaatttgaa

SEQ ID NO: 4151597 - DNA, 16 bp, Homo sapiens
tattaatttgaaacca

SEQ ID NO: 4151598 - DNA, 21 bp, Homo sapiens
tattacaataccgttaagata

SEQ ID NO: 4151599 - DNA, 16 bp, Homo sapiens
tattacatggcagtgt

SEQ ID NO: 4151600 - DNA, 14 bp, Homo sapiens
tattacctctgata

SEQ ID NO: 4151601 - DNA, 20 bp, Homo sapiens
tattactgttgcatttactt

SEQ ID NO: 4151602 - DNA, 23 bp, Homo sapiens
tattagaaattagaaaaaaatta

SEQ ID NO: 4151603 - DNA, 15 bp, Homo sapiens
tattagatgcactta

SEQ ID NO: 4151604 - DNA, 21 bp, Homo sapiens
tattagccaggtaatgtgaat

SEQ ID NO: 4151605 - DNA, 15 bp, Homo sapiens
tattaggttgtcacg

SEQ ID NO: 4151606 - DNA, 14 bp, Homo sapiens
tattagtaccatag

SEQ ID NO: 4151607 - DNA, 16 bp, Homo sapiens
tattagtgctttgcca

SEQ ID NO: 4151608 - DNA, 14 bp, Homo sapiens
tattataaactgta

SEQ ID NO: 4151609 - DNA, 19 bp, Homo sapiens
tattataacaagtgtgtct

SEQ ID NO: 4151610 - DNA, 13 bp, Homo sapiens
tattataagcatt

SEQ ID NO: 4151611 - DNA, 18 bp, Homo sapiens
tattatactaagaaaaga

SEQ ID NO: 4151612 - DNA, 20 bp, Homo sapiens
tattataggtaatcaatgaa

SEQ ID NO: 4151613 - DNA, 13 bp, Homo sapiens
tattatctgtgtt

SEQ ID NO: 4151614 - DNA, 17 bp, Homo sapiens
tattatgaaatttcact

SEQ ID NO: 4151615 - DNA, 12 bp, Homo sapiens
tattatgtgttt

SEQ ID NO: 4151616 - DNA, 18 bp, Homo sapiens
tattattagaaattagaa

SEQ ID NO: 4151617 - DNA, 15 bp, Homo sapiens
tattattatctttaa

SEQ ID NO: 4151618 - DNA, 22 bp, Homo sapiens
tattattctgttttgcacagtt

SEQ ID NO: 4151619 - DNA, 22 bp, Homo sapiens
tattatttaccgttgcttgaaa

SEQ ID NO: 4151620 - DNA, 16 bp, Homo sapiens
tattattttcacctgt

SEQ ID NO: 4151621 - DNA, 15 bp, Homo sapiens
tattatttttaccta

SEQ ID NO: 4151622 - DNA, 19 bp, Homo sapiens
tattatttttatactgaat

SEQ ID NO: 4151623 - DNA, 18 bp, Homo sapiens
tattcaattcctctggga

SEQ ID NO: 4151624 - DNA, 16 bp, Homo sapiens
tattcaattcttttaa

SEQ ID NO: 4151625 - DNA, 14 bp, Homo sapiens
tattcagacaagca

SEQ ID NO: 4151626 - DNA, 18 bp, Homo sapiens
tattcagacaagcaacag

SEQ ID NO: 4151627 - DNA, 15 bp, Homo sapiens
tattcagtaaacaac

SEQ ID NO: 4151628 - DNA, 19 bp, Homo sapiens
tattcagtgaaaagatttt

SEQ ID NO: 4151629 - DNA, 14 bp, Homo sapiens
tattcatccagagt

SEQ ID NO: 4151630 - DNA, 17 bp, Homo sapiens
tattcatccagcagtgt

SEQ ID NO: 4151631 - DNA, 14 bp, Homo sapiens
tattcatttaaaat

SEQ ID NO: 4151632 - DNA, 16 bp, Homo sapiens
tattcatttaaaatga

SEQ ID NO: 4151633 - DNA, 19 bp, Homo sapiens
tattcatttaaaatgatta

SEQ ID NO: 4151634 - DNA, 15 bp, Homo sapiens
tattccatatttatt

SEQ ID NO: 4151635 - DNA, 17 bp, Homo sapiens
tattccatatttattca

SEQ ID NO: 4151636 - DNA, 12 bp, Homo sapiens
tattccatcaat

SEQ ID NO: 4151637 - DNA, 22 bp, Homo sapiens
tattccatgaatgtatcaggaa

SEQ ID NO: 4151638 - DNA, 13 bp, Homo sapiens
tattcccaagccg

SEQ ID NO: 4151639 - DNA, 18 bp, Homo sapiens
tattccctttgacttcag

SEQ ID NO: 4151640 - DNA, 20 bp, Homo sapiens
tattccctttgacttcagct

SEQ ID NO: 4151641 - DNA, 16 bp, Homo sapiens
tattcctccaaatctc

SEQ ID NO: 4151642 - DNA, 23 bp, Homo sapiens
tattcctccaaatctcttgcttg

SEQ ID NO: 4151643 - DNA, 22 bp, Homo sapiens
tattcctttatacacagtggat

SEQ ID NO: 4151644 - DNA, 15 bp, Homo sapiens
tattccttttctgta

SEQ ID NO: 4151645 - DNA, 19 bp, Homo sapiens
tattccttttgtgtacagt

SEQ ID NO: 4151646 - DNA, 20 bp, Homo sapiens
tattccttttgtgtacagtg

SEQ ID NO: 4151647 - DNA, 13 bp, Homo sapiens
tattcgccatctg

SEQ ID NO: 4151648 - DNA, 21 bp, Homo sapiens
tattctaagccagttttcatt

SEQ ID NO: 4151649 - DNA, 19 bp, Homo sapiens
tattctagctaatgtaata

SEQ ID NO: 4151650 - DNA, 19 bp, Homo sapiens
tattctattaactttaatt

SEQ ID NO: 4151651 - DNA, 15 bp, Homo sapiens
tattctcagagcatg

SEQ ID NO: 4151652 - DNA, 17 bp, Homo sapiens
tattctctgcaatttgt

SEQ ID NO: 4151653 - DNA, 18 bp, Homo sapiens
tattctcttttatctgtt

SEQ ID NO: 4151654 - DNA, 12 bp, Homo sapiens
tattctggagtt

SEQ ID NO: 4151655 - DNA, 20 bp, Homo sapiens
tattctgggctcctggaacc

SEQ ID NO: 4151656 - DNA, 22 bp, Homo sapiens
tattctgtcagtgttaaagatt

SEQ ID NO: 4151657 - DNA, 15 bp, Homo sapiens
tattcttatttaatg

SEQ ID NO: 4151658 - DNA, 13 bp, Homo sapiens
tattcttgtgctt

SEQ ID NO: 4151659 - DNA, 19 bp, Homo sapiens
tattgaacttttgtactga

SEQ ID NO: 4151660 - DNA, 20 bp, Homo sapiens
tattgaagacaatttgatac

SEQ ID NO: 4151661 - DNA, 20 bp, Homo sapiens
tattgaaggaagccaaattt

SEQ ID NO: 4151662 - DNA, 16 bp, Homo sapiens
tattgaagtttcagct

SEQ ID NO: 4151663 - DNA, 16 bp, Homo sapiens
tattgacacagaaaat

SEQ ID NO: 4151664 - DNA, 11 bp, Homo sapiens
tattgacactg

SEQ ID NO: 4151665 - DNA, 14 bp, Homo sapiens
tattgacatttgta

SEQ ID NO: 4151666 - DNA, 15 bp, Homo sapiens
tattgacatttgtag

SEQ ID NO: 4151667 - DNA, 17 bp, Homo sapiens
tattgacatttgtagtt

SEQ ID NO: 4151668 - DNA, 22 bp, Homo sapiens
tattgactgtaccacagacaca

SEQ ID NO: 4151669 - DNA, 15 bp, Homo sapiens
tattgacttgtatat

SEQ ID NO: 4151670 - DNA, 15 bp, Homo sapiens
tattgagatttctta

SEQ ID NO: 4151671 - DNA, 23 bp, Homo sapiens
tattgaggctttgtgttgtaatt

SEQ ID NO: 4151672 - DNA, 14 bp, Homo sapiens
tattgagtcaaatg

SEQ ID NO: 4151673 - DNA, 13 bp, Homo sapiens
tattgatgaaaag

SEQ ID NO: 4151674 - DNA, 17 bp, Homo sapiens
tattgatgaaaagattt

SEQ ID NO: 4151675 - DNA, 18 bp, Homo sapiens
tattgatgaaaagattta

SEQ ID NO: 4151676 - DNA, 13 bp, Homo sapiens
tattgcatttata

SEQ ID NO: 4151677 - DNA, 17 bp, Homo sapiens
tattgctagtatttgaa

SEQ ID NO: 4151678 - DNA, 16 bp, Homo sapiens
tattgctgagagaaat

SEQ ID NO: 4151679 - DNA, 15 bp, Homo sapiens
tattggaacttgcga

SEQ ID NO: 4151680 - DNA, 23 bp, Homo sapiens
tattggaattaacctggtgctgg

SEQ ID NO: 4151681 - DNA, 16 bp, Homo sapiens
tattggagcacatgtt

SEQ ID NO: 4151682 - DNA, 21 bp, Homo sapiens
tattggctttttcagagtcat

SEQ ID NO: 4151683 - DNA, 16 bp, Homo sapiens
tattggggtctgaccc

SEQ ID NO: 4151684 - DNA, 18 bp, Homo sapiens
tattggtggttctcagca

SEQ ID NO: 4151685 - DNA, 20 bp, Homo sapiens
tattgtaagttgtacaaatg

SEQ ID NO: 4151686 - DNA, 22 bp, Homo sapiens
tattgtaagttgtacaaatgta

SEQ ID NO: 4151687 - DNA, 11 bp, Homo sapiens
tattgtacata

SEQ ID NO: 4151688 - DNA, 15 bp, Homo sapiens
tattgtacataaaag

SEQ ID NO: 4151689 - DNA, 22 bp, Homo sapiens
tattgtacataaaagaattttt

SEQ ID NO: 4151690 - DNA, 17 bp, Homo sapiens
tattgtattatttggag

SEQ ID NO: 4151691 - DNA, 15 bp, Homo sapiens
tattgtatttatgtg

SEQ ID NO: 4151692 - DNA, 21 bp, Homo sapiens
tattgtcatggggatcaattt

SEQ ID NO: 4151693 - DNA, 17 bp, Homo sapiens
tattgtcattaaaggta

SEQ ID NO: 4151694 - DNA, 21 bp, Homo sapiens
tattgtccctggcttccttac

SEQ ID NO: 4151695 - DNA, 22 bp, Homo sapiens
tattgtccctggcttccttact

SEQ ID NO: 4151696 - DNA, 23 bp, Homo sapiens
tattgtctgaacttgcattgtga

SEQ ID NO: 4151697 - DNA, 15 bp, Homo sapiens
tattgtgaagtacat

SEQ ID NO: 4151698 - DNA, 14 bp, Homo sapiens
tattgtgttgtgaa

SEQ ID NO: 4151699 - DNA, 21 bp, Homo sapiens
tattgttaactcttgtctatt

SEQ ID NO: 4151700 - DNA, 15 bp, Homo sapiens
tattgttactctggt

SEQ ID NO: 4151701 - DNA, 20 bp, Homo sapiens
tattgttcaaacaatatcat

SEQ ID NO: 4151702 - DNA, 23 bp, Homo sapiens
tattgttccagcagttttcaagt

SEQ ID NO: 4151703 - DNA, 13 bp, Homo sapiens
tattgttcccagt

SEQ ID NO: 4151704 - DNA, 21 bp, Homo sapiens
tattgttgaacatacttcaaa

SEQ ID NO: 4151705 - DNA, 16 bp, Homo sapiens
tattgtttaaaattca

SEQ ID NO: 4151706 - DNA, 13 bp, Homo sapiens
tattgtttatgta

SEQ ID NO: 4151707 - DNA, 12 bp, Homo sapiens
tattgtttctgc

SEQ ID NO: 4151708 - DNA, 13 bp, Homo sapiens
tattgtttctgca

SEQ ID NO: 4151709 - DNA, 15 bp, Homo sapiens
tattgttttctgtaa

SEQ ID NO: 4151710 - DNA, 19 bp, Homo sapiens
tatttaaaaacaaaaggca

SEQ ID NO: 4151711 - DNA, 21 bp, Homo sapiens
tatttaaaaatatttcagata

SEQ ID NO: 4151712 - DNA, 18 bp, Homo sapiens
tatttaaaaatatttttg

SEQ ID NO: 4151713 - DNA, 12 bp, Homo sapiens
tatttaaaactt

SEQ ID NO: 4151714 - DNA, 22 bp, Homo sapiens
tatttaaaattccattatctta

SEQ ID NO: 4151715 - DNA, 14 bp, Homo sapiens
tatttaaacatggt

SEQ ID NO: 4151716 - DNA, 15 bp, Homo sapiens
tatttaaaccttttt

SEQ ID NO: 4151717 - DNA, 21 bp, Homo sapiens
tatttaaacctttttcttgat

SEQ ID NO: 4151718 - DNA, 12 bp, Homo sapiens
tatttaaactat

SEQ ID NO: 4151719 - DNA, 16 bp, Homo sapiens
tatttaaacttataaa

SEQ ID NO: 4151720 - DNA, 20 bp, Homo sapiens
tatttaaacttataaatcat

SEQ ID NO: 4151721 - DNA, 14 bp, Homo sapiens
tatttaaagacagg

SEQ ID NO: 4151722 - DNA, 15 bp, Homo sapiens
tatttaacagctgaa

SEQ ID NO: 4151723 - DNA, 16 bp, Homo sapiens
tatttaagaaaagcac

SEQ ID NO: 4151724 - DNA, 17 bp, Homo sapiens
tatttaagaaaagcact

SEQ ID NO: 4151725 - DNA, 20 bp, Homo sapiens
tatttaagaaaagcactttt

SEQ ID NO: 4151726 - DNA, 22 bp, Homo sapiens
tatttaagaaaatacaataaac

SEQ ID NO: 4151727 - DNA, 15 bp, Homo sapiens
tatttaagttatcaa

SEQ ID NO: 4151728 - DNA, 19 bp, Homo sapiens
tatttaagttatcaacttt

SEQ ID NO: 4151729 - DNA, 14 bp, Homo sapiens
tatttaataacatt

SEQ ID NO: 4151730 - DNA, 15 bp, Homo sapiens
tatttaatgaaagac

SEQ ID NO: 4151731 - DNA, 17 bp, Homo sapiens
tatttaatggaagtgta

SEQ ID NO: 4151732 - DNA, 20 bp, Homo sapiens
tatttaatggaagtgtattt

SEQ ID NO: 4151733 - DNA, 23 bp, Homo sapiens
tatttaattattaactacattta

SEQ ID NO: 4151734 - DNA, 15 bp, Homo sapiens
tatttacaaataaaa

SEQ ID NO: 4151735 - DNA, 21 bp, Homo sapiens
tatttacatgaattgcatttt

SEQ ID NO: 4151736 - DNA, 16 bp, Homo sapiens
tatttacattctagtt

SEQ ID NO: 4151737 - DNA, 19 bp, Homo sapiens
tatttaccgttgcttgaaa

SEQ ID NO: 4151738 - DNA, 17 bp, Homo sapiens
tatttacctgcaggctg

SEQ ID NO: 4151739 - DNA, 15 bp, Homo sapiens
tatttacgctttgat

SEQ ID NO: 4151740 - DNA, 21 bp, Homo sapiens
tatttactgagcttctctgtg

SEQ ID NO: 4151741 - DNA, 18 bp, Homo sapiens
tatttacttctaatctta

SEQ ID NO: 4151742 - DNA, 23 bp, Homo sapiens
tatttacttttaccactatttaa

SEQ ID NO: 4151743 - DNA, 22 bp, Homo sapiens
tatttactttttcggtttcaaa

SEQ ID NO: 4151744 - DNA, 21 bp, Homo sapiens
tatttagatgataaagagaca

SEQ ID NO: 4151745 - DNA, 17 bp, Homo sapiens
tatttaggcagattgaa

SEQ ID NO: 4151746 - DNA, 19 bp, Homo sapiens
tatttagtgttagttataa

SEQ ID NO: 4151747 - DNA, 22 bp, Homo sapiens
tatttagttgtaaaccaagtga

SEQ ID NO: 4151748 - DNA, 14 bp, Homo sapiens
tatttataaaactt

SEQ ID NO: 4151749 - DNA, 17 bp, Homo sapiens
tatttataaatatattt

SEQ ID NO: 4151750 - DNA, 19 bp, Homo sapiens
tatttataacaacctaaat

SEQ ID NO: 4151751 - DNA, 20 bp, Homo sapiens
tatttataacaacctaaatt

SEQ ID NO: 4151752 - DNA, 13 bp, Homo sapiens
tatttataactca

SEQ ID NO: 4151753 - DNA, 21 bp, Homo sapiens
tatttataactcatcataaaa

SEQ ID NO: 4151754 - DNA, 19 bp, Homo sapiens
tatttatacaagattgaaa

SEQ ID NO: 4151755 - DNA, 18 bp, Homo sapiens
tatttatagcaatccatg

SEQ ID NO: 4151756 - DNA, 16 bp, Homo sapiens
tatttatatatgtatt

SEQ ID NO: 4151757 - DNA, 13 bp, Homo sapiens
tatttatatattt

SEQ ID NO: 4151758 - DNA, 17 bp, Homo sapiens
tatttatatatttataa

SEQ ID NO: 4151759 - DNA, 17 bp, Homo sapiens
tatttatatgtacatga

SEQ ID NO: 4151760 - DNA, 13 bp, Homo sapiens
tatttatcagtga

SEQ ID NO: 4151761 - DNA, 20 bp, Homo sapiens
tatttatccaaaatgtgtat

SEQ ID NO: 4151762 - DNA, 16 bp, Homo sapiens
tatttatctctattta

SEQ ID NO: 4151763 - DNA, 17 bp, Homo sapiens
tatttatctctatttaa

SEQ ID NO: 4151764 - DNA, 16 bp, Homo sapiens
tatttatctgattaag

SEQ ID NO: 4151765 - DNA, 22 bp, Homo sapiens
tatttatctgtgtttttgaaat

SEQ ID NO: 4151766 - DNA, 14 bp, Homo sapiens
tatttatgaagttt

SEQ ID NO: 4151767 - DNA, 15 bp, Homo sapiens
tatttatgaagttta

SEQ ID NO: 4151768 - DNA, 16 bp, Homo sapiens
tatttatgaagtttaa

SEQ ID NO: 4151769 - DNA, 20 bp, Homo sapiens
tatttatgcctctgtattta

SEQ ID NO: 4151770 - DNA, 14 bp, Homo sapiens
tatttatgtgtgag

SEQ ID NO: 4151771 - DNA, 15 bp, Homo sapiens
tatttatgttaaaag

SEQ ID NO: 4151772 - DNA, 23 bp, Homo sapiens
tatttattaaacagatttttaca

SEQ ID NO: 4151773 - DNA, 13 bp, Homo sapiens
tatttattaaata

SEQ ID NO: 4151774 - DNA, 18 bp, Homo sapiens
tatttattaatatttaac

SEQ ID NO: 4151775 - DNA, 14 bp, Homo sapiens
tatttattaatttg

SEQ ID NO: 4151776 - DNA, 16 bp, Homo sapiens
tatttattaatttgaa

SEQ ID NO: 4151777 - DNA, 16 bp, Homo sapiens
tatttattacctctga

SEQ ID NO: 4151778 - DNA, 14 bp, Homo sapiens
tatttattatttat

SEQ ID NO: 4151779 - DNA, 23 bp, Homo sapiens
tatttattgagtacctactgtgt

SEQ ID NO: 4151780 - DNA, 15 bp, Homo sapiens
tatttattgttagaa

SEQ ID NO: 4151781 - DNA, 22 bp, Homo sapiens
tatttattgtttatttatcagt

SEQ ID NO: 4151782 - DNA, 13 bp, Homo sapiens
tatttatttaaat

SEQ ID NO: 4151783 - DNA, 14 bp, Homo sapiens
tatttatttaaatt

SEQ ID NO: 4151784 - DNA, 15 bp, Homo sapiens
tatttattttgtaat

SEQ ID NO: 4151785 - DNA, 20 bp, Homo sapiens
tatttcaaaatatacattca

SEQ ID NO: 4151786 - DNA, 16 bp, Homo sapiens
tatttcactatcttct

SEQ ID NO: 4151787 - DNA, 18 bp, Homo sapiens
tatttcagatatcaaaat

SEQ ID NO: 4151788 - DNA, 22 bp, Homo sapiens
tatttcagatatcaaaattcta

SEQ ID NO: 4151789 - DNA, 22 bp, Homo sapiens
tatttcagttattgtccctggc

SEQ ID NO: 4151790 - DNA, 12 bp, Homo sapiens
tatttcattgcc

SEQ ID NO: 4151791 - DNA, 14 bp, Homo sapiens
tatttccactaaaa

SEQ ID NO: 4151792 - DNA, 17 bp, Homo sapiens
tatttccactaaaaata

SEQ ID NO: 4151793 - DNA, 19 bp, Homo sapiens
tatttccactaaaaatatt

SEQ ID NO: 4151794 - DNA, 21 bp, Homo sapiens
tatttccattccagaatatct

SEQ ID NO: 4151795 - DNA, 21 bp, Homo sapiens
tatttccccaggggaaaatga

SEQ ID NO: 4151796 - DNA, 22 bp, Homo sapiens
tatttccccaggggaaaatgaa

SEQ ID NO: 4151797 - DNA, 23 bp, Homo sapiens
tatttccccaggtgtgtgcttta

SEQ ID NO: 4151798 - DNA, 15 bp, Homo sapiens
tatttccccctttct

SEQ ID NO: 4151799 - DNA, 22 bp, Homo sapiens
tatttccctcacctttcccatc

SEQ ID NO: 4151800 - DNA, 19 bp, Homo sapiens
tatttccttaaactgtgtg

SEQ ID NO: 4151801 - DNA, 15 bp, Homo sapiens
tatttctaactatat

SEQ ID NO: 4151802 - DNA, 13 bp, Homo sapiens
tatttctagaagc

SEQ ID NO: 4151803 - DNA, 20 bp, Homo sapiens
tatttctagacactttttct

SEQ ID NO: 4151804 - DNA, 11 bp, Homo sapiens
tatttctattg

SEQ ID NO: 4151805 - DNA, 13 bp, Homo sapiens
tatttctcaggaa

SEQ ID NO: 4151806 - DNA, 19 bp, Homo sapiens
tatttctctgatttgcaaa

SEQ ID NO: 4151807 - DNA, 22 bp, Homo sapiens
tatttctgggtcttttgctact

SEQ ID NO: 4151808 - DNA, 16 bp, Homo sapiens
tatttctgtttctcat

SEQ ID NO: 4151809 - DNA, 22 bp, Homo sapiens
tatttcttcaaatccttccaaa

SEQ ID NO: 4151810 - DNA, 22 bp, Homo sapiens
tatttcttcctaccaagtcaaa

SEQ ID NO: 4151811 - DNA, 14 bp, Homo sapiens
tatttcttgctttc

SEQ ID NO: 4151812 - DNA, 23 bp, Homo sapiens
tatttgaaaaaaacttcattctc

SEQ ID NO: 4151813 - DNA, 15 bp, Homo sapiens
tatttgaaatactaa

SEQ ID NO: 4151814 - DNA, 16 bp, Homo sapiens
tatttgaaatactaaa

SEQ ID NO: 4151815 - DNA, 20 bp, Homo sapiens
tatttgaaatactaaaagca

SEQ ID NO: 4151816 - DNA, 17 bp, Homo sapiens
tatttgaattaaaactt

SEQ ID NO: 4151817 - DNA, 23 bp, Homo sapiens
tatttgaattaaaacttcttaaa

SEQ ID NO: 4151818 - DNA, 12 bp, Homo sapiens
tatttgaatttt

SEQ ID NO: 4151819 - DNA, 19 bp, Homo sapiens
tatttgacttgcatgaaga

SEQ ID NO: 4151820 - DNA, 16 bp, Homo sapiens
tatttgagagttctaa

SEQ ID NO: 4151821 - DNA, 19 bp, Homo sapiens
tatttgagagttctaaatt

SEQ ID NO: 4151822 - DNA, 14 bp, Homo sapiens
tatttgcattgagg

SEQ ID NO: 4151823 - DNA, 15 bp, Homo sapiens
tatttgctaattaaa

SEQ ID NO: 4151824 - DNA, 15 bp, Homo sapiens
tatttgctttttgct

SEQ ID NO: 4151825 - DNA, 21 bp, Homo sapiens
tatttggaagaaaaaaatctt

SEQ ID NO: 4151826 - DNA, 23 bp, Homo sapiens
tatttgggagggaaaagggaagt

SEQ ID NO: 4151827 - DNA, 15 bp, Homo sapiens
tatttggtccaaaaa

SEQ ID NO: 4151828 - DNA, 13 bp, Homo sapiens
tatttgtaaatct

SEQ ID NO: 4151829 - DNA, 15 bp, Homo sapiens
tatttgttgttttct

SEQ ID NO: 4151830 - DNA, 13 bp, Homo sapiens
tattttaaaatga

SEQ ID NO: 4151831 - DNA, 12 bp, Homo sapiens
tattttaatcct

SEQ ID NO: 4151832 - DNA, 18 bp, Homo sapiens
tattttacagctcattaa

SEQ ID NO: 4151833 - DNA, 21 bp, Homo sapiens
tattttacagctcattaaact

SEQ ID NO: 4151834 - DNA, 14 bp, Homo sapiens
tattttactttgta

SEQ ID NO: 4151835 - DNA, 16 bp, Homo sapiens
tattttagaataaatt

SEQ ID NO: 4151836 - DNA, 13 bp, Homo sapiens
tattttataatca

SEQ ID NO: 4151837 - DNA, 15 bp, Homo sapiens
tattttatcctctgg

SEQ ID NO: 4151838 - DNA, 19 bp, Homo sapiens
tattttcaaatctggtcca

SEQ ID NO: 4151839 - DNA, 14 bp, Homo sapiens
tattttcacaatgt

SEQ ID NO: 4151840 - DNA, 16 bp, Homo sapiens
tattttcacaatgtca

SEQ ID NO: 4151841 - DNA, 15 bp, Homo sapiens
tattttctacagtgg

SEQ ID NO: 4151842 - DNA, 20 bp, Homo sapiens
tattttctggtagatagaaa

SEQ ID NO: 4151843 - DNA, 12 bp, Homo sapiens
tattttcttcat

SEQ ID NO: 4151844 - DNA, 19 bp, Homo sapiens
tattttcttttgaattgtt

SEQ ID NO: 4151845 - DNA, 16 bp, Homo sapiens
tattttgaaaagcttc

SEQ ID NO: 4151846 - DNA, 17 bp, Homo sapiens
tattttgaaaagcttct

SEQ ID NO: 4151847 - DNA, 17 bp, Homo sapiens
tattttgacactggtat

SEQ ID NO: 4151848 - DNA, 18 bp, Homo sapiens
tattttgataataaattg

SEQ ID NO: 4151849 - DNA, 20 bp, Homo sapiens
tattttgataataaattgaa

SEQ ID NO: 4151850 - DNA, 18 bp, Homo sapiens
tattttgcattccagaat

SEQ ID NO: 4151851 - DNA, 18 bp, Homo sapiens
tattttggaaagaagaaa

SEQ ID NO: 4151852 - DNA, 21 bp, Homo sapiens
tattttggatatattattgta

SEQ ID NO: 4151853 - DNA, 20 bp, Homo sapiens
tattttggattgtatattgt

SEQ ID NO: 4151854 - DNA, 19 bp, Homo sapiens
tattttggttcttagttct

SEQ ID NO: 4151855 - DNA, 21 bp, Homo sapiens
tattttggttcttagttctca

SEQ ID NO: 4151856 - DNA, 20 bp, Homo sapiens
tattttgtactttgtggaga

SEQ ID NO: 4151857 - DNA, 16 bp, Homo sapiens
tattttgtagatgtga

SEQ ID NO: 4151858 - DNA, 23 bp, Homo sapiens
tattttgtggttctattttactt

SEQ ID NO: 4151859 - DNA, 17 bp, Homo sapiens
tattttgtttcttttaa

SEQ ID NO: 4151860 - DNA, 21 bp, Homo sapiens
tattttgttttgtgcagagat

SEQ ID NO: 4151861 - DNA, 19 bp, Homo sapiens
tatttttaaaaagaaatct

SEQ ID NO: 4151862 - DNA, 13 bp, Homo sapiens
tatttttaaaata

SEQ ID NO: 4151863 - DNA, 15 bp, Homo sapiens
tatttttaaaatatt

SEQ ID NO: 4151864 - DNA, 17 bp, Homo sapiens
tatttttaaaatattac

SEQ ID NO: 4151865 - DNA, 13 bp, Homo sapiens
tatttttaaagat

SEQ ID NO: 4151866 - DNA, 19 bp, Homo sapiens
tatttttagactcatcaat

SEQ ID NO: 4151867 - DNA, 19 bp, Homo sapiens
tatttttatatcatgcaaa

SEQ ID NO: 4151868 - DNA, 17 bp, Homo sapiens
tatttttatatttcctt

SEQ ID NO: 4151869 - DNA, 15 bp, Homo sapiens
tatttttcaaggaag

SEQ ID NO: 4151870 - DNA, 18 bp, Homo sapiens
tatttttgactgtagcca

SEQ ID NO: 4151871 - DNA, 21 bp, Homo sapiens
tatttttgtaatgtgaaaagt

SEQ ID NO: 4151872 - DNA, 13 bp, Homo sapiens
tatttttgtacat

SEQ ID NO: 4151873 - DNA, 14 bp, Homo sapiens
tatttttgtacatg

SEQ ID NO: 4151874 - DNA, 13 bp, Homo sapiens
tatttttgtactt

SEQ ID NO: 4151875 - DNA, 17 bp, Homo sapiens
tattttttaaaacacta

SEQ ID NO: 4151876 - DNA, 13 bp, Homo sapiens
tattttttaagta

SEQ ID NO: 4151877 - DNA, 15 bp, Homo sapiens
tattttttaagtatt

SEQ ID NO: 4151878 - DNA, 12 bp, Homo sapiens
tattttttaatt

SEQ ID NO: 4151879 - DNA, 15 bp, Homo sapiens
tattttttaattatt

SEQ ID NO: 4151880 - DNA, 16 bp, Homo sapiens
tattttttaatttgat

SEQ ID NO: 4151881 - DNA, 19 bp, Homo sapiens
tatttttttaactgaaaat

SEQ ID NO: 4151882 - DNA, 15 bp, Homo sapiens
tatttttttaagcgt

SEQ ID NO: 4151883 - DNA, 16 bp, Homo sapiens
tatttttttaatttaa

SEQ ID NO: 4151884 - DNA, 18 bp, Homo sapiens
tatttttttaatttaaca

SEQ ID NO: 4151885 - DNA, 16 bp, Homo sapiens
tatttttttttctaag

SEQ ID NO: 4151886 - DNA, 19 bp, Homo sapiens
tatttttttttctaagaga

SEQ ID NO: 4151887 - DNA, 14 bp, Homo sapiens
tcaaaaataatgtg

SEQ ID NO: 4151888 - DNA, 14 bp, Homo sapiens
tcaaaaatacaaaa

SEQ ID NO: 4151889 - DNA, 21 bp, Homo sapiens
tcaaaaatacaaaataaaaac

SEQ ID NO: 4151890 - DNA, 16 bp, Homo sapiens
tcaaaaattgaagaga

SEQ ID NO: 4151891 - DNA, 15 bp, Homo sapiens
tcaaaacagagatgt

SEQ ID NO: 4151892 - DNA, 18 bp, Homo sapiens
tcaaaactcacaagtgct

SEQ ID NO: 4151893 - DNA, 19 bp, Homo sapiens
tcaaaagaatcagaaacag

SEQ ID NO: 4151894 - DNA, 15 bp, Homo sapiens
tcaaaagcattgtct

SEQ ID NO: 4151895 - DNA, 13 bp, Homo sapiens
tcaaaagcattta

SEQ ID NO: 4151896 - DNA, 15 bp, Homo sapiens
tcaaaaggaaaccaa

SEQ ID NO: 4151897 - DNA, 17 bp, Homo sapiens
tcaaaaggaaaccaagt

SEQ ID NO: 4151898 - DNA, 21 bp, Homo sapiens
tcaaaataaaaagtgacacag

SEQ ID NO: 4151899 - DNA, 14 bp, Homo sapiens
tcaaaatgtagctt

SEQ ID NO: 4151900 - DNA, 14 bp, Homo sapiens
tcaaaattaaatct

SEQ ID NO: 4151901 - DNA, 17 bp, Homo sapiens
tcaaaattctagctgta

SEQ ID NO: 4151902 - DNA, 15 bp, Homo sapiens
tcaaacagtaggttg

SEQ ID NO: 4151903 - DNA, 22 bp, Homo sapiens
tcaaacagtgccaaatgctggg

SEQ ID NO: 4151904 - DNA, 17 bp, Homo sapiens
tcaaaccctagccttgc

SEQ ID NO: 4151905 - DNA, 21 bp, Homo sapiens
tcaaaccctagccttgcttgt

SEQ ID NO: 4151906 - DNA, 13 bp, Homo sapiens
tcaaactaaaaga

SEQ ID NO: 4151907 - DNA, 16 bp, Homo sapiens
tcaaactaattctcac

SEQ ID NO: 4151908 - DNA, 17 bp, Homo sapiens
tcaaactatctggccat

SEQ ID NO: 4151909 - DNA, 16 bp, Homo sapiens
tcaaactggggcctcc

SEQ ID NO: 4151910 - DNA, 20 bp, Homo sapiens
tcaaactggggcctccagaa

SEQ ID NO: 4151911 - DNA, 23 bp, Homo sapiens
tcaaactggggcctccagaactc

SEQ ID NO: 4151912 - DNA, 19 bp, Homo sapiens
tcaaactggggcctccctg

SEQ ID NO: 4151913 - DNA, 17 bp, Homo sapiens
tcaaactgtagaaatga

SEQ ID NO: 4151914 - DNA, 18 bp, Homo sapiens
tcaaactgtgaagcattt

SEQ ID NO: 4151915 - DNA, 16 bp, Homo sapiens
tcaaacttactatttt

SEQ ID NO: 4151916 - DNA, 14 bp, Homo sapiens
tcaaactttcactt

SEQ ID NO: 4151917 - DNA, 15 bp, Homo sapiens
tcaaagacagaatgg

SEQ ID NO: 4151918 - DNA, 15 bp, Homo sapiens
tcaaagatgccccat

SEQ ID NO: 4151919 - DNA, 21 bp, Homo sapiens
tcaaagatgccccattccttg

SEQ ID NO: 4151920 - DNA, 18 bp, Homo sapiens
tcaaagccacattatttc

SEQ ID NO: 4151921 - DNA, 20 bp, Homo sapiens
tcaaagccacattatttcta

SEQ ID NO: 4151922 - DNA, 21 bp, Homo sapiens
tcaaagccacattatttctag

SEQ ID NO: 4151923 - DNA, 14 bp, Homo sapiens
tcaaagcttgaaga

SEQ ID NO: 4151924 - DNA, 22 bp, Homo sapiens
tcaaagtagttttattttaata

SEQ ID NO: 4151925 - DNA, 13 bp, Homo sapiens
tcaaagtcaaaaa

SEQ ID NO: 4151926 - DNA, 18 bp, Homo sapiens
tcaaagtgttgtgttcct

SEQ ID NO: 4151927 - DNA, 21 bp, Homo sapiens
tcaaagtgttgtgttcctggc

SEQ ID NO: 4151928 - DNA, 15 bp, Homo sapiens
tcaaagttaattcac

SEQ ID NO: 4151929 - DNA, 22 bp, Homo sapiens
tcaaagtttcctaatcagaaat

SEQ ID NO: 4151930 - DNA, 18 bp, Homo sapiens
tcaaagttttgaaaagct

SEQ ID NO: 4151931 - DNA, 14 bp, Homo sapiens
tcaaataaaaataa

SEQ ID NO: 4151932 - DNA, 18 bp, Homo sapiens
tcaaataagtatttataa

SEQ ID NO: 4151933 - DNA, 16 bp, Homo sapiens
tcaaatacaaagtaaa

SEQ ID NO: 4151934 - DNA, 20 bp, Homo sapiens
tcaaatacaaagtaaataca

SEQ ID NO: 4151935 - DNA, 15 bp, Homo sapiens
tcaaatactttaaag

SEQ ID NO: 4151936 - DNA, 21 bp, Homo sapiens
tcaaatatgagtacaaatgcc

SEQ ID NO: 4151937 - DNA, 23 bp, Homo sapiens
tcaaatcaggctactagaattct

SEQ ID NO: 4151938 - DNA, 15 bp, Homo sapiens
tcaaatccatccaga

SEQ ID NO: 4151939 - DNA, 22 bp, Homo sapiens
tcaaatccttccaaaaattatt

SEQ ID NO: 4151940 - DNA, 12 bp, Homo sapiens
tcaaatctggtc

SEQ ID NO: 4151941 - DNA, 13 bp, Homo sapiens
tcaaatctggtcc

SEQ ID NO: 4151942 - DNA, 22 bp, Homo sapiens
tcaaatctggtccatatttaca

SEQ ID NO: 4151943 - DNA, 20 bp, Homo sapiens
tcaaatggtaggcatttcct

SEQ ID NO: 4151944 - DNA, 21 bp, Homo sapiens
tcaaatggtaggcatttccta

SEQ ID NO: 4151945 - DNA, 20 bp, Homo sapiens
tcaaattaaaacagctgcat

SEQ ID NO: 4151946 - DNA, 12 bp, Homo sapiens
tcaaattaataa

SEQ ID NO: 4151947 - DNA, 14 bp, Homo sapiens
tcaaattgtatcta

SEQ ID NO: 4151948 - DNA, 16 bp, Homo sapiens
tcaaatttattttaat

SEQ ID NO: 4151949 - DNA, 15 bp, Homo sapiens
tcaacaaagaaatat

SEQ ID NO: 4151950 - DNA, 20 bp, Homo sapiens
tcaacaaggcttgctgcaga

SEQ ID NO: 4151951 - DNA, 16 bp, Homo sapiens
tcaacaagggagagac

SEQ ID NO: 4151952 - DNA, 14 bp, Homo sapiens
tcaacagaacatat

SEQ ID NO: 4151953 - DNA, 14 bp, Homo sapiens
tcaacagccaagtg

SEQ ID NO: 4151954 - DNA, 17 bp, Homo sapiens
tcaacaggcccagggag

SEQ ID NO: 4151955 - DNA, 14 bp, Homo sapiens
tcaacatcaatgtt

SEQ ID NO: 4151956 - DNA, 15 bp, Homo sapiens
tcaacatcaatgttc

SEQ ID NO: 4151957 - DNA, 19 bp, Homo sapiens
tcaacatcaatgttcattg

SEQ ID NO: 4151958 - DNA, 18 bp, Homo sapiens
tcaacatcctgccagccc

SEQ ID NO: 4151959 - DNA, 15 bp, Homo sapiens
tcaacatcttttaca

SEQ ID NO: 4151960 - DNA, 20 bp, Homo sapiens
tcaacatgctccaaatataa

SEQ ID NO: 4151961 - DNA, 17 bp, Homo sapiens
tcaaccacgtggagaaa

SEQ ID NO: 4151962 - DNA, 21 bp, Homo sapiens
tcaaccacgtggagaaaatca

SEQ ID NO: 4151963 - DNA, 11 bp, Homo sapiens
tcaaccactgt

SEQ ID NO: 4151964 - DNA, 15 bp, Homo sapiens
tcaaccactgtggcg

SEQ ID NO: 4151965 - DNA, 18 bp, Homo sapiens
tcaaccattccccatggg

SEQ ID NO: 4151966 - DNA, 15 bp, Homo sapiens
tcaaccgtacaatgg

SEQ ID NO: 4151967 - DNA, 20 bp, Homo sapiens
tcaacctggcaaaaatgcaa

SEQ ID NO: 4151968 - DNA, 17 bp, Homo sapiens
tcaacctggtggcacca

SEQ ID NO: 4151969 - DNA, 16 bp, Homo sapiens
tcaactcacctaatgt

SEQ ID NO: 4151970 - DNA, 14 bp, Homo sapiens
tcaactctacccct

SEQ ID NO: 4151971 - DNA, 16 bp, Homo sapiens
tcaactctttgttatt

SEQ ID NO: 4151972 - DNA, 19 bp, Homo sapiens
tcaactggttgtatatttt

SEQ ID NO: 4151973 - DNA, 18 bp, Homo sapiens
tcaacttctggctcctca

SEQ ID NO: 4151974 - DNA, 19 bp, Homo sapiens
tcaacttctggctcctcaa

SEQ ID NO: 4151975 - DNA, 22 bp, Homo sapiens
tcaagaaataaaaggaagccaa

SEQ ID NO: 4151976 - DNA, 14 bp, Homo sapiens
tcaagaacctggaa

SEQ ID NO: 4151977 - DNA, 12 bp, Homo sapiens
tcaagaagacat

SEQ ID NO: 4151978 - DNA, 14 bp, Homo sapiens
tcaagactttagct

SEQ ID NO: 4151979 - DNA, 15 bp, Homo sapiens
tcaagactttagctt

SEQ ID NO: 4151980 - DNA, 20 bp, Homo sapiens
tcaagactttagcttttcct

SEQ ID NO: 4151981 - DNA, 13 bp, Homo sapiens
tcaagagaaaatg

SEQ ID NO: 4151982 - DNA, 13 bp, Homo sapiens
tcaagagctgccc

SEQ ID NO: 4151983 - DNA, 19 bp, Homo sapiens
tcaagatactgctactgta

SEQ ID NO: 4151984 - DNA, 20 bp, Homo sapiens
tcaagatgggggcagggctg

SEQ ID NO: 4151985 - DNA, 13 bp, Homo sapiens
tcaagattttgaa

SEQ ID NO: 4151986 - DNA, 19 bp, Homo sapiens
tcaagattttgaatgcttc

SEQ ID NO: 4151987 - DNA, 18 bp, Homo sapiens
tcaagatttttttcctga

SEQ ID NO: 4151988 - DNA, 21 bp, Homo sapiens
tcaagcaatccacctgccttg

SEQ ID NO: 4151989 - DNA, 19 bp, Homo sapiens
tcaagcaatcctcctgcct

SEQ ID NO: 4151990 - DNA, 12 bp, Homo sapiens
tcaagcactgat

SEQ ID NO: 4151991 - DNA, 18 bp, Homo sapiens
tcaagcagcgaccgcccc

SEQ ID NO: 4151992 - DNA, 21 bp, Homo sapiens
tcaagcagcgaccgccccctc

SEQ ID NO: 4151993 - DNA, 23 bp, Homo sapiens
tcaagcagcgaccgccccctcct

SEQ ID NO: 4151994 - DNA, 16 bp, Homo sapiens
tcaagccatgtataaa

SEQ ID NO: 4151995 - DNA, 14 bp, Homo sapiens
tcaagcccaggagg

SEQ ID NO: 4151996 - DNA, 21 bp, Homo sapiens
tcaagccccagcagccctcaa

SEQ ID NO: 4151997 - DNA, 21 bp, Homo sapiens
tcaagctgttatttcttccct

SEQ ID NO: 4151998 - DNA, 22 bp, Homo sapiens
tcaagctgttatttcttccctg

SEQ ID NO: 4151999 - DNA, 14 bp, Homo sapiens
tcaagggctttcct

SEQ ID NO: 4152000 - DNA, 15 bp, Homo sapiens
tcaagggctttcctg

SEQ ID NO: 4152001 - DNA, 19 bp, Homo sapiens
tcaagggctttcctgtgcc

SEQ ID NO: 4152002 - DNA, 16 bp, Homo sapiens
tcaagtaagaagacat

SEQ ID NO: 4152003 - DNA, 23 bp, Homo sapiens
tcaagtaagaagacatgaaccaa

SEQ ID NO: 4152004 - DNA, 15 bp, Homo sapiens
tcaagtaattgtgaa

SEQ ID NO: 4152005 - DNA, 12 bp, Homo sapiens
tcaagtatttgg

SEQ ID NO: 4152006 - DNA, 20 bp, Homo sapiens
tcaagtattttgtgtttgga

SEQ ID NO: 4152007 - DNA, 18 bp, Homo sapiens
tcaagtcaatcatttctc

SEQ ID NO: 4152008 - DNA, 16 bp, Homo sapiens
tcaagtcctgactggg

SEQ ID NO: 4152009 - DNA, 22 bp, Homo sapiens
tcaagtccttacctcttccgga

SEQ ID NO: 4152010 - DNA, 18 bp, Homo sapiens
tcaagtcctttgtgaata

SEQ ID NO: 4152011 - DNA, 19 bp, Homo sapiens
tcaagtcctttgtgaatat

SEQ ID NO: 4152012 - DNA, 16 bp, Homo sapiens
tcaagtctctgctggc

SEQ ID NO: 4152013 - DNA, 23 bp, Homo sapiens
tcaagtgccttttgctgcgcacc

SEQ ID NO: 4152014 - DNA, 19 bp, Homo sapiens
tcaagtggcaaagctgttc

SEQ ID NO: 4152015 - DNA, 15 bp, Homo sapiens
tcaagtgtcatatgt

SEQ ID NO: 4152016 - DNA, 19 bp, Homo sapiens
tcaagtgtccccagaccct

SEQ ID NO: 4152017 - DNA, 16 bp, Homo sapiens
tcaagttaacaaggaa

SEQ ID NO: 4152018 - DNA, 14 bp, Homo sapiens
tcaagttcctttgg

SEQ ID NO: 4152019 - DNA, 16 bp, Homo sapiens
tcaagttcctttgggt

SEQ ID NO: 4152020 - DNA, 15 bp, Homo sapiens
tcaagttgagatttt

SEQ ID NO: 4152021 - DNA, 20 bp, Homo sapiens
tcaagttgtaaaaatgaaag

SEQ ID NO: 4152022 - DNA, 21 bp, Homo sapiens
tcaagttgtaacttatattga

SEQ ID NO: 4152023 - DNA, 16 bp, Homo sapiens
tcaataaaatgtgatt

SEQ ID NO: 4152024 - DNA, 23 bp, Homo sapiens
tcaataaaatgtgatttttctga

SEQ ID NO: 4152025 - DNA, 13 bp, Homo sapiens
tcaataaacactt

SEQ ID NO: 4152026 - DNA, 14 bp, Homo sapiens
tcaataaacagctt

SEQ ID NO: 4152027 - DNA, 21 bp, Homo sapiens
tcaataaacttagaggaaaat

SEQ ID NO: 4152028 - DNA, 14 bp, Homo sapiens
tcaataaagaaaac

SEQ ID NO: 4152029 - DNA, 15 bp, Homo sapiens
tcaataaagaaaact

SEQ ID NO: 4152030 - DNA, 12 bp, Homo sapiens
tcaataaagcat

SEQ ID NO: 4152031 - DNA, 17 bp, Homo sapiens
tcaataaatctttcaaa

SEQ ID NO: 4152032 - DNA, 15 bp, Homo sapiens
tcaataaattgcaac

SEQ ID NO: 4152033 - DNA, 20 bp, Homo sapiens
tcaatacagacaaggttctg

SEQ ID NO: 4152034 - DNA, 16 bp, Homo sapiens
tcaatatattgaactt

SEQ ID NO: 4152035 - DNA, 18 bp, Homo sapiens
tcaatatccaaaccaaat

SEQ ID NO: 4152036 - DNA, 18 bp, Homo sapiens
tcaatatccctcttgtaa

SEQ ID NO: 4152037 - DNA, 16 bp, Homo sapiens
tcaatattaaatacag

SEQ ID NO: 4152038 - DNA, 22 bp, Homo sapiens
tcaatattaaatacagacacta

SEQ ID NO: 4152039 - DNA, 14 bp, Homo sapiens
tcaatattcctgaa

SEQ ID NO: 4152040 - DNA, 10 bp, Homo sapiens
tcaatattta

SEQ ID NO: 4152041 - DNA, 20 bp, Homo sapiens
tcaatatttattattttcac

SEQ ID NO: 4152042 - DNA, 16 bp, Homo sapiens
tcaatatttttatatc

SEQ ID NO: 4152043 - DNA, 21 bp, Homo sapiens
tcaatcaaataagtatttata

SEQ ID NO: 4152044 - DNA, 15 bp, Homo sapiens
tcaatcctacctgtt

SEQ ID NO: 4152045 - DNA, 16 bp, Homo sapiens
tcaatcctgttaagag

SEQ ID NO: 4152046 - DNA, 20 bp, Homo sapiens
tcaatctcccgctgctgctg

SEQ ID NO: 4152047 - DNA, 14 bp, Homo sapiens
tcaatctcctctct

SEQ ID NO: 4152048 - DNA, 18 bp, Homo sapiens
tcaatgaaaaatgtaatt

SEQ ID NO: 4152049 - DNA, 21 bp, Homo sapiens
tcaatgaagccagctcacagt

SEQ ID NO: 4152050 - DNA, 21 bp, Homo sapiens
tcaatggcctaaaactggcct

SEQ ID NO: 4152051 - DNA, 13 bp, Homo sapiens
tcaatgtgcagtg

SEQ ID NO: 4152052 - DNA, 20 bp, Homo sapiens
tcaatgttcacgcaacttga

SEQ ID NO: 4152053 - DNA, 22 bp, Homo sapiens
tcaatgttcacgcaacttgaaa

SEQ ID NO: 4152054 - DNA, 12 bp, Homo sapiens
tcaatgttcatt

SEQ ID NO: 4152055 - DNA, 13 bp, Homo sapiens
tcaatgttcattg

SEQ ID NO: 4152056 - DNA, 23 bp, Homo sapiens
tcaatgtttatgcaaggaaggaa

SEQ ID NO: 4152057 - DNA, 20 bp, Homo sapiens
tcaattccctctctcagcac

SEQ ID NO: 4152058 - DNA, 14 bp, Homo sapiens
tcaattcctctggg

SEQ ID NO: 4152059 - DNA, 13 bp, Homo sapiens
tcaattgtaaatt

SEQ ID NO: 4152060 - DNA, 14 bp, Homo sapiens
tcaattgtaaattg

SEQ ID NO: 4152061 - DNA, 14 bp, Homo sapiens
tcaatttccctcag

SEQ ID NO: 4152062 - DNA, 18 bp, Homo sapiens
tcaatttccctgactcct

SEQ ID NO: 4152063 - DNA, 17 bp, Homo sapiens
tcaatttttgtctcaga

SEQ ID NO: 4152064 - DNA, 19 bp, Homo sapiens
tcaatttttgtctcagaag

SEQ ID NO: 4152065 - DNA, 13 bp, Homo sapiens
tcacaaaatgtct

SEQ ID NO: 4152066 - DNA, 15 bp, Homo sapiens
tcacaaacttttata

SEQ ID NO: 4152067 - DNA, 17 bp, Homo sapiens
tcacaaacttttatact

SEQ ID NO: 4152068 - DNA, 18 bp, Homo sapiens
tcacaataaatgtattca

SEQ ID NO: 4152069 - DNA, 15 bp, Homo sapiens
tcacaatacagataa

SEQ ID NO: 4152070 - DNA, 17 bp, Homo sapiens
tcacaatgtcagtattt

SEQ ID NO: 4152071 - DNA, 10 bp, Homo sapiens
tcacacacac

SEQ ID NO: 4152072 - DNA, 14 bp, Homo sapiens
tcacacacacagct

SEQ ID NO: 4152073 - DNA, 19 bp, Homo sapiens
tcacacacacagctgggca

SEQ ID NO: 4152074 - DNA, 12 bp, Homo sapiens
tcacacactgat

SEQ ID NO: 4152075 - DNA, 22 bp, Homo sapiens
tcacacagctagtgaagaccag

SEQ ID NO: 4152076 - DNA, 23 bp, Homo sapiens
tcacacagtgggtggtggatctg

SEQ ID NO: 4152077 - DNA, 19 bp, Homo sapiens
tcacacatccagacatcat

SEQ ID NO: 4152078 - DNA, 11 bp, Homo sapiens
tcacacattca

SEQ ID NO: 4152079 - DNA, 11 bp, Homo sapiens
tcacaccagcc

SEQ ID NO: 4152080 - DNA, 12 bp, Homo sapiens
tcacaccagcca

SEQ ID NO: 4152081 - DNA, 13 bp, Homo sapiens
tcacaccccaggc

SEQ ID NO: 4152082 - DNA, 14 bp, Homo sapiens
tcacacccctgtcc

SEQ ID NO: 4152083 - DNA, 12 bp, Homo sapiens
tcacacggccac

SEQ ID NO: 4152084 - DNA, 14 bp, Homo sapiens
tcacacggccaccc

SEQ ID NO: 4152085 - DNA, 21 bp, Homo sapiens
tcacactaagagggcagactg

SEQ ID NO: 4152086 - DNA, 23 bp, Homo sapiens
tcacactgggtggtggcctggtc

SEQ ID NO: 4152087 - DNA, 16 bp, Homo sapiens
tcacactgtcttctga

SEQ ID NO: 4152088 - DNA, 18 bp, Homo sapiens
tcacactttttatttaat

SEQ ID NO: 4152089 - DNA, 14 bp, Homo sapiens
tcacagaaaaagca

SEQ ID NO: 4152090 - DNA, 16 bp, Homo sapiens
tcacagaaaaagcatg

SEQ ID NO: 4152091 - DNA, 21 bp, Homo sapiens
tcacagaaatcagaggagaga

SEQ ID NO: 4152092 - DNA, 21 bp, Homo sapiens
tcacagaacccttggagccaa

SEQ ID NO: 4152093 - DNA, 23 bp, Homo sapiens
tcacagaagtgttaacttttcta

SEQ ID NO: 4152094 - DNA, 13 bp, Homo sapiens
tcacagcagcctc

SEQ ID NO: 4152095 - DNA, 16 bp, Homo sapiens
tcacagccacccctga

SEQ ID NO: 4152096 - DNA, 11 bp, Homo sapiens
tcacagccagg

SEQ ID NO: 4152097 - DNA, 22 bp, Homo sapiens
tcacagccaggcgctagcacag

SEQ ID NO: 4152098 - DNA, 15 bp, Homo sapiens
tcacagcctccaggg

SEQ ID NO: 4152099 - DNA, 18 bp, Homo sapiens
tcacagcctccagggccc

SEQ ID NO: 4152100 - DNA, 18 bp, Homo sapiens
tcacaggaggccagtggg

SEQ ID NO: 4152101 - DNA, 19 bp, Homo sapiens
tcacaggaggccagtgggc

SEQ ID NO: 4152102 - DNA, 16 bp, Homo sapiens
tcacagggttgggccc

SEQ ID NO: 4152103 - DNA, 17 bp, Homo sapiens
tcacagtacagcatgtg

SEQ ID NO: 4152104 - DNA, 14 bp, Homo sapiens
tcacagtgtttcga

SEQ ID NO: 4152105 - DNA, 23 bp, Homo sapiens
tcacagtgtttgcaatggtgttg

SEQ ID NO: 4152106 - DNA, 22 bp, Homo sapiens
tcacagttctttgggccagaca

SEQ ID NO: 4152107 - DNA, 15 bp, Homo sapiens
tcacatagatgtccc

SEQ ID NO: 4152108 - DNA, 18 bp, Homo sapiens
tcacatatatcaaagtga

SEQ ID NO: 4152109 - DNA, 13 bp, Homo sapiens
tcacatcacagga

SEQ ID NO: 4152110 - DNA, 17 bp, Homo sapiens
tcacatcagataagaca

SEQ ID NO: 4152111 - DNA, 12 bp, Homo sapiens
tcacatccctct

SEQ ID NO: 4152112 - DNA, 13 bp, Homo sapiens
tcacatgtggcaa

SEQ ID NO: 4152113 - DNA, 22 bp, Homo sapiens
tcacatgtttaactttaaggat

SEQ ID NO: 4152114 - DNA, 21 bp, Homo sapiens
tcacattaaaaaatgaaatat

SEQ ID NO: 4152115 - DNA, 22 bp, Homo sapiens
tcacattaaaaaatgaaatatt

SEQ ID NO: 4152116 - DNA, 16 bp, Homo sapiens
tcacattatttgcatg

SEQ ID NO: 4152117 - DNA, 20 bp, Homo sapiens
tcacattgagctgatataaa

SEQ ID NO: 4152118 - DNA, 21 bp, Homo sapiens
tcacattgcattctattgcct

SEQ ID NO: 4152119 - DNA, 22 bp, Homo sapiens
tcacattgcattctattgcctt

SEQ ID NO: 4152120 - DNA, 20 bp, Homo sapiens
tcacattggagtcactgcca

SEQ ID NO: 4152121 - DNA, 23 bp, Homo sapiens
tcacattgtaactgaacttcagg

SEQ ID NO: 4152122 - DNA, 23 bp, Homo sapiens
tcacatttatgtggcttgtttat

SEQ ID NO: 4152123 - DNA, 13 bp, Homo sapiens
tcaccaaaaacat

SEQ ID NO: 4152124 - DNA, 15 bp, Homo sapiens
tcaccaacacagttg

SEQ ID NO: 4152125 - DNA, 24 bp, Homo sapiens
tcaccaccaataaatcagaccatg

SEQ ID NO: 4152126 - DNA, 22 bp, Homo sapiens
tcaccaccacccgaaatgccac

SEQ ID NO: 4152127 - DNA, 20 bp, Homo sapiens
tcaccacgactggccagggc

SEQ ID NO: 4152128 - DNA, 18 bp, Homo sapiens
tcaccagagcccatgctc

SEQ ID NO: 4152129 - DNA, 13 bp, Homo sapiens
tcaccagcaccaa

SEQ ID NO: 4152130 - DNA, 19 bp, Homo sapiens
tcaccagcaccaacaccac

SEQ ID NO: 4152131 - DNA, 20 bp, Homo sapiens
tcaccagccctgcagcccac

SEQ ID NO: 4152132 - DNA, 22 bp, Homo sapiens
tcaccaggtgcatgcatgccct

SEQ ID NO: 4152133 - DNA, 19 bp, Homo sapiens
tcaccagtgacctggaagg

SEQ ID NO: 4152134 - DNA, 19 bp, Homo sapiens
tcacccaggctggactgca

SEQ ID NO: 4152135 - DNA, 15 bp, Homo sapiens
tcacccataaacagt

SEQ ID NO: 4152136 - DNA, 16 bp, Homo sapiens
tcacccatcccacccc

SEQ ID NO: 4152137 - DNA, 12 bp, Homo sapiens
tcaccccaccct

SEQ ID NO: 4152138 - DNA, 21 bp, Homo sapiens
tcaccccagtggccactcagc

SEQ ID NO: 4152139 - DNA, 19 bp, Homo sapiens
tcaccccatcccacaccct

SEQ ID NO: 4152140 - DNA, 17 bp, Homo sapiens
tcacccccactcccgcc

SEQ ID NO: 4152141 - DNA, 18 bp, Homo sapiens
tcaccccccactcaccag

SEQ ID NO: 4152142 - DNA, 21 bp, Homo sapiens
tcaccccctccctacacacac

SEQ ID NO: 4152143 - DNA, 22 bp, Homo sapiens
tcaccccctccctacacacaca

SEQ ID NO: 4152144 - DNA, 16 bp, Homo sapiens
tcacccctgggcaggc

SEQ ID NO: 4152145 - DNA, 19 bp, Homo sapiens
tcacccctttctgtcccac

SEQ ID NO: 4152146 - DNA, 14 bp, Homo sapiens
tcaccctccacctc

SEQ ID NO: 4152147 - DNA, 23 bp, Homo sapiens
tcaccctgatttaggagaagcca

SEQ ID NO: 4152148 - DNA, 13 bp, Homo sapiens
tcaccctgcctta

SEQ ID NO: 4152149 - DNA, 17 bp, Homo sapiens
tcaccctgggagccagt

SEQ ID NO: 4152150 - DNA, 13 bp, Homo sapiens
tcaccctgtcaag

SEQ ID NO: 4152151 - DNA, 15 bp, Homo sapiens
tcaccctttgctgtg

SEQ ID NO: 4152152 - DNA, 16 bp, Homo sapiens
tcaccgagtgggggca

SEQ ID NO: 4152153 - DNA, 20 bp, Homo sapiens
tcaccgctggcccttagaga

SEQ ID NO: 4152154 - DNA, 14 bp, Homo sapiens
tcacctaatgttta

SEQ ID NO: 4152155 - DNA, 21 bp, Homo sapiens
tcacctaatgtttatgagcca

SEQ ID NO: 4152156 - DNA, 23 bp, Homo sapiens
tcacctcatgcccaccccctgcc

SEQ ID NO: 4152157 - DNA, 17 bp, Homo sapiens
tcacctctatccaaaga

SEQ ID NO: 4152158 - DNA, 16 bp, Homo sapiens
tcacctctccaggtgc

SEQ ID NO: 4152159 - DNA, 17 bp, Homo sapiens
tcacctctccaggtgct

SEQ ID NO: 4152160 - DNA, 18 bp, Homo sapiens
tcacctctccaggtgctc

SEQ ID NO: 4152161 - DNA, 20 bp, Homo sapiens
tcacctctccaggtgctcat

SEQ ID NO: 4152162 - DNA, 23 bp, Homo sapiens
tcacctgagcccggatgcttctc

SEQ ID NO: 4152163 - DNA, 14 bp, Homo sapiens
tcacctgctccaga

SEQ ID NO: 4152164 - DNA, 15 bp, Homo sapiens
tcacctgctccagaa

SEQ ID NO: 4152165 - DNA, 11 bp, Homo sapiens
tcacctggctg

SEQ ID NO: 4152166 - DNA, 22 bp, Homo sapiens
tcacctggctgagcagttcccc

SEQ ID NO: 4152167 - DNA, 18 bp, Homo sapiens
tcacctgtttttaagctg

SEQ ID NO: 4152168 - DNA, 16 bp, Homo sapiens
tcaccttgggctgggg

SEQ ID NO: 4152169 - DNA, 18 bp, Homo sapiens
tcaccttgggctggggga

SEQ ID NO: 4152170 - DNA, 14 bp, Homo sapiens
tcacctttcccatc

SEQ ID NO: 4152171 - DNA, 17 bp, Homo sapiens
tcaccttttctgtggct

SEQ ID NO: 4152172 - DNA, 22 bp, Homo sapiens
tcaccttttctgtggctggctc

SEQ ID NO: 4152173 - DNA, 15 bp, Homo sapiens
tcacgcaggctgagt

SEQ ID NO: 4152174 - DNA, 20 bp, Homo sapiens
tcacgcaggctgagtccaga

SEQ ID NO: 4152175 - DNA, 21 bp, Homo sapiens
tcacgcaggctgagtccagag

SEQ ID NO: 4152176 - DNA, 21 bp, Homo sapiens
tcacgcctgtaatcccagcac

SEQ ID NO: 4152177 - DNA, 17 bp, Homo sapiens
tcacgctcacccagtca

SEQ ID NO: 4152178 - DNA, 17 bp, Homo sapiens
tcacgtaccccactggg

SEQ ID NO: 4152179 - DNA, 21 bp, Homo sapiens
tcacgtggctcgactatagaa

SEQ ID NO: 4152180 - DNA, 19 bp, Homo sapiens
tcactaaaccgataatgca

SEQ ID NO: 4152181 - DNA, 15 bp, Homo sapiens
tcactagctttgcct

SEQ ID NO: 4152182 - DNA, 13 bp, Homo sapiens
tcactagtgccaa

SEQ ID NO: 4152183 - DNA, 18 bp, Homo sapiens
tcactagtgtcaggcccc

SEQ ID NO: 4152184 - DNA, 21 bp, Homo sapiens
tcactagtgtcaggcccccag

SEQ ID NO: 4152185 - DNA, 13 bp, Homo sapiens
tcactataaatgg

SEQ ID NO: 4152186 - DNA, 17 bp, Homo sapiens
tcactataaatggtgtt

SEQ ID NO: 4152187 - DNA, 16 bp, Homo sapiens
tcactatcttcttcaa

SEQ ID NO: 4152188 - DNA, 22 bp, Homo sapiens
tcactatcttcttcaaatacaa

SEQ ID NO: 4152189 - DNA, 15 bp, Homo sapiens
tcactatctttctga

SEQ ID NO: 4152190 - DNA, 16 bp, Homo sapiens
tcactatctttctgat

SEQ ID NO: 4152191 - DNA, 13 bp, Homo sapiens
tcactatggtatg

SEQ ID NO: 4152192 - DNA, 23 bp, Homo sapiens
tcactatggtatgctggccagca

SEQ ID NO: 4152193 - DNA, 18 bp, Homo sapiens
tcactatttttatttata

SEQ ID NO: 4152194 - DNA, 15 bp, Homo sapiens
tcactcaagcactga

SEQ ID NO: 4152195 - DNA, 17 bp, Homo sapiens
tcactcaagcactgata

SEQ ID NO: 4152196 - DNA, 19 bp, Homo sapiens
tcactcagaagtccagagt

SEQ ID NO: 4152197 - DNA, 13 bp, Homo sapiens
tcactcagagcag

SEQ ID NO: 4152198 - DNA, 13 bp, Homo sapiens
tcactcattgctg

SEQ ID NO: 4152199 - DNA, 17 bp, Homo sapiens
tcactcattgctgagcc

SEQ ID NO: 4152200 - DNA, 20 bp, Homo sapiens
tcactcattgctgagcctct

SEQ ID NO: 4152201 - DNA, 14 bp, Homo sapiens
tcactccagcctgg

SEQ ID NO: 4152202 - DNA, 19 bp, Homo sapiens
tcactcccacctgcatctg

SEQ ID NO: 4152203 - DNA, 18 bp, Homo sapiens
tcactccccaaggaagag

SEQ ID NO: 4152204 - DNA, 19 bp, Homo sapiens
tcactccccagggagctct

SEQ ID NO: 4152205 - DNA, 21 bp, Homo sapiens
tcactccccatgccacgttcc

SEQ ID NO: 4152206 - DNA, 18 bp, Homo sapiens
tcactcctaggagagcca

SEQ ID NO: 4152207 - DNA, 19 bp, Homo sapiens
tcactctacttagcatgtc

SEQ ID NO: 4152208 - DNA, 13 bp, Homo sapiens
tcactctggcctc

SEQ ID NO: 4152209 - DNA, 23 bp, Homo sapiens
tcactctgtcagccagccgccct

SEQ ID NO: 4152210 - DNA, 18 bp, Homo sapiens
tcactcttcctgcaagga

SEQ ID NO: 4152211 - DNA, 15 bp, Homo sapiens
tcactgaactccacc

SEQ ID NO: 4152212 - DNA, 17 bp, Homo sapiens
tcactgaactccaccga

SEQ ID NO: 4152213 - DNA, 11 bp, Homo sapiens
tcactgaagcc

SEQ ID NO: 4152214 - DNA, 22 bp, Homo sapiens
tcactgaatgcctcaatgtgac

SEQ ID NO: 4152215 - DNA, 16 bp, Homo sapiens
tcactgagctccccag

SEQ ID NO: 4152216 - DNA, 17 bp, Homo sapiens
tcactgcagtcttattt

SEQ ID NO: 4152217 - DNA, 18 bp, Homo sapiens
tcactgccaggccagcct

SEQ ID NO: 4152218 - DNA, 18 bp, Homo sapiens
tcactgcgaagaccctct

SEQ ID NO: 4152219 - DNA, 13 bp, Homo sapiens
tcactgctggctg

SEQ ID NO: 4152220 - DNA, 14 bp, Homo sapiens
tcactgctggctgc

SEQ ID NO: 4152221 - DNA, 21 bp, Homo sapiens
tcactgcttgatgaagcaagg

SEQ ID NO: 4152222 - DNA, 21 bp, Homo sapiens
tcactggaaaggggagagcct

SEQ ID NO: 4152223 - DNA, 14 bp, Homo sapiens
tcactggatgaaga

SEQ ID NO: 4152224 - DNA, 14 bp, Homo sapiens
tcactggctggctc

SEQ ID NO: 4152225 - DNA, 19 bp, Homo sapiens
tcactggctggctcctagg

SEQ ID NO: 4152226 - DNA, 11 bp, Homo sapiens
tcactgggtgg

SEQ ID NO: 4152227 - DNA, 18 bp, Homo sapiens
tcactgggtggggtgagg

SEQ ID NO: 4152228 - DNA, 17 bp, Homo sapiens
tcactgtataaatagga

SEQ ID NO: 4152229 - DNA, 24 bp, Homo sapiens
tcactgtataaataggagaggatg

SEQ ID NO: 4152230 - DNA, 12 bp, Homo sapiens
tcactgtgatca

SEQ ID NO: 4152231 - DNA, 15 bp, Homo sapiens
tcactgttccctctg

SEQ ID NO: 4152232 - DNA, 17 bp, Homo sapiens
tcactgttccctctgct

SEQ ID NO: 4152233 - DNA, 13 bp, Homo sapiens
tcactgttctgca

SEQ ID NO: 4152234 - DNA, 16 bp, Homo sapiens
tcactgttctgcaaag

SEQ ID NO: 4152235 - DNA, 20 bp, Homo sapiens
tcactgtttctctgctgttg

SEQ ID NO: 4152236 - DNA, 18 bp, Homo sapiens
tcacttactattgttgct

SEQ ID NO: 4152237 - DNA, 19 bp, Homo sapiens
tcacttagcagcaactgaa

SEQ ID NO: 4152238 - DNA, 12 bp, Homo sapiens
tcacttagtcct

SEQ ID NO: 4152239 - DNA, 13 bp, Homo sapiens
tcacttatacctg

SEQ ID NO: 4152240 - DNA, 22 bp, Homo sapiens
tcacttccatacagctctacgt

SEQ ID NO: 4152241 - DNA, 22 bp, Homo sapiens
tcacttcgcgtgccctcgctgc

SEQ ID NO: 4152242 - DNA, 23 bp, Homo sapiens
tcacttcgcgtgccctcgctgct

SEQ ID NO: 4152243 - DNA, 13 bp, Homo sapiens
tcacttctaaatg

SEQ ID NO: 4152244 - DNA, 15 bp, Homo sapiens
tcacttcttctgtcc

SEQ ID NO: 4152245 - DNA, 14 bp, Homo sapiens
tcacttctttccct

SEQ ID NO: 4152246 - DNA, 20 bp, Homo sapiens
tcacttgatgatacaatgaa

SEQ ID NO: 4152247 - DNA, 15 bp, Homo sapiens
tcacttgtgctttgc

SEQ ID NO: 4152248 - DNA, 23 bp, Homo sapiens
tcacttgtgctttgctcttgtcc

SEQ ID NO: 4152249 - DNA, 15 bp, Homo sapiens
tcactttaagatctt

SEQ ID NO: 4152250 - DNA, 14 bp, Homo sapiens
tcactttatttcat

SEQ ID NO: 4152251 - DNA, 19 bp, Homo sapiens
tcactttcacatagatgtc

SEQ ID NO: 4152252 - DNA, 19 bp, Homo sapiens
tcactttgtctaactcaga

SEQ ID NO: 4152253 - DNA, 21 bp, Homo sapiens
tcacttttgctccgaagctac

SEQ ID NO: 4152254 - DNA, 14 bp, Homo sapiens
tcacttttgttctg

SEQ ID NO: 4152255 - DNA, 15 bp, Homo sapiens
tcacttttgttctgc

SEQ ID NO: 4152256 - DNA, 16 bp, Homo sapiens
tcacttttgttctgct

SEQ ID NO: 4152257 - DNA, 21 bp, Homo sapiens
tcactttttatgctatttctg

SEQ ID NO: 4152258 - DNA, 22 bp, Homo sapiens
tcactttttatgctatttctgt

SEQ ID NO: 4152259 - DNA, 19 bp, Homo sapiens
tcagaaaatgttctgtttg

SEQ ID NO: 4152260 - DNA, 12 bp, Homo sapiens
tcagaaatatgt

SEQ ID NO: 4152261 - DNA, 22 bp, Homo sapiens
tcagaaatttttatcagtttcc

SEQ ID NO: 4152262 - DNA, 16 bp, Homo sapiens
tcagaacaatccgatt

SEQ ID NO: 4152263 - DNA, 12 bp, Homo sapiens
tcagaagataac

SEQ ID NO: 4152264 - DNA, 14 bp, Homo sapiens
tcagaagcaagcca

SEQ ID NO: 4152265 - DNA, 19 bp, Homo sapiens
tcagaagcaagccagacct

SEQ ID NO: 4152266 - DNA, 23 bp, Homo sapiens
tcagaagcctccaagcctgcctc

SEQ ID NO: 4152267 - DNA, 15 bp, Homo sapiens
tcagaagtccagagt

SEQ ID NO: 4152268 - DNA, 20 bp, Homo sapiens
tcagaataaggcaggcattg

SEQ ID NO: 4152269 - DNA, 19 bp, Homo sapiens
tcagaatctcaaataacta

SEQ ID NO: 4152270 - DNA, 18 bp, Homo sapiens
tcagaattaaacttttaa

SEQ ID NO: 4152271 - DNA, 11 bp, Homo sapiens
tcagacaagca

SEQ ID NO: 4152272 - DNA, 16 bp, Homo sapiens
tcagacaccctctcct

SEQ ID NO: 4152273 - DNA, 17 bp, Homo sapiens
tcagacaccctctcctt

SEQ ID NO: 4152274 - DNA, 20 bp, Homo sapiens
tcagaccaactctctcctgt

SEQ ID NO: 4152275 - DNA, 19 bp, Homo sapiens
tcagaccccagttctaggg

SEQ ID NO: 4152276 - DNA, 22 bp, Homo sapiens
tcagaccccagttctaggggag

SEQ ID NO: 4152277 - DNA, 13 bp, Homo sapiens
tcagacccctgcc

SEQ ID NO: 4152278 - DNA, 14 bp, Homo sapiens
tcagacccctgcct

SEQ ID NO: 4152279 - DNA, 13 bp, Homo sapiens
tcagaccctttag

SEQ ID NO: 4152280 - DNA, 13 bp, Homo sapiens
tcagacctgtctt

SEQ ID NO: 4152281 - DNA, 16 bp, Homo sapiens
tcagacctgtcttcca

SEQ ID NO: 4152282 - DNA, 17 bp, Homo sapiens
tcagacctgtcttccaa

SEQ ID NO: 4152283 - DNA, 16 bp, Homo sapiens
tcagacggcggccagg

SEQ ID NO: 4152284 - DNA, 17 bp, Homo sapiens
tcagacggcggccaggc

SEQ ID NO: 4152285 - DNA, 18 bp, Homo sapiens
tcagacggcggccaggca

SEQ ID NO: 4152286 - DNA, 18 bp, Homo sapiens
tcagacgttgcctgagaa

SEQ ID NO: 4152287 - DNA, 15 bp, Homo sapiens
tcagactcaagtacc

SEQ ID NO: 4152288 - DNA, 19 bp, Homo sapiens
tcagactcccattcctgaa

SEQ ID NO: 4152289 - DNA, 13 bp, Homo sapiens
tcagactccgccc

SEQ ID NO: 4152290 - DNA, 23 bp, Homo sapiens
tcagactttaaagaataatatgc

SEQ ID NO: 4152291 - DNA, 20 bp, Homo sapiens
tcagagacaggaagtcttca

SEQ ID NO: 4152292 - DNA, 17 bp, Homo sapiens
tcagagatttatataaa

SEQ ID NO: 4152293 - DNA, 13 bp, Homo sapiens
tcagagccaagtc

SEQ ID NO: 4152294 - DNA, 18 bp, Homo sapiens
tcagagcccctacagcat

SEQ ID NO: 4152295 - DNA, 13 bp, Homo sapiens
tcagaggagctct

SEQ ID NO: 4152296 - DNA, 21 bp, Homo sapiens
tcagaggagtgattgaaccag

SEQ ID NO: 4152297 - DNA, 13 bp, Homo sapiens
tcagaggcctgct

SEQ ID NO: 4152298 - DNA, 18 bp, Homo sapiens
tcagaggcctgctgccag

SEQ ID NO: 4152299 - DNA, 16 bp, Homo sapiens
tcagaggtgtacacta

SEQ ID NO: 4152300 - DNA, 23 bp, Homo sapiens
tcagaggtttacctagagaacag

SEQ ID NO: 4152301 - DNA, 15 bp, Homo sapiens
tcagagtacgtcctg

SEQ ID NO: 4152302 - DNA, 21 bp, Homo sapiens
tcagagtcatttatgagcaga

SEQ ID NO: 4152303 - DNA, 21 bp, Homo sapiens
tcagagtccagtgctctgcct

SEQ ID NO: 4152304 - DNA, 23 bp, Homo sapiens
tcagagtccttgcaaaattgtct

SEQ ID NO: 4152305 - DNA, 19 bp, Homo sapiens
tcagatacatcactgcttg

SEQ ID NO: 4152306 - DNA, 15 bp, Homo sapiens
tcagatatcaaaatt

SEQ ID NO: 4152307 - DNA, 16 bp, Homo sapiens
tcagatatcaaaattc

SEQ ID NO: 4152308 - DNA, 21 bp, Homo sapiens
tcagatatttatatttttatt

SEQ ID NO: 4152309 - DNA, 22 bp, Homo sapiens
tcagatattttttcagaaatat

SEQ ID NO: 4152310 - DNA, 21 bp, Homo sapiens
tcagatcactgaatttataaa

SEQ ID NO: 4152311 - DNA, 23 bp, Homo sapiens
tcagatcagtgtaccatttgcct

SEQ ID NO: 4152312 - DNA, 16 bp, Homo sapiens
tcagatccagggacag

SEQ ID NO: 4152313 - DNA, 22 bp, Homo sapiens
tcagatctggtctagttaacct

SEQ ID NO: 4152314 - DNA, 14 bp, Homo sapiens
tcagatgagcaagg

SEQ ID NO: 4152315 - DNA, 17 bp, Homo sapiens
tcagatgagcaaggaca

SEQ ID NO: 4152316 - DNA, 19 bp, Homo sapiens
tcagatgagcaaggacatt

SEQ ID NO: 4152317 - DNA, 14 bp, Homo sapiens
tcagatggactggg

SEQ ID NO: 4152318 - DNA, 15 bp, Homo sapiens
tcagatggactggga

SEQ ID NO: 4152319 - DNA, 21 bp, Homo sapiens
tcagatggaggttctcagagc

SEQ ID NO: 4152320 - DNA, 15 bp, Homo sapiens
tcagatgggaagaca

SEQ ID NO: 4152321 - DNA, 13 bp, Homo sapiens
tcagattagatgt

SEQ ID NO: 4152322 - DNA, 14 bp, Homo sapiens
tcagattgtcttgc

SEQ ID NO: 4152323 - DNA, 18 bp, Homo sapiens
tcagattgtcttgcaact

SEQ ID NO: 4152324 - DNA, 15 bp, Homo sapiens
tcagcaaacaggatc

SEQ ID NO: 4152325 - DNA, 13 bp, Homo sapiens
tcagcaaaccatt

SEQ ID NO: 4152326 - DNA, 20 bp, Homo sapiens
tcagcaaaccatttttaaag

SEQ ID NO: 4152327 - DNA, 23 bp, Homo sapiens
tcagcaccaccctagtcccttcc

SEQ ID NO: 4152328 - DNA, 13 bp, Homo sapiens
tcagcacccccac

SEQ ID NO: 4152329 - DNA, 20 bp, Homo sapiens
tcagcacccccacccacctc

SEQ ID NO: 4152330 - DNA, 17 bp, Homo sapiens
tcagcactgatttcaca

SEQ ID NO: 4152331 - DNA, 12 bp, Homo sapiens
tcagcactgtcc

SEQ ID NO: 4152332 - DNA, 15 bp, Homo sapiens
tcagcagacacacat

SEQ ID NO: 4152333 - DNA, 20 bp, Homo sapiens
tcagcagactttctctgtgt

SEQ ID NO: 4152334 - DNA, 23 bp, Homo sapiens
tcagcagccgccttaagctgatc

SEQ ID NO: 4152335 - DNA, 14 bp, Homo sapiens
tcagcagctagaaa

SEQ ID NO: 4152336 - DNA, 17 bp, Homo sapiens
tcagcagctagaaaaca

SEQ ID NO: 4152337 - DNA, 13 bp, Homo sapiens
tcagcaggcagcc

SEQ ID NO: 4152338 - DNA, 16 bp, Homo sapiens
tcagcaggcagccttg

SEQ ID NO: 4152339 - DNA, 20 bp, Homo sapiens
tcagcagtacctataaagta

SEQ ID NO: 4152340 - DNA, 15 bp, Homo sapiens
tcagcagtcaataca

SEQ ID NO: 4152341 - DNA, 17 bp, Homo sapiens
tcagcagtgagagcaga

SEQ ID NO: 4152342 - DNA, 16 bp, Homo sapiens
tcagcatgcttcccag

SEQ ID NO: 4152343 - DNA, 18 bp, Homo sapiens
tcagcatgcttcccagag

SEQ ID NO: 4152344 - DNA, 20 bp, Homo sapiens
tcagcatgcttcccagaggg

SEQ ID NO: 4152345 - DNA, 17 bp, Homo sapiens
tcagcattctcactcct

SEQ ID NO: 4152346 - DNA, 16 bp, Homo sapiens
tcagcatttccttcca

SEQ ID NO: 4152347 - DNA, 21 bp, Homo sapiens
tcagcatttccttccagccca

SEQ ID NO: 4152348 - DNA, 14 bp, Homo sapiens
tcagccaaatgtaa

SEQ ID NO: 4152349 - DNA, 23 bp, Homo sapiens
tcagccaaatgtaattgaataaa

SEQ ID NO: 4152350 - DNA, 15 bp, Homo sapiens
tcagccacacccagg

SEQ ID NO: 4152351 - DNA, 17 bp, Homo sapiens
tcagccacacccaggca

SEQ ID NO: 4152352 - DNA, 12 bp, Homo sapiens
tcagccagcact

SEQ ID NO: 4152353 - DNA, 23 bp, Homo sapiens
tcagccagcacttgtccagctga

SEQ ID NO: 4152354 - DNA, 17 bp, Homo sapiens
tcagccagccgccctgg

SEQ ID NO: 4152355 - DNA, 23 bp, Homo sapiens
tcagccagccgccctgggctgtc

SEQ ID NO: 4152356 - DNA, 16 bp, Homo sapiens
tcagccaggctgctaa

SEQ ID NO: 4152357 - DNA, 16 bp, Homo sapiens
tcagccagggccaggg

SEQ ID NO: 4152358 - DNA, 18 bp, Homo sapiens
tcagccagggccaggggt

SEQ ID NO: 4152359 - DNA, 16 bp, Homo sapiens
tcagccccgagctgtc

SEQ ID NO: 4152360 - DNA, 18 bp, Homo sapiens
tcagccgagccgggcctg

SEQ ID NO: 4152361 - DNA, 21 bp, Homo sapiens
tcagccgagccgggcctgggg

SEQ ID NO: 4152362 - DNA, 19 bp, Homo sapiens
tcagcctcagaggagctct

SEQ ID NO: 4152363 - DNA, 20 bp, Homo sapiens
tcagcctccggagtagctgg

SEQ ID NO: 4152364 - DNA, 11 bp, Homo sapiens
tcagcctgagt

SEQ ID NO: 4152365 - DNA, 16 bp, Homo sapiens
tcagcctgctgcccag

SEQ ID NO: 4152366 - DNA, 21 bp, Homo sapiens
tcagcctgctgcccaggctgt

SEQ ID NO: 4152367 - DNA, 11 bp, Homo sapiens
tcagcctggcc

SEQ ID NO: 4152368 - DNA, 13 bp, Homo sapiens
tcagcctggcctg

SEQ ID NO: 4152369 - DNA, 19 bp, Homo sapiens
tcagcctggcctgcccgtg

SEQ ID NO: 4152370 - DNA, 14 bp, Homo sapiens
tcagccttgccaga

SEQ ID NO: 4152371 - DNA, 15 bp, Homo sapiens
tcagctactaatgat

SEQ ID NO: 4152372 - DNA, 14 bp, Homo sapiens
tcagctccaggtgg

SEQ ID NO: 4152373 - DNA, 19 bp, Homo sapiens
tcagctccaggtggctctg

SEQ ID NO: 4152374 - DNA, 16 bp, Homo sapiens
tcagctcctacctctg

SEQ ID NO: 4152375 - DNA, 18 bp, Homo sapiens
tcagctcctacctctgtg

SEQ ID NO: 4152376 - DNA, 22 bp, Homo sapiens
tcagctcctacctctgtgccag

SEQ ID NO: 4152377 - DNA, 14 bp, Homo sapiens
tcagctctctggga

SEQ ID NO: 4152378 - DNA, 21 bp, Homo sapiens
tcagctctctgggacctcctt

SEQ ID NO: 4152379 - DNA, 11 bp, Homo sapiens
tcagctctggg

SEQ ID NO: 4152380 - DNA, 13 bp, Homo sapiens
tcagctctttttg

SEQ ID NO: 4152381 - DNA, 13 bp, Homo sapiens
tcagctgagccct

SEQ ID NO: 4152382 - DNA, 12 bp, Homo sapiens
tcagctgagcct

SEQ ID NO: 4152383 - DNA, 21 bp, Homo sapiens
tcagctgagccttctgagctg

SEQ ID NO: 4152384 - DNA, 12 bp, Homo sapiens
tcagctgcctca

SEQ ID NO: 4152385 - DNA, 15 bp, Homo sapiens
tcagctgcctgaaac

SEQ ID NO: 4152386 - DNA, 22 bp, Homo sapiens
tcagctgcctgaaacagccatg

SEQ ID NO: 4152387 - DNA, 23 bp, Homo sapiens
tcagctgcctgaaacagccatgt

SEQ ID NO: 4152388 - DNA, 18 bp, Homo sapiens
tcagctggttactcaggg

SEQ ID NO: 4152389 - DNA, 23 bp, Homo sapiens
tcagctgtaagaagagactggga

SEQ ID NO: 4152390 - DNA, 16 bp, Homo sapiens
tcagctgtagtcctca

SEQ ID NO: 4152391 - DNA, 15 bp, Homo sapiens
tcagctgtcctgcag

SEQ ID NO: 4152392 - DNA, 17 bp, Homo sapiens
tcagctgtcctgcagca

SEQ ID NO: 4152393 - DNA, 19 bp, Homo sapiens
tcagctgtcctgcagcaaa

SEQ ID NO: 4152394 - DNA, 17 bp, Homo sapiens
tcagctgtctgtggctt

SEQ ID NO: 4152395 - DNA, 18 bp, Homo sapiens
tcagctgttgcagatgaa

SEQ ID NO: 4152396 - DNA, 19 bp, Homo sapiens
tcagcttatctcttttata

SEQ ID NO: 4152397 - DNA, 16 bp, Homo sapiens
tcagcttcttcctagg

SEQ ID NO: 4152398 - DNA, 12 bp, Homo sapiens
tcagctttgact

SEQ ID NO: 4152399 - DNA, 17 bp, Homo sapiens
tcagctttgactttatc

SEQ ID NO: 4152400 - DNA, 18 bp, Homo sapiens
tcagcttttgttgtttat

SEQ ID NO: 4152401 - DNA, 19 bp, Homo sapiens
tcaggaaatatatatgtgt

SEQ ID NO: 4152402 - DNA, 20 bp, Homo sapiens
tcaggaaatatatatgtgtg

SEQ ID NO: 4152403 - DNA, 14 bp, Homo sapiens
tcaggaacagaagg

SEQ ID NO: 4152404 - DNA, 18 bp, Homo sapiens
tcaggaacagtggctggg

SEQ ID NO: 4152405 - DNA, 21 bp, Homo sapiens
tcaggaacagtggctgggtgg

SEQ ID NO: 4152406 - DNA, 11 bp, Homo sapiens
tcaggaagctc

SEQ ID NO: 4152407 - DNA, 14 bp, Homo sapiens
tcaggaagctctct

SEQ ID NO: 4152408 - DNA, 20 bp, Homo sapiens
tcaggacagcatcccttccc

SEQ ID NO: 4152409 - DNA, 21 bp, Homo sapiens
tcaggacagcatcccttccca

SEQ ID NO: 4152410 - DNA, 22 bp, Homo sapiens
tcaggacagcatcccttcccac

SEQ ID NO: 4152411 - DNA, 17 bp, Homo sapiens
tcaggacctctgtaggc

SEQ ID NO: 4152412 - DNA, 14 bp, Homo sapiens
tcaggactcctctc

SEQ ID NO: 4152413 - DNA, 20 bp, Homo sapiens
tcaggacttaacggctccag

SEQ ID NO: 4152414 - DNA, 22 bp, Homo sapiens
tcaggagagtagaacagataat

SEQ ID NO: 4152415 - DNA, 13 bp, Homo sapiens
tcaggagggattg

SEQ ID NO: 4152416 - DNA, 17 bp, Homo sapiens
tcaggagttgtttctga

SEQ ID NO: 4152417 - DNA, 14 bp, Homo sapiens
tcaggatacatgtg

SEQ ID NO: 4152418 - DNA, 18 bp, Homo sapiens
tcaggatactctgtcaga

SEQ ID NO: 4152419 - DNA, 20 bp, Homo sapiens
tcaggatactctgtcagatg

SEQ ID NO: 4152420 - DNA, 23 bp, Homo sapiens
tcaggatattagttaatgagcca

SEQ ID NO: 4152421 - DNA, 17 bp, Homo sapiens
tcaggatgaacccagga

SEQ ID NO: 4152422 - DNA, 17 bp, Homo sapiens
tcaggcataggcctggg

SEQ ID NO: 4152423 - DNA, 19 bp, Homo sapiens
tcaggcataggcctgggtg

SEQ ID NO: 4152424 - DNA, 20 bp, Homo sapiens
tcaggcataggcctgggtgc

SEQ ID NO: 4152425 - DNA, 12 bp, Homo sapiens
tcaggcatggct

SEQ ID NO: 4152426 - DNA, 19 bp, Homo sapiens
tcaggcatggctcagagct

SEQ ID NO: 4152427 - DNA, 13 bp, Homo sapiens
tcaggccagccca

SEQ ID NO: 4152428 - DNA, 15 bp, Homo sapiens
tcaggccagcccagc

SEQ ID NO: 4152429 - DNA, 19 bp, Homo sapiens
tcaggccagcccagccagg

SEQ ID NO: 4152430 - DNA, 14 bp, Homo sapiens
tcaggcccccagtg

SEQ ID NO: 4152431 - DNA, 21 bp, Homo sapiens
tcaggcccggcagggcgggca

SEQ ID NO: 4152432 - DNA, 16 bp, Homo sapiens
tcaggccctgactcct

SEQ ID NO: 4152433 - DNA, 18 bp, Homo sapiens
tcaggccgggcagagcac

SEQ ID NO: 4152434 - DNA, 22 bp, Homo sapiens
tcaggcctataaccccagctcc

SEQ ID NO: 4152435 - DNA, 12 bp, Homo sapiens
tcaggcctgtgc

SEQ ID NO: 4152436 - DNA, 13 bp, Homo sapiens
tcaggcctgtgcc

SEQ ID NO: 4152437 - DNA, 16 bp, Homo sapiens
tcaggcctgtgcccac

SEQ ID NO: 4152438 - DNA, 17 bp, Homo sapiens
tcaggcctgtgcccact

SEQ ID NO: 4152439 - DNA, 13 bp, Homo sapiens
tcaggcctgtgtg

SEQ ID NO: 4152440 - DNA, 20 bp, Homo sapiens
tcaggcggggtgctgtggtg

SEQ ID NO: 4152441 - DNA, 18 bp, Homo sapiens
tcaggctatatgcagtcc

SEQ ID NO: 4152442 - DNA, 11 bp, Homo sapiens
tcaggctccat

SEQ ID NO: 4152443 - DNA, 16 bp, Homo sapiens
tcaggctccattagga

SEQ ID NO: 4152444 - DNA, 15 bp, Homo sapiens
tcaggctctctgggc

SEQ ID NO: 4152445 - DNA, 17 bp, Homo sapiens
tcaggctctctgggctg

SEQ ID NO: 4152446 - DNA, 15 bp, Homo sapiens
tcaggctctgctggt

SEQ ID NO: 4152447 - DNA, 21 bp, Homo sapiens
tcaggctctgtggagggcatt

SEQ ID NO: 4152448 - DNA, 13 bp, Homo sapiens
tcaggctgaggtg

SEQ ID NO: 4152449 - DNA, 17 bp, Homo sapiens
tcaggctgcagaggcac

SEQ ID NO: 4152450 - DNA, 15 bp, Homo sapiens
tcaggctgggcagcc

SEQ ID NO: 4152451 - DNA, 16 bp, Homo sapiens
tcaggctgggcagccc

SEQ ID NO: 4152452 - DNA, 19 bp, Homo sapiens
tcaggctgggcagccccag

SEQ ID NO: 4152453 - DNA, 20 bp, Homo sapiens
tcaggctgggcagccccaga

SEQ ID NO: 4152454 - DNA, 21 bp, Homo sapiens
tcaggctgggcagccccagag

SEQ ID NO: 4152455 - DNA, 15 bp, Homo sapiens
tcagggacagagcca

SEQ ID NO: 4152456 - DNA, 14 bp, Homo sapiens
tcagggatctcaga

SEQ ID NO: 4152457 - DNA, 15 bp, Homo sapiens
tcagggcagcgccag

SEQ ID NO: 4152458 - DNA, 22 bp, Homo sapiens
tcagggccaggcccaggcctca

SEQ ID NO: 4152459 - DNA, 13 bp, Homo sapiens
tcagggccagtcc

SEQ ID NO: 4152460 - DNA, 22 bp, Homo sapiens
tcagggccagtcctcctgggag

SEQ ID NO: 4152461 - DNA, 22 bp, Homo sapiens
tcagggcctggcaggccagtgt

SEQ ID NO: 4152462 - DNA, 20 bp, Homo sapiens
tcagggcctggggcctgaga

SEQ ID NO: 4152463 - DNA, 23 bp, Homo sapiens
tcagggcctggggcctgagagaa

SEQ ID NO: 4152464 - DNA, 13 bp, Homo sapiens
tcagggcgctcag

SEQ ID NO: 4152465 - DNA, 16 bp, Homo sapiens
tcagggcgctcagacg

SEQ ID NO: 4152466 - DNA, 14 bp, Homo sapiens
tcagggctcccagg

SEQ ID NO: 4152467 - DNA, 15 bp, Homo sapiens
tcagggctgtcccag

SEQ ID NO: 4152468 - DNA, 17 bp, Homo sapiens
tcaggggaaaactgtta

SEQ ID NO: 4152469 - DNA, 14 bp, Homo sapiens
tcaggggagaaaaa

SEQ ID NO: 4152470 - DNA, 12 bp, Homo sapiens
tcaggggccaga

SEQ ID NO: 4152471 - DNA, 18 bp, Homo sapiens
tcagggtcaaagacagaa

SEQ ID NO: 4152472 - DNA, 21 bp, Homo sapiens
tcagggtcaaagacagaatgg

SEQ ID NO: 4152473 - DNA, 18 bp, Homo sapiens
tcagggttcatctgtcca

SEQ ID NO: 4152474 - DNA, 17 bp, Homo sapiens
tcagggtttaatagact

SEQ ID NO: 4152475 - DNA, 16 bp, Homo sapiens
tcaggtcagggacttg

SEQ ID NO: 4152476 - DNA, 21 bp, Homo sapiens
tcaggtctcccacgtgggaga

SEQ ID NO: 4152477 - DNA, 17 bp, Homo sapiens
tcaggtgacatgtgaaa

SEQ ID NO: 4152478 - DNA, 14 bp, Homo sapiens
tcaggtgctcaatg

SEQ ID NO: 4152479 - DNA, 14 bp, Homo sapiens
tcaggtgttgccaa

SEQ ID NO: 4152480 - DNA, 17 bp, Homo sapiens
tcaggtgttttaagact

SEQ ID NO: 4152481 - DNA, 18 bp, Homo sapiens
tcaggtgttttaagactg

SEQ ID NO: 4152482 - DNA, 15 bp, Homo sapiens
tcaggttatactcct

SEQ ID NO: 4152483 - DNA, 20 bp, Homo sapiens
tcaggttatcgaaataacaa

SEQ ID NO: 4152484 - DNA, 15 bp, Homo sapiens
tcaggttctattttc

SEQ ID NO: 4152485 - DNA, 18 bp, Homo sapiens
tcaggttcttagtgtcac

SEQ ID NO: 4152486 - DNA, 22 bp, Homo sapiens
tcaggttgtctgaagtcactgc

SEQ ID NO: 4152487 - DNA, 19 bp, Homo sapiens
tcaggtttgtcatcagatg

SEQ ID NO: 4152488 - DNA, 22 bp, Homo sapiens
tcagtaaataacaggcatttgt

SEQ ID NO: 4152489 - DNA, 13 bp, Homo sapiens
tcagtaataactc

SEQ ID NO: 4152490 - DNA, 19 bp, Homo sapiens
tcagtagcttaagaaaaaa

SEQ ID NO: 4152491 - DNA, 17 bp, Homo sapiens
tcagtataaacaaagtt

SEQ ID NO: 4152492 - DNA, 13 bp, Homo sapiens
tcagtatccaggc

SEQ ID NO: 4152493 - DNA, 16 bp, Homo sapiens
tcagtatgtattcttt

SEQ ID NO: 4152494 - DNA, 22 bp, Homo sapiens
tcagtattaaaggggggagggg

SEQ ID NO: 4152495 - DNA, 20 bp, Homo sapiens
tcagtattagatgcacttaa

SEQ ID NO: 4152496 - DNA, 17 bp, Homo sapiens
tcagtcagaaaacttta

SEQ ID NO: 4152497 - DNA, 23 bp, Homo sapiens
tcagtcagaaaactttaaaaaat

SEQ ID NO: 4152498 - DNA, 15 bp, Homo sapiens
tcagtcatgcataaa

SEQ ID NO: 4152499 - DNA, 17 bp, Homo sapiens
tcagtccagaagaattg

SEQ ID NO: 4152500 - DNA, 14 bp, Homo sapiens
tcagtctccctttc

SEQ ID NO: 4152501 - DNA, 17 bp, Homo sapiens
tcagtctccctttccct

SEQ ID NO: 4152502 - DNA, 23 bp, Homo sapiens
tcagtctccctttcccttcttgg

SEQ ID NO: 4152503 - DNA, 23 bp, Homo sapiens
tcagtcttcacttgcactggggg

SEQ ID NO: 4152504 - DNA, 16 bp, Homo sapiens
tcagtgagcctcctgt

SEQ ID NO: 4152505 - DNA, 20 bp, Homo sapiens
tcagtggcttcatctgtcaa

SEQ ID NO: 4152506 - DNA, 19 bp, Homo sapiens
tcagtgggcaggataaact

SEQ ID NO: 4152507 - DNA, 20 bp, Homo sapiens
tcagtgtcatttatgaaaag

SEQ ID NO: 4152508 - DNA, 15 bp, Homo sapiens
tcagtgtcctttcca

SEQ ID NO: 4152509 - DNA, 11 bp, Homo sapiens
tcagtgtctgg

SEQ ID NO: 4152510 - DNA, 15 bp, Homo sapiens
tcagtgtctggcttt

SEQ ID NO: 4152511 - DNA, 17 bp, Homo sapiens
tcagtgttacctgtgtg

SEQ ID NO: 4152512 - DNA, 19 bp, Homo sapiens
tcagtgttacctgtgtgct

SEQ ID NO: 4152513 - DNA, 15 bp, Homo sapiens
tcagtgtttctgggg

SEQ ID NO: 4152514 - DNA, 15 bp, Homo sapiens
tcagtgttttggact

SEQ ID NO: 4152515 - DNA, 23 bp, Homo sapiens
tcagtgttttggactccatctct

SEQ ID NO: 4152516 - DNA, 16 bp, Homo sapiens
tcagttaactattgca

SEQ ID NO: 4152517 - DNA, 21 bp, Homo sapiens
tcagttacaaagtaatttctt

SEQ ID NO: 4152518 - DNA, 20 bp, Homo sapiens
tcagttacaagattgtaagt

SEQ ID NO: 4152519 - DNA, 16 bp, Homo sapiens
tcagttattcattctg

SEQ ID NO: 4152520 - DNA, 20 bp, Homo sapiens
tcagttccaggcctgatctt

SEQ ID NO: 4152521 - DNA, 15 bp, Homo sapiens
tcagttcccttggcc

SEQ ID NO: 4152522 - DNA, 16 bp, Homo sapiens
tcagttcctttgtgtg

SEQ ID NO: 4152523 - DNA, 18 bp, Homo sapiens
tcagttcttggtgctctg

SEQ ID NO: 4152524 - DNA, 21 bp, Homo sapiens
tcagttcttggtgctctgtgt

SEQ ID NO: 4152525 - DNA, 16 bp, Homo sapiens
tcagttggagtttgtg

SEQ ID NO: 4152526 - DNA, 16 bp, Homo sapiens
tcagttggttgtgtct

SEQ ID NO: 4152527 - DNA, 19 bp, Homo sapiens
tcagttgtttgtttttgct

SEQ ID NO: 4152528 - DNA, 23 bp, Homo sapiens
tcagtttatccaaggtgtaactc

SEQ ID NO: 4152529 - DNA, 16 bp, Homo sapiens
tcagtttatgttgtac

SEQ ID NO: 4152530 - DNA, 21 bp, Homo sapiens
tcagtttatgttgtacaatgt

SEQ ID NO: 4152531 - DNA, 20 bp, Homo sapiens
tcagtttgaaaatattttgt

SEQ ID NO: 4152532 - DNA, 15 bp, Homo sapiens
tcagtttgtgtgtct

SEQ ID NO: 4152533 - DNA, 16 bp, Homo sapiens
tcagttttatcatttt

SEQ ID NO: 4152534 - DNA, 14 bp, Homo sapiens
tcagttttatcttt

SEQ ID NO: 4152535 - DNA, 12 bp, Homo sapiens
tcagttttcatt

SEQ ID NO: 4152536 - DNA, 20 bp, Homo sapiens
tcataaaaagcaaaacaaaa

SEQ ID NO: 4152537 - DNA, 23 bp, Homo sapiens
tcataaaatcaaaacaagtgaaa

SEQ ID NO: 4152538 - DNA, 11 bp, Homo sapiens
tcataaatgaa

SEQ ID NO: 4152539 - DNA, 14 bp, Homo sapiens
tcataaatgaattt

SEQ ID NO: 4152540 - DNA, 16 bp, Homo sapiens
tcataaccaacaatat

SEQ ID NO: 4152541 - DNA, 22 bp, Homo sapiens
tcataaccaacaatataaaccg

SEQ ID NO: 4152542 - DNA, 21 bp, Homo sapiens
tcataagaatttttcagcact

SEQ ID NO: 4152543 - DNA, 19 bp, Homo sapiens
tcataataaatatctgtac

SEQ ID NO: 4152544 - DNA, 15 bp, Homo sapiens
tcataataggtagtt

SEQ ID NO: 4152545 - DNA, 20 bp, Homo sapiens
tcataattaaaatttatctt

SEQ ID NO: 4152546 - DNA, 18 bp, Homo sapiens
tcataattcctacagcac

SEQ ID NO: 4152547 - DNA, 14 bp, Homo sapiens
tcataattttgcaa

SEQ ID NO: 4152548 - DNA, 14 bp, Homo sapiens
tcatacaaaataaa

SEQ ID NO: 4152549 - DNA, 13 bp, Homo sapiens
tcatacacagaaa

SEQ ID NO: 4152550 - DNA, 14 bp, Homo sapiens
tcatacctcagaat

SEQ ID NO: 4152551 - DNA, 20 bp, Homo sapiens
tcatactactgaaacagatt

SEQ ID NO: 4152552 - DNA, 20 bp, Homo sapiens
tcatagcaagcttttgctca

SEQ ID NO: 4152553 - DNA, 18 bp, Homo sapiens
tcatagcagattttaatt

SEQ ID NO: 4152554 - DNA, 21 bp, Homo sapiens
tcatagcattaactaatctat

SEQ ID NO: 4152555 - DNA, 17 bp, Homo sapiens
tcatagccataaatgat

SEQ ID NO: 4152556 - DNA, 17 bp, Homo sapiens
tcatagctgagattcct

SEQ ID NO: 4152557 - DNA, 20 bp, Homo sapiens
tcataggaaaagtacattta

SEQ ID NO: 4152558 - DNA, 15 bp, Homo sapiens
tcatagggaaaggtt

SEQ ID NO: 4152559 - DNA, 21 bp, Homo sapiens
tcatagggaaaggttttgtat

SEQ ID NO: 4152560 - DNA, 17 bp, Homo sapiens
tcatagggtctcttcag

SEQ ID NO: 4152561 - DNA, 21 bp, Homo sapiens
tcatagggtctcttcaggttc

SEQ ID NO: 4152562 - DNA, 14 bp, Homo sapiens
tcatagtaacttct

SEQ ID NO: 4152563 - DNA, 16 bp, Homo sapiens
tcatagtattggagca

SEQ ID NO: 4152564 - DNA, 14 bp, Homo sapiens
tcatagttcagaat

SEQ ID NO: 4152565 - DNA, 14 bp, Homo sapiens
tcatagtttattat

SEQ ID NO: 4152566 - DNA, 16 bp, Homo sapiens
tcatataccagcaata

SEQ ID NO: 4152567 - DNA, 17 bp, Homo sapiens
tcatataccagcaatat

SEQ ID NO: 4152568 - DNA, 15 bp, Homo sapiens
tcatatactgccatg

SEQ ID NO: 4152569 - DNA, 21 bp, Homo sapiens
tcatatcatcacattgagctg

SEQ ID NO: 4152570 - DNA, 20 bp, Homo sapiens
tcatatgttgctcagtctcc

SEQ ID NO: 4152571 - DNA, 15 bp, Homo sapiens
tcatattgatgaaaa

SEQ ID NO: 4152572 - DNA, 18 bp, Homo sapiens
tcatattgatgaaaagat

SEQ ID NO: 4152573 - DNA, 19 bp, Homo sapiens
tcatattgatgaaaagatt

SEQ ID NO: 4152574 - DNA, 12 bp, Homo sapiens
tcatatttaaag

SEQ ID NO: 4152575 - DNA, 15 bp, Homo sapiens
tcatatttacttctt

SEQ ID NO: 4152576 - DNA, 16 bp, Homo sapiens
tcatatttacttctta

SEQ ID NO: 4152577 - DNA, 23 bp, Homo sapiens
tcatcaatcaaataagtatttat

SEQ ID NO: 4152578 - DNA, 14 bp, Homo sapiens
tcatcacactgggt

SEQ ID NO: 4152579 - DNA, 15 bp, Homo sapiens
tcatcactggatgaa

SEQ ID NO: 4152580 - DNA, 22 bp, Homo sapiens
tcatcactggatgaagattctc

SEQ ID NO: 4152581 - DNA, 15 bp, Homo sapiens
tcatcagatggaaat

SEQ ID NO: 4152582 - DNA, 13 bp, Homo sapiens
tcatcagggcctg

SEQ ID NO: 4152583 - DNA, 16 bp, Homo sapiens
tcatcagggcctgggg

SEQ ID NO: 4152584 - DNA, 13 bp, Homo sapiens
tcatcatcagggc

SEQ ID NO: 4152585 - DNA, 20 bp, Homo sapiens
tcatcatggaggtcatacat

SEQ ID NO: 4152586 - DNA, 22 bp, Homo sapiens
tcatcattgtttctgcatgaat

SEQ ID NO: 4152587 - DNA, 21 bp, Homo sapiens
tcatccaaaatattttttgca

SEQ ID NO: 4152588 - DNA, 22 bp, Homo sapiens
tcatccaaaatattttttgcaa

SEQ ID NO: 4152589 - DNA, 12 bp, Homo sapiens
tcatccaacaag

SEQ ID NO: 4152590 - DNA, 13 bp, Homo sapiens
tcatccaacaaga

SEQ ID NO: 4152591 - DNA, 18 bp, Homo sapiens
tcatccaacaagaagaaa

SEQ ID NO: 4152592 - DNA, 19 bp, Homo sapiens
tcatccaacaagaagaaat

SEQ ID NO: 4152593 - DNA, 17 bp, Homo sapiens
tcatccaacttatgttt

SEQ ID NO: 4152594 - DNA, 19 bp, Homo sapiens
tcatccaatcctcactggg

SEQ ID NO: 4152595 - DNA, 12 bp, Homo sapiens
tcatccacccca

SEQ ID NO: 4152596 - DNA, 14 bp, Homo sapiens
tcatccaccccatc

SEQ ID NO: 4152597 - DNA, 20 bp, Homo sapiens
tcatccaccccatccctccc

SEQ ID NO: 4152598 - DNA, 16 bp, Homo sapiens
tcatccagcagtgttg

SEQ ID NO: 4152599 - DNA, 20 bp, Homo sapiens
tcatccaggcccaactgtga

SEQ ID NO: 4152600 - DNA, 21 bp, Homo sapiens
tcatcccattaatcatttccc

SEQ ID NO: 4152601 - DNA, 18 bp, Homo sapiens
tcatccccatcctccaga

SEQ ID NO: 4152602 - DNA, 14 bp, Homo sapiens
tcatcccttctctt

SEQ ID NO: 4152603 - DNA, 13 bp, Homo sapiens
tcatcctccagta

SEQ ID NO: 4152604 - DNA, 11 bp, Homo sapiens
tcatcctcctg

SEQ ID NO: 4152605 - DNA, 17 bp, Homo sapiens
tcatcctgccttcatgg

SEQ ID NO: 4152606 - DNA, 17 bp, Homo sapiens
tcatccttggtctttgt

SEQ ID NO: 4152607 - DNA, 20 bp, Homo sapiens
tcatccttggtctttgtatc

SEQ ID NO: 4152608 - DNA, 16 bp, Homo sapiens
tcatcctttgttctga

SEQ ID NO: 4152609 - DNA, 17 bp, Homo sapiens
tcatccttttggataag

SEQ ID NO: 4152610 - DNA, 23 bp, Homo sapiens
tcatcggaggctgggcccctggg

SEQ ID NO: 4152611 - DNA, 13 bp, Homo sapiens
tcatctataaaga

SEQ ID NO: 4152612 - DNA, 21 bp, Homo sapiens
tcatctattcaagcacttaca

SEQ ID NO: 4152613 - DNA, 16 bp, Homo sapiens
tcatctcaggtagaag

SEQ ID NO: 4152614 - DNA, 13 bp, Homo sapiens
tcatctccatcag

SEQ ID NO: 4152615 - DNA, 16 bp, Homo sapiens
tcatctctctgcccaa

SEQ ID NO: 4152616 - DNA, 13 bp, Homo sapiens
tcatctctctggg

SEQ ID NO: 4152617 - DNA, 14 bp, Homo sapiens
tcatctctctgggg

SEQ ID NO: 4152618 - DNA, 16 bp, Homo sapiens
tcatctctctggggcc

SEQ ID NO: 4152619 - DNA, 21 bp, Homo sapiens
tcatctggataggagcctgct

SEQ ID NO: 4152620 - DNA, 20 bp, Homo sapiens
tcatctggggttggcaacag

SEQ ID NO: 4152621 - DNA, 23 bp, Homo sapiens
tcatctggggttggcaacaggac

SEQ ID NO: 4152622 - DNA, 23 bp, Homo sapiens
tcatctggttgaactctggtggc

SEQ ID NO: 4152623 - DNA, 17 bp, Homo sapiens
tcatctgtagatactag

SEQ ID NO: 4152624 - DNA, 19 bp, Homo sapiens
tcatctgttagggccttgg

SEQ ID NO: 4152625 - DNA, 14 bp, Homo sapiens
tcatcttcctgtgt

SEQ ID NO: 4152626 - DNA, 14 bp, Homo sapiens
tcatgaaatatgca

SEQ ID NO: 4152627 - DNA, 12 bp, Homo sapiens
tcatgaagccca

SEQ ID NO: 4152628 - DNA, 16 bp, Homo sapiens
tcatgaattttacatg

SEQ ID NO: 4152629 - DNA, 21 bp, Homo sapiens
tcatgacccctcgtccacccc

SEQ ID NO: 4152630 - DNA, 13 bp, Homo sapiens
tcatgagcctgct

SEQ ID NO: 4152631 - DNA, 16 bp, Homo sapiens
tcatgatgctctttcc

SEQ ID NO: 4152632 - DNA, 23 bp, Homo sapiens
tcatgatgctctttcccacccag

SEQ ID NO: 4152633 - DNA, 13 bp, Homo sapiens
tcatgattagcaa

SEQ ID NO: 4152634 - DNA, 17 bp, Homo sapiens
tcatgatttcatttcaa

SEQ ID NO: 4152635 - DNA, 11 bp, Homo sapiens
tcatgcaaaat

SEQ ID NO: 4152636 - DNA, 15 bp, Homo sapiens
tcatgcaatgacatc

SEQ ID NO: 4152637 - DNA, 15 bp, Homo sapiens
tcatgcatttcaagc

SEQ ID NO: 4152638 - DNA, 19 bp, Homo sapiens
tcatgccaccatggccagc

SEQ ID NO: 4152639 - DNA, 12 bp, Homo sapiens
tcatgccagcta

SEQ ID NO: 4152640 - DNA, 23 bp, Homo sapiens
tcatgccagctacttcctcctcc

SEQ ID NO: 4152641 - DNA, 13 bp, Homo sapiens
tcatgcccacccc

SEQ ID NO: 4152642 - DNA, 19 bp, Homo sapiens
tcatgcccaccccctgccc

SEQ ID NO: 4152643 - DNA, 17 bp, Homo sapiens
tcatgcctttcatagtt

SEQ ID NO: 4152644 - DNA, 21 bp, Homo sapiens
tcatgcctttcatagtttatt

SEQ ID NO: 4152645 - DNA, 16 bp, Homo sapiens
tcatgcggtgggtgct

SEQ ID NO: 4152646 - DNA, 19 bp, Homo sapiens
tcatgcggtgggtgctgcc

SEQ ID NO: 4152647 - DNA, 19 bp, Homo sapiens
tcatgctcccctgtgccag

SEQ ID NO: 4152648 - DNA, 16 bp, Homo sapiens
tcatggactgttgcca

SEQ ID NO: 4152649 - DNA, 23 bp, Homo sapiens
tcatggatgggggaactcagatc

SEQ ID NO: 4152650 - DNA, 19 bp, Homo sapiens
tcatggcagctgtttctca

SEQ ID NO: 4152651 - DNA, 22 bp, Homo sapiens
tcatggcagctgtttctcatga

SEQ ID NO: 4152652 - DNA, 17 bp, Homo sapiens
tcatggcccccaggggc

SEQ ID NO: 4152653 - DNA, 19 bp, Homo sapiens
tcatggcccccaggggcag

SEQ ID NO: 4152654 - DNA, 21 bp, Homo sapiens
tcatggcccccaggggcagga

SEQ ID NO: 4152655 - DNA, 14 bp, Homo sapiens
tcatggcccctctg

SEQ ID NO: 4152656 - DNA, 18 bp, Homo sapiens
tcatggcttaatgtttat

SEQ ID NO: 4152657 - DNA, 17 bp, Homo sapiens
tcatggggatcaatttt

SEQ ID NO: 4152658 - DNA, 19 bp, Homo sapiens
tcatggggatcaattttca

SEQ ID NO: 4152659 - DNA, 17 bp, Homo sapiens
tcatgggtcctagccct

SEQ ID NO: 4152660 - DNA, 22 bp, Homo sapiens
tcatgggtcctagcccttccct

SEQ ID NO: 4152661 - DNA, 16 bp, Homo sapiens
tcatggtgtaataaga

SEQ ID NO: 4152662 - DNA, 20 bp, Homo sapiens
tcatggtgtaataagacata

SEQ ID NO: 4152663 - DNA, 15 bp, Homo sapiens
tcatggtttccattt

SEQ ID NO: 4152664 - DNA, 15 bp, Homo sapiens
tcatgtaaaacagaa

SEQ ID NO: 4152665 - DNA, 18 bp, Homo sapiens
tcatgtaaaacagaaaaa

SEQ ID NO: 4152666 - DNA, 22 bp, Homo sapiens
tcatgtaaagaaatgtcttaat

SEQ ID NO: 4152667 - DNA, 14 bp, Homo sapiens
tcatgtaacacata

SEQ ID NO: 4152668 - DNA, 20 bp, Homo sapiens
tcatgtaacacataaacaat

SEQ ID NO: 4152669 - DNA, 20 bp, Homo sapiens
tcatgtagagaaaagcacac

SEQ ID NO: 4152670 - DNA, 20 bp, Homo sapiens
tcatgtatcatctggatagg

SEQ ID NO: 4152671 - DNA, 19 bp, Homo sapiens
tcatgtatgttatgatatt

SEQ ID NO: 4152672 - DNA, 17 bp, Homo sapiens
tcatgtcaacttctggc

SEQ ID NO: 4152673 - DNA, 21 bp, Homo sapiens
tcatgtcaacttctggctcct

SEQ ID NO: 4152674 - DNA, 14 bp, Homo sapiens
tcatgtcaggcctg

SEQ ID NO: 4152675 - DNA, 14 bp, Homo sapiens
tcatgtgcctctgc

SEQ ID NO: 4152676 - DNA, 20 bp, Homo sapiens
tcatgtgggtgagccagtgg

SEQ ID NO: 4152677 - DNA, 16 bp, Homo sapiens
tcatgttcactgtgag

SEQ ID NO: 4152678 - DNA, 19 bp, Homo sapiens
tcatgttcccacttcaaaa

SEQ ID NO: 4152679 - DNA, 22 bp, Homo sapiens
tcatgttcccacttcaaaacaa

SEQ ID NO: 4152680 - DNA, 23 bp, Homo sapiens
tcatgttcccacttcaaaacaaa

SEQ ID NO: 4152681 - DNA, 15 bp, Homo sapiens
tcatgtttttgatca

SEQ ID NO: 4152682 - DNA, 14 bp, Homo sapiens
tcattaaacttgaa

SEQ ID NO: 4152683 - DNA, 15 bp, Homo sapiens
tcattaaacttgaag

SEQ ID NO: 4152684 - DNA, 21 bp, Homo sapiens
tcattacttgattaagatttt

SEQ ID NO: 4152685 - DNA, 20 bp, Homo sapiens
tcattatatcattggaacaa

SEQ ID NO: 4152686 - DNA, 14 bp, Homo sapiens
tcattattggaggg

SEQ ID NO: 4152687 - DNA, 15 bp, Homo sapiens
tcattattttgtggt

SEQ ID NO: 4152688 - DNA, 17 bp, Homo sapiens
tcattatttttccactt

SEQ ID NO: 4152689 - DNA, 16 bp, Homo sapiens
tcattcaatacaagtg

SEQ ID NO: 4152690 - DNA, 13 bp, Homo sapiens
tcattccagtgct

SEQ ID NO: 4152691 - DNA, 14 bp, Homo sapiens
tcattccagtgcta

SEQ ID NO: 4152692 - DNA, 13 bp, Homo sapiens
tcattccattgcc

SEQ ID NO: 4152693 - DNA, 15 bp, Homo sapiens
tcattccattgccta

SEQ ID NO: 4152694 - DNA, 20 bp, Homo sapiens
tcattccctcgtctttccca

SEQ ID NO: 4152695 - DNA, 18 bp, Homo sapiens
tcattccctctcatctca

SEQ ID NO: 4152696 - DNA, 16 bp, Homo sapiens
tcattcctgaaagaaa

SEQ ID NO: 4152697 - DNA, 21 bp, Homo sapiens
tcattcctgaaagaaacagtt

SEQ ID NO: 4152698 - DNA, 22 bp, Homo sapiens
tcattcctgaaagaaacagtta

SEQ ID NO: 4152699 - DNA, 15 bp, Homo sapiens
tcattcgggatgatt

SEQ ID NO: 4152700 - DNA, 22 bp, Homo sapiens
tcattctacagaataatccagt

SEQ ID NO: 4152701 - DNA, 16 bp, Homo sapiens
tcattctaggatgtgg

SEQ ID NO: 4152702 - DNA, 14 bp, Homo sapiens
tcattctcctgcct

SEQ ID NO: 4152703 - DNA, 15 bp, Homo sapiens
tcattctcctgcctg

SEQ ID NO: 4152704 - DNA, 13 bp, Homo sapiens
tcattctgcattg

SEQ ID NO: 4152705 - DNA, 16 bp, Homo sapiens
tcattctgcattgcta

SEQ ID NO: 4152706 - DNA, 17 bp, Homo sapiens
tcattcttgaaagctgt

SEQ ID NO: 4152707 - DNA, 17 bp, Homo sapiens
tcattcttgaggagcat

SEQ ID NO: 4152708 - DNA, 15 bp, Homo sapiens
tcattgacctctcag

SEQ ID NO: 4152709 - DNA, 21 bp, Homo sapiens
tcattgacctctcagggcctg

SEQ ID NO: 4152710 - DNA, 16 bp, Homo sapiens
tcattgcctgtgtatg

SEQ ID NO: 4152711 - DNA, 23 bp, Homo sapiens
tcattgcctgtgtatggaaaaac

SEQ ID NO: 4152712 - DNA, 13 bp, Homo sapiens
tcattgcttacaa

SEQ ID NO: 4152713 - DNA, 18 bp, Homo sapiens
tcattggaacaactgata

SEQ ID NO: 4152714 - DNA, 20 bp, Homo sapiens
tcattgtaaccatttctcac

SEQ ID NO: 4152715 - DNA, 19 bp, Homo sapiens
tcattgtaatgttactgat

SEQ ID NO: 4152716 - DNA, 20 bp, Homo sapiens
tcattgtaatgttactgatc

SEQ ID NO: 4152717 - DNA, 22 bp, Homo sapiens
tcattgtccagagctgcttccc

SEQ ID NO: 4152718 - DNA, 12 bp, Homo sapiens
tcattgttctcc

SEQ ID NO: 4152719 - DNA, 23 bp, Homo sapiens
tcattgtttattaacaaattatg

SEQ ID NO: 4152720 - DNA, 17 bp, Homo sapiens
tcatttaaaatgattag

SEQ ID NO: 4152721 - DNA, 13 bp, Homo sapiens
tcatttaatttgt

SEQ ID NO: 4152722 - DNA, 15 bp, Homo sapiens
tcatttactaaacat

SEQ ID NO: 4152723 - DNA, 12 bp, Homo sapiens
tcatttagaact

SEQ ID NO: 4152724 - DNA, 17 bp, Homo sapiens
tcatttagcatgttgtt

SEQ ID NO: 4152725 - DNA, 18 bp, Homo sapiens
tcatttagtcatgtgacc

SEQ ID NO: 4152726 - DNA, 15 bp, Homo sapiens
tcatttatgaaaaga

SEQ ID NO: 4152727 - DNA, 18 bp, Homo sapiens
tcatttcatcctttcact

SEQ ID NO: 4152728 - DNA, 15 bp, Homo sapiens
tcatttcatgaaaat

SEQ ID NO: 4152729 - DNA, 15 bp, Homo sapiens
tcatttcattccatt

SEQ ID NO: 4152730 - DNA, 16 bp, Homo sapiens
tcatttcattccattg

SEQ ID NO: 4152731 - DNA, 22 bp, Homo sapiens
tcatttccccataactcaatgg

SEQ ID NO: 4152732 - DNA, 18 bp, Homo sapiens
tcatttctactgtgactg

SEQ ID NO: 4152733 - DNA, 22 bp, Homo sapiens
tcatttctcataattttgcaaa

SEQ ID NO: 4152734 - DNA, 15 bp, Homo sapiens
tcatttcttcctcag

SEQ ID NO: 4152735 - DNA, 20 bp, Homo sapiens
tcatttcttgtcaattatgt

SEQ ID NO: 4152736 - DNA, 16 bp, Homo sapiens
tcatttgatgctaaat

SEQ ID NO: 4152737 - DNA, 19 bp, Homo sapiens
tcatttgcccttaaggaca

SEQ ID NO: 4152738 - DNA, 16 bp, Homo sapiens
tcatttggtctgccag

SEQ ID NO: 4152739 - DNA, 17 bp, Homo sapiens
tcatttggtctgccaga

SEQ ID NO: 4152740 - DNA, 19 bp, Homo sapiens
tcatttggtctgccagaat

SEQ ID NO: 4152741 - DNA, 18 bp, Homo sapiens
tcatttggttcattaatt

SEQ ID NO: 4152742 - DNA, 20 bp, Homo sapiens
tcatttggttcattaattct

SEQ ID NO: 4152743 - DNA, 21 bp, Homo sapiens
tcatttgtggcagtcccttat

SEQ ID NO: 4152744 - DNA, 16 bp, Homo sapiens
tcatttgttgtgatgt

SEQ ID NO: 4152745 - DNA, 22 bp, Homo sapiens
tcatttgttgtgatgtcttttc

SEQ ID NO: 4152746 - DNA, 18 bp, Homo sapiens
tcattttacccttggctc

SEQ ID NO: 4152747 - DNA, 10 bp, Homo sapiens
tcattttcct

SEQ ID NO: 4152748 - DNA, 13 bp, Homo sapiens
tcattttcctgtt

SEQ ID NO: 4152749 - DNA, 15 bp, Homo sapiens
tcattttctataaca

SEQ ID NO: 4152750 - DNA, 16 bp, Homo sapiens
tcattttctataacag

SEQ ID NO: 4152751 - DNA, 12 bp, Homo sapiens
tcattttctgac

SEQ ID NO: 4152752 - DNA, 21 bp, Homo sapiens
tcattttctgacatgcattgt

SEQ ID NO: 4152753 - DNA, 21 bp, Homo sapiens
tcattttcttatcttctgcaa

SEQ ID NO: 4152754 - DNA, 13 bp, Homo sapiens
tcattttggagct

SEQ ID NO: 4152755 - DNA, 23 bp, Homo sapiens
tcattttggtttatttttgtaat

SEQ ID NO: 4152756 - DNA, 17 bp, Homo sapiens
tcatttttgccatacat

SEQ ID NO: 4152757 - DNA, 14 bp, Homo sapiens
tccaaaaaaaggaa

SEQ ID NO: 4152758 - DNA, 16 bp, Homo sapiens
tccaaaaaaaggaaaa

SEQ ID NO: 4152759 - DNA, 14 bp, Homo sapiens
tccaaaaaattaaa

SEQ ID NO: 4152760 - DNA, 14 bp, Homo sapiens
tccaaaaattatta

SEQ ID NO: 4152761 - DNA, 23 bp, Homo sapiens
tccaaaacttctcttgaaaagtt

SEQ ID NO: 4152762 - DNA, 14 bp, Homo sapiens
tccaaaagaaaaac

SEQ ID NO: 4152763 - DNA, 15 bp, Homo sapiens
tccaaaagaagcccc

SEQ ID NO: 4152764 - DNA, 18 bp, Homo sapiens
tccaaaagaagcccccag

SEQ ID NO: 4152765 - DNA, 22 bp, Homo sapiens
tccaaacactgaggcagccttg

SEQ ID NO: 4152766 - DNA, 16 bp, Homo sapiens
tccaaaccaaataaaa

SEQ ID NO: 4152767 - DNA, 14 bp, Homo sapiens
tccaaacctccagc

SEQ ID NO: 4152768 - DNA, 15 bp, Homo sapiens
tccaaacctccagcc

SEQ ID NO: 4152769 - DNA, 19 bp, Homo sapiens
tccaaacctccagcctccc

SEQ ID NO: 4152770 - DNA, 20 bp, Homo sapiens
tccaaacctccagcctccct

SEQ ID NO: 4152771 - DNA, 22 bp, Homo sapiens
tccaaacctccagcctccctgt

SEQ ID NO: 4152772 - DNA, 22 bp, Homo sapiens
tccaaagaacttgatttgcatg

SEQ ID NO: 4152773 - DNA, 15 bp, Homo sapiens
tccaaagtaaaattg

SEQ ID NO: 4152774 - DNA, 19 bp, Homo sapiens
tccaaagtcagatctggtc

SEQ ID NO: 4152775 - DNA, 16 bp, Homo sapiens
tccaaatgcaatttga

SEQ ID NO: 4152776 - DNA, 18 bp, Homo sapiens
tccaaatggcgtctggaa

SEQ ID NO: 4152777 - DNA, 20 bp, Homo sapiens
tccaaatgtcctccagaagc

SEQ ID NO: 4152778 - DNA, 16 bp, Homo sapiens
tccaaattcagtttca

SEQ ID NO: 4152779 - DNA, 13 bp, Homo sapiens
tccaacaagaaga

SEQ ID NO: 4152780 - DNA, 18 bp, Homo sapiens
tccaacaagaagaaatat

SEQ ID NO: 4152781 - DNA, 23 bp, Homo sapiens
tccaacaagaagaaatatgaaat

SEQ ID NO: 4152782 - DNA, 14 bp, Homo sapiens
tccaacaagaatgc

SEQ ID NO: 4152783 - DNA, 23 bp, Homo sapiens
tccaacaagaatgcattccctga

SEQ ID NO: 4152784 - DNA, 16 bp, Homo sapiens
tccaacaccacagaca

SEQ ID NO: 4152785 - DNA, 19 bp, Homo sapiens
tccaacccggggaccccca

SEQ ID NO: 4152786 - DNA, 18 bp, Homo sapiens
tccaactcccttaaaata

SEQ ID NO: 4152787 - DNA, 21 bp, Homo sapiens
tccaactggattataaataaa

SEQ ID NO: 4152788 - DNA, 23 bp, Homo sapiens
tccaactggccctatttagatga

SEQ ID NO: 4152789 - DNA, 11 bp, Homo sapiens
tccaagacatt

SEQ ID NO: 4152790 - DNA, 16 bp, Homo sapiens
tccaagacattgtcaa

SEQ ID NO: 4152791 - DNA, 14 bp, Homo sapiens
tccaagaggctgta

SEQ ID NO: 4152792 - DNA, 19 bp, Homo sapiens
tccaagatcaattccctct

SEQ ID NO: 4152793 - DNA, 23 bp, Homo sapiens
tccaagatcaattccctctctca

SEQ ID NO: 4152794 - DNA, 22 bp, Homo sapiens
tccaagcacagagcctggcccc

SEQ ID NO: 4152795 - DNA, 15 bp, Homo sapiens
tccaagccagcaagc

SEQ ID NO: 4152796 - DNA, 18 bp, Homo sapiens
tccaagccccccacacct

SEQ ID NO: 4152797 - DNA, 13 bp, Homo sapiens
tccaagcctgcct

SEQ ID NO: 4152798 - DNA, 12 bp, Homo sapiens
tccaagctggga

SEQ ID NO: 4152799 - DNA, 23 bp, Homo sapiens
tccaaggacagaaggctcctgcc

SEQ ID NO: 4152800 - DNA, 21 bp, Homo sapiens
tccaaggggaatcagaactca

SEQ ID NO: 4152801 - DNA, 20 bp, Homo sapiens
tccaaggggtcccctccagg

SEQ ID NO: 4152802 - DNA, 18 bp, Homo sapiens
tccaagggttgagagcca

SEQ ID NO: 4152803 - DNA, 19 bp, Homo sapiens
tccaagggttgagagccag

SEQ ID NO: 4152804 - DNA, 17 bp, Homo sapiens
tccaagtctcagtggct

SEQ ID NO: 4152805 - DNA, 20 bp, Homo sapiens
tccaagtctctctgtgaata

SEQ ID NO: 4152806 - DNA, 22 bp, Homo sapiens
tccaagtgccccctcacctctc

SEQ ID NO: 4152807 - DNA, 16 bp, Homo sapiens
tccaagttcttcacct

SEQ ID NO: 4152808 - DNA, 23 bp, Homo sapiens
tccaataaaaacattttgaagtg

SEQ ID NO: 4152809 - DNA, 14 bp, Homo sapiens
tccaataaaccagg

SEQ ID NO: 4152810 - DNA, 23 bp, Homo sapiens
tccaataagacactcaaatatga

SEQ ID NO: 4152811 - DNA, 17 bp, Homo sapiens
tccaatcctcactgggt

SEQ ID NO: 4152812 - DNA, 17 bp, Homo sapiens
tccaatcttgctttgtg

SEQ ID NO: 4152813 - DNA, 18 bp, Homo sapiens
tccaatgtggcaaggaaa

SEQ ID NO: 4152814 - DNA, 15 bp, Homo sapiens
tccaattagtttcct

SEQ ID NO: 4152815 - DNA, 20 bp, Homo sapiens
tccaattagtttccttttta

SEQ ID NO: 4152816 - DNA, 18 bp, Homo sapiens
tccacaaggaataaatga

SEQ ID NO: 4152817 - DNA, 17 bp, Homo sapiens
tccacaagttaaataaa

SEQ ID NO: 4152818 - DNA, 15 bp, Homo sapiens
tccacacacgcagga

SEQ ID NO: 4152819 - DNA, 16 bp, Homo sapiens
tccacaccagtggcct

SEQ ID NO: 4152820 - DNA, 15 bp, Homo sapiens
tccacaccttttatt

SEQ ID NO: 4152821 - DNA, 19 bp, Homo sapiens
tccacagcaaccccaggct

SEQ ID NO: 4152822 - DNA, 15 bp, Homo sapiens
tccacagcctgcaag

SEQ ID NO: 4152823 - DNA, 12 bp, Homo sapiens
tccacagttgcc

SEQ ID NO: 4152824 - DNA, 21 bp, Homo sapiens
tccacagttgccaccacctct

SEQ ID NO: 4152825 - DNA, 15 bp, Homo sapiens
tccacatctgcctta

SEQ ID NO: 4152826 - DNA, 17 bp, Homo sapiens
tccaccaagaaagcagg

SEQ ID NO: 4152827 - DNA, 15 bp, Homo sapiens
tccaccacatctgcc

SEQ ID NO: 4152828 - DNA, 18 bp, Homo sapiens
tccaccacctccctcacc

SEQ ID NO: 4152829 - DNA, 16 bp, Homo sapiens
tccacccagcccctgg

SEQ ID NO: 4152830 - DNA, 20 bp, Homo sapiens
tccacccataatcctttctg

SEQ ID NO: 4152831 - DNA, 22 bp, Homo sapiens
tccaccccatccctccccagtt

SEQ ID NO: 4152832 - DNA, 18 bp, Homo sapiens
tccaccccccacacacac

SEQ ID NO: 4152833 - DNA, 18 bp, Homo sapiens
tccacccgggggagccca

SEQ ID NO: 4152834 - DNA, 20 bp, Homo sapiens
tccacccgggggagcccagt

SEQ ID NO: 4152835 - DNA, 15 bp, Homo sapiens
tccaccctccacctt

SEQ ID NO: 4152836 - DNA, 20 bp, Homo sapiens
tccaccctcctcctcttcac

SEQ ID NO: 4152837 - DNA, 16 bp, Homo sapiens
tccacccttggcctgt

SEQ ID NO: 4152838 - DNA, 17 bp, Homo sapiens
tccacccttggcctgtc

SEQ ID NO: 4152839 - DNA, 19 bp, Homo sapiens
tccacccttggcctgtctc

SEQ ID NO: 4152840 - DNA, 19 bp, Homo sapiens
tccaccgaccaactgccct

SEQ ID NO: 4152841 - DNA, 20 bp, Homo sapiens
tccaccgaccaactgcccta

SEQ ID NO: 4152842 - DNA, 13 bp, Homo sapiens
tccacctccctcc

SEQ ID NO: 4152843 - DNA, 18 bp, Homo sapiens
tccacctcttcacccccc

SEQ ID NO: 4152844 - DNA, 13 bp, Homo sapiens
tccacctgccttg

SEQ ID NO: 4152845 - DNA, 18 bp, Homo sapiens
tccacctgccttggcctc

SEQ ID NO: 4152846 - DNA, 20 bp, Homo sapiens
tccacctgccttggcctccc

SEQ ID NO: 4152847 - DNA, 18 bp, Homo sapiens
tccacctgctctgctgat

SEQ ID NO: 4152848 - DNA, 14 bp, Homo sapiens
tccaccttggctct

SEQ ID NO: 4152849 - DNA, 15 bp, Homo sapiens
tccaccttggctctg

SEQ ID NO: 4152850 - DNA, 20 bp, Homo sapiens
tccacgaagccttaagccat

SEQ ID NO: 4152851 - DNA, 15 bp, Homo sapiens
tccacgcctcctggc

SEQ ID NO: 4152852 - DNA, 18 bp, Homo sapiens
tccacgcctcctggccag

SEQ ID NO: 4152853 - DNA, 20 bp, Homo sapiens
tccacgtcctccaagctcac

SEQ ID NO: 4152854 - DNA, 17 bp, Homo sapiens
tccactacacctggctg

SEQ ID NO: 4152855 - DNA, 19 bp, Homo sapiens
tccactaccccacaccagc

SEQ ID NO: 4152856 - DNA, 22 bp, Homo sapiens
tccactaccccacaccagcctt

SEQ ID NO: 4152857 - DNA, 23 bp, Homo sapiens
tccactaccccacaccagccttg

SEQ ID NO: 4152858 - DNA, 21 bp, Homo sapiens
tccactcagctgtcctgcagc

SEQ ID NO: 4152859 - DNA, 18 bp, Homo sapiens
tccactccagctctgaga

SEQ ID NO: 4152860 - DNA, 14 bp, Homo sapiens
tccactcccacctc

SEQ ID NO: 4152861 - DNA, 15 bp, Homo sapiens
tccactccctgctcc

SEQ ID NO: 4152862 - DNA, 21 bp, Homo sapiens
tccactcctcctcactaaaaa

SEQ ID NO: 4152863 - DNA, 18 bp, Homo sapiens
tccactcgacccagaatg

SEQ ID NO: 4152864 - DNA, 18 bp, Homo sapiens
tccactctaccctcccac

SEQ ID NO: 4152865 - DNA, 21 bp, Homo sapiens
tccactctaccctcccacccc

SEQ ID NO: 4152866 - DNA, 16 bp, Homo sapiens
tccactcttgatctct

SEQ ID NO: 4152867 - DNA, 20 bp, Homo sapiens
tccactcttgatctctcttg

SEQ ID NO: 4152868 - DNA, 15 bp, Homo sapiens
tccactgtaattaaa

SEQ ID NO: 4152869 - DNA, 16 bp, Homo sapiens
tccactgtaattaaaa

SEQ ID NO: 4152870 - DNA, 17 bp, Homo sapiens
tccactgtaattaaaac

SEQ ID NO: 4152871 - DNA, 17 bp, Homo sapiens
tccactgtcaccctcca

SEQ ID NO: 4152872 - DNA, 20 bp, Homo sapiens
tccacttcttcctttctctt

SEQ ID NO: 4152873 - DNA, 13 bp, Homo sapiens
tccactttgttct

SEQ ID NO: 4152874 - DNA, 15 bp, Homo sapiens
tccagaaacttgttc

SEQ ID NO: 4152875 - DNA, 16 bp, Homo sapiens
tccagaaacttgttct

SEQ ID NO: 4152876 - DNA, 17 bp, Homo sapiens
tccagaaacttgttctt

SEQ ID NO: 4152877 - DNA, 22 bp, Homo sapiens
tccagaaaggatatttaagaaa

SEQ ID NO: 4152878 - DNA, 19 bp, Homo sapiens
tccagaaatgtccctttct

SEQ ID NO: 4152879 - DNA, 20 bp, Homo sapiens
tccagaaatgtccctttctt

SEQ ID NO: 4152880 - DNA, 20 bp, Homo sapiens
tccagaacacggctcacgct

SEQ ID NO: 4152881 - DNA, 22 bp, Homo sapiens
tccagaactcactggggcctac

SEQ ID NO: 4152882 - DNA, 18 bp, Homo sapiens
tccagaagaagagaagct

SEQ ID NO: 4152883 - DNA, 19 bp, Homo sapiens
tccagaagaagagaagctg

SEQ ID NO: 4152884 - DNA, 21 bp, Homo sapiens
tccagaagaagagaagctgct

SEQ ID NO: 4152885 - DNA, 23 bp, Homo sapiens
tccagaagaagagaagctgctga

SEQ ID NO: 4152886 - DNA, 18 bp, Homo sapiens
tccagaagaatattcagg

SEQ ID NO: 4152887 - DNA, 14 bp, Homo sapiens
tccagaagagccca

SEQ ID NO: 4152888 - DNA, 22 bp, Homo sapiens
tccagaataaaacgcaaagggc

SEQ ID NO: 4152889 - DNA, 14 bp, Homo sapiens
tccagaatatctgg

SEQ ID NO: 4152890 - DNA, 17 bp, Homo sapiens
tccagaatcttgacttt

SEQ ID NO: 4152891 - DNA, 21 bp, Homo sapiens
tccagaatcttgactttctga

SEQ ID NO: 4152892 - DNA, 12 bp, Homo sapiens
tccagaatgtaa

SEQ ID NO: 4152893 - DNA, 17 bp, Homo sapiens
tccagaatgtaagaaaa

SEQ ID NO: 4152894 - DNA, 23 bp, Homo sapiens
tccagaatgtaagaaaacaaaat

SEQ ID NO: 4152895 - DNA, 16 bp, Homo sapiens
tccagaattgaccttt

SEQ ID NO: 4152896 - DNA, 13 bp, Homo sapiens
tccagacatcatg

SEQ ID NO: 4152897 - DNA, 13 bp, Homo sapiens
tccagacccaagt

SEQ ID NO: 4152898 - DNA, 15 bp, Homo sapiens
tccagacccctggct

SEQ ID NO: 4152899 - DNA, 18 bp, Homo sapiens
tccagacccctggctttt

SEQ ID NO: 4152900 - DNA, 13 bp, Homo sapiens
tccagacctgatc

SEQ ID NO: 4152901 - DNA, 22 bp, Homo sapiens
tccagacctgatcctggaggcc

SEQ ID NO: 4152902 - DNA, 14 bp, Homo sapiens
tccagacctggctc

SEQ ID NO: 4152903 - DNA, 19 bp, Homo sapiens
tccagacctggctccactc

SEQ ID NO: 4152904 - DNA, 18 bp, Homo sapiens
tccagagaaacccaggga

SEQ ID NO: 4152905 - DNA, 22 bp, Homo sapiens
tccagagaaacccagggaggaa

SEQ ID NO: 4152906 - DNA, 12 bp, Homo sapiens
tccagagagcag

SEQ ID NO: 4152907 - DNA, 15 bp, Homo sapiens
tccagagagtggctc

SEQ ID NO: 4152908 - DNA, 16 bp, Homo sapiens
tccagagagtggctcc

SEQ ID NO: 4152909 - DNA, 17 bp, Homo sapiens
tccagagagtggctcct

SEQ ID NO: 4152910 - DNA, 21 bp, Homo sapiens
tccagagcggaggctgtgtgc

SEQ ID NO: 4152911 - DNA, 16 bp, Homo sapiens
tccagagcttgtgctc

SEQ ID NO: 4152912 - DNA, 20 bp, Homo sapiens
tccagagtgctgaggccagg

SEQ ID NO: 4152913 - DNA, 18 bp, Homo sapiens
tccagatgcagggcagtc

SEQ ID NO: 4152914 - DNA, 15 bp, Homo sapiens
tccagattattggct

SEQ ID NO: 4152915 - DNA, 17 bp, Homo sapiens
tccagcagaagacaaaa

SEQ ID NO: 4152916 - DNA, 23 bp, Homo sapiens
tccagcagaagacaaaaagacaa

SEQ ID NO: 4152917 - DNA, 12 bp, Homo sapiens
tccagcagtgtt

SEQ ID NO: 4152918 - DNA, 13 bp, Homo sapiens
tccagcagtgttg

SEQ ID NO: 4152919 - DNA, 15 bp, Homo sapiens
tccagcccctgtccc

SEQ ID NO: 4152920 - DNA, 20 bp, Homo sapiens
tccagcccctgtcccacccc

SEQ ID NO: 4152921 - DNA, 16 bp, Homo sapiens
tccagccgccattgcc

SEQ ID NO: 4152922 - DNA, 13 bp, Homo sapiens
tccagcctccctg

SEQ ID NO: 4152923 - DNA, 19 bp, Homo sapiens
tccagcctccctgtctcca

SEQ ID NO: 4152924 - DNA, 23 bp, Homo sapiens
tccagcctccctgtctccagctg

SEQ ID NO: 4152925 - DNA, 21 bp, Homo sapiens
tccagcctgctagtctgccct

SEQ ID NO: 4152926 - DNA, 11 bp, Homo sapiens
tccagcctggg

SEQ ID NO: 4152927 - DNA, 17 bp, Homo sapiens
tccagcctggggtctgg

SEQ ID NO: 4152928 - DNA, 16 bp, Homo sapiens
tccagctccaacctgc

SEQ ID NO: 4152929 - DNA, 10 bp, Homo sapiens
tccagctccc

SEQ ID NO: 4152930 - DNA, 15 bp, Homo sapiens
tccagctccctagac

SEQ ID NO: 4152931 - DNA, 16 bp, Homo sapiens
tccagctccctagact

SEQ ID NO: 4152932 - DNA, 18 bp, Homo sapiens
tccagctctaataaaaca

SEQ ID NO: 4152933 - DNA, 15 bp, Homo sapiens
tccagctctggcatg

SEQ ID NO: 4152934 - DNA, 20 bp, Homo sapiens
tccagctcttggcccctgtg

SEQ ID NO: 4152935 - DNA, 16 bp, Homo sapiens
tccagctgagcgccag

SEQ ID NO: 4152936 - DNA, 12 bp, Homo sapiens
tccagctgcctg

SEQ ID NO: 4152937 - DNA, 12 bp, Homo sapiens
tccagctgctgt

SEQ ID NO: 4152938 - DNA, 14 bp, Homo sapiens
tccagctgctgtct

SEQ ID NO: 4152939 - DNA, 17 bp, Homo sapiens
tccagctggggccagag

SEQ ID NO: 4152940 - DNA, 13 bp, Homo sapiens
tccagctgtgcag

SEQ ID NO: 4152941 - DNA, 16 bp, Homo sapiens
tccagctgtgcagcac

SEQ ID NO: 4152942 - DNA, 17 bp, Homo sapiens
tccagcttcaggcacca

SEQ ID NO: 4152943 - DNA, 16 bp, Homo sapiens
tccagctttctgccat

SEQ ID NO: 4152944 - DNA, 21 bp, Homo sapiens
tccaggaaagagcagtcagag

SEQ ID NO: 4152945 - DNA, 19 bp, Homo sapiens
tccaggaaggtagcccagc

SEQ ID NO: 4152946 - DNA, 22 bp, Homo sapiens
tccaggaattcctcttttgctt

SEQ ID NO: 4152947 - DNA, 19 bp, Homo sapiens
tccaggagggaccaccctc

SEQ ID NO: 4152948 - DNA, 21 bp, Homo sapiens
tccaggagggaccaccctccc

SEQ ID NO: 4152949 - DNA, 20 bp, Homo sapiens
tccaggatctccactgataa

SEQ ID NO: 4152950 - DNA, 15 bp, Homo sapiens
tccaggcacagctga

SEQ ID NO: 4152951 - DNA, 16 bp, Homo sapiens
tccaggcacagctgag

SEQ ID NO: 4152952 - DNA, 17 bp, Homo sapiens
tccaggcacagctgagt

SEQ ID NO: 4152953 - DNA, 19 bp, Homo sapiens
tccaggcaccctcagggag

SEQ ID NO: 4152954 - DNA, 17 bp, Homo sapiens
tccaggcagatccagga

SEQ ID NO: 4152955 - DNA, 12 bp, Homo sapiens
tccaggcagcac

SEQ ID NO: 4152956 - DNA, 19 bp, Homo sapiens
tccaggcctgatcttgcct

SEQ ID NO: 4152957 - DNA, 14 bp, Homo sapiens
tccaggcctgcagc

SEQ ID NO: 4152958 - DNA, 16 bp, Homo sapiens
tccaggcctgcctccc

SEQ ID NO: 4152959 - DNA, 17 bp, Homo sapiens
tccaggcctgcctccca

SEQ ID NO: 4152960 - DNA, 13 bp, Homo sapiens
tccaggcttcaca

SEQ ID NO: 4152961 - DNA, 15 bp, Homo sapiens
tccaggcttcacagt

SEQ ID NO: 4152962 - DNA, 19 bp, Homo sapiens
tccaggcttcacagtctgg

SEQ ID NO: 4152963 - DNA, 17 bp, Homo sapiens
tccagggaagctggccg

SEQ ID NO: 4152964 - DNA, 18 bp, Homo sapiens
tccagggaagctggccga

SEQ ID NO: 4152965 - DNA, 20 bp, Homo sapiens
tccagggaaggtggccacag

SEQ ID NO: 4152966 - DNA, 21 bp, Homo sapiens
tccagggaaggtggccacagc

SEQ ID NO: 4152967 - DNA, 21 bp, Homo sapiens
tccagggacagaggccccagc

SEQ ID NO: 4152968 - DNA, 13 bp, Homo sapiens
tccagggatggcc

SEQ ID NO: 4152969 - DNA, 16 bp, Homo sapiens
tccagggcccaggttc

SEQ ID NO: 4152970 - DNA, 17 bp, Homo sapiens
tccagggcccccatctc

SEQ ID NO: 4152971 - DNA, 20 bp, Homo sapiens
tccagggcctgacaccccct

SEQ ID NO: 4152972 - DNA, 22 bp, Homo sapiens
tccagggcctgacaccccctcc

SEQ ID NO: 4152973 - DNA, 14 bp, Homo sapiens
tccagggctagtga

SEQ ID NO: 4152974 - DNA, 14 bp, Homo sapiens
tccaggggaacctg

SEQ ID NO: 4152975 - DNA, 18 bp, Homo sapiens
tccagggtttctctgcag

SEQ ID NO: 4152976 - DNA, 16 bp, Homo sapiens
tccaggtctcacgggc

SEQ ID NO: 4152977 - DNA, 23 bp, Homo sapiens
tccaggtcttgactcatggcagc

SEQ ID NO: 4152978 - DNA, 18 bp, Homo sapiens
tccaggtgttactgtaat

SEQ ID NO: 4152979 - DNA, 19 bp, Homo sapiens
tccagtaatctaatatggc

SEQ ID NO: 4152980 - DNA, 22 bp, Homo sapiens
tccagtaccttgcttcttactg

SEQ ID NO: 4152981 - DNA, 13 bp, Homo sapiens
tccagtctattca

SEQ ID NO: 4152982 - DNA, 14 bp, Homo sapiens
tccagtgccagcaa

SEQ ID NO: 4152983 - DNA, 13 bp, Homo sapiens
tccagtgctccca

SEQ ID NO: 4152984 - DNA, 22 bp, Homo sapiens
tccagtggaggtttgtcgggca

SEQ ID NO: 4152985 - DNA, 14 bp, Homo sapiens
tccagtggcagaca

SEQ ID NO: 4152986 - DNA, 20 bp, Homo sapiens
tccagtggcagacaaacaga

SEQ ID NO: 4152987 - DNA, 12 bp, Homo sapiens
tccagtggtgaa

SEQ ID NO: 4152988 - DNA, 20 bp, Homo sapiens
tccagtgtacatagtgtaat

SEQ ID NO: 4152989 - DNA, 14 bp, Homo sapiens
tccagtgtcacctc

SEQ ID NO: 4152990 - DNA, 20 bp, Homo sapiens
tccagtgtcacctctctcag

SEQ ID NO: 4152991 - DNA, 18 bp, Homo sapiens
tccagtgtgggcttgacc

SEQ ID NO: 4152992 - DNA, 14 bp, Homo sapiens
tccagttagttctc

SEQ ID NO: 4152993 - DNA, 17 bp, Homo sapiens
tccagttcctttagaaa

SEQ ID NO: 4152994 - DNA, 13 bp, Homo sapiens
tccagtttattcc

SEQ ID NO: 4152995 - DNA, 14 bp, Homo sapiens
tccagtttctgtaa

SEQ ID NO: 4152996 - DNA, 18 bp, Homo sapiens
tccagtttgcacctgtcc

SEQ ID NO: 4152997 - DNA, 17 bp, Homo sapiens
tccagtttgttctccgg

SEQ ID NO: 4152998 - DNA, 23 bp, Homo sapiens
tccataaacagactgttaattat

SEQ ID NO: 4152999 - DNA, 16 bp, Homo sapiens
tccataaggaatgtag

SEQ ID NO: 4153000 - DNA, 17 bp, Homo sapiens
tccataattatgacagt

SEQ ID NO: 4153001 - DNA, 12 bp, Homo sapiens
tccataccagct

SEQ ID NO: 4153002 - DNA, 15 bp, Homo sapiens
tccataccagctcgc

SEQ ID NO: 4153003 - DNA, 15 bp, Homo sapiens
tccatagctgtggtg

SEQ ID NO: 4153004 - DNA, 13 bp, Homo sapiens
tccatatcctggt

SEQ ID NO: 4153005 - DNA, 17 bp, Homo sapiens
tccatatccttctggct

SEQ ID NO: 4153006 - DNA, 22 bp, Homo sapiens
tccatatccttctggctgtaga

SEQ ID NO: 4153007 - DNA, 11 bp, Homo sapiens
tccatatttac

SEQ ID NO: 4153008 - DNA, 13 bp, Homo sapiens
tccatatttggaa

SEQ ID NO: 4153009 - DNA, 17 bp, Homo sapiens
tccatatttggaagaaa

SEQ ID NO: 4153010 - DNA, 23 bp, Homo sapiens
tccatcaactcccaacttcttcc

SEQ ID NO: 4153011 - DNA, 15 bp, Homo sapiens
tccatcaataaatgc

SEQ ID NO: 4153012 - DNA, 14 bp, Homo sapiens
tccatcattttaca

SEQ ID NO: 4153013 - DNA, 22 bp, Homo sapiens
tccatccataaatccagttcta

SEQ ID NO: 4153014 - DNA, 13 bp, Homo sapiens
tccatccatcctt

SEQ ID NO: 4153015 - DNA, 18 bp, Homo sapiens
tccatccctaccccctaa

SEQ ID NO: 4153016 - DNA, 22 bp, Homo sapiens
tccatccctaccccctaagagc

SEQ ID NO: 4153017 - DNA, 16 bp, Homo sapiens
tccatccctccattca

SEQ ID NO: 4153018 - DNA, 17 bp, Homo sapiens
tccatcctcctccttcc

SEQ ID NO: 4153019 - DNA, 18 bp, Homo sapiens
tccatcctcctccttcct

SEQ ID NO: 4153020 - DNA, 18 bp, Homo sapiens
tccatccttccaacatat

SEQ ID NO: 4153021 - DNA, 14 bp, Homo sapiens
tccatctctgactt

SEQ ID NO: 4153022 - DNA, 13 bp, Homo sapiens
tccatctttacaa

SEQ ID NO: 4153023 - DNA, 15 bp, Homo sapiens
tccatctttctacag

SEQ ID NO: 4153024 - DNA, 13 bp, Homo sapiens
tccatctttttct

SEQ ID NO: 4153025 - DNA, 21 bp, Homo sapiens
tccatgaagaccacatccaca

SEQ ID NO: 4153026 - DNA, 23 bp, Homo sapiens
tccatgaagaccacatccacaca

SEQ ID NO: 4153027 - DNA, 13 bp, Homo sapiens
tccatgaatgtat

SEQ ID NO: 4153028 - DNA, 15 bp, Homo sapiens
tccatgaatgtatca

SEQ ID NO: 4153029 - DNA, 16 bp, Homo sapiens
tccatgaatgtatcag

SEQ ID NO: 4153030 - DNA, 21 bp, Homo sapiens
tccatgaatgtatcaggaaat

SEQ ID NO: 4153031 - DNA, 14 bp, Homo sapiens
tccatgatggaata

SEQ ID NO: 4153032 - DNA, 14 bp, Homo sapiens
tccatgcaactgga

SEQ ID NO: 4153033 - DNA, 17 bp, Homo sapiens
tccatgcccactgctgg

SEQ ID NO: 4153034 - DNA, 13 bp, Homo sapiens
tccatgcctgagg

SEQ ID NO: 4153035 - DNA, 21 bp, Homo sapiens
tccatgcctgagggtggagac

SEQ ID NO: 4153036 - DNA, 21 bp, Homo sapiens
tccatgccttaaacctacctc

SEQ ID NO: 4153037 - DNA, 14 bp, Homo sapiens
tccatggccctgtc

SEQ ID NO: 4153038 - DNA, 19 bp, Homo sapiens
tccatgggagccagctgct

SEQ ID NO: 4153039 - DNA, 14 bp, Homo sapiens
tccatgtacttgtt

SEQ ID NO: 4153040 - DNA, 18 bp, Homo sapiens
tccatgtacttgtttgca

SEQ ID NO: 4153041 - DNA, 12 bp, Homo sapiens
tccatgtgcacc

SEQ ID NO: 4153042 - DNA, 20 bp, Homo sapiens
tccatgtgcctttctttgcc

SEQ ID NO: 4153043 - DNA, 21 bp, Homo sapiens
tccatgtgcctttctttgcct

SEQ ID NO: 4153044 - DNA, 17 bp, Homo sapiens
tccatgtgtggactcaa

SEQ ID NO: 4153045 - DNA, 18 bp, Homo sapiens
tccatgttagtttttact

SEQ ID NO: 4153046 - DNA, 19 bp, Homo sapiens
tccattaaagtctgaatca

SEQ ID NO: 4153047 - DNA, 20 bp, Homo sapiens
tccattaacttagcatgtgt

SEQ ID NO: 4153048 - DNA, 22 bp, Homo sapiens
tccattaacttagcatgtgttg

SEQ ID NO: 4153049 - DNA, 18 bp, Homo sapiens
tccattacctccatccat

SEQ ID NO: 4153050 - DNA, 21 bp, Homo sapiens
tccattacctccatccatcct

SEQ ID NO: 4153051 - DNA, 14 bp, Homo sapiens
tccattaggccagc

SEQ ID NO: 4153052 - DNA, 20 bp, Homo sapiens
tccattaggccagcaacgct

SEQ ID NO: 4153053 - DNA, 15 bp, Homo sapiens
tccattctcccaggt

SEQ ID NO: 4153054 - DNA, 22 bp, Homo sapiens
tccattgaagccgactctggcc

SEQ ID NO: 4153055 - DNA, 14 bp, Homo sapiens
tccatttatatatg

SEQ ID NO: 4153056 - DNA, 15 bp, Homo sapiens
tccatttatatatga

SEQ ID NO: 4153057 - DNA, 16 bp, Homo sapiens
tccatttatatatgaa

SEQ ID NO: 4153058 - DNA, 18 bp, Homo sapiens
tccatttcccctccttcc

SEQ ID NO: 4153059 - DNA, 16 bp, Homo sapiens
tccatttcttcctcac

SEQ ID NO: 4153060 - DNA, 15 bp, Homo sapiens
tccatttgcctttct

SEQ ID NO: 4153061 - DNA, 13 bp, Homo sapiens
tccatttgttcct

SEQ ID NO: 4153062 - DNA, 15 bp, Homo sapiens
tccatttgttcctgc

SEQ ID NO: 4153063 - DNA, 16 bp, Homo sapiens
tccatttgttcctgct

SEQ ID NO: 4153064 - DNA, 21 bp, Homo sapiens
tccatttttctcccaagaaac

SEQ ID NO: 4153065 - DNA, 23 bp, Homo sapiens
tccatttttctcccaagaaacct

SEQ ID NO: 4153066 - DNA, 15 bp, Homo sapiens
tcccaaacgcctccc

SEQ ID NO: 4153067 - DNA, 11 bp, Homo sapiens
tcccaaagtgc

SEQ ID NO: 4153068 - DNA, 14 bp, Homo sapiens
tcccaaatgagcca

SEQ ID NO: 4153069 - DNA, 19 bp, Homo sapiens
tcccaaatttgattgattt

SEQ ID NO: 4153070 - DNA, 20 bp, Homo sapiens
tcccaaatttgattgatttg

SEQ ID NO: 4153071 - DNA, 22 bp, Homo sapiens
tcccaacagccttagctgccag

SEQ ID NO: 4153072 - DNA, 13 bp, Homo sapiens
tcccaacccagcc

SEQ ID NO: 4153073 - DNA, 17 bp, Homo sapiens
tcccaactcctataatt

SEQ ID NO: 4153074 - DNA, 16 bp, Homo sapiens
tcccaaggtcctctca

SEQ ID NO: 4153075 - DNA, 16 bp, Homo sapiens
tcccaaggttctgggt

SEQ ID NO: 4153076 - DNA, 20 bp, Homo sapiens
tcccaaggttggagcccagg

SEQ ID NO: 4153077 - DNA, 23 bp, Homo sapiens
tcccaaggttggagcccagggca

SEQ ID NO: 4153078 - DNA, 19 bp, Homo sapiens
tcccaagtttccatagcaa

SEQ ID NO: 4153079 - DNA, 23 bp, Homo sapiens
tcccaagtttccatagcaacagg

SEQ ID NO: 4153080 - DNA, 20 bp, Homo sapiens
tcccaatccttatcccaagc

SEQ ID NO: 4153081 - DNA, 19 bp, Homo sapiens
tcccaattaggaagtgtaa

SEQ ID NO: 4153082 - DNA, 18 bp, Homo sapiens
tcccaatttcagactccc

SEQ ID NO: 4153083 - DNA, 16 bp, Homo sapiens
tcccacaaccacatgt

SEQ ID NO: 4153084 - DNA, 18 bp, Homo sapiens
tcccacactcgccatctc

SEQ ID NO: 4153085 - DNA, 13 bp, Homo sapiens
tcccacacttgct

SEQ ID NO: 4153086 - DNA, 14 bp, Homo sapiens
tcccacacttgctg

SEQ ID NO: 4153087 - DNA, 19 bp, Homo sapiens
tcccacacttgctggggct

SEQ ID NO: 4153088 - DNA, 22 bp, Homo sapiens
tcccacaggcccttcctctcca

SEQ ID NO: 4153089 - DNA, 20 bp, Homo sapiens
tcccacatacgcagggggaa

SEQ ID NO: 4153090 - DNA, 23 bp, Homo sapiens
tcccacatgaggccatctcagga

SEQ ID NO: 4153091 - DNA, 15 bp, Homo sapiens
tcccacatgcctgcg

SEQ ID NO: 4153092 - DNA, 19 bp, Homo sapiens
tcccaccaaccctcagagc

SEQ ID NO: 4153093 - DNA, 19 bp, Homo sapiens
tcccacccacacagctgcc

SEQ ID NO: 4153094 - DNA, 19 bp, Homo sapiens
tcccaccccatcctccagg

SEQ ID NO: 4153095 - DNA, 23 bp, Homo sapiens
tcccacccccacccccagctcaa

SEQ ID NO: 4153096 - DNA, 18 bp, Homo sapiens
tcccacccctacacacac

SEQ ID NO: 4153097 - DNA, 16 bp, Homo sapiens
tcccacccctagccac

SEQ ID NO: 4153098 - DNA, 14 bp, Homo sapiens
tcccacccctccat

SEQ ID NO: 4153099 - DNA, 13 bp, Homo sapiens
tcccaccctcctg

SEQ ID NO: 4153100 - DNA, 16 bp, Homo sapiens
tcccaccctcctgccc

SEQ ID NO: 4153101 - DNA, 12 bp, Homo sapiens
tcccaccgggag

SEQ ID NO: 4153102 - DNA, 18 bp, Homo sapiens
tcccaccgggagcctccc

SEQ ID NO: 4153103 - DNA, 16 bp, Homo sapiens
tcccacctagcagcac

SEQ ID NO: 4153104 - DNA, 13 bp, Homo sapiens
tcccacctcaccc

SEQ ID NO: 4153105 - DNA, 14 bp, Homo sapiens
tcccacctcacccg

SEQ ID NO: 4153106 - DNA, 12 bp, Homo sapiens
tcccaccttccc

SEQ ID NO: 4153107 - DNA, 14 bp, Homo sapiens
tcccaccttcccac

SEQ ID NO: 4153108 - DNA, 21 bp, Homo sapiens
tcccacgaatttgctggggaa

SEQ ID NO: 4153109 - DNA, 19 bp, Homo sapiens
tcccacgtctggccaggca

SEQ ID NO: 4153110 - DNA, 23 bp, Homo sapiens
tcccacgtcttcttgctgcagcc

SEQ ID NO: 4153111 - DNA, 16 bp, Homo sapiens
tcccactccaagccag

SEQ ID NO: 4153112 - DNA, 13 bp, Homo sapiens
tcccactgtatga

SEQ ID NO: 4153113 - DNA, 18 bp, Homo sapiens
tcccactgtatgatttat

SEQ ID NO: 4153114 - DNA, 17 bp, Homo sapiens
tcccagaacctcagcat

SEQ ID NO: 4153115 - DNA, 23 bp, Homo sapiens
tcccagactactattttcttttt

SEQ ID NO: 4153116 - DNA, 15 bp, Homo sapiens
tcccagagggagcag

SEQ ID NO: 4153117 - DNA, 22 bp, Homo sapiens
tcccagaggtgggatcctccct

SEQ ID NO: 4153118 - DNA, 13 bp, Homo sapiens
tcccagcactttg

SEQ ID NO: 4153119 - DNA, 16 bp, Homo sapiens
tcccagcactttggga

SEQ ID NO: 4153120 - DNA, 21 bp, Homo sapiens
tcccagcactttgggaggcct

SEQ ID NO: 4153121 - DNA, 14 bp, Homo sapiens
tcccagcagcccaa

SEQ ID NO: 4153122 - DNA, 18 bp, Homo sapiens
tcccagcagcccaagctt

SEQ ID NO: 4153123 - DNA, 19 bp, Homo sapiens
tcccagcatccctggagca

SEQ ID NO: 4153124 - DNA, 21 bp, Homo sapiens
tcccagcatccctggagcagg

SEQ ID NO: 4153125 - DNA, 23 bp, Homo sapiens
tcccagcatccctggagcaggag

SEQ ID NO: 4153126 - DNA, 12 bp, Homo sapiens
tcccagccaccc

SEQ ID NO: 4153127 - DNA, 20 bp, Homo sapiens
tcccagccaccccgggctct

SEQ ID NO: 4153128 - DNA, 16 bp, Homo sapiens
tcccagccactcggga

SEQ ID NO: 4153129 - DNA, 21 bp, Homo sapiens
tcccagccccggcaagccaca

SEQ ID NO: 4153130 - DNA, 16 bp, Homo sapiens
tcccagcctgctgaga

SEQ ID NO: 4153131 - DNA, 19 bp, Homo sapiens
tcccagcctgctgagagcc

SEQ ID NO: 4153132 - DNA, 15 bp, Homo sapiens
tcccagcctgggggc

SEQ ID NO: 4153133 - DNA, 18 bp, Homo sapiens
tcccagcctgggggccag

SEQ ID NO: 4153134 - DNA, 17 bp, Homo sapiens
tcccagctacttgggaa

SEQ ID NO: 4153135 - DNA, 23 bp, Homo sapiens
tcccagctaggaagagcaggact

SEQ ID NO: 4153136 - DNA, 19 bp, Homo sapiens
tcccaggaccctgaagggg

SEQ ID NO: 4153137 - DNA, 19 bp, Homo sapiens
tcccaggagatgggtccag

SEQ ID NO: 4153138 - DNA, 17 bp, Homo sapiens
tcccaggccccctgcat

SEQ ID NO: 4153139 - DNA, 17 bp, Homo sapiens
tcccaggccggcccaga

SEQ ID NO: 4153140 - DNA, 18 bp, Homo sapiens
tcccaggccggcccagat

SEQ ID NO: 4153141 - DNA, 19 bp, Homo sapiens
tcccaggccggcccagatg

SEQ ID NO: 4153142 - DNA, 20 bp, Homo sapiens
tcccaggcgccccttccccc

SEQ ID NO: 4153143 - DNA, 16 bp, Homo sapiens
tcccagggctggctct

SEQ ID NO: 4153144 - DNA, 21 bp, Homo sapiens
tcccaggtaccagctgcgctt

SEQ ID NO: 4153145 - DNA, 20 bp, Homo sapiens
tcccaggttcccccagcaag

SEQ ID NO: 4153146 - DNA, 20 bp, Homo sapiens
tcccagtccaaatgtcctcc

SEQ ID NO: 4153147 - DNA, 18 bp, Homo sapiens
tcccagtgaactcctgcc

SEQ ID NO: 4153148 - DNA, 19 bp, Homo sapiens
tcccagtgaactcctgcca

SEQ ID NO: 4153149 - DNA, 20 bp, Homo sapiens
tcccagttggggaagccagg

SEQ ID NO: 4153150 - DNA, 22 bp, Homo sapiens
tcccataataaagcaatctgat

SEQ ID NO: 4153151 - DNA, 14 bp, Homo sapiens
tcccatcaaaactc

SEQ ID NO: 4153152 - DNA, 15 bp, Homo sapiens
tcccatcatcctttg

SEQ ID NO: 4153153 - DNA, 22 bp, Homo sapiens
tcccatcattacccttccctgc

SEQ ID NO: 4153154 - DNA, 23 bp, Homo sapiens
tcccatcattacccttccctgca

SEQ ID NO: 4153155 - DNA, 19 bp, Homo sapiens
tcccatctgcaccccttct

SEQ ID NO: 4153156 - DNA, 20 bp, Homo sapiens
tcccatgactgcacccagct

SEQ ID NO: 4153157 - DNA, 21 bp, Homo sapiens
tcccatgagaccctggtgcct

SEQ ID NO: 4153158 - DNA, 15 bp, Homo sapiens
tcccatgatccctgt

SEQ ID NO: 4153159 - DNA, 22 bp, Homo sapiens
tcccatggacactccagtgcca

SEQ ID NO: 4153160 - DNA, 21 bp, Homo sapiens
tcccatgggggcacttgagtt

SEQ ID NO: 4153161 - DNA, 22 bp, Homo sapiens
tcccatgggggcacttgagttt

SEQ ID NO: 4153162 - DNA, 15 bp, Homo sapiens
tcccatgtagccccc

SEQ ID NO: 4153163 - DNA, 21 bp, Homo sapiens
tcccatgtagccccctggcct

SEQ ID NO: 4153164 - DNA, 13 bp, Homo sapiens
tcccatgtatgga

SEQ ID NO: 4153165 - DNA, 21 bp, Homo sapiens
tcccattaatcatttccccat

SEQ ID NO: 4153166 - DNA, 14 bp, Homo sapiens
tcccattcctccct

SEQ ID NO: 4153167 - DNA, 15 bp, Homo sapiens
tcccattcctgaaga

SEQ ID NO: 4153168 - DNA, 15 bp, Homo sapiens
tcccattcttggccc

SEQ ID NO: 4153169 - DNA, 16 bp, Homo sapiens
tcccattcttggccca

SEQ ID NO: 4153170 - DNA, 22 bp, Homo sapiens
tcccattgttggcgctgaggtg

SEQ ID NO: 4153171 - DNA, 13 bp, Homo sapiens
tcccatttccttg

SEQ ID NO: 4153172 - DNA, 16 bp, Homo sapiens
tcccatttccttggag

SEQ ID NO: 4153173 - DNA, 18 bp, Homo sapiens
tcccatttccttggaggc

SEQ ID NO: 4153174 - DNA, 11 bp, Homo sapiens
tcccatttctt

SEQ ID NO: 4153175 - DNA, 21 bp, Homo sapiens
tcccattttgcaaaatttcca

SEQ ID NO: 4153176 - DNA, 18 bp, Homo sapiens
tcccattttggaagtttt

SEQ ID NO: 4153177 - DNA, 14 bp, Homo sapiens
tccccaaaatgtga

SEQ ID NO: 4153178 - DNA, 20 bp, Homo sapiens
tccccaagcccaccaggtgt

SEQ ID NO: 4153179 - DNA, 20 bp, Homo sapiens
tccccaaggccccctgcctg

SEQ ID NO: 4153180 - DNA, 20 bp, Homo sapiens
tccccacaccttccagggcc

SEQ ID NO: 4153181 - DNA, 10 bp, Homo sapiens
tccccacact

SEQ ID NO: 4153182 - DNA, 18 bp, Homo sapiens
tccccacagcgtccctgg

SEQ ID NO: 4153183 - DNA, 16 bp, Homo sapiens
tccccacccctgcccc

SEQ ID NO: 4153184 - DNA, 18 bp, Homo sapiens
tccccacccctgccccca

SEQ ID NO: 4153185 - DNA, 13 bp, Homo sapiens
tccccacctggga

SEQ ID NO: 4153186 - DNA, 14 bp, Homo sapiens
tccccacctgggac

SEQ ID NO: 4153187 - DNA, 15 bp, Homo sapiens
tccccacgagggctg

SEQ ID NO: 4153188 - DNA, 22 bp, Homo sapiens
tccccacggggcctcgggacct

SEQ ID NO: 4153189 - DNA, 19 bp, Homo sapiens
tccccacttgtccgctggg

SEQ ID NO: 4153190 - DNA, 21 bp, Homo sapiens
tccccacttgtccgctgggtg

SEQ ID NO: 4153191 - DNA, 20 bp, Homo sapiens
tccccagacccttcttgcct

SEQ ID NO: 4153192 - DNA, 22 bp, Homo sapiens
tccccagacccttcttgcctgc

SEQ ID NO: 4153193 - DNA, 10 bp, Homo sapiens
tccccagaga

SEQ ID NO: 4153194 - DNA, 22 bp, Homo sapiens
tccccagagaaaggggagccca

SEQ ID NO: 4153195 - DNA, 23 bp, Homo sapiens
tccccagagaaaggggagcccac

SEQ ID NO: 4153196 - DNA, 11 bp, Homo sapiens
tccccagagag

SEQ ID NO: 4153197 - DNA, 13 bp, Homo sapiens
tccccagcccaga

SEQ ID NO: 4153198 - DNA, 14 bp, Homo sapiens
tccccagcccagag

SEQ ID NO: 4153199 - DNA, 15 bp, Homo sapiens
tccccagcccagaga

SEQ ID NO: 4153200 - DNA, 13 bp, Homo sapiens
tccccagccctgg

SEQ ID NO: 4153201 - DNA, 16 bp, Homo sapiens
tccccagccctgtcct

SEQ ID NO: 4153202 - DNA, 16 bp, Homo sapiens
tccccaggagctcagg

SEQ ID NO: 4153203 - DNA, 16 bp, Homo sapiens
tccccaggatggactc

SEQ ID NO: 4153204 - DNA, 16 bp, Homo sapiens
tccccaggccaggcca

SEQ ID NO: 4153205 - DNA, 16 bp, Homo sapiens
tccccaggctggagac

SEQ ID NO: 4153206 - DNA, 19 bp, Homo sapiens
tccccaggctggagacccc

SEQ ID NO: 4153207 - DNA, 14 bp, Homo sapiens
tccccagggagctc

SEQ ID NO: 4153208 - DNA, 18 bp, Homo sapiens
tccccaggggtcccagcc

SEQ ID NO: 4153209 - DNA, 15 bp, Homo sapiens
tccccatccccacca

SEQ ID NO: 4153210 - DNA, 16 bp, Homo sapiens
tccccatccccaccag

SEQ ID NO: 4153211 - DNA, 19 bp, Homo sapiens
tccccatctccctgcctgg

SEQ ID NO: 4153212 - DNA, 16 bp, Homo sapiens
tccccatctgtccagc

SEQ ID NO: 4153213 - DNA, 13 bp, Homo sapiens
tccccatggagcc

SEQ ID NO: 4153214 - DNA, 19 bp, Homo sapiens
tccccatttcccatctgca

SEQ ID NO: 4153215 - DNA, 15 bp, Homo sapiens
tcccccaacccccac

SEQ ID NO: 4153216 - DNA, 16 bp, Homo sapiens
tcccccaacccccacc

SEQ ID NO: 4153217 - DNA, 21 bp, Homo sapiens
tcccccaacccccaccccaca

SEQ ID NO: 4153218 - DNA, 17 bp, Homo sapiens
tcccccaccagctgcag

SEQ ID NO: 4153219 - DNA, 19 bp, Homo sapiens
tcccccaccagctgcagcc

SEQ ID NO: 4153220 - DNA, 17 bp, Homo sapiens
tcccccaccctccatgc

SEQ ID NO: 4153221 - DNA, 20 bp, Homo sapiens
tcccccagcaacgcccctcc

SEQ ID NO: 4153222 - DNA, 22 bp, Homo sapiens
tcccccagcaacgcccctccaa

SEQ ID NO: 4153223 - DNA, 13 bp, Homo sapiens
tcccccagcaagc

SEQ ID NO: 4153224 - DNA, 17 bp, Homo sapiens
tcccccaggctgttctc

SEQ ID NO: 4153225 - DNA, 18 bp, Homo sapiens
tcccccaggctgttctcc

SEQ ID NO: 4153226 - DNA, 16 bp, Homo sapiens
tcccccagtacctcca

SEQ ID NO: 4153227 - DNA, 23 bp, Homo sapiens
tccccccagtgggatgggacagg

SEQ ID NO: 4153228 - DNA, 13 bp, Homo sapiens
tcccccccatgca

SEQ ID NO: 4153229 - DNA, 19 bp, Homo sapiens
tcccccgtttctccttttc

SEQ ID NO: 4153230 - DNA, 15 bp, Homo sapiens
tccccctacccaccg

SEQ ID NO: 4153231 - DNA, 22 bp, Homo sapiens
tccccctcagatgatctctcca

SEQ ID NO: 4153232 - DNA, 13 bp, Homo sapiens
tccccctccccag

SEQ ID NO: 4153233 - DNA, 14 bp, Homo sapiens
tccccctccccagg

SEQ ID NO: 4153234 - DNA, 16 bp, Homo sapiens
tccccctccccaggct

SEQ ID NO: 4153235 - DNA, 18 bp, Homo sapiens
tccccctgtagactagtg

SEQ ID NO: 4153236 - DNA, 18 bp, Homo sapiens
tcccccttcccatttctt

SEQ ID NO: 4153237 - DNA, 21 bp, Homo sapiens
tcccccttcccatttcttccc

SEQ ID NO: 4153238 - DNA, 12 bp, Homo sapiens
tcccccttgcca

SEQ ID NO: 4153239 - DNA, 19 bp, Homo sapiens
tcccccttttctgcatttt

SEQ ID NO: 4153240 - DNA, 12 bp, Homo sapiens
tccccgcccctg

SEQ ID NO: 4153241 - DNA, 21 bp, Homo sapiens
tccccgcccctgtggccctgg

SEQ ID NO: 4153242 - DNA, 13 bp, Homo sapiens
tccccggctcgag

SEQ ID NO: 4153243 - DNA, 15 bp, Homo sapiens
tccccgttcctgaca

SEQ ID NO: 4153244 - DNA, 14 bp, Homo sapiens
tcccctaacctcat

SEQ ID NO: 4153245 - DNA, 21 bp, Homo sapiens
tcccctattgcgctctcaaga

SEQ ID NO: 4153246 - DNA, 17 bp, Homo sapiens
tcccctcacctcctcta

SEQ ID NO: 4153247 - DNA, 16 bp, Homo sapiens
tcccctcactctgtca

SEQ ID NO: 4153248 - DNA, 21 bp, Homo sapiens
tcccctcactctgtcagccag

SEQ ID NO: 4153249 - DNA, 13 bp, Homo sapiens
tcccctcactgga

SEQ ID NO: 4153250 - DNA, 21 bp, Homo sapiens
tcccctcagccacacccaggc

SEQ ID NO: 4153251 - DNA, 16 bp, Homo sapiens
tcccctcaggactgca

SEQ ID NO: 4153252 - DNA, 13 bp, Homo sapiens
tcccctccagcct

SEQ ID NO: 4153253 - DNA, 15 bp, Homo sapiens
tcccctccaggaaga

SEQ ID NO: 4153254 - DNA, 23 bp, Homo sapiens
tcccctccaggagggaccaccct

SEQ ID NO: 4153255 - DNA, 24 bp, Homo sapiens
tcccctccaggagggaccaccctc

SEQ ID NO: 4153256 - DNA, 14 bp, Homo sapiens
tcccctccaggagt

SEQ ID NO: 4153257 - DNA, 15 bp, Homo sapiens
tcccctcccagtcct

SEQ ID NO: 4153258 - DNA, 13 bp, Homo sapiens
tcccctccctggc

SEQ ID NO: 4153259 - DNA, 21 bp, Homo sapiens
tcccctccctggctcccatga

SEQ ID NO: 4153260 - DNA, 19 bp, Homo sapiens
tcccctccggactggtgcc

SEQ ID NO: 4153261 - DNA, 17 bp, Homo sapiens
tcccctctgctgctgtc

SEQ ID NO: 4153262 - DNA, 12 bp, Homo sapiens
tcccctctggct

SEQ ID NO: 4153263 - DNA, 12 bp, Homo sapiens
tcccctgagccc

SEQ ID NO: 4153264 - DNA, 17 bp, Homo sapiens
tcccctgcggtcaggct

SEQ ID NO: 4153265 - DNA, 15 bp, Homo sapiens
tcccctggactggga

SEQ ID NO: 4153266 - DNA, 17 bp, Homo sapiens
tcccctggactgggagg

SEQ ID NO: 4153267 - DNA, 15 bp, Homo sapiens
tcccctgttcactct

SEQ ID NO: 4153268 - DNA, 20 bp, Homo sapiens
tccccttccccaattactat

SEQ ID NO: 4153269 - DNA, 16 bp, Homo sapiens
tccccttccccttcct

SEQ ID NO: 4153270 - DNA, 12 bp, Homo sapiens
tccccttccctt

SEQ ID NO: 4153271 - DNA, 11 bp, Homo sapiens
tccccttcctg

SEQ ID NO: 4153272 - DNA, 13 bp, Homo sapiens
tccccttcctgtt

SEQ ID NO: 4153273 - DNA, 16 bp, Homo sapiens
tccccttcctgtttca

SEQ ID NO: 4153274 - DNA, 11 bp, Homo sapiens
tccccttcctt

SEQ ID NO: 4153275 - DNA, 14 bp, Homo sapiens
tcccctttcctgtc

SEQ ID NO: 4153276 - DNA, 17 bp, Homo sapiens
tcccctttcctgtccca

SEQ ID NO: 4153277 - DNA, 22 bp, Homo sapiens
tcccgaagaatgaacccaagag

SEQ ID NO: 4153278 - DNA, 22 bp, Homo sapiens
tcccgagcaatggcgcctgctc

SEQ ID NO: 4153279 - DNA, 18 bp, Homo sapiens
tcccgccagactgttaga

SEQ ID NO: 4153280 - DNA, 17 bp, Homo sapiens
tcccgccagagggcttg

SEQ ID NO: 4153281 - DNA, 18 bp, Homo sapiens
tcccgcccaaacctttcc

SEQ ID NO: 4153282 - DNA, 20 bp, Homo sapiens
tcccgcccaaacctttcccc

SEQ ID NO: 4153283 - DNA, 9 bp, Homo sapiens
tcccgctcc

SEQ ID NO: 4153284 - DNA, 23 bp, Homo sapiens
tcccggcatgggaaagccacctc

SEQ ID NO: 4153285 - DNA, 16 bp, Homo sapiens
tcccgggccacgcccc

SEQ ID NO: 4153286 - DNA, 21 bp, Homo sapiens
tcccgggccagggctgcccct

SEQ ID NO: 4153287 - DNA, 14 bp, Homo sapiens
tcccgtacctcttc

SEQ ID NO: 4153288 - DNA, 23 bp, Homo sapiens
tcccgtgaaagaattatttttgt

SEQ ID NO: 4153289 - DNA, 22 bp, Homo sapiens
tcccgtgcatcccccctgctca

SEQ ID NO: 4153290 - DNA, 19 bp, Homo sapiens
tccctaaactttggccttt

SEQ ID NO: 4153291 - DNA, 14 bp, Homo sapiens
tccctacacacaca

SEQ ID NO: 4153292 - DNA, 13 bp, Homo sapiens
tccctacatgtat

SEQ ID NO: 4153293 - DNA, 19 bp, Homo sapiens
tccctaccccagggccctg

SEQ ID NO: 4153294 - DNA, 21 bp, Homo sapiens
tccctaccgagtctcttctcc

SEQ ID NO: 4153295 - DNA, 14 bp, Homo sapiens
tccctacctgcttc

SEQ ID NO: 4153296 - DNA, 22 bp, Homo sapiens
tccctagaaaacaatgcaaaac

SEQ ID NO: 4153297 - DNA, 17 bp, Homo sapiens
tccctagagggttcctg

SEQ ID NO: 4153298 - DNA, 19 bp, Homo sapiens
tccctagctttagaccctg

SEQ ID NO: 4153299 - DNA, 22 bp, Homo sapiens
tccctagctttagaccctgggt

SEQ ID NO: 4153300 - DNA, 22 bp, Homo sapiens
tccctagtccccctgttttctg

SEQ ID NO: 4153301 - DNA, 20 bp, Homo sapiens
tccctatctattaaagtgac

SEQ ID NO: 4153302 - DNA, 21 bp, Homo sapiens
tccctatctattaaagtgact

SEQ ID NO: 4153303 - DNA, 12 bp, Homo sapiens
tccctcacctgt

SEQ ID NO: 4153304 - DNA, 15 bp, Homo sapiens
tccctcaccttggca

SEQ ID NO: 4153305 - DNA, 20 bp, Homo sapiens
tccctcaccttggcaccaga

SEQ ID NO: 4153306 - DNA, 21 bp, Homo sapiens
tccctcaccttggcaccagac

SEQ ID NO: 4153307 - DNA, 22 bp, Homo sapiens
tccctcaccttggcaccagaca

SEQ ID NO: 4153308 - DNA, 17 bp, Homo sapiens
tccctcagctctctggg

SEQ ID NO: 4153309 - DNA, 18 bp, Homo sapiens
tccctcaggttctatttt

SEQ ID NO: 4153310 - DNA, 14 bp, Homo sapiens
tccctccaccccac

SEQ ID NO: 4153311 - DNA, 18 bp, Homo sapiens
tccctccattcatccttc

SEQ ID NO: 4153312 - DNA, 20 bp, Homo sapiens
tccctccattcatccttcca

SEQ ID NO: 4153313 - DNA, 19 bp, Homo sapiens
tccctccatttttctccca

SEQ ID NO: 4153314 - DNA, 12 bp, Homo sapiens
tccctccccccc

SEQ ID NO: 4153315 - DNA, 14 bp, Homo sapiens
tccctcccccccat

SEQ ID NO: 4153316 - DNA, 13 bp, Homo sapiens
tccctcccctgcc

SEQ ID NO: 4153317 - DNA, 19 bp, Homo sapiens
tccctcccctgccctggtc

SEQ ID NO: 4153318 - DNA, 20 bp, Homo sapiens
tccctcccggcatgggaaag

SEQ ID NO: 4153319 - DNA, 14 bp, Homo sapiens
tccctccctgcctg

SEQ ID NO: 4153320 - DNA, 16 bp, Homo sapiens
tccctccctgctgtca

SEQ ID NO: 4153321 - DNA, 22 bp, Homo sapiens
tccctcccttgctgaacacaca

SEQ ID NO: 4153322 - DNA, 22 bp, Homo sapiens
tccctccgccttctcccacatg

SEQ ID NO: 4153323 - DNA, 12 bp, Homo sapiens
tccctcctcacc

SEQ ID NO: 4153324 - DNA, 13 bp, Homo sapiens
tccctcctcacct

SEQ ID NO: 4153325 - DNA, 18 bp, Homo sapiens
tccctcctcacctctgga

SEQ ID NO: 4153326 - DNA, 16 bp, Homo sapiens
tccctcctccaggcct

SEQ ID NO: 4153327 - DNA, 12 bp, Homo sapiens
tccctccttggg

SEQ ID NO: 4153328 - DNA, 13 bp, Homo sapiens
tccctccttgggt

SEQ ID NO: 4153329 - DNA, 23 bp, Homo sapiens
tccctccttgggtcattgacctc

SEQ ID NO: 4153330 - DNA, 15 bp, Homo sapiens
tccctcctttagtga

SEQ ID NO: 4153331 - DNA, 22 bp, Homo sapiens
tccctcgacagcgcccctgctg

SEQ ID NO: 4153332 - DNA, 19 bp, Homo sapiens
tccctctcagaggcctgct

SEQ ID NO: 4153333 - DNA, 12 bp, Homo sapiens
tccctctcctgc

SEQ ID NO: 4153334 - DNA, 19 bp, Homo sapiens
tccctctctcagcacagcc

SEQ ID NO: 4153335 - DNA, 21 bp, Homo sapiens
tccctctctcttctgctccac

SEQ ID NO: 4153336 - DNA, 19 bp, Homo sapiens
tccctctctgatgtcccag

SEQ ID NO: 4153337 - DNA, 21 bp, Homo sapiens
tccctctgagaattccaagga

SEQ ID NO: 4153338 - DNA, 12 bp, Homo sapiens
tccctctgctca

SEQ ID NO: 4153339 - DNA, 21 bp, Homo sapiens
tccctctgctcagccaagctt

SEQ ID NO: 4153340 - DNA, 15 bp, Homo sapiens
tccctctgctcctgg

SEQ ID NO: 4153341 - DNA, 18 bp, Homo sapiens
tccctctgctcctggagc

SEQ ID NO: 4153342 - DNA, 20 bp, Homo sapiens
tccctctgctcctggagcct

SEQ ID NO: 4153343 - DNA, 23 bp, Homo sapiens
tccctcttctaacccaactgact

SEQ ID NO: 4153344 - DNA, 14 bp, Homo sapiens
tccctctttggcag

SEQ ID NO: 4153345 - DNA, 20 bp, Homo sapiens
tccctctttggcagttgcat

SEQ ID NO: 4153346 - DNA, 21 bp, Homo sapiens
tccctgaatcccccttgccac

SEQ ID NO: 4153347 - DNA, 18 bp, Homo sapiens
tccctgaatctgtgcctg

SEQ ID NO: 4153348 - DNA, 17 bp, Homo sapiens
tccctgacctccctcta

SEQ ID NO: 4153349 - DNA, 16 bp, Homo sapiens
tccctgactccctgtg

SEQ ID NO: 4153350 - DNA, 17 bp, Homo sapiens
tccctgactccctgtgg

SEQ ID NO: 4153351 - DNA, 16 bp, Homo sapiens
tccctgagcaggaaag

SEQ ID NO: 4153352 - DNA, 15 bp, Homo sapiens
tccctgaggatgggt

SEQ ID NO: 4153353 - DNA, 22 bp, Homo sapiens
tccctgaggatgggtcagagct

SEQ ID NO: 4153354 - DNA, 23 bp, Homo sapiens
tccctgaggatgggtcagagcta

SEQ ID NO: 4153355 - DNA, 22 bp, Homo sapiens
tccctgaggttaaacggtgccc

SEQ ID NO: 4153356 - DNA, 17 bp, Homo sapiens
tccctgatcccttccac

SEQ ID NO: 4153357 - DNA, 21 bp, Homo sapiens
tccctgatggcagaactccca

SEQ ID NO: 4153358 - DNA, 23 bp, Homo sapiens
tccctgatggcagaactcccaca

SEQ ID NO: 4153359 - DNA, 20 bp, Homo sapiens
tccctgcactaaagccagcc

SEQ ID NO: 4153360 - DNA, 21 bp, Homo sapiens
tccctgcactaaagccagcct

SEQ ID NO: 4153361 - DNA, 22 bp, Homo sapiens
tccctgcagacctcaagccatc

SEQ ID NO: 4153362 - DNA, 12 bp, Homo sapiens
tccctgccagag

SEQ ID NO: 4153363 - DNA, 19 bp, Homo sapiens
tccctgcccctcccttcaa

SEQ ID NO: 4153364 - DNA, 13 bp, Homo sapiens
tccctgcctgagg

SEQ ID NO: 4153365 - DNA, 23 bp, Homo sapiens
tccctgcgagacgcacacagctg

SEQ ID NO: 4153366 - DNA, 16 bp, Homo sapiens
tccctgcgcctgtgat

SEQ ID NO: 4153367 - DNA, 22 bp, Homo sapiens
tccctgctgtcattgcttcttc

SEQ ID NO: 4153368 - DNA, 14 bp, Homo sapiens
tccctgcttccagg

SEQ ID NO: 4153369 - DNA, 18 bp, Homo sapiens
tccctgcttccaggaaac

SEQ ID NO: 4153370 - DNA, 22 bp, Homo sapiens
tccctgcttgcaggaggccaaa

SEQ ID NO: 4153371 - DNA, 18 bp, Homo sapiens
tccctgctttgcatcttt

SEQ ID NO: 4153372 - DNA, 20 bp, Homo sapiens
tccctgctttggctgagggg

SEQ ID NO: 4153373 - DNA, 20 bp, Homo sapiens
tccctggaactcctggcctt

SEQ ID NO: 4153374 - DNA, 18 bp, Homo sapiens
tccctggagcaggagccc

SEQ ID NO: 4153375 - DNA, 11 bp, Homo sapiens
tccctggagtg

SEQ ID NO: 4153376 - DNA, 11 bp, Homo sapiens
tccctggcgca

SEQ ID NO: 4153377 - DNA, 21 bp, Homo sapiens
tccctggcgcaggtgggctgg

SEQ ID NO: 4153378 - DNA, 12 bp, Homo sapiens
tccctggctccc

SEQ ID NO: 4153379 - DNA, 14 bp, Homo sapiens
tccctggctcccat

SEQ ID NO: 4153380 - DNA, 14 bp, Homo sapiens
tccctgggaggccc

SEQ ID NO: 4153381 - DNA, 12 bp, Homo sapiens
tccctgggcatt

SEQ ID NO: 4153382 - DNA, 17 bp, Homo sapiens
tccctgggcattgcttt

SEQ ID NO: 4153383 - DNA, 17 bp, Homo sapiens
tccctgggccagggtct

SEQ ID NO: 4153384 - DNA, 15 bp, Homo sapiens
tccctgggcccctcc

SEQ ID NO: 4153385 - DNA, 17 bp, Homo sapiens
tccctgggcccctccac

SEQ ID NO: 4153386 - DNA, 18 bp, Homo sapiens
tccctgggcccctccacg

SEQ ID NO: 4153387 - DNA, 17 bp, Homo sapiens
tccctggggctgtgcat

SEQ ID NO: 4153388 - DNA, 17 bp, Homo sapiens
tccctgggggccttggg

SEQ ID NO: 4153389 - DNA, 21 bp, Homo sapiens
tccctgggggccttgggtgag

SEQ ID NO: 4153390 - DNA, 17 bp, Homo sapiens
tccctggtaagaaaaag

SEQ ID NO: 4153391 - DNA, 14 bp, Homo sapiens
tccctgtccccctc

SEQ ID NO: 4153392 - DNA, 14 bp, Homo sapiens
tccctgtctccagc

SEQ ID NO: 4153393 - DNA, 18 bp, Homo sapiens
tccctgtctccagctgcc

SEQ ID NO: 4153394 - DNA, 19 bp, Homo sapiens
tccctgtctccagctgcct

SEQ ID NO: 4153395 - DNA, 20 bp, Homo sapiens
tccctgtctccagctgcctg

SEQ ID NO: 4153396 - DNA, 12 bp, Homo sapiens
tccctgtggggg

SEQ ID NO: 4153397 - DNA, 19 bp, Homo sapiens
tccctgtgggggtggccat

SEQ ID NO: 4153398 - DNA, 22 bp, Homo sapiens
tccctgtgggggtggccatccc

SEQ ID NO: 4153399 - DNA, 16 bp, Homo sapiens
tccctgttccccagag

SEQ ID NO: 4153400 - DNA, 17 bp, Homo sapiens
tccctgttcttcctcca

SEQ ID NO: 4153401 - DNA, 16 bp, Homo sapiens
tcccttagtgactctt

SEQ ID NO: 4153402 - DNA, 14 bp, Homo sapiens
tcccttccacctgc

SEQ ID NO: 4153403 - DNA, 19 bp, Homo sapiens
tcccttccacctgctctgc

SEQ ID NO: 4153404 - DNA, 20 bp, Homo sapiens
tcccttccacctgctctgct

SEQ ID NO: 4153405 - DNA, 21 bp, Homo sapiens
tcccttccacctgctctgctg

SEQ ID NO: 4153406 - DNA, 23 bp, Homo sapiens
tcccttccagtttattccagagc

SEQ ID NO: 4153407 - DNA, 16 bp, Homo sapiens
tcccttcccacatgcc

SEQ ID NO: 4153408 - DNA, 14 bp, Homo sapiens
tcccttcctctctc

SEQ ID NO: 4153409 - DNA, 18 bp, Homo sapiens
tcccttccttttccctgc

SEQ ID NO: 4153410 - DNA, 19 bp, Homo sapiens
tcccttccttttccctgct

SEQ ID NO: 4153411 - DNA, 20 bp, Homo sapiens
tcccttccttttccctgctt

SEQ ID NO: 4153412 - DNA, 12 bp, Homo sapiens
tcccttctcttc

SEQ ID NO: 4153413 - DNA, 20 bp, Homo sapiens
tcccttctcttccaggcagc

SEQ ID NO: 4153414 - DNA, 19 bp, Homo sapiens
tcccttctggacactgaga

SEQ ID NO: 4153415 - DNA, 20 bp, Homo sapiens
tcccttgcaggggtcccccc

SEQ ID NO: 4153416 - DNA, 12 bp, Homo sapiens
tcccttgcctca

SEQ ID NO: 4153417 - DNA, 20 bp, Homo sapiens
tcccttgcctcaatgccagt

SEQ ID NO: 4153418 - DNA, 13 bp, Homo sapiens
tcccttgcctctg

SEQ ID NO: 4153419 - DNA, 15 bp, Homo sapiens
tcccttgcctctgcc

SEQ ID NO: 4153420 - DNA, 18 bp, Homo sapiens
tcccttgctgaacacaca

SEQ ID NO: 4153421 - DNA, 15 bp, Homo sapiens
tcccttgctttgttt

SEQ ID NO: 4153422 - DNA, 13 bp, Homo sapiens
tccctttatgtat

SEQ ID NO: 4153423 - DNA, 15 bp, Homo sapiens
tccctttccccagca

SEQ ID NO: 4153424 - DNA, 15 bp, Homo sapiens
tccctttcccttctt

SEQ ID NO: 4153425 - DNA, 17 bp, Homo sapiens
tccctttccttccatcc

SEQ ID NO: 4153426 - DNA, 19 bp, Homo sapiens
tccctttctgcttgtgtta

SEQ ID NO: 4153427 - DNA, 16 bp, Homo sapiens
tccctttcttctcccc

SEQ ID NO: 4153428 - DNA, 16 bp, Homo sapiens
tccctttcttggccag

SEQ ID NO: 4153429 - DNA, 13 bp, Homo sapiens
tccctttgacttc

SEQ ID NO: 4153430 - DNA, 17 bp, Homo sapiens
tccctttgacttcagct

SEQ ID NO: 4153431 - DNA, 23 bp, Homo sapiens
tccgaactgttcaagtgtcccca

SEQ ID NO: 4153432 - DNA, 17 bp, Homo sapiens
tccgagcctccagtcca

SEQ ID NO: 4153433 - DNA, 20 bp, Homo sapiens
tccgatggatgaatctccca

SEQ ID NO: 4153434 - DNA, 21 bp, Homo sapiens
tccgccaatctggcccttaca

SEQ ID NO: 4153435 - DNA, 11 bp, Homo sapiens
tccgccagcct

SEQ ID NO: 4153436 - DNA, 20 bp, Homo sapiens
tccgccagcctcctctggac

SEQ ID NO: 4153437 - DNA, 15 bp, Homo sapiens
tccgccatggtgtcc

SEQ ID NO: 4153438 - DNA, 21 bp, Homo sapiens
tccgcccacaggaagcctgca

SEQ ID NO: 4153439 - DNA, 12 bp, Homo sapiens
tccgccctcctc

SEQ ID NO: 4153440 - DNA, 18 bp, Homo sapiens
tccgcctacctcagcctc

SEQ ID NO: 4153441 - DNA, 14 bp, Homo sapiens
tccgcggagccctt

SEQ ID NO: 4153442 - DNA, 16 bp, Homo sapiens
tccgctgccagccttg

SEQ ID NO: 4153443 - DNA, 21 bp, Homo sapiens
tccgctgtcgccccaggccct

SEQ ID NO: 4153444 - DNA, 21 bp, Homo sapiens
tccggaacgtagtcggcacag

SEQ ID NO: 4153445 - DNA, 15 bp, Homo sapiens
tccggggccagctcc

SEQ ID NO: 4153446 - DNA, 16 bp, Homo sapiens
tccggggccagctccg

SEQ ID NO: 4153447 - DNA, 17 bp, Homo sapiens
tccgggtgtggcctcag

SEQ ID NO: 4153448 - DNA, 18 bp, Homo sapiens
tccgggtgtggcctcagc

SEQ ID NO: 4153449 - DNA, 19 bp, Homo sapiens
tccgggtgtggcctcagcc

SEQ ID NO: 4153450 - DNA, 22 bp, Homo sapiens
tccgggtgtggcctcagccctc

SEQ ID NO: 4153451 - DNA, 17 bp, Homo sapiens
tccggtagggaggcagc

SEQ ID NO: 4153452 - DNA, 18 bp, Homo sapiens
tccggtggcctattccag

SEQ ID NO: 4153453 - DNA, 21 bp, Homo sapiens
tccggtttagtcatccaacaa

SEQ ID NO: 4153454 - DNA, 16 bp, Homo sapiens
tccgtccggtgtgtca

SEQ ID NO: 4153455 - DNA, 18 bp, Homo sapiens
tccgtgaaaacggagctg

SEQ ID NO: 4153456 - DNA, 17 bp, Homo sapiens
tccgtgaactctggtgc

SEQ ID NO: 4153457 - DNA, 19 bp, Homo sapiens
tccgttaacctttttgtaa

SEQ ID NO: 4153458 - DNA, 20 bp, Homo sapiens
tccgttaacctttttgtaaa

SEQ ID NO: 4153459 - DNA, 13 bp, Homo sapiens
tcctaaaactggg

SEQ ID NO: 4153460 - DNA, 22 bp, Homo sapiens
tcctaaaactgggattaagaaa

SEQ ID NO: 4153461 - DNA, 23 bp, Homo sapiens
tcctaaaccgtcccctccttccc

SEQ ID NO: 4153462 - DNA, 19 bp, Homo sapiens
tcctaaatgcagtgaattg

SEQ ID NO: 4153463 - DNA, 16 bp, Homo sapiens
tcctaacacagcatgt

SEQ ID NO: 4153464 - DNA, 14 bp, Homo sapiens
tcctaacttttcaa

SEQ ID NO: 4153465 - DNA, 13 bp, Homo sapiens
tcctaagaaatat

SEQ ID NO: 4153466 - DNA, 20 bp, Homo sapiens
tcctaagaaatatgtgagat

SEQ ID NO: 4153467 - DNA, 23 bp, Homo sapiens
tcctaagaaatatgtgagatttt

SEQ ID NO: 4153468 - DNA, 18 bp, Homo sapiens
tcctaagctattcagtaa

SEQ ID NO: 4153469 - DNA, 20 bp, Homo sapiens
tcctaagctattcagtaata

SEQ ID NO: 4153470 - DNA, 18 bp, Homo sapiens
tcctaagtgtcaagtcct

SEQ ID NO: 4153471 - DNA, 22 bp, Homo sapiens
tcctaatcagaaatttttatca

SEQ ID NO: 4153472 - DNA, 17 bp, Homo sapiens
tcctaatggctattttt

SEQ ID NO: 4153473 - DNA, 19 bp, Homo sapiens
tcctaatggctatttttga

SEQ ID NO: 4153474 - DNA, 16 bp, Homo sapiens
tcctaatttctcctcc

SEQ ID NO: 4153475 - DNA, 19 bp, Homo sapiens
tcctaatttctcctccctt

SEQ ID NO: 4153476 - DNA, 15 bp, Homo sapiens
tcctaattttaaata

SEQ ID NO: 4153477 - DNA, 15 bp, Homo sapiens
tcctacaaagatgtt

SEQ ID NO: 4153478 - DNA, 19 bp, Homo sapiens
tcctacaacttaatggaaa

SEQ ID NO: 4153479 - DNA, 20 bp, Homo sapiens
tcctacaagagcagcctgtg

SEQ ID NO: 4153480 - DNA, 22 bp, Homo sapiens
tcctacaagagcagcctgtggc

SEQ ID NO: 4153481 - DNA, 13 bp, Homo sapiens
tcctacagcacta

SEQ ID NO: 4153482 - DNA, 14 bp, Homo sapiens
tcctaccaagtcaa

SEQ ID NO: 4153483 - DNA, 17 bp, Homo sapiens
tcctaccagttgcccta

SEQ ID NO: 4153484 - DNA, 15 bp, Homo sapiens
tcctacccaaccact

SEQ ID NO: 4153485 - DNA, 15 bp, Homo sapiens
tcctacccacacctc

SEQ ID NO: 4153486 - DNA, 18 bp, Homo sapiens
tcctacctgccctggaac

SEQ ID NO: 4153487 - DNA, 15 bp, Homo sapiens
tcctacgtccaaggt

SEQ ID NO: 4153488 - DNA, 14 bp, Homo sapiens
tcctactcctgact

SEQ ID NO: 4153489 - DNA, 17 bp, Homo sapiens
tcctactcttctctctg

SEQ ID NO: 4153490 - DNA, 20 bp, Homo sapiens
tcctactcttctctctgctc

SEQ ID NO: 4153491 - DNA, 23 bp, Homo sapiens
tcctactcttctctctgctctga

SEQ ID NO: 4153492 - DNA, 18 bp, Homo sapiens
tcctagagaacgcagccc

SEQ ID NO: 4153493 - DNA, 15 bp, Homo sapiens
tcctagcagacagaa

SEQ ID NO: 4153494 - DNA, 13 bp, Homo sapiens
tcctagccactca

SEQ ID NO: 4153495 - DNA, 17 bp, Homo sapiens
tcctagccactcaggag

SEQ ID NO: 4153496 - DNA, 19 bp, Homo sapiens
tcctagcccttccctgagt

SEQ ID NO: 4153497 - DNA, 20 bp, Homo sapiens
tcctagctgtgttattcctg

SEQ ID NO: 4153498 - DNA, 21 bp, Homo sapiens
tcctagcttgggaggcttccc

SEQ ID NO: 4153499 - DNA, 15 bp, Homo sapiens
tcctaggcccaggcc

SEQ ID NO: 4153500 - DNA, 22 bp, Homo sapiens
tcctaggtccaagccccccaca

SEQ ID NO: 4153501 - DNA, 17 bp, Homo sapiens
tcctagtgtctttaaat

SEQ ID NO: 4153502 - DNA, 18 bp, Homo sapiens
tcctagtgtctttaaata

SEQ ID NO: 4153503 - DNA, 20 bp, Homo sapiens
tcctagttcatcccttctct

SEQ ID NO: 4153504 - DNA, 20 bp, Homo sapiens
tcctataattccctatcttt

SEQ ID NO: 4153505 - DNA, 18 bp, Homo sapiens
tcctatatcctgtgactg

SEQ ID NO: 4153506 - DNA, 21 bp, Homo sapiens
tcctatattgttttcagtgta

SEQ ID NO: 4153507 - DNA, 19 bp, Homo sapiens
tcctatcacctatttccat

SEQ ID NO: 4153508 - DNA, 15 bp, Homo sapiens
tcctatccactgggc

SEQ ID NO: 4153509 - DNA, 16 bp, Homo sapiens
tcctatcctaaataaa

SEQ ID NO: 4153510 - DNA, 13 bp, Homo sapiens
tcctatccttata

SEQ ID NO: 4153511 - DNA, 22 bp, Homo sapiens
tcctatccttataggcctgtcc

SEQ ID NO: 4153512 - DNA, 19 bp, Homo sapiens
tcctatggacaacttattt

SEQ ID NO: 4153513 - DNA, 14 bp, Homo sapiens
tcctattctcacca

SEQ ID NO: 4153514 - DNA, 17 bp, Homo sapiens
tcctattctcaccagga

SEQ ID NO: 4153515 - DNA, 18 bp, Homo sapiens
tcctattctcaccaggaa

SEQ ID NO: 4153516 - DNA, 20 bp, Homo sapiens
tcctattctgatgaatctca

SEQ ID NO: 4153517 - DNA, 17 bp, Homo sapiens
tcctattgtcattaaag

SEQ ID NO: 4153518 - DNA, 23 bp, Homo sapiens
tcctcaagaaataaaaggaagcc

SEQ ID NO: 4153519 - DNA, 14 bp, Homo sapiens
tcctcacacccctg

SEQ ID NO: 4153520 - DNA, 15 bp, Homo sapiens
tcctcacctcatgcc

SEQ ID NO: 4153521 - DNA, 21 bp, Homo sapiens
tcctcacctcatgcccacccc

SEQ ID NO: 4153522 - DNA, 20 bp, Homo sapiens
tcctcacctctggactggct

SEQ ID NO: 4153523 - DNA, 22 bp, Homo sapiens
tcctcacctctggactggctag

SEQ ID NO: 4153524 - DNA, 23 bp, Homo sapiens
tcctcacctctggactggctaga

SEQ ID NO: 4153525 - DNA, 17 bp, Homo sapiens
tcctcacctgtctaggt

SEQ ID NO: 4153526 - DNA, 19 bp, Homo sapiens
tcctcactgccctccccag

SEQ ID NO: 4153527 - DNA, 15 bp, Homo sapiens
tcctcactgggtggg

SEQ ID NO: 4153528 - DNA, 22 bp, Homo sapiens
tcctcacttccatacagctcta

SEQ ID NO: 4153529 - DNA, 14 bp, Homo sapiens
tcctcagagcgcca

SEQ ID NO: 4153530 - DNA, 18 bp, Homo sapiens
tcctcagagcgccaggaa

SEQ ID NO: 4153531 - DNA, 20 bp, Homo sapiens
tcctcagagcgccaggaagc

SEQ ID NO: 4153532 - DNA, 23 bp, Homo sapiens
tcctcagagcgccaggaagccag

SEQ ID NO: 4153533 - DNA, 21 bp, Homo sapiens
tcctcagattagatgtgccaa

SEQ ID NO: 4153534 - DNA, 15 bp, Homo sapiens
tcctcagctgcctcc

SEQ ID NO: 4153535 - DNA, 12 bp, Homo sapiens
tcctcagctggt

SEQ ID NO: 4153536 - DNA, 16 bp, Homo sapiens
tcctcagggtgggggg

SEQ ID NO: 4153537 - DNA, 17 bp, Homo sapiens
tcctcagggtggggggt

SEQ ID NO: 4153538 - DNA, 16 bp, Homo sapiens
tcctcagtccatttat

SEQ ID NO: 4153539 - DNA, 14 bp, Homo sapiens
tcctcatccacccc

SEQ ID NO: 4153540 - DNA, 12 bp, Homo sapiens
tcctcatccctg

SEQ ID NO: 4153541 - DNA, 20 bp, Homo sapiens
tcctcatgacccctcgtcca

SEQ ID NO: 4153542 - DNA, 22 bp, Homo sapiens
tcctcattccctcgtctttccc

SEQ ID NO: 4153543 - DNA, 18 bp, Homo sapiens
tcctccaagtgccccctc

SEQ ID NO: 4153544 - DNA, 22 bp, Homo sapiens
tcctccaagtgccccctcacct

SEQ ID NO: 4153545 - DNA, 16 bp, Homo sapiens
tcctccactcgaccca

SEQ ID NO: 4153546 - DNA, 10 bp, Homo sapiens
tcctccagaa

SEQ ID NO: 4153547 - DNA, 11 bp, Homo sapiens
tcctccagaac

SEQ ID NO: 4153548 - DNA, 18 bp, Homo sapiens
tcctccagaagcctctgg

SEQ ID NO: 4153549 - DNA, 19 bp, Homo sapiens
tcctccagaagcctctggc

SEQ ID NO: 4153550 - DNA, 20 bp, Homo sapiens
tcctccagaagcctctggct

SEQ ID NO: 4153551 - DNA, 21 bp, Homo sapiens
tcctccagaagcctctggcta

SEQ ID NO: 4153552 - DNA, 13 bp, Homo sapiens
tcctccagaccac

SEQ ID NO: 4153553 - DNA, 17 bp, Homo sapiens
tcctccagaccaccagc

SEQ ID NO: 4153554 - DNA, 15 bp, Homo sapiens
tcctccagcccctgt

SEQ ID NO: 4153555 - DNA, 13 bp, Homo sapiens
tcctccaggagct

SEQ ID NO: 4153556 - DNA, 20 bp, Homo sapiens
tcctccatcccaacagccat

SEQ ID NO: 4153557 - DNA, 22 bp, Homo sapiens
tcctcccagtgagactgcccca

SEQ ID NO: 4153558 - DNA, 15 bp, Homo sapiens
tcctcccatcccctg

SEQ ID NO: 4153559 - DNA, 14 bp, Homo sapiens
tcctccccctgcaa

SEQ ID NO: 4153560 - DNA, 20 bp, Homo sapiens
tcctccctcatggctctggc

SEQ ID NO: 4153561 - DNA, 18 bp, Homo sapiens
tcctcccttccttttccc

SEQ ID NO: 4153562 - DNA, 21 bp, Homo sapiens
tcctcccttccttttccctgc

SEQ ID NO: 4153563 - DNA, 19 bp, Homo sapiens
tcctccgtagggtctttct

SEQ ID NO: 4153564 - DNA, 16 bp, Homo sapiens
tcctccgtccagccgc

SEQ ID NO: 4153565 - DNA, 22 bp, Homo sapiens
tcctccgtccatatcagaactg

SEQ ID NO: 4153566 - DNA, 14 bp, Homo sapiens
tcctcctacttaca

SEQ ID NO: 4153567 - DNA, 12 bp, Homo sapiens
tcctcctcacct

SEQ ID NO: 4153568 - DNA, 16 bp, Homo sapiens
tcctcctcacctcatg

SEQ ID NO: 4153569 - DNA, 18 bp, Homo sapiens
tcctcctcacctcatgcc

SEQ ID NO: 4153570 - DNA, 14 bp, Homo sapiens
tcctcctccagggt

SEQ ID NO: 4153571 - DNA, 12 bp, Homo sapiens
tcctcctcttca

SEQ ID NO: 4153572 - DNA, 19 bp, Homo sapiens
tcctcctgccctgtccctg

SEQ ID NO: 4153573 - DNA, 15 bp, Homo sapiens
tcctcctgctgccag

SEQ ID NO: 4153574 - DNA, 13 bp, Homo sapiens
tcctcctggacac

SEQ ID NO: 4153575 - DNA, 13 bp, Homo sapiens
tcctcgcctgaca

SEQ ID NO: 4153576 - DNA, 19 bp, Homo sapiens
tcctcggagagcagcagca

SEQ ID NO: 4153577 - DNA, 21 bp, Homo sapiens
tcctctaaagcagaggcaaca

SEQ ID NO: 4153578 - DNA, 18 bp, Homo sapiens
tcctctacttaatgagat

SEQ ID NO: 4153579 - DNA, 16 bp, Homo sapiens
tcctctagaagccaag

SEQ ID NO: 4153580 - DNA, 17 bp, Homo sapiens
tcctctaggcaagcagg

SEQ ID NO: 4153581 - DNA, 18 bp, Homo sapiens
tcctctaggcaagcagga

SEQ ID NO: 4153582 - DNA, 22 bp, Homo sapiens
tcctctaggcaagcaggacctg

SEQ ID NO: 4153583 - DNA, 21 bp, Homo sapiens
tcctctatacatctctcccca

SEQ ID NO: 4153584 - DNA, 11 bp, Homo sapiens
tcctctatttt

SEQ ID NO: 4153585 - DNA, 18 bp, Homo sapiens
tcctctattttgtgatga

SEQ ID NO: 4153586 - DNA, 13 bp, Homo sapiens
tcctctccactgc

SEQ ID NO: 4153587 - DNA, 18 bp, Homo sapiens
tcctctccactgccttcg

SEQ ID NO: 4153588 - DNA, 17 bp, Homo sapiens
tcctctccccagcccag

SEQ ID NO: 4153589 - DNA, 20 bp, Homo sapiens
tcctctccccagcccagaga

SEQ ID NO: 4153590 - DNA, 23 bp, Homo sapiens
tcctctccccagcccagagacat

SEQ ID NO: 4153591 - DNA, 19 bp, Homo sapiens
tcctctccccctcctccag

SEQ ID NO: 4153592 - DNA, 13 bp, Homo sapiens
tcctctcctggag

SEQ ID NO: 4153593 - DNA, 18 bp, Homo sapiens
tcctctgagcccagctgc

SEQ ID NO: 4153594 - DNA, 19 bp, Homo sapiens
tcctctgagcccagctgcc

SEQ ID NO: 4153595 - DNA, 21 bp, Homo sapiens
tcctctgagcccagctgcctg

SEQ ID NO: 4153596 - DNA, 14 bp, Homo sapiens
tcctctgcctacag

SEQ ID NO: 4153597 - DNA, 19 bp, Homo sapiens
tcctctgcctacagccagg

SEQ ID NO: 4153598 - DNA, 13 bp, Homo sapiens
tcctctgcctgcc

SEQ ID NO: 4153599 - DNA, 19 bp, Homo sapiens
tcctctgctcccccttttc

SEQ ID NO: 4153600 - DNA, 13 bp, Homo sapiens
tcctctggccgca

SEQ ID NO: 4153601 - DNA, 18 bp, Homo sapiens
tcctctggccgcagaggt

SEQ ID NO: 4153602 - DNA, 12 bp, Homo sapiens
tcctctggcttt

SEQ ID NO: 4153603 - DNA, 11 bp, Homo sapiens
tcctcttcaga

SEQ ID NO: 4153604 - DNA, 14 bp, Homo sapiens
tcctcttccctctc

SEQ ID NO: 4153605 - DNA, 18 bp, Homo sapiens
tcctcttctgctcttttc

SEQ ID NO: 4153606 - DNA, 14 bp, Homo sapiens
tcctcttgctcaaa

SEQ ID NO: 4153607 - DNA, 22 bp, Homo sapiens
tcctgaaacgctcctttgtgtg

SEQ ID NO: 4153608 - DNA, 14 bp, Homo sapiens
tcctgaaccatgtg

SEQ ID NO: 4153609 - DNA, 16 bp, Homo sapiens
tcctgacatcacagca

SEQ ID NO: 4153610 - DNA, 18 bp, Homo sapiens
tcctgacatcacagcagc

SEQ ID NO: 4153611 - DNA, 19 bp, Homo sapiens
tcctgacatcacagcagcc

SEQ ID NO: 4153612 - DNA, 21 bp, Homo sapiens
tcctgacatcacagcagcctc

SEQ ID NO: 4153613 - DNA, 20 bp, Homo sapiens
tcctgacgtctgaagcttga

SEQ ID NO: 4153614 - DNA, 23 bp, Homo sapiens
tcctgactcctacctgccctgga

SEQ ID NO: 4153615 - DNA, 17 bp, Homo sapiens
tcctgactctgccccct

SEQ ID NO: 4153616 - DNA, 20 bp, Homo sapiens
tcctgactgaaagtaggggg

SEQ ID NO: 4153617 - DNA, 13 bp, Homo sapiens
tcctgactgtaac

SEQ ID NO: 4153618 - DNA, 22 bp, Homo sapiens
tcctgactgtaacatattctgt

SEQ ID NO: 4153619 - DNA, 17 bp, Homo sapiens
tcctgaggctttggatt

SEQ ID NO: 4153620 - DNA, 16 bp, Homo sapiens
tcctgaggggcatctg

SEQ ID NO: 4153621 - DNA, 21 bp, Homo sapiens
tcctgaggggcatctgcccct

SEQ ID NO: 4153622 - DNA, 22 bp, Homo sapiens
tcctgaggggcatctgcccctc

SEQ ID NO: 4153623 - DNA, 17 bp, Homo sapiens
tcctgagggtccccacc

SEQ ID NO: 4153624 - DNA, 15 bp, Homo sapiens
tcctgataaagcaca

SEQ ID NO: 4153625 - DNA, 21 bp, Homo sapiens
tcctgataaagcacagctgta

SEQ ID NO: 4153626 - DNA, 19 bp, Homo sapiens
tcctgataataattgatca

SEQ ID NO: 4153627 - DNA, 23 bp, Homo sapiens
tcctgcaaccaaactcccatcag

SEQ ID NO: 4153628 - DNA, 18 bp, Homo sapiens
tcctgcaactcaaggact

SEQ ID NO: 4153629 - DNA, 13 bp, Homo sapiens
tcctgcaatgaaa

SEQ ID NO: 4153630 - DNA, 16 bp, Homo sapiens
tcctgcaattttctaa

SEQ ID NO: 4153631 - DNA, 22 bp, Homo sapiens
tcctgcagcaaacactccaccc

SEQ ID NO: 4153632 - DNA, 17 bp, Homo sapiens
tcctgcagcatggtccc

SEQ ID NO: 4153633 - DNA, 22 bp, Homo sapiens
tcctgcagcatggtccctgcct

SEQ ID NO: 4153634 - DNA, 18 bp, Homo sapiens
tcctgcagccccagaaga

SEQ ID NO: 4153635 - DNA, 20 bp, Homo sapiens
tcctgcagccccagaagaaa

SEQ ID NO: 4153636 - DNA, 13 bp, Homo sapiens
tcctgccagcccc

SEQ ID NO: 4153637 - DNA, 15 bp, Homo sapiens
tcctgccagccccac

SEQ ID NO: 4153638 - DNA, 15 bp, Homo sapiens
tcctgcccagcctgg

SEQ ID NO: 4153639 - DNA, 17 bp, Homo sapiens
tcctgcccagcctgggg

SEQ ID NO: 4153640 - DNA, 17 bp, Homo sapiens
tcctgcccatgtgtccc

SEQ ID NO: 4153641 - DNA, 20 bp, Homo sapiens
tcctgcccatgtgtcccctc

SEQ ID NO: 4153642 - DNA, 15 bp, Homo sapiens
tcctgccccaggcct

SEQ ID NO: 4153643 - DNA, 15 bp, Homo sapiens
tcctgccctgtccct

SEQ ID NO: 4153644 - DNA, 12 bp, Homo sapiens
tcctgccctgtt

SEQ ID NO: 4153645 - DNA, 14 bp, Homo sapiens
tcctgcctcagcct

SEQ ID NO: 4153646 - DNA, 17 bp, Homo sapiens
tcctgcctcagcctccg

SEQ ID NO: 4153647 - DNA, 14 bp, Homo sapiens
tcctgcctgcccct

SEQ ID NO: 4153648 - DNA, 13 bp, Homo sapiens
tcctgcctggcac

SEQ ID NO: 4153649 - DNA, 16 bp, Homo sapiens
tcctgcctggccaggc

SEQ ID NO: 4153650 - DNA, 14 bp, Homo sapiens
tcctgcctgtctgc

SEQ ID NO: 4153651 - DNA, 17 bp, Homo sapiens
tcctgcctgtctgcccc

SEQ ID NO: 4153652 - DNA, 12 bp, Homo sapiens
tcctgcctttta

SEQ ID NO: 4153653 - DNA, 14 bp, Homo sapiens
tcctgcgggtttta

SEQ ID NO: 4153654 - DNA, 16 bp, Homo sapiens
tcctgcgggttttaat

SEQ ID NO: 4153655 - DNA, 21 bp, Homo sapiens
tcctgcgggttttaatttatt

SEQ ID NO: 4153656 - DNA, 18 bp, Homo sapiens
tcctgcgtcctcctcacc

SEQ ID NO: 4153657 - DNA, 21 bp, Homo sapiens
tcctgcgtcctcctcacctca

SEQ ID NO: 4153658 - DNA, 21 bp, Homo sapiens
tcctgctacaacttcagcagt

SEQ ID NO: 4153659 - DNA, 15 bp, Homo sapiens
tcctgctacaggagg

SEQ ID NO: 4153660 - DNA, 15 bp, Homo sapiens
tcctgctcaccacct

SEQ ID NO: 4153661 - DNA, 12 bp, Homo sapiens
tcctgctctgct

SEQ ID NO: 4153662 - DNA, 13 bp, Homo sapiens
tcctgctgcaccc

SEQ ID NO: 4153663 - DNA, 23 bp, Homo sapiens
tcctgctgcaccctgcgcctcca

SEQ ID NO: 4153664 - DNA, 13 bp, Homo sapiens
tcctgctgccagt

SEQ ID NO: 4153665 - DNA, 22 bp, Homo sapiens
tcctgctgcggaggagctgcct

SEQ ID NO: 4153666 - DNA, 15 bp, Homo sapiens
tcctgctgctgtgtt

SEQ ID NO: 4153667 - DNA, 23 bp, Homo sapiens
tcctgctggcttccagcttcagg

SEQ ID NO: 4153668 - DNA, 18 bp, Homo sapiens
tcctgcttccgagatccc

SEQ ID NO: 4153669 - DNA, 18 bp, Homo sapiens
tcctgcttttctgtcctg

SEQ ID NO: 4153670 - DNA, 22 bp, Homo sapiens
tcctgcttttctgtcctgggca

SEQ ID NO: 4153671 - DNA, 15 bp, Homo sapiens
tcctggaaatattaa

SEQ ID NO: 4153672 - DNA, 14 bp, Homo sapiens
tcctggaaccaatc

SEQ ID NO: 4153673 - DNA, 17 bp, Homo sapiens
tcctggaaccttgctgt

SEQ ID NO: 4153674 - DNA, 19 bp, Homo sapiens
tcctggaaccttgctgtcc

SEQ ID NO: 4153675 - DNA, 20 bp, Homo sapiens
tcctggaaccttgctgtcct

SEQ ID NO: 4153676 - DNA, 13 bp, Homo sapiens
tcctggaggccca

SEQ ID NO: 4153677 - DNA, 18 bp, Homo sapiens
tcctggaggcccagttca

SEQ ID NO: 4153678 - DNA, 13 bp, Homo sapiens
tcctggagttttg

SEQ ID NO: 4153679 - DNA, 16 bp, Homo sapiens
tcctggagttttgatt

SEQ ID NO: 4153680 - DNA, 20 bp, Homo sapiens
tcctggcaatagtgtgttct

SEQ ID NO: 4153681 - DNA, 18 bp, Homo sapiens
tcctggcctatccgctgc

SEQ ID NO: 4153682 - DNA, 13 bp, Homo sapiens
tcctggcctgaga

SEQ ID NO: 4153683 - DNA, 21 bp, Homo sapiens
tcctggctacatcccagcctg

SEQ ID NO: 4153684 - DNA, 16 bp, Homo sapiens
tcctggctcctgaggg

SEQ ID NO: 4153685 - DNA, 19 bp, Homo sapiens
tcctggctgatgatccaga

SEQ ID NO: 4153686 - DNA, 14 bp, Homo sapiens
tcctggctgggcca

SEQ ID NO: 4153687 - DNA, 23 bp, Homo sapiens
tcctgggaagatgaggttctgag

SEQ ID NO: 4153688 - DNA, 19 bp, Homo sapiens
tcctgggcaatcagacacc

SEQ ID NO: 4153689 - DNA, 18 bp, Homo sapiens
tcctgggcatgggtccag

SEQ ID NO: 4153690 - DNA, 22 bp, Homo sapiens
tcctgggcatgggtccagggcc

SEQ ID NO: 4153691 - DNA, 13 bp, Homo sapiens
tcctgggcctgca

SEQ ID NO: 4153692 - DNA, 15 bp, Homo sapiens
tcctgggcctgcaga

SEQ ID NO: 4153693 - DNA, 13 bp, Homo sapiens
tcctgggcctttg

SEQ ID NO: 4153694 - DNA, 13 bp, Homo sapiens
tcctgggctcagg

SEQ ID NO: 4153695 - DNA, 20 bp, Homo sapiens
tcctgggctggggccaccat

SEQ ID NO: 4153696 - DNA, 16 bp, Homo sapiens
tcctgggggtggcagg

SEQ ID NO: 4153697 - DNA, 21 bp, Homo sapiens
tcctggttcccgtttctccac

SEQ ID NO: 4153698 - DNA, 23 bp, Homo sapiens
tcctggtttcataacttcctgta

SEQ ID NO: 4153699 - DNA, 19 bp, Homo sapiens
tcctggttttgtacactgc

SEQ ID NO: 4153700 - DNA, 20 bp, Homo sapiens
tcctggttttgtacactgct

SEQ ID NO: 4153701 - DNA, 21 bp, Homo sapiens
tcctggttttgtacactgctg

SEQ ID NO: 4153702 - DNA, 23 bp, Homo sapiens
tcctggttttgtacactgctgta

SEQ ID NO: 4153703 - DNA, 17 bp, Homo sapiens
tcctgtaacaggtgtgg

SEQ ID NO: 4153704 - DNA, 20 bp, Homo sapiens
tcctgtacattgtgggatgt

SEQ ID NO: 4153705 - DNA, 15 bp, Homo sapiens
tcctgtaccaaatct

SEQ ID NO: 4153706 - DNA, 23 bp, Homo sapiens
tcctgtaccaaatctgacatatt

SEQ ID NO: 4153707 - DNA, 20 bp, Homo sapiens
tcctgtagacctagggagga

SEQ ID NO: 4153708 - DNA, 23 bp, Homo sapiens
tcctgtagacctagggaggacct

SEQ ID NO: 4153709 - DNA, 13 bp, Homo sapiens
tcctgtccagctc

SEQ ID NO: 4153710 - DNA, 15 bp, Homo sapiens
tcctgtccagctcca

SEQ ID NO: 4153711 - DNA, 10 bp, Homo sapiens
tcctgtccca

SEQ ID NO: 4153712 - DNA, 22 bp, Homo sapiens
tcctgtccccaaaatgtgatgc

SEQ ID NO: 4153713 - DNA, 14 bp, Homo sapiens
tcctgtccctgagg

SEQ ID NO: 4153714 - DNA, 16 bp, Homo sapiens
tcctgtccctgaggtt

SEQ ID NO: 4153715 - DNA, 16 bp, Homo sapiens
tcctgtcttttcaggt

SEQ ID NO: 4153716 - DNA, 22 bp, Homo sapiens
tcctgtgaagtttaattgtctc

SEQ ID NO: 4153717 - DNA, 15 bp, Homo sapiens
tcctgtgacatgtaa

SEQ ID NO: 4153718 - DNA, 15 bp, Homo sapiens
tcctgtgcatgggtg

SEQ ID NO: 4153719 - DNA, 18 bp, Homo sapiens
tcctgtgcatgggtgaag

SEQ ID NO: 4153720 - DNA, 13 bp, Homo sapiens
tcctgtgccaggt

SEQ ID NO: 4153721 - DNA, 17 bp, Homo sapiens
tcctgtgcccacatccc

SEQ ID NO: 4153722 - DNA, 14 bp, Homo sapiens
tcctgtgctggggg

SEQ ID NO: 4153723 - DNA, 15 bp, Homo sapiens
tcctgtggggaaagg

SEQ ID NO: 4153724 - DNA, 23 bp, Homo sapiens
tcctgtgggtgttctttcctgcc

SEQ ID NO: 4153725 - DNA, 13 bp, Homo sapiens
tcctgttcagtga

SEQ ID NO: 4153726 - DNA, 16 bp, Homo sapiens
tcctgtttcaagttca

SEQ ID NO: 4153727 - DNA, 17 bp, Homo sapiens
tcctgtttttctgggtg

SEQ ID NO: 4153728 - DNA, 18 bp, Homo sapiens
tccttaaaaatcacactg

SEQ ID NO: 4153729 - DNA, 17 bp, Homo sapiens
tccttaaactgtgtgga

SEQ ID NO: 4153730 - DNA, 22 bp, Homo sapiens
tccttaacccacctctcctgcc

SEQ ID NO: 4153731 - DNA, 15 bp, Homo sapiens
tccttagaacatttt

SEQ ID NO: 4153732 - DNA, 12 bp, Homo sapiens
tccttagtgtat

SEQ ID NO: 4153733 - DNA, 14 bp, Homo sapiens
tccttatcagagct

SEQ ID NO: 4153734 - DNA, 19 bp, Homo sapiens
tccttatccctctcttccc

SEQ ID NO: 4153735 - DNA, 21 bp, Homo sapiens
tccttatccctctcttcccct

SEQ ID NO: 4153736 - DNA, 22 bp, Homo sapiens
tccttatgtatcagtgtccttt

SEQ ID NO: 4153737 - DNA, 15 bp, Homo sapiens
tccttatttgccttc

SEQ ID NO: 4153738 - DNA, 19 bp, Homo sapiens
tccttcaccagagcccatg

SEQ ID NO: 4153739 - DNA, 14 bp, Homo sapiens
tccttcagatttgg

SEQ ID NO: 4153740 - DNA, 15 bp, Homo sapiens
tccttcattcatagg

SEQ ID NO: 4153741 - DNA, 17 bp, Homo sapiens
tccttccaaaaaattaa

SEQ ID NO: 4153742 - DNA, 16 bp, Homo sapiens
tccttccagcccatcc

SEQ ID NO: 4153743 - DNA, 17 bp, Homo sapiens
tccttccagcccatcca

SEQ ID NO: 4153744 - DNA, 13 bp, Homo sapiens
tccttccatccat

SEQ ID NO: 4153745 - DNA, 16 bp, Homo sapiens
tccttccatccctacc

SEQ ID NO: 4153746 - DNA, 17 bp, Homo sapiens
tccttccatccctaccc

SEQ ID NO: 4153747 - DNA, 23 bp, Homo sapiens
tccttcccacccctacacacaca

SEQ ID NO: 4153748 - DNA, 19 bp, Homo sapiens
tccttccctcacccccagc

SEQ ID NO: 4153749 - DNA, 17 bp, Homo sapiens
tccttccctctctgatg

SEQ ID NO: 4153750 - DNA, 12 bp, Homo sapiens
tccttcctatgc

SEQ ID NO: 4153751 - DNA, 13 bp, Homo sapiens
tccttcctggcct

SEQ ID NO: 4153752 - DNA, 14 bp, Homo sapiens
tccttcctggcctg

SEQ ID NO: 4153753 - DNA, 21 bp, Homo sapiens
tccttcctgttagtggttgtg

SEQ ID NO: 4153754 - DNA, 15 bp, Homo sapiens
tccttccttcagggt

SEQ ID NO: 4153755 - DNA, 23 bp, Homo sapiens
tccttcggggcgatgctccctca

SEQ ID NO: 4153756 - DNA, 16 bp, Homo sapiens
tccttcgggtgctgga

SEQ ID NO: 4153757 - DNA, 20 bp, Homo sapiens
tccttctcattacccacccg

SEQ ID NO: 4153758 - DNA, 12 bp, Homo sapiens
tccttctccttc

SEQ ID NO: 4153759 - DNA, 15 bp, Homo sapiens
tccttctctgaacac

SEQ ID NO: 4153760 - DNA, 22 bp, Homo sapiens
tccttctctgaacacaggcagc

SEQ ID NO: 4153761 - DNA, 13 bp, Homo sapiens
tccttctctgggt

SEQ ID NO: 4153762 - DNA, 16 bp, Homo sapiens
tccttctttgataatg

SEQ ID NO: 4153763 - DNA, 22 bp, Homo sapiens
tccttgaacaagatgtgggcct

SEQ ID NO: 4153764 - DNA, 19 bp, Homo sapiens
tccttgaggggagccagga

SEQ ID NO: 4153765 - DNA, 22 bp, Homo sapiens
tccttgaggggagccaggaggg

SEQ ID NO: 4153766 - DNA, 13 bp, Homo sapiens
tccttgatcattt

SEQ ID NO: 4153767 - DNA, 16 bp, Homo sapiens
tccttgccccccgccc

SEQ ID NO: 4153768 - DNA, 20 bp, Homo sapiens
tccttgccccccgccctcat

SEQ ID NO: 4153769 - DNA, 19 bp, Homo sapiens
tccttgcgcctcagccctc

SEQ ID NO: 4153770 - DNA, 14 bp, Homo sapiens
tccttgcttcctga

SEQ ID NO: 4153771 - DNA, 15 bp, Homo sapiens
tccttgcttcctgat

SEQ ID NO: 4153772 - DNA, 13 bp, Homo sapiens
tccttggaggcca

SEQ ID NO: 4153773 - DNA, 18 bp, Homo sapiens
tccttgggggctcccagg

SEQ ID NO: 4153774 - DNA, 21 bp, Homo sapiens
tccttggtgtgaccctctgaa

SEQ ID NO: 4153775 - DNA, 18 bp, Homo sapiens
tccttgttggtcagagga

SEQ ID NO: 4153776 - DNA, 14 bp, Homo sapiens
tccttgttgttggt

SEQ ID NO: 4153777 - DNA, 18 bp, Homo sapiens
tccttgttgtttgctttg

SEQ ID NO: 4153778 - DNA, 21 bp, Homo sapiens
tccttgtttatcagatacatc

SEQ ID NO: 4153779 - DNA, 14 bp, Homo sapiens
tcctttacgtgttt

SEQ ID NO: 4153780 - DNA, 16 bp, Homo sapiens
tcctttacgtgtttaa

SEQ ID NO: 4153781 - DNA, 15 bp, Homo sapiens
tcctttatactgtga

SEQ ID NO: 4153782 - DNA, 19 bp, Homo sapiens
tcctttatactgtgaagtt

SEQ ID NO: 4153783 - DNA, 14 bp, Homo sapiens
tcctttatgtgaat

SEQ ID NO: 4153784 - DNA, 19 bp, Homo sapiens
tcctttcacaaccttctgt

SEQ ID NO: 4153785 - DNA, 13 bp, Homo sapiens
tcctttcacttct

SEQ ID NO: 4153786 - DNA, 14 bp, Homo sapiens
tcctttctcagccg

SEQ ID NO: 4153787 - DNA, 13 bp, Homo sapiens
tcctttctccagg

SEQ ID NO: 4153788 - DNA, 22 bp, Homo sapiens
tcctttcttggttcataaatga

SEQ ID NO: 4153789 - DNA, 12 bp, Homo sapiens
tcctttcttttc

SEQ ID NO: 4153790 - DNA, 17 bp, Homo sapiens
tcctttgacaaaagtaa

SEQ ID NO: 4153791 - DNA, 19 bp, Homo sapiens
tcctttgacaaaagtaaat

SEQ ID NO: 4153792 - DNA, 17 bp, Homo sapiens
tcctttgcactgagggc

SEQ ID NO: 4153793 - DNA, 20 bp, Homo sapiens
tcctttgcactgagggccac

SEQ ID NO: 4153794 - DNA, 15 bp, Homo sapiens
tcctttgcagggcag

SEQ ID NO: 4153795 - DNA, 13 bp, Homo sapiens
tcctttgtagcta

SEQ ID NO: 4153796 - DNA, 18 bp, Homo sapiens
tcctttgtgtgtgtgtca

SEQ ID NO: 4153797 - DNA, 13 bp, Homo sapiens
tccttttagccta

SEQ ID NO: 4153798 - DNA, 14 bp, Homo sapiens
tccttttagcctag

SEQ ID NO: 4153799 - DNA, 15 bp, Homo sapiens
tccttttagcctagt

SEQ ID NO: 4153800 - DNA, 14 bp, Homo sapiens
tccttttccagagc

SEQ ID NO: 4153801 - DNA, 15 bp, Homo sapiens
tccttttccgttctg

SEQ ID NO: 4153802 - DNA, 14 bp, Homo sapiens
tccttttcctatcc

SEQ ID NO: 4153803 - DNA, 19 bp, Homo sapiens
tccttttccttatttgcct

SEQ ID NO: 4153804 - DNA, 14 bp, Homo sapiens
tccttttctgtgtt

SEQ ID NO: 4153805 - DNA, 15 bp, Homo sapiens
tccttttctgtgttt

SEQ ID NO: 4153806 - DNA, 17 bp, Homo sapiens
tccttttgtgtacagtg

SEQ ID NO: 4153807 - DNA, 19 bp, Homo sapiens
tccttttgtgttccaaaca

SEQ ID NO: 4153808 - DNA, 16 bp, Homo sapiens
tcctttttaaatgtga

SEQ ID NO: 4153809 - DNA, 18 bp, Homo sapiens
tcctttttaaatgtgaat

SEQ ID NO: 4153810 - DNA, 21 bp, Homo sapiens
tcctttttaaatgtgaatttt

SEQ ID NO: 4153811 - DNA, 12 bp, Homo sapiens
tcctttttaata

SEQ ID NO: 4153812 - DNA, 17 bp, Homo sapiens
tcctttttaatatgctt

SEQ ID NO: 4153813 - DNA, 14 bp, Homo sapiens
tcctttttccatca

SEQ ID NO: 4153814 - DNA, 21 bp, Homo sapiens
tcctttttccatcattttaca

SEQ ID NO: 4153815 - DNA, 20 bp, Homo sapiens
tcctttttctgattagcttt

SEQ ID NO: 4153816 - DNA, 22 bp, Homo sapiens
tcctttttctgattagctttgt

SEQ ID NO: 4153817 - DNA, 23 bp, Homo sapiens
tcctttttctgattagctttgtg

SEQ ID NO: 4153818 - DNA, 21 bp, Homo sapiens
tcctttttcttcgctggacta

SEQ ID NO: 4153819 - DNA, 14 bp, Homo sapiens
tcctttttgacact

SEQ ID NO: 4153820 - DNA, 16 bp, Homo sapiens
tcctttttgacactga

SEQ ID NO: 4153821 - DNA, 17 bp, Homo sapiens
tccttttttatacagga

SEQ ID NO: 4153822 - DNA, 19 bp, Homo sapiens
tcgaaacctgggattcagg

SEQ ID NO: 4153823 - DNA, 14 bp, Homo sapiens
tcgaaataacaatg

SEQ ID NO: 4153824 - DNA, 18 bp, Homo sapiens
tcgaaataacaatgttaa

SEQ ID NO: 4153825 - DNA, 19 bp, Homo sapiens
tcgaaataacaatgttaag

SEQ ID NO: 4153826 - DNA, 20 bp, Homo sapiens
tcgaaataacaatgttaagg

SEQ ID NO: 4153827 - DNA, 22 bp, Homo sapiens
tcgaaatagatatcctctcccc

SEQ ID NO: 4153828 - DNA, 15 bp, Homo sapiens
tcgaaccgttttgaa

SEQ ID NO: 4153829 - DNA, 18 bp, Homo sapiens
tcgaaccgttttgaagct

SEQ ID NO: 4153830 - DNA, 14 bp, Homo sapiens
tcgaacttcacaac

SEQ ID NO: 4153831 - DNA, 18 bp, Homo sapiens
tcgaacttcacaactagg

SEQ ID NO: 4153832 - DNA, 18 bp, Homo sapiens
tcgaaggctctctctttc

SEQ ID NO: 4153833 - DNA, 21 bp, Homo sapiens
tcgacataccccactgggcac

SEQ ID NO: 4153834 - DNA, 14 bp, Homo sapiens
tcgacccagaatgg

SEQ ID NO: 4153835 - DNA, 16 bp, Homo sapiens
tcgactcaggatccag

SEQ ID NO: 4153836 - DNA, 14 bp, Homo sapiens
tcgagaccagtctg

SEQ ID NO: 4153837 - DNA, 21 bp, Homo sapiens
tcgagcagtcctgcctcagcc

SEQ ID NO: 4153838 - DNA, 10 bp, Homo sapiens
tcgaggcctg

SEQ ID NO: 4153839 - DNA, 16 bp, Homo sapiens
tcgaggctgcagtcag

SEQ ID NO: 4153840 - DNA, 20 bp, Homo sapiens
tcgaggctgcagtcagtcat

SEQ ID NO: 4153841 - DNA, 16 bp, Homo sapiens
tcgaggggctctcagc

SEQ ID NO: 4153842 - DNA, 20 bp, Homo sapiens
tcgaggggctctcagctcag

SEQ ID NO: 4153843 - DNA, 20 bp, Homo sapiens
tcgaggggtgggctggtatc

SEQ ID NO: 4153844 - DNA, 13 bp, Homo sapiens
tcgatatgtatat

SEQ ID NO: 4153845 - DNA, 21 bp, Homo sapiens
tcgatatgtatatcattctac

SEQ ID NO: 4153846 - DNA, 20 bp, Homo sapiens
tcgatctcattcagtattaa

SEQ ID NO: 4153847 - DNA, 15 bp, Homo sapiens
tcgatgaaggctgcc

SEQ ID NO: 4153848 - DNA, 17 bp, Homo sapiens
tcgcacccccctgttct

SEQ ID NO: 4153849 - DNA, 18 bp, Homo sapiens
tcgcacctaccatcaggg

SEQ ID NO: 4153850 - DNA, 19 bp, Homo sapiens
tcgcaggcctccctgccag

SEQ ID NO: 4153851 - DNA, 20 bp, Homo sapiens
tcgcatggtcacacactgat

SEQ ID NO: 4153852 - DNA, 18 bp, Homo sapiens
tcgccacctggcattcct

SEQ ID NO: 4153853 - DNA, 21 bp, Homo sapiens
tcgccacctggcattccttct

SEQ ID NO: 4153854 - DNA, 13 bp, Homo sapiens
tcgcccagcagga

SEQ ID NO: 4153855 - DNA, 14 bp, Homo sapiens
tcgcccagcaggag

SEQ ID NO: 4153856 - DNA, 14 bp, Homo sapiens
tcgccccagcaggt

SEQ ID NO: 4153857 - DNA, 11 bp, Homo sapiens
tcgcctgacaa

SEQ ID NO: 4153858 - DNA, 16 bp, Homo sapiens
tcgcctgcctgcagca

SEQ ID NO: 4153859 - DNA, 18 bp, Homo sapiens
tcgcctgtggagctcagc

SEQ ID NO: 4153860 - DNA, 16 bp, Homo sapiens
tcgcctttcagcaggc

SEQ ID NO: 4153861 - DNA, 15 bp, Homo sapiens
tcgcctttcccaccc

SEQ ID NO: 4153862 - DNA, 18 bp, Homo sapiens
tcgcgtgccctcgctgct

SEQ ID NO: 4153863 - DNA, 21 bp, Homo sapiens
tcgctcaccgctggcccttag

SEQ ID NO: 4153864 - DNA, 17 bp, Homo sapiens
tcgctgacttcatggaa

SEQ ID NO: 4153865 - DNA, 18 bp, Homo sapiens
tcgctgccctctctgcca

SEQ ID NO: 4153866 - DNA, 19 bp, Homo sapiens
tcgctgtcactggctggct

SEQ ID NO: 4153867 - DNA, 17 bp, Homo sapiens
tcgctttctcagtgtgt

SEQ ID NO: 4153868 - DNA, 19 bp, Homo sapiens
tcgctttctcagtgtgtgt

SEQ ID NO: 4153869 - DNA, 15 bp, Homo sapiens
tcggaagcagtgcct

SEQ ID NO: 4153870 - DNA, 16 bp, Homo sapiens
tcggaagcagtgcctt

SEQ ID NO: 4153871 - DNA, 22 bp, Homo sapiens
tcggaagcagtgccttccataa

SEQ ID NO: 4153872 - DNA, 23 bp, Homo sapiens
tcggaagcagtgccttccataat

SEQ ID NO: 4153873 - DNA, 23 bp, Homo sapiens
tcggactaagcctacctgctctc

SEQ ID NO: 4153874 - DNA, 23 bp, Homo sapiens
tcggagacagtgatctccatatg

SEQ ID NO: 4153875 - DNA, 13 bp, Homo sapiens
tcggagagcagca

SEQ ID NO: 4153876 - DNA, 19 bp, Homo sapiens
tcggagcgaagcagagagg

SEQ ID NO: 4153877 - DNA, 13 bp, Homo sapiens
tcggaggaagccc

SEQ ID NO: 4153878 - DNA, 14 bp, Homo sapiens
tcggaggctgcccc

SEQ ID NO: 4153879 - DNA, 13 bp, Homo sapiens
tcggaggctgggc

SEQ ID NO: 4153880 - DNA, 14 bp, Homo sapiens
tcggaggctgggcc

SEQ ID NO: 4153881 - DNA, 21 bp, Homo sapiens
tcggaggctgggcccctggga

SEQ ID NO: 4153882 - DNA, 20 bp, Homo sapiens
tcggatctggggctctggga

SEQ ID NO: 4153883 - DNA, 21 bp, Homo sapiens
tcggatggaccaacctgctct

SEQ ID NO: 4153884 - DNA, 21 bp, Homo sapiens
tcggcagaggaacccccacca

SEQ ID NO: 4153885 - DNA, 23 bp, Homo sapiens
tcggcagaggaacccccaccaga

SEQ ID NO: 4153886 - DNA, 14 bp, Homo sapiens
tcggccctgcccaa

SEQ ID NO: 4153887 - DNA, 19 bp, Homo sapiens
tcggctcaggctctgctgg

SEQ ID NO: 4153888 - DNA, 20 bp, Homo sapiens
tcggctcaggctctgctggt

SEQ ID NO: 4153889 - DNA, 22 bp, Homo sapiens
tcggctccagtccccagaactc

SEQ ID NO: 4153890 - DNA, 16 bp, Homo sapiens
tcggcttgtgggctgg

SEQ ID NO: 4153891 - DNA, 15 bp, Homo sapiens
tcgggaagcagccag

SEQ ID NO: 4153892 - DNA, 19 bp, Homo sapiens
tcgggaagcagccagctcc

SEQ ID NO: 4153893 - DNA, 19 bp, Homo sapiens
tcgggacacctgccctgcc

SEQ ID NO: 4153894 - DNA, 17 bp, Homo sapiens
tcgggagcacccagagc

SEQ ID NO: 4153895 - DNA, 18 bp, Homo sapiens
tcgggagcacccagagca

SEQ ID NO: 4153896 - DNA, 22 bp, Homo sapiens
tcgggagcagtgtcttccataa

SEQ ID NO: 4153897 - DNA, 21 bp, Homo sapiens
tcgggagtcctctagcaggcc

SEQ ID NO: 4153898 - DNA, 15 bp, Homo sapiens
tcgggatgtcagcag

SEQ ID NO: 4153899 - DNA, 16 bp, Homo sapiens
tcgggatgtcagcaga

SEQ ID NO: 4153900 - DNA, 16 bp, Homo sapiens
tcgggcaccagccagc

SEQ ID NO: 4153901 - DNA, 13 bp, Homo sapiens
tcgggcagccagc

SEQ ID NO: 4153902 - DNA, 15 bp, Homo sapiens
tcgggcagccagcag

SEQ ID NO: 4153903 - DNA, 16 bp, Homo sapiens
tcgggcagccagcaga

SEQ ID NO: 4153904 - DNA, 21 bp, Homo sapiens
tcggggcgatgctccctcagc

SEQ ID NO: 4153905 - DNA, 18 bp, Homo sapiens
tcggttctccagaatgta

SEQ ID NO: 4153906 - DNA, 13 bp, Homo sapiens
tcgtaaagatttg

SEQ ID NO: 4153907 - DNA, 15 bp, Homo sapiens
tcgtaaagatttggg

SEQ ID NO: 4153908 - DNA, 15 bp, Homo sapiens
tcgtctttcccaaag

SEQ ID NO: 4153909 - DNA, 14 bp, Homo sapiens
tcgtgaaaccctgt

SEQ ID NO: 4153910 - DNA, 15 bp, Homo sapiens
tcgtgagctggggac

SEQ ID NO: 4153911 - DNA, 20 bp, Homo sapiens
tcgtgagctggggactcagg

SEQ ID NO: 4153912 - DNA, 14 bp, Homo sapiens
tcgtgagtcattta

SEQ ID NO: 4153913 - DNA, 20 bp, Homo sapiens
tcgtgcactctgctaatcat

SEQ ID NO: 4153914 - DNA, 18 bp, Homo sapiens
tcgtgctaaattttcagt

SEQ ID NO: 4153915 - DNA, 14 bp, Homo sapiens
tcgttaacattgac

SEQ ID NO: 4153916 - DNA, 17 bp, Homo sapiens
tcgttaacattgaccaa

SEQ ID NO: 4153917 - DNA, 16 bp, Homo sapiens
tcgttaattaatgtca

SEQ ID NO: 4153918 - DNA, 19 bp, Homo sapiens
tcgttagtatctaacatgt

SEQ ID NO: 4153919 - DNA, 17 bp, Homo sapiens
tcgttattataaatgtt

SEQ ID NO: 4153920 - DNA, 18 bp, Homo sapiens
tctaaaaaacagaggcca

SEQ ID NO: 4153921 - DNA, 18 bp, Homo sapiens
tctaaaacaaaatctgaa

SEQ ID NO: 4153922 - DNA, 11 bp, Homo sapiens
tctaaaagaaa

SEQ ID NO: 4153923 - DNA, 12 bp, Homo sapiens
tctaaaagcacc

SEQ ID NO: 4153924 - DNA, 12 bp, Homo sapiens
tctaaaatgtca

SEQ ID NO: 4153925 - DNA, 15 bp, Homo sapiens
tctaaacaaaattgc

SEQ ID NO: 4153926 - DNA, 16 bp, Homo sapiens
tctaaacccaatccaa

SEQ ID NO: 4153927 - DNA, 19 bp, Homo sapiens
tctaaacccaatccaaatg

SEQ ID NO: 4153928 - DNA, 12 bp, Homo sapiens
tctaaagagcac

SEQ ID NO: 4153929 - DNA, 23 bp, Homo sapiens
tctaaatatttccttaaactgtg

SEQ ID NO: 4153930 - DNA, 16 bp, Homo sapiens
tctaaatctatttatt

SEQ ID NO: 4153931 - DNA, 18 bp, Homo sapiens
tctaaatcttccttgtga

SEQ ID NO: 4153932 - DNA, 23 bp, Homo sapiens
tctaaatgcatatcctgagccat

SEQ ID NO: 4153933 - DNA, 20 bp, Homo sapiens
tctaaatggtgctgcagatt

SEQ ID NO: 4153934 - DNA, 19 bp, Homo sapiens
tctaacaaaaaaatatatt

SEQ ID NO: 4153935 - DNA, 23 bp, Homo sapiens
tctaacaagtcataggttaatat

SEQ ID NO: 4153936 - DNA, 16 bp, Homo sapiens
tctaaccacagctcct

SEQ ID NO: 4153937 - DNA, 17 bp, Homo sapiens
tctaacccccagctggg

SEQ ID NO: 4153938 - DNA, 21 bp, Homo sapiens
tctaaccttgaatgctgccag

SEQ ID NO: 4153939 - DNA, 12 bp, Homo sapiens
tctaagagaagt

SEQ ID NO: 4153940 - DNA, 21 bp, Homo sapiens
tctaagatacatatactgatt

SEQ ID NO: 4153941 - DNA, 17 bp, Homo sapiens
tctaagccagttttcat

SEQ ID NO: 4153942 - DNA, 15 bp, Homo sapiens
tctaagctcagtgct

SEQ ID NO: 4153943 - DNA, 17 bp, Homo sapiens
tctaaggataatgaaat

SEQ ID NO: 4153944 - DNA, 19 bp, Homo sapiens
tctaaggatgtcacagggc

SEQ ID NO: 4153945 - DNA, 13 bp, Homo sapiens
tctaagtgatata

SEQ ID NO: 4153946 - DNA, 14 bp, Homo sapiens
tctaagtgtttgct

SEQ ID NO: 4153947 - DNA, 16 bp, Homo sapiens
tctaataaacttggat

SEQ ID NO: 4153948 - DNA, 13 bp, Homo sapiens
tctaatagtgctt

SEQ ID NO: 4153949 - DNA, 17 bp, Homo sapiens
tctaatcgaaagaaaat

SEQ ID NO: 4153950 - DNA, 20 bp, Homo sapiens
tctaatcgaaagaaaatggg

SEQ ID NO: 4153951 - DNA, 22 bp, Homo sapiens
tctaatctgagctgcagcctgg

SEQ ID NO: 4153952 - DNA, 23 bp, Homo sapiens
tctaatctgagctgcagcctggc

SEQ ID NO: 4153953 - DNA, 13 bp, Homo sapiens
tctaatgaagaca

SEQ ID NO: 4153954 - DNA, 15 bp, Homo sapiens
tctaatgaagacaat

SEQ ID NO: 4153955 - DNA, 20 bp, Homo sapiens
tctaatgggtatttaaacaa

SEQ ID NO: 4153956 - DNA, 11 bp, Homo sapiens
tctaatgtggt

SEQ ID NO: 4153957 - DNA, 15 bp, Homo sapiens
tctaattaattgtaa

SEQ ID NO: 4153958 - DNA, 18 bp, Homo sapiens
tctaattcccattttgca

SEQ ID NO: 4153959 - DNA, 19 bp, Homo sapiens
tctaattgcatctcaaaat

SEQ ID NO: 4153960 - DNA, 23 bp, Homo sapiens
tctaatttatcttgtctctgggc

SEQ ID NO: 4153961 - DNA, 22 bp, Homo sapiens
tctaatttgaactggtattgtt

SEQ ID NO: 4153962 - DNA, 15 bp, Homo sapiens
tctaattttggatgg

SEQ ID NO: 4153963 - DNA, 14 bp, Homo sapiens
tctaatttttaaga

SEQ ID NO: 4153964 - DNA, 16 bp, Homo sapiens
tctaatttttaagcaa

SEQ ID NO: 4153965 - DNA, 14 bp, Homo sapiens
tctacaagtatatg

SEQ ID NO: 4153966 - DNA, 19 bp, Homo sapiens
tctacaatcagttgacttt

SEQ ID NO: 4153967 - DNA, 19 bp, Homo sapiens
tctacaatgtgaactttat

SEQ ID NO: 4153968 - DNA, 17 bp, Homo sapiens
tctacacagcctggact

SEQ ID NO: 4153969 - DNA, 15 bp, Homo sapiens
tctacactcatctta

SEQ ID NO: 4153970 - DNA, 17 bp, Homo sapiens
tctacagaataatccag

SEQ ID NO: 4153971 - DNA, 23 bp, Homo sapiens
tctacagaataatccagtattgc

SEQ ID NO: 4153972 - DNA, 17 bp, Homo sapiens
tctacagacttctccag

SEQ ID NO: 4153973 - DNA, 19 bp, Homo sapiens
tctacagatcctttttcca

SEQ ID NO: 4153974 - DNA, 16 bp, Homo sapiens
tctacagctcccccag

SEQ ID NO: 4153975 - DNA, 22 bp, Homo sapiens
tctacagtggttttatactgaa

SEQ ID NO: 4153976 - DNA, 23 bp, Homo sapiens
tctacagtggttttatactgaag

SEQ ID NO: 4153977 - DNA, 22 bp, Homo sapiens
tctacataagtaattcaagaaa

SEQ ID NO: 4153978 - DNA, 15 bp, Homo sapiens
tctacatcttctgcc

SEQ ID NO: 4153979 - DNA, 13 bp, Homo sapiens
tctacatgactgg

SEQ ID NO: 4153980 - DNA, 15 bp, Homo sapiens
tctacatgactgggc

SEQ ID NO: 4153981 - DNA, 17 bp, Homo sapiens
tctaccaggcaaattca

SEQ ID NO: 4153982 - DNA, 17 bp, Homo sapiens
tctaccatcatccggtt

SEQ ID NO: 4153983 - DNA, 16 bp, Homo sapiens
tctacccatgagcctg

SEQ ID NO: 4153984 - DNA, 21 bp, Homo sapiens
tctacccatgagcctgcccgc

SEQ ID NO: 4153985 - DNA, 16 bp, Homo sapiens
tctaccctcccacccc

SEQ ID NO: 4153986 - DNA, 18 bp, Homo sapiens
tctaccctcccaccccct

SEQ ID NO: 4153987 - DNA, 15 bp, Homo sapiens
tctaccctgctccct

SEQ ID NO: 4153988 - DNA, 23 bp, Homo sapiens
tctacctaatgtctcactgttct

SEQ ID NO: 4153989 - DNA, 19 bp, Homo sapiens
tctacctcaggcagctcaa

SEQ ID NO: 4153990 - DNA, 16 bp, Homo sapiens
tctaccttcctgtccc

SEQ ID NO: 4153991 - DNA, 22 bp, Homo sapiens
tctaccttcctgtccctgaggt

SEQ ID NO: 4153992 - DNA, 21 bp, Homo sapiens
tctacgccactccacaaatga

SEQ ID NO: 4153993 - DNA, 18 bp, Homo sapiens
tctactaattccacacct

SEQ ID NO: 4153994 - DNA, 14 bp, Homo sapiens
tctactcagaaatt

SEQ ID NO: 4153995 - DNA, 12 bp, Homo sapiens
tctactcccctt

SEQ ID NO: 4153996 - DNA, 14 bp, Homo sapiens
tctacttcatagct

SEQ ID NO: 4153997 - DNA, 14 bp, Homo sapiens
tctagaaacaaaca

SEQ ID NO: 4153998 - DNA, 22 bp, Homo sapiens
tctagaaagcctgttcccctca

SEQ ID NO: 4153999 - DNA, 20 bp, Homo sapiens
tctagaaccacttcctgcta

SEQ ID NO: 4154000 - DNA, 17 bp, Homo sapiens
tctagaagccaagggaa

SEQ ID NO: 4154001 - DNA, 23 bp, Homo sapiens
tctagaagccaagggaaaggggt

SEQ ID NO: 4154002 - DNA, 13 bp, Homo sapiens
tctagacaagata

SEQ ID NO: 4154003 - DNA, 13 bp, Homo sapiens
tctagagaagagg

SEQ ID NO: 4154004 - DNA, 21 bp, Homo sapiens
tctagatgaagttttacattg

SEQ ID NO: 4154005 - DNA, 22 bp, Homo sapiens
tctagatgaagttttacattgt

SEQ ID NO: 4154006 - DNA, 21 bp, Homo sapiens
tctagattaccccctcattgt

SEQ ID NO: 4154007 - DNA, 14 bp, Homo sapiens
tctagcacttcctt

SEQ ID NO: 4154008 - DNA, 18 bp, Homo sapiens
tctagccttaaggggggc

SEQ ID NO: 4154009 - DNA, 15 bp, Homo sapiens
tctagcgtagtgcag

SEQ ID NO: 4154010 - DNA, 14 bp, Homo sapiens
tctagctctctagg

SEQ ID NO: 4154011 - DNA, 14 bp, Homo sapiens
tctaggaaatctag

SEQ ID NO: 4154012 - DNA, 15 bp, Homo sapiens
tctaggaagacattt

SEQ ID NO: 4154013 - DNA, 23 bp, Homo sapiens
tctaggaggagctagtaggaatg

SEQ ID NO: 4154014 - DNA, 20 bp, Homo sapiens
tctaggcaagcaggacctgg

SEQ ID NO: 4154015 - DNA, 22 bp, Homo sapiens
tctaggcaagcaggacctggca

SEQ ID NO: 4154016 - DNA, 16 bp, Homo sapiens
tctaggcacaaggttg

SEQ ID NO: 4154017 - DNA, 14 bp, Homo sapiens
tctaggcctctcca

SEQ ID NO: 4154018 - DNA, 15 bp, Homo sapiens
tctaggcctctccag

SEQ ID NO: 4154019 - DNA, 20 bp, Homo sapiens
tctaggggagaagagccctg

SEQ ID NO: 4154020 - DNA, 19 bp, Homo sapiens
tctaggggtcaggctccat

SEQ ID NO: 4154021 - DNA, 14 bp, Homo sapiens
tctaggtctcctca

SEQ ID NO: 4154022 - DNA, 17 bp, Homo sapiens
tctaggtgtggctgtga

SEQ ID NO: 4154023 - DNA, 17 bp, Homo sapiens
tctagtacttgaaaaag

SEQ ID NO: 4154024 - DNA, 16 bp, Homo sapiens
tctagtgcagctgatt

SEQ ID NO: 4154025 - DNA, 22 bp, Homo sapiens
tctagtgcagctgattttaaca

SEQ ID NO: 4154026 - DNA, 23 bp, Homo sapiens
tctagtgcagctgattttaacaa

SEQ ID NO: 4154027 - DNA, 13 bp, Homo sapiens
tctagtgggacag

SEQ ID NO: 4154028 - DNA, 22 bp, Homo sapiens
tctagttcagagccaagcctta

SEQ ID NO: 4154029 - DNA, 16 bp, Homo sapiens
tctagttctttcctcc

SEQ ID NO: 4154030 - DNA, 21 bp, Homo sapiens
tctagttgccaaatctggctc

SEQ ID NO: 4154031 - DNA, 13 bp, Homo sapiens
tctagttttgtca

SEQ ID NO: 4154032 - DNA, 22 bp, Homo sapiens
tctataaagcgatatacagatg

SEQ ID NO: 4154033 - DNA, 13 bp, Homo sapiens
tctataacagata

SEQ ID NO: 4154034 - DNA, 19 bp, Homo sapiens
tctataatcccagcacttt

SEQ ID NO: 4154035 - DNA, 18 bp, Homo sapiens
tctatacatatctttatt

SEQ ID NO: 4154036 - DNA, 16 bp, Homo sapiens
tctatacatctctccc

SEQ ID NO: 4154037 - DNA, 14 bp, Homo sapiens
tctatatgaattta

SEQ ID NO: 4154038 - DNA, 17 bp, Homo sapiens
tctatattttaatagaa

SEQ ID NO: 4154039 - DNA, 20 bp, Homo sapiens
tctatcaactttaatcaagt

SEQ ID NO: 4154040 - DNA, 23 bp, Homo sapiens
tctatcaactttaatcaagttgt

SEQ ID NO: 4154041 - DNA, 17 bp, Homo sapiens
tctatcaagtcaatcat

SEQ ID NO: 4154042 - DNA, 18 bp, Homo sapiens
tctatcaagtcaatcatt

SEQ ID NO: 4154043 - DNA, 18 bp, Homo sapiens
tctatcagtacttttatt

SEQ ID NO: 4154044 - DNA, 12 bp, Homo sapiens
tctatctctcaa

SEQ ID NO: 4154045 - DNA, 16 bp, Homo sapiens
tctatggttatgaaag

SEQ ID NO: 4154046 - DNA, 22 bp, Homo sapiens
tctatggttatgaaagaatata

SEQ ID NO: 4154047 - DNA, 22 bp, Homo sapiens
tctatgttaaatactgtgcaga

SEQ ID NO: 4154048 - DNA, 13 bp, Homo sapiens
tctattaaagtga

SEQ ID NO: 4154049 - DNA, 15 bp, Homo sapiens
tctattaaagtgact

SEQ ID NO: 4154050 - DNA, 10 bp, Homo sapiens
tctattaata

SEQ ID NO: 4154051 - DNA, 14 bp, Homo sapiens
tctattagacttta

SEQ ID NO: 4154052 - DNA, 15 bp, Homo sapiens
tctattatggaaaac

SEQ ID NO: 4154053 - DNA, 20 bp, Homo sapiens
tctattatggaaaactgtgt

SEQ ID NO: 4154054 - DNA, 13 bp, Homo sapiens
tctattcaaaagg

SEQ ID NO: 4154055 - DNA, 17 bp, Homo sapiens
tctattctcaaagtttc

SEQ ID NO: 4154056 - DNA, 13 bp, Homo sapiens
tctattgccttct

SEQ ID NO: 4154057 - DNA, 20 bp, Homo sapiens
tctattggaggtgagatcac

SEQ ID NO: 4154058 - DNA, 18 bp, Homo sapiens
tctattgggttcattatt

SEQ ID NO: 4154059 - DNA, 12 bp, Homo sapiens
tctatttaagcc

SEQ ID NO: 4154060 - DNA, 13 bp, Homo sapiens
tctatttatgttt

SEQ ID NO: 4154061 - DNA, 15 bp, Homo sapiens
tctatttatttgtga

SEQ ID NO: 4154062 - DNA, 13 bp, Homo sapiens
tctatttcactta

SEQ ID NO: 4154063 - DNA, 14 bp, Homo sapiens
tctatttcatgttt

SEQ ID NO: 4154064 - DNA, 21 bp, Homo sapiens
tctatttcccctcttctgcta

SEQ ID NO: 4154065 - DNA, 13 bp, Homo sapiens
tctattttacttt

SEQ ID NO: 4154066 - DNA, 17 bp, Homo sapiens
tctattttgtgatgatg

SEQ ID NO: 4154067 - DNA, 18 bp, Homo sapiens
tctattttttctctcctt

SEQ ID NO: 4154068 - DNA, 16 bp, Homo sapiens
tctatttttttaactg

SEQ ID NO: 4154069 - DNA, 16 bp, Homo sapiens
tctcaaaaatacaaaa

SEQ ID NO: 4154070 - DNA, 13 bp, Homo sapiens
tctcaaaagcatt

SEQ ID NO: 4154071 - DNA, 14 bp, Homo sapiens
tctcaaaagcattt

SEQ ID NO: 4154072 - DNA, 18 bp, Homo sapiens
tctcaaaagtctattttt

SEQ ID NO: 4154073 - DNA, 19 bp, Homo sapiens
tctcaaactaaaagacatt

SEQ ID NO: 4154074 - DNA, 17 bp, Homo sapiens
tctcaaagttaattcac

SEQ ID NO: 4154075 - DNA, 22 bp, Homo sapiens
tctcaaagtttcctaatcagaa

SEQ ID NO: 4154076 - DNA, 16 bp, Homo sapiens
tctcaaagttttgaaa

SEQ ID NO: 4154077 - DNA, 20 bp, Homo sapiens
tctcaaagttttgaaaagct

SEQ ID NO: 4154078 - DNA, 23 bp, Homo sapiens
tctcaaagttttgaaaagctatt

SEQ ID NO: 4154079 - DNA, 21 bp, Homo sapiens
tctcaagatgggggcagggct

SEQ ID NO: 4154080 - DNA, 23 bp, Homo sapiens
tctcaagctagtgtttctagcta

SEQ ID NO: 4154081 - DNA, 21 bp, Homo sapiens
tctcaagtcaaggaagctggg

SEQ ID NO: 4154082 - DNA, 21 bp, Homo sapiens
tctcaatacgcctttaaaggt

SEQ ID NO: 4154083 - DNA, 16 bp, Homo sapiens
tctcacagatgtgact

SEQ ID NO: 4154084 - DNA, 14 bp, Homo sapiens
tctcacagtgtggg

SEQ ID NO: 4154085 - DNA, 15 bp, Homo sapiens
tctcacatccctcta

SEQ ID NO: 4154086 - DNA, 21 bp, Homo sapiens
tctcacatgtggcaaaatatg

SEQ ID NO: 4154087 - DNA, 17 bp, Homo sapiens
tctcaccccatcccaca

SEQ ID NO: 4154088 - DNA, 19 bp, Homo sapiens
tctcaccccatcccacacc

SEQ ID NO: 4154089 - DNA, 21 bp, Homo sapiens
tctcacgggcatgggcactcc

SEQ ID NO: 4154090 - DNA, 20 bp, Homo sapiens
tctcactagtgtcaggcccc

SEQ ID NO: 4154091 - DNA, 15 bp, Homo sapiens
tctcactccccatgc

SEQ ID NO: 4154092 - DNA, 13 bp, Homo sapiens
tctcactcctacc

SEQ ID NO: 4154093 - DNA, 18 bp, Homo sapiens
tctcactcctacctggta

SEQ ID NO: 4154094 - DNA, 22 bp, Homo sapiens
tctcactgagaagattgtgaat

SEQ ID NO: 4154095 - DNA, 17 bp, Homo sapiens
tctcactggatgcaaag

SEQ ID NO: 4154096 - DNA, 16 bp, Homo sapiens
tctcactgttccctct

SEQ ID NO: 4154097 - DNA, 18 bp, Homo sapiens
tctcactgttccctctgc

SEQ ID NO: 4154098 - DNA, 21 bp, Homo sapiens
tctcactgttccctctgctcc

SEQ ID NO: 4154099 - DNA, 16 bp, Homo sapiens
tctcactgttctgcaa

SEQ ID NO: 4154100 - DNA, 16 bp, Homo sapiens
tctcacttcaattaat

SEQ ID NO: 4154101 - DNA, 17 bp, Homo sapiens
tctcagaaagtgcctga

SEQ ID NO: 4154102 - DNA, 12 bp, Homo sapiens
tctcagaagcac

SEQ ID NO: 4154103 - DNA, 16 bp, Homo sapiens
tctcagaagcacagaa

SEQ ID NO: 4154104 - DNA, 14 bp, Homo sapiens
tctcagagccaagt

SEQ ID NO: 4154105 - DNA, 21 bp, Homo sapiens
tctcagaggcctgctgccagt

SEQ ID NO: 4154106 - DNA, 14 bp, Homo sapiens
tctcagatatttat

SEQ ID NO: 4154107 - DNA, 16 bp, Homo sapiens
tctcagatatttatat

SEQ ID NO: 4154108 - DNA, 23 bp, Homo sapiens
tctcagatatttatatttttatt

SEQ ID NO: 4154109 - DNA, 14 bp, Homo sapiens
tctcagcaagagaa

SEQ ID NO: 4154110 - DNA, 14 bp, Homo sapiens
tctcagccctgcct

SEQ ID NO: 4154111 - DNA, 21 bp, Homo sapiens
tctcagccgcttctgactgct

SEQ ID NO: 4154112 - DNA, 12 bp, Homo sapiens
tctcagcctccc

SEQ ID NO: 4154113 - DNA, 22 bp, Homo sapiens
tctcaggacctctgtaggcagc

SEQ ID NO: 4154114 - DNA, 16 bp, Homo sapiens
tctcaggagatttcat

SEQ ID NO: 4154115 - DNA, 19 bp, Homo sapiens
tctcaggagcacaggcagc

SEQ ID NO: 4154116 - DNA, 20 bp, Homo sapiens
tctcaggagcacaggcagct

SEQ ID NO: 4154117 - DNA, 23 bp, Homo sapiens
tctcaggagcacaggcagctgga

SEQ ID NO: 4154118 - DNA, 12 bp, Homo sapiens
tctcagggcaga

SEQ ID NO: 4154119 - DNA, 12 bp, Homo sapiens
tctcagggcctg

SEQ ID NO: 4154120 - DNA, 20 bp, Homo sapiens
tctcagggcctggcaggcca

SEQ ID NO: 4154121 - DNA, 21 bp, Homo sapiens
tctcagggcctggcaggccag

SEQ ID NO: 4154122 - DNA, 17 bp, Homo sapiens
tctcaggggccagagga

SEQ ID NO: 4154123 - DNA, 15 bp, Homo sapiens
tctcagtcagtaatt

SEQ ID NO: 4154124 - DNA, 16 bp, Homo sapiens
tctcagtcatgcataa

SEQ ID NO: 4154125 - DNA, 21 bp, Homo sapiens
tctcagtcatgcataaatatg

SEQ ID NO: 4154126 - DNA, 12 bp, Homo sapiens
tctcagtgtttt

SEQ ID NO: 4154127 - DNA, 16 bp, Homo sapiens
tctcagtttgtgtgtc

SEQ ID NO: 4154128 - DNA, 18 bp, Homo sapiens
tctcataattcctacagc

SEQ ID NO: 4154129 - DNA, 20 bp, Homo sapiens
tctcataattcctacagcac

SEQ ID NO: 4154130 - DNA, 16 bp, Homo sapiens
tctcataattttgcaa

SEQ ID NO: 4154131 - DNA, 17 bp, Homo sapiens
tctcataattttgcaaa

SEQ ID NO: 4154132 - DNA, 19 bp, Homo sapiens
tctcataggaaaagtacat

SEQ ID NO: 4154133 - DNA, 16 bp, Homo sapiens
tctcatcctcctggaa

SEQ ID NO: 4154134 - DNA, 17 bp, Homo sapiens
tctcatcctcctggaac

SEQ ID NO: 4154135 - DNA, 16 bp, Homo sapiens
tctcatccttttggat

SEQ ID NO: 4154136 - DNA, 15 bp, Homo sapiens
tctcatctgccggcc

SEQ ID NO: 4154137 - DNA, 22 bp, Homo sapiens
tctcatctgccggcccccagga

SEQ ID NO: 4154138 - DNA, 23 bp, Homo sapiens
tctcatctgccggcccccaggac

SEQ ID NO: 4154139 - DNA, 22 bp, Homo sapiens
tctcatgaggggagaggagacg

SEQ ID NO: 4154140 - DNA, 18 bp, Homo sapiens
tctcatgtatcatctgga

SEQ ID NO: 4154141 - DNA, 12 bp, Homo sapiens
tctcatgtatct

SEQ ID NO: 4154142 - DNA, 17 bp, Homo sapiens
tctcatgtcctgctggc

SEQ ID NO: 4154143 - DNA, 18 bp, Homo sapiens
tctcatgtcctgctggct

SEQ ID NO: 4154144 - DNA, 16 bp, Homo sapiens
tctcattacttttgaa

SEQ ID NO: 4154145 - DNA, 18 bp, Homo sapiens
tctcatttagaacttgca

SEQ ID NO: 4154146 - DNA, 17 bp, Homo sapiens
tctcatttggtctgcca

SEQ ID NO: 4154147 - DNA, 20 bp, Homo sapiens
tctcatttggtctgccagaa

SEQ ID NO: 4154148 - DNA, 12 bp, Homo sapiens
tctccaaatgag

SEQ ID NO: 4154149 - DNA, 14 bp, Homo sapiens
tctccaaggaccag

SEQ ID NO: 4154150 - DNA, 17 bp, Homo sapiens
tctccaagtctctctgt

SEQ ID NO: 4154151 - DNA, 22 bp, Homo sapiens
tctccaagtctctctgtgaata

SEQ ID NO: 4154152 - DNA, 16 bp, Homo sapiens
tctccactaccccaca

SEQ ID NO: 4154153 - DNA, 17 bp, Homo sapiens
tctccagctgggctctg

SEQ ID NO: 4154154 - DNA, 20 bp, Homo sapiens
tctccaggaaggtagcccag

SEQ ID NO: 4154155 - DNA, 18 bp, Homo sapiens
tctccaggccatgatggc

SEQ ID NO: 4154156 - DNA, 21 bp, Homo sapiens
tctccagggagcaagacagag

SEQ ID NO: 4154157 - DNA, 19 bp, Homo sapiens
tctccaggtctcacgggca

SEQ ID NO: 4154158 - DNA, 20 bp, Homo sapiens
tctccagttgggactcagga

SEQ ID NO: 4154159 - DNA, 21 bp, Homo sapiens
tctccagttgggactcaggat

SEQ ID NO: 4154160 - DNA, 13 bp, Homo sapiens
tctccatctgtca

SEQ ID NO: 4154161 - DNA, 13 bp, Homo sapiens
tctccatggccct

SEQ ID NO: 4154162 - DNA, 20 bp, Homo sapiens
tctccatggccctgtcccag

SEQ ID NO: 4154163 - DNA, 16 bp, Homo sapiens
tctccatgtttgatgt

SEQ ID NO: 4154164 - DNA, 12 bp, Homo sapiens
tctccatttcaa

SEQ ID NO: 4154165 - DNA, 17 bp, Homo sapiens
tctccattttcaagctg

SEQ ID NO: 4154166 - DNA, 19 bp, Homo sapiens
tctccattttggtgtcttt

SEQ ID NO: 4154167 - DNA, 22 bp, Homo sapiens
tctcccaaagtaccttgaactc

SEQ ID NO: 4154168 - DNA, 22 bp, Homo sapiens
tctcccaagctatctaaagttt

SEQ ID NO: 4154169 - DNA, 12 bp, Homo sapiens
tctcccagcaca

SEQ ID NO: 4154170 - DNA, 20 bp, Homo sapiens
tctccccacgagggctggct

SEQ ID NO: 4154171 - DNA, 14 bp, Homo sapiens
tctccccagcccag

SEQ ID NO: 4154172 - DNA, 15 bp, Homo sapiens
tctccccagcccaga

SEQ ID NO: 4154173 - DNA, 13 bp, Homo sapiens
tctcccgctgctg

SEQ ID NO: 4154174 - DNA, 16 bp, Homo sapiens
tctcccgctgctgctg

SEQ ID NO: 4154175 - DNA, 16 bp, Homo sapiens
tctccctgcctggccc

SEQ ID NO: 4154176 - DNA, 17 bp, Homo sapiens
tctccctgcctggcccc

SEQ ID NO: 4154177 - DNA, 14 bp, Homo sapiens
tctccctggctccc

SEQ ID NO: 4154178 - DNA, 23 bp, Homo sapiens
tctccctggctccctcctccagg

SEQ ID NO: 4154179 - DNA, 13 bp, Homo sapiens
tctccgccagcct

SEQ ID NO: 4154180 - DNA, 15 bp, Homo sapiens
tctccgccagcctcc

SEQ ID NO: 4154181 - DNA, 18 bp, Homo sapiens
tctccgccagcctcctct

SEQ ID NO: 4154182 - DNA, 21 bp, Homo sapiens
tctccgccagcctcctctgga

SEQ ID NO: 4154183 - DNA, 13 bp, Homo sapiens
tctccgcgcctac

SEQ ID NO: 4154184 - DNA, 16 bp, Homo sapiens
tctccgggtgtggcct

SEQ ID NO: 4154185 - DNA, 21 bp, Homo sapiens
tctccgggtgtggcctcagcc

SEQ ID NO: 4154186 - DNA, 16 bp, Homo sapiens
tctcctactcctgact

SEQ ID NO: 4154187 - DNA, 16 bp, Homo sapiens
tctcctcagggtgggg

SEQ ID NO: 4154188 - DNA, 17 bp, Homo sapiens
tctcctcagggtggggg

SEQ ID NO: 4154189 - DNA, 18 bp, Homo sapiens
tctcctcagggtgggggg

SEQ ID NO: 4154190 - DNA, 18 bp, Homo sapiens
tctcctccatactcagga

SEQ ID NO: 4154191 - DNA, 15 bp, Homo sapiens
tctcctccccacccg

SEQ ID NO: 4154192 - DNA, 11 bp, Homo sapiens
tctcctccctc

SEQ ID NO: 4154193 - DNA, 14 bp, Homo sapiens
tctcctctccatct

SEQ ID NO: 4154194 - DNA, 13 bp, Homo sapiens
tctcctctctggg

SEQ ID NO: 4154195 - DNA, 20 bp, Homo sapiens
tctcctctctgggcctttgt

SEQ ID NO: 4154196 - DNA, 14 bp, Homo sapiens
tctcctgccctgtg

SEQ ID NO: 4154197 - DNA, 15 bp, Homo sapiens
tctcctgcctcagcc

SEQ ID NO: 4154198 - DNA, 13 bp, Homo sapiens
tctcctgcctgta

SEQ ID NO: 4154199 - DNA, 13 bp, Homo sapiens
tctcctgctcacc

SEQ ID NO: 4154200 - DNA, 21 bp, Homo sapiens
tctcctgctcaccacctgcct

SEQ ID NO: 4154201 - DNA, 17 bp, Homo sapiens
tctcctggaggattgca

SEQ ID NO: 4154202 - DNA, 21 bp, Homo sapiens
tctcctggcctatccgctgcc

SEQ ID NO: 4154203 - DNA, 14 bp, Homo sapiens
tctcctggctgggc

SEQ ID NO: 4154204 - DNA, 16 bp, Homo sapiens
tctcctggctgggcca

SEQ ID NO: 4154205 - DNA, 18 bp, Homo sapiens
tctcctgggggtggcagg

SEQ ID NO: 4154206 - DNA, 19 bp, Homo sapiens
tctcctgtataaccccacc

SEQ ID NO: 4154207 - DNA, 23 bp, Homo sapiens
tctcctgtcttatggtccagaaa

SEQ ID NO: 4154208 - DNA, 23 bp, Homo sapiens
tctcctgtgcatgggtgaaggga

SEQ ID NO: 4154209 - DNA, 18 bp, Homo sapiens
tctccttagtcttctcat

SEQ ID NO: 4154210 - DNA, 18 bp, Homo sapiens
tctccttagttggctgga

SEQ ID NO: 4154211 - DNA, 20 bp, Homo sapiens
tctccttatagacacttgct

SEQ ID NO: 4154212 - DNA, 13 bp, Homo sapiens
tctccttcccacc

SEQ ID NO: 4154213 - DNA, 14 bp, Homo sapiens
tctccttccccagg

SEQ ID NO: 4154214 - DNA, 15 bp, Homo sapiens
tctccttccccagga

SEQ ID NO: 4154215 - DNA, 16 bp, Homo sapiens
tctccttccccaggat

SEQ ID NO: 4154216 - DNA, 13 bp, Homo sapiens
tctccttctcctt

SEQ ID NO: 4154217 - DNA, 22 bp, Homo sapiens
tctcctttgcactgagggccac

SEQ ID NO: 4154218 - DNA, 17 bp, Homo sapiens
tctccttttcctctctc

SEQ ID NO: 4154219 - DNA, 13 bp, Homo sapiens
tctcgctgtcact

SEQ ID NO: 4154220 - DNA, 14 bp, Homo sapiens
tctcgctgtcactg

SEQ ID NO: 4154221 - DNA, 17 bp, Homo sapiens
tctcgctgtcactggct

SEQ ID NO: 4154222 - DNA, 19 bp, Homo sapiens
tctcgctgtcactggctgg

SEQ ID NO: 4154223 - DNA, 22 bp, Homo sapiens
tctcgctgtcactggctggctc

SEQ ID NO: 4154224 - DNA, 19 bp, Homo sapiens
tctcggatgacaccctggc

SEQ ID NO: 4154225 - DNA, 22 bp, Homo sapiens
tctcggatgacaccctggcctg

SEQ ID NO: 4154226 - DNA, 21 bp, Homo sapiens
tctcggctccccatgtgtcct

SEQ ID NO: 4154227 - DNA, 14 bp, Homo sapiens
tctcgggagaggat

SEQ ID NO: 4154228 - DNA, 14 bp, Homo sapiens
tctcgggtgcattt

SEQ ID NO: 4154229 - DNA, 13 bp, Homo sapiens
tctctaaagcact

SEQ ID NO: 4154230 - DNA, 19 bp, Homo sapiens
tctctaaatcttccttgtg

SEQ ID NO: 4154231 - DNA, 15 bp, Homo sapiens
tctctaatcgaaaga

SEQ ID NO: 4154232 - DNA, 17 bp, Homo sapiens
tctctactaccacaagg

SEQ ID NO: 4154233 - DNA, 19 bp, Homo sapiens
tctctactaccacaaggaa

SEQ ID NO: 4154234 - DNA, 17 bp, Homo sapiens
tctctagaattttaagt

SEQ ID NO: 4154235 - DNA, 13 bp, Homo sapiens
tctctagctttgt

SEQ ID NO: 4154236 - DNA, 13 bp, Homo sapiens
tctctattctctg

SEQ ID NO: 4154237 - DNA, 15 bp, Homo sapiens
tctctatttaatatt

SEQ ID NO: 4154238 - DNA, 15 bp, Homo sapiens
tctctcagcacagcc

SEQ ID NO: 4154239 - DNA, 15 bp, Homo sapiens
tctctcaggagcaca

SEQ ID NO: 4154240 - DNA, 23 bp, Homo sapiens
tctctcatcctccagtaccttgc

SEQ ID NO: 4154241 - DNA, 18 bp, Homo sapiens
tctctccaaggtgtgccc

SEQ ID NO: 4154242 - DNA, 13 bp, Homo sapiens
tctctccagatgt

SEQ ID NO: 4154243 - DNA, 14 bp, Homo sapiens
tctctccaggaagg

SEQ ID NO: 4154244 - DNA, 21 bp, Homo sapiens
tctctccctcccctgccattt

SEQ ID NO: 4154245 - DNA, 15 bp, Homo sapiens
tctctccctgccaga

SEQ ID NO: 4154246 - DNA, 22 bp, Homo sapiens
tctctccctgccagaggggaag

SEQ ID NO: 4154247 - DNA, 11 bp, Homo sapiens
tctctcctggc

SEQ ID NO: 4154248 - DNA, 13 bp, Homo sapiens
tctctcctggcct

SEQ ID NO: 4154249 - DNA, 13 bp, Homo sapiens
tctctccttgccc

SEQ ID NO: 4154250 - DNA, 15 bp, Homo sapiens
tctctccttgccccc

SEQ ID NO: 4154251 - DNA, 14 bp, Homo sapiens
tctctcctttgctg

SEQ ID NO: 4154252 - DNA, 20 bp, Homo sapiens
tctctcggctccccatgtgt

SEQ ID NO: 4154253 - DNA, 15 bp, Homo sapiens
tctctctacagtgcc

SEQ ID NO: 4154254 - DNA, 17 bp, Homo sapiens
tctctctagctttgtca

SEQ ID NO: 4154255 - DNA, 12 bp, Homo sapiens
tctctctgcagc

SEQ ID NO: 4154256 - DNA, 16 bp, Homo sapiens
tctctctgcagctgcc

SEQ ID NO: 4154257 - DNA, 18 bp, Homo sapiens
tctctctgcagctgccgg

SEQ ID NO: 4154258 - DNA, 11 bp, Homo sapiens
tctctctgggc

SEQ ID NO: 4154259 - DNA, 18 bp, Homo sapiens
tctctctggggccctggg

SEQ ID NO: 4154260 - DNA, 21 bp, Homo sapiens
tctctctgtgctgtggaagca

SEQ ID NO: 4154261 - DNA, 14 bp, Homo sapiens
tctctcttaaagtt

SEQ ID NO: 4154262 - DNA, 14 bp, Homo sapiens
tctctcttctgctc

SEQ ID NO: 4154263 - DNA, 19 bp, Homo sapiens
tctctcttctgctccaccc

SEQ ID NO: 4154264 - DNA, 19 bp, Homo sapiens
tctctctttcctccaccca

SEQ ID NO: 4154265 - DNA, 17 bp, Homo sapiens
tctctgaacacaggcag

SEQ ID NO: 4154266 - DNA, 20 bp, Homo sapiens
tctctgaacacaggcagctt

SEQ ID NO: 4154267 - DNA, 21 bp, Homo sapiens
tctctgaacacaggcagcttt

SEQ ID NO: 4154268 - DNA, 14 bp, Homo sapiens
tctctgagactgct

SEQ ID NO: 4154269 - DNA, 19 bp, Homo sapiens
tctctgatcttgtgctcag

SEQ ID NO: 4154270 - DNA, 22 bp, Homo sapiens
tctctgatcttgtgctcagcat

SEQ ID NO: 4154271 - DNA, 23 bp, Homo sapiens
tctctgatcttgtgctcagcatg

SEQ ID NO: 4154272 - DNA, 15 bp, Homo sapiens
tctctgatgtcccag

SEQ ID NO: 4154273 - DNA, 16 bp, Homo sapiens
tctctgatgtcccagt

SEQ ID NO: 4154274 - DNA, 22 bp, Homo sapiens
tctctgcaatttgtttaaagaa

SEQ ID NO: 4154275 - DNA, 11 bp, Homo sapiens
tctctgcaccc

SEQ ID NO: 4154276 - DNA, 20 bp, Homo sapiens
tctctgcagacttcccagct

SEQ ID NO: 4154277 - DNA, 12 bp, Homo sapiens
tctctgcagctg

SEQ ID NO: 4154278 - DNA, 13 bp, Homo sapiens
tctctgcagctgc

SEQ ID NO: 4154279 - DNA, 15 bp, Homo sapiens
tctctgcagctgccg

SEQ ID NO: 4154280 - DNA, 17 bp, Homo sapiens
tctctgccacccactca

SEQ ID NO: 4154281 - DNA, 13 bp, Homo sapiens
tctctgcccaacc

SEQ ID NO: 4154282 - DNA, 15 bp, Homo sapiens
tctctgcccagcttt

SEQ ID NO: 4154283 - DNA, 15 bp, Homo sapiens
tctctgccccaccca

SEQ ID NO: 4154284 - DNA, 16 bp, Homo sapiens
tctctgccccacccaa

SEQ ID NO: 4154285 - DNA, 23 bp, Homo sapiens
tctctgcctggtggtcagatgca

SEQ ID NO: 4154286 - DNA, 21 bp, Homo sapiens
tctctgcctttgacatttaat

SEQ ID NO: 4154287 - DNA, 14 bp, Homo sapiens
tctctgctccacca

SEQ ID NO: 4154288 - DNA, 15 bp, Homo sapiens
tctctgctccaccac

SEQ ID NO: 4154289 - DNA, 19 bp, Homo sapiens
tctctgctccaccacatcc

SEQ ID NO: 4154290 - DNA, 13 bp, Homo sapiens
tctctgctgaagg

SEQ ID NO: 4154291 - DNA, 11 bp, Homo sapiens
tctctgctgta

SEQ ID NO: 4154292 - DNA, 14 bp, Homo sapiens
tctctggaaagagg

SEQ ID NO: 4154293 - DNA, 19 bp, Homo sapiens
tctctggcccttcttgcct

SEQ ID NO: 4154294 - DNA, 19 bp, Homo sapiens
tctctgggtctgattttct

SEQ ID NO: 4154295 - DNA, 13 bp, Homo sapiens
tctctggtccgga

SEQ ID NO: 4154296 - DNA, 20 bp, Homo sapiens
tctctggtccggacactcct

SEQ ID NO: 4154297 - DNA, 16 bp, Homo sapiens
tctctgtgaacgattt

SEQ ID NO: 4154298 - DNA, 22 bp, Homo sapiens
tctctgtgtatgagtgtgaatg

SEQ ID NO: 4154299 - DNA, 10 bp, Homo sapiens
tctctgtgtt

SEQ ID NO: 4154300 - DNA, 13 bp, Homo sapiens
tctcttaaagttg

SEQ ID NO: 4154301 - DNA, 22 bp, Homo sapiens
tctcttaaatgcaagtgcctag

SEQ ID NO: 4154302 - DNA, 18 bp, Homo sapiens
tctcttaatttaatcttt

SEQ ID NO: 4154303 - DNA, 20 bp, Homo sapiens
tctcttagctactgtatgca

SEQ ID NO: 4154304 - DNA, 22 bp, Homo sapiens
tctcttagctactgtatgcaaa

SEQ ID NO: 4154305 - DNA, 15 bp, Homo sapiens
tctcttatagaatat

SEQ ID NO: 4154306 - DNA, 13 bp, Homo sapiens
tctcttcaggttc

SEQ ID NO: 4154307 - DNA, 16 bp, Homo sapiens
tctcttcaggttctta

SEQ ID NO: 4154308 - DNA, 23 bp, Homo sapiens
tctcttcaggttcttagtgtcac

SEQ ID NO: 4154309 - DNA, 19 bp, Homo sapiens
tctcttcattattctctgc

SEQ ID NO: 4154310 - DNA, 15 bp, Homo sapiens
tctcttccccagaga

SEQ ID NO: 4154311 - DNA, 18 bp, Homo sapiens
tctcttccccttccctta

SEQ ID NO: 4154312 - DNA, 16 bp, Homo sapiens
tctcttccccttcctg

SEQ ID NO: 4154313 - DNA, 19 bp, Homo sapiens
tctcttccctttccccagc

SEQ ID NO: 4154314 - DNA, 17 bp, Homo sapiens
tctcttctgctccaccc

SEQ ID NO: 4154315 - DNA, 14 bp, Homo sapiens
tctcttctgtgttt

SEQ ID NO: 4154316 - DNA, 12 bp, Homo sapiens
tctcttcttcat

SEQ ID NO: 4154317 - DNA, 14 bp, Homo sapiens
tctcttgcttgtca

SEQ ID NO: 4154318 - DNA, 15 bp, Homo sapiens
tctcttgcttgtcat

SEQ ID NO: 4154319 - DNA, 13 bp, Homo sapiens
tctcttgtcctct

SEQ ID NO: 4154320 - DNA, 20 bp, Homo sapiens
tctctttaatcttcagtttt

SEQ ID NO: 4154321 - DNA, 15 bp, Homo sapiens
tctctttcctccacc

SEQ ID NO: 4154322 - DNA, 19 bp, Homo sapiens
tctcttttatctgtttaaa

SEQ ID NO: 4154323 - DNA, 22 bp, Homo sapiens
tctcttttcccctttcctgtcc

SEQ ID NO: 4154324 - DNA, 19 bp, Homo sapiens
tctcttttctttctgtctt

SEQ ID NO: 4154325 - DNA, 12 bp, Homo sapiens
tctgaaaactgg

SEQ ID NO: 4154326 - DNA, 14 bp, Homo sapiens
tctgaaaactggaa

SEQ ID NO: 4154327 - DNA, 21 bp, Homo sapiens
tctgaaacacactgaaagctc

SEQ ID NO: 4154328 - DNA, 16 bp, Homo sapiens
tctgaacacaggcagc

SEQ ID NO: 4154329 - DNA, 17 bp, Homo sapiens
tctgaaccacctttgtc

SEQ ID NO: 4154330 - DNA, 14 bp, Homo sapiens
tctgaactctcaaa

SEQ ID NO: 4154331 - DNA, 12 bp, Homo sapiens
tctgaacttgcc

SEQ ID NO: 4154332 - DNA, 15 bp, Homo sapiens
tctgaactttggaga

SEQ ID NO: 4154333 - DNA, 17 bp, Homo sapiens
tctgaactttggagagt

SEQ ID NO: 4154334 - DNA, 17 bp, Homo sapiens
tctgaagagtatccttc

SEQ ID NO: 4154335 - DNA, 16 bp, Homo sapiens
tctgaagcctctggga

SEQ ID NO: 4154336 - DNA, 17 bp, Homo sapiens
tctgaagcttgactccc

SEQ ID NO: 4154337 - DNA, 18 bp, Homo sapiens
tctgaagcttgactccca

SEQ ID NO: 4154338 - DNA, 22 bp, Homo sapiens
tctgaagtcacatcacaggaca

SEQ ID NO: 4154339 - DNA, 16 bp, Homo sapiens
tctgaataacatttgt

SEQ ID NO: 4154340 - DNA, 13 bp, Homo sapiens
tctgaatgctgcc

SEQ ID NO: 4154341 - DNA, 17 bp, Homo sapiens
tctgaatgctgctactt

SEQ ID NO: 4154342 - DNA, 13 bp, Homo sapiens
tctgaatggtcca

SEQ ID NO: 4154343 - DNA, 14 bp, Homo sapiens
tctgaatgttctga

SEQ ID NO: 4154344 - DNA, 17 bp, Homo sapiens
tctgaatgttctgacat

SEQ ID NO: 4154345 - DNA, 15 bp, Homo sapiens
tctgaatttatttaa

SEQ ID NO: 4154346 - DNA, 13 bp, Homo sapiens
tctgacagtcctt

SEQ ID NO: 4154347 - DNA, 17 bp, Homo sapiens
tctgacagtttttctgt

SEQ ID NO: 4154348 - DNA, 13 bp, Homo sapiens
tctgacataatcc

SEQ ID NO: 4154349 - DNA, 17 bp, Homo sapiens
tctgacatattatgcct

SEQ ID NO: 4154350 - DNA, 21 bp, Homo sapiens
tctgacatgcattgttggcta

SEQ ID NO: 4154351 - DNA, 19 bp, Homo sapiens
tctgacattaacagttttc

SEQ ID NO: 4154352 - DNA, 21 bp, Homo sapiens
tctgacattaacagttttcca

SEQ ID NO: 4154353 - DNA, 23 bp, Homo sapiens
tctgacattaacagttttccatg

SEQ ID NO: 4154354 - DNA, 17 bp, Homo sapiens
tctgacccactgatctc

SEQ ID NO: 4154355 - DNA, 13 bp, Homo sapiens
tctgacccagtgc

SEQ ID NO: 4154356 - DNA, 21 bp, Homo sapiens
tctgaccctagctctttcctt

SEQ ID NO: 4154357 - DNA, 19 bp, Homo sapiens
tctgaccctgcttcaaata

SEQ ID NO: 4154358 - DNA, 23 bp, Homo sapiens
tctgacccttgggcctgggcctc

SEQ ID NO: 4154359 - DNA, 15 bp, Homo sapiens
tctgacgggatttgt

SEQ ID NO: 4154360 - DNA, 13 bp, Homo sapiens
tctgactaattag

SEQ ID NO: 4154361 - DNA, 16 bp, Homo sapiens
tctgactcatccccac

SEQ ID NO: 4154362 - DNA, 14 bp, Homo sapiens
tctgactttttgtt

SEQ ID NO: 4154363 - DNA, 17 bp, Homo sapiens
tctgactttttgtttct

SEQ ID NO: 4154364 - DNA, 18 bp, Homo sapiens
tctgagaattccaaggag

SEQ ID NO: 4154365 - DNA, 19 bp, Homo sapiens
tctgagacccttttctcag

SEQ ID NO: 4154366 - DNA, 20 bp, Homo sapiens
tctgagactctttagagcag

SEQ ID NO: 4154367 - DNA, 15 bp, Homo sapiens
tctgagagcaaactg

SEQ ID NO: 4154368 - DNA, 16 bp, Homo sapiens
tctgagagcaaactgg

SEQ ID NO: 4154369 - DNA, 19 bp, Homo sapiens
tctgagatttttttgtgta

SEQ ID NO: 4154370 - DNA, 16 bp, Homo sapiens
tctgagcaagagctgg

SEQ ID NO: 4154371 - DNA, 23 bp, Homo sapiens
tctgagcattcgctgtacccttt

SEQ ID NO: 4154372 - DNA, 15 bp, Homo sapiens
tctgagccacagtgg

SEQ ID NO: 4154373 - DNA, 17 bp, Homo sapiens
tctgagccacagtggga

SEQ ID NO: 4154374 - DNA, 20 bp, Homo sapiens
tctgagcccagctgcctgga

SEQ ID NO: 4154375 - DNA, 17 bp, Homo sapiens
tctgagcgggaggcaga

SEQ ID NO: 4154376 - DNA, 20 bp, Homo sapiens
tctgagctgcagcctggctg

SEQ ID NO: 4154377 - DNA, 21 bp, Homo sapiens
tctgagctgcagcctggctgg

SEQ ID NO: 4154378 - DNA, 19 bp, Homo sapiens
tctgaggatgtagagagaa

SEQ ID NO: 4154379 - DNA, 12 bp, Homo sapiens
tctgagggggag

SEQ ID NO: 4154380 - DNA, 21 bp, Homo sapiens
tctgaggtgcctgtcccaccc

SEQ ID NO: 4154381 - DNA, 14 bp, Homo sapiens
tctgagtctggact

SEQ ID NO: 4154382 - DNA, 15 bp, Homo sapiens
tctgagtctggactt

SEQ ID NO: 4154383 - DNA, 20 bp, Homo sapiens
tctgagtttcattctcctgc

SEQ ID NO: 4154384 - DNA, 14 bp, Homo sapiens
tctgatacccagag

SEQ ID NO: 4154385 - DNA, 13 bp, Homo sapiens
tctgatctataca

SEQ ID NO: 4154386 - DNA, 13 bp, Homo sapiens
tctgatggcctta

SEQ ID NO: 4154387 - DNA, 20 bp, Homo sapiens
tctgatggccttaatttcct

SEQ ID NO: 4154388 - DNA, 21 bp, Homo sapiens
tctgatggccttaatttcctt

SEQ ID NO: 4154389 - DNA, 14 bp, Homo sapiens
tctgatgtctctaa

SEQ ID NO: 4154390 - DNA, 19 bp, Homo sapiens
tctgattaaaatgcttcct

SEQ ID NO: 4154391 - DNA, 16 bp, Homo sapiens
tctgattagctttgtg

SEQ ID NO: 4154392 - DNA, 19 bp, Homo sapiens
tctgcaaaaatatttataa

SEQ ID NO: 4154393 - DNA, 20 bp, Homo sapiens
tctgcaaaaatatttataaa

SEQ ID NO: 4154394 - DNA, 21 bp, Homo sapiens
tctgcaaaggtggcaatgctt

SEQ ID NO: 4154395 - DNA, 18 bp, Homo sapiens
tctgcaagcttcttgctg

SEQ ID NO: 4154396 - DNA, 16 bp, Homo sapiens
tctgcaatgggcactg

SEQ ID NO: 4154397 - DNA, 18 bp, Homo sapiens
tctgcaattcccctctgc

SEQ ID NO: 4154398 - DNA, 21 bp, Homo sapiens
tctgcaattcccctctgctgc

SEQ ID NO: 4154399 - DNA, 22 bp, Homo sapiens
tctgcaattcccctctgctgct

SEQ ID NO: 4154400 - DNA, 21 bp, Homo sapiens
tctgcaatttgtttaaagaat

SEQ ID NO: 4154401 - DNA, 23 bp, Homo sapiens
tctgcacacacctccgagacagt

SEQ ID NO: 4154402 - DNA, 22 bp, Homo sapiens
tctgcaccccttctctcctccc

SEQ ID NO: 4154403 - DNA, 20 bp, Homo sapiens
tctgcactctaaactgcaaa

SEQ ID NO: 4154404 - DNA, 23 bp, Homo sapiens
tctgcagacacgccttcccctca

SEQ ID NO: 4154405 - DNA, 16 bp, Homo sapiens
tctgcagacttcccag

SEQ ID NO: 4154406 - DNA, 20 bp, Homo sapiens
tctgcagcccttgggcagtt

SEQ ID NO: 4154407 - DNA, 17 bp, Homo sapiens
tctgcagtctcatttct

SEQ ID NO: 4154408 - DNA, 16 bp, Homo sapiens
tctgcagtgtgccccc

SEQ ID NO: 4154409 - DNA, 15 bp, Homo sapiens
tctgcatatgttgaa

SEQ ID NO: 4154410 - DNA, 19 bp, Homo sapiens
tctgcatcatctgtagata

SEQ ID NO: 4154411 - DNA, 18 bp, Homo sapiens
tctgcatcccagcacctg

SEQ ID NO: 4154412 - DNA, 22 bp, Homo sapiens
tctgcatcccagcacctgcctc

SEQ ID NO: 4154413 - DNA, 16 bp, Homo sapiens
tctgcattcattttta

SEQ ID NO: 4154414 - DNA, 18 bp, Homo sapiens
tctgcattgctagataaa

SEQ ID NO: 4154415 - DNA, 21 bp, Homo sapiens
tctgcattgctagataaaagc

SEQ ID NO: 4154416 - DNA, 21 bp, Homo sapiens
tctgcattttcaccccaccct

SEQ ID NO: 4154417 - DNA, 18 bp, Homo sapiens
tctgcattttgctattgt

SEQ ID NO: 4154418 - DNA, 19 bp, Homo sapiens
tctgccaaaggatgtgata

SEQ ID NO: 4154419 - DNA, 21 bp, Homo sapiens
tctgccacccactcaggattg

SEQ ID NO: 4154420 - DNA, 13 bp, Homo sapiens
tctgccagacctt

SEQ ID NO: 4154421 - DNA, 12 bp, Homo sapiens
tctgccaggcaa

SEQ ID NO: 4154422 - DNA, 13 bp, Homo sapiens
tctgccagggagc

SEQ ID NO: 4154423 - DNA, 13 bp, Homo sapiens
tctgccagtgaca

SEQ ID NO: 4154424 - DNA, 23 bp, Homo sapiens
tctgccagtgacagacaggctct

SEQ ID NO: 4154425 - DNA, 21 bp, Homo sapiens
tctgccagtggatcccctgcg

SEQ ID NO: 4154426 - DNA, 18 bp, Homo sapiens
tctgccatctagccagcc

SEQ ID NO: 4154427 - DNA, 12 bp, Homo sapiens
tctgcccaaccc

SEQ ID NO: 4154428 - DNA, 19 bp, Homo sapiens
tctgcccacttccccttcc

SEQ ID NO: 4154429 - DNA, 17 bp, Homo sapiens
tctgcccagcttttcat

SEQ ID NO: 4154430 - DNA, 14 bp, Homo sapiens
tctgccccacccaa

SEQ ID NO: 4154431 - DNA, 23 bp, Homo sapiens
tctgccccacccaagcccaaact

SEQ ID NO: 4154432 - DNA, 21 bp, Homo sapiens
tctgccccacgctgtggccct

SEQ ID NO: 4154433 - DNA, 16 bp, Homo sapiens
tctgccccagcccaga

SEQ ID NO: 4154434 - DNA, 17 bp, Homo sapiens
tctgccccagcccagat

SEQ ID NO: 4154435 - DNA, 19 bp, Homo sapiens
tctgcccctggacctggga

SEQ ID NO: 4154436 - DNA, 15 bp, Homo sapiens
tctgccctgtgtact

SEQ ID NO: 4154437 - DNA, 15 bp, Homo sapiens
tctgccgctacctcc

SEQ ID NO: 4154438 - DNA, 18 bp, Homo sapiens
tctgccgctacctccctc

SEQ ID NO: 4154439 - DNA, 14 bp, Homo sapiens
tctgcctccaccct

SEQ ID NO: 4154440 - DNA, 18 bp, Homo sapiens
tctgcctccaccctcctc

SEQ ID NO: 4154441 - DNA, 23 bp, Homo sapiens
tctgcctgaggggcagcctgcct

SEQ ID NO: 4154442 - DNA, 16 bp, Homo sapiens
tctgcctgccagctgc

SEQ ID NO: 4154443 - DNA, 17 bp, Homo sapiens
tctgcctgccagctgca

SEQ ID NO: 4154444 - DNA, 20 bp, Homo sapiens
tctgcctggtggtcagatgc

SEQ ID NO: 4154445 - DNA, 13 bp, Homo sapiens
tctgcctgttctg

SEQ ID NO: 4154446 - DNA, 16 bp, Homo sapiens
tctgcctttgacattt

SEQ ID NO: 4154447 - DNA, 22 bp, Homo sapiens
tctgcgtggttcctttctcagc

SEQ ID NO: 4154448 - DNA, 16 bp, Homo sapiens
tctgctaatgtaaact

SEQ ID NO: 4154449 - DNA, 14 bp, Homo sapiens
tctgctagaaagtt

SEQ ID NO: 4154450 - DNA, 13 bp, Homo sapiens
tctgctagagagt

SEQ ID NO: 4154451 - DNA, 19 bp, Homo sapiens
tctgctcactttaaacctg

SEQ ID NO: 4154452 - DNA, 14 bp, Homo sapiens
tctgctcagctctg

SEQ ID NO: 4154453 - DNA, 16 bp, Homo sapiens
tctgctcagctctggg

SEQ ID NO: 4154454 - DNA, 14 bp, Homo sapiens
tctgctccaccaca

SEQ ID NO: 4154455 - DNA, 15 bp, Homo sapiens
tctgctccacccttg

SEQ ID NO: 4154456 - DNA, 20 bp, Homo sapiens
tctgctccataccttttctc

SEQ ID NO: 4154457 - DNA, 12 bp, Homo sapiens
tctgctcctgct

SEQ ID NO: 4154458 - DNA, 13 bp, Homo sapiens
tctgctcctgctt

SEQ ID NO: 4154459 - DNA, 19 bp, Homo sapiens
tctgctcctgcttttctgt

SEQ ID NO: 4154460 - DNA, 17 bp, Homo sapiens
tctgctcgccctccttt

SEQ ID NO: 4154461 - DNA, 21 bp, Homo sapiens
tctgctcgccctcctttctgt

SEQ ID NO: 4154462 - DNA, 12 bp, Homo sapiens
tctgctctcagc

SEQ ID NO: 4154463 - DNA, 16 bp, Homo sapiens
tctgctgagttggcct

SEQ ID NO: 4154464 - DNA, 16 bp, Homo sapiens
tctgctggataaaatg

SEQ ID NO: 4154465 - DNA, 22 bp, Homo sapiens
tctgctggataaaatgaggttc

SEQ ID NO: 4154466 - DNA, 17 bp, Homo sapiens
tctgctggcctggatct

SEQ ID NO: 4154467 - DNA, 18 bp, Homo sapiens
tctgctggcctggatctc

SEQ ID NO: 4154468 - DNA, 21 bp, Homo sapiens
tctgctgggagttctagaacc

SEQ ID NO: 4154469 - DNA, 14 bp, Homo sapiens
tctgctggtggaaa

SEQ ID NO: 4154470 - DNA, 17 bp, Homo sapiens
tctgctgtccccttggc

SEQ ID NO: 4154471 - DNA, 22 bp, Homo sapiens
tctgctgtccccttggcaggtc

SEQ ID NO: 4154472 - DNA, 23 bp, Homo sapiens
tctgctgtgggcacaggtcaggc

SEQ ID NO: 4154473 - DNA, 16 bp, Homo sapiens
tctgcttctcatccca

SEQ ID NO: 4154474 - DNA, 13 bp, Homo sapiens
tctgcttctctca

SEQ ID NO: 4154475 - DNA, 14 bp, Homo sapiens
tctgcttgtgttaa

SEQ ID NO: 4154476 - DNA, 18 bp, Homo sapiens
tctgctttaaagggcctg

SEQ ID NO: 4154477 - DNA, 21 bp, Homo sapiens
tctgctttaaagggcctgcct

SEQ ID NO: 4154478 - DNA, 22 bp, Homo sapiens
tctgctttaaagggcctgcctg

SEQ ID NO: 4154479 - DNA, 15 bp, Homo sapiens
tctgctttatctttt

SEQ ID NO: 4154480 - DNA, 19 bp, Homo sapiens
tctgcttttctgccctggc

SEQ ID NO: 4154481 - DNA, 22 bp, Homo sapiens
tctgcttttctgccctggctgc

SEQ ID NO: 4154482 - DNA, 13 bp, Homo sapiens
tctggaaaagagg

SEQ ID NO: 4154483 - DNA, 18 bp, Homo sapiens
tctggaaaatgtgaccca

SEQ ID NO: 4154484 - DNA, 13 bp, Homo sapiens
tctggaacccaga

SEQ ID NO: 4154485 - DNA, 16 bp, Homo sapiens
tctggaacccagactc

SEQ ID NO: 4154486 - DNA, 16 bp, Homo sapiens
tctggaacctcagcct

SEQ ID NO: 4154487 - DNA, 17 bp, Homo sapiens
tctggaacctcagcctg

SEQ ID NO: 4154488 - DNA, 20 bp, Homo sapiens
tctggaagagaggaatgcct

SEQ ID NO: 4154489 - DNA, 18 bp, Homo sapiens
tctggaagccctggagac

SEQ ID NO: 4154490 - DNA, 19 bp, Homo sapiens
tctggaataaagttgcaga

SEQ ID NO: 4154491 - DNA, 20 bp, Homo sapiens
tctggaatatgcaacattgt

SEQ ID NO: 4154492 - DNA, 19 bp, Homo sapiens
tctggaatattgtgattct

SEQ ID NO: 4154493 - DNA, 23 bp, Homo sapiens
tctggaatcattgtccagagctg

SEQ ID NO: 4154494 - DNA, 18 bp, Homo sapiens
tctggaatgtttttccct

SEQ ID NO: 4154495 - DNA, 21 bp, Homo sapiens
tctggacaagccaacttgtaa

SEQ ID NO: 4154496 - DNA, 13 bp, Homo sapiens
tctggacagcaga

SEQ ID NO: 4154497 - DNA, 16 bp, Homo sapiens
tctggacagcagaagc

SEQ ID NO: 4154498 - DNA, 13 bp, Homo sapiens
tctggacagccag

SEQ ID NO: 4154499 - DNA, 19 bp, Homo sapiens
tctggacagccccaccctg

SEQ ID NO: 4154500 - DNA, 14 bp, Homo sapiens
tctggacaggctct

SEQ ID NO: 4154501 - DNA, 20 bp, Homo sapiens
tctggacaggctctgcttct

SEQ ID NO: 4154502 - DNA, 20 bp, Homo sapiens
tctggacatgaattaaagta

SEQ ID NO: 4154503 - DNA, 14 bp, Homo sapiens
tctggacggcaggc

SEQ ID NO: 4154504 - DNA, 15 bp, Homo sapiens
tctggacggcaggct

SEQ ID NO: 4154505 - DNA, 21 bp, Homo sapiens
tctggacggcaggctcactgc

SEQ ID NO: 4154506 - DNA, 19 bp, Homo sapiens
tctggagaccagggagcct

SEQ ID NO: 4154507 - DNA, 20 bp, Homo sapiens
tctggagaccagggagcctt

SEQ ID NO: 4154508 - DNA, 19 bp, Homo sapiens
tctggaggaaagggaggag

SEQ ID NO: 4154509 - DNA, 17 bp, Homo sapiens
tctggaggccttccagc

SEQ ID NO: 4154510 - DNA, 21 bp, Homo sapiens
tctggagtctcacttgtctca

SEQ ID NO: 4154511 - DNA, 13 bp, Homo sapiens
tctggagtgggca

SEQ ID NO: 4154512 - DNA, 16 bp, Homo sapiens
tctggagttgatctgg

SEQ ID NO: 4154513 - DNA, 17 bp, Homo sapiens
tctggagttgatctgga

SEQ ID NO: 4154514 - DNA, 21 bp, Homo sapiens
tctggataggagcctgctggt

SEQ ID NO: 4154515 - DNA, 15 bp, Homo sapiens
tctggattctgggag

SEQ ID NO: 4154516 - DNA, 22 bp, Homo sapiens
tctggattctgggaggcaagaa

SEQ ID NO: 4154517 - DNA, 22 bp, Homo sapiens
tctggcaaaaaggagccttttg

SEQ ID NO: 4154518 - DNA, 21 bp, Homo sapiens
tctggcagcctcccatccagg

SEQ ID NO: 4154519 - DNA, 17 bp, Homo sapiens
tctggccaggcactgcc

SEQ ID NO: 4154520 - DNA, 13 bp, Homo sapiens
tctggccctggcc

SEQ ID NO: 4154521 - DNA, 14 bp, Homo sapiens
tctggcccttacac

SEQ ID NO: 4154522 - DNA, 16 bp, Homo sapiens
tctggcctcagaccaa

SEQ ID NO: 4154523 - DNA, 14 bp, Homo sapiens
tctggctgagctga

SEQ ID NO: 4154524 - DNA, 22 bp, Homo sapiens
tctggctgccccaacctgctga

SEQ ID NO: 4154525 - DNA, 18 bp, Homo sapiens
tctggctgtctagaatgt

SEQ ID NO: 4154526 - DNA, 19 bp, Homo sapiens
tctggctgtttagcagaac

SEQ ID NO: 4154527 - DNA, 13 bp, Homo sapiens
tctggcttccagg

SEQ ID NO: 4154528 - DNA, 16 bp, Homo sapiens
tctggctttcccagga

SEQ ID NO: 4154529 - DNA, 19 bp, Homo sapiens
tctggctttttcctctgag

SEQ ID NO: 4154530 - DNA, 18 bp, Homo sapiens
tctgggaaataagagaga

SEQ ID NO: 4154531 - DNA, 22 bp, Homo sapiens
tctgggaaatgagaaggcagcc

SEQ ID NO: 4154532 - DNA, 22 bp, Homo sapiens
tctgggacctgccaggcagggg

SEQ ID NO: 4154533 - DNA, 16 bp, Homo sapiens
tctgggagaggatttt

SEQ ID NO: 4154534 - DNA, 14 bp, Homo sapiens
tctgggagcagaaa

SEQ ID NO: 4154535 - DNA, 16 bp, Homo sapiens
tctgggagcagaaaca

SEQ ID NO: 4154536 - DNA, 22 bp, Homo sapiens
tctgggagcagaaacagccatt

SEQ ID NO: 4154537 - DNA, 16 bp, Homo sapiens
tctgggagtcacacag

SEQ ID NO: 4154538 - DNA, 17 bp, Homo sapiens
tctgggagtcacacagt

SEQ ID NO: 4154539 - DNA, 23 bp, Homo sapiens
tctgggatatggctgcccaggag

SEQ ID NO: 4154540 - DNA, 15 bp, Homo sapiens
tctgggattctactt

SEQ ID NO: 4154541 - DNA, 20 bp, Homo sapiens
tctgggcggcgggcggctgg

SEQ ID NO: 4154542 - DNA, 21 bp, Homo sapiens
tctgggctgtaacgtggcact

SEQ ID NO: 4154543 - DNA, 17 bp, Homo sapiens
tctggggacagcttcct

SEQ ID NO: 4154544 - DNA, 23 bp, Homo sapiens
tctggggacagcttcctcacacc

SEQ ID NO: 4154545 - DNA, 20 bp, Homo sapiens
tctggggcaggctgggccat

SEQ ID NO: 4154546 - DNA, 15 bp, Homo sapiens
tctggggccctgggc

SEQ ID NO: 4154547 - DNA, 14 bp, Homo sapiens
tctgggggaaaaag

SEQ ID NO: 4154548 - DNA, 16 bp, Homo sapiens
tctgggggacagagaa

SEQ ID NO: 4154549 - DNA, 22 bp, Homo sapiens
tctggggtctttttatgcattt

SEQ ID NO: 4154550 - DNA, 19 bp, Homo sapiens
tctggggtgctgcctgaat

SEQ ID NO: 4154551 - DNA, 20 bp, Homo sapiens
tctggggttggcaacaggac

SEQ ID NO: 4154552 - DNA, 13 bp, Homo sapiens
tctgggtcttttg

SEQ ID NO: 4154553 - DNA, 21 bp, Homo sapiens
tctggtaatattgacttgtat

SEQ ID NO: 4154554 - DNA, 22 bp, Homo sapiens
tctggtcaagttgagattttta

SEQ ID NO: 4154555 - DNA, 18 bp, Homo sapiens
tctggtccatatttacat

SEQ ID NO: 4154556 - DNA, 14 bp, Homo sapiens
tctggtcccttgca

SEQ ID NO: 4154557 - DNA, 18 bp, Homo sapiens
tctggtccggacactcct

SEQ ID NO: 4154558 - DNA, 13 bp, Homo sapiens
tctggtccttttt

SEQ ID NO: 4154559 - DNA, 14 bp, Homo sapiens
tctggtctcgaact

SEQ ID NO: 4154560 - DNA, 17 bp, Homo sapiens
tctggtgatctcccaag

SEQ ID NO: 4154561 - DNA, 16 bp, Homo sapiens
tctggttagttaaaag

SEQ ID NO: 4154562 - DNA, 15 bp, Homo sapiens
tctggttgaactctg

SEQ ID NO: 4154563 - DNA, 16 bp, Homo sapiens
tctggttgtttctgtt

SEQ ID NO: 4154564 - DNA, 14 bp, Homo sapiens
tctggtttctcatt

SEQ ID NO: 4154565 - DNA, 13 bp, Homo sapiens
tctggtttggcat

SEQ ID NO: 4154566 - DNA, 16 bp, Homo sapiens
tctgtaaaaacactga

SEQ ID NO: 4154567 - DNA, 21 bp, Homo sapiens
tctgtaaaactaagaaactta

SEQ ID NO: 4154568 - DNA, 23 bp, Homo sapiens
tctgtaacaggtattttgtttct

SEQ ID NO: 4154569 - DNA, 17 bp, Homo sapiens
tctgtaagatatcccag

SEQ ID NO: 4154570 - DNA, 18 bp, Homo sapiens
tctgtacatattactgtt

SEQ ID NO: 4154571 - DNA, 18 bp, Homo sapiens
tctgtagagccttctgat

SEQ ID NO: 4154572 - DNA, 22 bp, Homo sapiens
tctgtagggatttttggctaca

SEQ ID NO: 4154573 - DNA, 14 bp, Homo sapiens
tctgtagggctgga

SEQ ID NO: 4154574 - DNA, 23 bp, Homo sapiens
tctgtagtactccttaagaacac

SEQ ID NO: 4154575 - DNA, 18 bp, Homo sapiens
tctgtagtcatttactaa

SEQ ID NO: 4154576 - DNA, 22 bp, Homo sapiens
tctgtatagaaatctaaaagaa

SEQ ID NO: 4154577 - DNA, 15 bp, Homo sapiens
tctgtatatactttt

SEQ ID NO: 4154578 - DNA, 17 bp, Homo sapiens
tctgtattgtgctgatt

SEQ ID NO: 4154579 - DNA, 20 bp, Homo sapiens
tctgtatttaatggttttta

SEQ ID NO: 4154580 - DNA, 23 bp, Homo sapiens
tctgtattttatttagacaagag

SEQ ID NO: 4154581 - DNA, 20 bp, Homo sapiens
tctgtcaccagctatctgtc

SEQ ID NO: 4154582 - DNA, 18 bp, Homo sapiens
tctgtcagatgggaagac

SEQ ID NO: 4154583 - DNA, 19 bp, Homo sapiens
tctgtcagatgggaagaca

SEQ ID NO: 4154584 - DNA, 19 bp, Homo sapiens
tctgtcagcatctggctgt

SEQ ID NO: 4154585 - DNA, 17 bp, Homo sapiens
tctgtcagccagccgcc

SEQ ID NO: 4154586 - DNA, 21 bp, Homo sapiens
tctgtcagccagccgccctgg

SEQ ID NO: 4154587 - DNA, 13 bp, Homo sapiens
tctgtcagtcaca

SEQ ID NO: 4154588 - DNA, 19 bp, Homo sapiens
tctgtcagtcacagccacc

SEQ ID NO: 4154589 - DNA, 17 bp, Homo sapiens
tctgtcatctctctggg

SEQ ID NO: 4154590 - DNA, 21 bp, Homo sapiens
tctgtcatctctctggggccc

SEQ ID NO: 4154591 - DNA, 16 bp, Homo sapiens
tctgtccaaaggaggc

SEQ ID NO: 4154592 - DNA, 17 bp, Homo sapiens
tctgtccaaaggaggct

SEQ ID NO: 4154593 - DNA, 19 bp, Homo sapiens
tctgtccaactgagaagta

SEQ ID NO: 4154594 - DNA, 19 bp, Homo sapiens
tctgtccatggcctttcta

SEQ ID NO: 4154595 - DNA, 21 bp, Homo sapiens
tctgtccatggcctttctaat

SEQ ID NO: 4154596 - DNA, 22 bp, Homo sapiens
tctgtccatggcctttctaata

SEQ ID NO: 4154597 - DNA, 19 bp, Homo sapiens
tctgtccatttatccacag

SEQ ID NO: 4154598 - DNA, 19 bp, Homo sapiens
tctgtcccacccctagcca

SEQ ID NO: 4154599 - DNA, 13 bp, Homo sapiens
tctgtccccagcc

SEQ ID NO: 4154600 - DNA, 23 bp, Homo sapiens
tctgtccgtggaaaatttcagtc

SEQ ID NO: 4154601 - DNA, 23 bp, Homo sapiens
tctgtcctcagccttgccagaga

SEQ ID NO: 4154602 - DNA, 16 bp, Homo sapiens
tctgtcctgagaagca

SEQ ID NO: 4154603 - DNA, 13 bp, Homo sapiens
tctgtcctgtgac

SEQ ID NO: 4154604 - DNA, 20 bp, Homo sapiens
tctgtccttcagatggaaac

SEQ ID NO: 4154605 - DNA, 14 bp, Homo sapiens
tctgtctacaaata

SEQ ID NO: 4154606 - DNA, 9 bp, Homo sapiens
tctgtctgc

SEQ ID NO: 4154607 - DNA, 12 bp, Homo sapiens
tctgtctgcttt

SEQ ID NO: 4154608 - DNA, 18 bp, Homo sapiens
tctgtctggagtgacaga

SEQ ID NO: 4154609 - DNA, 17 bp, Homo sapiens
tctgtgaaatgctggca

SEQ ID NO: 4154610 - DNA, 12 bp, Homo sapiens
tctgtgaataca

SEQ ID NO: 4154611 - DNA, 19 bp, Homo sapiens
tctgtgaatacaattaaag

SEQ ID NO: 4154612 - DNA, 18 bp, Homo sapiens
tctgtgaggtgctgatga

SEQ ID NO: 4154613 - DNA, 20 bp, Homo sapiens
tctgtgatcttttaaagtgt

SEQ ID NO: 4154614 - DNA, 17 bp, Homo sapiens
tctgtgatgacattccc

SEQ ID NO: 4154615 - DNA, 18 bp, Homo sapiens
tctgtgcagggctggttt

SEQ ID NO: 4154616 - DNA, 22 bp, Homo sapiens
tctgtgccagaaacagtgggag

SEQ ID NO: 4154617 - DNA, 14 bp, Homo sapiens
tctgtgccccatgc

SEQ ID NO: 4154618 - DNA, 15 bp, Homo sapiens
tctgtgccccatgcc

SEQ ID NO: 4154619 - DNA, 22 bp, Homo sapiens
tctgtgccccatgcctgtccag

SEQ ID NO: 4154620 - DNA, 17 bp, Homo sapiens
tctgtgccttgtttttt

SEQ ID NO: 4154621 - DNA, 16 bp, Homo sapiens
tctgtgcgtgaaacac

SEQ ID NO: 4154622 - DNA, 18 bp, Homo sapiens
tctgtggatggtcattgc

SEQ ID NO: 4154623 - DNA, 18 bp, Homo sapiens
tctgtgggcccctcaaca

SEQ ID NO: 4154624 - DNA, 18 bp, Homo sapiens
tctgtggttcctctgctc

SEQ ID NO: 4154625 - DNA, 20 bp, Homo sapiens
tctgtggttcctctgctcac

SEQ ID NO: 4154626 - DNA, 13 bp, Homo sapiens
tctgtgtatcttt

SEQ ID NO: 4154627 - DNA, 14 bp, Homo sapiens
tctgtgtcatttct

SEQ ID NO: 4154628 - DNA, 16 bp, Homo sapiens
tctgtgtgaaactttc

SEQ ID NO: 4154629 - DNA, 19 bp, Homo sapiens
tctgtgtgaaactttcatt

SEQ ID NO: 4154630 - DNA, 12 bp, Homo sapiens
tctgtgtttaaa

SEQ ID NO: 4154631 - DNA, 20 bp, Homo sapiens
tctgtgtttacagagatgtc

SEQ ID NO: 4154632 - DNA, 21 bp, Homo sapiens
tctgttaccatgtcactgtgg

SEQ ID NO: 4154633 - DNA, 15 bp, Homo sapiens
tctgttacccaggct

SEQ ID NO: 4154634 - DNA, 14 bp, Homo sapiens
tctgttcaggaagt

SEQ ID NO: 4154635 - DNA, 17 bp, Homo sapiens
tctgttccaaattcagt

SEQ ID NO: 4154636 - DNA, 19 bp, Homo sapiens
tctgttccatgcaactgga

SEQ ID NO: 4154637 - DNA, 15 bp, Homo sapiens
tctgttctaacatgt

SEQ ID NO: 4154638 - DNA, 15 bp, Homo sapiens
tctgttctagttttt

SEQ ID NO: 4154639 - DNA, 14 bp, Homo sapiens
tctgttctgctggg

SEQ ID NO: 4154640 - DNA, 13 bp, Homo sapiens
tctgttctggggg

SEQ ID NO: 4154641 - DNA, 16 bp, Homo sapiens
tctgttgcaagtgcaa

SEQ ID NO: 4154642 - DNA, 18 bp, Homo sapiens
tctgttgccacaaccctg

SEQ ID NO: 4154643 - DNA, 18 bp, Homo sapiens
tctgttgtcattgctgtt

SEQ ID NO: 4154644 - DNA, 23 bp, Homo sapiens
tctgttgtcgtaaagatttgggt

SEQ ID NO: 4154645 - DNA, 20 bp, Homo sapiens
tctgttgtttggttcaggga

SEQ ID NO: 4154646 - DNA, 19 bp, Homo sapiens
tctgtttaaagcatataga

SEQ ID NO: 4154647 - DNA, 14 bp, Homo sapiens
tctgtttaaagtgg

SEQ ID NO: 4154648 - DNA, 19 bp, Homo sapiens
tctgtttaagaaaagtatt

SEQ ID NO: 4154649 - DNA, 20 bp, Homo sapiens
tctgtttatggccacattta

SEQ ID NO: 4154650 - DNA, 13 bp, Homo sapiens
tctgtttgattct

SEQ ID NO: 4154651 - DNA, 19 bp, Homo sapiens
tctgtttggactgcagaag

SEQ ID NO: 4154652 - DNA, 17 bp, Homo sapiens
tctgtttgtaaattatt

SEQ ID NO: 4154653 - DNA, 13 bp, Homo sapiens
tctgtttgtttca

SEQ ID NO: 4154654 - DNA, 17 bp, Homo sapiens
tctgttttgaaggcaaa

SEQ ID NO: 4154655 - DNA, 17 bp, Homo sapiens
tctgttttgtatcttaa

SEQ ID NO: 4154656 - DNA, 23 bp, Homo sapiens
tctgttttgtttggcaaggaaag

SEQ ID NO: 4154657 - DNA, 14 bp, Homo sapiens
tctgtttttctttt

SEQ ID NO: 4154658 - DNA, 20 bp, Homo sapiens
tcttaaaatacccattgccc

SEQ ID NO: 4154659 - DNA, 21 bp, Homo sapiens
tcttaaacataataaatcaca

SEQ ID NO: 4154660 - DNA, 16 bp, Homo sapiens
tcttaaaccaaccttt

SEQ ID NO: 4154661 - DNA, 19 bp, Homo sapiens
tcttaaagcaaaaaatgaa

SEQ ID NO: 4154662 - DNA, 22 bp, Homo sapiens
tcttaaatcagaataaattaat

SEQ ID NO: 4154663 - DNA, 21 bp, Homo sapiens
tcttaaatgcaagtgcctaga

SEQ ID NO: 4154664 - DNA, 19 bp, Homo sapiens
tcttaaatgctcattttct

SEQ ID NO: 4154665 - DNA, 21 bp, Homo sapiens
tcttaacaaaccaacatcttt

SEQ ID NO: 4154666 - DNA, 15 bp, Homo sapiens
tcttaacaatttctg

SEQ ID NO: 4154667 - DNA, 18 bp, Homo sapiens
tcttaagcagcatggaaa

SEQ ID NO: 4154668 - DNA, 11 bp, Homo sapiens
tcttaatctgt

SEQ ID NO: 4154669 - DNA, 23 bp, Homo sapiens
tcttaatttaatcttttttatgt

SEQ ID NO: 4154670 - DNA, 21 bp, Homo sapiens
tcttacaagatattgatgata

SEQ ID NO: 4154671 - DNA, 17 bp, Homo sapiens
tcttacctactattggc

SEQ ID NO: 4154672 - DNA, 18 bp, Homo sapiens
tcttacctactattggcc

SEQ ID NO: 4154673 - DNA, 16 bp, Homo sapiens
tcttactaatgtaaaa

SEQ ID NO: 4154674 - DNA, 17 bp, Homo sapiens
tcttactattaagcagt

SEQ ID NO: 4154675 - DNA, 21 bp, Homo sapiens
tcttactattaagcagtaaaa

SEQ ID NO: 4154676 - DNA, 23 bp, Homo sapiens
tcttactattaagcagtaaaaac

SEQ ID NO: 4154677 - DNA, 14 bp, Homo sapiens
tcttactctttcct

SEQ ID NO: 4154678 - DNA, 16 bp, Homo sapiens
tcttactctttcctat

SEQ ID NO: 4154679 - DNA, 16 bp, Homo sapiens
tcttactgataatttt

SEQ ID NO: 4154680 - DNA, 15 bp, Homo sapiens
tcttactttgcttga

SEQ ID NO: 4154681 - DNA, 14 bp, Homo sapiens
tcttagattcttaa

SEQ ID NO: 4154682 - DNA, 16 bp, Homo sapiens
tcttagcagcttccag

SEQ ID NO: 4154683 - DNA, 22 bp, Homo sapiens
tcttagcatagcttattattga

SEQ ID NO: 4154684 - DNA, 14 bp, Homo sapiens
tcttagctttttaa

SEQ ID NO: 4154685 - DNA, 16 bp, Homo sapiens
tcttagctttttaatt

SEQ ID NO: 4154686 - DNA, 17 bp, Homo sapiens
tcttagctttttaattg

SEQ ID NO: 4154687 - DNA, 19 bp, Homo sapiens
tcttaggaagagaaaccag

SEQ ID NO: 4154688 - DNA, 19 bp, Homo sapiens
tcttaggggagagctttct

SEQ ID NO: 4154689 - DNA, 16 bp, Homo sapiens
tcttagtggatgttct

SEQ ID NO: 4154690 - DNA, 20 bp, Homo sapiens
tcttagttgacaacctagaa

SEQ ID NO: 4154691 - DNA, 14 bp, Homo sapiens
tcttatacacattg

SEQ ID NO: 4154692 - DNA, 20 bp, Homo sapiens
tcttatacgcttttctttgt

SEQ ID NO: 4154693 - DNA, 17 bp, Homo sapiens
tcttatagaataaaagc

SEQ ID NO: 4154694 - DNA, 19 bp, Homo sapiens
tcttatagaataaaagctg

SEQ ID NO: 4154695 - DNA, 21 bp, Homo sapiens
tcttatagaataaaagctgtg

SEQ ID NO: 4154696 - DNA, 23 bp, Homo sapiens
tcttatagaataaaagctgtgga

SEQ ID NO: 4154697 - DNA, 17 bp, Homo sapiens
tcttatgcttccagaaa

SEQ ID NO: 4154698 - DNA, 17 bp, Homo sapiens
tcttatggaattgattt

SEQ ID NO: 4154699 - DNA, 18 bp, Homo sapiens
tcttatggtccagaaact

SEQ ID NO: 4154700 - DNA, 12 bp, Homo sapiens
tcttatgtgaca

SEQ ID NO: 4154701 - DNA, 13 bp, Homo sapiens
tcttatgtgacat

SEQ ID NO: 4154702 - DNA, 16 bp, Homo sapiens
tcttatgtgacattaa

SEQ ID NO: 4154703 - DNA, 17 bp, Homo sapiens
tcttattagggagaaaa

SEQ ID NO: 4154704 - DNA, 19 bp, Homo sapiens
tcttattttctcaatctcc

SEQ ID NO: 4154705 - DNA, 16 bp, Homo sapiens
tcttcaaatacaaagt

SEQ ID NO: 4154706 - DNA, 13 bp, Homo sapiens
tcttcaaatcctt

SEQ ID NO: 4154707 - DNA, 11 bp, Homo sapiens
tcttcaacaga

SEQ ID NO: 4154708 - DNA, 21 bp, Homo sapiens
tcttcaacatcaatgttcatt

SEQ ID NO: 4154709 - DNA, 23 bp, Homo sapiens
tcttcaacatcaatgttcattgt

SEQ ID NO: 4154710 - DNA, 18 bp, Homo sapiens
tcttcaacatcctgccag

SEQ ID NO: 4154711 - DNA, 21 bp, Homo sapiens
tcttcaacatcctgccagccc

SEQ ID NO: 4154712 - DNA, 14 bp, Homo sapiens
tcttcaatagctaa

SEQ ID NO: 4154713 - DNA, 18 bp, Homo sapiens
tcttcaatagctaagcat

SEQ ID NO: 4154714 - DNA, 19 bp, Homo sapiens
tcttcacatgtttaacttt

SEQ ID NO: 4154715 - DNA, 21 bp, Homo sapiens
tcttcaccaggtgcatgcatg

SEQ ID NO: 4154716 - DNA, 19 bp, Homo sapiens
tcttcacccagctaatctg

SEQ ID NO: 4154717 - DNA, 20 bp, Homo sapiens
tcttcacccagctaatctgt

SEQ ID NO: 4154718 - DNA, 18 bp, Homo sapiens
tcttcacctcctgccagc

SEQ ID NO: 4154719 - DNA, 16 bp, Homo sapiens
tcttcacctctatcca

SEQ ID NO: 4154720 - DNA, 15 bp, Homo sapiens
tcttcacctgttatg

SEQ ID NO: 4154721 - DNA, 18 bp, Homo sapiens
tcttcagaagacactgca

SEQ ID NO: 4154722 - DNA, 16 bp, Homo sapiens
tcttcagagcaggggt

SEQ ID NO: 4154723 - DNA, 16 bp, Homo sapiens
tcttcagccatcaaca

SEQ ID NO: 4154724 - DNA, 16 bp, Homo sapiens
tcttcagcgtaaaatg

SEQ ID NO: 4154725 - DNA, 15 bp, Homo sapiens
tcttcaggaaaataa

SEQ ID NO: 4154726 - DNA, 15 bp, Homo sapiens
tcttcaggcctccct

SEQ ID NO: 4154727 - DNA, 22 bp, Homo sapiens
tcttcagtcagaaaactttaaa

SEQ ID NO: 4154728 - DNA, 12 bp, Homo sapiens
tcttcagtttta

SEQ ID NO: 4154729 - DNA, 18 bp, Homo sapiens
tcttcagttttatcttta

SEQ ID NO: 4154730 - DNA, 19 bp, Homo sapiens
tcttcagttttatctttaa

SEQ ID NO: 4154731 - DNA, 21 bp, Homo sapiens
tcttcatattctaaaaccatt

SEQ ID NO: 4154732 - DNA, 18 bp, Homo sapiens
tcttcatccaacttccaa

SEQ ID NO: 4154733 - DNA, 14 bp, Homo sapiens
tcttcatgcaatga

SEQ ID NO: 4154734 - DNA, 17 bp, Homo sapiens
tcttcatgcaatgacat

SEQ ID NO: 4154735 - DNA, 17 bp, Homo sapiens
tcttcattattctctgc

SEQ ID NO: 4154736 - DNA, 20 bp, Homo sapiens
tcttcattttggtttatttt

SEQ ID NO: 4154737 - DNA, 23 bp, Homo sapiens
tcttcattttggtttatttttgt

SEQ ID NO: 4154738 - DNA, 20 bp, Homo sapiens
tcttccacaaaaaatacttt

SEQ ID NO: 4154739 - DNA, 19 bp, Homo sapiens
tcttccagttactttccaa

SEQ ID NO: 4154740 - DNA, 19 bp, Homo sapiens
tcttccatgtatcttttga

SEQ ID NO: 4154741 - DNA, 13 bp, Homo sapiens
tcttcccataata

SEQ ID NO: 4154742 - DNA, 20 bp, Homo sapiens
tcttccccagaaaggagact

SEQ ID NO: 4154743 - DNA, 14 bp, Homo sapiens
tcttccccttccct

SEQ ID NO: 4154744 - DNA, 18 bp, Homo sapiens
tcttccccttcctgtttc

SEQ ID NO: 4154745 - DNA, 14 bp, Homo sapiens
tcttccctacctca

SEQ ID NO: 4154746 - DNA, 20 bp, Homo sapiens
tcttccctagagggttcctg

SEQ ID NO: 4154747 - DNA, 16 bp, Homo sapiens
tcttccctctctgcag

SEQ ID NO: 4154748 - DNA, 19 bp, Homo sapiens
tcttccctggtaagaaaaa

SEQ ID NO: 4154749 - DNA, 17 bp, Homo sapiens
tcttccctttccccagc

SEQ ID NO: 4154750 - DNA, 18 bp, Homo sapiens
tcttccggagatgtagca

SEQ ID NO: 4154751 - DNA, 22 bp, Homo sapiens
tcttcctacatcttcttcccag

SEQ ID NO: 4154752 - DNA, 20 bp, Homo sapiens
tcttcctaccaagtcaaact

SEQ ID NO: 4154753 - DNA, 21 bp, Homo sapiens
tcttcctaccaagtcaaactt

SEQ ID NO: 4154754 - DNA, 12 bp, Homo sapiens
tcttcctcagct

SEQ ID NO: 4154755 - DNA, 13 bp, Homo sapiens
tcttcctcagctg

SEQ ID NO: 4154756 - DNA, 16 bp, Homo sapiens
tcttcctccaaggaca

SEQ ID NO: 4154757 - DNA, 20 bp, Homo sapiens
tcttcctccaaggacagaag

SEQ ID NO: 4154758 - DNA, 13 bp, Homo sapiens
tcttcctccagct

SEQ ID NO: 4154759 - DNA, 14 bp, Homo sapiens
tcttcctccagctg

SEQ ID NO: 4154760 - DNA, 17 bp, Homo sapiens
tcttcctccagctgcac

SEQ ID NO: 4154761 - DNA, 13 bp, Homo sapiens
tcttcctggacag

SEQ ID NO: 4154762 - DNA, 14 bp, Homo sapiens
tcttcctgtgtcct

SEQ ID NO: 4154763 - DNA, 15 bp, Homo sapiens
tcttccttgatgttt

SEQ ID NO: 4154764 - DNA, 21 bp, Homo sapiens
tcttccttggccaagagaagg

SEQ ID NO: 4154765 - DNA, 17 bp, Homo sapiens
tcttcctttctctttct

SEQ ID NO: 4154766 - DNA, 19 bp, Homo sapiens
tcttcggccgagctggttt

SEQ ID NO: 4154767 - DNA, 22 bp, Homo sapiens
tcttctaaacttccccatcttc

SEQ ID NO: 4154768 - DNA, 17 bp, Homo sapiens
tcttctaggttctaaaa

SEQ ID NO: 4154769 - DNA, 20 bp, Homo sapiens
tcttctatttttatcatgaa

SEQ ID NO: 4154770 - DNA, 16 bp, Homo sapiens
tcttctcatagcatta

SEQ ID NO: 4154771 - DNA, 17 bp, Homo sapiens
tcttctcatagcattaa

SEQ ID NO: 4154772 - DNA, 17 bp, Homo sapiens
tcttctccagatttttc

SEQ ID NO: 4154773 - DNA, 16 bp, Homo sapiens
tcttctcccccatcct

SEQ ID NO: 4154774 - DNA, 13 bp, Homo sapiens
tcttctcctttca

SEQ ID NO: 4154775 - DNA, 13 bp, Homo sapiens
tcttctcggctca

SEQ ID NO: 4154776 - DNA, 16 bp, Homo sapiens
tcttctcggctcaggc

SEQ ID NO: 4154777 - DNA, 18 bp, Homo sapiens
tcttctcggctcaggctc

SEQ ID NO: 4154778 - DNA, 14 bp, Homo sapiens
tcttctctctgctc

SEQ ID NO: 4154779 - DNA, 13 bp, Homo sapiens
tcttctctttagt

SEQ ID NO: 4154780 - DNA, 16 bp, Homo sapiens
tcttctgaatatttta

SEQ ID NO: 4154781 - DNA, 21 bp, Homo sapiens
tcttctgaggaccgctgataa

SEQ ID NO: 4154782 - DNA, 12 bp, Homo sapiens
tcttctgccctt

SEQ ID NO: 4154783 - DNA, 20 bp, Homo sapiens
tcttctgccctttcctaggc

SEQ ID NO: 4154784 - DNA, 13 bp, Homo sapiens
tcttctgctccac

SEQ ID NO: 4154785 - DNA, 19 bp, Homo sapiens
tcttctgctccacccttgg

SEQ ID NO: 4154786 - DNA, 20 bp, Homo sapiens
tcttctgctccacccttggc

SEQ ID NO: 4154787 - DNA, 21 bp, Homo sapiens
tcttctggggcaggctgggcc

SEQ ID NO: 4154788 - DNA, 16 bp, Homo sapiens
tcttctgtatttctag

SEQ ID NO: 4154789 - DNA, 15 bp, Homo sapiens
tcttctgtccctgtt

SEQ ID NO: 4154790 - DNA, 16 bp, Homo sapiens
tcttctgtgaaatata

SEQ ID NO: 4154791 - DNA, 12 bp, Homo sapiens
tcttctgtgttt

SEQ ID NO: 4154792 - DNA, 22 bp, Homo sapiens
tcttcttaatatgttcttttaa

SEQ ID NO: 4154793 - DNA, 17 bp, Homo sapiens
tcttcttgctgcagcct

SEQ ID NO: 4154794 - DNA, 12 bp, Homo sapiens
tcttctttgtgc

SEQ ID NO: 4154795 - DNA, 14 bp, Homo sapiens
tcttctttgtgcct

SEQ ID NO: 4154796 - DNA, 16 bp, Homo sapiens
tcttctttgtgccttt

SEQ ID NO: 4154797 - DNA, 23 bp, Homo sapiens
tcttctttgtgcctttggcctgg

SEQ ID NO: 4154798 - DNA, 14 bp, Homo sapiens
tcttcttttacttg

SEQ ID NO: 4154799 - DNA, 17 bp, Homo sapiens
tcttgaaaagttcaggg

SEQ ID NO: 4154800 - DNA, 21 bp, Homo sapiens
tcttgaaaggtccaaatgttt

SEQ ID NO: 4154801 - DNA, 22 bp, Homo sapiens
tcttgaaattaagaaggcaaaa

SEQ ID NO: 4154802 - DNA, 19 bp, Homo sapiens
tcttgaagcccccagccct

SEQ ID NO: 4154803 - DNA, 14 bp, Homo sapiens
tcttgaatttctga

SEQ ID NO: 4154804 - DNA, 20 bp, Homo sapiens
tcttgacagagcctgcccca

SEQ ID NO: 4154805 - DNA, 18 bp, Homo sapiens
tcttgactcatggcagct

SEQ ID NO: 4154806 - DNA, 14 bp, Homo sapiens
tcttgactctaaat

SEQ ID NO: 4154807 - DNA, 13 bp, Homo sapiens
tcttgactttctg

SEQ ID NO: 4154808 - DNA, 17 bp, Homo sapiens
tcttgatacccccctct

SEQ ID NO: 4154809 - DNA, 20 bp, Homo sapiens
tcttgatacccccctctgtc

SEQ ID NO: 4154810 - DNA, 22 bp, Homo sapiens
tcttgatacccccctctgtctt

SEQ ID NO: 4154811 - DNA, 19 bp, Homo sapiens
tcttgatctctcttgtcct

SEQ ID NO: 4154812 - DNA, 21 bp, Homo sapiens
tcttgatgtgaagataatttg

SEQ ID NO: 4154813 - DNA, 15 bp, Homo sapiens
tcttgattcctggtt

SEQ ID NO: 4154814 - DNA, 14 bp, Homo sapiens
tcttgcaacttcag

SEQ ID NO: 4154815 - DNA, 21 bp, Homo sapiens
tcttgcataggctcttaagca

SEQ ID NO: 4154816 - DNA, 16 bp, Homo sapiens
tcttgcctgctgggct

SEQ ID NO: 4154817 - DNA, 15 bp, Homo sapiens
tcttgcgtattggct

SEQ ID NO: 4154818 - DNA, 23 bp, Homo sapiens
tcttgcgtgtcaatttccctcag

SEQ ID NO: 4154819 - DNA, 18 bp, Homo sapiens
tcttgctcaaaaatctgt

SEQ ID NO: 4154820 - DNA, 17 bp, Homo sapiens
tcttgctcccttcagcc

SEQ ID NO: 4154821 - DNA, 17 bp, Homo sapiens
tcttgctctatctctca

SEQ ID NO: 4154822 - DNA, 14 bp, Homo sapiens
tcttgctctgtccc

SEQ ID NO: 4154823 - DNA, 11 bp, Homo sapiens
tcttgcttgtc

SEQ ID NO: 4154824 - DNA, 12 bp, Homo sapiens
tcttgcttgtca

SEQ ID NO: 4154825 - DNA, 21 bp, Homo sapiens
tcttgcttgtcattgactctt

SEQ ID NO: 4154826 - DNA, 21 bp, Homo sapiens
tcttggaacattggaatgttc

SEQ ID NO: 4154827 - DNA, 18 bp, Homo sapiens
tcttggaagtacatgaat

SEQ ID NO: 4154828 - DNA, 20 bp, Homo sapiens
tcttggaccatgccagattc

SEQ ID NO: 4154829 - DNA, 17 bp, Homo sapiens
tcttggagaccctgcaa

SEQ ID NO: 4154830 - DNA, 14 bp, Homo sapiens
tcttggagctgtga

SEQ ID NO: 4154831 - DNA, 23 bp, Homo sapiens
tcttggagctgtgagttctccct

SEQ ID NO: 4154832 - DNA, 15 bp, Homo sapiens
tcttggagtttttca

SEQ ID NO: 4154833 - DNA, 13 bp, Homo sapiens
tcttggccagcca

SEQ ID NO: 4154834 - DNA, 22 bp, Homo sapiens
tcttggcccctgtgtgagttga

SEQ ID NO: 4154835 - DNA, 11 bp, Homo sapiens
tcttggccttt

SEQ ID NO: 4154836 - DNA, 13 bp, Homo sapiens
tcttggcctttgc

SEQ ID NO: 4154837 - DNA, 16 bp, Homo sapiens
tcttggctgacccctc

SEQ ID NO: 4154838 - DNA, 19 bp, Homo sapiens
tcttggctgacccctctgg

SEQ ID NO: 4154839 - DNA, 15 bp, Homo sapiens
tcttgggccccagac

SEQ ID NO: 4154840 - DNA, 11 bp, Homo sapiens
tcttgggggtc

SEQ ID NO: 4154841 - DNA, 14 bp, Homo sapiens
tcttgggggtcagg

SEQ ID NO: 4154842 - DNA, 21 bp, Homo sapiens
tcttggggtactcttgatgtg

SEQ ID NO: 4154843 - DNA, 18 bp, Homo sapiens
tcttggtgctctgtgttc

SEQ ID NO: 4154844 - DNA, 21 bp, Homo sapiens
tcttggttcgatacctggagc

SEQ ID NO: 4154845 - DNA, 14 bp, Homo sapiens
tcttgtaaagactg

SEQ ID NO: 4154846 - DNA, 20 bp, Homo sapiens
tcttgtcccacgtgtcttcc

SEQ ID NO: 4154847 - DNA, 23 bp, Homo sapiens
tcttgtcccacgtgtcttccact

SEQ ID NO: 4154848 - DNA, 19 bp, Homo sapiens
tcttgtcctcagtccattt

SEQ ID NO: 4154849 - DNA, 13 bp, Homo sapiens
tcttgtctccact

SEQ ID NO: 4154850 - DNA, 17 bp, Homo sapiens
tcttgtctgagggacat

SEQ ID NO: 4154851 - DNA, 15 bp, Homo sapiens
tcttgtcttttcaga

SEQ ID NO: 4154852 - DNA, 18 bp, Homo sapiens
tcttgtgaagttgttttt

SEQ ID NO: 4154853 - DNA, 22 bp, Homo sapiens
tcttgtgctcagcatgattctt

SEQ ID NO: 4154854 - DNA, 20 bp, Homo sapiens
tcttgtggtgtaaagctggc

SEQ ID NO: 4154855 - DNA, 18 bp, Homo sapiens
tcttgtgtgattaactta

SEQ ID NO: 4154856 - DNA, 14 bp, Homo sapiens
tcttgtttctcccg

SEQ ID NO: 4154857 - DNA, 18 bp, Homo sapiens
tcttgttttttttttcca

SEQ ID NO: 4154858 - DNA, 21 bp, Homo sapiens
tcttgttttttttttccactt

SEQ ID NO: 4154859 - DNA, 16 bp, Homo sapiens
tctttaaaagagagag

SEQ ID NO: 4154860 - DNA, 23 bp, Homo sapiens
tctttaaatacttcatgagcatt

SEQ ID NO: 4154861 - DNA, 12 bp, Homo sapiens
tctttaaataga

SEQ ID NO: 4154862 - DNA, 11 bp, Homo sapiens
tctttaaatgt

SEQ ID NO: 4154863 - DNA, 19 bp, Homo sapiens
tctttaaatgttttataag

SEQ ID NO: 4154864 - DNA, 13 bp, Homo sapiens
tctttaagccata

SEQ ID NO: 4154865 - DNA, 14 bp, Homo sapiens
tctttaagccatag

SEQ ID NO: 4154866 - DNA, 18 bp, Homo sapiens
tctttaagggcatgcctt

SEQ ID NO: 4154867 - DNA, 14 bp, Homo sapiens
tctttaatcttcag

SEQ ID NO: 4154868 - DNA, 16 bp, Homo sapiens
tctttacctgagacca

SEQ ID NO: 4154869 - DNA, 16 bp, Homo sapiens
tctttagaaaaggcat

SEQ ID NO: 4154870 - DNA, 15 bp, Homo sapiens
tctttcaaaagcctt

SEQ ID NO: 4154871 - DNA, 18 bp, Homo sapiens
tctttcaagggctttcct

SEQ ID NO: 4154872 - DNA, 13 bp, Homo sapiens
tctttcacttgaa

SEQ ID NO: 4154873 - DNA, 12 bp, Homo sapiens
tctttccaggct

SEQ ID NO: 4154874 - DNA, 18 bp, Homo sapiens
tctttcccttagtgactc

SEQ ID NO: 4154875 - DNA, 15 bp, Homo sapiens
tctttcccttccagt

SEQ ID NO: 4154876 - DNA, 15 bp, Homo sapiens
tctttcccttcctcc

SEQ ID NO: 4154877 - DNA, 17 bp, Homo sapiens
tctttcccttcctccat

SEQ ID NO: 4154878 - DNA, 14 bp, Homo sapiens
tctttcctccaccc

SEQ ID NO: 4154879 - DNA, 12 bp, Homo sapiens
tctttcctgccc

SEQ ID NO: 4154880 - DNA, 14 bp, Homo sapiens
tctttcctgccctg

SEQ ID NO: 4154881 - DNA, 17 bp, Homo sapiens
tctttcctgccctgtcc

SEQ ID NO: 4154882 - DNA, 15 bp, Homo sapiens
tctttctagaggtgc

SEQ ID NO: 4154883 - DNA, 24 bp, Homo sapiens
tctttctccttagtcttctcatag

SEQ ID NO: 4154884 - DNA, 14 bp, Homo sapiens
tctttctctcagcc

SEQ ID NO: 4154885 - DNA, 14 bp, Homo sapiens
tctttctctcttcc

SEQ ID NO: 4154886 - DNA, 17 bp, Homo sapiens
tctttctctcttccctc

SEQ ID NO: 4154887 - DNA, 13 bp, Homo sapiens
tctttctctttta

SEQ ID NO: 4154888 - DNA, 13 bp, Homo sapiens
tctttctgatttt

SEQ ID NO: 4154889 - DNA, 13 bp, Homo sapiens
tctttctgctttg

SEQ ID NO: 4154890 - DNA, 16 bp, Homo sapiens
tctttctggcctgcct

SEQ ID NO: 4154891 - DNA, 18 bp, Homo sapiens
tctttctggcctgccttc

SEQ ID NO: 4154892 - DNA, 12 bp, Homo sapiens
tctttcttggga

SEQ ID NO: 4154893 - DNA, 12 bp, Homo sapiens
tctttctttaaa

SEQ ID NO: 4154894 - DNA, 22 bp, Homo sapiens
tctttgaaatagtctgtgtgaa

SEQ ID NO: 4154895 - DNA, 21 bp, Homo sapiens
tctttgataatgttaaatttg

SEQ ID NO: 4154896 - DNA, 22 bp, Homo sapiens
tctttgccctttacttgtcttt

SEQ ID NO: 4154897 - DNA, 12 bp, Homo sapiens
tctttgcctctg

SEQ ID NO: 4154898 - DNA, 13 bp, Homo sapiens
tctttgcctctgc

SEQ ID NO: 4154899 - DNA, 14 bp, Homo sapiens
tctttgccttgggc

SEQ ID NO: 4154900 - DNA, 20 bp, Homo sapiens
tctttgctcaacagaacata

SEQ ID NO: 4154901 - DNA, 12 bp, Homo sapiens
tctttgctgcag

SEQ ID NO: 4154902 - DNA, 22 bp, Homo sapiens
tctttgctgcagtcatctactt

SEQ ID NO: 4154903 - DNA, 22 bp, Homo sapiens
tctttggctcccctgtaccttt

SEQ ID NO: 4154904 - DNA, 18 bp, Homo sapiens
tctttggggtcagccagg

SEQ ID NO: 4154905 - DNA, 21 bp, Homo sapiens
tctttgtaagagtgtagaagc

SEQ ID NO: 4154906 - DNA, 23 bp, Homo sapiens
tctttgtaagagtgtagaagcat

SEQ ID NO: 4154907 - DNA, 22 bp, Homo sapiens
tctttgtaagtcagtgttgaga

SEQ ID NO: 4154908 - DNA, 14 bp, Homo sapiens
tctttgtgacagga

SEQ ID NO: 4154909 - DNA, 20 bp, Homo sapiens
tctttgtgacaggaaagccc

SEQ ID NO: 4154910 - DNA, 14 bp, Homo sapiens
tctttgtgataatt

SEQ ID NO: 4154911 - DNA, 16 bp, Homo sapiens
tctttgtgataattta

SEQ ID NO: 4154912 - DNA, 23 bp, Homo sapiens
tctttgtgataatttaagagcta

SEQ ID NO: 4154913 - DNA, 13 bp, Homo sapiens
tctttgtgccttt

SEQ ID NO: 4154914 - DNA, 19 bp, Homo sapiens
tctttgtgcctttggcctg

SEQ ID NO: 4154915 - DNA, 19 bp, Homo sapiens
tctttgtggtttcttgttt

SEQ ID NO: 4154916 - DNA, 16 bp, Homo sapiens
tctttgttacttcctt

SEQ ID NO: 4154917 - DNA, 21 bp, Homo sapiens
tcttttaaagtgttacttttt

SEQ ID NO: 4154918 - DNA, 23 bp, Homo sapiens
tcttttaaagtgttactttttgt

SEQ ID NO: 4154919 - DNA, 12 bp, Homo sapiens
tcttttaatgct

SEQ ID NO: 4154920 - DNA, 16 bp, Homo sapiens
tcttttagttttagtt

SEQ ID NO: 4154921 - DNA, 16 bp, Homo sapiens
tcttttatatttgtat

SEQ ID NO: 4154922 - DNA, 17 bp, Homo sapiens
tcttttatatttgtatc

SEQ ID NO: 4154923 - DNA, 18 bp, Homo sapiens
tcttttatatttgtatcg

SEQ ID NO: 4154924 - DNA, 22 bp, Homo sapiens
tcttttatatttgtatcgatgt

SEQ ID NO: 4154925 - DNA, 16 bp, Homo sapiens
tcttttatgtttgaat

SEQ ID NO: 4154926 - DNA, 19 bp, Homo sapiens
tcttttattcttctttctt

SEQ ID NO: 4154927 - DNA, 21 bp, Homo sapiens
tcttttcataaagggttgaaa

SEQ ID NO: 4154928 - DNA, 16 bp, Homo sapiens
tcttttcattctcatt

SEQ ID NO: 4154929 - DNA, 24 bp, Homo sapiens
tcttttccccctttgtgcacattt

SEQ ID NO: 4154930 - DNA, 21 bp, Homo sapiens
tcttttctgtcaccaaatttg

SEQ ID NO: 4154931 - DNA, 15 bp, Homo sapiens
tcttttcttgatttt

SEQ ID NO: 4154932 - DNA, 15 bp, Homo sapiens
tcttttcttggcaaa

SEQ ID NO: 4154933 - DNA, 16 bp, Homo sapiens
tcttttctttctgtct

SEQ ID NO: 4154934 - DNA, 16 bp, Homo sapiens
tcttttctttttacat

SEQ ID NO: 4154935 - DNA, 13 bp, Homo sapiens
tcttttgacatgt

SEQ ID NO: 4154936 - DNA, 14 bp, Homo sapiens
tcttttgacatgtg

SEQ ID NO: 4154937 - DNA, 15 bp, Homo sapiens
tcttttgagtggtaa

SEQ ID NO: 4154938 - DNA, 16 bp, Homo sapiens
tcttttgattatgttt

SEQ ID NO: 4154939 - DNA, 14 bp, Homo sapiens
tcttttgtaaatta

SEQ ID NO: 4154940 - DNA, 12 bp, Homo sapiens
tctttttcctcc

SEQ ID NO: 4154941 - DNA, 14 bp, Homo sapiens
tctttttctggact

SEQ ID NO: 4154942 - DNA, 22 bp, Homo sapiens
tctttttgccagttttccctgg

SEQ ID NO: 4154943 - DNA, 23 bp, Homo sapiens
tcttttttcatttcttcctcagc

SEQ ID NO: 4154944 - DNA, 22 bp, Homo sapiens
tcttttttgtttgtttctttgt

SEQ ID NO: 4154945 - DNA, 23 bp, Homo sapiens
tcttttttgtttgtttctttgtg

SEQ ID NO: 4154946 - DNA, 18 bp, Homo sapiens
tctttttttttaagttct

SEQ ID NO: 4154947 - DNA, 21 bp, Homo sapiens
tctttttttttttttttgaaa

SEQ ID NO: 4154948 - DNA, 14 bp, Homo sapiens
tgaaaaaaaagttt

SEQ ID NO: 4154949 - DNA, 15 bp, Homo sapiens
tgaaaaaaacttcat

SEQ ID NO: 4154950 - DNA, 15 bp, Homo sapiens
tgaaaaagatgccaa

SEQ ID NO: 4154951 - DNA, 18 bp, Homo sapiens
tgaaaaaggaataaattg

SEQ ID NO: 4154952 - DNA, 18 bp, Homo sapiens
tgaaaaatcggcttacca

SEQ ID NO: 4154953 - DNA, 18 bp, Homo sapiens
tgaaaaatttaagcattg

SEQ ID NO: 4154954 - DNA, 14 bp, Homo sapiens
tgaaaacatgtaat

SEQ ID NO: 4154955 - DNA, 17 bp, Homo sapiens
tgaaaacgttttattgt

SEQ ID NO: 4154956 - DNA, 13 bp, Homo sapiens
tgaaaactataca

SEQ ID NO: 4154957 - DNA, 12 bp, Homo sapiens
tgaaaactggaa

SEQ ID NO: 4154958 - DNA, 14 bp, Homo sapiens
tgaaaactggaata

SEQ ID NO: 4154959 - DNA, 17 bp, Homo sapiens
tgaaaacttagccagag

SEQ ID NO: 4154960 - DNA, 23 bp, Homo sapiens
tgaaaagctattagccaggatca

SEQ ID NO: 4154961 - DNA, 17 bp, Homo sapiens
tgaaaagcttcttaatt

SEQ ID NO: 4154962 - DNA, 19 bp, Homo sapiens
tgaaaagcttcttaattaa

SEQ ID NO: 4154963 - DNA, 18 bp, Homo sapiens
tgaaaagtaattgaaaaa

SEQ ID NO: 4154964 - DNA, 24 bp, Homo sapiens
tgaaaagtaattgaaaaaggtgat

SEQ ID NO: 4154965 - DNA, 16 bp, Homo sapiens
tgaaaataagaataga

SEQ ID NO: 4154966 - DNA, 14 bp, Homo sapiens
tgaaaatataacca

SEQ ID NO: 4154967 - DNA, 12 bp, Homo sapiens
tgaaaatgtaaa

SEQ ID NO: 4154968 - DNA, 21 bp, Homo sapiens
tgaaaatgtcagaaaccagtt

SEQ ID NO: 4154969 - DNA, 12 bp, Homo sapiens
tgaaaatgttta

SEQ ID NO: 4154970 - DNA, 21 bp, Homo sapiens
tgaaaattttaaaaatacata

SEQ ID NO: 4154971 - DNA, 14 bp, Homo sapiens
tgaaacaaagctgc

SEQ ID NO: 4154972 - DNA, 21 bp, Homo sapiens
tgaaacaagataactgagaat

SEQ ID NO: 4154973 - DNA, 18 bp, Homo sapiens
tgaaacacaccaggctgt

SEQ ID NO: 4154974 - DNA, 14 bp, Homo sapiens
tgaaacacagctgt

SEQ ID NO: 4154975 - DNA, 23 bp, Homo sapiens
tgaaacactcagttgttcaataa

SEQ ID NO: 4154976 - DNA, 23 bp, Homo sapiens
tgaaacagattcaggccagccca

SEQ ID NO: 4154977 - DNA, 14 bp, Homo sapiens
tgaaacattttgtc

SEQ ID NO: 4154978 - DNA, 22 bp, Homo sapiens
tgaaacccacagatgtctctgg

SEQ ID NO: 4154979 - DNA, 16 bp, Homo sapiens
tgaaacctacacactg

SEQ ID NO: 4154980 - DNA, 14 bp, Homo sapiens
tgaaactagttatt

SEQ ID NO: 4154981 - DNA, 18 bp, Homo sapiens
tgaaactggcactgaatt

SEQ ID NO: 4154982 - DNA, 16 bp, Homo sapiens
tgaaactggcttcccc

SEQ ID NO: 4154983 - DNA, 22 bp, Homo sapiens
tgaaagaatatatttatttaaa

SEQ ID NO: 4154984 - DNA, 12 bp, Homo sapiens
tgaaagaccttc

SEQ ID NO: 4154985 - DNA, 19 bp, Homo sapiens
tgaaagaccttctccaaat

SEQ ID NO: 4154986 - DNA, 13 bp, Homo sapiens
tgaaagactgtac

SEQ ID NO: 4154987 - DNA, 16 bp, Homo sapiens
tgaaagactgtacaaa

SEQ ID NO: 4154988 - DNA, 18 bp, Homo sapiens
tgaaagactgtacaaagt

SEQ ID NO: 4154989 - DNA, 21 bp, Homo sapiens
tgaaagaggtaaaattctcta

SEQ ID NO: 4154990 - DNA, 19 bp, Homo sapiens
tgaaagagttaagaatgtc

SEQ ID NO: 4154991 - DNA, 14 bp, Homo sapiens
tgaaagccatttgt

SEQ ID NO: 4154992 - DNA, 17 bp, Homo sapiens
tgaaagccttagggaag

SEQ ID NO: 4154993 - DNA, 22 bp, Homo sapiens
tgaaagccttagggaagctggc

SEQ ID NO: 4154994 - DNA, 14 bp, Homo sapiens
tgaaagctgagaac

SEQ ID NO: 4154995 - DNA, 19 bp, Homo sapiens
tgaaagctgagaactcctg

SEQ ID NO: 4154996 - DNA, 22 bp, Homo sapiens
tgaaagctgagaactcctgact

SEQ ID NO: 4154997 - DNA, 22 bp, Homo sapiens
tgaaaggaagagctaataaatc

SEQ ID NO: 4154998 - DNA, 23 bp, Homo sapiens
tgaaaggcagggcccttggggct

SEQ ID NO: 4154999 - DNA, 13 bp, Homo sapiens
tgaaaggtactat

SEQ ID NO: 4155000 - DNA, 18 bp, Homo sapiens
tgaaaggtactatatttg

SEQ ID NO: 4155001 - DNA, 16 bp, Homo sapiens
tgaaaggtatatgact

SEQ ID NO: 4155002 - DNA, 14 bp, Homo sapiens
tgaaagtacatttg

SEQ ID NO: 4155003 - DNA, 13 bp, Homo sapiens
tgaaagtgttttt

SEQ ID NO: 4155004 - DNA, 20 bp, Homo sapiens
tgaaagttttcagaacctct

SEQ ID NO: 4155005 - DNA, 13 bp, Homo sapiens
tgaaagttttgta

SEQ ID NO: 4155006 - DNA, 14 bp, Homo sapiens
tgaaagttttgtaa

SEQ ID NO: 4155007 - DNA, 22 bp, Homo sapiens
tgaaagttttgtaaaagaaatc

SEQ ID NO: 4155008 - DNA, 21 bp, Homo sapiens
tgaaataaagacccaggggga

SEQ ID NO: 4155009 - DNA, 22 bp, Homo sapiens
tgaaataaattctgattcttct

SEQ ID NO: 4155010 - DNA, 16 bp, Homo sapiens
tgaaataacaaaatgg

SEQ ID NO: 4155011 - DNA, 19 bp, Homo sapiens
tgaaatacacaagtaaaca

SEQ ID NO: 4155012 - DNA, 14 bp, Homo sapiens
tgaaataccagtgt

SEQ ID NO: 4155013 - DNA, 16 bp, Homo sapiens
tgaaatactaaaagca

SEQ ID NO: 4155014 - DNA, 12 bp, Homo sapiens
tgaaatataatt

SEQ ID NO: 4155015 - DNA, 21 bp, Homo sapiens
tgaaatattttttaatttaaa

SEQ ID NO: 4155016 - DNA, 22 bp, Homo sapiens
tgaaatcaatgcaagagtgatt

SEQ ID NO: 4155017 - DNA, 18 bp, Homo sapiens
tgaaatccttgactggac

SEQ ID NO: 4155018 - DNA, 19 bp, Homo sapiens
tgaaatctcagaattcctt

SEQ ID NO: 4155019 - DNA, 14 bp, Homo sapiens
tgaaatgaaaacat

SEQ ID NO: 4155020 - DNA, 17 bp, Homo sapiens
tgaaatgagcacctcca

SEQ ID NO: 4155021 - DNA, 19 bp, Homo sapiens
tgaaatgaggtctgtttaa

SEQ ID NO: 4155022 - DNA, 23 bp, Homo sapiens
tgaaatgaggtctgtttaaagtg

SEQ ID NO: 4155023 - DNA, 16 bp, Homo sapiens
tgaaatgctggcattt

SEQ ID NO: 4155024 - DNA, 19 bp, Homo sapiens
tgaaatggatactacatct

SEQ ID NO: 4155025 - DNA, 21 bp, Homo sapiens
tgaaattaagaaggcaaaaat

SEQ ID NO: 4155026 - DNA, 15 bp, Homo sapiens
tgaaattactgtgta

SEQ ID NO: 4155027 - DNA, 15 bp, Homo sapiens
tgaaattatatctgt

SEQ ID NO: 4155028 - DNA, 19 bp, Homo sapiens
tgaaattatgtatgtttac

SEQ ID NO: 4155029 - DNA, 20 bp, Homo sapiens
tgaaattatgtgacatttta

SEQ ID NO: 4155030 - DNA, 13 bp, Homo sapiens
tgaaattcttcct

SEQ ID NO: 4155031 - DNA, 22 bp, Homo sapiens
tgaaattgtgaactcattgctc

SEQ ID NO: 4155032 - DNA, 23 bp, Homo sapiens
tgaaattgtttaagtgttgtaaa

SEQ ID NO: 4155033 - DNA, 12 bp, Homo sapiens
tgaaatttaatg

SEQ ID NO: 4155034 - DNA, 20 bp, Homo sapiens
tgaaatttcacttcaggaga

SEQ ID NO: 4155035 - DNA, 12 bp, Homo sapiens
tgaaatttgcaa

SEQ ID NO: 4155036 - DNA, 19 bp, Homo sapiens
tgaaatttgcaaaatcact

SEQ ID NO: 4155037 - DNA, 12 bp, Homo sapiens
tgaaattttgca

SEQ ID NO: 4155038 - DNA, 14 bp, Homo sapiens
tgaacaaaagattg

SEQ ID NO: 4155039 - DNA, 20 bp, Homo sapiens
tgaacaaatcttgggtgggt

SEQ ID NO: 4155040 - DNA, 18 bp, Homo sapiens
tgaacaacgagccttttc

SEQ ID NO: 4155041 - DNA, 11 bp, Homo sapiens
tgaacacacac

SEQ ID NO: 4155042 - DNA, 14 bp, Homo sapiens
tgaacacacacaca

SEQ ID NO: 4155043 - DNA, 13 bp, Homo sapiens
tgaacacaggcag

SEQ ID NO: 4155044 - DNA, 14 bp, Homo sapiens
tgaacacaggcagc

SEQ ID NO: 4155045 - DNA, 16 bp, Homo sapiens
tgaacacaggcagctt

SEQ ID NO: 4155046 - DNA, 13 bp, Homo sapiens
tgaacacttataa

SEQ ID NO: 4155047 - DNA, 17 bp, Homo sapiens
tgaacatcccctcccat

SEQ ID NO: 4155048 - DNA, 23 bp, Homo sapiens
tgaacattttatcattaattttt

SEQ ID NO: 4155049 - DNA, 21 bp, Homo sapiens
tgaaccacctttgtctctgca

SEQ ID NO: 4155050 - DNA, 16 bp, Homo sapiens
tgaaccacgcgggggc

SEQ ID NO: 4155051 - DNA, 22 bp, Homo sapiens
tgaaccagctcatctccaagga

SEQ ID NO: 4155052 - DNA, 19 bp, Homo sapiens
tgaacccattttgagtgac

SEQ ID NO: 4155053 - DNA, 21 bp, Homo sapiens
tgaacccccgccatccttcac

SEQ ID NO: 4155054 - DNA, 14 bp, Homo sapiens
tgaaccctggggcc

SEQ ID NO: 4155055 - DNA, 13 bp, Homo sapiens
tgaacccttgctt

SEQ ID NO: 4155056 - DNA, 13 bp, Homo sapiens
tgaacctggatcc

SEQ ID NO: 4155057 - DNA, 23 bp, Homo sapiens
tgaacctgtgagtaaatattgag

SEQ ID NO: 4155058 - DNA, 23 bp, Homo sapiens
tgaacctttttttttgaaacagc

SEQ ID NO: 4155059 - DNA, 14 bp, Homo sapiens
tgaactccaccgac

SEQ ID NO: 4155060 - DNA, 23 bp, Homo sapiens
tgaactccaccgaccaactgccc

SEQ ID NO: 4155061 - DNA, 15 bp, Homo sapiens
tgaactcctgccagg

SEQ ID NO: 4155062 - DNA, 13 bp, Homo sapiens
tgaactccttgtt

SEQ ID NO: 4155063 - DNA, 19 bp, Homo sapiens
tgaactctggtgctcctgc

SEQ ID NO: 4155064 - DNA, 21 bp, Homo sapiens
tgaactcttaatcaaatagca

SEQ ID NO: 4155065 - DNA, 14 bp, Homo sapiens
tgaactctttctgg

SEQ ID NO: 4155066 - DNA, 20 bp, Homo sapiens
tgaactctttctggcctgcc

SEQ ID NO: 4155067 - DNA, 15 bp, Homo sapiens
tgaactgaagtttca

SEQ ID NO: 4155068 - DNA, 17 bp, Homo sapiens
tgaactggcaattgtct

SEQ ID NO: 4155069 - DNA, 18 bp, Homo sapiens
tgaacttaataactgtgt

SEQ ID NO: 4155070 - DNA, 22 bp, Homo sapiens
tgaacttaataactgtgtactg

SEQ ID NO: 4155071 - DNA, 14 bp, Homo sapiens
tgaactttgccaaa

SEQ ID NO: 4155072 - DNA, 18 bp, Homo sapiens
tgaactttgccaaaaaaa

SEQ ID NO: 4155073 - DNA, 23 bp, Homo sapiens
tgaactttgccaaaaaaaaaaga

SEQ ID NO: 4155074 - DNA, 15 bp, Homo sapiens
tgaacttttgtactg

SEQ ID NO: 4155075 - DNA, 18 bp, Homo sapiens
tgaacttttgtactgaat

SEQ ID NO: 4155076 - DNA, 17 bp, Homo sapiens
tgaagaaaactccttta

SEQ ID NO: 4155077 - DNA, 13 bp, Homo sapiens
tgaagaacatgtg

SEQ ID NO: 4155078 - DNA, 19 bp, Homo sapiens
tgaagaaggtggacctttt

SEQ ID NO: 4155079 - DNA, 20 bp, Homo sapiens
tgaagaatacagttaggcac

SEQ ID NO: 4155080 - DNA, 13 bp, Homo sapiens
tgaagaatattta

SEQ ID NO: 4155081 - DNA, 19 bp, Homo sapiens
tgaagaatatttaagaaaa

SEQ ID NO: 4155082 - DNA, 23 bp, Homo sapiens
tgaagaatatttaagaaaagcac

SEQ ID NO: 4155083 - DNA, 19 bp, Homo sapiens
tgaagaattgccaatcttg

SEQ ID NO: 4155084 - DNA, 12 bp, Homo sapiens
tgaagacaatga

SEQ ID NO: 4155085 - DNA, 22 bp, Homo sapiens
tgaagacaatttgatacataat

SEQ ID NO: 4155086 - DNA, 23 bp, Homo sapiens
tgaagacaatttgatacataata

SEQ ID NO: 4155087 - DNA, 12 bp, Homo sapiens
tgaagacataaa

SEQ ID NO: 4155088 - DNA, 13 bp, Homo sapiens
tgaagacatttct

SEQ ID NO: 4155089 - DNA, 22 bp, Homo sapiens
tgaagacatttctgctctcagc

SEQ ID NO: 4155090 - DNA, 20 bp, Homo sapiens
tgaagacattttttgctata

SEQ ID NO: 4155091 - DNA, 13 bp, Homo sapiens
tgaagacccagca

SEQ ID NO: 4155092 - DNA, 15 bp, Homo sapiens
tgaagacctaaagtg

SEQ ID NO: 4155093 - DNA, 15 bp, Homo sapiens
tgaagacctaaccag

SEQ ID NO: 4155094 - DNA, 22 bp, Homo sapiens
tgaagacctaaccagggccaga

SEQ ID NO: 4155095 - DNA, 23 bp, Homo sapiens
tgaagacctaaccagggccagaa

SEQ ID NO: 4155096 - DNA, 14 bp, Homo sapiens
tgaagactccagaa

SEQ ID NO: 4155097 - DNA, 17 bp, Homo sapiens
tgaagactggaagctaa

SEQ ID NO: 4155098 - DNA, 18 bp, Homo sapiens
tgaagactggaagctaat

SEQ ID NO: 4155099 - DNA, 19 bp, Homo sapiens
tgaagagaagcaattttgg

SEQ ID NO: 4155100 - DNA, 15 bp, Homo sapiens
tgaagagagatatat

SEQ ID NO: 4155101 - DNA, 21 bp, Homo sapiens
tgaagagagatatatctgaaa

SEQ ID NO: 4155102 - DNA, 22 bp, Homo sapiens
tgaagagccagaagtgaagagt

SEQ ID NO: 4155103 - DNA, 16 bp, Homo sapiens
tgaagagcttgctttg

SEQ ID NO: 4155104 - DNA, 17 bp, Homo sapiens
tgaagagcttgtgtcct

SEQ ID NO: 4155105 - DNA, 18 bp, Homo sapiens
tgaagagggagaagcatg

SEQ ID NO: 4155106 - DNA, 16 bp, Homo sapiens
tgaagataatttgcat

SEQ ID NO: 4155107 - DNA, 19 bp, Homo sapiens
tgaagatcgttagtatcta

SEQ ID NO: 4155108 - DNA, 15 bp, Homo sapiens
tgaagatgcagctca

SEQ ID NO: 4155109 - DNA, 15 bp, Homo sapiens
tgaagatggtttcaa

SEQ ID NO: 4155110 - DNA, 21 bp, Homo sapiens
tgaagatggtttcaattcaga

SEQ ID NO: 4155111 - DNA, 16 bp, Homo sapiens
tgaagatgtctaatag

SEQ ID NO: 4155112 - DNA, 21 bp, Homo sapiens
tgaagattaccctcaaatgct

SEQ ID NO: 4155113 - DNA, 15 bp, Homo sapiens
tgaagattctcctgt

SEQ ID NO: 4155114 - DNA, 18 bp, Homo sapiens
tgaagattctcctgtgct

SEQ ID NO: 4155115 - DNA, 11 bp, Homo sapiens
tgaagattctt

SEQ ID NO: 4155116 - DNA, 19 bp, Homo sapiens
tgaagattcttaaaaattg

SEQ ID NO: 4155117 - DNA, 13 bp, Homo sapiens
tgaagcaaggaag

SEQ ID NO: 4155118 - DNA, 17 bp, Homo sapiens
tgaagcaattagtctga

SEQ ID NO: 4155119 - DNA, 18 bp, Homo sapiens
tgaagcaattagtctgaa

SEQ ID NO: 4155120 - DNA, 20 bp, Homo sapiens
tgaagcaggttcccaagctc

SEQ ID NO: 4155121 - DNA, 16 bp, Homo sapiens
tgaagcagtcttgctc

SEQ ID NO: 4155122 - DNA, 20 bp, Homo sapiens
tgaagcagtcttgctctgtt

SEQ ID NO: 4155123 - DNA, 14 bp, Homo sapiens
tgaagcctctggga

SEQ ID NO: 4155124 - DNA, 22 bp, Homo sapiens
tgaagcctgcgttggtccagag

SEQ ID NO: 4155125 - DNA, 13 bp, Homo sapiens
tgaagcctgctcc

SEQ ID NO: 4155126 - DNA, 14 bp, Homo sapiens
tgaagcctgtgcct

SEQ ID NO: 4155127 - DNA, 16 bp, Homo sapiens
tgaagcctgtgcctcc

SEQ ID NO: 4155128 - DNA, 15 bp, Homo sapiens
tgaagcttgactccc

SEQ ID NO: 4155129 - DNA, 23 bp, Homo sapiens
tgaaggaaaaacacaagcaaaaa

SEQ ID NO: 4155130 - DNA, 17 bp, Homo sapiens
tgaaggaaatccttcgg

SEQ ID NO: 4155131 - DNA, 20 bp, Homo sapiens
tgaaggaatcattccagtgc

SEQ ID NO: 4155132 - DNA, 21 bp, Homo sapiens
tgaaggaatcattccagtgct

SEQ ID NO: 4155133 - DNA, 22 bp, Homo sapiens
tgaaggagaggcaacatccaaa

SEQ ID NO: 4155134 - DNA, 22 bp, Homo sapiens
tgaaggaggctccaggcagcac

SEQ ID NO: 4155135 - DNA, 17 bp, Homo sapiens
tgaaggcaaaattgcaa

SEQ ID NO: 4155136 - DNA, 18 bp, Homo sapiens
tgaaggcaaaattgcaaa

SEQ ID NO: 4155137 - DNA, 14 bp, Homo sapiens
tgaaggccctgctg

SEQ ID NO: 4155138 - DNA, 15 bp, Homo sapiens
tgaaggcctggctgg

SEQ ID NO: 4155139 - DNA, 16 bp, Homo sapiens
tgaagggccagagcca

SEQ ID NO: 4155140 - DNA, 18 bp, Homo sapiens
tgaagggccagagccagg

SEQ ID NO: 4155141 - DNA, 15 bp, Homo sapiens
tgaagtaaaagcaag

SEQ ID NO: 4155142 - DNA, 14 bp, Homo sapiens
tgaagtaaactttt

SEQ ID NO: 4155143 - DNA, 16 bp, Homo sapiens
tgaagtaaactttttg

SEQ ID NO: 4155144 - DNA, 16 bp, Homo sapiens
tgaagtaaattatgta

SEQ ID NO: 4155145 - DNA, 13 bp, Homo sapiens
tgaagtacatatt

SEQ ID NO: 4155146 - DNA, 13 bp, Homo sapiens
tgaagtatacttt

SEQ ID NO: 4155147 - DNA, 21 bp, Homo sapiens
tgaagtatacttttcccctgt

SEQ ID NO: 4155148 - DNA, 14 bp, Homo sapiens
tgaagtcactgcac

SEQ ID NO: 4155149 - DNA, 15 bp, Homo sapiens
tgaagtcactgcaca

SEQ ID NO: 4155150 - DNA, 16 bp, Homo sapiens
tgaagtcactgcacag

SEQ ID NO: 4155151 - DNA, 16 bp, Homo sapiens
tgaagtcatgctcccc

SEQ ID NO: 4155152 - DNA, 13 bp, Homo sapiens
tgaagtccggaac

SEQ ID NO: 4155153 - DNA, 17 bp, Homo sapiens
tgaagtctgtattgtaa

SEQ ID NO: 4155154 - DNA, 16 bp, Homo sapiens
tgaagtgcatccaaag

SEQ ID NO: 4155155 - DNA, 18 bp, Homo sapiens
tgaagtgcatccaaaggt

SEQ ID NO: 4155156 - DNA, 22 bp, Homo sapiens
tgaagtgtacctgtgtacataa

SEQ ID NO: 4155157 - DNA, 17 bp, Homo sapiens
tgaagttacatgcataa

SEQ ID NO: 4155158 - DNA, 20 bp, Homo sapiens
tgaagtttaaaacagtattt

SEQ ID NO: 4155159 - DNA, 21 bp, Homo sapiens
tgaagtttaaaacagtattta

SEQ ID NO: 4155160 - DNA, 18 bp, Homo sapiens
tgaagtttaattgtctca

SEQ ID NO: 4155161 - DNA, 19 bp, Homo sapiens
tgaagtttaattgtctcaa

SEQ ID NO: 4155162 - DNA, 17 bp, Homo sapiens
tgaagtttacaatcaaa

SEQ ID NO: 4155163 - DNA, 12 bp, Homo sapiens
tgaagtttacat

SEQ ID NO: 4155164 - DNA, 13 bp, Homo sapiens
tgaagtttacatt

SEQ ID NO: 4155165 - DNA, 14 bp, Homo sapiens
tgaagtttacattg

SEQ ID NO: 4155166 - DNA, 20 bp, Homo sapiens
tgaagtttgtagttgtttta

SEQ ID NO: 4155167 - DNA, 14 bp, Homo sapiens
tgaagtttgtgggg

SEQ ID NO: 4155168 - DNA, 13 bp, Homo sapiens
tgaataaactgaa

SEQ ID NO: 4155169 - DNA, 16 bp, Homo sapiens
tgaataaagaatgcca

SEQ ID NO: 4155170 - DNA, 15 bp, Homo sapiens
tgaataaagacacct

SEQ ID NO: 4155171 - DNA, 12 bp, Homo sapiens
tgaataaagtgt

SEQ ID NO: 4155172 - DNA, 17 bp, Homo sapiens
tgaataaagttgaagct

SEQ ID NO: 4155173 - DNA, 16 bp, Homo sapiens
tgaataaataaatgta

SEQ ID NO: 4155174 - DNA, 19 bp, Homo sapiens
tgaataaattctataggaa

SEQ ID NO: 4155175 - DNA, 17 bp, Homo sapiens
tgaatacaattaaaggt

SEQ ID NO: 4155176 - DNA, 20 bp, Homo sapiens
tgaatacaattaaaggtcct

SEQ ID NO: 4155177 - DNA, 15 bp, Homo sapiens
tgaatacatttccaa

SEQ ID NO: 4155178 - DNA, 23 bp, Homo sapiens
tgaatacttactataatttgact

SEQ ID NO: 4155179 - DNA, 15 bp, Homo sapiens
tgaatagaaatggga

SEQ ID NO: 4155180 - DNA, 21 bp, Homo sapiens
tgaatataaaaacatttgtaa

SEQ ID NO: 4155181 - DNA, 14 bp, Homo sapiens
tgaatataaagctt

SEQ ID NO: 4155182 - DNA, 16 bp, Homo sapiens
tgaatatctattaata

SEQ ID NO: 4155183 - DNA, 17 bp, Homo sapiens
tgaatatctattaatat

SEQ ID NO: 4155184 - DNA, 11 bp, Homo sapiens
tgaatatttat

SEQ ID NO: 4155185 - DNA, 18 bp, Homo sapiens
tgaatatttataacagca

SEQ ID NO: 4155186 - DNA, 19 bp, Homo sapiens
tgaatatttataacagcat

SEQ ID NO: 4155187 - DNA, 20 bp, Homo sapiens
tgaatatttatatttcacta

SEQ ID NO: 4155188 - DNA, 21 bp, Homo sapiens
tgaatcaatgaaaaatgtaat

SEQ ID NO: 4155189 - DNA, 16 bp, Homo sapiens
tgaatcagtataaaca

SEQ ID NO: 4155190 - DNA, 19 bp, Homo sapiens
tgaatcagtataaacaaag

SEQ ID NO: 4155191 - DNA, 20 bp, Homo sapiens
tgaatcagtataaacaaagt

SEQ ID NO: 4155192 - DNA, 13 bp, Homo sapiens
tgaatcagttttt

SEQ ID NO: 4155193 - DNA, 20 bp, Homo sapiens
tgaatcagtttttaaaatat

SEQ ID NO: 4155194 - DNA, 22 bp, Homo sapiens
tgaatcagtttttaaaatattt

SEQ ID NO: 4155195 - DNA, 15 bp, Homo sapiens
tgaatcatgagcctg

SEQ ID NO: 4155196 - DNA, 22 bp, Homo sapiens
tgaatcctaagggctggtctct

SEQ ID NO: 4155197 - DNA, 12 bp, Homo sapiens
tgaatctcaaag

SEQ ID NO: 4155198 - DNA, 14 bp, Homo sapiens
tgaatctgtgcctg

SEQ ID NO: 4155199 - DNA, 17 bp, Homo sapiens
tgaatgaaaaatttaag

SEQ ID NO: 4155200 - DNA, 18 bp, Homo sapiens
tgaatgaaaaatttaagc

SEQ ID NO: 4155201 - DNA, 12 bp, Homo sapiens
tgaatgaaaaca

SEQ ID NO: 4155202 - DNA, 14 bp, Homo sapiens
tgaatgaaaacatt

SEQ ID NO: 4155203 - DNA, 12 bp, Homo sapiens
tgaatgaacact

SEQ ID NO: 4155204 - DNA, 15 bp, Homo sapiens
tgaatgaacactctt

SEQ ID NO: 4155205 - DNA, 22 bp, Homo sapiens
tgaatgactccactgtttttct

SEQ ID NO: 4155206 - DNA, 19 bp, Homo sapiens
tgaatgaggattattataa

SEQ ID NO: 4155207 - DNA, 19 bp, Homo sapiens
tgaatgcacactagcctct

SEQ ID NO: 4155208 - DNA, 20 bp, Homo sapiens
tgaatgcccagtgagactgt

SEQ ID NO: 4155209 - DNA, 18 bp, Homo sapiens
tgaatgcctcctgtgggg

SEQ ID NO: 4155210 - DNA, 22 bp, Homo sapiens
tgaatgcgctttattgcccatg

SEQ ID NO: 4155211 - DNA, 12 bp, Homo sapiens
tgaatgctgcca

SEQ ID NO: 4155212 - DNA, 13 bp, Homo sapiens
tgaatgctgccag

SEQ ID NO: 4155213 - DNA, 14 bp, Homo sapiens
tgaatgctgccagt

SEQ ID NO: 4155214 - DNA, 18 bp, Homo sapiens
tgaatgctgccagtgtgg

SEQ ID NO: 4155215 - DNA, 20 bp, Homo sapiens
tgaatggtatggaactctct

SEQ ID NO: 4155216 - DNA, 14 bp, Homo sapiens
tgaatggtccaggg

SEQ ID NO: 4155217 - DNA, 15 bp, Homo sapiens
tgaatggtccagggt

SEQ ID NO: 4155218 - DNA, 19 bp, Homo sapiens
tgaatggttccatgcctga

SEQ ID NO: 4155219 - DNA, 23 bp, Homo sapiens
tgaatggttccatgcctgagggt

SEQ ID NO: 4155220 - DNA, 15 bp, Homo sapiens
tgaatgtatcaggaa

SEQ ID NO: 4155221 - DNA, 22 bp, Homo sapiens
tgaatgtatgtaatgtgtggtg

SEQ ID NO: 4155222 - DNA, 23 bp, Homo sapiens
tgaatgtatgtgcactgtcactt

SEQ ID NO: 4155223 - DNA, 11 bp, Homo sapiens
tgaatgtattt

SEQ ID NO: 4155224 - DNA, 23 bp, Homo sapiens
tgaatgtatttatttgggagacc

SEQ ID NO: 4155225 - DNA, 18 bp, Homo sapiens
tgaatgtctaaaattgtt

SEQ ID NO: 4155226 - DNA, 18 bp, Homo sapiens
tgaatgtggctgaagttg

SEQ ID NO: 4155227 - DNA, 20 bp, Homo sapiens
tgaatgtggctgaagttgaa

SEQ ID NO: 4155228 - DNA, 21 bp, Homo sapiens
tgaatgtgggcactggcccag

SEQ ID NO: 4155229 - DNA, 15 bp, Homo sapiens
tgaatgtggtctcag

SEQ ID NO: 4155230 - DNA, 18 bp, Homo sapiens
tgaatgtgtctggacctc

SEQ ID NO: 4155231 - DNA, 12 bp, Homo sapiens
tgaatgttctga

SEQ ID NO: 4155232 - DNA, 23 bp, Homo sapiens
tgaatgttctgacattaacagtt

SEQ ID NO: 4155233 - DNA, 22 bp, Homo sapiens
tgaatgtttacactctttgtaa

SEQ ID NO: 4155234 - DNA, 14 bp, Homo sapiens
tgaatgttttattt

SEQ ID NO: 4155235 - DNA, 19 bp, Homo sapiens
tgaatgttttatttatcaa

SEQ ID NO: 4155236 - DNA, 11 bp, Homo sapiens
tgaattaaaac

SEQ ID NO: 4155237 - DNA, 16 bp, Homo sapiens
tgaattaaaacttctt

SEQ ID NO: 4155238 - DNA, 15 bp, Homo sapiens
tgaattaaatttaat

SEQ ID NO: 4155239 - DNA, 16 bp, Homo sapiens
tgaattattgacactg

SEQ ID NO: 4155240 - DNA, 18 bp, Homo sapiens
tgaattattgacactgaa

SEQ ID NO: 4155241 - DNA, 21 bp, Homo sapiens
tgaattattgacactgaactt

SEQ ID NO: 4155242 - DNA, 13 bp, Homo sapiens
tgaattgtacaga

SEQ ID NO: 4155243 - DNA, 17 bp, Homo sapiens
tgaatttaaataaagtt

SEQ ID NO: 4155244 - DNA, 18 bp, Homo sapiens
tgaatttaaataaagtta

SEQ ID NO: 4155245 - DNA, 17 bp, Homo sapiens
tgaatttataaagtacc

SEQ ID NO: 4155246 - DNA, 21 bp, Homo sapiens
tgaatttatacctacctgtgt

SEQ ID NO: 4155247 - DNA, 15 bp, Homo sapiens
tgaatttgaatgaaa

SEQ ID NO: 4155248 - DNA, 16 bp, Homo sapiens
tgaatttgaatgaaaa

SEQ ID NO: 4155249 - DNA, 17 bp, Homo sapiens
tgaatttgaatgaaaaa

SEQ ID NO: 4155250 - DNA, 19 bp, Homo sapiens
tgaatttgaatgaaaaatt

SEQ ID NO: 4155251 - DNA, 21 bp, Homo sapiens
tgaatttggcctgcactaatt

SEQ ID NO: 4155252 - DNA, 17 bp, Homo sapiens
tgaattttccacgcagt

SEQ ID NO: 4155253 - DNA, 15 bp, Homo sapiens
tgaatttttatttct

SEQ ID NO: 4155254 - DNA, 15 bp, Homo sapiens
tgaatttttttgtaa

SEQ ID NO: 4155255 - DNA, 22 bp, Homo sapiens
tgaatttttttgtaataagcaa

SEQ ID NO: 4155256 - DNA, 19 bp, Homo sapiens
tgacaaaactaaccttgaa

SEQ ID NO: 4155257 - DNA, 14 bp, Homo sapiens
tgacaaagcttccc

SEQ ID NO: 4155258 - DNA, 18 bp, Homo sapiens
tgacaactgcacatgaaa

SEQ ID NO: 4155259 - DNA, 14 bp, Homo sapiens
tgacaactgtgact

SEQ ID NO: 4155260 - DNA, 15 bp, Homo sapiens
tgacaactgtgactg

SEQ ID NO: 4155261 - DNA, 16 bp, Homo sapiens
tgacaactgtgactgt

SEQ ID NO: 4155262 - DNA, 16 bp, Homo sapiens
tgacaagatggtccat

SEQ ID NO: 4155263 - DNA, 19 bp, Homo sapiens
tgacaagatggtccatttg

SEQ ID NO: 4155264 - DNA, 12 bp, Homo sapiens
tgacaataaaac

SEQ ID NO: 4155265 - DNA, 18 bp, Homo sapiens
tgacaataatattgttgt

SEQ ID NO: 4155266 - DNA, 18 bp, Homo sapiens
tgacaatccgagcagtgg

SEQ ID NO: 4155267 - DNA, 23 bp, Homo sapiens
tgacaattcctagataaaaagat

SEQ ID NO: 4155268 - DNA, 16 bp, Homo sapiens
tgacaattttgtacaa

SEQ ID NO: 4155269 - DNA, 16 bp, Homo sapiens
tgacacaagtggacct

SEQ ID NO: 4155270 - DNA, 19 bp, Homo sapiens
tgacacaagtggaccttag

SEQ ID NO: 4155271 - DNA, 18 bp, Homo sapiens
tgacacagaaaatgttga

SEQ ID NO: 4155272 - DNA, 16 bp, Homo sapiens
tgacacagcagcttca

SEQ ID NO: 4155273 - DNA, 18 bp, Homo sapiens
tgacaccagaaagccctc

SEQ ID NO: 4155274 - DNA, 12 bp, Homo sapiens
tgacaccccctc

SEQ ID NO: 4155275 - DNA, 22 bp, Homo sapiens
tgacaccccctccccgcccctg

SEQ ID NO: 4155276 - DNA, 16 bp, Homo sapiens
tgacaccctggcctga

SEQ ID NO: 4155277 - DNA, 19 bp, Homo sapiens
tgacacgcctaaggtcaca

SEQ ID NO: 4155278 - DNA, 18 bp, Homo sapiens
tgacactatagtttaaaa

SEQ ID NO: 4155279 - DNA, 13 bp, Homo sapiens
tgacactgagccc

SEQ ID NO: 4155280 - DNA, 15 bp, Homo sapiens
tgacactgagcccca

SEQ ID NO: 4155281 - DNA, 15 bp, Homo sapiens
tgacactgtccctct

SEQ ID NO: 4155282 - DNA, 16 bp, Homo sapiens
tgacactgtccctctt

SEQ ID NO: 4155283 - DNA, 17 bp, Homo sapiens
tgacacttcagagagct

SEQ ID NO: 4155284 - DNA, 20 bp, Homo sapiens
tgacacttcagagagctggt

SEQ ID NO: 4155285 - DNA, 14 bp, Homo sapiens
tgacagacaggctc

SEQ ID NO: 4155286 - DNA, 14 bp, Homo sapiens
tgacagagcctgcc

SEQ ID NO: 4155287 - DNA, 13 bp, Homo sapiens
tgacagatatatt

SEQ ID NO: 4155288 - DNA, 20 bp, Homo sapiens
tgacagatatatttaagcct

SEQ ID NO: 4155289 - DNA, 19 bp, Homo sapiens
tgacagatgtcagccgagc

SEQ ID NO: 4155290 - DNA, 22 bp, Homo sapiens
tgacagatgtcagccgagccgg

SEQ ID NO: 4155291 - DNA, 19 bp, Homo sapiens
tgacagcccctccctcctc

SEQ ID NO: 4155292 - DNA, 11 bp, Homo sapiens
tgacagcctcc

SEQ ID NO: 4155293 - DNA, 16 bp, Homo sapiens
tgacaggaaagccctc

SEQ ID NO: 4155294 - DNA, 18 bp, Homo sapiens
tgacaggaaagccctccc

SEQ ID NO: 4155295 - DNA, 12 bp, Homo sapiens
tgacagggcaga

SEQ ID NO: 4155296 - DNA, 23 bp, Homo sapiens
tgacagggcagagcaggaaggac

SEQ ID NO: 4155297 - DNA, 21 bp, Homo sapiens
tgacagtattatacgctggca

SEQ ID NO: 4155298 - DNA, 11 bp, Homo sapiens
tgacagtcatc

SEQ ID NO: 4155299 - DNA, 14 bp, Homo sapiens
tgacagtcatcatc

SEQ ID NO: 4155300 - DNA, 17 bp, Homo sapiens
tgacagtcatcatcagg

SEQ ID NO: 4155301 - DNA, 18 bp, Homo sapiens
tgacagtcatcatcaggg

SEQ ID NO: 4155302 - DNA, 23 bp, Homo sapiens
tgacagtcatcatcagggcctgg

SEQ ID NO: 4155303 - DNA, 20 bp, Homo sapiens
tgacagtgcctgggaatgta

SEQ ID NO: 4155304 - DNA, 21 bp, Homo sapiens
tgacagtgcctgggaatgtat

SEQ ID NO: 4155305 - DNA, 12 bp, Homo sapiens
tgacagtgcctt

SEQ ID NO: 4155306 - DNA, 16 bp, Homo sapiens
tgacagtttttctgtt

SEQ ID NO: 4155307 - DNA, 17 bp, Homo sapiens
tgacataacactataaa

SEQ ID NO: 4155308 - DNA, 15 bp, Homo sapiens
tgacatattatgcct

SEQ ID NO: 4155309 - DNA, 17 bp, Homo sapiens
tgacatattatgcctga

SEQ ID NO: 4155310 - DNA, 18 bp, Homo sapiens
tgacatcacagcagcctc

SEQ ID NO: 4155311 - DNA, 21 bp, Homo sapiens
tgacatcctttcttttaatga

SEQ ID NO: 4155312 - DNA, 14 bp, Homo sapiens
tgacatctggaatc

SEQ ID NO: 4155313 - DNA, 15 bp, Homo sapiens
tgacatggtgcctga

SEQ ID NO: 4155314 - DNA, 17 bp, Homo sapiens
tgacatggtgcctgaga

SEQ ID NO: 4155315 - DNA, 17 bp, Homo sapiens
tgacatgtagcttcttc

SEQ ID NO: 4155316 - DNA, 22 bp, Homo sapiens
tgacatgtggaaagtgaatttg

SEQ ID NO: 4155317 - DNA, 17 bp, Homo sapiens
tgacatgtggggccagg

SEQ ID NO: 4155318 - DNA, 22 bp, Homo sapiens
tgacattaacagttttccatga

SEQ ID NO: 4155319 - DNA, 15 bp, Homo sapiens
tgacattcacctgcc

SEQ ID NO: 4155320 - DNA, 18 bp, Homo sapiens
tgacattcacctgcccca

SEQ ID NO: 4155321 - DNA, 12 bp, Homo sapiens
tgacatttaaat

SEQ ID NO: 4155322 - DNA, 23 bp, Homo sapiens
tgacatttgggagacatgtgaca

SEQ ID NO: 4155323 - DNA, 24 bp, Homo sapiens
tgacatttgggagacatgtgacat

SEQ ID NO: 4155324 - DNA, 17 bp, Homo sapiens
tgacatttgtagttgag

SEQ ID NO: 4155325 - DNA, 16 bp, Homo sapiens
tgacatttgtagttgg

SEQ ID NO: 4155326 - DNA, 12 bp, Homo sapiens
tgacattttaca

SEQ ID NO: 4155327 - DNA, 14 bp, Homo sapiens
tgacattttacatt

SEQ ID NO: 4155328 - DNA, 22 bp, Homo sapiens
tgaccaaatatcaccaggactg

SEQ ID NO: 4155329 - DNA, 16 bp, Homo sapiens
tgaccaagaactgcat

SEQ ID NO: 4155330 - DNA, 16 bp, Homo sapiens
tgaccaagttataaat

SEQ ID NO: 4155331 - DNA, 15 bp, Homo sapiens
tgaccaattgtgctg

SEQ ID NO: 4155332 - DNA, 19 bp, Homo sapiens
tgaccaattgtgctgccat

SEQ ID NO: 4155333 - DNA, 15 bp, Homo sapiens
tgaccacagcacagc

SEQ ID NO: 4155334 - DNA, 19 bp, Homo sapiens
tgaccacagcacagccaac

SEQ ID NO: 4155335 - DNA, 22 bp, Homo sapiens
tgaccacagcatcattttgcat

SEQ ID NO: 4155336 - DNA, 16 bp, Homo sapiens
tgaccactctgtcttg

SEQ ID NO: 4155337 - DNA, 17 bp, Homo sapiens
tgaccagaagccttgga

SEQ ID NO: 4155338 - DNA, 15 bp, Homo sapiens
tgaccaggcttcttc

SEQ ID NO: 4155339 - DNA, 23 bp, Homo sapiens
tgaccatccactctaccctccca

SEQ ID NO: 4155340 - DNA, 14 bp, Homo sapiens
tgaccatctgcttt

SEQ ID NO: 4155341 - DNA, 14 bp, Homo sapiens
tgaccatttataat

SEQ ID NO: 4155342 - DNA, 21 bp, Homo sapiens
tgacccagccccttgagaaac

SEQ ID NO: 4155343 - DNA, 21 bp, Homo sapiens
tgaccccaaacaccttccagc

SEQ ID NO: 4155344 - DNA, 17 bp, Homo sapiens
tgaccccgagaagtgct

SEQ ID NO: 4155345 - DNA, 22 bp, Homo sapiens
tgaccccgagaagtgctcttgg

SEQ ID NO: 4155346 - DNA, 19 bp, Homo sapiens
tgacccctcgtccaccccc

SEQ ID NO: 4155347 - DNA, 22 bp, Homo sapiens
tgacccggctgggtcggccctg

SEQ ID NO: 4155348 - DNA, 22 bp, Homo sapiens
tgaccctctgaatggtccaggg

SEQ ID NO: 4155349 - DNA, 20 bp, Homo sapiens
tgacccttctacatttgagg

SEQ ID NO: 4155350 - DNA, 18 bp, Homo sapiens
tgaccgacagctttccag

SEQ ID NO: 4155351 - DNA, 12 bp, Homo sapiens
tgaccgagagaa

SEQ ID NO: 4155352 - DNA, 13 bp, Homo sapiens
tgacctaaattag

SEQ ID NO: 4155353 - DNA, 13 bp, Homo sapiens
tgacctactctca

SEQ ID NO: 4155354 - DNA, 19 bp, Homo sapiens
tgacctcaggtgatccgcc

SEQ ID NO: 4155355 - DNA, 18 bp, Homo sapiens
tgacctcgtgatccaccc

SEQ ID NO: 4155356 - DNA, 18 bp, Homo sapiens
tgacctcgtgatccgccc

SEQ ID NO: 4155357 - DNA, 21 bp, Homo sapiens
tgacctctcagggcctggcag

SEQ ID NO: 4155358 - DNA, 19 bp, Homo sapiens
tgacctcttgctgtctctg

SEQ ID NO: 4155359 - DNA, 20 bp, Homo sapiens
tgacctgaccccattcctga

SEQ ID NO: 4155360 - DNA, 12 bp, Homo sapiens
tgacctgagggc

SEQ ID NO: 4155361 - DNA, 15 bp, Homo sapiens
tgacctgctccgctg

SEQ ID NO: 4155362 - DNA, 17 bp, Homo sapiens
tgacctgctccgctgct

SEQ ID NO: 4155363 - DNA, 19 bp, Homo sapiens
tgacctgctccgctgctcc

SEQ ID NO: 4155364 - DNA, 20 bp, Homo sapiens
tgacctggaaggcccagcac

SEQ ID NO: 4155365 - DNA, 13 bp, Homo sapiens
tgacctgtgacca

SEQ ID NO: 4155366 - DNA, 18 bp, Homo sapiens
tgacctgtgaccagcact

SEQ ID NO: 4155367 - DNA, 20 bp, Homo sapiens
tgacctgtgagcccagctgg

SEQ ID NO: 4155368 - DNA, 15 bp, Homo sapiens
tgacctgtttctctg

SEQ ID NO: 4155369 - DNA, 14 bp, Homo sapiens
tgaccttccttcct

SEQ ID NO: 4155370 - DNA, 19 bp, Homo sapiens
tgaccttggctgactgggg

SEQ ID NO: 4155371 - DNA, 21 bp, Homo sapiens
tgaccttggctgactggggct

SEQ ID NO: 4155372 - DNA, 23 bp, Homo sapiens
tgaccttttatgtagtaattgac

SEQ ID NO: 4155373 - DNA, 17 bp, Homo sapiens
tgaccttttcttcattt

SEQ ID NO: 4155374 - DNA, 19 bp, Homo sapiens
tgaccttttcttcattttg

SEQ ID NO: 4155375 - DNA, 15 bp, Homo sapiens
tgacgacaagtgctg

SEQ ID NO: 4155376 - DNA, 20 bp, Homo sapiens
tgacgacaagtgctgaacag

SEQ ID NO: 4155377 - DNA, 17 bp, Homo sapiens
tgacgctgcatgagaca

SEQ ID NO: 4155378 - DNA, 18 bp, Homo sapiens
tgacggaagaacatagaa

SEQ ID NO: 4155379 - DNA, 19 bp, Homo sapiens
tgacggcgcccccagtgtg

SEQ ID NO: 4155380 - DNA, 20 bp, Homo sapiens
tgacggcgcccccagtgtgc

SEQ ID NO: 4155381 - DNA, 20 bp, Homo sapiens
tgacgtgtaaatgctggtat

SEQ ID NO: 4155382 - DNA, 12 bp, Homo sapiens
tgacgtttacat

SEQ ID NO: 4155383 - DNA, 14 bp, Homo sapiens
tgactaaaaatatt

SEQ ID NO: 4155384 - DNA, 16 bp, Homo sapiens
tgactaaagagagaat

SEQ ID NO: 4155385 - DNA, 14 bp, Homo sapiens
tgactaattagggt

SEQ ID NO: 4155386 - DNA, 23 bp, Homo sapiens
tgactagatgatggatgccaata

SEQ ID NO: 4155387 - DNA, 16 bp, Homo sapiens
tgactataaccttgtt

SEQ ID NO: 4155388 - DNA, 12 bp, Homo sapiens
tgactatgtaaa

SEQ ID NO: 4155389 - DNA, 13 bp, Homo sapiens
tgactatgtaaac

SEQ ID NO: 4155390 - DNA, 23 bp, Homo sapiens
tgactcaacatgttactgaccag

SEQ ID NO: 4155391 - DNA, 16 bp, Homo sapiens
tgactcaattatttgc

SEQ ID NO: 4155392 - DNA, 20 bp, Homo sapiens
tgactcaattatttgcatat

SEQ ID NO: 4155393 - DNA, 13 bp, Homo sapiens
tgactcacaggcc

SEQ ID NO: 4155394 - DNA, 20 bp, Homo sapiens
tgactcacaggccctggaga

SEQ ID NO: 4155395 - DNA, 14 bp, Homo sapiens
tgactcatccccac

SEQ ID NO: 4155396 - DNA, 17 bp, Homo sapiens
tgactcctacctgccct

SEQ ID NO: 4155397 - DNA, 21 bp, Homo sapiens
tgactcgagggttgggttcat

SEQ ID NO: 4155398 - DNA, 18 bp, Homo sapiens
tgactctgccccctgctg

SEQ ID NO: 4155399 - DNA, 15 bp, Homo sapiens
tgactcttactcctt

SEQ ID NO: 4155400 - DNA, 23 bp, Homo sapiens
tgactctttttagggccaggcag

SEQ ID NO: 4155401 - DNA, 21 bp, Homo sapiens
tgactgagcgtagcatacagg

SEQ ID NO: 4155402 - DNA, 16 bp, Homo sapiens
tgactgcacccagctc

SEQ ID NO: 4155403 - DNA, 18 bp, Homo sapiens
tgactgcacccagctcca

SEQ ID NO: 4155404 - DNA, 19 bp, Homo sapiens
tgactgcacccagctccag

SEQ ID NO: 4155405 - DNA, 17 bp, Homo sapiens
tgactgcgatcttcaga

SEQ ID NO: 4155406 - DNA, 16 bp, Homo sapiens
tgactgctcagaactt

SEQ ID NO: 4155407 - DNA, 22 bp, Homo sapiens
tgactgctccccagccctggct

SEQ ID NO: 4155408 - DNA, 15 bp, Homo sapiens
tgactgctgattctc

SEQ ID NO: 4155409 - DNA, 23 bp, Homo sapiens
tgactggaggaggcctgtcccaa

SEQ ID NO: 4155410 - DNA, 20 bp, Homo sapiens
tgactggccaaacccttgct

SEQ ID NO: 4155411 - DNA, 11 bp, Homo sapiens
tgactggcctg

SEQ ID NO: 4155412 - DNA, 11 bp, Homo sapiens
tgactggggct

SEQ ID NO: 4155413 - DNA, 15 bp, Homo sapiens
tgactggggctgggg

SEQ ID NO: 4155414 - DNA, 19 bp, Homo sapiens
tgactggggctggggtgag

SEQ ID NO: 4155415 - DNA, 18 bp, Homo sapiens
tgactgtactcctcccag

SEQ ID NO: 4155416 - DNA, 24 bp, Homo sapiens
tgactgtcctctcccctccagcct

SEQ ID NO: 4155417 - DNA, 17 bp, Homo sapiens
tgactgttgatgaagta

SEQ ID NO: 4155418 - DNA, 18 bp, Homo sapiens
tgactgttgatgaagtat

SEQ ID NO: 4155419 - DNA, 12 bp, Homo sapiens
tgactgtttggc

SEQ ID NO: 4155420 - DNA, 15 bp, Homo sapiens
tgactgtttggctta

SEQ ID NO: 4155421 - DNA, 13 bp, Homo sapiens
tgacttaatgtga

SEQ ID NO: 4155422 - DNA, 14 bp, Homo sapiens
tgacttatagtaca

SEQ ID NO: 4155423 - DNA, 19 bp, Homo sapiens
tgacttatagtacatgata

SEQ ID NO: 4155424 - DNA, 12 bp, Homo sapiens
tgacttatttct

SEQ ID NO: 4155425 - DNA, 14 bp, Homo sapiens
tgacttatttctgc

SEQ ID NO: 4155426 - DNA, 21 bp, Homo sapiens
tgacttatttctgctctggaa

SEQ ID NO: 4155427 - DNA, 19 bp, Homo sapiens
tgacttattttctctgtgt

SEQ ID NO: 4155428 - DNA, 13 bp, Homo sapiens
tgacttcatctgg

SEQ ID NO: 4155429 - DNA, 17 bp, Homo sapiens
tgacttctaatatcatt

SEQ ID NO: 4155430 - DNA, 20 bp, Homo sapiens
tgacttctaatatcattcac

SEQ ID NO: 4155431 - DNA, 21 bp, Homo sapiens
tgacttctgctggcatcaaga

SEQ ID NO: 4155432 - DNA, 17 bp, Homo sapiens
tgacttgcatgaagaga

SEQ ID NO: 4155433 - DNA, 19 bp, Homo sapiens
tgacttgcatgaagagaag

SEQ ID NO: 4155434 - DNA, 18 bp, Homo sapiens
tgacttgtttgtcttcca

SEQ ID NO: 4155435 - DNA, 18 bp, Homo sapiens
tgactttacgcccatctc

SEQ ID NO: 4155436 - DNA, 17 bp, Homo sapiens
tgactttatctcctgct

SEQ ID NO: 4155437 - DNA, 14 bp, Homo sapiens
tgactttcagtaaa

SEQ ID NO: 4155438 - DNA, 15 bp, Homo sapiens
tgactttgcttgctt

SEQ ID NO: 4155439 - DNA, 12 bp, Homo sapiens
tgactttgtata

SEQ ID NO: 4155440 - DNA, 17 bp, Homo sapiens
tgactttgtctctcctg

SEQ ID NO: 4155441 - DNA, 20 bp, Homo sapiens
tgactttgtctctcctggct

SEQ ID NO: 4155442 - DNA, 23 bp, Homo sapiens
tgactttgtctctcctggctggg

SEQ ID NO: 4155443 - DNA, 17 bp, Homo sapiens
tgactttttttggtata

SEQ ID NO: 4155444 - DNA, 14 bp, Homo sapiens
tgactttttttgta

SEQ ID NO: 4155445 - DNA, 16 bp, Homo sapiens
tgagaaaaagctcctg

SEQ ID NO: 4155446 - DNA, 18 bp, Homo sapiens
tgagaaaaatatatacta

SEQ ID NO: 4155447 - DNA, 16 bp, Homo sapiens
tgagaaaatgcctcaa

SEQ ID NO: 4155448 - DNA, 16 bp, Homo sapiens
tgagaaaattgaaata

SEQ ID NO: 4155449 - DNA, 23 bp, Homo sapiens
tgagaaactgtttgaaaacttca

SEQ ID NO: 4155450 - DNA, 17 bp, Homo sapiens
tgagaaagaaagtaaaa

SEQ ID NO: 4155451 - DNA, 21 bp, Homo sapiens
tgagaaagaatttgagacgca

SEQ ID NO: 4155452 - DNA, 15 bp, Homo sapiens
tgagaaatatggaca

SEQ ID NO: 4155453 - DNA, 15 bp, Homo sapiens
tgagaaatgaataat

SEQ ID NO: 4155454 - DNA, 13 bp, Homo sapiens
tgagaaatgatga

SEQ ID NO: 4155455 - DNA, 15 bp, Homo sapiens
tgagaactcctgact

SEQ ID NO: 4155456 - DNA, 15 bp, Homo sapiens
tgagaagaatgaaaa

SEQ ID NO: 4155457 - DNA, 16 bp, Homo sapiens
tgagaagagggcctgt

SEQ ID NO: 4155458 - DNA, 15 bp, Homo sapiens
tgagaagctgctcca

SEQ ID NO: 4155459 - DNA, 20 bp, Homo sapiens
tgagaagctgctccaggcct

SEQ ID NO: 4155460 - DNA, 21 bp, Homo sapiens
tgagaagctgctccaggcctg

SEQ ID NO: 4155461 - DNA, 13 bp, Homo sapiens
tgagaagtacttg

SEQ ID NO: 4155462 - DNA, 15 bp, Homo sapiens
tgagaagtgccttct

SEQ ID NO: 4155463 - DNA, 16 bp, Homo sapiens
tgagaatcaaaactct

SEQ ID NO: 4155464 - DNA, 21 bp, Homo sapiens
tgagaatcccaaatttgattg

SEQ ID NO: 4155465 - DNA, 17 bp, Homo sapiens
tgagaatcccttaaaat

SEQ ID NO: 4155466 - DNA, 15 bp, Homo sapiens
tgagaatcctctcct

SEQ ID NO: 4155467 - DNA, 15 bp, Homo sapiens
tgagaattccaagga

SEQ ID NO: 4155468 - DNA, 13 bp, Homo sapiens
tgagaatttctaa

SEQ ID NO: 4155469 - DNA, 22 bp, Homo sapiens
tgagacacggagcccagccctc

SEQ ID NO: 4155470 - DNA, 13 bp, Homo sapiens
tgagacagaatct

SEQ ID NO: 4155471 - DNA, 14 bp, Homo sapiens
tgagacagaatctc

SEQ ID NO: 4155472 - DNA, 15 bp, Homo sapiens
tgagacaggagaatc

SEQ ID NO: 4155473 - DNA, 18 bp, Homo sapiens
tgagacagtttcttagct

SEQ ID NO: 4155474 - DNA, 19 bp, Homo sapiens
tgagacagtttcttagctt

SEQ ID NO: 4155475 - DNA, 14 bp, Homo sapiens
tgagaccactgtta

SEQ ID NO: 4155476 - DNA, 21 bp, Homo sapiens
tgagaccagttgggagcactg

SEQ ID NO: 4155477 - DNA, 17 bp, Homo sapiens
tgagacccccacacctc

SEQ ID NO: 4155478 - DNA, 13 bp, Homo sapiens
tgagaccctggtg

SEQ ID NO: 4155479 - DNA, 14 bp, Homo sapiens
tgagacccttttct

SEQ ID NO: 4155480 - DNA, 17 bp, Homo sapiens
tgagacccttttctcag

SEQ ID NO: 4155481 - DNA, 21 bp, Homo sapiens
tgagactcaaaggtgatgtaa

SEQ ID NO: 4155482 - DNA, 22 bp, Homo sapiens
tgagactctagggtccagtgga

SEQ ID NO: 4155483 - DNA, 22 bp, Homo sapiens
tgagactgccccacggagacag

SEQ ID NO: 4155484 - DNA, 19 bp, Homo sapiens
tgagactgtcggagaggct

SEQ ID NO: 4155485 - DNA, 21 bp, Homo sapiens
tgagactgtcggagaggctgt

SEQ ID NO: 4155486 - DNA, 15 bp, Homo sapiens
tgagacttactgggt

SEQ ID NO: 4155487 - DNA, 17 bp, Homo sapiens
tgagagaagccacgctg

SEQ ID NO: 4155488 - DNA, 21 bp, Homo sapiens
tgagagaagccacgctgtcct

SEQ ID NO: 4155489 - DNA, 15 bp, Homo sapiens
tgagagaatggagac

SEQ ID NO: 4155490 - DNA, 16 bp, Homo sapiens
tgagagaatggagaca

SEQ ID NO: 4155491 - DNA, 18 bp, Homo sapiens
tgagagaattgtatcatt

SEQ ID NO: 4155492 - DNA, 18 bp, Homo sapiens
tgagagacgccactccct

SEQ ID NO: 4155493 - DNA, 22 bp, Homo sapiens
tgagagacgccactccctggga

SEQ ID NO: 4155494 - DNA, 23 bp, Homo sapiens
tgagagagatgggagctcctctc

SEQ ID NO: 4155495 - DNA, 19 bp, Homo sapiens
tgagagcccagaggtaaca

SEQ ID NO: 4155496 - DNA, 20 bp, Homo sapiens
tgagagcccagaggtaacag

SEQ ID NO: 4155497 - DNA, 23 bp, Homo sapiens
tgagagcccattcccaccattct

SEQ ID NO: 4155498 - DNA, 15 bp, Homo sapiens
tgagagcgaggctga

SEQ ID NO: 4155499 - DNA, 16 bp, Homo sapiens
tgagaggacactcccg

SEQ ID NO: 4155500 - DNA, 14 bp, Homo sapiens
tgagaggctctccg

SEQ ID NO: 4155501 - DNA, 22 bp, Homo sapiens
tgagagggctcgaggggtgggc

SEQ ID NO: 4155502 - DNA, 16 bp, Homo sapiens
tgagaggggaagcggc

SEQ ID NO: 4155503 - DNA, 17 bp, Homo sapiens
tgagagtatcaggtctc

SEQ ID NO: 4155504 - DNA, 22 bp, Homo sapiens
tgagagtcagctctctgccctg

SEQ ID NO: 4155505 - DNA, 20 bp, Homo sapiens
tgagagtctggtctgcgcct

SEQ ID NO: 4155506 - DNA, 19 bp, Homo sapiens
tgagatagtagcatacatt

SEQ ID NO: 4155507 - DNA, 15 bp, Homo sapiens
tgagatatttattgt

SEQ ID NO: 4155508 - DNA, 16 bp, Homo sapiens
tgagatcacagcctcc

SEQ ID NO: 4155509 - DNA, 21 bp, Homo sapiens
tgagatcacagcctccagggc

SEQ ID NO: 4155510 - DNA, 22 bp, Homo sapiens
tgagatcactgactctgactca

SEQ ID NO: 4155511 - DNA, 21 bp, Homo sapiens
tgagatcgtgctactgcactc

SEQ ID NO: 4155512 - DNA, 16 bp, Homo sapiens
tgagatctaagccttt

SEQ ID NO: 4155513 - DNA, 20 bp, Homo sapiens
tgagatctaagcctttccat

SEQ ID NO: 4155514 - DNA, 17 bp, Homo sapiens
tgagatgctggttttct

SEQ ID NO: 4155515 - DNA, 17 bp, Homo sapiens
tgagatggggataaaat

SEQ ID NO: 4155516 - DNA, 21 bp, Homo sapiens
tgagatggggataaaatgact

SEQ ID NO: 4155517 - DNA, 17 bp, Homo sapiens
tgagatttcttaaataa

SEQ ID NO: 4155518 - DNA, 14 bp, Homo sapiens
tgagatttttaaga

SEQ ID NO: 4155519 - DNA, 18 bp, Homo sapiens
tgagatttttaagaactt

SEQ ID NO: 4155520 - DNA, 16 bp, Homo sapiens
tgagattttttattgc

SEQ ID NO: 4155521 - DNA, 18 bp, Homo sapiens
tgagattttttattgcta

SEQ ID NO: 4155522 - DNA, 23 bp, Homo sapiens
tgagattttttattgctagtatt

SEQ ID NO: 4155523 - DNA, 20 bp, Homo sapiens
tgagcaagatcttgtctcca

SEQ ID NO: 4155524 - DNA, 22 bp, Homo sapiens
tgagcaagatcttgtctccact

SEQ ID NO: 4155525 - DNA, 13 bp, Homo sapiens
tgagcaaggacat

SEQ ID NO: 4155526 - DNA, 18 bp, Homo sapiens
tgagcaaggacattgccc

SEQ ID NO: 4155527 - DNA, 19 bp, Homo sapiens
tgagcaaggacattgcccc

SEQ ID NO: 4155528 - DNA, 19 bp, Homo sapiens
tgagcaccgtcatggctta

SEQ ID NO: 4155529 - DNA, 21 bp, Homo sapiens
tgagcagcctctggacagcca

SEQ ID NO: 4155530 - DNA, 22 bp, Homo sapiens
tgagcagcctctggacagccag

SEQ ID NO: 4155531 - DNA, 18 bp, Homo sapiens
tgagcagtcacactgtta

SEQ ID NO: 4155532 - DNA, 22 bp, Homo sapiens
tgagcagtcgcctgcctgcagc

SEQ ID NO: 4155533 - DNA, 15 bp, Homo sapiens
tgagcagtgcctctt

SEQ ID NO: 4155534 - DNA, 17 bp, Homo sapiens
tgagcagtgcctcttgt

SEQ ID NO: 4155535 - DNA, 13 bp, Homo sapiens
tgagcagtggctg

SEQ ID NO: 4155536 - DNA, 21 bp, Homo sapiens
tgagcagtgttggagtgagga

SEQ ID NO: 4155537 - DNA, 15 bp, Homo sapiens
tgagcagttcccctg

SEQ ID NO: 4155538 - DNA, 15 bp, Homo sapiens
tgagccacagaccac

SEQ ID NO: 4155539 - DNA, 17 bp, Homo sapiens
tgagccaccgctgccag

SEQ ID NO: 4155540 - DNA, 23 bp, Homo sapiens
tgagccaccgctgccagcacaga

SEQ ID NO: 4155541 - DNA, 21 bp, Homo sapiens
tgagccaccgtgcctggccag

SEQ ID NO: 4155542 - DNA, 23 bp, Homo sapiens
tgagccaccgtgcctggccagat

SEQ ID NO: 4155543 - DNA, 13 bp, Homo sapiens
tgagccagcaggg

SEQ ID NO: 4155544 - DNA, 14 bp, Homo sapiens
tgagccaggcctgg

SEQ ID NO: 4155545 - DNA, 13 bp, Homo sapiens
tgagccatcacta

SEQ ID NO: 4155546 - DNA, 20 bp, Homo sapiens
tgagccatcactagaagaaa

SEQ ID NO: 4155547 - DNA, 18 bp, Homo sapiens
tgagcccagctgcctgga

SEQ ID NO: 4155548 - DNA, 19 bp, Homo sapiens
tgagcccagctgcctggag

SEQ ID NO: 4155549 - DNA, 13 bp, Homo sapiens
tgagcccaggagt

SEQ ID NO: 4155550 - DNA, 21 bp, Homo sapiens
tgagcccatgtggagtcagcc

SEQ ID NO: 4155551 - DNA, 20 bp, Homo sapiens
tgagccccacctctccaagt

SEQ ID NO: 4155552 - DNA, 20 bp, Homo sapiens
tgagccccagggtgcccaga

SEQ ID NO: 4155553 - DNA, 16 bp, Homo sapiens
tgagccctgaggaggc

SEQ ID NO: 4155554 - DNA, 22 bp, Homo sapiens
tgagccgcggggaagctggctt

SEQ ID NO: 4155555 - DNA, 23 bp, Homo sapiens
tgagccgcggggaagctggcttt

SEQ ID NO: 4155556 - DNA, 21 bp, Homo sapiens
tgagccgctgtgagcccctgg

SEQ ID NO: 4155557 - DNA, 15 bp, Homo sapiens
tgagccgggcccctg

SEQ ID NO: 4155558 - DNA, 16 bp, Homo sapiens
tgagcctacagatgaa

SEQ ID NO: 4155559 - DNA, 16 bp, Homo sapiens
tgagcctcctgtgcct

SEQ ID NO: 4155560 - DNA, 22 bp, Homo sapiens
tgagcctcctgtgcctggcccc

SEQ ID NO: 4155561 - DNA, 16 bp, Homo sapiens
tgagcctctgctcccc

SEQ ID NO: 4155562 - DNA, 18 bp, Homo sapiens
tgagcctctgctccccag

SEQ ID NO: 4155563 - DNA, 21 bp, Homo sapiens
tgagcctgcccgctgcaatgc

SEQ ID NO: 4155564 - DNA, 14 bp, Homo sapiens
tgagccttcagtct

SEQ ID NO: 4155565 - DNA, 13 bp, Homo sapiens
tgagccttgtaat

SEQ ID NO: 4155566 - DNA, 12 bp, Homo sapiens
tgagcgccagga

SEQ ID NO: 4155567 - DNA, 13 bp, Homo sapiens
tgagcgggaggca

SEQ ID NO: 4155568 - DNA, 16 bp, Homo sapiens
tgagctattttcctct

SEQ ID NO: 4155569 - DNA, 17 bp, Homo sapiens
tgagctattttcctctg

SEQ ID NO: 4155570 - DNA, 20 bp, Homo sapiens
tgagctattttcctctggcc

SEQ ID NO: 4155571 - DNA, 23 bp, Homo sapiens
tgagctctgacccttgggcctgg

SEQ ID NO: 4155572 - DNA, 14 bp, Homo sapiens
tgagctcttccctt

SEQ ID NO: 4155573 - DNA, 15 bp, Homo sapiens
tgagctcttccctta

SEQ ID NO: 4155574 - DNA, 17 bp, Homo sapiens
tgagctgatataaattc

SEQ ID NO: 4155575 - DNA, 14 bp, Homo sapiens
tgagctgcagcctg

SEQ ID NO: 4155576 - DNA, 15 bp, Homo sapiens
tgagctgcagcctgg

SEQ ID NO: 4155577 - DNA, 12 bp, Homo sapiens
tgagctgcaggt

SEQ ID NO: 4155578 - DNA, 20 bp, Homo sapiens
tgagctgcctgtaacttgag

SEQ ID NO: 4155579 - DNA, 19 bp, Homo sapiens
tgagctgccttccctagct

SEQ ID NO: 4155580 - DNA, 22 bp, Homo sapiens
tgagctggggacctggtaccct

SEQ ID NO: 4155581 - DNA, 17 bp, Homo sapiens
tgagcttcggttctcca

SEQ ID NO: 4155582 - DNA, 18 bp, Homo sapiens
tgaggaaatccattgttt

SEQ ID NO: 4155583 - DNA, 22 bp, Homo sapiens
tgaggaccgctgataagcattg

SEQ ID NO: 4155584 - DNA, 21 bp, Homo sapiens
tgaggagatgaccagggatgc

SEQ ID NO: 4155585 - DNA, 15 bp, Homo sapiens
tgaggagccaggccg

SEQ ID NO: 4155586 - DNA, 21 bp, Homo sapiens
tgaggagcccatactcagcct

SEQ ID NO: 4155587 - DNA, 23 bp, Homo sapiens
tgaggagcccatactcagcctgc

SEQ ID NO: 4155588 - DNA, 11 bp, Homo sapiens
tgaggagctgc

SEQ ID NO: 4155589 - DNA, 12 bp, Homo sapiens
tgaggagctgct

SEQ ID NO: 4155590 - DNA, 12 bp, Homo sapiens
tgaggagctggg

SEQ ID NO: 4155591 - DNA, 12 bp, Homo sapiens
tgaggaggaaaa

SEQ ID NO: 4155592 - DNA, 14 bp, Homo sapiens
tgaggaggcctcca

SEQ ID NO: 4155593 - DNA, 17 bp, Homo sapiens
tgaggaggcctccatct

SEQ ID NO: 4155594 - DNA, 13 bp, Homo sapiens
tgaggaggggagg

SEQ ID NO: 4155595 - DNA, 16 bp, Homo sapiens
tgaggaggggagggta

SEQ ID NO: 4155596 - DNA, 20 bp, Homo sapiens
tgaggagggtgggggaggga

SEQ ID NO: 4155597 - DNA, 16 bp, Homo sapiens
tgaggagtgtgagaat

SEQ ID NO: 4155598 - DNA, 23 bp, Homo sapiens
tgaggattatgggtcctgcaatt

SEQ ID NO: 4155599 - DNA, 16 bp, Homo sapiens
tgaggcaagtgtgggc

SEQ ID NO: 4155600 - DNA, 21 bp, Homo sapiens
tgaggcatgcacatctggaat

SEQ ID NO: 4155601 - DNA, 13 bp, Homo sapiens
tgaggccagagtc

SEQ ID NO: 4155602 - DNA, 14 bp, Homo sapiens
tgaggccatctcag

SEQ ID NO: 4155603 - DNA, 15 bp, Homo sapiens
tgaggccatctcagg

SEQ ID NO: 4155604 - DNA, 14 bp, Homo sapiens
tgaggccctgggct

SEQ ID NO: 4155605 - DNA, 15 bp, Homo sapiens
tgaggccctgggctg

SEQ ID NO: 4155606 - DNA, 19 bp, Homo sapiens
tgaggcctaaaagtaaaca

SEQ ID NO: 4155607 - DNA, 17 bp, Homo sapiens
tgaggcctgccctcagg

SEQ ID NO: 4155608 - DNA, 17 bp, Homo sapiens
tgaggcctggccaggca

SEQ ID NO: 4155609 - DNA, 20 bp, Homo sapiens
tgaggctatggagggtcctc

SEQ ID NO: 4155610 - DNA, 11 bp, Homo sapiens
tgaggctggca

SEQ ID NO: 4155611 - DNA, 18 bp, Homo sapiens
tgaggctgtcctgtacat

SEQ ID NO: 4155612 - DNA, 17 bp, Homo sapiens
tgaggcttctccttctc

SEQ ID NO: 4155613 - DNA, 13 bp, Homo sapiens
tgagggactctga

SEQ ID NO: 4155614 - DNA, 23 bp, Homo sapiens
tgagggaggacaggcgggaggag

SEQ ID NO: 4155615 - DNA, 14 bp, Homo sapiens
tgagggaggggaaa

SEQ ID NO: 4155616 - DNA, 13 bp, Homo sapiens
tgagggcaagggg

SEQ ID NO: 4155617 - DNA, 15 bp, Homo sapiens
tgagggcagtgcaag

SEQ ID NO: 4155618 - DNA, 12 bp, Homo sapiens
tgagggcccaga

SEQ ID NO: 4155619 - DNA, 19 bp, Homo sapiens
tgagggcccagagcaggaa

SEQ ID NO: 4155620 - DNA, 13 bp, Homo sapiens
tgagggcccagcc

SEQ ID NO: 4155621 - DNA, 13 bp, Homo sapiens
tgagggcctgctg

SEQ ID NO: 4155622 - DNA, 20 bp, Homo sapiens
tgagggcctgctggaggcct

SEQ ID NO: 4155623 - DNA, 21 bp, Homo sapiens
tgagggcctgctggaggcctc

SEQ ID NO: 4155624 - DNA, 15 bp, Homo sapiens
tgagggctgccagca

SEQ ID NO: 4155625 - DNA, 17 bp, Homo sapiens
tgagggctgccagcagc

SEQ ID NO: 4155626 - DNA, 16 bp, Homo sapiens
tgaggggagaggagac

SEQ ID NO: 4155627 - DNA, 17 bp, Homo sapiens
tgaggggcaacgaagaa

SEQ ID NO: 4155628 - DNA, 17 bp, Homo sapiens
tgaggggcatctgcccc

SEQ ID NO: 4155629 - DNA, 22 bp, Homo sapiens
tgaggggcatctgcccctcccc

SEQ ID NO: 4155630 - DNA, 17 bp, Homo sapiens
tgaggggccctggccag

SEQ ID NO: 4155631 - DNA, 18 bp, Homo sapiens
tgaggggccctggccagg

SEQ ID NO: 4155632 - DNA, 20 bp, Homo sapiens
tgaggggggccgtgcccagg

SEQ ID NO: 4155633 - DNA, 22 bp, Homo sapiens
tgaggggggccgtgcccagggg

SEQ ID NO: 4155634 - DNA, 11 bp, Homo sapiens
tgaggggtctc

SEQ ID NO: 4155635 - DNA, 19 bp, Homo sapiens
tgagggtccccacctggga

SEQ ID NO: 4155636 - DNA, 14 bp, Homo sapiens
tgagggtgtttctt

SEQ ID NO: 4155637 - DNA, 21 bp, Homo sapiens
tgaggtagaaatgcaaggggg

SEQ ID NO: 4155638 - DNA, 12 bp, Homo sapiens
tgaggtcaggga

SEQ ID NO: 4155639 - DNA, 15 bp, Homo sapiens
tgaggtcagggagtg

SEQ ID NO: 4155640 - DNA, 16 bp, Homo sapiens
tgaggtcagggagtgc

SEQ ID NO: 4155641 - DNA, 16 bp, Homo sapiens
tgaggtcccaggaagt

SEQ ID NO: 4155642 - DNA, 15 bp, Homo sapiens
tgaggtcccaggcag

SEQ ID NO: 4155643 - DNA, 17 bp, Homo sapiens
tgaggtcccaggcagag

SEQ ID NO: 4155644 - DNA, 17 bp, Homo sapiens
tgaggtctcttgaggga

SEQ ID NO: 4155645 - DNA, 18 bp, Homo sapiens
tgaggtctcttgagggag

SEQ ID NO: 4155646 - DNA, 13 bp, Homo sapiens
tgaggtctgttcc

SEQ ID NO: 4155647 - DNA, 14 bp, Homo sapiens
tgaggtctgttcct

SEQ ID NO: 4155648 - DNA, 22 bp, Homo sapiens
tgaggtcttttgacatgtggaa

SEQ ID NO: 4155649 - DNA, 15 bp, Homo sapiens
tgaggtgaaagggag

SEQ ID NO: 4155650 - DNA, 14 bp, Homo sapiens
tgaggtgcctgtcc

SEQ ID NO: 4155651 - DNA, 16 bp, Homo sapiens
tgaggtgctatgttct

SEQ ID NO: 4155652 - DNA, 18 bp, Homo sapiens
tgaggtgctgatgagtga

SEQ ID NO: 4155653 - DNA, 13 bp, Homo sapiens
tgaggtggtctga

SEQ ID NO: 4155654 - DNA, 18 bp, Homo sapiens
tgaggtggtctgaatgtt

SEQ ID NO: 4155655 - DNA, 19 bp, Homo sapiens
tgaggtggtctgaatgttc

SEQ ID NO: 4155656 - DNA, 17 bp, Homo sapiens
tgaggtgtctggcctga

SEQ ID NO: 4155657 - DNA, 15 bp, Homo sapiens
tgaggtgtgcctggc

SEQ ID NO: 4155658 - DNA, 18 bp, Homo sapiens
tgaggtgtgcctggcctc

SEQ ID NO: 4155659 - DNA, 17 bp, Homo sapiens
tgaggtgttgtgcattt

SEQ ID NO: 4155660 - DNA, 16 bp, Homo sapiens
tgaggttcctctgcct

SEQ ID NO: 4155661 - DNA, 19 bp, Homo sapiens
tgaggttcctctgcctgcc

SEQ ID NO: 4155662 - DNA, 20 bp, Homo sapiens
tgaggttcctctgcctgccc

SEQ ID NO: 4155663 - DNA, 15 bp, Homo sapiens
tgagtaaatattgag

SEQ ID NO: 4155664 - DNA, 10 bp, Homo sapiens
tgagtaacat

SEQ ID NO: 4155665 - DNA, 18 bp, Homo sapiens
tgagtaacatttgctgtt

SEQ ID NO: 4155666 - DNA, 19 bp, Homo sapiens
tgagtaacatttgctgttt

SEQ ID NO: 4155667 - DNA, 14 bp, Homo sapiens
tgagtaagagctgg

SEQ ID NO: 4155668 - DNA, 18 bp, Homo sapiens
tgagtaagagctggtgtc

SEQ ID NO: 4155669 - DNA, 21 bp, Homo sapiens
tgagtaagagctggtgtctga

SEQ ID NO: 4155670 - DNA, 23 bp, Homo sapiens
tgagtaagagctggtgtctgatt

SEQ ID NO: 4155671 - DNA, 23 bp, Homo sapiens
tgagtaagtgaaggtctcctaaa

SEQ ID NO: 4155672 - DNA, 14 bp, Homo sapiens
tgagtagagttgat

SEQ ID NO: 4155673 - DNA, 17 bp, Homo sapiens
tgagtagagttgatcaa

SEQ ID NO: 4155674 - DNA, 19 bp, Homo sapiens
tgagtatttggtccaaaaa

SEQ ID NO: 4155675 - DNA, 13 bp, Homo sapiens
tgagtcacctgct

SEQ ID NO: 4155676 - DNA, 19 bp, Homo sapiens
tgagtcacctgctccagaa

SEQ ID NO: 4155677 - DNA, 21 bp, Homo sapiens
tgagtcacgctggggctctct

SEQ ID NO: 4155678 - DNA, 22 bp, Homo sapiens
tgagtcacgctggggctctctg

SEQ ID NO: 4155679 - DNA, 23 bp, Homo sapiens
tgagtcactatgggatgagaaaa

SEQ ID NO: 4155680 - DNA, 13 bp, Homo sapiens
tgagtcatttaaa

SEQ ID NO: 4155681 - DNA, 23 bp, Homo sapiens
tgagtcatttaaatgtgtacaat

SEQ ID NO: 4155682 - DNA, 15 bp, Homo sapiens
tgagtccagagcttg

SEQ ID NO: 4155683 - DNA, 19 bp, Homo sapiens
tgagtccattctcccaggt

SEQ ID NO: 4155684 - DNA, 14 bp, Homo sapiens
tgagtctcttcaga

SEQ ID NO: 4155685 - DNA, 19 bp, Homo sapiens
tgagtcttcatgttcccac

SEQ ID NO: 4155686 - DNA, 17 bp, Homo sapiens
tgagtgaacctgtataa

SEQ ID NO: 4155687 - DNA, 23 bp, Homo sapiens
tgagtgattgacacacagcactc

SEQ ID NO: 4155688 - DNA, 17 bp, Homo sapiens
tgagtgccttttgcaga

SEQ ID NO: 4155689 - DNA, 22 bp, Homo sapiens
tgagtgccttttgcagaagagg

SEQ ID NO: 4155690 - DNA, 15 bp, Homo sapiens
tgagtggtgtgactc

SEQ ID NO: 4155691 - DNA, 14 bp, Homo sapiens
tgagtgtaagtgtg

SEQ ID NO: 4155692 - DNA, 13 bp, Homo sapiens
tgagtgtaatgtt

SEQ ID NO: 4155693 - DNA, 16 bp, Homo sapiens
tgagtgtgacagggcc

SEQ ID NO: 4155694 - DNA, 12 bp, Homo sapiens
tgagtgtggaag

SEQ ID NO: 4155695 - DNA, 15 bp, Homo sapiens
tgagtgtggaagccg

SEQ ID NO: 4155696 - DNA, 17 bp, Homo sapiens
tgagtgttcctttttaa

SEQ ID NO: 4155697 - DNA, 23 bp, Homo sapiens
tgagtgttcctttttaaatgtga

SEQ ID NO: 4155698 - DNA, 15 bp, Homo sapiens
tgagttctacataag

SEQ ID NO: 4155699 - DNA, 20 bp, Homo sapiens
tgagttctacataagtaatt

SEQ ID NO: 4155700 - DNA, 14 bp, Homo sapiens
tgagttgtgatgaa

SEQ ID NO: 4155701 - DNA, 19 bp, Homo sapiens
tgagtttaccatttgtaat

SEQ ID NO: 4155702 - DNA, 20 bp, Homo sapiens
tgagtttaccatttgtaata

SEQ ID NO: 4155703 - DNA, 23 bp, Homo sapiens
tgagtttaccttgtatactgtag

SEQ ID NO: 4155704 - DNA, 18 bp, Homo sapiens
tgagtttcattctcctgc

SEQ ID NO: 4155705 - DNA, 19 bp, Homo sapiens
tgagtttcattctcctgcc

SEQ ID NO: 4155706 - DNA, 19 bp, Homo sapiens
tgagtttccagcctgctag

SEQ ID NO: 4155707 - DNA, 17 bp, Homo sapiens
tgagtttgagctgcctt

SEQ ID NO: 4155708 - DNA, 21 bp, Homo sapiens
tgagtttgagctgccttccct

SEQ ID NO: 4155709 - DNA, 20 bp, Homo sapiens
tgagttttaaattatgtata

SEQ ID NO: 4155710 - DNA, 18 bp, Homo sapiens
tgagttttattgagaatt

SEQ ID NO: 4155711 - DNA, 16 bp, Homo sapiens
tgataaaataaataat

SEQ ID NO: 4155712 - DNA, 16 bp, Homo sapiens
tgataacagaactttt

SEQ ID NO: 4155713 - DNA, 15 bp, Homo sapiens
tgataagcattgact

SEQ ID NO: 4155714 - DNA, 16 bp, Homo sapiens
tgataagtaaatgcta

SEQ ID NO: 4155715 - DNA, 21 bp, Homo sapiens
tgataatgatttgctctttga

SEQ ID NO: 4155716 - DNA, 23 bp, Homo sapiens
tgataatgatttgctctttgaca

SEQ ID NO: 4155717 - DNA, 14 bp, Homo sapiens
tgataatgttaaat

SEQ ID NO: 4155718 - DNA, 13 bp, Homo sapiens
tgataattttgct

SEQ ID NO: 4155719 - DNA, 14 bp, Homo sapiens
tgatacaacattaa

SEQ ID NO: 4155720 - DNA, 16 bp, Homo sapiens
tgatacaatgaacact

SEQ ID NO: 4155721 - DNA, 17 bp, Homo sapiens
tgataccagaagggaaa

SEQ ID NO: 4155722 - DNA, 15 bp, Homo sapiens
tgatacccccctctg

SEQ ID NO: 4155723 - DNA, 20 bp, Homo sapiens
tgatactctttctaatgctg

SEQ ID NO: 4155724 - DNA, 12 bp, Homo sapiens
tgatagcacttt

SEQ ID NO: 4155725 - DNA, 21 bp, Homo sapiens
tgatagcactttctacaatgt

SEQ ID NO: 4155726 - DNA, 14 bp, Homo sapiens
tgatagctttattt

SEQ ID NO: 4155727 - DNA, 23 bp, Homo sapiens
tgatagctttattttttaagtat

SEQ ID NO: 4155728 - DNA, 21 bp, Homo sapiens
tgataggaatgtgaaagcacg

SEQ ID NO: 4155729 - DNA, 16 bp, Homo sapiens
tgataggaattcatct

SEQ ID NO: 4155730 - DNA, 23 bp, Homo sapiens
tgataggtaaatttttaggcaaa

SEQ ID NO: 4155731 - DNA, 18 bp, Homo sapiens
tgatatataagtgtacat

SEQ ID NO: 4155732 - DNA, 22 bp, Homo sapiens
tgatatataagtgtacatatgt

SEQ ID NO: 4155733 - DNA, 14 bp, Homo sapiens
tgatatatttaaaa

SEQ ID NO: 4155734 - DNA, 17 bp, Homo sapiens
tgatatatttaaaaaca

SEQ ID NO: 4155735 - DNA, 14 bp, Homo sapiens
tgatatattttcca

SEQ ID NO: 4155736 - DNA, 16 bp, Homo sapiens
tgatatcccccagcct

SEQ ID NO: 4155737 - DNA, 15 bp, Homo sapiens
tgatatggcagaaga

SEQ ID NO: 4155738 - DNA, 17 bp, Homo sapiens
tgatatggcagaagaca

SEQ ID NO: 4155739 - DNA, 20 bp, Homo sapiens
tgatatggcagaagacacca

SEQ ID NO: 4155740 - DNA, 13 bp, Homo sapiens
tgatattaaagga

SEQ ID NO: 4155741 - DNA, 16 bp, Homo sapiens
tgatattccatgaatg

SEQ ID NO: 4155742 - DNA, 21 bp, Homo sapiens
tgatattccccccacttaaga

SEQ ID NO: 4155743 - DNA, 17 bp, Homo sapiens
tgatattgacactgtcc

SEQ ID NO: 4155744 - DNA, 18 bp, Homo sapiens
tgatattgtttaaaattc

SEQ ID NO: 4155745 - DNA, 17 bp, Homo sapiens
tgatatttcttgctttc

SEQ ID NO: 4155746 - DNA, 12 bp, Homo sapiens
tgatatttgcat

SEQ ID NO: 4155747 - DNA, 14 bp, Homo sapiens
tgatatttgcattg

SEQ ID NO: 4155748 - DNA, 21 bp, Homo sapiens
tgatatttgcattgaggaaat

SEQ ID NO: 4155749 - DNA, 22 bp, Homo sapiens
tgatattttcaacgcagccctg

SEQ ID NO: 4155750 - DNA, 16 bp, Homo sapiens
tgatattttgtacttt

SEQ ID NO: 4155751 - DNA, 19 bp, Homo sapiens
tgatcaaaatcaattaaaa

SEQ ID NO: 4155752 - DNA, 23 bp, Homo sapiens
tgatcaaattcatttttttcact

SEQ ID NO: 4155753 - DNA, 15 bp, Homo sapiens
tgatcaataaaatgt

SEQ ID NO: 4155754 - DNA, 16 bp, Homo sapiens
tgatcaataaaatgtg

SEQ ID NO: 4155755 - DNA, 19 bp, Homo sapiens
tgatcaataaaatgtgatt

SEQ ID NO: 4155756 - DNA, 14 bp, Homo sapiens
tgatcaattaaatg

SEQ ID NO: 4155757 - DNA, 16 bp, Homo sapiens
tgatcaattaaatgta

SEQ ID NO: 4155758 - DNA, 17 bp, Homo sapiens
tgatcaattaaatgtag

SEQ ID NO: 4155759 - DNA, 15 bp, Homo sapiens
tgatcacactctggg

SEQ ID NO: 4155760 - DNA, 14 bp, Homo sapiens
tgatcacgcctggc

SEQ ID NO: 4155761 - DNA, 16 bp, Homo sapiens
tgatcacgcctggcta

SEQ ID NO: 4155762 - DNA, 16 bp, Homo sapiens
tgatcactagcctgtc

SEQ ID NO: 4155763 - DNA, 22 bp, Homo sapiens
tgatcactccaggtagtttggg

SEQ ID NO: 4155764 - DNA, 18 bp, Homo sapiens
tgatcagaccataatgtt

SEQ ID NO: 4155765 - DNA, 12 bp, Homo sapiens
tgatcagtgttg

SEQ ID NO: 4155766 - DNA, 15 bp, Homo sapiens
tgatcatcgccagag

SEQ ID NO: 4155767 - DNA, 15 bp, Homo sapiens
tgatcatgcattgtt

SEQ ID NO: 4155768 - DNA, 22 bp, Homo sapiens
tgatcatgtgtggaagttatta

SEQ ID NO: 4155769 - DNA, 13 bp, Homo sapiens
tgatcatttattt

SEQ ID NO: 4155770 - DNA, 20 bp, Homo sapiens
tgatcatttattttaagcac

SEQ ID NO: 4155771 - DNA, 23 bp, Homo sapiens
tgatcatttattttaagcactct

SEQ ID NO: 4155772 - DNA, 19 bp, Homo sapiens
tgatcattttccccccact

SEQ ID NO: 4155773 - DNA, 20 bp, Homo sapiens
tgatcattttccccccactc

SEQ ID NO: 4155774 - DNA, 19 bp, Homo sapiens
tgatccacactttgggctt

SEQ ID NO: 4155775 - DNA, 12 bp, Homo sapiens
tgatccagaaga

SEQ ID NO: 4155776 - DNA, 13 bp, Homo sapiens
tgatccagaagag

SEQ ID NO: 4155777 - DNA, 19 bp, Homo sapiens
tgatccctgtgttgtctct

SEQ ID NO: 4155778 - DNA, 15 bp, Homo sapiens
tgatcctctattttg

SEQ ID NO: 4155779 - DNA, 20 bp, Homo sapiens
tgatcctggaggcccagttc

SEQ ID NO: 4155780 - DNA, 18 bp, Homo sapiens
tgatcggagcctcctctc

SEQ ID NO: 4155781 - DNA, 22 bp, Homo sapiens
tgatctacttcatagctccttg

SEQ ID NO: 4155782 - DNA, 14 bp, Homo sapiens
tgatctcagggcag

SEQ ID NO: 4155783 - DNA, 18 bp, Homo sapiens
tgatctctactaccacaa

SEQ ID NO: 4155784 - DNA, 21 bp, Homo sapiens
tgatctctactaccacaagga

SEQ ID NO: 4155785 - DNA, 17 bp, Homo sapiens
tgatctctcttgtcctc

SEQ ID NO: 4155786 - DNA, 14 bp, Homo sapiens
tgatctggaaccca

SEQ ID NO: 4155787 - DNA, 15 bp, Homo sapiens
tgatctggaacccag

SEQ ID NO: 4155788 - DNA, 17 bp, Homo sapiens
tgatctggaacccagac

SEQ ID NO: 4155789 - DNA, 19 bp, Homo sapiens
tgatctggaacccagactc

SEQ ID NO: 4155790 - DNA, 11 bp, Homo sapiens
tgatcttaaag

SEQ ID NO: 4155791 - DNA, 13 bp, Homo sapiens
tgatcttaaagat

SEQ ID NO: 4155792 - DNA, 19 bp, Homo sapiens
tgatcttgcattcattttc

SEQ ID NO: 4155793 - DNA, 21 bp, Homo sapiens
tgatcttgcctgtctggctca

SEQ ID NO: 4155794 - DNA, 15 bp, Homo sapiens
tgatcttgtgctcag

SEQ ID NO: 4155795 - DNA, 14 bp, Homo sapiens
tgatgaaaagattt

SEQ ID NO: 4155796 - DNA, 15 bp, Homo sapiens
tgatgaaaagattta

SEQ ID NO: 4155797 - DNA, 11 bp, Homo sapiens
tgatgaaagct

SEQ ID NO: 4155798 - DNA, 15 bp, Homo sapiens
tgatgaagtatactt

SEQ ID NO: 4155799 - DNA, 19 bp, Homo sapiens
tgatgaatcaatgaaaaat

SEQ ID NO: 4155800 - DNA, 15 bp, Homo sapiens
tgatgacagagcgag

SEQ ID NO: 4155801 - DNA, 18 bp, Homo sapiens
tgatgacccccccagctt

SEQ ID NO: 4155802 - DNA, 15 bp, Homo sapiens
tgatgactttctgtt

SEQ ID NO: 4155803 - DNA, 23 bp, Homo sapiens
tgatgagaatttctaaaaagatt

SEQ ID NO: 4155804 - DNA, 13 bp, Homo sapiens
tgatgagttgtga

SEQ ID NO: 4155805 - DNA, 15 bp, Homo sapiens
tgatgatccagaaca

SEQ ID NO: 4155806 - DNA, 15 bp, Homo sapiens
tgatgattaaacacc

SEQ ID NO: 4155807 - DNA, 21 bp, Homo sapiens
tgatgattaaacacctgacac

SEQ ID NO: 4155808 - DNA, 14 bp, Homo sapiens
tgatgatttggggg

SEQ ID NO: 4155809 - DNA, 13 bp, Homo sapiens
tgatgattttcct

SEQ ID NO: 4155810 - DNA, 14 bp, Homo sapiens
tgatgattttcctt

SEQ ID NO: 4155811 - DNA, 11 bp, Homo sapiens
tgatgctaaat

SEQ ID NO: 4155812 - DNA, 14 bp, Homo sapiens
tgatgctcaggctt

SEQ ID NO: 4155813 - DNA, 14 bp, Homo sapiens
tgatgctccctccc

SEQ ID NO: 4155814 - DNA, 16 bp, Homo sapiens
tgatgctccctcccct

SEQ ID NO: 4155815 - DNA, 20 bp, Homo sapiens
tgatgctccctcccctgccc

SEQ ID NO: 4155816 - DNA, 23 bp, Homo sapiens
tgatgctccctcccctgccctgg

SEQ ID NO: 4155817 - DNA, 15 bp, Homo sapiens
tgatgctgcccctca

SEQ ID NO: 4155818 - DNA, 16 bp, Homo sapiens
tgatgctggagaggtt

SEQ ID NO: 4155819 - DNA, 15 bp, Homo sapiens
tgatgctgggcaatg

SEQ ID NO: 4155820 - DNA, 14 bp, Homo sapiens
tgatggaaaataaa

SEQ ID NO: 4155821 - DNA, 23 bp, Homo sapiens
tgatggaccttctagaattataa

SEQ ID NO: 4155822 - DNA, 15 bp, Homo sapiens
tgatggaggaaaaag

SEQ ID NO: 4155823 - DNA, 16 bp, Homo sapiens
tgatggcaacagatct

SEQ ID NO: 4155824 - DNA, 18 bp, Homo sapiens
tgatggcaacagatctgg

SEQ ID NO: 4155825 - DNA, 23 bp, Homo sapiens
tgatggcaacagatctggaacct

SEQ ID NO: 4155826 - DNA, 22 bp, Homo sapiens
tgatggcaccactgcactccag

SEQ ID NO: 4155827 - DNA, 13 bp, Homo sapiens
tgatggcagctgg

SEQ ID NO: 4155828 - DNA, 18 bp, Homo sapiens
tgatggccagcccctggg

SEQ ID NO: 4155829 - DNA, 18 bp, Homo sapiens
tgatggccttaatttcct

SEQ ID NO: 4155830 - DNA, 19 bp, Homo sapiens
tgatggccttaatttcctt

SEQ ID NO: 4155831 - DNA, 15 bp, Homo sapiens
tgatgggaaaatatt

SEQ ID NO: 4155832 - DNA, 18 bp, Homo sapiens
tgatgggaaaatatttcc

SEQ ID NO: 4155833 - DNA, 20 bp, Homo sapiens
tgatggtggactaagcaatt

SEQ ID NO: 4155834 - DNA, 19 bp, Homo sapiens
tgatggttcttcacctcct

SEQ ID NO: 4155835 - DNA, 22 bp, Homo sapiens
tgatgtacataactcctgtccc

SEQ ID NO: 4155836 - DNA, 24 bp, Homo sapiens
tgatgtacataactcctgtccctt

SEQ ID NO: 4155837 - DNA, 18 bp, Homo sapiens
tgatgtaccatgaaacaa

SEQ ID NO: 4155838 - DNA, 15 bp, Homo sapiens
tgatgtacctgatgc

SEQ ID NO: 4155839 - DNA, 15 bp, Homo sapiens
tgatgtatatgttta

SEQ ID NO: 4155840 - DNA, 16 bp, Homo sapiens
tgatgtatatgtttat

SEQ ID NO: 4155841 - DNA, 12 bp, Homo sapiens
tgatgtccagaa

SEQ ID NO: 4155842 - DNA, 15 bp, Homo sapiens
tgatgtccagaagaa

SEQ ID NO: 4155843 - DNA, 23 bp, Homo sapiens
tgatgtgactttttttggtataa

SEQ ID NO: 4155844 - DNA, 18 bp, Homo sapiens
tgatgtgttgccactttc

SEQ ID NO: 4155845 - DNA, 14 bp, Homo sapiens
tgatgttaaaattc

SEQ ID NO: 4155846 - DNA, 16 bp, Homo sapiens
tgatgttaaaattcca

SEQ ID NO: 4155847 - DNA, 17 bp, Homo sapiens
tgatgttaaaattccat

SEQ ID NO: 4155848 - DNA, 13 bp, Homo sapiens
tgatgtttgctct

SEQ ID NO: 4155849 - DNA, 13 bp, Homo sapiens
tgatgtttgtcct

SEQ ID NO: 4155850 - DNA, 16 bp, Homo sapiens
tgatgtttgtggcctc

SEQ ID NO: 4155851 - DNA, 17 bp, Homo sapiens
tgatgtttgtggcctca

SEQ ID NO: 4155852 - DNA, 18 bp, Homo sapiens
tgatgttttcctataata

SEQ ID NO: 4155853 - DNA, 14 bp, Homo sapiens
tgattaaacacctg

SEQ ID NO: 4155854 - DNA, 14 bp, Homo sapiens
tgattactgtcaat

SEQ ID NO: 4155855 - DNA, 19 bp, Homo sapiens
tgattactgtcaataaaca

SEQ ID NO: 4155856 - DNA, 23 bp, Homo sapiens
tgattactgtcaataaacagctt

SEQ ID NO: 4155857 - DNA, 18 bp, Homo sapiens
tgattagcaagttacagt

SEQ ID NO: 4155858 - DNA, 14 bp, Homo sapiens
tgattagctttgtg

SEQ ID NO: 4155859 - DNA, 16 bp, Homo sapiens
tgattatttattattt

SEQ ID NO: 4155860 - DNA, 18 bp, Homo sapiens
tgattcaaagtagtttta

SEQ ID NO: 4155861 - DNA, 23 bp, Homo sapiens
tgattcaaagtagttttatttta

SEQ ID NO: 4155862 - DNA, 22 bp, Homo sapiens
tgattcagaaaatgttctgttt

SEQ ID NO: 4155863 - DNA, 16 bp, Homo sapiens
tgattcagaaattgga

SEQ ID NO: 4155864 - DNA, 17 bp, Homo sapiens
tgattcataataaatat

SEQ ID NO: 4155865 - DNA, 16 bp, Homo sapiens
tgattcatagtaactt

SEQ ID NO: 4155866 - DNA, 18 bp, Homo sapiens
tgattcattttcctgttc

SEQ ID NO: 4155867 - DNA, 22 bp, Homo sapiens
tgattccactacacctggctga

SEQ ID NO: 4155868 - DNA, 18 bp, Homo sapiens
tgattccatccacctttc

SEQ ID NO: 4155869 - DNA, 13 bp, Homo sapiens
tgattctgtgtgt

SEQ ID NO: 4155870 - DNA, 17 bp, Homo sapiens
tgattgaaccagctcat

SEQ ID NO: 4155871 - DNA, 20 bp, Homo sapiens
tgattgaaccagctcatctc

SEQ ID NO: 4155872 - DNA, 20 bp, Homo sapiens
tgattgaggagctgcactga

SEQ ID NO: 4155873 - DNA, 12 bp, Homo sapiens
tgattgatttga

SEQ ID NO: 4155874 - DNA, 14 bp, Homo sapiens
tgattgatttgaag

SEQ ID NO: 4155875 - DNA, 13 bp, Homo sapiens
tgattgcacagaa

SEQ ID NO: 4155876 - DNA, 20 bp, Homo sapiens
tgattgcacagaatttgtat

SEQ ID NO: 4155877 - DNA, 14 bp, Homo sapiens
tgattgcagcttta

SEQ ID NO: 4155878 - DNA, 22 bp, Homo sapiens
tgattggacaggcatgggtgca

SEQ ID NO: 4155879 - DNA, 17 bp, Homo sapiens
tgattggattattcatt

SEQ ID NO: 4155880 - DNA, 12 bp, Homo sapiens
tgattggctcac

SEQ ID NO: 4155881 - DNA, 12 bp, Homo sapiens
tgattggttttg

SEQ ID NO: 4155882 - DNA, 19 bp, Homo sapiens
tgattgttaatttacagct

SEQ ID NO: 4155883 - DNA, 19 bp, Homo sapiens
tgattgttcgggtgtgcaa

SEQ ID NO: 4155884 - DNA, 19 bp, Homo sapiens
tgattgtttctcaaatctt

SEQ ID NO: 4155885 - DNA, 19 bp, Homo sapiens
tgatttaaaaagtgagaaa

SEQ ID NO: 4155886 - DNA, 16 bp, Homo sapiens
tgatttaaacacacag

SEQ ID NO: 4155887 - DNA, 14 bp, Homo sapiens
tgatttaataaaat

SEQ ID NO: 4155888 - DNA, 17 bp, Homo sapiens
tgatttaataaaataat

SEQ ID NO: 4155889 - DNA, 22 bp, Homo sapiens
tgatttaataaaataattctaa

SEQ ID NO: 4155890 - DNA, 22 bp, Homo sapiens
tgatttaggtagccttgtgttc

SEQ ID NO: 4155891 - DNA, 17 bp, Homo sapiens
tgatttataaacagaca

SEQ ID NO: 4155892 - DNA, 13 bp, Homo sapiens
tgatttcatttca

SEQ ID NO: 4155893 - DNA, 15 bp, Homo sapiens
tgatttccttgaatg

SEQ ID NO: 4155894 - DNA, 18 bp, Homo sapiens
tgatttctttaaaagaat

SEQ ID NO: 4155895 - DNA, 22 bp, Homo sapiens
tgatttgcatggattttggata

SEQ ID NO: 4155896 - DNA, 14 bp, Homo sapiens
tgatttgcattgaa

SEQ ID NO: 4155897 - DNA, 19 bp, Homo sapiens
tgatttggtgaccaactgt

SEQ ID NO: 4155898 - DNA, 12 bp, Homo sapiens
tgattttaacaa

SEQ ID NO: 4155899 - DNA, 17 bp, Homo sapiens
tgattttaacaataact

SEQ ID NO: 4155900 - DNA, 11 bp, Homo sapiens
tgattttaagt

SEQ ID NO: 4155901 - DNA, 23 bp, Homo sapiens
tgattttcctttgtagctacttt

SEQ ID NO: 4155902 - DNA, 15 bp, Homo sapiens
tgattttcctttttc

SEQ ID NO: 4155903 - DNA, 12 bp, Homo sapiens
tgattttctcac

SEQ ID NO: 4155904 - DNA, 12 bp, Homo sapiens
tgattttctgtt

SEQ ID NO: 4155905 - DNA, 22 bp, Homo sapiens
tgattttgcaaaatgagttgtg

SEQ ID NO: 4155906 - DNA, 13 bp, Homo sapiens
tgatttttcttct

SEQ ID NO: 4155907 - DNA, 19 bp, Homo sapiens
tgatttttgttgattaaaa

SEQ ID NO: 4155908 - DNA, 18 bp, Homo sapiens
tgattttttcaaaaaagt

SEQ ID NO: 4155909 - DNA, 20 bp, Homo sapiens
tgatttttttttttttttcc

SEQ ID NO: 4155910 - DNA, 23 bp, Homo sapiens
tgcaaaaatatttataaaacttc

SEQ ID NO: 4155911 - DNA, 15 bp, Homo sapiens
tgcaaaagcttcaaa

SEQ ID NO: 4155912 - DNA, 23 bp, Homo sapiens
tgcaaaaggttcactaaagcagt

SEQ ID NO: 4155913 - DNA, 21 bp, Homo sapiens
tgcaaaatttccagtaccttt

SEQ ID NO: 4155914 - DNA, 14 bp, Homo sapiens
tgcaaacagaacag

SEQ ID NO: 4155915 - DNA, 18 bp, Homo sapiens
tgcaaacagaacagggtc

SEQ ID NO: 4155916 - DNA, 19 bp, Homo sapiens
tgcaaacagaacagggtca

SEQ ID NO: 4155917 - DNA, 17 bp, Homo sapiens
tgcaaacatcaacctgg

SEQ ID NO: 4155918 - DNA, 19 bp, Homo sapiens
tgcaaaccgttaggaaaac

SEQ ID NO: 4155919 - DNA, 14 bp, Homo sapiens
tgcaaatctgatgg

SEQ ID NO: 4155920 - DNA, 14 bp, Homo sapiens
tgcaaatcttgaaa

SEQ ID NO: 4155921 - DNA, 12 bp, Homo sapiens
tgcaaatttcat

SEQ ID NO: 4155922 - DNA, 15 bp, Homo sapiens
tgcaacatttacagt

SEQ ID NO: 4155923 - DNA, 15 bp, Homo sapiens
tgcaaccactgcaac

SEQ ID NO: 4155924 - DNA, 20 bp, Homo sapiens
tgcaacccaaggactgaggg

SEQ ID NO: 4155925 - DNA, 21 bp, Homo sapiens
tgcaacccaaggactgaggga

SEQ ID NO: 4155926 - DNA, 17 bp, Homo sapiens
tgcaacccttacccctt

SEQ ID NO: 4155927 - DNA, 17 bp, Homo sapiens
tgcaacctcaccttcct

SEQ ID NO: 4155928 - DNA, 21 bp, Homo sapiens
tgcaacctcaccttcctgtgg

SEQ ID NO: 4155929 - DNA, 23 bp, Homo sapiens
tgcaacctcaccttcctgtgggt

SEQ ID NO: 4155930 - DNA, 14 bp, Homo sapiens
tgcaacctctgcct

SEQ ID NO: 4155931 - DNA, 18 bp, Homo sapiens
tgcaacctcttggcctga

SEQ ID NO: 4155932 - DNA, 18 bp, Homo sapiens
tgcaactaggtatttcta

SEQ ID NO: 4155933 - DNA, 19 bp, Homo sapiens
tgcaagatgcttggttgtg

SEQ ID NO: 4155934 - DNA, 14 bp, Homo sapiens
tgcaagatgtgaat

SEQ ID NO: 4155935 - DNA, 15 bp, Homo sapiens
tgcaagatgtgaatt

SEQ ID NO: 4155936 - DNA, 16 bp, Homo sapiens
tgcaaggactcccgga

SEQ ID NO: 4155937 - DNA, 21 bp, Homo sapiens
tgcaaggactcccggagcctg

SEQ ID NO: 4155938 - DNA, 23 bp, Homo sapiens
tgcaaggcctggtgtttcttgat

SEQ ID NO: 4155939 - DNA, 21 bp, Homo sapiens
tgcaataaatctgacccagtg

SEQ ID NO: 4155940 - DNA, 23 bp, Homo sapiens
tgcaataaatctgacccagtgcc

SEQ ID NO: 4155941 - DNA, 15 bp, Homo sapiens
tgcaataacttctga

SEQ ID NO: 4155942 - DNA, 16 bp, Homo sapiens
tgcaataacttctgac

SEQ ID NO: 4155943 - DNA, 15 bp, Homo sapiens
tgcaatgcctagact

SEQ ID NO: 4155944 - DNA, 22 bp, Homo sapiens
tgcaatgcttttatatggccca

SEQ ID NO: 4155945 - DNA, 19 bp, Homo sapiens
tgcaatgtcacaacctctc

SEQ ID NO: 4155946 - DNA, 20 bp, Homo sapiens
tgcaatgtcacaacctctct

SEQ ID NO: 4155947 - DNA, 20 bp, Homo sapiens
tgcaatgtccagcagtctga

SEQ ID NO: 4155948 - DNA, 22 bp, Homo sapiens
tgcaatgtctgagtgaacctgt

SEQ ID NO: 4155949 - DNA, 21 bp, Homo sapiens
tgcaattgtaggggtgtgtgt

SEQ ID NO: 4155950 - DNA, 20 bp, Homo sapiens
tgcaatttcatatgctgtat

SEQ ID NO: 4155951 - DNA, 23 bp, Homo sapiens
tgcaatttgattgactgcccatt

SEQ ID NO: 4155952 - DNA, 17 bp, Homo sapiens
tgcaatttgtttaaaga

SEQ ID NO: 4155953 - DNA, 20 bp, Homo sapiens
tgcaatttgtttaaagaata

SEQ ID NO: 4155954 - DNA, 19 bp, Homo sapiens
tgcacaaaacccagacctg

SEQ ID NO: 4155955 - DNA, 16 bp, Homo sapiens
tgcacaagaatggatc

SEQ ID NO: 4155956 - DNA, 13 bp, Homo sapiens
tgcacacacctcc

SEQ ID NO: 4155957 - DNA, 18 bp, Homo sapiens
tgcacactccatctcctg

SEQ ID NO: 4155958 - DNA, 21 bp, Homo sapiens
tgcacagatatttccatttct

SEQ ID NO: 4155959 - DNA, 18 bp, Homo sapiens
tgcacagcggcccctgca

SEQ ID NO: 4155960 - DNA, 12 bp, Homo sapiens
tgcacagcgtgg

SEQ ID NO: 4155961 - DNA, 21 bp, Homo sapiens
tgcacaggcagatgtttgcct

SEQ ID NO: 4155962 - DNA, 23 bp, Homo sapiens
tgcacagttagttgtgaaagaaa

SEQ ID NO: 4155963 - DNA, 19 bp, Homo sapiens
tgcacagttgccacattta

SEQ ID NO: 4155964 - DNA, 13 bp, Homo sapiens
tgcacatgaaagt

SEQ ID NO: 4155965 - DNA, 14 bp, Homo sapiens
tgcacatgaatgca

SEQ ID NO: 4155966 - DNA, 18 bp, Homo sapiens
tgcacatgattgtataag

SEQ ID NO: 4155967 - DNA, 22 bp, Homo sapiens
tgcacatttatttcctccctct

SEQ ID NO: 4155968 - DNA, 17 bp, Homo sapiens
tgcacatttctttgcat

SEQ ID NO: 4155969 - DNA, 23 bp, Homo sapiens
tgcaccaagaaagcttcttcaga

SEQ ID NO: 4155970 - DNA, 22 bp, Homo sapiens
tgcaccacggcgtttttttaca

SEQ ID NO: 4155971 - DNA, 21 bp, Homo sapiens
tgcaccagagcaacctctcac

SEQ ID NO: 4155972 - DNA, 23 bp, Homo sapiens
tgcaccagagcaacctctcactc

SEQ ID NO: 4155973 - DNA, 21 bp, Homo sapiens
tgcaccaggtagaacgccagg

SEQ ID NO: 4155974 - DNA, 21 bp, Homo sapiens
tgcacccaactactgagctga

SEQ ID NO: 4155975 - DNA, 17 bp, Homo sapiens
tgcacccacccaggagt

SEQ ID NO: 4155976 - DNA, 15 bp, Homo sapiens
tgcacccatgggctc

SEQ ID NO: 4155977 - DNA, 18 bp, Homo sapiens
tgcacccatgggctctga

SEQ ID NO: 4155978 - DNA, 21 bp, Homo sapiens
tgcaccccaaagctttcctgc

SEQ ID NO: 4155979 - DNA, 22 bp, Homo sapiens
tgcaccccaaagctttcctgcc

SEQ ID NO: 4155980 - DNA, 18 bp, Homo sapiens
tgcacccctgagccagca

SEQ ID NO: 4155981 - DNA, 15 bp, Homo sapiens
tgcaccccttctctc

SEQ ID NO: 4155982 - DNA, 20 bp, Homo sapiens
tgcaccccttctctcctccc

SEQ ID NO: 4155983 - DNA, 14 bp, Homo sapiens
tgcacccggcctgg

SEQ ID NO: 4155984 - DNA, 17 bp, Homo sapiens
tgcacccggcctggatg

SEQ ID NO: 4155985 - DNA, 18 bp, Homo sapiens
tgcaccctgcgcctccag

SEQ ID NO: 4155986 - DNA, 18 bp, Homo sapiens
tgcacgtggagagctggt

SEQ ID NO: 4155987 - DNA, 15 bp, Homo sapiens
tgcacgtggcctctt

SEQ ID NO: 4155988 - DNA, 16 bp, Homo sapiens
tgcacgtggcctcttg

SEQ ID NO: 4155989 - DNA, 14 bp, Homo sapiens
tgcacgttcataac

SEQ ID NO: 4155990 - DNA, 19 bp, Homo sapiens
tgcactaaagccagcctga

SEQ ID NO: 4155991 - DNA, 18 bp, Homo sapiens
tgcactactgacatgtgg

SEQ ID NO: 4155992 - DNA, 13 bp, Homo sapiens
tgcactccagcct

SEQ ID NO: 4155993 - DNA, 12 bp, Homo sapiens
tgcactgagggc

SEQ ID NO: 4155994 - DNA, 15 bp, Homo sapiens
tgcactgagggccac

SEQ ID NO: 4155995 - DNA, 17 bp, Homo sapiens
tgcactgagggccacac

SEQ ID NO: 4155996 - DNA, 14 bp, Homo sapiens
tgcactgatgctgc

SEQ ID NO: 4155997 - DNA, 22 bp, Homo sapiens
tgcactgggggaacagatgcta

SEQ ID NO: 4155998 - DNA, 15 bp, Homo sapiens
tgcactgtcactttg

SEQ ID NO: 4155999 - DNA, 22 bp, Homo sapiens
tgcactgtcactttgctctggg

SEQ ID NO: 4156000 - DNA, 15 bp, Homo sapiens
tgcactgtgaaggac

SEQ ID NO: 4156001 - DNA, 18 bp, Homo sapiens
tgcactgtgaaggaccct

SEQ ID NO: 4156002 - DNA, 17 bp, Homo sapiens
tgcacttgtgattattt

SEQ ID NO: 4156003 - DNA, 20 bp, Homo sapiens
tgcacttgtgattatttatt

SEQ ID NO: 4156004 - DNA, 21 bp, Homo sapiens
tgcactttcctccacctccca

SEQ ID NO: 4156005 - DNA, 18 bp, Homo sapiens
tgcagaaaattctgtgcc

SEQ ID NO: 4156006 - DNA, 21 bp, Homo sapiens
tgcagaacttgaagcctgctc

SEQ ID NO: 4156007 - DNA, 23 bp, Homo sapiens
tgcagaacttgaagcctgctcct

SEQ ID NO: 4156008 - DNA, 19 bp, Homo sapiens
tgcagacagaagtctcctc

SEQ ID NO: 4156009 - DNA, 14 bp, Homo sapiens
tgcagactcagttt

SEQ ID NO: 4156010 - DNA, 19 bp, Homo sapiens
tgcagactcagtttgtcag

SEQ ID NO: 4156011 - DNA, 20 bp, Homo sapiens
tgcagactcagtttgtcaga

SEQ ID NO: 4156012 - DNA, 22 bp, Homo sapiens
tgcagacttcccagctaggaag

SEQ ID NO: 4156013 - DNA, 20 bp, Homo sapiens
tgcagagaaacttaagcaaa

SEQ ID NO: 4156014 - DNA, 15 bp, Homo sapiens
tgcagagaagctgga

SEQ ID NO: 4156015 - DNA, 17 bp, Homo sapiens
tgcagagagccattttg

SEQ ID NO: 4156016 - DNA, 18 bp, Homo sapiens
tgcagagagccattttgt

SEQ ID NO: 4156017 - DNA, 15 bp, Homo sapiens
tgcagagccttctca

SEQ ID NO: 4156018 - DNA, 16 bp, Homo sapiens
tgcagagccttctcag

SEQ ID NO: 4156019 - DNA, 19 bp, Homo sapiens
tgcagagggtactttaaga

SEQ ID NO: 4156020 - DNA, 20 bp, Homo sapiens
tgcagaggtaaaagtgtgag

SEQ ID NO: 4156021 - DNA, 23 bp, Homo sapiens
tgcagagtaaattgctctgttcc

SEQ ID NO: 4156022 - DNA, 20 bp, Homo sapiens
tgcagagtccatttcccaca

SEQ ID NO: 4156023 - DNA, 22 bp, Homo sapiens
tgcagatgagcagtcacactgt

SEQ ID NO: 4156024 - DNA, 17 bp, Homo sapiens
tgcagatgcaattgttt

SEQ ID NO: 4156025 - DNA, 16 bp, Homo sapiens
tgcagatttgatattt

SEQ ID NO: 4156026 - DNA, 20 bp, Homo sapiens
tgcagatttgatatttgcat

SEQ ID NO: 4156027 - DNA, 18 bp, Homo sapiens
tgcagcaaacactccacc

SEQ ID NO: 4156028 - DNA, 20 bp, Homo sapiens
tgcagcaaggccctgctgcc

SEQ ID NO: 4156029 - DNA, 15 bp, Homo sapiens
tgcagcacctccagg

SEQ ID NO: 4156030 - DNA, 13 bp, Homo sapiens
tgcagcaggagtg

SEQ ID NO: 4156031 - DNA, 18 bp, Homo sapiens
tgcagcagtgagtctctt

SEQ ID NO: 4156032 - DNA, 17 bp, Homo sapiens
tgcagcatgacctgtga

SEQ ID NO: 4156033 - DNA, 15 bp, Homo sapiens
tgcagcatgagactt

SEQ ID NO: 4156034 - DNA, 16 bp, Homo sapiens
tgcagcatggtccctg

SEQ ID NO: 4156035 - DNA, 20 bp, Homo sapiens
tgcagccacatggccccatc

SEQ ID NO: 4156036 - DNA, 21 bp, Homo sapiens
tgcagccacgattggagaata

SEQ ID NO: 4156037 - DNA, 12 bp, Homo sapiens
tgcagcccttgg

SEQ ID NO: 4156038 - DNA, 18 bp, Homo sapiens
tgcagcccttgggcagtt

SEQ ID NO: 4156039 - DNA, 19 bp, Homo sapiens
tgcagcccttgggcagttc

SEQ ID NO: 4156040 - DNA, 18 bp, Homo sapiens
tgcagccggcacagggtc

SEQ ID NO: 4156041 - DNA, 16 bp, Homo sapiens
tgcagccgtggtccaa

SEQ ID NO: 4156042 - DNA, 22 bp, Homo sapiens
tgcagcctcatactcctgggct

SEQ ID NO: 4156043 - DNA, 12 bp, Homo sapiens
tgcagcctggct

SEQ ID NO: 4156044 - DNA, 22 bp, Homo sapiens
tgcagcgcagctggactctgca

SEQ ID NO: 4156045 - DNA, 14 bp, Homo sapiens
tgcagctcttcctg

SEQ ID NO: 4156046 - DNA, 15 bp, Homo sapiens
tgcagctcttcctgg

SEQ ID NO: 4156047 - DNA, 18 bp, Homo sapiens
tgcagctcttcctggaca

SEQ ID NO: 4156048 - DNA, 15 bp, Homo sapiens
tgcagctgagcctga

SEQ ID NO: 4156049 - DNA, 19 bp, Homo sapiens
tgcagctgattttaacaat

SEQ ID NO: 4156050 - DNA, 20 bp, Homo sapiens
tgcagctgattttaacaata

SEQ ID NO: 4156051 - DNA, 15 bp, Homo sapiens
tgcaggaatcaaaaa

SEQ ID NO: 4156052 - DNA, 19 bp, Homo sapiens
tgcaggaatcaaaaattga

SEQ ID NO: 4156053 - DNA, 14 bp, Homo sapiens
tgcaggacaggagg

SEQ ID NO: 4156054 - DNA, 15 bp, Homo sapiens
tgcaggacaggaggc

SEQ ID NO: 4156055 - DNA, 13 bp, Homo sapiens
tgcaggacttgag

SEQ ID NO: 4156056 - DNA, 21 bp, Homo sapiens
tgcaggagcagtttgccaccc

SEQ ID NO: 4156057 - DNA, 13 bp, Homo sapiens
tgcaggaggccaa

SEQ ID NO: 4156058 - DNA, 16 bp, Homo sapiens
tgcagggacagagcat

SEQ ID NO: 4156059 - DNA, 20 bp, Homo sapiens
tgcagggagggcagttttct

SEQ ID NO: 4156060 - DNA, 14 bp, Homo sapiens
tgcagggcagcccc

SEQ ID NO: 4156061 - DNA, 14 bp, Homo sapiens
tgcagggcagtcat

SEQ ID NO: 4156062 - DNA, 23 bp, Homo sapiens
tgcagggccactggaaggaacat

SEQ ID NO: 4156063 - DNA, 22 bp, Homo sapiens
tgcaggggtgacggccctcatc

SEQ ID NO: 4156064 - DNA, 19 bp, Homo sapiens
tgcagggtcctcttctggg

SEQ ID NO: 4156065 - DNA, 17 bp, Homo sapiens
tgcaggtgccagggccc

SEQ ID NO: 4156066 - DNA, 23 bp, Homo sapiens
tgcaggtgccagggcccacccca

SEQ ID NO: 4156067 - DNA, 23 bp, Homo sapiens
tgcaggtgggggttgctgtataa

SEQ ID NO: 4156068 - DNA, 15 bp, Homo sapiens
tgcaggtttgttaca

SEQ ID NO: 4156069 - DNA, 14 bp, Homo sapiens
tgcaggttttctgt

SEQ ID NO: 4156070 - DNA, 18 bp, Homo sapiens
tgcagtaaatcttttaca

SEQ ID NO: 4156071 - DNA, 14 bp, Homo sapiens
tgcagtcactggag

SEQ ID NO: 4156072 - DNA, 15 bp, Homo sapiens
tgcagtcactggagg

SEQ ID NO: 4156073 - DNA, 16 bp, Homo sapiens
tgcagtcatcagaagt

SEQ ID NO: 4156074 - DNA, 16 bp, Homo sapiens
tgcagtctcatttctc

SEQ ID NO: 4156075 - DNA, 21 bp, Homo sapiens
tgcagttacactaaaaggtga

SEQ ID NO: 4156076 - DNA, 15 bp, Homo sapiens
tgcagttcagcacca

SEQ ID NO: 4156077 - DNA, 19 bp, Homo sapiens
tgcagttggactctcaggg

SEQ ID NO: 4156078 - DNA, 20 bp, Homo sapiens
tgcagttggactctcaggga

SEQ ID NO: 4156079 - DNA, 18 bp, Homo sapiens
tgcagtttaagagcagaa

SEQ ID NO: 4156080 - DNA, 12 bp, Homo sapiens
tgcagtttcctg

SEQ ID NO: 4156081 - DNA, 21 bp, Homo sapiens
tgcataaaagggtcaaacctg

SEQ ID NO: 4156082 - DNA, 13 bp, Homo sapiens
tgcataaatatgc

SEQ ID NO: 4156083 - DNA, 19 bp, Homo sapiens
tgcataaatatgcagtgat

SEQ ID NO: 4156084 - DNA, 18 bp, Homo sapiens
tgcataagtgaaaatctt

SEQ ID NO: 4156085 - DNA, 17 bp, Homo sapiens
tgcatactgagccaagt

SEQ ID NO: 4156086 - DNA, 22 bp, Homo sapiens
tgcatagcagatggtttccaca

SEQ ID NO: 4156087 - DNA, 13 bp, Homo sapiens
tgcatagtgctgg

SEQ ID NO: 4156088 - DNA, 13 bp, Homo sapiens
tgcatatcctgag

SEQ ID NO: 4156089 - DNA, 18 bp, Homo sapiens
tgcatatcctgagccatc

SEQ ID NO: 4156090 - DNA, 15 bp, Homo sapiens
tgcatatgaaatcct

SEQ ID NO: 4156091 - DNA, 19 bp, Homo sapiens
tgcatatgtcactagaatg

SEQ ID NO: 4156092 - DNA, 21 bp, Homo sapiens
tgcatatgtcactagaatgga

SEQ ID NO: 4156093 - DNA, 19 bp, Homo sapiens
tgcatatgttgaatacttt

SEQ ID NO: 4156094 - DNA, 17 bp, Homo sapiens
tgcatcatctgtagata

SEQ ID NO: 4156095 - DNA, 16 bp, Homo sapiens
tgcatccaaaggtgct

SEQ ID NO: 4156096 - DNA, 14 bp, Homo sapiens
tgcatctcaaaatt

SEQ ID NO: 4156097 - DNA, 14 bp, Homo sapiens
tgcatctcagccca

SEQ ID NO: 4156098 - DNA, 12 bp, Homo sapiens
tgcatctcctcc

SEQ ID NO: 4156099 - DNA, 13 bp, Homo sapiens
tgcatctcctccc

SEQ ID NO: 4156100 - DNA, 19 bp, Homo sapiens
tgcatgaatatcatacaaa

SEQ ID NO: 4156101 - DNA, 22 bp, Homo sapiens
tgcatgccaaattgtagttctt

SEQ ID NO: 4156102 - DNA, 20 bp, Homo sapiens
tgcatgccctctctgagtct

SEQ ID NO: 4156103 - DNA, 15 bp, Homo sapiens
tgcatggacctaaca

SEQ ID NO: 4156104 - DNA, 18 bp, Homo sapiens
tgcatggacctaacattc

SEQ ID NO: 4156105 - DNA, 21 bp, Homo sapiens
tgcatggacctaacattcgat

SEQ ID NO: 4156106 - DNA, 13 bp, Homo sapiens
tgcatggagcagg

SEQ ID NO: 4156107 - DNA, 18 bp, Homo sapiens
tgcatggctccagaaatg

SEQ ID NO: 4156108 - DNA, 19 bp, Homo sapiens
tgcatggctccagaaatgt

SEQ ID NO: 4156109 - DNA, 20 bp, Homo sapiens
tgcatggctccagaaatgtc

SEQ ID NO: 4156110 - DNA, 23 bp, Homo sapiens
tgcatggggtggggtagggctga

SEQ ID NO: 4156111 - DNA, 20 bp, Homo sapiens
tgcatggtgccccaggacca

SEQ ID NO: 4156112 - DNA, 21 bp, Homo sapiens
tgcatggtgccccaggaccag

SEQ ID NO: 4156113 - DNA, 13 bp, Homo sapiens
tgcattaaattca

SEQ ID NO: 4156114 - DNA, 14 bp, Homo sapiens
tgcattaaattcac

SEQ ID NO: 4156115 - DNA, 16 bp, Homo sapiens
tgcattacagagagga

SEQ ID NO: 4156116 - DNA, 23 bp, Homo sapiens
tgcattcattttctgacatgcat

SEQ ID NO: 4156117 - DNA, 14 bp, Homo sapiens
tgcattcattttta

SEQ ID NO: 4156118 - DNA, 18 bp, Homo sapiens
tgcattcatttttatagc

SEQ ID NO: 4156119 - DNA, 20 bp, Homo sapiens
tgcattcatttttatagcaa

SEQ ID NO: 4156120 - DNA, 24 bp, Homo sapiens
tgcattccagaatcttgactttct

SEQ ID NO: 4156121 - DNA, 15 bp, Homo sapiens
tgcattcctttgtct

SEQ ID NO: 4156122 - DNA, 14 bp, Homo sapiens
tgcattctatcgtt

SEQ ID NO: 4156123 - DNA, 19 bp, Homo sapiens
tgcattctattgccttctt

SEQ ID NO: 4156124 - DNA, 22 bp, Homo sapiens
tgcattctattgccttctttga

SEQ ID NO: 4156125 - DNA, 18 bp, Homo sapiens
tgcattctggccaagggg

SEQ ID NO: 4156126 - DNA, 16 bp, Homo sapiens
tgcattcttctctgtt

SEQ ID NO: 4156127 - DNA, 15 bp, Homo sapiens
tgcattgaatatatt

SEQ ID NO: 4156128 - DNA, 14 bp, Homo sapiens
tgcattgactttca

SEQ ID NO: 4156129 - DNA, 20 bp, Homo sapiens
tgcattgaggaaatattaat

SEQ ID NO: 4156130 - DNA, 22 bp, Homo sapiens
tgcattgccgctgtataaagca

SEQ ID NO: 4156131 - DNA, 19 bp, Homo sapiens
tgcattgtgattggcctgt

SEQ ID NO: 4156132 - DNA, 20 bp, Homo sapiens
tgcattgttggctatttgaa

SEQ ID NO: 4156133 - DNA, 22 bp, Homo sapiens
tgcattgttggctatttgaaat

SEQ ID NO: 4156134 - DNA, 15 bp, Homo sapiens
tgcatttagaaatca

SEQ ID NO: 4156135 - DNA, 22 bp, Homo sapiens
tgcatttagcttctttccctta

SEQ ID NO: 4156136 - DNA, 13 bp, Homo sapiens
tgcatttatatgt

SEQ ID NO: 4156137 - DNA, 14 bp, Homo sapiens
tgcatttatatgta

SEQ ID NO: 4156138 - DNA, 23 bp, Homo sapiens
tgcatttatttatacagtgcctt

SEQ ID NO: 4156139 - DNA, 18 bp, Homo sapiens
tgcatttctgaatagaaa

SEQ ID NO: 4156140 - DNA, 21 bp, Homo sapiens
tgcatttgagagaagccacgc

SEQ ID NO: 4156141 - DNA, 16 bp, Homo sapiens
tgcatttggtcaagat

SEQ ID NO: 4156142 - DNA, 18 bp, Homo sapiens
tgcatttgtaaatgctgt

SEQ ID NO: 4156143 - DNA, 16 bp, Homo sapiens
tgcatttgttcagctc

SEQ ID NO: 4156144 - DNA, 18 bp, Homo sapiens
tgcattttgcagcagtga

SEQ ID NO: 4156145 - DNA, 16 bp, Homo sapiens
tgcatttttgtgaaat

SEQ ID NO: 4156146 - DNA, 21 bp, Homo sapiens
tgcatttttttcattactgtt

SEQ ID NO: 4156147 - DNA, 14 bp, Homo sapiens
tgccaaaaccaggc

SEQ ID NO: 4156148 - DNA, 20 bp, Homo sapiens
tgccaaagctagggtggccc

SEQ ID NO: 4156149 - DNA, 21 bp, Homo sapiens
tgccaaagctagggtggccct

SEQ ID NO: 4156150 - DNA, 22 bp, Homo sapiens
tgccaaagctagggtggccctt

SEQ ID NO: 4156151 - DNA, 15 bp, Homo sapiens
tgccaaaggatgtga

SEQ ID NO: 4156152 - DNA, 17 bp, Homo sapiens
tgccaaaggatgtgata

SEQ ID NO: 4156153 - DNA, 16 bp, Homo sapiens
tgccaaataataaaaa

SEQ ID NO: 4156154 - DNA, 14 bp, Homo sapiens
tgccaaatctggct

SEQ ID NO: 4156155 - DNA, 13 bp, Homo sapiens
tgccaaatgctgg

SEQ ID NO: 4156156 - DNA, 16 bp, Homo sapiens
tgccaaccctcccggg

SEQ ID NO: 4156157 - DNA, 14 bp, Homo sapiens
tgccaagaaaatga

SEQ ID NO: 4156158 - DNA, 16 bp, Homo sapiens
tgccaagctttcttct

SEQ ID NO: 4156159 - DNA, 18 bp, Homo sapiens
tgccaaggcctccctcag

SEQ ID NO: 4156160 - DNA, 20 bp, Homo sapiens
tgccaatgtgaaatgtaaat

SEQ ID NO: 4156161 - DNA, 17 bp, Homo sapiens
tgccacaaccagccagg

SEQ ID NO: 4156162 - DNA, 20 bp, Homo sapiens
tgccacacagagtggtcttt

SEQ ID NO: 4156163 - DNA, 13 bp, Homo sapiens
tgccacaccctcc

SEQ ID NO: 4156164 - DNA, 14 bp, Homo sapiens
tgccacacttcagg

SEQ ID NO: 4156165 - DNA, 13 bp, Homo sapiens
tgccacagccaga

SEQ ID NO: 4156166 - DNA, 17 bp, Homo sapiens
tgccacagccagaggag

SEQ ID NO: 4156167 - DNA, 11 bp, Homo sapiens
tgccacagctt

SEQ ID NO: 4156168 - DNA, 12 bp, Homo sapiens
tgccacatttct

SEQ ID NO: 4156169 - DNA, 17 bp, Homo sapiens
tgccacatttctgatca

SEQ ID NO: 4156170 - DNA, 21 bp, Homo sapiens
tgccacatttctgatcagagg

SEQ ID NO: 4156171 - DNA, 18 bp, Homo sapiens
tgccaccacctctgtggc

SEQ ID NO: 4156172 - DNA, 19 bp, Homo sapiens
tgccaccacctctgtggca

SEQ ID NO: 4156173 - DNA, 22 bp, Homo sapiens
tgccaccagcccccgccccaga

SEQ ID NO: 4156174 - DNA, 22 bp, Homo sapiens
tgccaccaggagaaccactaca

SEQ ID NO: 4156175 - DNA, 19 bp, Homo sapiens
tgccaccatcctgctgctg

SEQ ID NO: 4156176 - DNA, 18 bp, Homo sapiens
tgccaccatggccagcca

SEQ ID NO: 4156177 - DNA, 16 bp, Homo sapiens
tgccaccatgtattca

SEQ ID NO: 4156178 - DNA, 12 bp, Homo sapiens
tgccacccacca

SEQ ID NO: 4156179 - DNA, 14 bp, Homo sapiens
tgccacccactcag

SEQ ID NO: 4156180 - DNA, 15 bp, Homo sapiens
tgccacccactcagg

SEQ ID NO: 4156181 - DNA, 20 bp, Homo sapiens
tgccacccactcaggattgg

SEQ ID NO: 4156182 - DNA, 15 bp, Homo sapiens
tgccaccccaccctc

SEQ ID NO: 4156183 - DNA, 22 bp, Homo sapiens
tgccaccccaccctccctggag

SEQ ID NO: 4156184 - DNA, 23 bp, Homo sapiens
tgccaccccaccctccctggagt

SEQ ID NO: 4156185 - DNA, 17 bp, Homo sapiens
tgccacccctgtccaga

SEQ ID NO: 4156186 - DNA, 19 bp, Homo sapiens
tgccacgttccacagttgc

SEQ ID NO: 4156187 - DNA, 18 bp, Homo sapiens
tgccactaattttagtat

SEQ ID NO: 4156188 - DNA, 15 bp, Homo sapiens
tgccactcctccctc

SEQ ID NO: 4156189 - DNA, 22 bp, Homo sapiens
tgccactgcccgagctggtgca

SEQ ID NO: 4156190 - DNA, 13 bp, Homo sapiens
tgccactgcctgc

SEQ ID NO: 4156191 - DNA, 14 bp, Homo sapiens
tgccactgcctgca

SEQ ID NO: 4156192 - DNA, 18 bp, Homo sapiens
tgccactgcctgcacctt

SEQ ID NO: 4156193 - DNA, 18 bp, Homo sapiens
tgccagaaacagtgggag

SEQ ID NO: 4156194 - DNA, 23 bp, Homo sapiens
tgccagaaacagtgggagccctg

SEQ ID NO: 4156195 - DNA, 21 bp, Homo sapiens
tgccagaagatcccctcagga

SEQ ID NO: 4156196 - DNA, 22 bp, Homo sapiens
tgccagaggctgatgtcaagca

SEQ ID NO: 4156197 - DNA, 21 bp, Homo sapiens
tgccagatgcctttatggctg

SEQ ID NO: 4156198 - DNA, 16 bp, Homo sapiens
tgccagattctgcctc

SEQ ID NO: 4156199 - DNA, 19 bp, Homo sapiens
tgccagattctgcctctct

SEQ ID NO: 4156200 - DNA, 23 bp, Homo sapiens
tgccagcaatgacatctcagggg

SEQ ID NO: 4156201 - DNA, 13 bp, Homo sapiens
tgccagcacagag

SEQ ID NO: 4156202 - DNA, 14 bp, Homo sapiens
tgccagcagccccg

SEQ ID NO: 4156203 - DNA, 21 bp, Homo sapiens
tgccagcagccccgtctgccc

SEQ ID NO: 4156204 - DNA, 23 bp, Homo sapiens
tgccagcagccccgtctgcccac

SEQ ID NO: 4156205 - DNA, 18 bp, Homo sapiens
tgccagccccacacagct

SEQ ID NO: 4156206 - DNA, 21 bp, Homo sapiens
tgccagccttgagccctggct

SEQ ID NO: 4156207 - DNA, 15 bp, Homo sapiens
tgccagctgcactga

SEQ ID NO: 4156208 - DNA, 12 bp, Homo sapiens
tgccagctgtgt

SEQ ID NO: 4156209 - DNA, 20 bp, Homo sapiens
tgccagctgtgtccttcggg

SEQ ID NO: 4156210 - DNA, 19 bp, Homo sapiens
tgccagcttttcctccctt

SEQ ID NO: 4156211 - DNA, 14 bp, Homo sapiens
tgccaggaacctgt

SEQ ID NO: 4156212 - DNA, 22 bp, Homo sapiens
tgccaggactccccaggccagg

SEQ ID NO: 4156213 - DNA, 20 bp, Homo sapiens
tgccaggcaacttttaaagc

SEQ ID NO: 4156214 - DNA, 20 bp, Homo sapiens
tgccaggcacacacagcccc

SEQ ID NO: 4156215 - DNA, 12 bp, Homo sapiens
tgccaggcaggg

SEQ ID NO: 4156216 - DNA, 15 bp, Homo sapiens
tgccaggccagcctc

SEQ ID NO: 4156217 - DNA, 16 bp, Homo sapiens
tgccaggccagcctcc

SEQ ID NO: 4156218 - DNA, 19 bp, Homo sapiens
tgccaggctgcctcctgcc

SEQ ID NO: 4156219 - DNA, 22 bp, Homo sapiens
tgccagggcccaccccagcctc

SEQ ID NO: 4156220 - DNA, 16 bp, Homo sapiens
tgccagggtgggtgtc

SEQ ID NO: 4156221 - DNA, 17 bp, Homo sapiens
tgccaggtgagaaactg

SEQ ID NO: 4156222 - DNA, 22 bp, Homo sapiens
tgccagtaccagccccaccctg

SEQ ID NO: 4156223 - DNA, 22 bp, Homo sapiens
tgccagtgacagacaggctctt

SEQ ID NO: 4156224 - DNA, 14 bp, Homo sapiens
tgccatgatctgta

SEQ ID NO: 4156225 - DNA, 13 bp, Homo sapiens
tgccatgctgggc

SEQ ID NO: 4156226 - DNA, 14 bp, Homo sapiens
tgccatgctgggcc

SEQ ID NO: 4156227 - DNA, 15 bp, Homo sapiens
tgccatgctgggcca

SEQ ID NO: 4156228 - DNA, 19 bp, Homo sapiens
tgccatgctgggccactgg

SEQ ID NO: 4156229 - DNA, 22 bp, Homo sapiens
tgccatgctgggccactgggga

SEQ ID NO: 4156230 - DNA, 18 bp, Homo sapiens
tgccatgggcttcactgt

SEQ ID NO: 4156231 - DNA, 19 bp, Homo sapiens
tgccatgggcttcactgta

SEQ ID NO: 4156232 - DNA, 20 bp, Homo sapiens
tgccatgtaaatccccactg

SEQ ID NO: 4156233 - DNA, 22 bp, Homo sapiens
tgccatgtctgcagtgtgcccc

SEQ ID NO: 4156234 - DNA, 16 bp, Homo sapiens
tgccatgtgaagaggg

SEQ ID NO: 4156235 - DNA, 15 bp, Homo sapiens
tgccatgttgcccct

SEQ ID NO: 4156236 - DNA, 17 bp, Homo sapiens
tgccattccactccact

SEQ ID NO: 4156237 - DNA, 21 bp, Homo sapiens
tgccattccactccactcagg

SEQ ID NO: 4156238 - DNA, 13 bp, Homo sapiens
tgccatttccctt

SEQ ID NO: 4156239 - DNA, 16 bp, Homo sapiens
tgccatttctcacgcc

SEQ ID NO: 4156240 - DNA, 18 bp, Homo sapiens
tgccatttgatttttcta

SEQ ID NO: 4156241 - DNA, 22 bp, Homo sapiens
tgcccaacccttccctcacctt

SEQ ID NO: 4156242 - DNA, 14 bp, Homo sapiens
tgcccaagcccagg

SEQ ID NO: 4156243 - DNA, 18 bp, Homo sapiens
tgcccaagggcctcccac

SEQ ID NO: 4156244 - DNA, 18 bp, Homo sapiens
tgcccaagtcacacagct

SEQ ID NO: 4156245 - DNA, 12 bp, Homo sapiens
tgcccacaggcc

SEQ ID NO: 4156246 - DNA, 18 bp, Homo sapiens
tgcccaccattcccggcc

SEQ ID NO: 4156247 - DNA, 19 bp, Homo sapiens
tgcccaccattcccggccg

SEQ ID NO: 4156248 - DNA, 16 bp, Homo sapiens
tgcccaccccctgccc

SEQ ID NO: 4156249 - DNA, 20 bp, Homo sapiens
tgcccaccccctgccctgca

SEQ ID NO: 4156250 - DNA, 13 bp, Homo sapiens
tgcccacccctca

SEQ ID NO: 4156251 - DNA, 17 bp, Homo sapiens
tgcccacccctcactcc

SEQ ID NO: 4156252 - DNA, 18 bp, Homo sapiens
tgcccaccctgggagaca

SEQ ID NO: 4156253 - DNA, 21 bp, Homo sapiens
tgcccactccctatctccttc

SEQ ID NO: 4156254 - DNA, 18 bp, Homo sapiens
tgcccactcctgctctgc

SEQ ID NO: 4156255 - DNA, 20 bp, Homo sapiens
tgcccactcctgctctgctc

SEQ ID NO: 4156256 - DNA, 13 bp, Homo sapiens
tgcccactgctgg

SEQ ID NO: 4156257 - DNA, 14 bp, Homo sapiens
tgcccactgctggt

SEQ ID NO: 4156258 - DNA, 11 bp, Homo sapiens
tgcccagaact

SEQ ID NO: 4156259 - DNA, 18 bp, Homo sapiens
tgcccagaacttccctga

SEQ ID NO: 4156260 - DNA, 17 bp, Homo sapiens
tgcccagaatttaccat

SEQ ID NO: 4156261 - DNA, 18 bp, Homo sapiens
tgcccagacccctctggc

SEQ ID NO: 4156262 - DNA, 22 bp, Homo sapiens
tgcccagacccctctggccagg

SEQ ID NO: 4156263 - DNA, 17 bp, Homo sapiens
tgcccagactacagggc

SEQ ID NO: 4156264 - DNA, 21 bp, Homo sapiens
tgcccagaggactcccaaccc

SEQ ID NO: 4156265 - DNA, 20 bp, Homo sapiens
tgcccagcccggaccttggc

SEQ ID NO: 4156266 - DNA, 18 bp, Homo sapiens
tgcccagcctctttccct

SEQ ID NO: 4156267 - DNA, 20 bp, Homo sapiens
tgcccagcttttcattgctg

SEQ ID NO: 4156268 - DNA, 23 bp, Homo sapiens
tgcccaggaactcgcacctgtgc

SEQ ID NO: 4156269 - DNA, 22 bp, Homo sapiens
tgcccaggcatgaaattcttcc

SEQ ID NO: 4156270 - DNA, 23 bp, Homo sapiens
tgcccaggcatgaaattcttcct

SEQ ID NO: 4156271 - DNA, 22 bp, Homo sapiens
tgcccaggtaccacccttcaga

SEQ ID NO: 4156272 - DNA, 23 bp, Homo sapiens
tgcccatcacagggttgggccca

SEQ ID NO: 4156273 - DNA, 24 bp, Homo sapiens
tgcccatggacaggctggctccag

SEQ ID NO: 4156274 - DNA, 18 bp, Homo sapiens
tgcccatgtgtcccctca

SEQ ID NO: 4156275 - DNA, 16 bp, Homo sapiens
tgccccaacctgctga

SEQ ID NO: 4156276 - DNA, 15 bp, Homo sapiens
tgccccacacggact

SEQ ID NO: 4156277 - DNA, 15 bp, Homo sapiens
tgccccaccccacct

SEQ ID NO: 4156278 - DNA, 16 bp, Homo sapiens
tgccccaccccacctc

SEQ ID NO: 4156279 - DNA, 15 bp, Homo sapiens
tgccccagagctgtt

SEQ ID NO: 4156280 - DNA, 23 bp, Homo sapiens
tgccccagagctgtttatggcct

SEQ ID NO: 4156281 - DNA, 13 bp, Homo sapiens
tgccccaggacca

SEQ ID NO: 4156282 - DNA, 21 bp, Homo sapiens
tgccccatccagacctggctc

SEQ ID NO: 4156283 - DNA, 20 bp, Homo sapiens
tgccccattccttgcgcctc

SEQ ID NO: 4156284 - DNA, 22 bp, Homo sapiens
tgccccattccttgcgcctcag

SEQ ID NO: 4156285 - DNA, 19 bp, Homo sapiens
tgcccccactgtcccccta

SEQ ID NO: 4156286 - DNA, 19 bp, Homo sapiens
tgccccccagcctctggca

SEQ ID NO: 4156287 - DNA, 21 bp, Homo sapiens
tgcccccgctcccgctcccag

SEQ ID NO: 4156288 - DNA, 14 bp, Homo sapiens
tgcccccggccccc

SEQ ID NO: 4156289 - DNA, 20 bp, Homo sapiens
tgccccctcacctctccagg

SEQ ID NO: 4156290 - DNA, 22 bp, Homo sapiens
tgccccgcccccagtccccacc

SEQ ID NO: 4156291 - DNA, 18 bp, Homo sapiens
tgccccggaggaagcttg

SEQ ID NO: 4156292 - DNA, 15 bp, Homo sapiens
tgccccggcctcctc

SEQ ID NO: 4156293 - DNA, 17 bp, Homo sapiens
tgcccctcccccaaccc

SEQ ID NO: 4156294 - DNA, 21 bp, Homo sapiens
tgcccctcccccaacccccac

SEQ ID NO: 4156295 - DNA, 23 bp, Homo sapiens
tgcccctcccccaacccccaccc

SEQ ID NO: 4156296 - DNA, 19 bp, Homo sapiens
tgcccctggacctgggaac

SEQ ID NO: 4156297 - DNA, 13 bp, Homo sapiens
tgcccctggccca

SEQ ID NO: 4156298 - DNA, 13 bp, Homo sapiens
tgcccctggctgg

SEQ ID NO: 4156299 - DNA, 12 bp, Homo sapiens
tgcccctggctt

SEQ ID NO: 4156300 - DNA, 13 bp, Homo sapiens
tgcccctggcttt

SEQ ID NO: 4156301 - DNA, 21 bp, Homo sapiens
tgccccttcccatctcttcct

SEQ ID NO: 4156302 - DNA, 15 bp, Homo sapiens
tgccccttcttgggc

SEQ ID NO: 4156303 - DNA, 16 bp, Homo sapiens
tgcccctttcaggcct

SEQ ID NO: 4156304 - DNA, 18 bp, Homo sapiens
tgcccgaaactaagccag

SEQ ID NO: 4156305 - DNA, 18 bp, Homo sapiens
tgcccgactgactggagg

SEQ ID NO: 4156306 - DNA, 14 bp, Homo sapiens
tgcccgagctggtg

SEQ ID NO: 4156307 - DNA, 19 bp, Homo sapiens
tgcccgagctggtgcatta

SEQ ID NO: 4156308 - DNA, 15 bp, Homo sapiens
tgcccgtgccctggt

SEQ ID NO: 4156309 - DNA, 14 bp, Homo sapiens
tgccctaagccccc

SEQ ID NO: 4156310 - DNA, 16 bp, Homo sapiens
tgccctaagcccccag

SEQ ID NO: 4156311 - DNA, 17 bp, Homo sapiens
tgccctaagcccccagg

SEQ ID NO: 4156312 - DNA, 17 bp, Homo sapiens
tgccctagcccagactc

SEQ ID NO: 4156313 - DNA, 19 bp, Homo sapiens
tgccctagcccagactctg

SEQ ID NO: 4156314 - DNA, 14 bp, Homo sapiens
tgccctagctgacc

SEQ ID NO: 4156315 - DNA, 16 bp, Homo sapiens
tgccctatggatttga

SEQ ID NO: 4156316 - DNA, 15 bp, Homo sapiens
tgccctatgggcctg

SEQ ID NO: 4156317 - DNA, 12 bp, Homo sapiens
tgccctcagggg

SEQ ID NO: 4156318 - DNA, 14 bp, Homo sapiens
tgccctcctcactc

SEQ ID NO: 4156319 - DNA, 13 bp, Homo sapiens
tgccctcgctgct

SEQ ID NO: 4156320 - DNA, 15 bp, Homo sapiens
tgccctgagaagctg

SEQ ID NO: 4156321 - DNA, 22 bp, Homo sapiens
tgccctgcacgtcatgggaggg

SEQ ID NO: 4156322 - DNA, 17 bp, Homo sapiens
tgccctgctttgcaaac

SEQ ID NO: 4156323 - DNA, 12 bp, Homo sapiens
tgccctggctgc

SEQ ID NO: 4156324 - DNA, 14 bp, Homo sapiens
tgccctggctgctg

SEQ ID NO: 4156325 - DNA, 18 bp, Homo sapiens
tgccctggtccagggaag

SEQ ID NO: 4156326 - DNA, 14 bp, Homo sapiens
tgccctggtgctgc

SEQ ID NO: 4156327 - DNA, 17 bp, Homo sapiens
tgccctggtgctgccac

SEQ ID NO: 4156328 - DNA, 21 bp, Homo sapiens
tgccctggtgctgccacactt

SEQ ID NO: 4156329 - DNA, 16 bp, Homo sapiens
tgccctgtcaggaggc

SEQ ID NO: 4156330 - DNA, 12 bp, Homo sapiens
tgccctgtgcaa

SEQ ID NO: 4156331 - DNA, 11 bp, Homo sapiens
tgccctgtgta

SEQ ID NO: 4156332 - DNA, 20 bp, Homo sapiens
tgccctgttcatgtgcctct

SEQ ID NO: 4156333 - DNA, 19 bp, Homo sapiens
tgccctgttgtgtatagat

SEQ ID NO: 4156334 - DNA, 15 bp, Homo sapiens
tgcccttaaatcata

SEQ ID NO: 4156335 - DNA, 14 bp, Homo sapiens
tgcccttcacccca

SEQ ID NO: 4156336 - DNA, 15 bp, Homo sapiens
tgcccttcaccccag

SEQ ID NO: 4156337 - DNA, 15 bp, Homo sapiens
tgcccttccctctgg

SEQ ID NO: 4156338 - DNA, 19 bp, Homo sapiens
tgcccttccctctgggcac

SEQ ID NO: 4156339 - DNA, 21 bp, Homo sapiens
tgccctttacttgtctttctg

SEQ ID NO: 4156340 - DNA, 14 bp, Homo sapiens
tgccctttcctagg

SEQ ID NO: 4156341 - DNA, 22 bp, Homo sapiens
tgccctttcctaggcccaggcc

SEQ ID NO: 4156342 - DNA, 20 bp, Homo sapiens
tgccctttgtcctcctgctg

SEQ ID NO: 4156343 - DNA, 19 bp, Homo sapiens
tgccgaatgtgcaggtttg

SEQ ID NO: 4156344 - DNA, 19 bp, Homo sapiens
tgccgacccctagttccct

SEQ ID NO: 4156345 - DNA, 21 bp, Homo sapiens
tgccgatatactctagatgaa

SEQ ID NO: 4156346 - DNA, 19 bp, Homo sapiens
tgccgcagacgggcacaga

SEQ ID NO: 4156347 - DNA, 14 bp, Homo sapiens
tgccgcccttcctg

SEQ ID NO: 4156348 - DNA, 18 bp, Homo sapiens
tgccgcccttcctggagg

SEQ ID NO: 4156349 - DNA, 13 bp, Homo sapiens
tgccgctgatgtt

SEQ ID NO: 4156350 - DNA, 17 bp, Homo sapiens
tgccgctgcaccacggc

SEQ ID NO: 4156351 - DNA, 16 bp, Homo sapiens
tgccggctgtggagca

SEQ ID NO: 4156352 - DNA, 20 bp, Homo sapiens
tgccgtggattgcacgtggc

SEQ ID NO: 4156353 - DNA, 23 bp, Homo sapiens
tgccgtgtgagtgtgacagggcc

SEQ ID NO: 4156354 - DNA, 18 bp, Homo sapiens
tgcctaataaacatcctt

SEQ ID NO: 4156355 - DNA, 18 bp, Homo sapiens
tgcctacaaccatccctg

SEQ ID NO: 4156356 - DNA, 20 bp, Homo sapiens
tgcctacaaccatccctgcc

SEQ ID NO: 4156357 - DNA, 22 bp, Homo sapiens
tgcctagattaggtagactttg

SEQ ID NO: 4156358 - DNA, 23 bp, Homo sapiens
tgcctagattaggtagactttgc

SEQ ID NO: 4156359 - DNA, 19 bp, Homo sapiens
tgcctagcaagctggcctc

SEQ ID NO: 4156360 - DNA, 19 bp, Homo sapiens
tgcctagcagagtgctggc

SEQ ID NO: 4156361 - DNA, 20 bp, Homo sapiens
tgcctagcagagtgctggca

SEQ ID NO: 4156362 - DNA, 23 bp, Homo sapiens
tgcctagcagagtgctggcactt

SEQ ID NO: 4156363 - DNA, 23 bp, Homo sapiens
tgcctcaatgtgaccaggggtga

SEQ ID NO: 4156364 - DNA, 21 bp, Homo sapiens
tgcctcagacgttgcctgaga

SEQ ID NO: 4156365 - DNA, 17 bp, Homo sapiens
tgcctcagactccgccc

SEQ ID NO: 4156366 - DNA, 22 bp, Homo sapiens
tgcctcagctgacccggcctct

SEQ ID NO: 4156367 - DNA, 18 bp, Homo sapiens
tgcctcatattgtcctct

SEQ ID NO: 4156368 - DNA, 14 bp, Homo sapiens
tgcctccaccctcc

SEQ ID NO: 4156369 - DNA, 13 bp, Homo sapiens
tgcctcccacact

SEQ ID NO: 4156370 - DNA, 22 bp, Homo sapiens
tgcctcccacacttgctggggc

SEQ ID NO: 4156371 - DNA, 23 bp, Homo sapiens
tgcctcccacacttgctggggct

SEQ ID NO: 4156372 - DNA, 21 bp, Homo sapiens
tgcctccccatttcccatctg

SEQ ID NO: 4156373 - DNA, 18 bp, Homo sapiens
tgcctccccggctcgagc

SEQ ID NO: 4156374 - DNA, 20 bp, Homo sapiens
tgcctcctcgttcctttctc

SEQ ID NO: 4156375 - DNA, 14 bp, Homo sapiens
tgcctcctgccctt

SEQ ID NO: 4156376 - DNA, 14 bp, Homo sapiens
tgcctcctgcctgc

SEQ ID NO: 4156377 - DNA, 14 bp, Homo sapiens
tgcctcctgcgccc

SEQ ID NO: 4156378 - DNA, 17 bp, Homo sapiens
tgcctcctgcgccctgt

SEQ ID NO: 4156379 - DNA, 12 bp, Homo sapiens
tgcctcctggga

SEQ ID NO: 4156380 - DNA, 14 bp, Homo sapiens
tgcctcctgggaag

SEQ ID NO: 4156381 - DNA, 19 bp, Homo sapiens
tgcctcgctcaccgctggc

SEQ ID NO: 4156382 - DNA, 21 bp, Homo sapiens
tgcctctctggaaagaggctc

SEQ ID NO: 4156383 - DNA, 21 bp, Homo sapiens
tgcctctgcagtctcatttct

SEQ ID NO: 4156384 - DNA, 14 bp, Homo sapiens
tgcctctgccctgg

SEQ ID NO: 4156385 - DNA, 13 bp, Homo sapiens
tgcctctgggcca

SEQ ID NO: 4156386 - DNA, 20 bp, Homo sapiens
tgcctcttctttgtgccttt

SEQ ID NO: 4156387 - DNA, 21 bp, Homo sapiens
tgcctcttctttgtgcctttg

SEQ ID NO: 4156388 - DNA, 18 bp, Homo sapiens
tgcctcttgtctgaggga

SEQ ID NO: 4156389 - DNA, 21 bp, Homo sapiens
tgcctcttgtctgagggacat

SEQ ID NO: 4156390 - DNA, 12 bp, Homo sapiens
tgcctctttccc

SEQ ID NO: 4156391 - DNA, 17 bp, Homo sapiens
tgcctctttccctagga

SEQ ID NO: 4156392 - DNA, 22 bp, Homo sapiens
tgcctgaaacagccatgtccaa

SEQ ID NO: 4156393 - DNA, 16 bp, Homo sapiens
tgcctgacacactaac

SEQ ID NO: 4156394 - DNA, 22 bp, Homo sapiens
tgcctgactaatttttgtattt

SEQ ID NO: 4156395 - DNA, 14 bp, Homo sapiens
tgcctgagaagaag

SEQ ID NO: 4156396 - DNA, 21 bp, Homo sapiens
tgcctgagaagaagtggctgc

SEQ ID NO: 4156397 - DNA, 22 bp, Homo sapiens
tgcctgagaagaagtggctgcc

SEQ ID NO: 4156398 - DNA, 23 bp, Homo sapiens
tgcctgagaagaagtggctgcca

SEQ ID NO: 4156399 - DNA, 15 bp, Homo sapiens
tgcctgagaggcagg

SEQ ID NO: 4156400 - DNA, 16 bp, Homo sapiens
tgcctgagaggcaggc

SEQ ID NO: 4156401 - DNA, 18 bp, Homo sapiens
tgcctgagaggcaggcat

SEQ ID NO: 4156402 - DNA, 16 bp, Homo sapiens
tgcctgagctggggaa

SEQ ID NO: 4156403 - DNA, 17 bp, Homo sapiens
tgcctgagctggggaag

SEQ ID NO: 4156404 - DNA, 15 bp, Homo sapiens
tgcctgaggtctgta

SEQ ID NO: 4156405 - DNA, 18 bp, Homo sapiens
tgcctgaggtctgtacgt

SEQ ID NO: 4156406 - DNA, 16 bp, Homo sapiens
tgcctgcacctttcgg

SEQ ID NO: 4156407 - DNA, 14 bp, Homo sapiens
tgcctgcagagaga

SEQ ID NO: 4156408 - DNA, 15 bp, Homo sapiens
tgcctgcagagagaa

SEQ ID NO: 4156409 - DNA, 18 bp, Homo sapiens
tgcctgccccaaacaaat

SEQ ID NO: 4156410 - DNA, 16 bp, Homo sapiens
tgcctgcgcctgctgc

SEQ ID NO: 4156411 - DNA, 19 bp, Homo sapiens
tgcctgcgcctgctgcctg

SEQ ID NO: 4156412 - DNA, 15 bp, Homo sapiens
tgcctgctgagatga

SEQ ID NO: 4156413 - DNA, 13 bp, Homo sapiens
tgcctgctgggct

SEQ ID NO: 4156414 - DNA, 17 bp, Homo sapiens
tgcctgcttggcccggc

SEQ ID NO: 4156415 - DNA, 18 bp, Homo sapiens
tgcctggagacgtggaac

SEQ ID NO: 4156416 - DNA, 22 bp, Homo sapiens
tgcctggagacgtggaacctct

SEQ ID NO: 4156417 - DNA, 21 bp, Homo sapiens
tgcctggcacttactggtcct

SEQ ID NO: 4156418 - DNA, 13 bp, Homo sapiens
tgcctggccagat

SEQ ID NO: 4156419 - DNA, 14 bp, Homo sapiens
tgcctggccccagc

SEQ ID NO: 4156420 - DNA, 12 bp, Homo sapiens
tgcctggccccc

SEQ ID NO: 4156421 - DNA, 12 bp, Homo sapiens
tgcctggcctct

SEQ ID NO: 4156422 - DNA, 15 bp, Homo sapiens
tgcctgggaatgtat

SEQ ID NO: 4156423 - DNA, 19 bp, Homo sapiens
tgcctgggggagagaggca

SEQ ID NO: 4156424 - DNA, 19 bp, Homo sapiens
tgcctggtcccagagtggc

SEQ ID NO: 4156425 - DNA, 18 bp, Homo sapiens
tgcctggtgaatggcctt

SEQ ID NO: 4156426 - DNA, 20 bp, Homo sapiens
tgcctggtgcttccaaatat

SEQ ID NO: 4156427 - DNA, 18 bp, Homo sapiens
tgcctggtggtcagatgc

SEQ ID NO: 4156428 - DNA, 16 bp, Homo sapiens
tgcctgtccagcctgg

SEQ ID NO: 4156429 - DNA, 20 bp, Homo sapiens
tgcctgtccagcctgggcag

SEQ ID NO: 4156430 - DNA, 16 bp, Homo sapiens
tgcctgtcccaccccc

SEQ ID NO: 4156431 - DNA, 19 bp, Homo sapiens
tgcctgtcccacccccacc

SEQ ID NO: 4156432 - DNA, 16 bp, Homo sapiens
tgcctgtctgccccag

SEQ ID NO: 4156433 - DNA, 17 bp, Homo sapiens
tgcctgtctggctcagg

SEQ ID NO: 4156434 - DNA, 12 bp, Homo sapiens
tgcctgtgccaa

SEQ ID NO: 4156435 - DNA, 16 bp, Homo sapiens
tgcctgtgccacccac

SEQ ID NO: 4156436 - DNA, 15 bp, Homo sapiens
tgcctgtgtatggaa

SEQ ID NO: 4156437 - DNA, 18 bp, Homo sapiens
tgccttaaaaccaaagag

SEQ ID NO: 4156438 - DNA, 14 bp, Homo sapiens
tgccttaaaatgga

SEQ ID NO: 4156439 - DNA, 20 bp, Homo sapiens
tgccttaaaatggaattgaa

SEQ ID NO: 4156440 - DNA, 22 bp, Homo sapiens
tgccttaaacactcaccttcta

SEQ ID NO: 4156441 - DNA, 14 bp, Homo sapiens
tgccttagaacctt

SEQ ID NO: 4156442 - DNA, 17 bp, Homo sapiens
tgccttagaacctttct

SEQ ID NO: 4156443 - DNA, 21 bp, Homo sapiens
tgccttagaacctttcttaca

SEQ ID NO: 4156444 - DNA, 21 bp, Homo sapiens
tgccttaggcctacctgatgg

SEQ ID NO: 4156445 - DNA, 15 bp, Homo sapiens
tgccttagtctcagt

SEQ ID NO: 4156446 - DNA, 14 bp, Homo sapiens
tgccttatcttgca

SEQ ID NO: 4156447 - DNA, 17 bp, Homo sapiens
tgccttcagctctacag

SEQ ID NO: 4156448 - DNA, 18 bp, Homo sapiens
tgccttcagctctacagc

SEQ ID NO: 4156449 - DNA, 14 bp, Homo sapiens
tgccttcagctgtt

SEQ ID NO: 4156450 - DNA, 18 bp, Homo sapiens
tgccttcagctgttgcag

SEQ ID NO: 4156451 - DNA, 13 bp, Homo sapiens
tgccttccctagc

SEQ ID NO: 4156452 - DNA, 18 bp, Homo sapiens
tgccttcctttctccagg

SEQ ID NO: 4156453 - DNA, 19 bp, Homo sapiens
tgccttcctttctccagga

SEQ ID NO: 4156454 - DNA, 20 bp, Homo sapiens
tgccttcctttctccaggac

SEQ ID NO: 4156455 - DNA, 18 bp, Homo sapiens
tgccttctcctctctggg

SEQ ID NO: 4156456 - DNA, 21 bp, Homo sapiens
tgccttctcctctctgggcct

SEQ ID NO: 4156457 - DNA, 20 bp, Homo sapiens
tgccttctccttccccagga

SEQ ID NO: 4156458 - DNA, 22 bp, Homo sapiens
tgccttctccttccccaggatg

SEQ ID NO: 4156459 - DNA, 22 bp, Homo sapiens
tgccttctttagaccctcgggc

SEQ ID NO: 4156460 - DNA, 14 bp, Homo sapiens
tgccttctttccat

SEQ ID NO: 4156461 - DNA, 20 bp, Homo sapiens
tgccttctttgaagaaggtg

SEQ ID NO: 4156462 - DNA, 14 bp, Homo sapiens
tgccttcttttgta

SEQ ID NO: 4156463 - DNA, 23 bp, Homo sapiens
tgccttgaacctgtgagtaaata

SEQ ID NO: 4156464 - DNA, 15 bp, Homo sapiens
tgccttgatgattta

SEQ ID NO: 4156465 - DNA, 13 bp, Homo sapiens
tgccttgcagcca

SEQ ID NO: 4156466 - DNA, 13 bp, Homo sapiens
tgccttgctgttt

SEQ ID NO: 4156467 - DNA, 22 bp, Homo sapiens
tgccttgctgtttgtcctgaga

SEQ ID NO: 4156468 - DNA, 23 bp, Homo sapiens
tgccttggaaatagaaagaagcc

SEQ ID NO: 4156469 - DNA, 17 bp, Homo sapiens
tgccttggctcagacat

SEQ ID NO: 4156470 - DNA, 14 bp, Homo sapiens
tgccttgggccttg

SEQ ID NO: 4156471 - DNA, 17 bp, Homo sapiens
tgccttgggctgctcct

SEQ ID NO: 4156472 - DNA, 19 bp, Homo sapiens
tgccttgggctgctcctca

SEQ ID NO: 4156473 - DNA, 19 bp, Homo sapiens
tgccttgtgtacagttatt

SEQ ID NO: 4156474 - DNA, 17 bp, Homo sapiens
tgccttgtttgagtttt

SEQ ID NO: 4156475 - DNA, 18 bp, Homo sapiens
tgcctttctgggagcaga

SEQ ID NO: 4156476 - DNA, 20 bp, Homo sapiens
tgcctttctgggagcagaaa

SEQ ID NO: 4156477 - DNA, 16 bp, Homo sapiens
tgcctttcttctgccc

SEQ ID NO: 4156478 - DNA, 13 bp, Homo sapiens
tgcctttctttgc

SEQ ID NO: 4156479 - DNA, 12 bp, Homo sapiens
tgcctttgagac

SEQ ID NO: 4156480 - DNA, 13 bp, Homo sapiens
tgcctttgagaca

SEQ ID NO: 4156481 - DNA, 23 bp, Homo sapiens
tgcctttgagacagtttcttagc

SEQ ID NO: 4156482 - DNA, 11 bp, Homo sapiens
tgcctttgtaa

SEQ ID NO: 4156483 - DNA, 12 bp, Homo sapiens
tgcctttgtaag

SEQ ID NO: 4156484 - DNA, 17 bp, Homo sapiens
tgccttttgctgcgcac

SEQ ID NO: 4156485 - DNA, 17 bp, Homo sapiens
tgccttttgtgtgatgc

SEQ ID NO: 4156486 - DNA, 22 bp, Homo sapiens
tgcgagacgcacacagctgagc

SEQ ID NO: 4156487 - DNA, 23 bp, Homo sapiens
tgcgagacgcacacagctgagca

SEQ ID NO: 4156488 - DNA, 18 bp, Homo sapiens
tgcgagtccaaggccagt

SEQ ID NO: 4156489 - DNA, 15 bp, Homo sapiens
tgcgcaccaatgccc

SEQ ID NO: 4156490 - DNA, 20 bp, Homo sapiens
tgcgcaccaatgcccagcag

SEQ ID NO: 4156491 - DNA, 14 bp, Homo sapiens
tgcgcagtgccttg

SEQ ID NO: 4156492 - DNA, 20 bp, Homo sapiens
tgcgcataggcctgctttgt

SEQ ID NO: 4156493 - DNA, 16 bp, Homo sapiens
tgcgcccttaccttcc

SEQ ID NO: 4156494 - DNA, 12 bp, Homo sapiens
tgcgcctcagcc

SEQ ID NO: 4156495 - DNA, 18 bp, Homo sapiens
tgcgcctcagccctcagt

SEQ ID NO: 4156496 - DNA, 17 bp, Homo sapiens
tgcgcctgcaggcagag

SEQ ID NO: 4156497 - DNA, 12 bp, Homo sapiens
tgcgcctgctgc

SEQ ID NO: 4156498 - DNA, 18 bp, Homo sapiens
tgcgcctgtgatgctggg

SEQ ID NO: 4156499 - DNA, 16 bp, Homo sapiens
tgcgcgctatcccctc

SEQ ID NO: 4156500 - DNA, 23 bp, Homo sapiens
tgcgcgtgcacgtggagagctgg

SEQ ID NO: 4156501 - DNA, 23 bp, Homo sapiens
tgcgctggtggaccacaggcatc

SEQ ID NO: 4156502 - DNA, 14 bp, Homo sapiens
tgcgcttgcttttc

SEQ ID NO: 4156503 - DNA, 22 bp, Homo sapiens
tgcgctttattgcccatgggat

SEQ ID NO: 4156504 - DNA, 23 bp, Homo sapiens
tgcgctttattgcccatgggata

SEQ ID NO: 4156505 - DNA, 14 bp, Homo sapiens
tgcggacgggctgt

SEQ ID NO: 4156506 - DNA, 13 bp, Homo sapiens
tgcggccccagga

SEQ ID NO: 4156507 - DNA, 15 bp, Homo sapiens
tgcggccccaggagg

SEQ ID NO: 4156508 - DNA, 17 bp, Homo sapiens
tgcggggcagggccttc

SEQ ID NO: 4156509 - DNA, 17 bp, Homo sapiens
tgcggtagccagcacac

SEQ ID NO: 4156510 - DNA, 24 bp, Homo sapiens
tgcggtcaggctgggcagccccag

SEQ ID NO: 4156511 - DNA, 23 bp, Homo sapiens
tgcgtacgtttcctgagaagtgt

SEQ ID NO: 4156512 - DNA, 14 bp, Homo sapiens
tgcgtcctcctcac

SEQ ID NO: 4156513 - DNA, 22 bp, Homo sapiens
tgcgtcctcctcacctcatgcc

SEQ ID NO: 4156514 - DNA, 16 bp, Homo sapiens
tgcgtcttggtgtaat

SEQ ID NO: 4156515 - DNA, 22 bp, Homo sapiens
tgcgtcttggtgtaatttgaag

SEQ ID NO: 4156516 - DNA, 17 bp, Homo sapiens
tgcgtgccgtgtgagtg

SEQ ID NO: 4156517 - DNA, 15 bp, Homo sapiens
tgcgtggaaaaagac

SEQ ID NO: 4156518 - DNA, 21 bp, Homo sapiens
tgcgtgtgtagagttaagaag

SEQ ID NO: 4156519 - DNA, 13 bp, Homo sapiens
tgcgttactaatt

SEQ ID NO: 4156520 - DNA, 13 bp, Homo sapiens
tgcgtttttacag

SEQ ID NO: 4156521 - DNA, 14 bp, Homo sapiens
tgctaaaattctat

SEQ ID NO: 4156522 - DNA, 17 bp, Homo sapiens
tgctaaaattctataga

SEQ ID NO: 4156523 - DNA, 23 bp, Homo sapiens
tgctaaaattctatagagataga

SEQ ID NO: 4156524 - DNA, 21 bp, Homo sapiens
tgctaaatggtcgcccaggag

SEQ ID NO: 4156525 - DNA, 22 bp, Homo sapiens
tgctaaatggtcgcccaggaga

SEQ ID NO: 4156526 - DNA, 20 bp, Homo sapiens
tgctaaattctatgttaaat

SEQ ID NO: 4156527 - DNA, 23 bp, Homo sapiens
tgctaacaaagacaaaagtctgt

SEQ ID NO: 4156528 - DNA, 14 bp, Homo sapiens
tgctaacctggaaa

SEQ ID NO: 4156529 - DNA, 15 bp, Homo sapiens
tgctaacctggaaag

SEQ ID NO: 4156530 - DNA, 22 bp, Homo sapiens
tgctaagaagcgagcactgacc

SEQ ID NO: 4156531 - DNA, 14 bp, Homo sapiens
tgctaagcatattt

SEQ ID NO: 4156532 - DNA, 16 bp, Homo sapiens
tgctaaggctcctcct

SEQ ID NO: 4156533 - DNA, 15 bp, Homo sapiens
tgctaataaactgtt

SEQ ID NO: 4156534 - DNA, 23 bp, Homo sapiens
tgctaatacctcttactttgctt

SEQ ID NO: 4156535 - DNA, 22 bp, Homo sapiens
tgctaatcagggaggtcatttt

SEQ ID NO: 4156536 - DNA, 22 bp, Homo sapiens
tgctaatcatgtgggtgagcca

SEQ ID NO: 4156537 - DNA, 19 bp, Homo sapiens
tgctacaacttcagcagta

SEQ ID NO: 4156538 - DNA, 20 bp, Homo sapiens
tgctacagatgatagaggat

SEQ ID NO: 4156539 - DNA, 12 bp, Homo sapiens
tgctacaggagg

SEQ ID NO: 4156540 - DNA, 13 bp, Homo sapiens
tgctacaggaggg

SEQ ID NO: 4156541 - DNA, 18 bp, Homo sapiens
tgctacaggaggggtctc

SEQ ID NO: 4156542 - DNA, 18 bp, Homo sapiens
tgctaccacggcctcctt

SEQ ID NO: 4156543 - DNA, 21 bp, Homo sapiens
tgctaccacggcctcctttcc

SEQ ID NO: 4156544 - DNA, 23 bp, Homo sapiens
tgctacccatgactttatatgga

SEQ ID NO: 4156545 - DNA, 21 bp, Homo sapiens
tgctaccgccctgggctggac

SEQ ID NO: 4156546 - DNA, 22 bp, Homo sapiens
tgctaccgccctgggctggact

SEQ ID NO: 4156547 - DNA, 20 bp, Homo sapiens
tgctactgattgtttcattg

SEQ ID NO: 4156548 - DNA, 15 bp, Homo sapiens
tgctactgcactcca

SEQ ID NO: 4156549 - DNA, 19 bp, Homo sapiens
tgctacttaattcctttct

SEQ ID NO: 4156550 - DNA, 15 bp, Homo sapiens
tgctagaagctgtaa

SEQ ID NO: 4156551 - DNA, 20 bp, Homo sapiens
tgctagcaaatggcagaacc

SEQ ID NO: 4156552 - DNA, 17 bp, Homo sapiens
tgctagcttgacacagt

SEQ ID NO: 4156553 - DNA, 20 bp, Homo sapiens
tgctagcttgacacagtcag

SEQ ID NO: 4156554 - DNA, 19 bp, Homo sapiens
tgctaggcgagtgccagga

SEQ ID NO: 4156555 - DNA, 19 bp, Homo sapiens
tgctaggcgctggggagac

SEQ ID NO: 4156556 - DNA, 16 bp, Homo sapiens
tgctaggttaattcca

SEQ ID NO: 4156557 - DNA, 12 bp, Homo sapiens
tgctagtatttg

SEQ ID NO: 4156558 - DNA, 15 bp, Homo sapiens
tgctagtatttgaat

SEQ ID NO: 4156559 - DNA, 18 bp, Homo sapiens
tgctagtatttgaattaa

SEQ ID NO: 4156560 - DNA, 22 bp, Homo sapiens
tgctagtatttgaattaaaact

SEQ ID NO: 4156561 - DNA, 22 bp, Homo sapiens
tgctagtctgccctatggattt

SEQ ID NO: 4156562 - DNA, 22 bp, Homo sapiens
tgctagtgggccctctctctgg

SEQ ID NO: 4156563 - DNA, 16 bp, Homo sapiens
tgctataatcattagt

SEQ ID NO: 4156564 - DNA, 12 bp, Homo sapiens
tgctatcaatga

SEQ ID NO: 4156565 - DNA, 22 bp, Homo sapiens
tgctatcgcaccactgtgtatt

SEQ ID NO: 4156566 - DNA, 19 bp, Homo sapiens
tgctatgttactattttct

SEQ ID NO: 4156567 - DNA, 17 bp, Homo sapiens
tgctattgtaaatatgt

SEQ ID NO: 4156568 - DNA, 15 bp, Homo sapiens
tgctcaaaaaatgag

SEQ ID NO: 4156569 - DNA, 14 bp, Homo sapiens
tgctcaaccactgt

SEQ ID NO: 4156570 - DNA, 16 bp, Homo sapiens
tgctcaaccactgtgg

SEQ ID NO: 4156571 - DNA, 18 bp, Homo sapiens
tgctcaaccactgtggcg

SEQ ID NO: 4156572 - DNA, 15 bp, Homo sapiens
tgctcaagaagacat

SEQ ID NO: 4156573 - DNA, 22 bp, Homo sapiens
tgctcaagaagacatggagact

SEQ ID NO: 4156574 - DNA, 21 bp, Homo sapiens
tgctcaataaatgattcttag

SEQ ID NO: 4156575 - DNA, 16 bp, Homo sapiens
tgctcaccagccctgc

SEQ ID NO: 4156576 - DNA, 19 bp, Homo sapiens
tgctcaccgcccatcaggg

SEQ ID NO: 4156577 - DNA, 13 bp, Homo sapiens
tgctcacctctag

SEQ ID NO: 4156578 - DNA, 22 bp, Homo sapiens
tgctcagaacttgctgctgtct

SEQ ID NO: 4156579 - DNA, 14 bp, Homo sapiens
tgctcagagaagga

SEQ ID NO: 4156580 - DNA, 15 bp, Homo sapiens
tgctcagcagtgaga

SEQ ID NO: 4156581 - DNA, 17 bp, Homo sapiens
tgctcagcagtgagagc

SEQ ID NO: 4156582 - DNA, 12 bp, Homo sapiens
tgctcagctcct

SEQ ID NO: 4156583 - DNA, 20 bp, Homo sapiens
tgctcagctctgggccattc

SEQ ID NO: 4156584 - DNA, 19 bp, Homo sapiens
tgctcaggcttgaaatgca

SEQ ID NO: 4156585 - DNA, 16 bp, Homo sapiens
tgctcagggtcaattt

SEQ ID NO: 4156586 - DNA, 20 bp, Homo sapiens
tgctcagggtcaatttcttt

SEQ ID NO: 4156587 - DNA, 15 bp, Homo sapiens
tgctcattaattttg

SEQ ID NO: 4156588 - DNA, 16 bp, Homo sapiens
tgctcattttctggtt

SEQ ID NO: 4156589 - DNA, 15 bp, Homo sapiens
tgctccaccagcagc

SEQ ID NO: 4156590 - DNA, 22 bp, Homo sapiens
tgctccacccttggcctgtctc

SEQ ID NO: 4156591 - DNA, 16 bp, Homo sapiens
tgctccacgaagcctt

SEQ ID NO: 4156592 - DNA, 12 bp, Homo sapiens
tgctccagaaga

SEQ ID NO: 4156593 - DNA, 12 bp, Homo sapiens
tgctccagacct

SEQ ID NO: 4156594 - DNA, 14 bp, Homo sapiens
tgctccagacctga

SEQ ID NO: 4156595 - DNA, 21 bp, Homo sapiens
tgctccagacctgatcctgga

SEQ ID NO: 4156596 - DNA, 13 bp, Homo sapiens
tgctcccagcagc

SEQ ID NO: 4156597 - DNA, 17 bp, Homo sapiens
tgctcccagcagcccta

SEQ ID NO: 4156598 - DNA, 13 bp, Homo sapiens
tgctcccagcctg

SEQ ID NO: 4156599 - DNA, 14 bp, Homo sapiens
tgctcccagcctgc

SEQ ID NO: 4156600 - DNA, 17 bp, Homo sapiens
tgctcccagcctgctga

SEQ ID NO: 4156601 - DNA, 21 bp, Homo sapiens
tgctcccagcctgctgagagc

SEQ ID NO: 4156602 - DNA, 22 bp, Homo sapiens
tgctcccagcctgctgagagcc

SEQ ID NO: 4156603 - DNA, 17 bp, Homo sapiens
tgctcccattcctccct

SEQ ID NO: 4156604 - DNA, 18 bp, Homo sapiens
tgctcccattcctccctc

SEQ ID NO: 4156605 - DNA, 20 bp, Homo sapiens
tgctcccattcctccctccg

SEQ ID NO: 4156606 - DNA, 18 bp, Homo sapiens
tgctccccagccctggct

SEQ ID NO: 4156607 - DNA, 23 bp, Homo sapiens
tgctccccagccctggctctgca

SEQ ID NO: 4156608 - DNA, 16 bp, Homo sapiens
tgctccctcagcctca

SEQ ID NO: 4156609 - DNA, 17 bp, Homo sapiens
tgctccctcagcctcag

SEQ ID NO: 4156610 - DNA, 18 bp, Homo sapiens
tgctccctcagcctcaga

SEQ ID NO: 4156611 - DNA, 13 bp, Homo sapiens
tgctccctccaga

SEQ ID NO: 4156612 - DNA, 13 bp, Homo sapiens
tgctccctcccct

SEQ ID NO: 4156613 - DNA, 19 bp, Homo sapiens
tgctccctcccctgccctg

SEQ ID NO: 4156614 - DNA, 21 bp, Homo sapiens
tgctccctccgggtcttccta

SEQ ID NO: 4156615 - DNA, 23 bp, Homo sapiens
tgctccctgctttggctgagggg

SEQ ID NO: 4156616 - DNA, 17 bp, Homo sapiens
tgctccctgtgtccacc

SEQ ID NO: 4156617 - DNA, 21 bp, Homo sapiens
tgctccgctgctccttggctt

SEQ ID NO: 4156618 - DNA, 17 bp, Homo sapiens
tgctcctagcagacaga

SEQ ID NO: 4156619 - DNA, 17 bp, Homo sapiens
tgctcctcttgattcct

SEQ ID NO: 4156620 - DNA, 13 bp, Homo sapiens
tgctcctgcagca

SEQ ID NO: 4156621 - DNA, 15 bp, Homo sapiens
tgctcctgcttttct

SEQ ID NO: 4156622 - DNA, 14 bp, Homo sapiens
tgctcctggagcct

SEQ ID NO: 4156623 - DNA, 21 bp, Homo sapiens
tgctcctggagcctttgaata

SEQ ID NO: 4156624 - DNA, 14 bp, Homo sapiens
tgctcgccctgcgg

SEQ ID NO: 4156625 - DNA, 20 bp, Homo sapiens
tgctctacccatgagcctgc

SEQ ID NO: 4156626 - DNA, 17 bp, Homo sapiens
tgctctatctctcaaaa

SEQ ID NO: 4156627 - DNA, 16 bp, Homo sapiens
tgctctcagctccggg

SEQ ID NO: 4156628 - DNA, 18 bp, Homo sapiens
tgctctccaagtctcagt

SEQ ID NO: 4156629 - DNA, 20 bp, Homo sapiens
tgctctctcaaattgtcagc

SEQ ID NO: 4156630 - DNA, 12 bp, Homo sapiens
tgctctgagagc

SEQ ID NO: 4156631 - DNA, 22 bp, Homo sapiens
tgctctggaataaagttgcaga

SEQ ID NO: 4156632 - DNA, 23 bp, Homo sapiens
tgctctggttgtttctgttccaa

SEQ ID NO: 4156633 - DNA, 19 bp, Homo sapiens
tgctctgtcccccaggctg

SEQ ID NO: 4156634 - DNA, 23 bp, Homo sapiens
tgctcttaagaaactatgaagat

SEQ ID NO: 4156635 - DNA, 19 bp, Homo sapiens
tgctcttactacactgagg

SEQ ID NO: 4156636 - DNA, 21 bp, Homo sapiens
tgctcttactacactgaggag

SEQ ID NO: 4156637 - DNA, 19 bp, Homo sapiens
tgctcttgcagttgctctg

SEQ ID NO: 4156638 - DNA, 18 bp, Homo sapiens
tgctcttggctgacccct

SEQ ID NO: 4156639 - DNA, 22 bp, Homo sapiens
tgctcttgtcccacgtgtcttc

SEQ ID NO: 4156640 - DNA, 23 bp, Homo sapiens
tgctcttgtttttattaatttat

SEQ ID NO: 4156641 - DNA, 19 bp, Homo sapiens
tgctctttcccacccagcc

SEQ ID NO: 4156642 - DNA, 12 bp, Homo sapiens
tgctctttctct

SEQ ID NO: 4156643 - DNA, 13 bp, Homo sapiens
tgctctttctctg

SEQ ID NO: 4156644 - DNA, 16 bp, Homo sapiens
tgctctttctctgcca

SEQ ID NO: 4156645 - DNA, 18 bp, Homo sapiens
tgctctttgacaactaaa

SEQ ID NO: 4156646 - DNA, 13 bp, Homo sapiens
tgctgaacacaca

SEQ ID NO: 4156647 - DNA, 13 bp, Homo sapiens
tgctgaagggacc

SEQ ID NO: 4156648 - DNA, 18 bp, Homo sapiens
tgctgaatatacagcagg

SEQ ID NO: 4156649 - DNA, 15 bp, Homo sapiens
tgctgaatgcaggga

SEQ ID NO: 4156650 - DNA, 17 bp, Homo sapiens
tgctgaatggttttcaa

SEQ ID NO: 4156651 - DNA, 22 bp, Homo sapiens
tgctgaccaattgtgctgccat

SEQ ID NO: 4156652 - DNA, 23 bp, Homo sapiens
tgctgaccaattgtgctgccatt

SEQ ID NO: 4156653 - DNA, 16 bp, Homo sapiens
tgctgactgtactcct

SEQ ID NO: 4156654 - DNA, 19 bp, Homo sapiens
tgctgactgtactcctccc

SEQ ID NO: 4156655 - DNA, 22 bp, Homo sapiens
tgctgactgtactcctcccagg

SEQ ID NO: 4156656 - DNA, 14 bp, Homo sapiens
tgctgagagaaata

SEQ ID NO: 4156657 - DNA, 22 bp, Homo sapiens
tgctgagagggctcgaggggtg

SEQ ID NO: 4156658 - DNA, 16 bp, Homo sapiens
tgctgagattcttcag

SEQ ID NO: 4156659 - DNA, 16 bp, Homo sapiens
tgctgagcctctgctc

SEQ ID NO: 4156660 - DNA, 17 bp, Homo sapiens
tgctgagcctctgctcc

SEQ ID NO: 4156661 - DNA, 20 bp, Homo sapiens
tgctgagcctctgctcccca

SEQ ID NO: 4156662 - DNA, 15 bp, Homo sapiens
tgctgagctgtttat

SEQ ID NO: 4156663 - DNA, 13 bp, Homo sapiens
tgctgaggccagg

SEQ ID NO: 4156664 - DNA, 20 bp, Homo sapiens
tgctgagtccgacctggcct

SEQ ID NO: 4156665 - DNA, 14 bp, Homo sapiens
tgctgagttggcct

SEQ ID NO: 4156666 - DNA, 16 bp, Homo sapiens
tgctgagttggcctgg

SEQ ID NO: 4156667 - DNA, 19 bp, Homo sapiens
tgctgatcagagttcctcc

SEQ ID NO: 4156668 - DNA, 19 bp, Homo sapiens
tgctgatcatcgccagagg

SEQ ID NO: 4156669 - DNA, 22 bp, Homo sapiens
tgctgatgacccccccagcttc

SEQ ID NO: 4156670 - DNA, 13 bp, Homo sapiens
tgctgatggcttg

SEQ ID NO: 4156671 - DNA, 16 bp, Homo sapiens
tgctgatggcttgaca

SEQ ID NO: 4156672 - DNA, 21 bp, Homo sapiens
tgctgatggcttgacatgtgc

SEQ ID NO: 4156673 - DNA, 18 bp, Homo sapiens
tgctgatttggtgaccaa

SEQ ID NO: 4156674 - DNA, 19 bp, Homo sapiens
tgctgcacccaactactga

SEQ ID NO: 4156675 - DNA, 23 bp, Homo sapiens
tgctgcaccctgcgcctccagag

SEQ ID NO: 4156676 - DNA, 14 bp, Homo sapiens
tgctgcactaattg

SEQ ID NO: 4156677 - DNA, 22 bp, Homo sapiens
tgctgcagagaaacttaagcaa

SEQ ID NO: 4156678 - DNA, 13 bp, Homo sapiens
tgctgcagagatc

SEQ ID NO: 4156679 - DNA, 23 bp, Homo sapiens
tgctgcagattagttctttttgc

SEQ ID NO: 4156680 - DNA, 21 bp, Homo sapiens
tgctgcaggacttgagaagac

SEQ ID NO: 4156681 - DNA, 21 bp, Homo sapiens
tgctgcatagctctattttaa

SEQ ID NO: 4156682 - DNA, 19 bp, Homo sapiens
tgctgccagtaccagcccc

SEQ ID NO: 4156683 - DNA, 17 bp, Homo sapiens
tgctgccagtgcagcca

SEQ ID NO: 4156684 - DNA, 23 bp, Homo sapiens
tgctgccatgacagaggctgcac

SEQ ID NO: 4156685 - DNA, 20 bp, Homo sapiens
tgctgcccccaccccgggga

SEQ ID NO: 4156686 - DNA, 22 bp, Homo sapiens
tgctgcccccaccccggggacc

SEQ ID NO: 4156687 - DNA, 21 bp, Homo sapiens
tgctgcccctgcagttggcag

SEQ ID NO: 4156688 - DNA, 15 bp, Homo sapiens
tgctgcccctgcctt

SEQ ID NO: 4156689 - DNA, 22 bp, Homo sapiens
tgctgcgcaccaatgcccagca

SEQ ID NO: 4156690 - DNA, 18 bp, Homo sapiens
tgctgcgcctgcaggcag

SEQ ID NO: 4156691 - DNA, 18 bp, Homo sapiens
tgctgcggaggagctgcc

SEQ ID NO: 4156692 - DNA, 16 bp, Homo sapiens
tgctgctaccgccctg

SEQ ID NO: 4156693 - DNA, 15 bp, Homo sapiens
tgctgctacttaatt

SEQ ID NO: 4156694 - DNA, 19 bp, Homo sapiens
tgctgctatcctgccaaaa

SEQ ID NO: 4156695 - DNA, 22 bp, Homo sapiens
tgctgctgcacccaactactga

SEQ ID NO: 4156696 - DNA, 14 bp, Homo sapiens
tgctgctgcccctt

SEQ ID NO: 4156697 - DNA, 15 bp, Homo sapiens
tgctgctgcgccctt

SEQ ID NO: 4156698 - DNA, 12 bp, Homo sapiens
tgctgctgctgc

SEQ ID NO: 4156699 - DNA, 15 bp, Homo sapiens
tgctgctgctgcacc

SEQ ID NO: 4156700 - DNA, 13 bp, Homo sapiens
tgctgctgtccct

SEQ ID NO: 4156701 - DNA, 13 bp, Homo sapiens
tgctgctgtgcgt

SEQ ID NO: 4156702 - DNA, 20 bp, Homo sapiens
tgctgcttccggtagggagg

SEQ ID NO: 4156703 - DNA, 14 bp, Homo sapiens
tgctggaagtctcc

SEQ ID NO: 4156704 - DNA, 19 bp, Homo sapiens
tgctggaagtctccatgaa

SEQ ID NO: 4156705 - DNA, 16 bp, Homo sapiens
tgctggaattctaaca

SEQ ID NO: 4156706 - DNA, 12 bp, Homo sapiens
tgctggagaggt

SEQ ID NO: 4156707 - DNA, 14 bp, Homo sapiens
tgctggagccctgt

SEQ ID NO: 4156708 - DNA, 17 bp, Homo sapiens
tgctggaggcctcaggt

SEQ ID NO: 4156709 - DNA, 21 bp, Homo sapiens
tgctggaggcctcaggtgctg

SEQ ID NO: 4156710 - DNA, 15 bp, Homo sapiens
tgctggataaaatga

SEQ ID NO: 4156711 - DNA, 16 bp, Homo sapiens
tgctggatattttcaa

SEQ ID NO: 4156712 - DNA, 22 bp, Homo sapiens
tgctggatcacagctgctttct

SEQ ID NO: 4156713 - DNA, 23 bp, Homo sapiens
tgctggatcacagctgctttctg

SEQ ID NO: 4156714 - DNA, 13 bp, Homo sapiens
tgctggccaaata

SEQ ID NO: 4156715 - DNA, 18 bp, Homo sapiens
tgctggccaaatagcaaa

SEQ ID NO: 4156716 - DNA, 13 bp, Homo sapiens
tgctggccagcac

SEQ ID NO: 4156717 - DNA, 15 bp, Homo sapiens
tgctggccagcaccc

SEQ ID NO: 4156718 - DNA, 16 bp, Homo sapiens
tgctggccagcaccct

SEQ ID NO: 4156719 - DNA, 20 bp, Homo sapiens
tgctggcccagggcccagag

SEQ ID NO: 4156720 - DNA, 22 bp, Homo sapiens
tgctggcccagggcccagagcc

SEQ ID NO: 4156721 - DNA, 19 bp, Homo sapiens
tgctggctcacagtacagc

SEQ ID NO: 4156722 - DNA, 21 bp, Homo sapiens
tgctggctgcccagacccctc

SEQ ID NO: 4156723 - DNA, 21 bp, Homo sapiens
tgctggcttccagcttcaggc

SEQ ID NO: 4156724 - DNA, 16 bp, Homo sapiens
tgctgggaccagagcc

SEQ ID NO: 4156725 - DNA, 17 bp, Homo sapiens
tgctgggaggagggaga

SEQ ID NO: 4156726 - DNA, 20 bp, Homo sapiens
tgctgggaggagggagaggg

SEQ ID NO: 4156727 - DNA, 13 bp, Homo sapiens
tgctgggcaatga

SEQ ID NO: 4156728 - DNA, 17 bp, Homo sapiens
tgctgggccactgggga

SEQ ID NO: 4156729 - DNA, 14 bp, Homo sapiens
tgctgggctgggcc

SEQ ID NO: 4156730 - DNA, 15 bp, Homo sapiens
tgctgggctgggccc

SEQ ID NO: 4156731 - DNA, 15 bp, Homo sapiens
tgctggggcaggggg

SEQ ID NO: 4156732 - DNA, 21 bp, Homo sapiens
tgctgggtataagcagagagg

SEQ ID NO: 4156733 - DNA, 16 bp, Homo sapiens
tgctggtaacagtggc

SEQ ID NO: 4156734 - DNA, 17 bp, Homo sapiens
tgctggtgccagggtgg

SEQ ID NO: 4156735 - DNA, 22 bp, Homo sapiens
tgctggttttcctaaatgcagt

SEQ ID NO: 4156736 - DNA, 16 bp, Homo sapiens
tgctgtacatctattt

SEQ ID NO: 4156737 - DNA, 13 bp, Homo sapiens
tgctgtacccaga

SEQ ID NO: 4156738 - DNA, 16 bp, Homo sapiens
tgctgtacccagatgc

SEQ ID NO: 4156739 - DNA, 22 bp, Homo sapiens
tgctgtatatggaattctttta

SEQ ID NO: 4156740 - DNA, 22 bp, Homo sapiens
tgctgtatgctgatcatcgcca

SEQ ID NO: 4156741 - DNA, 14 bp, Homo sapiens
tgctgtcattgctt

SEQ ID NO: 4156742 - DNA, 20 bp, Homo sapiens
tgctgtccccttggcaggtc

SEQ ID NO: 4156743 - DNA, 14 bp, Homo sapiens
tgctgtcctgatct

SEQ ID NO: 4156744 - DNA, 16 bp, Homo sapiens
tgctgtcctgatctgt

SEQ ID NO: 4156745 - DNA, 19 bp, Homo sapiens
tgctgtctctgctcgccct

SEQ ID NO: 4156746 - DNA, 15 bp, Homo sapiens
tgctgtcttctggac

SEQ ID NO: 4156747 - DNA, 19 bp, Homo sapiens
tgctgtgaggaatgctctg

SEQ ID NO: 4156748 - DNA, 23 bp, Homo sapiens
tgctgtgaggaatgctctgtgcc

SEQ ID NO: 4156749 - DNA, 18 bp, Homo sapiens
tgctgtgagggaggggaa

SEQ ID NO: 4156750 - DNA, 22 bp, Homo sapiens
tgctgtgatacgatgcttcaag

SEQ ID NO: 4156751 - DNA, 13 bp, Homo sapiens
tgctgtggaagca

SEQ ID NO: 4156752 - DNA, 12 bp, Homo sapiens
tgctgtggccag

SEQ ID NO: 4156753 - DNA, 23 bp, Homo sapiens
tgctgtggccagggtgagagctg

SEQ ID NO: 4156754 - DNA, 17 bp, Homo sapiens
tgctgtgggcagcaccc

SEQ ID NO: 4156755 - DNA, 19 bp, Homo sapiens
tgctgtgggcagcaccctc

SEQ ID NO: 4156756 - DNA, 21 bp, Homo sapiens
tgctgtgggcagcaccctccc

SEQ ID NO: 4156757 - DNA, 12 bp, Homo sapiens
tgctgtgtaaaa

SEQ ID NO: 4156758 - DNA, 23 bp, Homo sapiens
tgctgttaactgttaactatgac

SEQ ID NO: 4156759 - DNA, 22 bp, Homo sapiens
tgctgttctcttgggaactgaa

SEQ ID NO: 4156760 - DNA, 18 bp, Homo sapiens
tgctgtttcacaatacct

SEQ ID NO: 4156761 - DNA, 15 bp, Homo sapiens
tgcttaaaataagca

SEQ ID NO: 4156762 - DNA, 17 bp, Homo sapiens
tgcttaaaataagcagg

SEQ ID NO: 4156763 - DNA, 19 bp, Homo sapiens
tgcttaaaataagcaggtg

SEQ ID NO: 4156764 - DNA, 16 bp, Homo sapiens
tgcttaaacaaagtga

SEQ ID NO: 4156765 - DNA, 20 bp, Homo sapiens
tgcttaaactaaataatgaa

SEQ ID NO: 4156766 - DNA, 20 bp, Homo sapiens
tgcttaaatcagttggagtt

SEQ ID NO: 4156767 - DNA, 16 bp, Homo sapiens
tgcttaaatttcttat

SEQ ID NO: 4156768 - DNA, 20 bp, Homo sapiens
tgcttaatttctaaagataa

SEQ ID NO: 4156769 - DNA, 16 bp, Homo sapiens
tgcttacacatctcag

SEQ ID NO: 4156770 - DNA, 17 bp, Homo sapiens
tgcttacacatctcaga

SEQ ID NO: 4156771 - DNA, 12 bp, Homo sapiens
tgcttacatttt

SEQ ID NO: 4156772 - DNA, 17 bp, Homo sapiens
tgcttacatttttacaa

SEQ ID NO: 4156773 - DNA, 23 bp, Homo sapiens
tgcttactaagctttgccagctg

SEQ ID NO: 4156774 - DNA, 19 bp, Homo sapiens
tgcttagaatccaaacttg

SEQ ID NO: 4156775 - DNA, 17 bp, Homo sapiens
tgcttagagactatcaa

SEQ ID NO: 4156776 - DNA, 13 bp, Homo sapiens
tgcttatacactt

SEQ ID NO: 4156777 - DNA, 18 bp, Homo sapiens
tgcttatgaatatttata

SEQ ID NO: 4156778 - DNA, 14 bp, Homo sapiens
tgcttattgttcca

SEQ ID NO: 4156779 - DNA, 21 bp, Homo sapiens
tgcttattgttccaagacatt

SEQ ID NO: 4156780 - DNA, 17 bp, Homo sapiens
tgcttcaaatccatcca

SEQ ID NO: 4156781 - DNA, 23 bp, Homo sapiens
tgcttcaagagaaaatgcggtta

SEQ ID NO: 4156782 - DNA, 18 bp, Homo sapiens
tgcttcatagtattggag

SEQ ID NO: 4156783 - DNA, 22 bp, Homo sapiens
tgcttcatagtattggagcaca

SEQ ID NO: 4156784 - DNA, 17 bp, Homo sapiens
tgcttcatgctcagccc

SEQ ID NO: 4156785 - DNA, 15 bp, Homo sapiens
tgcttcattttggag

SEQ ID NO: 4156786 - DNA, 17 bp, Homo sapiens
tgcttccaatcttgctt

SEQ ID NO: 4156787 - DNA, 12 bp, Homo sapiens
tgcttcccagag

SEQ ID NO: 4156788 - DNA, 17 bp, Homo sapiens
tgcttcccagagggagc

SEQ ID NO: 4156789 - DNA, 19 bp, Homo sapiens
tgcttcccagagggagcag

SEQ ID NO: 4156790 - DNA, 15 bp, Homo sapiens
tgcttccccttttgc

SEQ ID NO: 4156791 - DNA, 18 bp, Homo sapiens
tgcttccccttttgccaa

SEQ ID NO: 4156792 - DNA, 21 bp, Homo sapiens
tgcttccggtagggaggcagc

SEQ ID NO: 4156793 - DNA, 14 bp, Homo sapiens
tgcttcctgatgct

SEQ ID NO: 4156794 - DNA, 20 bp, Homo sapiens
tgcttcctgatgctgggcaa

SEQ ID NO: 4156795 - DNA, 21 bp, Homo sapiens
tgcttctctagctctctaggc

SEQ ID NO: 4156796 - DNA, 14 bp, Homo sapiens
tgcttctgaactca

SEQ ID NO: 4156797 - DNA, 13 bp, Homo sapiens
tgcttctgggaga

SEQ ID NO: 4156798 - DNA, 16 bp, Homo sapiens
tgcttctgtatttcct

SEQ ID NO: 4156799 - DNA, 20 bp, Homo sapiens
tgcttctgtatttccttgga

SEQ ID NO: 4156800 - DNA, 15 bp, Homo sapiens
tgcttcttactgata

SEQ ID NO: 4156801 - DNA, 16 bp, Homo sapiens
tgcttgaaattactgt

SEQ ID NO: 4156802 - DNA, 14 bp, Homo sapiens
tgcttgagaatcct

SEQ ID NO: 4156803 - DNA, 16 bp, Homo sapiens
tgcttgagcccaggag

SEQ ID NO: 4156804 - DNA, 22 bp, Homo sapiens
tgcttgatccagaagagcccat

SEQ ID NO: 4156805 - DNA, 17 bp, Homo sapiens
tgcttgatgaagcaagg

SEQ ID NO: 4156806 - DNA, 13 bp, Homo sapiens
tgcttgcaggagg

SEQ ID NO: 4156807 - DNA, 19 bp, Homo sapiens
tgcttgcctgcgttttgga

SEQ ID NO: 4156808 - DNA, 18 bp, Homo sapiens
tgcttggcccggccggcc

SEQ ID NO: 4156809 - DNA, 23 bp, Homo sapiens
tgcttgggaatgaaattaacaca

SEQ ID NO: 4156810 - DNA, 19 bp, Homo sapiens
tgcttggtgctggtttatt

SEQ ID NO: 4156811 - DNA, 22 bp, Homo sapiens
tgcttgtaatttaaacatttgt

SEQ ID NO: 4156812 - DNA, 16 bp, Homo sapiens
tgcttgtcattccaga

SEQ ID NO: 4156813 - DNA, 17 bp, Homo sapiens
tgcttgtcattgactct

SEQ ID NO: 4156814 - DNA, 19 bp, Homo sapiens
tgcttgttccctctccctg

SEQ ID NO: 4156815 - DNA, 16 bp, Homo sapiens
tgcttgttgcatttcc

SEQ ID NO: 4156816 - DNA, 18 bp, Homo sapiens
tgcttgtttatgatattt

SEQ ID NO: 4156817 - DNA, 12 bp, Homo sapiens
tgcttgttttat

SEQ ID NO: 4156818 - DNA, 19 bp, Homo sapiens
tgctttaaagggcctgcct

SEQ ID NO: 4156819 - DNA, 22 bp, Homo sapiens
tgctttagcttgaaaaggtgac

SEQ ID NO: 4156820 - DNA, 19 bp, Homo sapiens
tgctttcaattacaaagca

SEQ ID NO: 4156821 - DNA, 15 bp, Homo sapiens
tgctttcctgggcct

SEQ ID NO: 4156822 - DNA, 21 bp, Homo sapiens
tgctttctatgctgtttgtag

SEQ ID NO: 4156823 - DNA, 16 bp, Homo sapiens
tgctttctgttccaaa

SEQ ID NO: 4156824 - DNA, 22 bp, Homo sapiens
tgctttctgttccaaattcagt

SEQ ID NO: 4156825 - DNA, 16 bp, Homo sapiens
tgctttcttacctact

SEQ ID NO: 4156826 - DNA, 16 bp, Homo sapiens
tgctttctttgagttt

SEQ ID NO: 4156827 - DNA, 20 bp, Homo sapiens
tgctttgaagtagctctttt

SEQ ID NO: 4156828 - DNA, 12 bp, Homo sapiens
tgctttgcaaac

SEQ ID NO: 4156829 - DNA, 20 bp, Homo sapiens
tgctttgcatctttgttact

SEQ ID NO: 4156830 - DNA, 15 bp, Homo sapiens
tgctttgggaagccg

SEQ ID NO: 4156831 - DNA, 14 bp, Homo sapiens
tgctttgggctgcc

SEQ ID NO: 4156832 - DNA, 19 bp, Homo sapiens
tgctttgggctgccctggt

SEQ ID NO: 4156833 - DNA, 21 bp, Homo sapiens
tgctttgggctgccctggtgc

SEQ ID NO: 4156834 - DNA, 16 bp, Homo sapiens
tgctttgtaaattgtg

SEQ ID NO: 4156835 - DNA, 14 bp, Homo sapiens
tgctttgtctcctc

SEQ ID NO: 4156836 - DNA, 12 bp, Homo sapiens
tgcttttaatta

SEQ ID NO: 4156837 - DNA, 16 bp, Homo sapiens
tgcttttaattaaata

SEQ ID NO: 4156838 - DNA, 23 bp, Homo sapiens
tgcttttatatggcccagccttg

SEQ ID NO: 4156839 - DNA, 16 bp, Homo sapiens
tgcttttattttgaaa

SEQ ID NO: 4156840 - DNA, 18 bp, Homo sapiens
tgcttttctaagatacat

SEQ ID NO: 4156841 - DNA, 16 bp, Homo sapiens
tgcttttctgccctgg

SEQ ID NO: 4156842 - DNA, 22 bp, Homo sapiens
tgctttttcttgtttgtttaaa

SEQ ID NO: 4156843 - DNA, 14 bp, Homo sapiens
tgcttttttaaata

SEQ ID NO: 4156844 - DNA, 12 bp, Homo sapiens
tggaaaaaaaca

SEQ ID NO: 4156845 - DNA, 15 bp, Homo sapiens
tggaaaaaaacataa

SEQ ID NO: 4156846 - DNA, 18 bp, Homo sapiens
tggaaaaaaacataaaaa

SEQ ID NO: 4156847 - DNA, 16 bp, Homo sapiens
tggaaaaatggttgat

SEQ ID NO: 4156848 - DNA, 14 bp, Homo sapiens
tggaaaacctcctt

SEQ ID NO: 4156849 - DNA, 19 bp, Homo sapiens
tggaaaagaatacagaaag

SEQ ID NO: 4156850 - DNA, 14 bp, Homo sapiens
tggaaaataaacat

SEQ ID NO: 4156851 - DNA, 16 bp, Homo sapiens
tggaaaataaattatt

SEQ ID NO: 4156852 - DNA, 15 bp, Homo sapiens
tggaaacaatgtgga

SEQ ID NO: 4156853 - DNA, 17 bp, Homo sapiens
tggaaacaatgtggagt

SEQ ID NO: 4156854 - DNA, 19 bp, Homo sapiens
tggaaacctgtctgaggtt

SEQ ID NO: 4156855 - DNA, 14 bp, Homo sapiens
tggaaactgctaaa

SEQ ID NO: 4156856 - DNA, 15 bp, Homo sapiens
tggaaactgctaaat

SEQ ID NO: 4156857 - DNA, 14 bp, Homo sapiens
tggaaactgctccc

SEQ ID NO: 4156858 - DNA, 20 bp, Homo sapiens
tggaaactggactcacattc

SEQ ID NO: 4156859 - DNA, 18 bp, Homo sapiens
tggaaagatagagattgt

SEQ ID NO: 4156860 - DNA, 21 bp, Homo sapiens
tggaaagcactttttggctga

SEQ ID NO: 4156861 - DNA, 20 bp, Homo sapiens
tggaaagcgattcactgtat

SEQ ID NO: 4156862 - DNA, 13 bp, Homo sapiens
tggaaaggggaga

SEQ ID NO: 4156863 - DNA, 15 bp, Homo sapiens
tggaaagtgaatttg

SEQ ID NO: 4156864 - DNA, 21 bp, Homo sapiens
tggaaagtgaatttgaatgaa

SEQ ID NO: 4156865 - DNA, 17 bp, Homo sapiens
tggaaataaactgtgca

SEQ ID NO: 4156866 - DNA, 14 bp, Homo sapiens
tggaaatacacagt

SEQ ID NO: 4156867 - DNA, 14 bp, Homo sapiens
tggaaatagaaaga

SEQ ID NO: 4156868 - DNA, 21 bp, Homo sapiens
tggaacagaatgttttactgt

SEQ ID NO: 4156869 - DNA, 19 bp, Homo sapiens
tggaacagcgggagacctg

SEQ ID NO: 4156870 - DNA, 18 bp, Homo sapiens
tggaacataaaaaggaca

SEQ ID NO: 4156871 - DNA, 20 bp, Homo sapiens
tggaacataaaaaggacatc

SEQ ID NO: 4156872 - DNA, 13 bp, Homo sapiens
tggaacattggaa

SEQ ID NO: 4156873 - DNA, 17 bp, Homo sapiens
tggaacattggaatgtt

SEQ ID NO: 4156874 - DNA, 12 bp, Homo sapiens
tggaaccagccc

SEQ ID NO: 4156875 - DNA, 14 bp, Homo sapiens
tggaaccagcccca

SEQ ID NO: 4156876 - DNA, 18 bp, Homo sapiens
tggaacctcagcctggcc

SEQ ID NO: 4156877 - DNA, 23 bp, Homo sapiens
tggaacctcagcctggccagaca

SEQ ID NO: 4156878 - DNA, 20 bp, Homo sapiens
tggaacctctgtctcatcct

SEQ ID NO: 4156879 - DNA, 13 bp, Homo sapiens
tggaaccttgctg

SEQ ID NO: 4156880 - DNA, 14 bp, Homo sapiens
tggaaccttgctgt

SEQ ID NO: 4156881 - DNA, 15 bp, Homo sapiens
tggaaccttgctgtc

SEQ ID NO: 4156882 - DNA, 16 bp, Homo sapiens
tggaaccttgctgtcc

SEQ ID NO: 4156883 - DNA, 18 bp, Homo sapiens
tggaaccttgctgtcctg

SEQ ID NO: 4156884 - DNA, 12 bp, Homo sapiens
tggaagaaggga

SEQ ID NO: 4156885 - DNA, 16 bp, Homo sapiens
tggaagagtgtgtgtg

SEQ ID NO: 4156886 - DNA, 19 bp, Homo sapiens
tggaagatagttttctcct

SEQ ID NO: 4156887 - DNA, 14 bp, Homo sapiens
tggaagattcagct

SEQ ID NO: 4156888 - DNA, 16 bp, Homo sapiens
tggaagccctggagac

SEQ ID NO: 4156889 - DNA, 20 bp, Homo sapiens
tggaaggaacatggagctgt

SEQ ID NO: 4156890 - DNA, 19 bp, Homo sapiens
tggaaggaccacattttat

SEQ ID NO: 4156891 - DNA, 21 bp, Homo sapiens
tggaaggcccagcaccaccct

SEQ ID NO: 4156892 - DNA, 15 bp, Homo sapiens
tggaagggctgggtg

SEQ ID NO: 4156893 - DNA, 16 bp, Homo sapiens
tggaagtgtatttatt

SEQ ID NO: 4156894 - DNA, 22 bp, Homo sapiens
tggaagtgtatttattttacag

SEQ ID NO: 4156895 - DNA, 17 bp, Homo sapiens
tggaataaagttgcaga

SEQ ID NO: 4156896 - DNA, 16 bp, Homo sapiens
tggaataatttgtaaa

SEQ ID NO: 4156897 - DNA, 14 bp, Homo sapiens
tggaatataaggaa

SEQ ID NO: 4156898 - DNA, 21 bp, Homo sapiens
tggaatataaggaaagcaata

SEQ ID NO: 4156899 - DNA, 18 bp, Homo sapiens
tggaatcccactgtatga

SEQ ID NO: 4156900 - DNA, 21 bp, Homo sapiens
tggaatcttctctttgacaat

SEQ ID NO: 4156901 - DNA, 22 bp, Homo sapiens
tggaatcttctctttgacaatt

SEQ ID NO: 4156902 - DNA, 17 bp, Homo sapiens
tggaatgagtgtgcatg

SEQ ID NO: 4156903 - DNA, 16 bp, Homo sapiens
tggaatggtttgggaa

SEQ ID NO: 4156904 - DNA, 21 bp, Homo sapiens
tggaattaaccatttaataaa

SEQ ID NO: 4156905 - DNA, 17 bp, Homo sapiens
tggaattaacctggtgc

SEQ ID NO: 4156906 - DNA, 21 bp, Homo sapiens
tggaattaacctggtgctgga

SEQ ID NO: 4156907 - DNA, 23 bp, Homo sapiens
tggaattattgtaccattttcta

SEQ ID NO: 4156908 - DNA, 15 bp, Homo sapiens
tggaattgatttgca

SEQ ID NO: 4156909 - DNA, 18 bp, Homo sapiens
tggaattgatttgcattg

SEQ ID NO: 4156910 - DNA, 18 bp, Homo sapiens
tggaatttgtaacctcag

SEQ ID NO: 4156911 - DNA, 16 bp, Homo sapiens
tggacaaactggagtc

SEQ ID NO: 4156912 - DNA, 22 bp, Homo sapiens
tggacaaactggagtctggagt

SEQ ID NO: 4156913 - DNA, 16 bp, Homo sapiens
tggacaacttatttaa

SEQ ID NO: 4156914 - DNA, 23 bp, Homo sapiens
tggacaacttatttaaaaatatt

SEQ ID NO: 4156915 - DNA, 16 bp, Homo sapiens
tggacaatcatgaaat

SEQ ID NO: 4156916 - DNA, 16 bp, Homo sapiens
tggacacattggaatg

SEQ ID NO: 4156917 - DNA, 18 bp, Homo sapiens
tggacactaatgcagcca

SEQ ID NO: 4156918 - DNA, 16 bp, Homo sapiens
tggacactcagacctg

SEQ ID NO: 4156919 - DNA, 14 bp, Homo sapiens
tggacagcagaagc

SEQ ID NO: 4156920 - DNA, 18 bp, Homo sapiens
tggacagccagtgacctt

SEQ ID NO: 4156921 - DNA, 14 bp, Homo sapiens
tggacagccccacc

SEQ ID NO: 4156922 - DNA, 14 bp, Homo sapiens
tggacaggagtcag

SEQ ID NO: 4156923 - DNA, 19 bp, Homo sapiens
tggacaggagtcagtgtct

SEQ ID NO: 4156924 - DNA, 12 bp, Homo sapiens
tggacaggccca

SEQ ID NO: 4156925 - DNA, 14 bp, Homo sapiens
tggacaggcccagc

SEQ ID NO: 4156926 - DNA, 14 bp, Homo sapiens
tggacaggctggct

SEQ ID NO: 4156927 - DNA, 23 bp, Homo sapiens
tggacagtttaccagttgccttt

SEQ ID NO: 4156928 - DNA, 19 bp, Homo sapiens
tggacatagatattttcac

SEQ ID NO: 4156929 - DNA, 16 bp, Homo sapiens
tggaccaacctgctct

SEQ ID NO: 4156930 - DNA, 18 bp, Homo sapiens
tggaccaacctgctctgt

SEQ ID NO: 4156931 - DNA, 21 bp, Homo sapiens
tggaccaacctgctctgtccc

SEQ ID NO: 4156932 - DNA, 19 bp, Homo sapiens
tggaccagtggtttccagt

SEQ ID NO: 4156933 - DNA, 15 bp, Homo sapiens
tggaccatgccagat

SEQ ID NO: 4156934 - DNA, 19 bp, Homo sapiens
tggacctatgtcctaagga

SEQ ID NO: 4156935 - DNA, 22 bp, Homo sapiens
tggacctatgtcctaaggacac

SEQ ID NO: 4156936 - DNA, 18 bp, Homo sapiens
tggacctgcctcctgcct

SEQ ID NO: 4156937 - DNA, 16 bp, Homo sapiens
tggaccttgagaccac

SEQ ID NO: 4156938 - DNA, 13 bp, Homo sapiens
tggaccttttaaa

SEQ ID NO: 4156939 - DNA, 19 bp, Homo sapiens
tggactaaatatctgtcat

SEQ ID NO: 4156940 - DNA, 14 bp, Homo sapiens
tggactaagcaatt

SEQ ID NO: 4156941 - DNA, 14 bp, Homo sapiens
tggactacaaaata

SEQ ID NO: 4156942 - DNA, 17 bp, Homo sapiens
tggactacaaaatacaa

SEQ ID NO: 4156943 - DNA, 15 bp, Homo sapiens
tggactcagcagtga

SEQ ID NO: 4156944 - DNA, 13 bp, Homo sapiens
tggactctgcatc

SEQ ID NO: 4156945 - DNA, 13 bp, Homo sapiens
tggactctgcccc

SEQ ID NO: 4156946 - DNA, 15 bp, Homo sapiens
tggactgaagcctgc

SEQ ID NO: 4156947 - DNA, 15 bp, Homo sapiens
tggactgcgctggac

SEQ ID NO: 4156948 - DNA, 17 bp, Homo sapiens
tggactggaggcccctg

SEQ ID NO: 4156949 - DNA, 23 bp, Homo sapiens
tggactggaggcccctggagcca

SEQ ID NO: 4156950 - DNA, 15 bp, Homo sapiens
tggactggcccctgg

SEQ ID NO: 4156951 - DNA, 20 bp, Homo sapiens
tggactggcccctgggtcag

SEQ ID NO: 4156952 - DNA, 19 bp, Homo sapiens
tggactggctagagtcctc

SEQ ID NO: 4156953 - DNA, 20 bp, Homo sapiens
tggactggctagagtcctca

SEQ ID NO: 4156954 - DNA, 15 bp, Homo sapiens
tggactgggaggagg

SEQ ID NO: 4156955 - DNA, 21 bp, Homo sapiens
tggactgtgatgccacacaga

SEQ ID NO: 4156956 - DNA, 20 bp, Homo sapiens
tggactgttttctctcggct

SEQ ID NO: 4156957 - DNA, 22 bp, Homo sapiens
tggactgttttctctcggctcc

SEQ ID NO: 4156958 - DNA, 17 bp, Homo sapiens
tggacttatttcttcaa

SEQ ID NO: 4156959 - DNA, 18 bp, Homo sapiens
tggacttatttcttcaaa

SEQ ID NO: 4156960 - DNA, 18 bp, Homo sapiens
tggacttctacctgccct

SEQ ID NO: 4156961 - DNA, 14 bp, Homo sapiens
tggacttgtatatt

SEQ ID NO: 4156962 - DNA, 18 bp, Homo sapiens
tggacttgtatatttgta

SEQ ID NO: 4156963 - DNA, 16 bp, Homo sapiens
tggactttcaaaatta

SEQ ID NO: 4156964 - DNA, 18 bp, Homo sapiens
tggacttttcgttaacat

SEQ ID NO: 4156965 - DNA, 20 bp, Homo sapiens
tggacttttcgttaacattg

SEQ ID NO: 4156966 - DNA, 19 bp, Homo sapiens
tggagaatactttgcttca

SEQ ID NO: 4156967 - DNA, 20 bp, Homo sapiens
tggagaatactttgcttcat

SEQ ID NO: 4156968 - DNA, 19 bp, Homo sapiens
tggagaccctgcaaacaga

SEQ ID NO: 4156969 - DNA, 14 bp, Homo sapiens
tggagaccctgcca

SEQ ID NO: 4156970 - DNA, 21 bp, Homo sapiens
tggagaccctgccacagccag

SEQ ID NO: 4156971 - DNA, 22 bp, Homo sapiens
tggagacgtggaacctctgtct

SEQ ID NO: 4156972 - DNA, 19 bp, Homo sapiens
tggagactcctgccctgtt

SEQ ID NO: 4156973 - DNA, 18 bp, Homo sapiens
tggagactgatggccagg

SEQ ID NO: 4156974 - DNA, 23 bp, Homo sapiens
tggagagaagtttctggccctgg

SEQ ID NO: 4156975 - DNA, 21 bp, Homo sapiens
tggagagcccggcgcccctgc

SEQ ID NO: 4156976 - DNA, 17 bp, Homo sapiens
tggagagtttcctgaaa

SEQ ID NO: 4156977 - DNA, 18 bp, Homo sapiens
tggagatgctgagggtgt

SEQ ID NO: 4156978 - DNA, 15 bp, Homo sapiens
tggagcacatgttac

SEQ ID NO: 4156979 - DNA, 21 bp, Homo sapiens
tggagcacatgttactgcttc

SEQ ID NO: 4156980 - DNA, 21 bp, Homo sapiens
tggagcactctgagtttacca

SEQ ID NO: 4156981 - DNA, 22 bp, Homo sapiens
tggagcactctgagtttaccat

SEQ ID NO: 4156982 - DNA, 18 bp, Homo sapiens
tggagcaggactctattt

SEQ ID NO: 4156983 - DNA, 18 bp, Homo sapiens
tggagcatgggcctggcc

SEQ ID NO: 4156984 - DNA, 13 bp, Homo sapiens
tggagccagctcc

SEQ ID NO: 4156985 - DNA, 23 bp, Homo sapiens
tggagccagggagcggccgcctg

SEQ ID NO: 4156986 - DNA, 17 bp, Homo sapiens
tggagcccccagcagag

SEQ ID NO: 4156987 - DNA, 18 bp, Homo sapiens
tggagccccttcgggagc

SEQ ID NO: 4156988 - DNA, 23 bp, Homo sapiens
tggagccccttcgggagcagggc

SEQ ID NO: 4156989 - DNA, 13 bp, Homo sapiens
tggagcctgacag

SEQ ID NO: 4156990 - DNA, 23 bp, Homo sapiens
tggagcggagaggaagccagctg

SEQ ID NO: 4156991 - DNA, 13 bp, Homo sapiens
tggagctcagccc

SEQ ID NO: 4156992 - DNA, 14 bp, Homo sapiens
tggagctttctgta

SEQ ID NO: 4156993 - DNA, 16 bp, Homo sapiens
tggagcttttttcttt

SEQ ID NO: 4156994 - DNA, 11 bp, Homo sapiens
tggaggaaaaa

SEQ ID NO: 4156995 - DNA, 23 bp, Homo sapiens
tggaggaaaaccaagccgtggct

SEQ ID NO: 4156996 - DNA, 13 bp, Homo sapiens
tggaggaaagcaa

SEQ ID NO: 4156997 - DNA, 16 bp, Homo sapiens
tggaggaaagggagga

SEQ ID NO: 4156998 - DNA, 19 bp, Homo sapiens
tggaggaaggattgtaaaa

SEQ ID NO: 4156999 - DNA, 13 bp, Homo sapiens
tggaggaggaagg

SEQ ID NO: 4157000 - DNA, 15 bp, Homo sapiens
tggaggaggaaggca

SEQ ID NO: 4157001 - DNA, 17 bp, Homo sapiens
tggaggaggaaggcaag

SEQ ID NO: 4157002 - DNA, 14 bp, Homo sapiens
tggaggcactttag

SEQ ID NO: 4157003 - DNA, 22 bp, Homo sapiens
tggaggccaccgggacagacct

SEQ ID NO: 4157004 - DNA, 23 bp, Homo sapiens
tggaggccaccgggacagacctg

SEQ ID NO: 4157005 - DNA, 12 bp, Homo sapiens
tggaggcccagg

SEQ ID NO: 4157006 - DNA, 14 bp, Homo sapiens
tggaggcccaggct

SEQ ID NO: 4157007 - DNA, 17 bp, Homo sapiens
tggaggcctcaggtgct

SEQ ID NO: 4157008 - DNA, 20 bp, Homo sapiens
tggaggcctcaggtgctgtc

SEQ ID NO: 4157009 - DNA, 18 bp, Homo sapiens
tggaggccttccagctgc

SEQ ID NO: 4157010 - DNA, 20 bp, Homo sapiens
tggaggcttcctgcgtcctc

SEQ ID NO: 4157011 - DNA, 22 bp, Homo sapiens
tggaggcttcctgcgtcctcct

SEQ ID NO: 4157012 - DNA, 22 bp, Homo sapiens
tggagggacaagtggactcagg

SEQ ID NO: 4157013 - DNA, 24 bp, Homo sapiens
tggagggacttttaatcagtgaag

SEQ ID NO: 4157014 - DNA, 12 bp, Homo sapiens
tggagggcacag

SEQ ID NO: 4157015 - DNA, 13 bp, Homo sapiens
tggagggcacagc

SEQ ID NO: 4157016 - DNA, 13 bp, Homo sapiens
tggaggggtgtgg

SEQ ID NO: 4157017 - DNA, 14 bp, Homo sapiens
tggaggggtgtggc

SEQ ID NO: 4157018 - DNA, 17 bp, Homo sapiens
tggaggggtgtggcagt

SEQ ID NO: 4157019 - DNA, 15 bp, Homo sapiens
tggaggtcacagctg

SEQ ID NO: 4157020 - DNA, 19 bp, Homo sapiens
tggaggtcacagctggatc

SEQ ID NO: 4157021 - DNA, 22 bp, Homo sapiens
tggaggtcacattcaggaagat

SEQ ID NO: 4157022 - DNA, 13 bp, Homo sapiens
tggaggtgggcat

SEQ ID NO: 4157023 - DNA, 14 bp, Homo sapiens
tggaggtgggcatg

SEQ ID NO: 4157024 - DNA, 21 bp, Homo sapiens
tggaggtggggcgaggcaggc

SEQ ID NO: 4157025 - DNA, 22 bp, Homo sapiens
tggaggtggggcgaggcaggcc

SEQ ID NO: 4157026 - DNA, 18 bp, Homo sapiens
tggaggttgaagccaagt

SEQ ID NO: 4157027 - DNA, 22 bp, Homo sapiens
tggaggttgaagccaagtgggg

SEQ ID NO: 4157028 - DNA, 18 bp, Homo sapiens
tggagtactatatttaca

SEQ ID NO: 4157029 - DNA, 21 bp, Homo sapiens
tggagtagacaaaaggaaagg

SEQ ID NO: 4157030 - DNA, 14 bp, Homo sapiens
tggagtctccctct

SEQ ID NO: 4157031 - DNA, 16 bp, Homo sapiens
tggagtctccctctga

SEQ ID NO: 4157032 - DNA, 17 bp, Homo sapiens
tggagtctccctctgat

SEQ ID NO: 4157033 - DNA, 20 bp, Homo sapiens
tggagtgagtcacctgctcc

SEQ ID NO: 4157034 - DNA, 22 bp, Homo sapiens
tggagtgagtcacctgctccag

SEQ ID NO: 4157035 - DNA, 15 bp, Homo sapiens
tggagtgcagggagg

SEQ ID NO: 4157036 - DNA, 18 bp, Homo sapiens
tggagtgcccaccctggg

SEQ ID NO: 4157037 - DNA, 14 bp, Homo sapiens
tggagtgggcagag

SEQ ID NO: 4157038 - DNA, 15 bp, Homo sapiens
tggagtgtgtattgt

SEQ ID NO: 4157039 - DNA, 17 bp, Homo sapiens
tggagttacattaatgt

SEQ ID NO: 4157040 - DNA, 13 bp, Homo sapiens
tggagttccttat

SEQ ID NO: 4157041 - DNA, 15 bp, Homo sapiens
tggagttgatctgga

SEQ ID NO: 4157042 - DNA, 21 bp, Homo sapiens
tggagtttcatgtacaagatg

SEQ ID NO: 4157043 - DNA, 16 bp, Homo sapiens
tggataaactgagcct

SEQ ID NO: 4157044 - DNA, 16 bp, Homo sapiens
tggatattattagaaa

SEQ ID NO: 4157045 - DNA, 15 bp, Homo sapiens
tggatatttttgtac

SEQ ID NO: 4157046 - DNA, 14 bp, Homo sapiens
tggatccagcactg

SEQ ID NO: 4157047 - DNA, 17 bp, Homo sapiens
tggatcccctctgtcta

SEQ ID NO: 4157048 - DNA, 23 bp, Homo sapiens
tggatcccctctgtctacaaata

SEQ ID NO: 4157049 - DNA, 14 bp, Homo sapiens
tggatccctgccct

SEQ ID NO: 4157050 - DNA, 18 bp, Homo sapiens
tggatcgctaagctggct

SEQ ID NO: 4157051 - DNA, 19 bp, Homo sapiens
tggatcgctaagctggctc

SEQ ID NO: 4157052 - DNA, 15 bp, Homo sapiens
tggatctccaaggac

SEQ ID NO: 4157053 - DNA, 19 bp, Homo sapiens
tggatctccccactctagg

SEQ ID NO: 4157054 - DNA, 18 bp, Homo sapiens
tggatctgtccaaggaaa

SEQ ID NO: 4157055 - DNA, 20 bp, Homo sapiens
tggatctgtccaaggaaact

SEQ ID NO: 4157056 - DNA, 18 bp, Homo sapiens
tggatcttcaatggcttt

SEQ ID NO: 4157057 - DNA, 20 bp, Homo sapiens
tggatgaaaaatatttctga

SEQ ID NO: 4157058 - DNA, 22 bp, Homo sapiens
tggatgaagattctcctgtgct

SEQ ID NO: 4157059 - DNA, 19 bp, Homo sapiens
tggatgacagggcagagca

SEQ ID NO: 4157060 - DNA, 12 bp, Homo sapiens
tggatgactgtt

SEQ ID NO: 4157061 - DNA, 20 bp, Homo sapiens
tggatgccaatattaaatct

SEQ ID NO: 4157062 - DNA, 20 bp, Homo sapiens
tggatgccacagcccagctt

SEQ ID NO: 4157063 - DNA, 15 bp, Homo sapiens
tggatgcccagagga

SEQ ID NO: 4157064 - DNA, 18 bp, Homo sapiens
tggatggccgtggatgcg

SEQ ID NO: 4157065 - DNA, 23 bp, Homo sapiens
tggatgggagtgggcacctcaga

SEQ ID NO: 4157066 - DNA, 23 bp, Homo sapiens
tggatgggggaactcagatccag

SEQ ID NO: 4157067 - DNA, 13 bp, Homo sapiens
tggattaaattta

SEQ ID NO: 4157068 - DNA, 16 bp, Homo sapiens
tggattattcatttaa

SEQ ID NO: 4157069 - DNA, 19 bp, Homo sapiens
tggattattcatttaaaat

SEQ ID NO: 4157070 - DNA, 17 bp, Homo sapiens
tggattcattctcataa

SEQ ID NO: 4157071 - DNA, 16 bp, Homo sapiens
tggattcattgtctct

SEQ ID NO: 4157072 - DNA, 19 bp, Homo sapiens
tggattctcagatatttat

SEQ ID NO: 4157073 - DNA, 22 bp, Homo sapiens
tggattctcttagctactgtat

SEQ ID NO: 4157074 - DNA, 13 bp, Homo sapiens
tggattgagggta

SEQ ID NO: 4157075 - DNA, 17 bp, Homo sapiens
tggattgcacgtggcct

SEQ ID NO: 4157076 - DNA, 16 bp, Homo sapiens
tggattggattattta

SEQ ID NO: 4157077 - DNA, 15 bp, Homo sapiens
tggatttcctttata

SEQ ID NO: 4157078 - DNA, 23 bp, Homo sapiens
tggatttgattcattttcctgtt

SEQ ID NO: 4157079 - DNA, 16 bp, Homo sapiens
tggattttctactgta

SEQ ID NO: 4157080 - DNA, 16 bp, Homo sapiens
tggatttttacaagat

SEQ ID NO: 4157081 - DNA, 19 bp, Homo sapiens
tggatttttgactctggca

SEQ ID NO: 4157082 - DNA, 20 bp, Homo sapiens
tggatttttgactctggcaa

SEQ ID NO: 4157083 - DNA, 20 bp, Homo sapiens
tggcaaaacactatgtatag

SEQ ID NO: 4157084 - DNA, 16 bp, Homo sapiens
tggcaaaagccttgtg

SEQ ID NO: 4157085 - DNA, 21 bp, Homo sapiens
tggcaaaagccttgtgtatat

SEQ ID NO: 4157086 - DNA, 16 bp, Homo sapiens
tggcaaaatatggttt

SEQ ID NO: 4157087 - DNA, 21 bp, Homo sapiens
tggcaaaatatggtttggttt

SEQ ID NO: 4157088 - DNA, 24 bp, Homo sapiens
tggcaaacgctaaagagcccttgc

SEQ ID NO: 4157089 - DNA, 16 bp, Homo sapiens
tggcaaacgggcttga

SEQ ID NO: 4157090 - DNA, 16 bp, Homo sapiens
tggcaaagcttttaga

SEQ ID NO: 4157091 - DNA, 17 bp, Homo sapiens
tggcaaagcttttagaa

SEQ ID NO: 4157092 - DNA, 21 bp, Homo sapiens
tggcaaaggacccttgagtaa

SEQ ID NO: 4157093 - DNA, 22 bp, Homo sapiens
tggcaaaggacccttgagtaag

SEQ ID NO: 4157094 - DNA, 18 bp, Homo sapiens
tggcaagagggtgacagc

SEQ ID NO: 4157095 - DNA, 17 bp, Homo sapiens
tggcaagatgaaataat

SEQ ID NO: 4157096 - DNA, 18 bp, Homo sapiens
tggcaagatgaaataatt

SEQ ID NO: 4157097 - DNA, 13 bp, Homo sapiens
tggcaagctgtga

SEQ ID NO: 4157098 - DNA, 11 bp, Homo sapiens
tggcaaggaaa

SEQ ID NO: 4157099 - DNA, 16 bp, Homo sapiens
tggcaaggaaaaacag

SEQ ID NO: 4157100 - DNA, 23 bp, Homo sapiens
tggcaaggacgcttcacaggaca

SEQ ID NO: 4157101 - DNA, 15 bp, Homo sapiens
tggcaatagtgtgtt

SEQ ID NO: 4157102 - DNA, 17 bp, Homo sapiens
tggcaatagtgtgttct

SEQ ID NO: 4157103 - DNA, 13 bp, Homo sapiens
tggcaattgtcta

SEQ ID NO: 4157104 - DNA, 14 bp, Homo sapiens
tggcacaggacatg

SEQ ID NO: 4157105 - DNA, 16 bp, Homo sapiens
tggcacaggccccctt

SEQ ID NO: 4157106 - DNA, 18 bp, Homo sapiens
tggcacagggcagtggga

SEQ ID NO: 4157107 - DNA, 21 bp, Homo sapiens
tggcaccactgcactccagcc

SEQ ID NO: 4157108 - DNA, 20 bp, Homo sapiens
tggcaccagaggtgcttctg

SEQ ID NO: 4157109 - DNA, 20 bp, Homo sapiens
tggcaccagatgcaacctca

SEQ ID NO: 4157110 - DNA, 13 bp, Homo sapiens
tggcaccatgtgc

SEQ ID NO: 4157111 - DNA, 15 bp, Homo sapiens
tggcaccatgtgcca

SEQ ID NO: 4157112 - DNA, 20 bp, Homo sapiens
tggcacccaaatcacatctc

SEQ ID NO: 4157113 - DNA, 14 bp, Homo sapiens
tggcaccccagcta

SEQ ID NO: 4157114 - DNA, 23 bp, Homo sapiens
tggcacctgcacactccatctcc

SEQ ID NO: 4157115 - DNA, 14 bp, Homo sapiens
tggcacctgtctgc

SEQ ID NO: 4157116 - DNA, 19 bp, Homo sapiens
tggcactgactgggcatag

SEQ ID NO: 4157117 - DNA, 18 bp, Homo sapiens
tggcactggatgcagaaa

SEQ ID NO: 4157118 - DNA, 21 bp, Homo sapiens
tggcactggtaggttgggaca

SEQ ID NO: 4157119 - DNA, 16 bp, Homo sapiens
tggcactttgaagggg

SEQ ID NO: 4157120 - DNA, 16 bp, Homo sapiens
tggcagaactcccaca

SEQ ID NO: 4157121 - DNA, 17 bp, Homo sapiens
tggcagaactcccacaa

SEQ ID NO: 4157122 - DNA, 18 bp, Homo sapiens
tggcagaagacaccagag

SEQ ID NO: 4157123 - DNA, 22 bp, Homo sapiens
tggcagaagacaccagagcaga

SEQ ID NO: 4157124 - DNA, 15 bp, Homo sapiens
tggcagaagggaatt

SEQ ID NO: 4157125 - DNA, 13 bp, Homo sapiens
tggcagagagaga

SEQ ID NO: 4157126 - DNA, 13 bp, Homo sapiens
tggcagatgcagc

SEQ ID NO: 4157127 - DNA, 15 bp, Homo sapiens
tggcagatgtcttcc

SEQ ID NO: 4157128 - DNA, 18 bp, Homo sapiens
tggcagatgtcttccctg

SEQ ID NO: 4157129 - DNA, 20 bp, Homo sapiens
tggcagattttacaaaagat

SEQ ID NO: 4157130 - DNA, 18 bp, Homo sapiens
tggcagccgtgccttcag

SEQ ID NO: 4157131 - DNA, 15 bp, Homo sapiens
tggcagctgtttctc

SEQ ID NO: 4157132 - DNA, 19 bp, Homo sapiens
tggcaggcacacagcagcc

SEQ ID NO: 4157133 - DNA, 21 bp, Homo sapiens
tggcaggcacacagcagcccc

SEQ ID NO: 4157134 - DNA, 23 bp, Homo sapiens
tggcaggcacacagcagcccccc

SEQ ID NO: 4157135 - DNA, 13 bp, Homo sapiens
tggcaggccagtg

SEQ ID NO: 4157136 - DNA, 16 bp, Homo sapiens
tggcaggccagtgtct

SEQ ID NO: 4157137 - DNA, 24 bp, Homo sapiens
tggcaggggagacaggagcctagc

SEQ ID NO: 4157138 - DNA, 14 bp, Homo sapiens
tggcagtatttcat

SEQ ID NO: 4157139 - DNA, 13 bp, Homo sapiens
tggcagtgacttt

SEQ ID NO: 4157140 - DNA, 20 bp, Homo sapiens
tggcataatagtcaatttct

SEQ ID NO: 4157141 - DNA, 22 bp, Homo sapiens
tggcatacgcctgtagtcctag

SEQ ID NO: 4157142 - DNA, 23 bp, Homo sapiens
tggcatatatgtgatctgggcat

SEQ ID NO: 4157143 - DNA, 22 bp, Homo sapiens
tggcatcaagaggtgggagggc

SEQ ID NO: 4157144 - DNA, 14 bp, Homo sapiens
tggcatcatggtgg

SEQ ID NO: 4157145 - DNA, 20 bp, Homo sapiens
tggcatcttagacctccaca

SEQ ID NO: 4157146 - DNA, 16 bp, Homo sapiens
tggcatctttgccttg

SEQ ID NO: 4157147 - DNA, 13 bp, Homo sapiens
tggcatgttttga

SEQ ID NO: 4157148 - DNA, 22 bp, Homo sapiens
tggcatgttttgtgcatttgta

SEQ ID NO: 4157149 - DNA, 17 bp, Homo sapiens
tggcattagaattattt

SEQ ID NO: 4157150 - DNA, 16 bp, Homo sapiens
tggccaaacatcagac

SEQ ID NO: 4157151 - DNA, 14 bp, Homo sapiens
tggccaaagtgtta

SEQ ID NO: 4157152 - DNA, 11 bp, Homo sapiens
tggccaccagt

SEQ ID NO: 4157153 - DNA, 22 bp, Homo sapiens
tggccacccgttctgctggcct

SEQ ID NO: 4157154 - DNA, 20 bp, Homo sapiens
tggccacctctctcctttgc

SEQ ID NO: 4157155 - DNA, 15 bp, Homo sapiens
tggccactcagcttc

SEQ ID NO: 4157156 - DNA, 22 bp, Homo sapiens
tggccactcagcttcctaccca

SEQ ID NO: 4157157 - DNA, 20 bp, Homo sapiens
tggccactccagacccctgg

SEQ ID NO: 4157158 - DNA, 19 bp, Homo sapiens
tggccagacgctgccgctg

SEQ ID NO: 4157159 - DNA, 14 bp, Homo sapiens
tggccagagctggg

SEQ ID NO: 4157160 - DNA, 20 bp, Homo sapiens
tggccagagctgggaggcat

SEQ ID NO: 4157161 - DNA, 17 bp, Homo sapiens
tggccagcaaggcaggt

SEQ ID NO: 4157162 - DNA, 21 bp, Homo sapiens
tggccagcaccctctcctggg

SEQ ID NO: 4157163 - DNA, 21 bp, Homo sapiens
tggccagccaacttttgcatg

SEQ ID NO: 4157164 - DNA, 16 bp, Homo sapiens
tggccagccagtgcca

SEQ ID NO: 4157165 - DNA, 17 bp, Homo sapiens
tggccagcccctggggc

SEQ ID NO: 4157166 - DNA, 20 bp, Homo sapiens
tggccaggagctcttcaggc

SEQ ID NO: 4157167 - DNA, 21 bp, Homo sapiens
tggccaggcaccccctggaga

SEQ ID NO: 4157168 - DNA, 18 bp, Homo sapiens
tggccaggcactgccttc

SEQ ID NO: 4157169 - DNA, 16 bp, Homo sapiens
tggccaggcagatctg

SEQ ID NO: 4157170 - DNA, 20 bp, Homo sapiens
tggccaggcagatctgtgcc

SEQ ID NO: 4157171 - DNA, 16 bp, Homo sapiens
tggccaggccctgaga

SEQ ID NO: 4157172 - DNA, 22 bp, Homo sapiens
tggccagggccacgctccagct

SEQ ID NO: 4157173 - DNA, 17 bp, Homo sapiens
tggccagggtgagagct

SEQ ID NO: 4157174 - DNA, 19 bp, Homo sapiens
tggccagggtgagagctgc

SEQ ID NO: 4157175 - DNA, 18 bp, Homo sapiens
tggccagtttgaagcctg

SEQ ID NO: 4157176 - DNA, 19 bp, Homo sapiens
tggccagtttgaagcctgt

SEQ ID NO: 4157177 - DNA, 22 bp, Homo sapiens
tggccagtttgaagcctgtgcc

SEQ ID NO: 4157178 - DNA, 13 bp, Homo sapiens
tggccatccctgg

SEQ ID NO: 4157179 - DNA, 15 bp, Homo sapiens
tggccatccctgggc

SEQ ID NO: 4157180 - DNA, 17 bp, Homo sapiens
tggccatccctgggccc

SEQ ID NO: 4157181 - DNA, 20 bp, Homo sapiens
tggccatccctgggcccctc

SEQ ID NO: 4157182 - DNA, 16 bp, Homo sapiens
tggcccagggcccaga

SEQ ID NO: 4157183 - DNA, 22 bp, Homo sapiens
tggcccagggcccagagcccag

SEQ ID NO: 4157184 - DNA, 19 bp, Homo sapiens
tggcccatctcagcctcct

SEQ ID NO: 4157185 - DNA, 20 bp, Homo sapiens
tggcccatctcagcctcctg

SEQ ID NO: 4157186 - DNA, 18 bp, Homo sapiens
tggccccacaccagcccc

SEQ ID NO: 4157187 - DNA, 20 bp, Homo sapiens
tggccccaccgagctggagc

SEQ ID NO: 4157188 - DNA, 21 bp, Homo sapiens
tggccccaccgagctggagcg

SEQ ID NO: 4157189 - DNA, 21 bp, Homo sapiens
tggccccaggccccagacagg

SEQ ID NO: 4157190 - DNA, 21 bp, Homo sapiens
tggccccagtgcggttcctca

SEQ ID NO: 4157191 - DNA, 12 bp, Homo sapiens
tggcccccaggg

SEQ ID NO: 4157192 - DNA, 16 bp, Homo sapiens
tggcccccaggggcag

SEQ ID NO: 4157193 - DNA, 17 bp, Homo sapiens
tggcccccaggggcagg

SEQ ID NO: 4157194 - DNA, 20 bp, Homo sapiens
tggccccgcaaggcctccag

SEQ ID NO: 4157195 - DNA, 13 bp, Homo sapiens
tggcccctcgcct

SEQ ID NO: 4157196 - DNA, 17 bp, Homo sapiens
tggcccctcgcctgtgg

SEQ ID NO: 4157197 - DNA, 14 bp, Homo sapiens
tggcccctctgacc

SEQ ID NO: 4157198 - DNA, 18 bp, Homo sapiens
tggcccctctgacctgca

SEQ ID NO: 4157199 - DNA, 14 bp, Homo sapiens
tggcccctgtgtga

SEQ ID NO: 4157200 - DNA, 14 bp, Homo sapiens
tggcccgacagcct

SEQ ID NO: 4157201 - DNA, 19 bp, Homo sapiens
tggccctaaatagcagaaa

SEQ ID NO: 4157202 - DNA, 15 bp, Homo sapiens
tggccctgcctcctg

SEQ ID NO: 4157203 - DNA, 17 bp, Homo sapiens
tggccctgcctcctggg

SEQ ID NO: 4157204 - DNA, 12 bp, Homo sapiens
tggccctggggt

SEQ ID NO: 4157205 - DNA, 13 bp, Homo sapiens
tggccctggggtc

SEQ ID NO: 4157206 - DNA, 16 bp, Homo sapiens
tggccctgtcccaggc

SEQ ID NO: 4157207 - DNA, 19 bp, Homo sapiens
tggccgagggtcctggctc

SEQ ID NO: 4157208 - DNA, 20 bp, Homo sapiens
tggccgagggtcctggctcc

SEQ ID NO: 4157209 - DNA, 19 bp, Homo sapiens
tggccgagtccaagctggg

SEQ ID NO: 4157210 - DNA, 17 bp, Homo sapiens
tggccgccccctgcccc

SEQ ID NO: 4157211 - DNA, 14 bp, Homo sapiens
tggccgtggatggc

SEQ ID NO: 4157212 - DNA, 22 bp, Homo sapiens
tggccgtggtccagctcttggc

SEQ ID NO: 4157213 - DNA, 18 bp, Homo sapiens
tggcctatccgctgccag

SEQ ID NO: 4157214 - DNA, 19 bp, Homo sapiens
tggcctatccgctgccagc

SEQ ID NO: 4157215 - DNA, 21 bp, Homo sapiens
tggcctatccgctgccagcct

SEQ ID NO: 4157216 - DNA, 17 bp, Homo sapiens
tggcctattccaggaat

SEQ ID NO: 4157217 - DNA, 16 bp, Homo sapiens
tggcctcagaccaact

SEQ ID NO: 4157218 - DNA, 14 bp, Homo sapiens
tggcctcagccctc

SEQ ID NO: 4157219 - DNA, 15 bp, Homo sapiens
tggcctcagccctca

SEQ ID NO: 4157220 - DNA, 18 bp, Homo sapiens
tggcctcagctgaatgcc

SEQ ID NO: 4157221 - DNA, 12 bp, Homo sapiens
tggcctccctgc

SEQ ID NO: 4157222 - DNA, 13 bp, Homo sapiens
tggcctccctgct

SEQ ID NO: 4157223 - DNA, 14 bp, Homo sapiens
tggcctccctgctg

SEQ ID NO: 4157224 - DNA, 19 bp, Homo sapiens
tggcctccctgctgtgcca

SEQ ID NO: 4157225 - DNA, 21 bp, Homo sapiens
tggcctctgcctccaccctcc

SEQ ID NO: 4157226 - DNA, 20 bp, Homo sapiens
tggcctctttcctcagcctt

SEQ ID NO: 4157227 - DNA, 17 bp, Homo sapiens
tggcctgaactgaggag

SEQ ID NO: 4157228 - DNA, 14 bp, Homo sapiens
tggcctgcactaat

SEQ ID NO: 4157229 - DNA, 13 bp, Homo sapiens
tggcctgcccgtg

SEQ ID NO: 4157230 - DNA, 22 bp, Homo sapiens
tggcctgcccgtgccctggtga

SEQ ID NO: 4157231 - DNA, 21 bp, Homo sapiens
tggcctggatctccccactct

SEQ ID NO: 4157232 - DNA, 17 bp, Homo sapiens
tggcctggccaggagct

SEQ ID NO: 4157233 - DNA, 19 bp, Homo sapiens
tggcctggccatttccaag

SEQ ID NO: 4157234 - DNA, 16 bp, Homo sapiens
tggcctgtctcatccc

SEQ ID NO: 4157235 - DNA, 18 bp, Homo sapiens
tggcctgtctcatcccca

SEQ ID NO: 4157236 - DNA, 24 bp, Homo sapiens
tggcctgtctcatccccaggggtc

SEQ ID NO: 4157237 - DNA, 21 bp, Homo sapiens
tggcctgtgcgatcccacccg

SEQ ID NO: 4157238 - DNA, 18 bp, Homo sapiens
tggcctgtttcaacacag

SEQ ID NO: 4157239 - DNA, 18 bp, Homo sapiens
tggccttccatttatatg

SEQ ID NO: 4157240 - DNA, 18 bp, Homo sapiens
tggccttgaaaccacctt

SEQ ID NO: 4157241 - DNA, 11 bp, Homo sapiens
tggcctttcct

SEQ ID NO: 4157242 - DNA, 21 bp, Homo sapiens
tggcctttccttccctctctg

SEQ ID NO: 4157243 - DNA, 16 bp, Homo sapiens
tggcctttgtgctgcg

SEQ ID NO: 4157244 - DNA, 24 bp, Homo sapiens
tggcctttgtgctgcgcctgcagg

SEQ ID NO: 4157245 - DNA, 21 bp, Homo sapiens
tggcgcaggtgggctggactt

SEQ ID NO: 4157246 - DNA, 19 bp, Homo sapiens
tggcgcctgctccctccag

SEQ ID NO: 4157247 - DNA, 13 bp, Homo sapiens
tggcgcttagaga

SEQ ID NO: 4157248 - DNA, 20 bp, Homo sapiens
tggcgcttagagaggacaat

SEQ ID NO: 4157249 - DNA, 17 bp, Homo sapiens
tggcgggcgcctgtagt

SEQ ID NO: 4157250 - DNA, 13 bp, Homo sapiens
tggcgtctccctc

SEQ ID NO: 4157251 - DNA, 12 bp, Homo sapiens
tggctaaagata

SEQ ID NO: 4157252 - DNA, 16 bp, Homo sapiens
tggctaataaggcttt

SEQ ID NO: 4157253 - DNA, 17 bp, Homo sapiens
tggctaatgtactgcat

SEQ ID NO: 4157254 - DNA, 19 bp, Homo sapiens
tggctaattttttgtactt

SEQ ID NO: 4157255 - DNA, 15 bp, Homo sapiens
tggctacatcccagc

SEQ ID NO: 4157256 - DNA, 18 bp, Homo sapiens
tggctacatcccagcctg

SEQ ID NO: 4157257 - DNA, 21 bp, Homo sapiens
tggctagaggccagccccacc

SEQ ID NO: 4157258 - DNA, 15 bp, Homo sapiens
tggctagagtcctca

SEQ ID NO: 4157259 - DNA, 17 bp, Homo sapiens
tggctagcgcaagacca

SEQ ID NO: 4157260 - DNA, 15 bp, Homo sapiens
tggctagtccttgtt

SEQ ID NO: 4157261 - DNA, 16 bp, Homo sapiens
tggctcaatcctctaa

SEQ ID NO: 4157262 - DNA, 22 bp, Homo sapiens
tggctcacagtacagcatgtgc

SEQ ID NO: 4157263 - DNA, 13 bp, Homo sapiens
tggctcacgcctg

SEQ ID NO: 4157264 - DNA, 19 bp, Homo sapiens
tggctcacgcctgtaatcc

SEQ ID NO: 4157265 - DNA, 16 bp, Homo sapiens
tggctcagccagcact

SEQ ID NO: 4157266 - DNA, 20 bp, Homo sapiens
tggctcagggtcaaagacag

SEQ ID NO: 4157267 - DNA, 18 bp, Homo sapiens
tggctccacacacacaaa

SEQ ID NO: 4157268 - DNA, 15 bp, Homo sapiens
tggctccagaaatgt

SEQ ID NO: 4157269 - DNA, 20 bp, Homo sapiens
tggctccagatgcagggcag

SEQ ID NO: 4157270 - DNA, 14 bp, Homo sapiens
tggctcccacaggc

SEQ ID NO: 4157271 - DNA, 20 bp, Homo sapiens
tggctcccacaggcccttcc

SEQ ID NO: 4157272 - DNA, 23 bp, Homo sapiens
tggctcccatgaccatactgagg

SEQ ID NO: 4157273 - DNA, 23 bp, Homo sapiens
tggctccccctccccaggctgga

SEQ ID NO: 4157274 - DNA, 14 bp, Homo sapiens
tggctcctcaaaca

SEQ ID NO: 4157275 - DNA, 14 bp, Homo sapiens
tggctcctcccggt

SEQ ID NO: 4157276 - DNA, 19 bp, Homo sapiens
tggctcctcccggtgccca

SEQ ID NO: 4157277 - DNA, 14 bp, Homo sapiens
tggctcctgagggg

SEQ ID NO: 4157278 - DNA, 23 bp, Homo sapiens
tggctcctgaggggcatctgccc

SEQ ID NO: 4157279 - DNA, 19 bp, Homo sapiens
tggctccttcccatcgctg

SEQ ID NO: 4157280 - DNA, 16 bp, Homo sapiens
tggctcctttacaaaa

SEQ ID NO: 4157281 - DNA, 19 bp, Homo sapiens
tggctctaccttcctgtcc

SEQ ID NO: 4157282 - DNA, 17 bp, Homo sapiens
tggctctcctctggcta

SEQ ID NO: 4157283 - DNA, 18 bp, Homo sapiens
tggctctcctctggctag

SEQ ID NO: 4157284 - DNA, 23 bp, Homo sapiens
tggctctgcaatgggcactggga

SEQ ID NO: 4157285 - DNA, 19 bp, Homo sapiens
tggctcttgatacccccct

SEQ ID NO: 4157286 - DNA, 20 bp, Homo sapiens
tggctcttgatacccccctc

SEQ ID NO: 4157287 - DNA, 20 bp, Homo sapiens
tggctgaccccaaagagcct

SEQ ID NO: 4157288 - DNA, 22 bp, Homo sapiens
tggctgaccccaaagagcctgg

SEQ ID NO: 4157289 - DNA, 13 bp, Homo sapiens
tggctgacccctc

SEQ ID NO: 4157290 - DNA, 17 bp, Homo sapiens
tggctgacttcatctgg

SEQ ID NO: 4157291 - DNA, 16 bp, Homo sapiens
tggctgagcagttccc

SEQ ID NO: 4157292 - DNA, 23 bp, Homo sapiens
tggctgagcagttcccctggagc

SEQ ID NO: 4157293 - DNA, 19 bp, Homo sapiens
tggctgagcggatgcatct

SEQ ID NO: 4157294 - DNA, 17 bp, Homo sapiens
tggctgaggaggcctcc

SEQ ID NO: 4157295 - DNA, 23 bp, Homo sapiens
tggctgaggaggcctccatctca

SEQ ID NO: 4157296 - DNA, 16 bp, Homo sapiens
tggctgaggggcttgg

SEQ ID NO: 4157297 - DNA, 18 bp, Homo sapiens
tggctgaggttcctctgc

SEQ ID NO: 4157298 - DNA, 24 bp, Homo sapiens
tggctgaggttcctctgcctgccc

SEQ ID NO: 4157299 - DNA, 17 bp, Homo sapiens
tggctgatgatccagaa

SEQ ID NO: 4157300 - DNA, 11 bp, Homo sapiens
tggctgcagct

SEQ ID NO: 4157301 - DNA, 16 bp, Homo sapiens
tggctgccacacccag

SEQ ID NO: 4157302 - DNA, 17 bp, Homo sapiens
tggctgccccaacctgc

SEQ ID NO: 4157303 - DNA, 12 bp, Homo sapiens
tggctgcccctc

SEQ ID NO: 4157304 - DNA, 20 bp, Homo sapiens
tggctgcccctcaccttggg

SEQ ID NO: 4157305 - DNA, 12 bp, Homo sapiens
tggctgctgccc

SEQ ID NO: 4157306 - DNA, 12 bp, Homo sapiens
tggctgcttctc

SEQ ID NO: 4157307 - DNA, 18 bp, Homo sapiens
tggctgctttgcctctac

SEQ ID NO: 4157308 - DNA, 18 bp, Homo sapiens
tggctggaaactgctccc

SEQ ID NO: 4157309 - DNA, 17 bp, Homo sapiens
tggctggaggagcagca

SEQ ID NO: 4157310 - DNA, 23 bp, Homo sapiens
tggctggaggagcagcagcttgg

SEQ ID NO: 4157311 - DNA, 20 bp, Homo sapiens
tggctggctctaccttcctg

SEQ ID NO: 4157312 - DNA, 19 bp, Homo sapiens
tggctgggacgtggctcag

SEQ ID NO: 4157313 - DNA, 10 bp, Homo sapiens
tggctgggca

SEQ ID NO: 4157314 - DNA, 20 bp, Homo sapiens
tggctgggcagagctgcatc

SEQ ID NO: 4157315 - DNA, 18 bp, Homo sapiens
tggctgggcgtgctagag

SEQ ID NO: 4157316 - DNA, 14 bp, Homo sapiens
tggctggggtgtca

SEQ ID NO: 4157317 - DNA, 19 bp, Homo sapiens
tggctgggttcaggtccca

SEQ ID NO: 4157318 - DNA, 14 bp, Homo sapiens
tggctggtcctccc

SEQ ID NO: 4157319 - DNA, 20 bp, Homo sapiens
tggctggtcctcccatttct

SEQ ID NO: 4157320 - DNA, 17 bp, Homo sapiens
tggctgtagatcccaag

SEQ ID NO: 4157321 - DNA, 14 bp, Homo sapiens
tggctgtctagaat

SEQ ID NO: 4157322 - DNA, 21 bp, Homo sapiens
tggctgtgtttgcagcctgct

SEQ ID NO: 4157323 - DNA, 18 bp, Homo sapiens
tggctgtttagcagaact

SEQ ID NO: 4157324 - DNA, 14 bp, Homo sapiens
tggcttaatgttta

SEQ ID NO: 4157325 - DNA, 22 bp, Homo sapiens
tggcttacctgacctcttgctg

SEQ ID NO: 4157326 - DNA, 19 bp, Homo sapiens
tggcttccagcttcaggca

SEQ ID NO: 4157327 - DNA, 20 bp, Homo sapiens
tggcttccaggtatctccag

SEQ ID NO: 4157328 - DNA, 22 bp, Homo sapiens
tggcttccaggtatctccagga

SEQ ID NO: 4157329 - DNA, 23 bp, Homo sapiens
tggcttccaggtatctccaggat

SEQ ID NO: 4157330 - DNA, 16 bp, Homo sapiens
tggcttcccgctcagc

SEQ ID NO: 4157331 - DNA, 16 bp, Homo sapiens
tggcttcctttcttgg

SEQ ID NO: 4157332 - DNA, 15 bp, Homo sapiens
tggcttgacatgtgc

SEQ ID NO: 4157333 - DNA, 17 bp, Homo sapiens
tggcttgggcagggtct

SEQ ID NO: 4157334 - DNA, 16 bp, Homo sapiens
tggctttatgcacatt

SEQ ID NO: 4157335 - DNA, 22 bp, Homo sapiens
tggctttccaggcaccctcagg

SEQ ID NO: 4157336 - DNA, 13 bp, Homo sapiens
tggctttcccagg

SEQ ID NO: 4157337 - DNA, 17 bp, Homo sapiens
tggctttgaaacctcag

SEQ ID NO: 4157338 - DNA, 18 bp, Homo sapiens
tggctttgaaacctcagg

SEQ ID NO: 4157339 - DNA, 19 bp, Homo sapiens
tggctttgaaacctcaggg

SEQ ID NO: 4157340 - DNA, 17 bp, Homo sapiens
tggctttgcccacccct

SEQ ID NO: 4157341 - DNA, 12 bp, Homo sapiens
tggctttgcctc

SEQ ID NO: 4157342 - DNA, 17 bp, Homo sapiens
tggctttggcagtgttt

SEQ ID NO: 4157343 - DNA, 15 bp, Homo sapiens
tggcttttactttat

SEQ ID NO: 4157344 - DNA, 18 bp, Homo sapiens
tggctttttcagagtcat

SEQ ID NO: 4157345 - DNA, 21 bp, Homo sapiens
tggctttttcctctgagccca

SEQ ID NO: 4157346 - DNA, 19 bp, Homo sapiens
tgggaaaatatttcctgac

SEQ ID NO: 4157347 - DNA, 16 bp, Homo sapiens
tgggaaagatggataa

SEQ ID NO: 4157348 - DNA, 22 bp, Homo sapiens
tgggaaagccacctctccctca

SEQ ID NO: 4157349 - DNA, 20 bp, Homo sapiens
tgggaaatgagaaggcagcc

SEQ ID NO: 4157350 - DNA, 21 bp, Homo sapiens
tgggaagagggggctggccat

SEQ ID NO: 4157351 - DNA, 22 bp, Homo sapiens
tgggaagagggggctggccatg

SEQ ID NO: 4157352 - DNA, 23 bp, Homo sapiens
tgggaagagggggctggccatgg

SEQ ID NO: 4157353 - DNA, 20 bp, Homo sapiens
tgggaagataggctctgcac

SEQ ID NO: 4157354 - DNA, 19 bp, Homo sapiens
tgggaagatgaggttctga

SEQ ID NO: 4157355 - DNA, 13 bp, Homo sapiens
tgggaaggacttg

SEQ ID NO: 4157356 - DNA, 22 bp, Homo sapiens
tgggaaggacttggcgcgccct

SEQ ID NO: 4157357 - DNA, 21 bp, Homo sapiens
tgggaaggcgagtctggggac

SEQ ID NO: 4157358 - DNA, 17 bp, Homo sapiens
tgggaatgaggtgggag

SEQ ID NO: 4157359 - DNA, 21 bp, Homo sapiens
tgggaatgtattattctgcag

SEQ ID NO: 4157360 - DNA, 17 bp, Homo sapiens
tgggaattgctggagga

SEQ ID NO: 4157361 - DNA, 16 bp, Homo sapiens
tgggacacagacccag

SEQ ID NO: 4157362 - DNA, 18 bp, Homo sapiens
tgggacaccagggaagaa

SEQ ID NO: 4157363 - DNA, 11 bp, Homo sapiens
tgggacagcca

SEQ ID NO: 4157364 - DNA, 15 bp, Homo sapiens
tgggacagccagagc

SEQ ID NO: 4157365 - DNA, 16 bp, Homo sapiens
tgggacagccagagct

SEQ ID NO: 4157366 - DNA, 23 bp, Homo sapiens
tgggaccaaccctggggaaggag

SEQ ID NO: 4157367 - DNA, 17 bp, Homo sapiens
tgggaccagagccagat

SEQ ID NO: 4157368 - DNA, 22 bp, Homo sapiens
tgggaccaggatactggacgct

SEQ ID NO: 4157369 - DNA, 18 bp, Homo sapiens
tgggaccagggatggggg

SEQ ID NO: 4157370 - DNA, 20 bp, Homo sapiens
tgggacccaaaacacaggaa

SEQ ID NO: 4157371 - DNA, 23 bp, Homo sapiens
tgggacctcagttttatcatttt

SEQ ID NO: 4157372 - DNA, 18 bp, Homo sapiens
tgggacctgccaggcagg

SEQ ID NO: 4157373 - DNA, 19 bp, Homo sapiens
tgggacctgccaggcaggg

SEQ ID NO: 4157374 - DNA, 20 bp, Homo sapiens
tgggacctgccaggcagggg

SEQ ID NO: 4157375 - DNA, 23 bp, Homo sapiens
tgggacctgccaggcaggggtgg

SEQ ID NO: 4157376 - DNA, 15 bp, Homo sapiens
tgggacgctctgctg

SEQ ID NO: 4157377 - DNA, 16 bp, Homo sapiens
tgggactggagtcaga

SEQ ID NO: 4157378 - DNA, 21 bp, Homo sapiens
tgggactggagtcagatgagc

SEQ ID NO: 4157379 - DNA, 22 bp, Homo sapiens
tgggagacaagaaatccctgtt

SEQ ID NO: 4157380 - DNA, 15 bp, Homo sapiens
tgggagacatgtgac

SEQ ID NO: 4157381 - DNA, 16 bp, Homo sapiens
tgggagacatgtgaca

SEQ ID NO: 4157382 - DNA, 23 bp, Homo sapiens
tgggagaggatttttttctgagc

SEQ ID NO: 4157383 - DNA, 23 bp, Homo sapiens
tgggagattcaagggacccatga

SEQ ID NO: 4157384 - DNA, 20 bp, Homo sapiens
tgggagcaaaataaggaaga

SEQ ID NO: 4157385 - DNA, 21 bp, Homo sapiens
tgggagcaaaataaggaagag

SEQ ID NO: 4157386 - DNA, 12 bp, Homo sapiens
tgggagcactgg

SEQ ID NO: 4157387 - DNA, 14 bp, Homo sapiens
tgggagcagaaaca

SEQ ID NO: 4157388 - DNA, 13 bp, Homo sapiens
tgggagccagcct

SEQ ID NO: 4157389 - DNA, 12 bp, Homo sapiens
tgggagccagct

SEQ ID NO: 4157390 - DNA, 14 bp, Homo sapiens
tgggagcccagagg

SEQ ID NO: 4157391 - DNA, 19 bp, Homo sapiens
tgggagcccagagggtggc

SEQ ID NO: 4157392 - DNA, 14 bp, Homo sapiens
tgggagccccaggg

SEQ ID NO: 4157393 - DNA, 22 bp, Homo sapiens
tgggagccccagggtcttccct

SEQ ID NO: 4157394 - DNA, 15 bp, Homo sapiens
tgggagccctttgga

SEQ ID NO: 4157395 - DNA, 12 bp, Homo sapiens
tgggagcctagc

SEQ ID NO: 4157396 - DNA, 22 bp, Homo sapiens
tgggagcctagctcctgccaca

SEQ ID NO: 4157397 - DNA, 18 bp, Homo sapiens
tgggagctcctctcctgg

SEQ ID NO: 4157398 - DNA, 19 bp, Homo sapiens
tgggagctcctctcctgga

SEQ ID NO: 4157399 - DNA, 22 bp, Homo sapiens
tgggagctcctctcctggagga

SEQ ID NO: 4157400 - DNA, 18 bp, Homo sapiens
tgggagctgagcagcctc

SEQ ID NO: 4157401 - DNA, 22 bp, Homo sapiens
tgggagctgaggccacactcag

SEQ ID NO: 4157402 - DNA, 15 bp, Homo sapiens
tgggaggaaatttga

SEQ ID NO: 4157403 - DNA, 20 bp, Homo sapiens
tgggaggacggtgcaaccca

SEQ ID NO: 4157404 - DNA, 15 bp, Homo sapiens
tgggaggagggagag

SEQ ID NO: 4157405 - DNA, 17 bp, Homo sapiens
tgggaggcaagaaaagg

SEQ ID NO: 4157406 - DNA, 18 bp, Homo sapiens
tgggaggcaagaaaagga

SEQ ID NO: 4157407 - DNA, 21 bp, Homo sapiens
tgggaggcaagaaaaggacaa

SEQ ID NO: 4157408 - DNA, 23 bp, Homo sapiens
tgggaggcaagaaaaggacaaat

SEQ ID NO: 4157409 - DNA, 16 bp, Homo sapiens
tgggaggcatggccct

SEQ ID NO: 4157410 - DNA, 11 bp, Homo sapiens
tgggaggctga

SEQ ID NO: 4157411 - DNA, 18 bp, Homo sapiens
tgggaggctgaggcagga

SEQ ID NO: 4157412 - DNA, 17 bp, Homo sapiens
tgggagggagcagacag

SEQ ID NO: 4157413 - DNA, 18 bp, Homo sapiens
tgggagggagcagacagg

SEQ ID NO: 4157414 - DNA, 22 bp, Homo sapiens
tgggagggaggctcaggtccct

SEQ ID NO: 4157415 - DNA, 23 bp, Homo sapiens
tgggagggggcttgaagccaaag

SEQ ID NO: 4157416 - DNA, 18 bp, Homo sapiens
tgggagggttggcacctg

SEQ ID NO: 4157417 - DNA, 22 bp, Homo sapiens
tgggaggtggaagaagggagaa

SEQ ID NO: 4157418 - DNA, 14 bp, Homo sapiens
tgggagtcagagcc

SEQ ID NO: 4157419 - DNA, 15 bp, Homo sapiens
tgggagtcagagccc

SEQ ID NO: 4157420 - DNA, 13 bp, Homo sapiens
tgggagtgggcac

SEQ ID NO: 4157421 - DNA, 15 bp, Homo sapiens
tgggagtgggcacct

SEQ ID NO: 4157422 - DNA, 16 bp, Homo sapiens
tgggataggggcagag

SEQ ID NO: 4157423 - DNA, 18 bp, Homo sapiens
tgggatagtgttctgctc

SEQ ID NO: 4157424 - DNA, 22 bp, Homo sapiens
tgggatagtgttctgctcctgc

SEQ ID NO: 4157425 - DNA, 23 bp, Homo sapiens
tgggatagtgttctgctcctgct

SEQ ID NO: 4157426 - DNA, 19 bp, Homo sapiens
tgggatatggctgcccagg

SEQ ID NO: 4157427 - DNA, 15 bp, Homo sapiens
tgggatcctccctca

SEQ ID NO: 4157428 - DNA, 19 bp, Homo sapiens
tgggatcctccctcatggc

SEQ ID NO: 4157429 - DNA, 23 bp, Homo sapiens
tgggatgacaggcgcctgccatc

SEQ ID NO: 4157430 - DNA, 13 bp, Homo sapiens
tgggatgaccagg

SEQ ID NO: 4157431 - DNA, 15 bp, Homo sapiens
tgggatgggaccagg

SEQ ID NO: 4157432 - DNA, 17 bp, Homo sapiens
tgggatgggttccagag

SEQ ID NO: 4157433 - DNA, 22 bp, Homo sapiens
tgggatgttcagcactgtccct

SEQ ID NO: 4157434 - DNA, 17 bp, Homo sapiens
tgggattcaggaatgtg

SEQ ID NO: 4157435 - DNA, 20 bp, Homo sapiens
tgggattcccaccaaggtct

SEQ ID NO: 4157436 - DNA, 22 bp, Homo sapiens
tgggattctactttaagcacta

SEQ ID NO: 4157437 - DNA, 16 bp, Homo sapiens
tgggcaacagagcaag

SEQ ID NO: 4157438 - DNA, 16 bp, Homo sapiens
tgggcacacgcacaaa

SEQ ID NO: 4157439 - DNA, 13 bp, Homo sapiens
tgggcacagctct

SEQ ID NO: 4157440 - DNA, 14 bp, Homo sapiens
tgggcacagtccag

SEQ ID NO: 4157441 - DNA, 19 bp, Homo sapiens
tgggcacagtccagaccca

SEQ ID NO: 4157442 - DNA, 13 bp, Homo sapiens
tgggcacctcaga

SEQ ID NO: 4157443 - DNA, 17 bp, Homo sapiens
tgggcacggagggggac

SEQ ID NO: 4157444 - DNA, 13 bp, Homo sapiens
tgggcactggagc

SEQ ID NO: 4157445 - DNA, 14 bp, Homo sapiens
tgggcactggagca

SEQ ID NO: 4157446 - DNA, 18 bp, Homo sapiens
tgggcagagcccccagga

SEQ ID NO: 4157447 - DNA, 12 bp, Homo sapiens
tgggcagcaatt

SEQ ID NO: 4157448 - DNA, 12 bp, Homo sapiens
tgggcagcaccc

SEQ ID NO: 4157449 - DNA, 13 bp, Homo sapiens
tgggcagcaccct

SEQ ID NO: 4157450 - DNA, 16 bp, Homo sapiens
tgggcagcaccctccc

SEQ ID NO: 4157451 - DNA, 16 bp, Homo sapiens
tgggcagccaggctgc

SEQ ID NO: 4157452 - DNA, 13 bp, Homo sapiens
tgggcagctgagg

SEQ ID NO: 4157453 - DNA, 17 bp, Homo sapiens
tgggcagtgccccaggg

SEQ ID NO: 4157454 - DNA, 19 bp, Homo sapiens
tgggcagtgccccagggag

SEQ ID NO: 4157455 - DNA, 20 bp, Homo sapiens
tgggcatgggtccagggcct

SEQ ID NO: 4157456 - DNA, 16 bp, Homo sapiens
tgggcattttcctcct

SEQ ID NO: 4157457 - DNA, 20 bp, Homo sapiens
tgggcattttcctcctctgc

SEQ ID NO: 4157458 - DNA, 17 bp, Homo sapiens
tgggccacggctgagcc

SEQ ID NO: 4157459 - DNA, 14 bp, Homo sapiens
tgggccactgggga

SEQ ID NO: 4157460 - DNA, 23 bp, Homo sapiens
tgggccactggggactttattta

SEQ ID NO: 4157461 - DNA, 19 bp, Homo sapiens
tgggccagcggggctgctc

SEQ ID NO: 4157462 - DNA, 13 bp, Homo sapiens
tgggccagggtct

SEQ ID NO: 4157463 - DNA, 14 bp, Homo sapiens
tgggccagggtctg

SEQ ID NO: 4157464 - DNA, 19 bp, Homo sapiens
tgggccagggtctgtgtga

SEQ ID NO: 4157465 - DNA, 14 bp, Homo sapiens
tgggccatgtccaa

SEQ ID NO: 4157466 - DNA, 24 bp, Homo sapiens
tgggccatgtccaaagaggctgcc

SEQ ID NO: 4157467 - DNA, 20 bp, Homo sapiens
tgggccattctccacagcaa

SEQ ID NO: 4157468 - DNA, 22 bp, Homo sapiens
tgggccccagaccccagggcag

SEQ ID NO: 4157469 - DNA, 14 bp, Homo sapiens
tgggcccctcaaca

SEQ ID NO: 4157470 - DNA, 15 bp, Homo sapiens
tgggcccctcagagc

SEQ ID NO: 4157471 - DNA, 22 bp, Homo sapiens
tgggcccctccacgcctcctgg

SEQ ID NO: 4157472 - DNA, 23 bp, Homo sapiens
tgggcccctccacgcctcctggc

SEQ ID NO: 4157473 - DNA, 13 bp, Homo sapiens
tgggcccctggga

SEQ ID NO: 4157474 - DNA, 13 bp, Homo sapiens
tgggccctctctt

SEQ ID NO: 4157475 - DNA, 21 bp, Homo sapiens
tgggccgctgctttgcgctgg

SEQ ID NO: 4157476 - DNA, 23 bp, Homo sapiens
tgggcctcaaggacttgaaagca

SEQ ID NO: 4157477 - DNA, 16 bp, Homo sapiens
tgggcctcccttgggc

SEQ ID NO: 4157478 - DNA, 13 bp, Homo sapiens
tgggcctgcagaa

SEQ ID NO: 4157479 - DNA, 19 bp, Homo sapiens
tgggcctgccgggctgagg

SEQ ID NO: 4157480 - DNA, 16 bp, Homo sapiens
tgggccttagtgggcc

SEQ ID NO: 4157481 - DNA, 18 bp, Homo sapiens
tgggccttagtgggccag

SEQ ID NO: 4157482 - DNA, 13 bp, Homo sapiens
tgggccttgctac

SEQ ID NO: 4157483 - DNA, 20 bp, Homo sapiens
tgggccttgctgctgctgca

SEQ ID NO: 4157484 - DNA, 16 bp, Homo sapiens
tgggcgctgcttccag

SEQ ID NO: 4157485 - DNA, 14 bp, Homo sapiens
tgggcgggccatga

SEQ ID NO: 4157486 - DNA, 19 bp, Homo sapiens
tgggctatttggactcagg

SEQ ID NO: 4157487 - DNA, 21 bp, Homo sapiens
tgggctcaagcaatcctcctg

SEQ ID NO: 4157488 - DNA, 13 bp, Homo sapiens
tgggctcctccag

SEQ ID NO: 4157489 - DNA, 14 bp, Homo sapiens
tgggctcctgcccc

SEQ ID NO: 4157490 - DNA, 19 bp, Homo sapiens
tgggctcctggaaccaatc

SEQ ID NO: 4157491 - DNA, 17 bp, Homo sapiens
tgggctcggaggctgcc

SEQ ID NO: 4157492 - DNA, 22 bp, Homo sapiens
tgggctctgcaattcccctctg

SEQ ID NO: 4157493 - DNA, 13 bp, Homo sapiens
tgggctctgctga

SEQ ID NO: 4157494 - DNA, 15 bp, Homo sapiens
tgggctctgctgagt

SEQ ID NO: 4157495 - DNA, 15 bp, Homo sapiens
tgggctgaccaggct

SEQ ID NO: 4157496 - DNA, 12 bp, Homo sapiens
tgggctgagtga

SEQ ID NO: 4157497 - DNA, 15 bp, Homo sapiens
tgggctgccctggtg

SEQ ID NO: 4157498 - DNA, 16 bp, Homo sapiens
tgggctgccctggtgc

SEQ ID NO: 4157499 - DNA, 15 bp, Homo sapiens
tgggctgctgcaggc

SEQ ID NO: 4157500 - DNA, 16 bp, Homo sapiens
tgggctggactggagg

SEQ ID NO: 4157501 - DNA, 23 bp, Homo sapiens
tgggctggacttctacctgccct

SEQ ID NO: 4157502 - DNA, 16 bp, Homo sapiens
tgggctgggtgctggg

SEQ ID NO: 4157503 - DNA, 17 bp, Homo sapiens
tgggctgggtgctggga

SEQ ID NO: 4157504 - DNA, 19 bp, Homo sapiens
tgggctgggtgctgggaag

SEQ ID NO: 4157505 - DNA, 21 bp, Homo sapiens
tgggctggtatctcagaaagt

SEQ ID NO: 4157506 - DNA, 12 bp, Homo sapiens
tgggctgtctgt

SEQ ID NO: 4157507 - DNA, 16 bp, Homo sapiens
tgggctgtctgtcacc

SEQ ID NO: 4157508 - DNA, 15 bp, Homo sapiens
tgggctgtgagtgta

SEQ ID NO: 4157509 - DNA, 22 bp, Homo sapiens
tgggctgtgagtgtaagtgtga

SEQ ID NO: 4157510 - DNA, 19 bp, Homo sapiens
tgggcttagtatttctcag

SEQ ID NO: 4157511 - DNA, 23 bp, Homo sapiens
tgggcttcctgcccttccctctg

SEQ ID NO: 4157512 - DNA, 14 bp, Homo sapiens
tgggcttgaccagg

SEQ ID NO: 4157513 - DNA, 13 bp, Homo sapiens
tgggcttgattct

SEQ ID NO: 4157514 - DNA, 15 bp, Homo sapiens
tgggcttggcctgct

SEQ ID NO: 4157515 - DNA, 20 bp, Homo sapiens
tggggaaaaaagcacataca

SEQ ID NO: 4157516 - DNA, 14 bp, Homo sapiens
tggggaaacctaga

SEQ ID NO: 4157517 - DNA, 16 bp, Homo sapiens
tggggaaggagccagt

SEQ ID NO: 4157518 - DNA, 14 bp, Homo sapiens
tggggacacagcag

SEQ ID NO: 4157519 - DNA, 18 bp, Homo sapiens
tggggacacagcagtgag

SEQ ID NO: 4157520 - DNA, 16 bp, Homo sapiens
tggggacagagggtgt

SEQ ID NO: 4157521 - DNA, 14 bp, Homo sapiens
tggggacagcttcc

SEQ ID NO: 4157522 - DNA, 15 bp, Homo sapiens
tggggacagcttcct

SEQ ID NO: 4157523 - DNA, 18 bp, Homo sapiens
tggggacctggtaccctc

SEQ ID NO: 4157524 - DNA, 14 bp, Homo sapiens
tggggactcaggga

SEQ ID NO: 4157525 - DNA, 14 bp, Homo sapiens
tggggactgttcca

SEQ ID NO: 4157526 - DNA, 21 bp, Homo sapiens
tggggactgttccaaagccag

SEQ ID NO: 4157527 - DNA, 21 bp, Homo sapiens
tggggactttatttatttcta

SEQ ID NO: 4157528 - DNA, 15 bp, Homo sapiens
tggggagatgcttct

SEQ ID NO: 4157529 - DNA, 17 bp, Homo sapiens
tggggagcagagacact

SEQ ID NO: 4157530 - DNA, 16 bp, Homo sapiens
tggggagcaggaggcc

SEQ ID NO: 4157531 - DNA, 18 bp, Homo sapiens
tggggagcaggaggccaa

SEQ ID NO: 4157532 - DNA, 18 bp, Homo sapiens
tggggagcccgtctcagt

SEQ ID NO: 4157533 - DNA, 21 bp, Homo sapiens
tggggagggaggggaaatgta

SEQ ID NO: 4157534 - DNA, 19 bp, Homo sapiens
tggggaggggcggcaggag

SEQ ID NO: 4157535 - DNA, 19 bp, Homo sapiens
tggggagtggttaggcagc

SEQ ID NO: 4157536 - DNA, 20 bp, Homo sapiens
tggggataaaatgactactt

SEQ ID NO: 4157537 - DNA, 14 bp, Homo sapiens
tggggatgtgggag

SEQ ID NO: 4157538 - DNA, 15 bp, Homo sapiens
tggggattgcccctg

SEQ ID NO: 4157539 - DNA, 21 bp, Homo sapiens
tggggcaagactgcaaacttt

SEQ ID NO: 4157540 - DNA, 15 bp, Homo sapiens
tggggcaggctgggc

SEQ ID NO: 4157541 - DNA, 20 bp, Homo sapiens
tggggcaggctgggccatgt

SEQ ID NO: 4157542 - DNA, 11 bp, Homo sapiens
tggggcagggg

SEQ ID NO: 4157543 - DNA, 11 bp, Homo sapiens
tggggcagtgg

SEQ ID NO: 4157544 - DNA, 17 bp, Homo sapiens
tggggccagaggctggg

SEQ ID NO: 4157545 - DNA, 14 bp, Homo sapiens
tggggccagatcca

SEQ ID NO: 4157546 - DNA, 15 bp, Homo sapiens
tggggccagatccag

SEQ ID NO: 4157547 - DNA, 22 bp, Homo sapiens
tggggccccgggttcagcctgg

SEQ ID NO: 4157548 - DNA, 23 bp, Homo sapiens
tggggccccgggttcagcctggc

SEQ ID NO: 4157549 - DNA, 14 bp, Homo sapiens
tggggccctcccag

SEQ ID NO: 4157550 - DNA, 12 bp, Homo sapiens
tggggccctggg

SEQ ID NO: 4157551 - DNA, 15 bp, Homo sapiens
tggggccctgggcct

SEQ ID NO: 4157552 - DNA, 17 bp, Homo sapiens
tggggccctgggcctca

SEQ ID NO: 4157553 - DNA, 14 bp, Homo sapiens
tggggcctccagaa

SEQ ID NO: 4157554 - DNA, 20 bp, Homo sapiens
tggggcctccagaactcact

SEQ ID NO: 4157555 - DNA, 12 bp, Homo sapiens
tggggcctgtgg

SEQ ID NO: 4157556 - DNA, 23 bp, Homo sapiens
tggggctaggggaagggctttga

SEQ ID NO: 4157557 - DNA, 19 bp, Homo sapiens
tggggctcacggggcctcc

SEQ ID NO: 4157558 - DNA, 21 bp, Homo sapiens
tggggctcacggggcctccaa

SEQ ID NO: 4157559 - DNA, 21 bp, Homo sapiens
tggggctcctttctccagcca

SEQ ID NO: 4157560 - DNA, 13 bp, Homo sapiens
tggggctctggga

SEQ ID NO: 4157561 - DNA, 11 bp, Homo sapiens
tggggctgggg

SEQ ID NO: 4157562 - DNA, 16 bp, Homo sapiens
tggggctggttctgta

SEQ ID NO: 4157563 - DNA, 18 bp, Homo sapiens
tggggctttgccttgcag

SEQ ID NO: 4157564 - DNA, 15 bp, Homo sapiens
tgggggaaaaagcca

SEQ ID NO: 4157565 - DNA, 18 bp, Homo sapiens
tgggggaactcagatcca

SEQ ID NO: 4157566 - DNA, 15 bp, Homo sapiens
tgggggactgggagt

SEQ ID NO: 4157567 - DNA, 14 bp, Homo sapiens
tgggggagagccgt

SEQ ID NO: 4157568 - DNA, 17 bp, Homo sapiens
tgggggagttttcctct

SEQ ID NO: 4157569 - DNA, 18 bp, Homo sapiens
tgggggatagaggggctg

SEQ ID NO: 4157570 - DNA, 23 bp, Homo sapiens
tgggggcatctcttccccagaga

SEQ ID NO: 4157571 - DNA, 19 bp, Homo sapiens
tgggggccaaacctgggac

SEQ ID NO: 4157572 - DNA, 14 bp, Homo sapiens
tggggggccgggca

SEQ ID NO: 4157573 - DNA, 17 bp, Homo sapiens
tggggggccgggcaggt

SEQ ID NO: 4157574 - DNA, 19 bp, Homo sapiens
tgggggtggaggcttcctg

SEQ ID NO: 4157575 - DNA, 14 bp, Homo sapiens
tgggggtggcaggc

SEQ ID NO: 4157576 - DNA, 16 bp, Homo sapiens
tgggggtggcaggcac

SEQ ID NO: 4157577 - DNA, 19 bp, Homo sapiens
tgggggtggccatccctgg

SEQ ID NO: 4157578 - DNA, 12 bp, Homo sapiens
tgggggttgctg

SEQ ID NO: 4157579 - DNA, 19 bp, Homo sapiens
tggggtactcttgatgtga

SEQ ID NO: 4157580 - DNA, 24 bp, Homo sapiens
tggggtatttaccacagcagctga

SEQ ID NO: 4157581 - DNA, 13 bp, Homo sapiens
tggggtcagccag

SEQ ID NO: 4157582 - DNA, 14 bp, Homo sapiens
tggggtcagccagg

SEQ ID NO: 4157583 - DNA, 19 bp, Homo sapiens
tggggtcagccagggccag

SEQ ID NO: 4157584 - DNA, 17 bp, Homo sapiens
tggggtccctccacccc

SEQ ID NO: 4157585 - DNA, 20 bp, Homo sapiens
tggggtcctggagcagacca

SEQ ID NO: 4157586 - DNA, 13 bp, Homo sapiens
tggggtcctgggc

SEQ ID NO: 4157587 - DNA, 21 bp, Homo sapiens
tggggtctcacagtgttgccc

SEQ ID NO: 4157588 - DNA, 19 bp, Homo sapiens
tggggtctgagcatgatgg

SEQ ID NO: 4157589 - DNA, 14 bp, Homo sapiens
tggggtgacagtca

SEQ ID NO: 4157590 - DNA, 17 bp, Homo sapiens
tggggtgaggaccactc

SEQ ID NO: 4157591 - DNA, 18 bp, Homo sapiens
tggggtgctgggaggagg

SEQ ID NO: 4157592 - DNA, 20 bp, Homo sapiens
tggggtgggaggtcttgcta

SEQ ID NO: 4157593 - DNA, 19 bp, Homo sapiens
tggggtgggggtggggaga

SEQ ID NO: 4157594 - DNA, 18 bp, Homo sapiens
tggggtgtggggtggggt

SEQ ID NO: 4157595 - DNA, 16 bp, Homo sapiens
tggggttgcaaccact

SEQ ID NO: 4157596 - DNA, 17 bp, Homo sapiens
tggggttggcaacagga

SEQ ID NO: 4157597 - DNA, 23 bp, Homo sapiens
tggggtttgggcccctcagagcc

SEQ ID NO: 4157598 - DNA, 15 bp, Homo sapiens
tgggtaaaatacttt

SEQ ID NO: 4157599 - DNA, 23 bp, Homo sapiens
tgggtaatccaggcacagctgag

SEQ ID NO: 4157600 - DNA, 16 bp, Homo sapiens
tgggtacttcttgaag

SEQ ID NO: 4157601 - DNA, 18 bp, Homo sapiens
tgggtataagcagagagg

SEQ ID NO: 4157602 - DNA, 21 bp, Homo sapiens
tgggtatttgcaatattcctt

SEQ ID NO: 4157603 - DNA, 21 bp, Homo sapiens
tgggtccgataatatctttgt

SEQ ID NO: 4157604 - DNA, 15 bp, Homo sapiens
tgggtcctagccctt

SEQ ID NO: 4157605 - DNA, 20 bp, Homo sapiens
tgggtcctagcccttccctg

SEQ ID NO: 4157606 - DNA, 17 bp, Homo sapiens
tgggtcggccctgccca

SEQ ID NO: 4157607 - DNA, 18 bp, Homo sapiens
tgggtcggccctgcccaa

SEQ ID NO: 4157608 - DNA, 13 bp, Homo sapiens
tgggtctggagga

SEQ ID NO: 4157609 - DNA, 15 bp, Homo sapiens
tgggtctggctgagc

SEQ ID NO: 4157610 - DNA, 21 bp, Homo sapiens
tgggtctgggagtcacacagt

SEQ ID NO: 4157611 - DNA, 14 bp, Homo sapiens
tgggtctgtgtctc

SEQ ID NO: 4157612 - DNA, 20 bp, Homo sapiens
tgggtctgtgtctcttttct

SEQ ID NO: 4157613 - DNA, 22 bp, Homo sapiens
tgggtcttgttttttttttcca

SEQ ID NO: 4157614 - DNA, 12 bp, Homo sapiens
tgggtgagccag

SEQ ID NO: 4157615 - DNA, 20 bp, Homo sapiens
tgggtgattcctaagccact

SEQ ID NO: 4157616 - DNA, 13 bp, Homo sapiens
tgggtgctcagaa

SEQ ID NO: 4157617 - DNA, 14 bp, Homo sapiens
tgggtgctcagaat

SEQ ID NO: 4157618 - DNA, 15 bp, Homo sapiens
tgggtgctcagaata

SEQ ID NO: 4157619 - DNA, 16 bp, Homo sapiens
tgggtgctgccctgtg

SEQ ID NO: 4157620 - DNA, 17 bp, Homo sapiens
tgggtgctgccctgtgt

SEQ ID NO: 4157621 - DNA, 18 bp, Homo sapiens
tgggtgctggctgcccag

SEQ ID NO: 4157622 - DNA, 15 bp, Homo sapiens
tgggtggcctcggga

SEQ ID NO: 4157623 - DNA, 19 bp, Homo sapiens
tgggtgggctctgtgcagt

SEQ ID NO: 4157624 - DNA, 18 bp, Homo sapiens
tgggtggtaccctctgga

SEQ ID NO: 4157625 - DNA, 14 bp, Homo sapiens
tgggtggtggatct

SEQ ID NO: 4157626 - DNA, 15 bp, Homo sapiens
tgggtggtggatctg

SEQ ID NO: 4157627 - DNA, 20 bp, Homo sapiens
tgggtgtaggggcttacaaa

SEQ ID NO: 4157628 - DNA, 19 bp, Homo sapiens
tgggtgtcatttcattcca

SEQ ID NO: 4157629 - DNA, 15 bp, Homo sapiens
tgggtgttcctggca

SEQ ID NO: 4157630 - DNA, 14 bp, Homo sapiens
tgggtgttctttcc

SEQ ID NO: 4157631 - DNA, 15 bp, Homo sapiens
tgggtgttctttcct

SEQ ID NO: 4157632 - DNA, 22 bp, Homo sapiens
tgggttaggcattaatgtttct

SEQ ID NO: 4157633 - DNA, 17 bp, Homo sapiens
tgggttattctggagtt

SEQ ID NO: 4157634 - DNA, 20 bp, Homo sapiens
tgggttcattattggaatta

SEQ ID NO: 4157635 - DNA, 19 bp, Homo sapiens
tgggttctgcctgccagct

SEQ ID NO: 4157636 - DNA, 22 bp, Homo sapiens
tgggttctgcctgccagctgca

SEQ ID NO: 4157637 - DNA, 16 bp, Homo sapiens
tgggttcttgttttat

SEQ ID NO: 4157638 - DNA, 11 bp, Homo sapiens
tgggtttcttt

SEQ ID NO: 4157639 - DNA, 18 bp, Homo sapiens
tggtaacagttcatgttt

SEQ ID NO: 4157640 - DNA, 21 bp, Homo sapiens
tggtaacagttcatgtttgct

SEQ ID NO: 4157641 - DNA, 14 bp, Homo sapiens
tggtaactgctttc

SEQ ID NO: 4157642 - DNA, 13 bp, Homo sapiens
tggtaagaaaaag

SEQ ID NO: 4157643 - DNA, 14 bp, Homo sapiens
tggtaagctctggc

SEQ ID NO: 4157644 - DNA, 18 bp, Homo sapiens
tggtaataacaaacgtgt

SEQ ID NO: 4157645 - DNA, 23 bp, Homo sapiens
tggtaatctttacctgtatacag

SEQ ID NO: 4157646 - DNA, 22 bp, Homo sapiens
tggtaattattttggtactttt

SEQ ID NO: 4157647 - DNA, 15 bp, Homo sapiens
tggtaccctcctggc

SEQ ID NO: 4157648 - DNA, 21 bp, Homo sapiens
tggtaccctcctggctcttga

SEQ ID NO: 4157649 - DNA, 20 bp, Homo sapiens
tggtactactagatgtcttt

SEQ ID NO: 4157650 - DNA, 16 bp, Homo sapiens
tggtactctgaaacac

SEQ ID NO: 4157651 - DNA, 24 bp, Homo sapiens
tggtacttagagtttctgtttgat

SEQ ID NO: 4157652 - DNA, 22 bp, Homo sapiens
tggtacttttatgatgtatatt

SEQ ID NO: 4157653 - DNA, 23 bp, Homo sapiens
tggtacttttatgatgtatattt

SEQ ID NO: 4157654 - DNA, 20 bp, Homo sapiens
tggtacttttgagtgtgtgt

SEQ ID NO: 4157655 - DNA, 20 bp, Homo sapiens
tggtagaattggagagtaaa

SEQ ID NO: 4157656 - DNA, 13 bp, Homo sapiens
tggtagagattca

SEQ ID NO: 4157657 - DNA, 15 bp, Homo sapiens
tggtagattaaatat

SEQ ID NO: 4157658 - DNA, 20 bp, Homo sapiens
tggtagattaaatatagatt

SEQ ID NO: 4157659 - DNA, 15 bp, Homo sapiens
tggtagcataaataa

SEQ ID NO: 4157660 - DNA, 21 bp, Homo sapiens
tggtagcataaataaaactga

SEQ ID NO: 4157661 - DNA, 23 bp, Homo sapiens
tggtagcataaataaaactgaat

SEQ ID NO: 4157662 - DNA, 18 bp, Homo sapiens
tggtagttagtagcatgt

SEQ ID NO: 4157663 - DNA, 17 bp, Homo sapiens
tggtatagccatgattt

SEQ ID NO: 4157664 - DNA, 16 bp, Homo sapiens
tggtatgagctgaggg

SEQ ID NO: 4157665 - DNA, 19 bp, Homo sapiens
tggtatgctggccagcacc

SEQ ID NO: 4157666 - DNA, 20 bp, Homo sapiens
tggtatgtaatttatgcaag

SEQ ID NO: 4157667 - DNA, 21 bp, Homo sapiens
tggtattctgttctggaggaa

SEQ ID NO: 4157668 - DNA, 14 bp, Homo sapiens
tggtcaaaccgcac

SEQ ID NO: 4157669 - DNA, 17 bp, Homo sapiens
tggtcaaaccgcactca

SEQ ID NO: 4157670 - DNA, 14 bp, Homo sapiens
tggtcaacacttaa

SEQ ID NO: 4157671 - DNA, 15 bp, Homo sapiens
tggtcacacactgat

SEQ ID NO: 4157672 - DNA, 16 bp, Homo sapiens
tggtcacacactgatg

SEQ ID NO: 4157673 - DNA, 15 bp, Homo sapiens
tggtcacagccaggc

SEQ ID NO: 4157674 - DNA, 17 bp, Homo sapiens
tggtcacagccaggcgc

SEQ ID NO: 4157675 - DNA, 13 bp, Homo sapiens
tggtcacagcctc

SEQ ID NO: 4157676 - DNA, 14 bp, Homo sapiens
tggtcacagcctcc

SEQ ID NO: 4157677 - DNA, 16 bp, Homo sapiens
tggtcacagcctcctc

SEQ ID NO: 4157678 - DNA, 18 bp, Homo sapiens
tggtcaccaaatcagctg

SEQ ID NO: 4157679 - DNA, 17 bp, Homo sapiens
tggtcactgtgcactgc

SEQ ID NO: 4157680 - DNA, 10 bp, Homo sapiens
tggtcagagg

SEQ ID NO: 4157681 - DNA, 15 bp, Homo sapiens
tggtcagatttgaac

SEQ ID NO: 4157682 - DNA, 16 bp, Homo sapiens
tggtcagatttgaact

SEQ ID NO: 4157683 - DNA, 21 bp, Homo sapiens
tggtcaggttatactcctcct

SEQ ID NO: 4157684 - DNA, 16 bp, Homo sapiens
tggtccaaaaaaagga

SEQ ID NO: 4157685 - DNA, 18 bp, Homo sapiens
tggtccaaaaaaaggaaa

SEQ ID NO: 4157686 - DNA, 19 bp, Homo sapiens
tggtccaaaaaaaggaaaa

SEQ ID NO: 4157687 - DNA, 20 bp, Homo sapiens
tggtccaaaaaaaggaaaaa

SEQ ID NO: 4157688 - DNA, 21 bp, Homo sapiens
tggtccaaaaaaaggaaaaat

SEQ ID NO: 4157689 - DNA, 19 bp, Homo sapiens
tggtccaaccaggagctga

SEQ ID NO: 4157690 - DNA, 15 bp, Homo sapiens
tggtccaattagttt

SEQ ID NO: 4157691 - DNA, 21 bp, Homo sapiens
tggtccaattagtttcctttt

SEQ ID NO: 4157692 - DNA, 21 bp, Homo sapiens
tggtccagaaactcctgtttc

SEQ ID NO: 4157693 - DNA, 21 bp, Homo sapiens
tggtccagaccagccctgcag

SEQ ID NO: 4157694 - DNA, 21 bp, Homo sapiens
tggtccagggctagtgacttg

SEQ ID NO: 4157695 - DNA, 13 bp, Homo sapiens
tggtccatgccca

SEQ ID NO: 4157696 - DNA, 18 bp, Homo sapiens
tggtccatgcccactgct

SEQ ID NO: 4157697 - DNA, 20 bp, Homo sapiens
tggtccatgcccactgctgg

SEQ ID NO: 4157698 - DNA, 16 bp, Homo sapiens
tggtccatttgttcct

SEQ ID NO: 4157699 - DNA, 13 bp, Homo sapiens
tggtcccatcctc

SEQ ID NO: 4157700 - DNA, 13 bp, Homo sapiens
tggtccctgcctt

SEQ ID NO: 4157701 - DNA, 22 bp, Homo sapiens
tggtccctgttttcccacgagg

SEQ ID NO: 4157702 - DNA, 19 bp, Homo sapiens
tggtccggacactcctaga

SEQ ID NO: 4157703 - DNA, 15 bp, Homo sapiens
tggtcctcccatttc

SEQ ID NO: 4157704 - DNA, 12 bp, Homo sapiens
tggtcctgactc

SEQ ID NO: 4157705 - DNA, 22 bp, Homo sapiens
tggtcctgactcaacatgttac

SEQ ID NO: 4157706 - DNA, 14 bp, Homo sapiens
tggtcgcccaggag

SEQ ID NO: 4157707 - DNA, 16 bp, Homo sapiens
tggtctcaaactcctg

SEQ ID NO: 4157708 - DNA, 22 bp, Homo sapiens
tggtctctgctgaaggttgtaa

SEQ ID NO: 4157709 - DNA, 17 bp, Homo sapiens
tggtctgaatgttctga

SEQ ID NO: 4157710 - DNA, 14 bp, Homo sapiens
tggtctgccagaat

SEQ ID NO: 4157711 - DNA, 13 bp, Homo sapiens
tggtctgcgcctt

SEQ ID NO: 4157712 - DNA, 19 bp, Homo sapiens
tggtcttcaaattgtcttt

SEQ ID NO: 4157713 - DNA, 15 bp, Homo sapiens
tggtctttctggaga

SEQ ID NO: 4157714 - DNA, 23 bp, Homo sapiens
tggtgaagtaaattaggcagtgc

SEQ ID NO: 4157715 - DNA, 14 bp, Homo sapiens
tggtgaatcacctg

SEQ ID NO: 4157716 - DNA, 19 bp, Homo sapiens
tggtgaatggccttccttc

SEQ ID NO: 4157717 - DNA, 21 bp, Homo sapiens
tggtgatcctctattttgtga

SEQ ID NO: 4157718 - DNA, 15 bp, Homo sapiens
tggtgcagacagaag

SEQ ID NO: 4157719 - DNA, 18 bp, Homo sapiens
tggtgcagagaagctgga

SEQ ID NO: 4157720 - DNA, 13 bp, Homo sapiens
tggtgcattacag

SEQ ID NO: 4157721 - DNA, 16 bp, Homo sapiens
tggtgccccaggacca

SEQ ID NO: 4157722 - DNA, 17 bp, Homo sapiens
tggtgccccaggaccag

SEQ ID NO: 4157723 - DNA, 20 bp, Homo sapiens
tggtgccccaggaccagctc

SEQ ID NO: 4157724 - DNA, 23 bp, Homo sapiens
tggtgccccaggaccagctcagg

SEQ ID NO: 4157725 - DNA, 17 bp, Homo sapiens
tggtgccctcctcactc

SEQ ID NO: 4157726 - DNA, 15 bp, Homo sapiens
tggtgcctgagaggc

SEQ ID NO: 4157727 - DNA, 23 bp, Homo sapiens
tggtgctataggctggagaagct

SEQ ID NO: 4157728 - DNA, 22 bp, Homo sapiens
tggtgctctgtgttcccagagg

SEQ ID NO: 4157729 - DNA, 16 bp, Homo sapiens
tggtgctcttttttct

SEQ ID NO: 4157730 - DNA, 15 bp, Homo sapiens
tggtgctgcagattt

SEQ ID NO: 4157731 - DNA, 19 bp, Homo sapiens
tggtgctgctgctgctgtg

SEQ ID NO: 4157732 - DNA, 13 bp, Homo sapiens
tggtgctggttta

SEQ ID NO: 4157733 - DNA, 17 bp, Homo sapiens
tggtgctgtggccaggg

SEQ ID NO: 4157734 - DNA, 20 bp, Homo sapiens
tggtgctgtggccagggtga

SEQ ID NO: 4157735 - DNA, 22 bp, Homo sapiens
tggtgcttacacatctcagacc

SEQ ID NO: 4157736 - DNA, 16 bp, Homo sapiens
tggtggcaagagcccc

SEQ ID NO: 4157737 - DNA, 16 bp, Homo sapiens
tggtggcaccagatgc

SEQ ID NO: 4157738 - DNA, 13 bp, Homo sapiens
tggtggcctcagc

SEQ ID NO: 4157739 - DNA, 14 bp, Homo sapiens
tggtggctcatgcc

SEQ ID NO: 4157740 - DNA, 14 bp, Homo sapiens
tggtggctgtggaa

SEQ ID NO: 4157741 - DNA, 23 bp, Homo sapiens
tggtgggccaacaaagaacacta

SEQ ID NO: 4157742 - DNA, 16 bp, Homo sapiens
tggtggggatattttt

SEQ ID NO: 4157743 - DNA, 22 bp, Homo sapiens
tggtgggtctatgttccccagg

SEQ ID NO: 4157744 - DNA, 21 bp, Homo sapiens
tggtgggttcaggggactcag

SEQ ID NO: 4157745 - DNA, 14 bp, Homo sapiens
tggtggtagagaag

SEQ ID NO: 4157746 - DNA, 15 bp, Homo sapiens
tggtggtcagatgca

SEQ ID NO: 4157747 - DNA, 19 bp, Homo sapiens
tggtgtaaagctggccctg

SEQ ID NO: 4157748 - DNA, 23 bp, Homo sapiens
tggtgtaaagctggccctgcctc

SEQ ID NO: 4157749 - DNA, 17 bp, Homo sapiens
tggtgtaataagacata

SEQ ID NO: 4157750 - DNA, 19 bp, Homo sapiens
tggtgtaataagacataac

SEQ ID NO: 4157751 - DNA, 12 bp, Homo sapiens
tggtgtgatctt

SEQ ID NO: 4157752 - DNA, 22 bp, Homo sapiens
tggtgtgatcttaatatatttg

SEQ ID NO: 4157753 - DNA, 15 bp, Homo sapiens
tggtgtgggtgtcct

SEQ ID NO: 4157754 - DNA, 21 bp, Homo sapiens
tggtgttggggaaaccttcat

SEQ ID NO: 4157755 - DNA, 17 bp, Homo sapiens
tggtgtttttcccccgc

SEQ ID NO: 4157756 - DNA, 21 bp, Homo sapiens
tggttacctgacctaaattag

SEQ ID NO: 4157757 - DNA, 18 bp, Homo sapiens
tggttacttcttctctta

SEQ ID NO: 4157758 - DNA, 20 bp, Homo sapiens
tggttcagaattaaactttt

SEQ ID NO: 4157759 - DNA, 21 bp, Homo sapiens
tggttcagaattaaactttta

SEQ ID NO: 4157760 - DNA, 13 bp, Homo sapiens
tggttccatgcct

SEQ ID NO: 4157761 - DNA, 15 bp, Homo sapiens
tggttccatgcctga

SEQ ID NO: 4157762 - DNA, 19 bp, Homo sapiens
tggttccatgcctgagggt

SEQ ID NO: 4157763 - DNA, 22 bp, Homo sapiens
tggttccatgcctgagggtgga

SEQ ID NO: 4157764 - DNA, 21 bp, Homo sapiens
tggttcccaataaaagtgact

SEQ ID NO: 4157765 - DNA, 19 bp, Homo sapiens
tggttcccctgttcactct

SEQ ID NO: 4157766 - DNA, 20 bp, Homo sapiens
tggttcccctgttcactcta

SEQ ID NO: 4157767 - DNA, 13 bp, Homo sapiens
tggttccttctct

SEQ ID NO: 4157768 - DNA, 14 bp, Homo sapiens
tggttccttctctg

SEQ ID NO: 4157769 - DNA, 15 bp, Homo sapiens
tggttctaatagaac

SEQ ID NO: 4157770 - DNA, 14 bp, Homo sapiens
tggttctcatttgg

SEQ ID NO: 4157771 - DNA, 22 bp, Homo sapiens
tggttctcatttggtctgccag

SEQ ID NO: 4157772 - DNA, 23 bp, Homo sapiens
tggttgaactctggtggcacagg

SEQ ID NO: 4157773 - DNA, 19 bp, Homo sapiens
tggttggggccctgccctg

SEQ ID NO: 4157774 - DNA, 20 bp, Homo sapiens
tggttgtatatttttatatt

SEQ ID NO: 4157775 - DNA, 16 bp, Homo sapiens
tggttgtcttattgca

SEQ ID NO: 4157776 - DNA, 19 bp, Homo sapiens
tggttgtggtgtagactgt

SEQ ID NO: 4157777 - DNA, 16 bp, Homo sapiens
tggtttaaaaagtttc

SEQ ID NO: 4157778 - DNA, 22 bp, Homo sapiens
tggtttaaaaagtttcacgtct

SEQ ID NO: 4157779 - DNA, 19 bp, Homo sapiens
tggtttacaggccctgctc

SEQ ID NO: 4157780 - DNA, 20 bp, Homo sapiens
tggtttatattttttcagtt

SEQ ID NO: 4157781 - DNA, 16 bp, Homo sapiens
tggtttatttgttgtt

SEQ ID NO: 4157782 - DNA, 18 bp, Homo sapiens
tggtttatttttgtaatg

SEQ ID NO: 4157783 - DNA, 19 bp, Homo sapiens
tggtttatttttgtaatgt

SEQ ID NO: 4157784 - DNA, 22 bp, Homo sapiens
tggtttcataacttcctgtact

SEQ ID NO: 4157785 - DNA, 15 bp, Homo sapiens
tggtttcgaactcct

SEQ ID NO: 4157786 - DNA, 16 bp, Homo sapiens
tggtttctagacttgt

SEQ ID NO: 4157787 - DNA, 15 bp, Homo sapiens
tggtttctcattctt

SEQ ID NO: 4157788 - DNA, 16 bp, Homo sapiens
tggtttctcattcttg

SEQ ID NO: 4157789 - DNA, 12 bp, Homo sapiens
tggtttctccag

SEQ ID NO: 4157790 - DNA, 13 bp, Homo sapiens
tggtttctcttct

SEQ ID NO: 4157791 - DNA, 21 bp, Homo sapiens
tggtttggtcagttacaaagt

SEQ ID NO: 4157792 - DNA, 15 bp, Homo sapiens
tggtttgttccctgt

SEQ ID NO: 4157793 - DNA, 16 bp, Homo sapiens
tggttttatactgaag

SEQ ID NO: 4157794 - DNA, 14 bp, Homo sapiens
tggttttcaaaata

SEQ ID NO: 4157795 - DNA, 16 bp, Homo sapiens
tggttttcctaaatgc

SEQ ID NO: 4157796 - DNA, 22 bp, Homo sapiens
tggttttcctaaatgcagtgaa

SEQ ID NO: 4157797 - DNA, 18 bp, Homo sapiens
tggttttctgccaatgac

SEQ ID NO: 4157798 - DNA, 21 bp, Homo sapiens
tggttttctgccaatgaccaa

SEQ ID NO: 4157799 - DNA, 21 bp, Homo sapiens
tggttttggggaaatgtggag

SEQ ID NO: 4157800 - DNA, 21 bp, Homo sapiens
tggttttgtacactgctgtac

SEQ ID NO: 4157801 - DNA, 19 bp, Homo sapiens
tggtttttatttctccttt

SEQ ID NO: 4157802 - DNA, 14 bp, Homo sapiens
tggtttttgctctc

SEQ ID NO: 4157803 - DNA, 20 bp, Homo sapiens
tggtttttttttttcttaaa

SEQ ID NO: 4157804 - DNA, 18 bp, Homo sapiens
tgtaaaaaaaaatgcctt

SEQ ID NO: 4157805 - DNA, 17 bp, Homo sapiens
tgtaaaaaagaaaaaca

SEQ ID NO: 4157806 - DNA, 15 bp, Homo sapiens
tgtaaaaaatggaaa

SEQ ID NO: 4157807 - DNA, 14 bp, Homo sapiens
tgtaaaaacactga

SEQ ID NO: 4157808 - DNA, 16 bp, Homo sapiens
tgtaaaaacactgaaa

SEQ ID NO: 4157809 - DNA, 20 bp, Homo sapiens
tgtaaaaacagcattgcttt

SEQ ID NO: 4157810 - DNA, 22 bp, Homo sapiens
tgtaaaaacagcattgctttct

SEQ ID NO: 4157811 - DNA, 12 bp, Homo sapiens
tgtaaaagaaat

SEQ ID NO: 4157812 - DNA, 19 bp, Homo sapiens
tgtaaaagaacagtaaaca

SEQ ID NO: 4157813 - DNA, 21 bp, Homo sapiens
tgtaaaatcttggcacagaaa

SEQ ID NO: 4157814 - DNA, 14 bp, Homo sapiens
tgtaaaccaaagcc

SEQ ID NO: 4157815 - DNA, 19 bp, Homo sapiens
tgtaaactgaatataaagc

SEQ ID NO: 4157816 - DNA, 12 bp, Homo sapiens
tgtaaactttgt

SEQ ID NO: 4157817 - DNA, 12 bp, Homo sapiens
tgtaaagctggc

SEQ ID NO: 4157818 - DNA, 15 bp, Homo sapiens
tgtaaataatttatt

SEQ ID NO: 4157819 - DNA, 12 bp, Homo sapiens
tgtaaatattta

SEQ ID NO: 4157820 - DNA, 16 bp, Homo sapiens
tgtaaatcctgccatt

SEQ ID NO: 4157821 - DNA, 19 bp, Homo sapiens
tgtaaatcctttttcttta

SEQ ID NO: 4157822 - DNA, 20 bp, Homo sapiens
tgtaaatcctttttctttat

SEQ ID NO: 4157823 - DNA, 15 bp, Homo sapiens
tgtaaatctgccaca

SEQ ID NO: 4157824 - DNA, 16 bp, Homo sapiens
tgtaaatggtgtacat

SEQ ID NO: 4157825 - DNA, 18 bp, Homo sapiens
tgtaaatggtgtacataa

SEQ ID NO: 4157826 - DNA, 22 bp, Homo sapiens
tgtaaatgtttgttaaaaataa

SEQ ID NO: 4157827 - DNA, 13 bp, Homo sapiens
tgtaaattatttg

SEQ ID NO: 4157828 - DNA, 21 bp, Homo sapiens
tgtaacaagggttttaatgta

SEQ ID NO: 4157829 - DNA, 19 bp, Homo sapiens
tgtaacaattgtgtagcct

SEQ ID NO: 4157830 - DNA, 21 bp, Homo sapiens
tgtaacaattgtgtagccttt

SEQ ID NO: 4157831 - DNA, 20 bp, Homo sapiens
tgtaacacagtcattctagg

SEQ ID NO: 4157832 - DNA, 15 bp, Homo sapiens
tgtaacacataaaca

SEQ ID NO: 4157833 - DNA, 20 bp, Homo sapiens
tgtaacacataaacaattca

SEQ ID NO: 4157834 - DNA, 22 bp, Homo sapiens
tgtaacacataaacaattcatg

SEQ ID NO: 4157835 - DNA, 14 bp, Homo sapiens
tgtaacagctgagg

SEQ ID NO: 4157836 - DNA, 14 bp, Homo sapiens
tgtaacctcagctc

SEQ ID NO: 4157837 - DNA, 16 bp, Homo sapiens
tgtaacctcagctctg

SEQ ID NO: 4157838 - DNA, 18 bp, Homo sapiens
tgtaacggttaactgtaa

SEQ ID NO: 4157839 - DNA, 19 bp, Homo sapiens
tgtaacgtgtgctgtgttt

SEQ ID NO: 4157840 - DNA, 22 bp, Homo sapiens
tgtaacgttttctttcacacac

SEQ ID NO: 4157841 - DNA, 18 bp, Homo sapiens
tgtaactaggctcagaga

SEQ ID NO: 4157842 - DNA, 18 bp, Homo sapiens
tgtaacttatattgaaga

SEQ ID NO: 4157843 - DNA, 22 bp, Homo sapiens
tgtaacttgcttaaatttctta

SEQ ID NO: 4157844 - DNA, 15 bp, Homo sapiens
tgtaagaaaacaaaa

SEQ ID NO: 4157845 - DNA, 17 bp, Homo sapiens
tgtaagaagagactggg

SEQ ID NO: 4157846 - DNA, 14 bp, Homo sapiens
tgtaagaaggcaat

SEQ ID NO: 4157847 - DNA, 16 bp, Homo sapiens
tgtaagaattcagaag

SEQ ID NO: 4157848 - DNA, 18 bp, Homo sapiens
tgtaagagcaccttcctc

SEQ ID NO: 4157849 - DNA, 22 bp, Homo sapiens
tgtaagagcaccttcctcactt

SEQ ID NO: 4157850 - DNA, 18 bp, Homo sapiens
tgtaagagtgtagaagca

SEQ ID NO: 4157851 - DNA, 18 bp, Homo sapiens
tgtaagcactctggatga

SEQ ID NO: 4157852 - DNA, 19 bp, Homo sapiens
tgtaagcaggagagaaatt

SEQ ID NO: 4157853 - DNA, 19 bp, Homo sapiens
tgtaagtcagtgttgagat

SEQ ID NO: 4157854 - DNA, 12 bp, Homo sapiens
tgtaagtgtgag

SEQ ID NO: 4157855 - DNA, 17 bp, Homo sapiens
tgtaagtgtgagtaaga

SEQ ID NO: 4157856 - DNA, 14 bp, Homo sapiens
tgtaagttcacaac

SEQ ID NO: 4157857 - DNA, 15 bp, Homo sapiens
tgtaagttgtacaaa

SEQ ID NO: 4157858 - DNA, 13 bp, Homo sapiens
tgtaagtttcagg

SEQ ID NO: 4157859 - DNA, 14 bp, Homo sapiens
tgtaagtttcaggt

SEQ ID NO: 4157860 - DNA, 16 bp, Homo sapiens
tgtaagtttcaggtga

SEQ ID NO: 4157861 - DNA, 20 bp, Homo sapiens
tgtaagtttcaggtgacatg

SEQ ID NO: 4157862 - DNA, 21 bp, Homo sapiens
tgtaagtttcaggtgacatgt

SEQ ID NO: 4157863 - DNA, 23 bp, Homo sapiens
tgtaagtttcaggtgacatgtga

SEQ ID NO: 4157864 - DNA, 16 bp, Homo sapiens
tgtaataaagtatata

SEQ ID NO: 4157865 - DNA, 14 bp, Homo sapiens
tgtaataactgtga

SEQ ID NO: 4157866 - DNA, 12 bp, Homo sapiens
tgtaataagaca

SEQ ID NO: 4157867 - DNA, 17 bp, Homo sapiens
tgtaatactggaataat

SEQ ID NO: 4157868 - DNA, 22 bp, Homo sapiens
tgtaatatttttatatacagag

SEQ ID NO: 4157869 - DNA, 23 bp, Homo sapiens
tgtaatcaagcctttatggctgc

SEQ ID NO: 4157870 - DNA, 20 bp, Homo sapiens
tgtaatcaatgtttcttcta

SEQ ID NO: 4157871 - DNA, 22 bp, Homo sapiens
tgtaatcccagcactttgggag

SEQ ID NO: 4157872 - DNA, 20 bp, Homo sapiens
tgtaatcccagctactcggg

SEQ ID NO: 4157873 - DNA, 14 bp, Homo sapiens
tgtaatctctctgc

SEQ ID NO: 4157874 - DNA, 20 bp, Homo sapiens
tgtaatctttcatccaaaat

SEQ ID NO: 4157875 - DNA, 15 bp, Homo sapiens
tgtaatgaaaatgaa

SEQ ID NO: 4157876 - DNA, 21 bp, Homo sapiens
tgtaatgaaaatgaatatcta

SEQ ID NO: 4157877 - DNA, 19 bp, Homo sapiens
tgtaatggtactgactttg

SEQ ID NO: 4157878 - DNA, 21 bp, Homo sapiens
tgtaatgtagcgtgtttacat

SEQ ID NO: 4157879 - DNA, 19 bp, Homo sapiens
tgtaatgtgtgaaaaagat

SEQ ID NO: 4157880 - DNA, 21 bp, Homo sapiens
tgtaatgtgtggtggcctcag

SEQ ID NO: 4157881 - DNA, 22 bp, Homo sapiens
tgtaatgtgtggtggcctcagc

SEQ ID NO: 4157882 - DNA, 14 bp, Homo sapiens
tgtaatgttactga

SEQ ID NO: 4157883 - DNA, 18 bp, Homo sapiens
tgtaattaagtactatgt

SEQ ID NO: 4157884 - DNA, 23 bp, Homo sapiens
tgtaattaagtactatgtatcaa

SEQ ID NO: 4157885 - DNA, 16 bp, Homo sapiens
tgtaattatgatttgg

SEQ ID NO: 4157886 - DNA, 15 bp, Homo sapiens
tgtaattcaaaagat

SEQ ID NO: 4157887 - DNA, 13 bp, Homo sapiens
tgtaattctaaat

SEQ ID NO: 4157888 - DNA, 16 bp, Homo sapiens
tgtaattgcttacatt

SEQ ID NO: 4157889 - DNA, 18 bp, Homo sapiens
tgtaattgcttacatttt

SEQ ID NO: 4157890 - DNA, 23 bp, Homo sapiens
tgtaattgcttacatttttacaa

SEQ ID NO: 4157891 - DNA, 23 bp, Homo sapiens
tgtaatttaaacatttgttcctg

SEQ ID NO: 4157892 - DNA, 20 bp, Homo sapiens
tgtaatttagaaactgattt

SEQ ID NO: 4157893 - DNA, 16 bp, Homo sapiens
tgtaattttatatgaa

SEQ ID NO: 4157894 - DNA, 23 bp, Homo sapiens
tgtaatttttggggaaaaaagca

SEQ ID NO: 4157895 - DNA, 15 bp, Homo sapiens
tgtacaaatgtattt

SEQ ID NO: 4157896 - DNA, 16 bp, Homo sapiens
tgtacaagatgaagga

SEQ ID NO: 4157897 - DNA, 23 bp, Homo sapiens
tgtacaagttgttattgttgaac

SEQ ID NO: 4157898 - DNA, 12 bp, Homo sapiens
tgtacactgaat

SEQ ID NO: 4157899 - DNA, 15 bp, Homo sapiens
tgtacactgaatatt

SEQ ID NO: 4157900 - DNA, 17 bp, Homo sapiens
tgtacactgaatattta

SEQ ID NO: 4157901 - DNA, 20 bp, Homo sapiens
tgtacactgctgtacccaga

SEQ ID NO: 4157902 - DNA, 17 bp, Homo sapiens
tgtacagaatttccact

SEQ ID NO: 4157903 - DNA, 19 bp, Homo sapiens
tgtacagaattttggaaga

SEQ ID NO: 4157904 - DNA, 19 bp, Homo sapiens
tgtacagtgtgtaaagtgt

SEQ ID NO: 4157905 - DNA, 12 bp, Homo sapiens
tgtacagtgtta

SEQ ID NO: 4157906 - DNA, 18 bp, Homo sapiens
tgtacataaaagaatttt

SEQ ID NO: 4157907 - DNA, 19 bp, Homo sapiens
tgtacataactcctgtccc

SEQ ID NO: 4157908 - DNA, 15 bp, Homo sapiens
tgtacatagtgtaat

SEQ ID NO: 4157909 - DNA, 16 bp, Homo sapiens
tgtacatagtgtaatg

SEQ ID NO: 4157910 - DNA, 15 bp, Homo sapiens
tgtacatatgtgctg

SEQ ID NO: 4157911 - DNA, 17 bp, Homo sapiens
tgtacatatgtgctgga

SEQ ID NO: 4157912 - DNA, 23 bp, Homo sapiens
tgtacatattactgttgcattta

SEQ ID NO: 4157913 - DNA, 20 bp, Homo sapiens
tgtacatatttgagactagt

SEQ ID NO: 4157914 - DNA, 18 bp, Homo sapiens
tgtacatctattttggat

SEQ ID NO: 4157915 - DNA, 14 bp, Homo sapiens
tgtacattaattac

SEQ ID NO: 4157916 - DNA, 14 bp, Homo sapiens
tgtacatttaaaat

SEQ ID NO: 4157917 - DNA, 20 bp, Homo sapiens
tgtacatttaaaattgctat

SEQ ID NO: 4157918 - DNA, 21 bp, Homo sapiens
tgtacatttatttattactgt

SEQ ID NO: 4157919 - DNA, 22 bp, Homo sapiens
tgtacatttatttattactgtc

SEQ ID NO: 4157920 - DNA, 18 bp, Homo sapiens
tgtaccaacctcatagag

SEQ ID NO: 4157921 - DNA, 23 bp, Homo sapiens
tgtaccacagacacaatatgtat

SEQ ID NO: 4157922 - DNA, 15 bp, Homo sapiens
tgtaccatcatttta

SEQ ID NO: 4157923 - DNA, 17 bp, Homo sapiens
tgtaccatcattttatt

SEQ ID NO: 4157924 - DNA, 17 bp, Homo sapiens
tgtaccatgtacatgaa

SEQ ID NO: 4157925 - DNA, 22 bp, Homo sapiens
tgtaccgtaggctttgtattca

SEQ ID NO: 4157926 - DNA, 18 bp, Homo sapiens
tgtacctctaagtacata

SEQ ID NO: 4157927 - DNA, 19 bp, Homo sapiens
tgtactctggggtgctgcc

SEQ ID NO: 4157928 - DNA, 20 bp, Homo sapiens
tgtactgaatttttttgtaa

SEQ ID NO: 4157929 - DNA, 15 bp, Homo sapiens
tgtactgacttgagg

SEQ ID NO: 4157930 - DNA, 20 bp, Homo sapiens
tgtactgagccttgtaattc

SEQ ID NO: 4157931 - DNA, 16 bp, Homo sapiens
tgtactgtagtttttc

SEQ ID NO: 4157932 - DNA, 16 bp, Homo sapiens
tgtactgtctgttatg

SEQ ID NO: 4157933 - DNA, 16 bp, Homo sapiens
tgtactgttctgtgtc

SEQ ID NO: 4157934 - DNA, 15 bp, Homo sapiens
tgtacttaactattc

SEQ ID NO: 4157935 - DNA, 16 bp, Homo sapiens
tgtacttaataaattc

SEQ ID NO: 4157936 - DNA, 22 bp, Homo sapiens
tgtacttcccgggccagggctg

SEQ ID NO: 4157937 - DNA, 18 bp, Homo sapiens
tgtacttgatttgatgtg

SEQ ID NO: 4157938 - DNA, 22 bp, Homo sapiens
tgtacttggagtattggggtct

SEQ ID NO: 4157939 - DNA, 22 bp, Homo sapiens
tgtacttgtgtttgcttaaaca

SEQ ID NO: 4157940 - DNA, 16 bp, Homo sapiens
tgtacttttaaggcag

SEQ ID NO: 4157941 - DNA, 17 bp, Homo sapiens
tgtagaacactaattca

SEQ ID NO: 4157942 - DNA, 18 bp, Homo sapiens
tgtagaacactaattcat

SEQ ID NO: 4157943 - DNA, 20 bp, Homo sapiens
tgtagaactcactctgggct

SEQ ID NO: 4157944 - DNA, 16 bp, Homo sapiens
tgtagaagcattcctt

SEQ ID NO: 4157945 - DNA, 15 bp, Homo sapiens
tgtagactgtgccag

SEQ ID NO: 4157946 - DNA, 14 bp, Homo sapiens
tgtagagttaagaa

SEQ ID NO: 4157947 - DNA, 16 bp, Homo sapiens
tgtagagttaagaagc

SEQ ID NO: 4157948 - DNA, 22 bp, Homo sapiens
tgtagatattgttttctgtaaa

SEQ ID NO: 4157949 - DNA, 24 bp, Homo sapiens
tgtagatattgttttctgtaaata

SEQ ID NO: 4157950 - DNA, 13 bp, Homo sapiens
tgtagatcccaag

SEQ ID NO: 4157951 - DNA, 19 bp, Homo sapiens
tgtagatgcagaaaaagaa

SEQ ID NO: 4157952 - DNA, 20 bp, Homo sapiens
tgtagcaaaacgcatggagt

SEQ ID NO: 4157953 - DNA, 22 bp, Homo sapiens
tgtagcaaaattcttaagtatg

SEQ ID NO: 4157954 - DNA, 14 bp, Homo sapiens
tgtagcactgaggg

SEQ ID NO: 4157955 - DNA, 11 bp, Homo sapiens
tgtagcagtga

SEQ ID NO: 4157956 - DNA, 13 bp, Homo sapiens
tgtagccacagct

SEQ ID NO: 4157957 - DNA, 16 bp, Homo sapiens
tgtagccacagctgct

SEQ ID NO: 4157958 - DNA, 22 bp, Homo sapiens
tgtagccacagctgctgttctc

SEQ ID NO: 4157959 - DNA, 15 bp, Homo sapiens
tgtagccagctgtgc

SEQ ID NO: 4157960 - DNA, 17 bp, Homo sapiens
tgtagccaggtatggct

SEQ ID NO: 4157961 - DNA, 20 bp, Homo sapiens
tgtagcgtgtttacatgtgt

SEQ ID NO: 4157962 - DNA, 19 bp, Homo sapiens
tgtagcttcttctgaaaga

SEQ ID NO: 4157963 - DNA, 18 bp, Homo sapiens
tgtagcttttggggaggg

SEQ ID NO: 4157964 - DNA, 21 bp, Homo sapiens
tgtaggaaggtctcattcttc

SEQ ID NO: 4157965 - DNA, 13 bp, Homo sapiens
tgtaggagaaact

SEQ ID NO: 4157966 - DNA, 18 bp, Homo sapiens
tgtaggagaaactcccat

SEQ ID NO: 4157967 - DNA, 12 bp, Homo sapiens
tgtaggagctgc

SEQ ID NO: 4157968 - DNA, 15 bp, Homo sapiens
tgtaggagctgcctt

SEQ ID NO: 4157969 - DNA, 16 bp, Homo sapiens
tgtaggtaaattctta

SEQ ID NO: 4157970 - DNA, 17 bp, Homo sapiens
tgtaggtatgaataagt

SEQ ID NO: 4157971 - DNA, 19 bp, Homo sapiens
tgtagtaaactatttatct

SEQ ID NO: 4157972 - DNA, 16 bp, Homo sapiens
tgtagtagcgtttttt

SEQ ID NO: 4157973 - DNA, 13 bp, Homo sapiens
tgtagtagtctca

SEQ ID NO: 4157974 - DNA, 14 bp, Homo sapiens
tgtagtagtctcat

SEQ ID NO: 4157975 - DNA, 19 bp, Homo sapiens
tgtagtcatttactaaaca

SEQ ID NO: 4157976 - DNA, 23 bp, Homo sapiens
tgtagtcctagccactcaggagg

SEQ ID NO: 4157977 - DNA, 14 bp, Homo sapiens
tgtagttttgttta

SEQ ID NO: 4157978 - DNA, 20 bp, Homo sapiens
tgtataaacataagttgcat

SEQ ID NO: 4157979 - DNA, 13 bp, Homo sapiens
tgtataaagcatg

SEQ ID NO: 4157980 - DNA, 14 bp, Homo sapiens
tgtataaatgtgat

SEQ ID NO: 4157981 - DNA, 18 bp, Homo sapiens
tgtataagcactgaaaaa

SEQ ID NO: 4157982 - DNA, 16 bp, Homo sapiens
tgtataagtggaggca

SEQ ID NO: 4157983 - DNA, 23 bp, Homo sapiens
tgtataagtggaggcactttagg

SEQ ID NO: 4157984 - DNA, 13 bp, Homo sapiens
tgtatacagtgca

SEQ ID NO: 4157985 - DNA, 19 bp, Homo sapiens
tgtatactatagtaccagt

SEQ ID NO: 4157986 - DNA, 14 bp, Homo sapiens
tgtatagaaatcta

SEQ ID NO: 4157987 - DNA, 12 bp, Homo sapiens
tgtatagaccaa

SEQ ID NO: 4157988 - DNA, 16 bp, Homo sapiens
tgtatagaccaaagca

SEQ ID NO: 4157989 - DNA, 20 bp, Homo sapiens
tgtatagaccaaagcaaaga

SEQ ID NO: 4157990 - DNA, 17 bp, Homo sapiens
tgtatagagaatttaag

SEQ ID NO: 4157991 - DNA, 22 bp, Homo sapiens
tgtatagagaatttaagtagaa

SEQ ID NO: 4157992 - DNA, 18 bp, Homo sapiens
tgtatagatgcaagatat

SEQ ID NO: 4157993 - DNA, 14 bp, Homo sapiens
tgtatatacagtta

SEQ ID NO: 4157994 - DNA, 21 bp, Homo sapiens
tgtatatagagattgtacatt

SEQ ID NO: 4157995 - DNA, 22 bp, Homo sapiens
tgtatatagagattgtacattt

SEQ ID NO: 4157996 - DNA, 21 bp, Homo sapiens
tgtatataggacaaaatgtta

SEQ ID NO: 4157997 - DNA, 17 bp, Homo sapiens
tgtatatatattaagag

SEQ ID NO: 4157998 - DNA, 18 bp, Homo sapiens
tgtatatatttcctatat

SEQ ID NO: 4157999 - DNA, 19 bp, Homo sapiens
tgtatatgtttatatactg

SEQ ID NO: 4158000 - DNA, 18 bp, Homo sapiens
tgtatattacacatttgt

SEQ ID NO: 4158001 - DNA, 19 bp, Homo sapiens
tgtatattgtcagatattt

SEQ ID NO: 4158002 - DNA, 15 bp, Homo sapiens
tgtatatttgtacaa

SEQ ID NO: 4158003 - DNA, 17 bp, Homo sapiens
tgtatcaatgagtaaca

SEQ ID NO: 4158004 - DNA, 16 bp, Homo sapiens
tgtatcaggtcaggga

SEQ ID NO: 4158005 - DNA, 17 bp, Homo sapiens
tgtatcaggtcagggac

SEQ ID NO: 4158006 - DNA, 14 bp, Homo sapiens
tgtatcagtgtcct

SEQ ID NO: 4158007 - DNA, 15 bp, Homo sapiens
tgtatcagtgtcctt

SEQ ID NO: 4158008 - DNA, 19 bp, Homo sapiens
tgtatcgatgttttattat

SEQ ID NO: 4158009 - DNA, 15 bp, Homo sapiens
tgtatcggagacagt

SEQ ID NO: 4158010 - DNA, 17 bp, Homo sapiens
tgtatctagtgcagctg

SEQ ID NO: 4158011 - DNA, 19 bp, Homo sapiens
tgtatctagtgcagctgat

SEQ ID NO: 4158012 - DNA, 21 bp, Homo sapiens
tgtatctagtgcagctgattt

SEQ ID NO: 4158013 - DNA, 18 bp, Homo sapiens
tgtatctcatttaatttg

SEQ ID NO: 4158014 - DNA, 15 bp, Homo sapiens
tgtatcttaaatttg

SEQ ID NO: 4158015 - DNA, 21 bp, Homo sapiens
tgtatgaaaaattggggagga

SEQ ID NO: 4158016 - DNA, 14 bp, Homo sapiens
tgtatgactaaaga

SEQ ID NO: 4158017 - DNA, 20 bp, Homo sapiens
tgtatgactaaagagagaat

SEQ ID NO: 4158018 - DNA, 21 bp, Homo sapiens
tgtatgactaaagagagaatg

SEQ ID NO: 4158019 - DNA, 15 bp, Homo sapiens
tgtatgatttataaa

SEQ ID NO: 4158020 - DNA, 13 bp, Homo sapiens
tgtatgatttgtt

SEQ ID NO: 4158021 - DNA, 20 bp, Homo sapiens
tgtatgccaagtgagaagat

SEQ ID NO: 4158022 - DNA, 14 bp, Homo sapiens
tgtatgctgatcat

SEQ ID NO: 4158023 - DNA, 13 bp, Homo sapiens
tgtatggaaacac

SEQ ID NO: 4158024 - DNA, 14 bp, Homo sapiens
tgtatggaaacact

SEQ ID NO: 4158025 - DNA, 16 bp, Homo sapiens
tgtatggaatacagtg

SEQ ID NO: 4158026 - DNA, 18 bp, Homo sapiens
tgtatggaatacagtgtt

SEQ ID NO: 4158027 - DNA, 19 bp, Homo sapiens
tgtatggaatacagtgtta

SEQ ID NO: 4158028 - DNA, 13 bp, Homo sapiens
tgtatggggaggc

SEQ ID NO: 4158029 - DNA, 17 bp, Homo sapiens
tgtatgtgcactgtcac

SEQ ID NO: 4158030 - DNA, 13 bp, Homo sapiens
tgtatgtttacat

SEQ ID NO: 4158031 - DNA, 14 bp, Homo sapiens
tgtattacagatgc

SEQ ID NO: 4158032 - DNA, 21 bp, Homo sapiens
tgtattaggtgtcatttccat

SEQ ID NO: 4158033 - DNA, 14 bp, Homo sapiens
tgtattatttataa

SEQ ID NO: 4158034 - DNA, 16 bp, Homo sapiens
tgtattatttggagtt

SEQ ID NO: 4158035 - DNA, 16 bp, Homo sapiens
tgtattcatccagagt

SEQ ID NO: 4158036 - DNA, 20 bp, Homo sapiens
tgtattcatccagagttctt

SEQ ID NO: 4158037 - DNA, 20 bp, Homo sapiens
tgtattctagctaatgtaat

SEQ ID NO: 4158038 - DNA, 22 bp, Homo sapiens
tgtattcttctgtatttctagg

SEQ ID NO: 4158039 - DNA, 20 bp, Homo sapiens
tgtattgagatttcttaaat

SEQ ID NO: 4158040 - DNA, 15 bp, Homo sapiens
tgtattgcacattgt

SEQ ID NO: 4158041 - DNA, 19 bp, Homo sapiens
tgtattggatatataagag

SEQ ID NO: 4158042 - DNA, 18 bp, Homo sapiens
tgtattggttaaaactgt

SEQ ID NO: 4158043 - DNA, 15 bp, Homo sapiens
tgtattgttcccagt

SEQ ID NO: 4158044 - DNA, 19 bp, Homo sapiens
tgtattgttcccagtgaca

SEQ ID NO: 4158045 - DNA, 20 bp, Homo sapiens
tgtatttacgctttgattca

SEQ ID NO: 4158046 - DNA, 23 bp, Homo sapiens
tgtatttacgctttgattcatag

SEQ ID NO: 4158047 - DNA, 14 bp, Homo sapiens
tgtatttataaata

SEQ ID NO: 4158048 - DNA, 21 bp, Homo sapiens
tgtatttataaatatatttaa

SEQ ID NO: 4158049 - DNA, 21 bp, Homo sapiens
tgtatttattcctctgtccta

SEQ ID NO: 4158050 - DNA, 11 bp, Homo sapiens
tgtatttcctt

SEQ ID NO: 4158051 - DNA, 18 bp, Homo sapiens
tgtatttcttatacgctt

SEQ ID NO: 4158052 - DNA, 23 bp, Homo sapiens
tgtattttatcttattttctcaa

SEQ ID NO: 4158053 - DNA, 15 bp, Homo sapiens
tgtattttgaagaat

SEQ ID NO: 4158054 - DNA, 19 bp, Homo sapiens
tgtatttttcaataaagca

SEQ ID NO: 4158055 - DNA, 19 bp, Homo sapiens
tgtattttttaaaacacta

SEQ ID NO: 4158056 - DNA, 22 bp, Homo sapiens
tgtattttttaaaacactaaaa

SEQ ID NO: 4158057 - DNA, 15 bp, Homo sapiens
tgtcaaacagtgcca

SEQ ID NO: 4158058 - DNA, 18 bp, Homo sapiens
tgtcaaactgtagaaatg

SEQ ID NO: 4158059 - DNA, 22 bp, Homo sapiens
tgtcaacacccctgtgtggatg

SEQ ID NO: 4158060 - DNA, 15 bp, Homo sapiens
tgtcaactaaatgag

SEQ ID NO: 4158061 - DNA, 15 bp, Homo sapiens
tgtcaactctttgtt

SEQ ID NO: 4158062 - DNA, 14 bp, Homo sapiens
tgtcaacttctggc

SEQ ID NO: 4158063 - DNA, 18 bp, Homo sapiens
tgtcaacttctggctcct

SEQ ID NO: 4158064 - DNA, 14 bp, Homo sapiens
tgtcaagaaagagc

SEQ ID NO: 4158065 - DNA, 15 bp, Homo sapiens
tgtcaagctgctctg

SEQ ID NO: 4158066 - DNA, 16 bp, Homo sapiens
tgtcaaggaagacttt

SEQ ID NO: 4158067 - DNA, 19 bp, Homo sapiens
tgtcaagtctctgctggcc

SEQ ID NO: 4158068 - DNA, 18 bp, Homo sapiens
tgtcaagttaacaaggaa

SEQ ID NO: 4158069 - DNA, 12 bp, Homo sapiens
tgtcaataaaca

SEQ ID NO: 4158070 - DNA, 16 bp, Homo sapiens
tgtcaataaacagctt

SEQ ID NO: 4158071 - DNA, 19 bp, Homo sapiens
tgtcaatattaaatacaga

SEQ ID NO: 4158072 - DNA, 23 bp, Homo sapiens
tgtcacaagtggtgtttattgca

SEQ ID NO: 4158073 - DNA, 14 bp, Homo sapiens
tgtcacaatcctaa

SEQ ID NO: 4158074 - DNA, 21 bp, Homo sapiens
tgtcacaatgagattgaattt

SEQ ID NO: 4158075 - DNA, 15 bp, Homo sapiens
tgtcacaccagccat

SEQ ID NO: 4158076 - DNA, 18 bp, Homo sapiens
tgtcacagaaatcagagg

SEQ ID NO: 4158077 - DNA, 15 bp, Homo sapiens
tgtcacatcagataa

SEQ ID NO: 4158078 - DNA, 14 bp, Homo sapiens
tgtcacattctatt

SEQ ID NO: 4158079 - DNA, 14 bp, Homo sapiens
tgtcacattgcatt

SEQ ID NO: 4158080 - DNA, 19 bp, Homo sapiens
tgtcacattgcattctatt

SEQ ID NO: 4158081 - DNA, 15 bp, Homo sapiens
tgtcaccaaggaaac

SEQ ID NO: 4158082 - DNA, 20 bp, Homo sapiens
tgtcacccccactcccgcct

SEQ ID NO: 4158083 - DNA, 20 bp, Homo sapiens
tgtcacccgatcgccagcaa

SEQ ID NO: 4158084 - DNA, 23 bp, Homo sapiens
tgtcaccgtgagcagctttggaa

SEQ ID NO: 4158085 - DNA, 16 bp, Homo sapiens
tgtcacctctctcaga

SEQ ID NO: 4158086 - DNA, 20 bp, Homo sapiens
tgtcactagaatggataaaa

SEQ ID NO: 4158087 - DNA, 16 bp, Homo sapiens
tgtcactggctggctc

SEQ ID NO: 4158088 - DNA, 17 bp, Homo sapiens
tgtcactggctggctcc

SEQ ID NO: 4158089 - DNA, 21 bp, Homo sapiens
tgtcactggctggctcctagg

SEQ ID NO: 4158090 - DNA, 18 bp, Homo sapiens
tgtcacttgtgctttgct

SEQ ID NO: 4158091 - DNA, 20 bp, Homo sapiens
tgtcacttgtgctttgctct

SEQ ID NO: 4158092 - DNA, 14 bp, Homo sapiens
tgtcactttgctct

SEQ ID NO: 4158093 - DNA, 15 bp, Homo sapiens
tgtcagaagcctcca

SEQ ID NO: 4158094 - DNA, 22 bp, Homo sapiens
tgtcagaatcagaatcatggag

SEQ ID NO: 4158095 - DNA, 23 bp, Homo sapiens
tgtcagatattttttcagaaata

SEQ ID NO: 4158096 - DNA, 11 bp, Homo sapiens
tgtcagatttt

SEQ ID NO: 4158097 - DNA, 11 bp, Homo sapiens
tgtcagcagac

SEQ ID NO: 4158098 - DNA, 16 bp, Homo sapiens
tgtcagcagacacaca

SEQ ID NO: 4158099 - DNA, 17 bp, Homo sapiens
tgtcagcagacacacat

SEQ ID NO: 4158100 - DNA, 16 bp, Homo sapiens
tgtcagcatctggctg

SEQ ID NO: 4158101 - DNA, 22 bp, Homo sapiens
tgtcagccagccgccctgggct

SEQ ID NO: 4158102 - DNA, 24 bp, Homo sapiens
tgtcagctgaggctgggggagagc

SEQ ID NO: 4158103 - DNA, 22 bp, Homo sapiens
tgtcaggcatggctcagagctt

SEQ ID NO: 4158104 - DNA, 13 bp, Homo sapiens
tgtcaggccccca

SEQ ID NO: 4158105 - DNA, 14 bp, Homo sapiens
tgtcaggcccccag

SEQ ID NO: 4158106 - DNA, 15 bp, Homo sapiens
tgtcagtatttcaac

SEQ ID NO: 4158107 - DNA, 18 bp, Homo sapiens
tgtcagtatttcagtgta

SEQ ID NO: 4158108 - DNA, 23 bp, Homo sapiens
tgtcagtatttcagtgtagttaa

SEQ ID NO: 4158109 - DNA, 22 bp, Homo sapiens
tgtcagtcacagccacccctga

SEQ ID NO: 4158110 - DNA, 15 bp, Homo sapiens
tgtcataagaatgaa

SEQ ID NO: 4158111 - DNA, 11 bp, Homo sapiens
tgtcatcactc

SEQ ID NO: 4158112 - DNA, 16 bp, Homo sapiens
tgtcatctctctgggg

SEQ ID NO: 4158113 - DNA, 20 bp, Homo sapiens
tgtcatgctgggatttccaa

SEQ ID NO: 4158114 - DNA, 15 bp, Homo sapiens
tgtcatgttgcttgt

SEQ ID NO: 4158115 - DNA, 18 bp, Homo sapiens
tgtcattgctgttgtccc

SEQ ID NO: 4158116 - DNA, 15 bp, Homo sapiens
tgtcatttcattcca

SEQ ID NO: 4158117 - DNA, 16 bp, Homo sapiens
tgtcatttcattccat

SEQ ID NO: 4158118 - DNA, 18 bp, Homo sapiens
tgtcatttgttgtgatgt

SEQ ID NO: 4158119 - DNA, 18 bp, Homo sapiens
tgtccaaaagcgccctca

SEQ ID NO: 4158120 - DNA, 21 bp, Homo sapiens
tgtccaaagaggctgcccctc

SEQ ID NO: 4158121 - DNA, 14 bp, Homo sapiens
tgtccaaggaaact

SEQ ID NO: 4158122 - DNA, 19 bp, Homo sapiens
tgtccaagttcttcacctc

SEQ ID NO: 4158123 - DNA, 15 bp, Homo sapiens
tgtccagaagaatat

SEQ ID NO: 4158124 - DNA, 16 bp, Homo sapiens
tgtccagaagaatatt

SEQ ID NO: 4158125 - DNA, 20 bp, Homo sapiens
tgtccagaagaatattcagg

SEQ ID NO: 4158126 - DNA, 21 bp, Homo sapiens
tgtccagagagcaactctgag

SEQ ID NO: 4158127 - DNA, 20 bp, Homo sapiens
tgtccagagctgcttccccg

SEQ ID NO: 4158128 - DNA, 22 bp, Homo sapiens
tgtccagattattggctgcttt

SEQ ID NO: 4158129 - DNA, 23 bp, Homo sapiens
tgtccagattattggctgctttg

SEQ ID NO: 4158130 - DNA, 21 bp, Homo sapiens
tgtccagcacagaaggaatct

SEQ ID NO: 4158131 - DNA, 14 bp, Homo sapiens
tgtccagcctgggc

SEQ ID NO: 4158132 - DNA, 11 bp, Homo sapiens
tgtccagctcc

SEQ ID NO: 4158133 - DNA, 12 bp, Homo sapiens
tgtccagctcca

SEQ ID NO: 4158134 - DNA, 23 bp, Homo sapiens
tgtccagctggggccagaggctg

SEQ ID NO: 4158135 - DNA, 13 bp, Homo sapiens
tgtccatacactt

SEQ ID NO: 4158136 - DNA, 20 bp, Homo sapiens
tgtccatacactttgttgca

SEQ ID NO: 4158137 - DNA, 14 bp, Homo sapiens
tgtccatactaaca

SEQ ID NO: 4158138 - DNA, 21 bp, Homo sapiens
tgtccatgtgcacccggcctg

SEQ ID NO: 4158139 - DNA, 19 bp, Homo sapiens
tgtcccaattctgcccgct

SEQ ID NO: 4158140 - DNA, 18 bp, Homo sapiens
tgtcccaccatacgagca

SEQ ID NO: 4158141 - DNA, 23 bp, Homo sapiens
tgtcccaccatacgagcacctcc

SEQ ID NO: 4158142 - DNA, 14 bp, Homo sapiens
tgtcccacccacac

SEQ ID NO: 4158143 - DNA, 18 bp, Homo sapiens
tgtcccacccacacagct

SEQ ID NO: 4158144 - DNA, 21 bp, Homo sapiens
tgtcccacccacacagctgcc

SEQ ID NO: 4158145 - DNA, 18 bp, Homo sapiens
tgtcccacccccaccccc

SEQ ID NO: 4158146 - DNA, 12 bp, Homo sapiens
tgtcccacccct

SEQ ID NO: 4158147 - DNA, 19 bp, Homo sapiens
tgtcccacccctagccacc

SEQ ID NO: 4158148 - DNA, 18 bp, Homo sapiens
tgtcccaccgggagcctc

SEQ ID NO: 4158149 - DNA, 17 bp, Homo sapiens
tgtcccacgtgtcttcc

SEQ ID NO: 4158150 - DNA, 12 bp, Homo sapiens
tgtcccagcccc

SEQ ID NO: 4158151 - DNA, 22 bp, Homo sapiens
tgtcccagccccggcaagccac

SEQ ID NO: 4158152 - DNA, 17 bp, Homo sapiens
tgtcccaggccggccca

SEQ ID NO: 4158153 - DNA, 17 bp, Homo sapiens
tgtcccatgatccctgt

SEQ ID NO: 4158154 - DNA, 18 bp, Homo sapiens
tgtcccatggacactcca

SEQ ID NO: 4158155 - DNA, 19 bp, Homo sapiens
tgtcccatggacactccag

SEQ ID NO: 4158156 - DNA, 15 bp, Homo sapiens
tgtcccatttccttg

SEQ ID NO: 4158157 - DNA, 17 bp, Homo sapiens
tgtcccatttccttgga

SEQ ID NO: 4158158 - DNA, 23 bp, Homo sapiens
tgtcccatttccttggaggccac

SEQ ID NO: 4158159 - DNA, 16 bp, Homo sapiens
tgtccccaaaatgtga

SEQ ID NO: 4158160 - DNA, 24 bp, Homo sapiens
tgtccccaaaggacgcctgcagga

SEQ ID NO: 4158161 - DNA, 19 bp, Homo sapiens
tgtcccccccaggccttgt

SEQ ID NO: 4158162 - DNA, 18 bp, Homo sapiens
tgtccccctcccctccca

SEQ ID NO: 4158163 - DNA, 17 bp, Homo sapiens
tgtccccgtgttgcatg

SEQ ID NO: 4158164 - DNA, 23 bp, Homo sapiens
tgtcccctcactctgtcagccag

SEQ ID NO: 4158165 - DNA, 14 bp, Homo sapiens
tgtcccctcttgac

SEQ ID NO: 4158166 - DNA, 20 bp, Homo sapiens
tgtccctaccgagtctcttc

SEQ ID NO: 4158167 - DNA, 21 bp, Homo sapiens
tgtccctaccgagtctcttct

SEQ ID NO: 4158168 - DNA, 17 bp, Homo sapiens
tgtccctcccttgctga

SEQ ID NO: 4158169 - DNA, 22 bp, Homo sapiens
tgtccctctagtgccttcttta

SEQ ID NO: 4158170 - DNA, 15 bp, Homo sapiens
tgtcccttgcctctg

SEQ ID NO: 4158171 - DNA, 14 bp, Homo sapiens
tgtcccttgctgta

SEQ ID NO: 4158172 - DNA, 15 bp, Homo sapiens
tgtccctttcagaga

SEQ ID NO: 4158173 - DNA, 12 bp, Homo sapiens
tgtccctttctt

SEQ ID NO: 4158174 - DNA, 15 bp, Homo sapiens
tgtccctttcttctc

SEQ ID NO: 4158175 - DNA, 17 bp, Homo sapiens
tgtccctttcttggcca

SEQ ID NO: 4158176 - DNA, 12 bp, Homo sapiens
tgtcccttttcc

SEQ ID NO: 4158177 - DNA, 23 bp, Homo sapiens
tgtccgctgggtggtaccctctg

SEQ ID NO: 4158178 - DNA, 22 bp, Homo sapiens
tgtcctaaaacacctggtagga

SEQ ID NO: 4158179 - DNA, 16 bp, Homo sapiens
tgtcctaaggaacctt

SEQ ID NO: 4158180 - DNA, 16 bp, Homo sapiens
tgtcctaaggacacac

SEQ ID NO: 4158181 - DNA, 21 bp, Homo sapiens
tgtcctaagtgtcaagtcctg

SEQ ID NO: 4158182 - DNA, 22 bp, Homo sapiens
tgtcctaagtgtcaagtcctga

SEQ ID NO: 4158183 - DNA, 20 bp, Homo sapiens
tgtcctaccagttgccctag

SEQ ID NO: 4158184 - DNA, 19 bp, Homo sapiens
tgtcctatctatcttccaa

SEQ ID NO: 4158185 - DNA, 18 bp, Homo sapiens
tgtcctatggacaactta

SEQ ID NO: 4158186 - DNA, 15 bp, Homo sapiens
tgtcctcagcatttc

SEQ ID NO: 4158187 - DNA, 13 bp, Homo sapiens
tgtcctcagcctt

SEQ ID NO: 4158188 - DNA, 20 bp, Homo sapiens
tgtcctcagccttgccagag

SEQ ID NO: 4158189 - DNA, 12 bp, Homo sapiens
tgtcctcaggga

SEQ ID NO: 4158190 - DNA, 23 bp, Homo sapiens
tgtcctcagggagcagggaaggc

SEQ ID NO: 4158191 - DNA, 14 bp, Homo sapiens
tgtcctccaagtgc

SEQ ID NO: 4158192 - DNA, 16 bp, Homo sapiens
tgtcctccaagtgccc

SEQ ID NO: 4158193 - DNA, 19 bp, Homo sapiens
tgtcctccaagtgccccct

SEQ ID NO: 4158194 - DNA, 16 bp, Homo sapiens
tgtcctccagaagcct

SEQ ID NO: 4158195 - DNA, 17 bp, Homo sapiens
tgtcctccagaagcctc

SEQ ID NO: 4158196 - DNA, 18 bp, Homo sapiens
tgtcctccagaagcctct

SEQ ID NO: 4158197 - DNA, 23 bp, Homo sapiens
tgtcctccagaagcctctggcta

SEQ ID NO: 4158198 - DNA, 21 bp, Homo sapiens
tgtcctccaggagcttcttgt

SEQ ID NO: 4158199 - DNA, 13 bp, Homo sapiens
tgtcctcccatcc

SEQ ID NO: 4158200 - DNA, 22 bp, Homo sapiens
tgtcctcccatcccctggactg

SEQ ID NO: 4158201 - DNA, 18 bp, Homo sapiens
tgtcctcctgctgccagt

SEQ ID NO: 4158202 - DNA, 13 bp, Homo sapiens
tgtcctctcgagc

SEQ ID NO: 4158203 - DNA, 22 bp, Homo sapiens
tgtcctctgcaagcttcttgct

SEQ ID NO: 4158204 - DNA, 22 bp, Homo sapiens
tgtcctcttctgctcttttcct

SEQ ID NO: 4158205 - DNA, 16 bp, Homo sapiens
tgtcctgcctgtctgc

SEQ ID NO: 4158206 - DNA, 17 bp, Homo sapiens
tgtcctgcctgtctgcc

SEQ ID NO: 4158207 - DNA, 20 bp, Homo sapiens
tgtcctgctggcttccagct

SEQ ID NO: 4158208 - DNA, 15 bp, Homo sapiens
tgtcctgggcctgca

SEQ ID NO: 4158209 - DNA, 16 bp, Homo sapiens
tgtccttaacccacct

SEQ ID NO: 4158210 - DNA, 18 bp, Homo sapiens
tgtccttagaacatttta

SEQ ID NO: 4158211 - DNA, 14 bp, Homo sapiens
tgtccttccctgca

SEQ ID NO: 4158212 - DNA, 22 bp, Homo sapiens
tgtccttccctgcatttctgag

SEQ ID NO: 4158213 - DNA, 18 bp, Homo sapiens
tgtcctttaaaaaagaaa

SEQ ID NO: 4158214 - DNA, 14 bp, Homo sapiens
tgtcctttcccttc

SEQ ID NO: 4158215 - DNA, 23 bp, Homo sapiens
tgtcctttcccttcagtaccctc

SEQ ID NO: 4158216 - DNA, 14 bp, Homo sapiens
tgtcgatgcacagt

SEQ ID NO: 4158217 - DNA, 17 bp, Homo sapiens
tgtcgccccaggccctc

SEQ ID NO: 4158218 - DNA, 19 bp, Homo sapiens
tgtcgccccaggccctccc

SEQ ID NO: 4158219 - DNA, 23 bp, Homo sapiens
tgtcgccccaggccctccctgac

SEQ ID NO: 4158220 - DNA, 12 bp, Homo sapiens
tgtcggctccag

SEQ ID NO: 4158221 - DNA, 19 bp, Homo sapiens
tgtcggctccagtccccag

SEQ ID NO: 4158222 - DNA, 20 bp, Homo sapiens
tgtctaaacaatgctgattt

SEQ ID NO: 4158223 - DNA, 16 bp, Homo sapiens
tgtctaacccccagct

SEQ ID NO: 4158224 - DNA, 17 bp, Homo sapiens
tgtctaacccccagctg

SEQ ID NO: 4158225 - DNA, 18 bp, Homo sapiens
tgtctaacccccagctgg

SEQ ID NO: 4158226 - DNA, 14 bp, Homo sapiens
tgtctaagatagta

SEQ ID NO: 4158227 - DNA, 18 bp, Homo sapiens
tgtctaattaaaacactt

SEQ ID NO: 4158228 - DNA, 18 bp, Homo sapiens
tgtctaattgcatctcaa

SEQ ID NO: 4158229 - DNA, 17 bp, Homo sapiens
tgtctagaatgtggatt

SEQ ID NO: 4158230 - DNA, 19 bp, Homo sapiens
tgtctaggtctcctcaggg

SEQ ID NO: 4158231 - DNA, 22 bp, Homo sapiens
tgtctataatcccagcactttg

SEQ ID NO: 4158232 - DNA, 17 bp, Homo sapiens
tgtctattattatgaag

SEQ ID NO: 4158233 - DNA, 12 bp, Homo sapiens
tgtctattttaa

SEQ ID NO: 4158234 - DNA, 18 bp, Homo sapiens
tgtctcaacgcctccccc

SEQ ID NO: 4158235 - DNA, 19 bp, Homo sapiens
tgtctcaagagggcactgg

SEQ ID NO: 4158236 - DNA, 21 bp, Homo sapiens
tgtctcaagagggcactggtg

SEQ ID NO: 4158237 - DNA, 23 bp, Homo sapiens
tgtctcaagagggcactggtggc

SEQ ID NO: 4158238 - DNA, 18 bp, Homo sapiens
tgtctcactgttctgcaa

SEQ ID NO: 4158239 - DNA, 19 bp, Homo sapiens
tgtctcactgttctgcaaa

SEQ ID NO: 4158240 - DNA, 14 bp, Homo sapiens
tgtctcatcctcct

SEQ ID NO: 4158241 - DNA, 11 bp, Homo sapiens
tgtctccagct

SEQ ID NO: 4158242 - DNA, 12 bp, Homo sapiens
tgtctccagctg

SEQ ID NO: 4158243 - DNA, 14 bp, Homo sapiens
tgtctccagctgcc

SEQ ID NO: 4158244 - DNA, 20 bp, Homo sapiens
tgtctccagctgcctgggcc

SEQ ID NO: 4158245 - DNA, 19 bp, Homo sapiens
tgtctccaggccatgatgg

SEQ ID NO: 4158246 - DNA, 14 bp, Homo sapiens
tgtctcctactcct

SEQ ID NO: 4158247 - DNA, 17 bp, Homo sapiens
tgtctcctactcctgac

SEQ ID NO: 4158248 - DNA, 13 bp, Homo sapiens
tgtctctgaggac

SEQ ID NO: 4158249 - DNA, 23 bp, Homo sapiens
tgtctctggggcagatccccact

SEQ ID NO: 4158250 - DNA, 12 bp, Homo sapiens
tgtctcttctgg

SEQ ID NO: 4158251 - DNA, 13 bp, Homo sapiens
tgtctcttgaaaa

SEQ ID NO: 4158252 - DNA, 18 bp, Homo sapiens
tgtctgaagtcactgcac

SEQ ID NO: 4158253 - DNA, 20 bp, Homo sapiens
tgtctgaagtcactgcacag

SEQ ID NO: 4158254 - DNA, 23 bp, Homo sapiens
tgtctgaatcgagtgagacaaaa

SEQ ID NO: 4158255 - DNA, 20 bp, Homo sapiens
tgtctgagtgaacctgtata

SEQ ID NO: 4158256 - DNA, 14 bp, Homo sapiens
tgtctgcacccagg

SEQ ID NO: 4158257 - DNA, 18 bp, Homo sapiens
tgtctgccatgttgcccc

SEQ ID NO: 4158258 - DNA, 11 bp, Homo sapiens
tgtctgccctt

SEQ ID NO: 4158259 - DNA, 23 bp, Homo sapiens
tgtctgctgagttggcctggcca

SEQ ID NO: 4158260 - DNA, 23 bp, Homo sapiens
tgtctgctggtcacttcttctgt

SEQ ID NO: 4158261 - DNA, 18 bp, Homo sapiens
tgtctggcctgaggtcaa

SEQ ID NO: 4158262 - DNA, 23 bp, Homo sapiens
tgtctggctttttcctctgagcc

SEQ ID NO: 4158263 - DNA, 17 bp, Homo sapiens
tgtctgtggatggtcat

SEQ ID NO: 4158264 - DNA, 19 bp, Homo sapiens
tgtctgttaccatgtcact

SEQ ID NO: 4158265 - DNA, 23 bp, Homo sapiens
tgtctgttaccatgtcactgtgg

SEQ ID NO: 4158266 - DNA, 15 bp, Homo sapiens
tgtctgtttgtttca

SEQ ID NO: 4158267 - DNA, 19 bp, Homo sapiens
tgtctgtttgtttcaagaa

SEQ ID NO: 4158268 - DNA, 20 bp, Homo sapiens
tgtctgtttgtttcaagaac

SEQ ID NO: 4158269 - DNA, 22 bp, Homo sapiens
tgtctgtttgtttcaagaacct

SEQ ID NO: 4158270 - DNA, 16 bp, Homo sapiens
tgtcttatctggccct

SEQ ID NO: 4158271 - DNA, 15 bp, Homo sapiens
tgtcttatggtccag

SEQ ID NO: 4158272 - DNA, 16 bp, Homo sapiens
tgtcttatggtccaga

SEQ ID NO: 4158273 - DNA, 13 bp, Homo sapiens
tgtcttccaagga

SEQ ID NO: 4158274 - DNA, 12 bp, Homo sapiens
tgtcttccataa

SEQ ID NO: 4158275 - DNA, 16 bp, Homo sapiens
tgtcttccctgggctg

SEQ ID NO: 4158276 - DNA, 23 bp, Homo sapiens
tgtcttcggccgagctggtttcc

SEQ ID NO: 4158277 - DNA, 13 bp, Homo sapiens
tgtcttctgggca

SEQ ID NO: 4158278 - DNA, 16 bp, Homo sapiens
tgtcttctgggcacag

SEQ ID NO: 4158279 - DNA, 15 bp, Homo sapiens
tgtcttgcaacttca

SEQ ID NO: 4158280 - DNA, 13 bp, Homo sapiens
tgtcttggaacat

SEQ ID NO: 4158281 - DNA, 22 bp, Homo sapiens
tgtcttggggtcccactgctcg

SEQ ID NO: 4158282 - DNA, 14 bp, Homo sapiens
tgtctttaaggaaa

SEQ ID NO: 4158283 - DNA, 15 bp, Homo sapiens
tgtctttaaggaaaa

SEQ ID NO: 4158284 - DNA, 21 bp, Homo sapiens
tgtctttaggcagcagctttt

SEQ ID NO: 4158285 - DNA, 18 bp, Homo sapiens
tgtctttatagatgtaca

SEQ ID NO: 4158286 - DNA, 17 bp, Homo sapiens
tgtctttctccaaagtt

SEQ ID NO: 4158287 - DNA, 13 bp, Homo sapiens
tgtctttctgggg

SEQ ID NO: 4158288 - DNA, 19 bp, Homo sapiens
tgtctttgttggaaaagaa

SEQ ID NO: 4158289 - DNA, 15 bp, Homo sapiens
tgtcttttatatttg

SEQ ID NO: 4158290 - DNA, 20 bp, Homo sapiens
tgtcttttatgcagatagaa

SEQ ID NO: 4158291 - DNA, 21 bp, Homo sapiens
tgtcttttcagaagcaagcca

SEQ ID NO: 4158292 - DNA, 17 bp, Homo sapiens
tgtctttttctggactg

SEQ ID NO: 4158293 - DNA, 20 bp, Homo sapiens
tgtctttttctggactgaag

SEQ ID NO: 4158294 - DNA, 19 bp, Homo sapiens
tgtgaaaaaaatgagactt

SEQ ID NO: 4158295 - DNA, 15 bp, Homo sapiens
tgtgaaacacagctg

SEQ ID NO: 4158296 - DNA, 20 bp, Homo sapiens
tgtgaaaccttttttaagat

SEQ ID NO: 4158297 - DNA, 22 bp, Homo sapiens
tgtgaaaccttttttaagattt

SEQ ID NO: 4158298 - DNA, 19 bp, Homo sapiens
tgtgaaactggcactgaat

SEQ ID NO: 4158299 - DNA, 15 bp, Homo sapiens
tgtgaaactttcatt

SEQ ID NO: 4158300 - DNA, 20 bp, Homo sapiens
tgtgaaaggaagctccactg

SEQ ID NO: 4158301 - DNA, 12 bp, Homo sapiens
tgtgaaatataa

SEQ ID NO: 4158302 - DNA, 14 bp, Homo sapiens
tgtgaaatgaaaac

SEQ ID NO: 4158303 - DNA, 23 bp, Homo sapiens
tgtgaacagagagacccttgtgg

SEQ ID NO: 4158304 - DNA, 15 bp, Homo sapiens
tgtgaacctacctgc

SEQ ID NO: 4158305 - DNA, 17 bp, Homo sapiens
tgtgaacctacctgcct

SEQ ID NO: 4158306 - DNA, 15 bp, Homo sapiens
tgtgaactgctttca

SEQ ID NO: 4158307 - DNA, 18 bp, Homo sapiens
tgtgaactttattaaata

SEQ ID NO: 4158308 - DNA, 18 bp, Homo sapiens
tgtgaagacccagcagga

SEQ ID NO: 4158309 - DNA, 21 bp, Homo sapiens
tgtgaaggcccaagagcagag

SEQ ID NO: 4158310 - DNA, 18 bp, Homo sapiens
tgtgaagtgaatgaaaca

SEQ ID NO: 4158311 - DNA, 20 bp, Homo sapiens
tgtgaagtttacattgtaaa

SEQ ID NO: 4158312 - DNA, 11 bp, Homo sapiens
tgtgaatacaa

SEQ ID NO: 4158313 - DNA, 15 bp, Homo sapiens
tgtgaatacaattaa

SEQ ID NO: 4158314 - DNA, 19 bp, Homo sapiens
tgtgaatacaattaaaggt

SEQ ID NO: 4158315 - DNA, 21 bp, Homo sapiens
tgtgaatatttccatatggat

SEQ ID NO: 4158316 - DNA, 18 bp, Homo sapiens
tgtgaatattttcaacta

SEQ ID NO: 4158317 - DNA, 13 bp, Homo sapiens
tgtgaatggattg

SEQ ID NO: 4158318 - DNA, 15 bp, Homo sapiens
tgtgaatggattgga

SEQ ID NO: 4158319 - DNA, 16 bp, Homo sapiens
tgtgaatggattggat

SEQ ID NO: 4158320 - DNA, 19 bp, Homo sapiens
tgtgaatggattggattat

SEQ ID NO: 4158321 - DNA, 18 bp, Homo sapiens
tgtgaatgtgggcactgg

SEQ ID NO: 4158322 - DNA, 21 bp, Homo sapiens
tgtgaatgttgtgatgtattc

SEQ ID NO: 4158323 - DNA, 18 bp, Homo sapiens
tgtgaattgcctgcagag

SEQ ID NO: 4158324 - DNA, 19 bp, Homo sapiens
tgtgaatttttaagctgca

SEQ ID NO: 4158325 - DNA, 20 bp, Homo sapiens
tgtgacaataatattgttgt

SEQ ID NO: 4158326 - DNA, 19 bp, Homo sapiens
tgtgacaattttgtacaaa

SEQ ID NO: 4158327 - DNA, 18 bp, Homo sapiens
tgtgacaggaaagccctc

SEQ ID NO: 4158328 - DNA, 18 bp, Homo sapiens
tgtgacatggtgcctgag

SEQ ID NO: 4158329 - DNA, 12 bp, Homo sapiens
tgtgacatgtaa

SEQ ID NO: 4158330 - DNA, 17 bp, Homo sapiens
tgtgacatttatatatt

SEQ ID NO: 4158331 - DNA, 17 bp, Homo sapiens
tgtgacattttacatta

SEQ ID NO: 4158332 - DNA, 17 bp, Homo sapiens
tgtgaccagcactgtct

SEQ ID NO: 4158333 - DNA, 21 bp, Homo sapiens
tgtgacccagatcctcacaac

SEQ ID NO: 4158334 - DNA, 22 bp, Homo sapiens
tgtgactgatgttacatcacag

SEQ ID NO: 4158335 - DNA, 20 bp, Homo sapiens
tgtgactgtacccaaatgga

SEQ ID NO: 4158336 - DNA, 17 bp, Homo sapiens
tgtgactttttttggta

SEQ ID NO: 4158337 - DNA, 16 bp, Homo sapiens
tgtgagaagtgccttc

SEQ ID NO: 4158338 - DNA, 17 bp, Homo sapiens
tgtgagaagtgccttct

SEQ ID NO: 4158339 - DNA, 20 bp, Homo sapiens
tgtgagaagtgccttctcct

SEQ ID NO: 4158340 - DNA, 13 bp, Homo sapiens
tgtgagaccccca

SEQ ID NO: 4158341 - DNA, 18 bp, Homo sapiens
tgtgagacccccacacct

SEQ ID NO: 4158342 - DNA, 17 bp, Homo sapiens
tgtgagagcgaggctga

SEQ ID NO: 4158343 - DNA, 15 bp, Homo sapiens
tgtgagaggtttgac

SEQ ID NO: 4158344 - DNA, 22 bp, Homo sapiens
tgtgagattttttattgctagt

SEQ ID NO: 4158345 - DNA, 19 bp, Homo sapiens
tgtgagcaagcatttatgt

SEQ ID NO: 4158346 - DNA, 21 bp, Homo sapiens
tgtgagccaccgtgcctggcc

SEQ ID NO: 4158347 - DNA, 14 bp, Homo sapiens
tgtgagcccagctg

SEQ ID NO: 4158348 - DNA, 18 bp, Homo sapiens
tgtgagcccagctgggtc

SEQ ID NO: 4158349 - DNA, 17 bp, Homo sapiens
tgtgagcccctggtcct

SEQ ID NO: 4158350 - DNA, 21 bp, Homo sapiens
tgtgagcccctggtcctgagg

SEQ ID NO: 4158351 - DNA, 16 bp, Homo sapiens
tgtgagcgccttggta

SEQ ID NO: 4158352 - DNA, 15 bp, Homo sapiens
tgtgagctcttccct

SEQ ID NO: 4158353 - DNA, 16 bp, Homo sapiens
tgtgagctcttccctt

SEQ ID NO: 4158354 - DNA, 21 bp, Homo sapiens
tgtgaggaatgctctgtgcca

SEQ ID NO: 4158355 - DNA, 22 bp, Homo sapiens
tgtgaggattatgggtcctgca

SEQ ID NO: 4158356 - DNA, 12 bp, Homo sapiens
tgtgagggcagt

SEQ ID NO: 4158357 - DNA, 15 bp, Homo sapiens
tgtgagggcagtgca

SEQ ID NO: 4158358 - DNA, 15 bp, Homo sapiens
tgtgagtaagagctg

SEQ ID NO: 4158359 - DNA, 16 bp, Homo sapiens
tgtgagtgccttttgc

SEQ ID NO: 4158360 - DNA, 13 bp, Homo sapiens
tgtgagtgtgaca

SEQ ID NO: 4158361 - DNA, 18 bp, Homo sapiens
tgtgagtgtgacagggcc

SEQ ID NO: 4158362 - DNA, 19 bp, Homo sapiens
tgtgagttgagtctcctct

SEQ ID NO: 4158363 - DNA, 13 bp, Homo sapiens
tgtgataatttaa

SEQ ID NO: 4158364 - DNA, 22 bp, Homo sapiens
tgtgatacccatagcttccatg

SEQ ID NO: 4158365 - DNA, 13 bp, Homo sapiens
tgtgatatataag

SEQ ID NO: 4158366 - DNA, 20 bp, Homo sapiens
tgtgatcaggctatgtatgg

SEQ ID NO: 4158367 - DNA, 18 bp, Homo sapiens
tgtgatcatgtgtggaag

SEQ ID NO: 4158368 - DNA, 22 bp, Homo sapiens
tgtgatctgggcattttcctcc

SEQ ID NO: 4158369 - DNA, 14 bp, Homo sapiens
tgtgatgaatcaat

SEQ ID NO: 4158370 - DNA, 17 bp, Homo sapiens
tgtgatgcgccttgctg

SEQ ID NO: 4158371 - DNA, 20 bp, Homo sapiens
tgtgattcagaaaatgttct

SEQ ID NO: 4158372 - DNA, 22 bp, Homo sapiens
tgtgattccactacacctggct

SEQ ID NO: 4158373 - DNA, 12 bp, Homo sapiens
tgtgattctgtt

SEQ ID NO: 4158374 - DNA, 17 bp, Homo sapiens
tgtgattggcctgtaga

SEQ ID NO: 4158375 - DNA, 17 bp, Homo sapiens
tgtgcaattgtgaggga

SEQ ID NO: 4158376 - DNA, 12 bp, Homo sapiens
tgtgcacaggca

SEQ ID NO: 4158377 - DNA, 14 bp, Homo sapiens
tgtgcacaggcaga

SEQ ID NO: 4158378 - DNA, 23 bp, Homo sapiens
tgtgcacccggcctggatgccag

SEQ ID NO: 4158379 - DNA, 13 bp, Homo sapiens
tgtgcagaataat

SEQ ID NO: 4158380 - DNA, 22 bp, Homo sapiens
tgtgcagaataatggaaacatt

SEQ ID NO: 4158381 - DNA, 15 bp, Homo sapiens
tgtgcagagctgaag

SEQ ID NO: 4158382 - DNA, 21 bp, Homo sapiens
tgtgcagagctgaagagctgg

SEQ ID NO: 4158383 - DNA, 16 bp, Homo sapiens
tgtgcagcacgtctca

SEQ ID NO: 4158384 - DNA, 20 bp, Homo sapiens
tgtgcagggctggtttgttc

SEQ ID NO: 4158385 - DNA, 17 bp, Homo sapiens
tgtgcagtcactggagg

SEQ ID NO: 4158386 - DNA, 12 bp, Homo sapiens
tgtgcagtgttg

SEQ ID NO: 4158387 - DNA, 13 bp, Homo sapiens
tgtgcatgggtga

SEQ ID NO: 4158388 - DNA, 19 bp, Homo sapiens
tgtgcatgggtgaagggag

SEQ ID NO: 4158389 - DNA, 14 bp, Homo sapiens
tgtgcatttgtaaa

SEQ ID NO: 4158390 - DNA, 14 bp, Homo sapiens
tgtgcatttgttca

SEQ ID NO: 4158391 - DNA, 17 bp, Homo sapiens
tgtgcatttgttcagct

SEQ ID NO: 4158392 - DNA, 20 bp, Homo sapiens
tgtgcatttgttcagctccc

SEQ ID NO: 4158393 - DNA, 22 bp, Homo sapiens
tgtgccaactgccaggctgcct

SEQ ID NO: 4158394 - DNA, 16 bp, Homo sapiens
tgtgccagaggccaga

SEQ ID NO: 4158395 - DNA, 13 bp, Homo sapiens
tgtgccatcacca

SEQ ID NO: 4158396 - DNA, 22 bp, Homo sapiens
tgtgccattttaaaaaaaaagg

SEQ ID NO: 4158397 - DNA, 17 bp, Homo sapiens
tgtgcccacatcccagg

SEQ ID NO: 4158398 - DNA, 20 bp, Homo sapiens
tgtgcccacatcccaggctt

SEQ ID NO: 4158399 - DNA, 14 bp, Homo sapiens
tgtgccccatgcct

SEQ ID NO: 4158400 - DNA, 15 bp, Homo sapiens
tgtgccccatgcctg

SEQ ID NO: 4158401 - DNA, 19 bp, Homo sapiens
tgtgccccatgcctgtcca

SEQ ID NO: 4158402 - DNA, 23 bp, Homo sapiens
tgtgccccatgcctgtccagcct

SEQ ID NO: 4158403 - DNA, 15 bp, Homo sapiens
tgtgcccctggccca

SEQ ID NO: 4158404 - DNA, 15 bp, Homo sapiens
tgtgccgaatgtgca

SEQ ID NO: 4158405 - DNA, 23 bp, Homo sapiens
tgtgcctctgcggggcagggcct

SEQ ID NO: 4158406 - DNA, 16 bp, Homo sapiens
tgtgcctctgggactg

SEQ ID NO: 4158407 - DNA, 17 bp, Homo sapiens
tgtgcctctgggactgg

SEQ ID NO: 4158408 - DNA, 16 bp, Homo sapiens
tgtgcctggccccagc

SEQ ID NO: 4158409 - DNA, 15 bp, Homo sapiens
tgtgccttcagctgt

SEQ ID NO: 4158410 - DNA, 16 bp, Homo sapiens
tgtgccttcttttgat

SEQ ID NO: 4158411 - DNA, 18 bp, Homo sapiens
tgtgccttgttttttgtt

SEQ ID NO: 4158412 - DNA, 16 bp, Homo sapiens
tgtgcctttctttgcc

SEQ ID NO: 4158413 - DNA, 19 bp, Homo sapiens
tgtgcctttctttgcctct

SEQ ID NO: 4158414 - DNA, 16 bp, Homo sapiens
tgtgcctttggcctgg

SEQ ID NO: 4158415 - DNA, 13 bp, Homo sapiens
tgtgcgtgaaaca

SEQ ID NO: 4158416 - DNA, 14 bp, Homo sapiens
tgtgcgtgaaacac

SEQ ID NO: 4158417 - DNA, 14 bp, Homo sapiens
tgtgctaaatatca

SEQ ID NO: 4158418 - DNA, 15 bp, Homo sapiens
tgtgctatgaatttt

SEQ ID NO: 4158419 - DNA, 15 bp, Homo sapiens
tgtgctcatttaagt

SEQ ID NO: 4158420 - DNA, 20 bp, Homo sapiens
tgtgctggagccctgttcct

SEQ ID NO: 4158421 - DNA, 23 bp, Homo sapiens
tgtgctgggggaatgagcccaga

SEQ ID NO: 4158422 - DNA, 12 bp, Homo sapiens
tgtgctgtgggc

SEQ ID NO: 4158423 - DNA, 14 bp, Homo sapiens
tgtgctgtgggcag

SEQ ID NO: 4158424 - DNA, 17 bp, Homo sapiens
tgtgctgtgggcagcac

SEQ ID NO: 4158425 - DNA, 22 bp, Homo sapiens
tgtgctgtgggcagcaccctcc

SEQ ID NO: 4158426 - DNA, 15 bp, Homo sapiens
tgtgcttgaaggccc

SEQ ID NO: 4158427 - DNA, 18 bp, Homo sapiens
tgtgcttggtctgtttga

SEQ ID NO: 4158428 - DNA, 19 bp, Homo sapiens
tgtgcttgttttataaaat

SEQ ID NO: 4158429 - DNA, 23 bp, Homo sapiens
tgtgctttgctcttgtcccacgt

SEQ ID NO: 4158430 - DNA, 17 bp, Homo sapiens
tgtggaaagcacttttt

SEQ ID NO: 4158431 - DNA, 16 bp, Homo sapiens
tgtggaacataaaaag

SEQ ID NO: 4158432 - DNA, 16 bp, Homo sapiens
tgtggaaggcctccct

SEQ ID NO: 4158433 - DNA, 13 bp, Homo sapiens
tgtggaatgagtg

SEQ ID NO: 4158434 - DNA, 16 bp, Homo sapiens
tgtggaatgagtgtgc

SEQ ID NO: 4158435 - DNA, 22 bp, Homo sapiens
tgtggaccgtggacaggcccag

SEQ ID NO: 4158436 - DNA, 14 bp, Homo sapiens
tgtggactgtgatg

SEQ ID NO: 4158437 - DNA, 20 bp, Homo sapiens
tgtggagaccctgccacagc

SEQ ID NO: 4158438 - DNA, 21 bp, Homo sapiens
tgtggagaccctgccacagcc

SEQ ID NO: 4158439 - DNA, 20 bp, Homo sapiens
tgtggagcaaaaggcagctc

SEQ ID NO: 4158440 - DNA, 22 bp, Homo sapiens
tgtggagcaaaaggcagctcac

SEQ ID NO: 4158441 - DNA, 19 bp, Homo sapiens
tgtggagctactgatgaaa

SEQ ID NO: 4158442 - DNA, 15 bp, Homo sapiens
tgtggagctcagccc

SEQ ID NO: 4158443 - DNA, 15 bp, Homo sapiens
tgtggaggaaggatt

SEQ ID NO: 4158444 - DNA, 16 bp, Homo sapiens
tgtggaggaaggattg

SEQ ID NO: 4158445 - DNA, 20 bp, Homo sapiens
tgtggaggaaggattgtaaa

SEQ ID NO: 4158446 - DNA, 14 bp, Homo sapiens
tgtggatcttgcca

SEQ ID NO: 4158447 - DNA, 19 bp, Homo sapiens
tgtggatcttgccacattt

SEQ ID NO: 4158448 - DNA, 21 bp, Homo sapiens
tgtggatcttgccacatttct

SEQ ID NO: 4158449 - DNA, 19 bp, Homo sapiens
tgtggatcttttcattctc

SEQ ID NO: 4158450 - DNA, 15 bp, Homo sapiens
tgtggatgacacaat

SEQ ID NO: 4158451 - DNA, 22 bp, Homo sapiens
tgtggatttgattcattttcct

SEQ ID NO: 4158452 - DNA, 18 bp, Homo sapiens
tgtggcaatctgtgggct

SEQ ID NO: 4158453 - DNA, 16 bp, Homo sapiens
tgtggcagtggttttg

SEQ ID NO: 4158454 - DNA, 17 bp, Homo sapiens
tgtggcatctttgcctt

SEQ ID NO: 4158455 - DNA, 18 bp, Homo sapiens
tgtggccacttatttcac

SEQ ID NO: 4158456 - DNA, 20 bp, Homo sapiens
tgtggccagggtgagagctg

SEQ ID NO: 4158457 - DNA, 12 bp, Homo sapiens
tgtggccctgga

SEQ ID NO: 4158458 - DNA, 13 bp, Homo sapiens
tgtggccctggag

SEQ ID NO: 4158459 - DNA, 15 bp, Homo sapiens
tgtggccctggccac

SEQ ID NO: 4158460 - DNA, 16 bp, Homo sapiens
tgtggccgtctcctcc

SEQ ID NO: 4158461 - DNA, 19 bp, Homo sapiens
tgtggccgtctcctccctc

SEQ ID NO: 4158462 - DNA, 10 bp, Homo sapiens
tgtggcctca

SEQ ID NO: 4158463 - DNA, 22 bp, Homo sapiens
tgtggcctcaagcaatccacct

SEQ ID NO: 4158464 - DNA, 12 bp, Homo sapiens
tgtggcctcagc

SEQ ID NO: 4158465 - DNA, 17 bp, Homo sapiens
tgtggcctcagccctca

SEQ ID NO: 4158466 - DNA, 17 bp, Homo sapiens
tgtggcctgcacagtga

SEQ ID NO: 4158467 - DNA, 15 bp, Homo sapiens
tgtggcgtctccctc

SEQ ID NO: 4158468 - DNA, 22 bp, Homo sapiens
tgtggcgttctgctgcccctgc

SEQ ID NO: 4158469 - DNA, 21 bp, Homo sapiens
tgtggctaaatgcctaataaa

SEQ ID NO: 4158470 - DNA, 15 bp, Homo sapiens
tgtggctccttccca

SEQ ID NO: 4158471 - DNA, 13 bp, Homo sapiens
tgtggctggctct

SEQ ID NO: 4158472 - DNA, 18 bp, Homo sapiens
tgtggcttttttaaaaaa

SEQ ID NO: 4158473 - DNA, 13 bp, Homo sapiens
tgtgggagcagcg

SEQ ID NO: 4158474 - DNA, 19 bp, Homo sapiens
tgtgggatgttcagcactg

SEQ ID NO: 4158475 - DNA, 16 bp, Homo sapiens
tgtgggcactggccca

SEQ ID NO: 4158476 - DNA, 19 bp, Homo sapiens
tgtgggcagcaccctcccc

SEQ ID NO: 4158477 - DNA, 14 bp, Homo sapiens
tgtgggctgtgagt

SEQ ID NO: 4158478 - DNA, 21 bp, Homo sapiens
tgtggggacacagcagtgagt

SEQ ID NO: 4158479 - DNA, 14 bp, Homo sapiens
tgtggggggtcctt

SEQ ID NO: 4158480 - DNA, 14 bp, Homo sapiens
tgtgggggtggcca

SEQ ID NO: 4158481 - DNA, 21 bp, Homo sapiens
tgtgggggtggccatccctgg

SEQ ID NO: 4158482 - DNA, 21 bp, Homo sapiens
tgtggggtttttggagaaggt

SEQ ID NO: 4158483 - DNA, 12 bp, Homo sapiens
tgtgggtgtagc

SEQ ID NO: 4158484 - DNA, 15 bp, Homo sapiens
tgtgggtgtagccag

SEQ ID NO: 4158485 - DNA, 14 bp, Homo sapiens
tgtgggtgtcctgc

SEQ ID NO: 4158486 - DNA, 21 bp, Homo sapiens
tgtgggtgttctttcctgccc

SEQ ID NO: 4158487 - DNA, 13 bp, Homo sapiens
tgtggtagaaaca

SEQ ID NO: 4158488 - DNA, 20 bp, Homo sapiens
tgtggtagcttatcttagaa

SEQ ID NO: 4158489 - DNA, 16 bp, Homo sapiens
tgtggtccatgcccac

SEQ ID NO: 4158490 - DNA, 13 bp, Homo sapiens
tgtggtctcagga

SEQ ID NO: 4158491 - DNA, 14 bp, Homo sapiens
tgtggtgaggggct

SEQ ID NO: 4158492 - DNA, 16 bp, Homo sapiens
tgtggtgcagtgtgaa

SEQ ID NO: 4158493 - DNA, 14 bp, Homo sapiens
tgtggtggcctcag

SEQ ID NO: 4158494 - DNA, 15 bp, Homo sapiens
tgtggtggcctcagc

SEQ ID NO: 4158495 - DNA, 23 bp, Homo sapiens
tgtggtgggttctttggaaggag

SEQ ID NO: 4158496 - DNA, 16 bp, Homo sapiens
tgtggtgtgagcttca

SEQ ID NO: 4158497 - DNA, 16 bp, Homo sapiens
tgtggtgttgaggctt

SEQ ID NO: 4158498 - DNA, 17 bp, Homo sapiens
tgtggttatttctctga

SEQ ID NO: 4158499 - DNA, 14 bp, Homo sapiens
tgtggttctatttt

SEQ ID NO: 4158500 - DNA, 15 bp, Homo sapiens
tgtgtaaaaaatgga

SEQ ID NO: 4158501 - DNA, 17 bp, Homo sapiens
tgtgtaaaaaatggaaa

SEQ ID NO: 4158502 - DNA, 20 bp, Homo sapiens
tgtgtaaaaaatggaaaaaa

SEQ ID NO: 4158503 - DNA, 21 bp, Homo sapiens
tgtgtaaacacagtcaaaata

SEQ ID NO: 4158504 - DNA, 21 bp, Homo sapiens
tgtgtaacaattttaatgcta

SEQ ID NO: 4158505 - DNA, 13 bp, Homo sapiens
tgtgtaatgaaaa

SEQ ID NO: 4158506 - DNA, 16 bp, Homo sapiens
tgtgtagagttaagaa

SEQ ID NO: 4158507 - DNA, 23 bp, Homo sapiens
tgtgtagcaattgacagagaata

SEQ ID NO: 4158508 - DNA, 13 bp, Homo sapiens
tgtgtagcctttt

SEQ ID NO: 4158509 - DNA, 20 bp, Homo sapiens
tgtgtagcctttttgtataa

SEQ ID NO: 4158510 - DNA, 15 bp, Homo sapiens
tgtgtatatagtttt

SEQ ID NO: 4158511 - DNA, 12 bp, Homo sapiens
tgtgtattgttc

SEQ ID NO: 4158512 - DNA, 14 bp, Homo sapiens
tgtgtattgttccc

SEQ ID NO: 4158513 - DNA, 15 bp, Homo sapiens
tgtgtatttacgctt

SEQ ID NO: 4158514 - DNA, 19 bp, Homo sapiens
tgtgtatttccagtgcaat

SEQ ID NO: 4158515 - DNA, 13 bp, Homo sapiens
tgtgtcagagtgt

SEQ ID NO: 4158516 - DNA, 17 bp, Homo sapiens
tgtgtcatttcttcact

SEQ ID NO: 4158517 - DNA, 19 bp, Homo sapiens
tgtgtccacctgtgggtgt

SEQ ID NO: 4158518 - DNA, 24 bp, Homo sapiens
tgtgtcccagatgggccacggctg

SEQ ID NO: 4158519 - DNA, 20 bp, Homo sapiens
tgtgtcccatgatccctgtg

SEQ ID NO: 4158520 - DNA, 13 bp, Homo sapiens
tgtgtcccctcac

SEQ ID NO: 4158521 - DNA, 14 bp, Homo sapiens
tgtgtcccctcact

SEQ ID NO: 4158522 - DNA, 18 bp, Homo sapiens
tgtgtcccctcactctgt

SEQ ID NO: 4158523 - DNA, 17 bp, Homo sapiens
tgtgtcctccaggagct

SEQ ID NO: 4158524 - DNA, 18 bp, Homo sapiens
tgtgtcctccaggagctt

SEQ ID NO: 4158525 - DNA, 20 bp, Homo sapiens
tgtgtcctgaaacgctcctt

SEQ ID NO: 4158526 - DNA, 14 bp, Homo sapiens
tgtgtcctggttcc

SEQ ID NO: 4158527 - DNA, 16 bp, Homo sapiens
tgtgtccttccctgca

SEQ ID NO: 4158528 - DNA, 13 bp, Homo sapiens
tgtgtccttcggg

SEQ ID NO: 4158529 - DNA, 20 bp, Homo sapiens
tgtgtctgctaatgtaaact

SEQ ID NO: 4158530 - DNA, 14 bp, Homo sapiens
tgtgtcttaattat

SEQ ID NO: 4158531 - DNA, 18 bp, Homo sapiens
tgtgtctttcacagctcc

SEQ ID NO: 4158532 - DNA, 22 bp, Homo sapiens
tgtgtctttcacagctcctccc

SEQ ID NO: 4158533 - DNA, 17 bp, Homo sapiens
tgtgtgaaactttcatt

SEQ ID NO: 4158534 - DNA, 12 bp, Homo sapiens
tgtgtgaatgaa

SEQ ID NO: 4158535 - DNA, 18 bp, Homo sapiens
tgtgtgaatgaacactct

SEQ ID NO: 4158536 - DNA, 13 bp, Homo sapiens
tgtgtgaatgtgg

SEQ ID NO: 4158537 - DNA, 20 bp, Homo sapiens
tgtgtgaggagctgctggct

SEQ ID NO: 4158538 - DNA, 14 bp, Homo sapiens
tgtgtgcagagctg

SEQ ID NO: 4158539 - DNA, 17 bp, Homo sapiens
tgtgtgcagagctgaag

SEQ ID NO: 4158540 - DNA, 22 bp, Homo sapiens
tgtgtgccgagcccttgcccat

SEQ ID NO: 4158541 - DNA, 17 bp, Homo sapiens
tgtgtgctttaggcgtg

SEQ ID NO: 4158542 - DNA, 16 bp, Homo sapiens
tgtgtggactgtgatg

SEQ ID NO: 4158543 - DNA, 12 bp, Homo sapiens
tgtgtggcaggg

SEQ ID NO: 4158544 - DNA, 15 bp, Homo sapiens
tgtgtggcagggggc

SEQ ID NO: 4158545 - DNA, 11 bp, Homo sapiens
tgtgtggcctg

SEQ ID NO: 4158546 - DNA, 14 bp, Homo sapiens
tgtgtggcctgcct

SEQ ID NO: 4158547 - DNA, 16 bp, Homo sapiens
tgtgtggtagaaacaa

SEQ ID NO: 4158548 - DNA, 15 bp, Homo sapiens
tgtgtggtccatgcc

SEQ ID NO: 4158549 - DNA, 20 bp, Homo sapiens
tgtgtggtgaggggctttct

SEQ ID NO: 4158550 - DNA, 14 bp, Homo sapiens
tgtgtggtggcctc

SEQ ID NO: 4158551 - DNA, 20 bp, Homo sapiens
tgtgtggtgggttctttgga

SEQ ID NO: 4158552 - DNA, 11 bp, Homo sapiens
tgtgtgtactc

SEQ ID NO: 4158553 - DNA, 19 bp, Homo sapiens
tgtgtgtatgtttgcacac

SEQ ID NO: 4158554 - DNA, 16 bp, Homo sapiens
tgtgtgtgaatgaaca

SEQ ID NO: 4158555 - DNA, 13 bp, Homo sapiens
tgtgtgtggcagg

SEQ ID NO: 4158556 - DNA, 15 bp, Homo sapiens
tgtgtgtgtgtatga

SEQ ID NO: 4158557 - DNA, 14 bp, Homo sapiens
tgtgtgtgtgtgta

SEQ ID NO: 4158558 - DNA, 19 bp, Homo sapiens
tgtgttaagtatgtgtaaa

SEQ ID NO: 4158559 - DNA, 22 bp, Homo sapiens
tgtgttaagtatgtgtaaaatg

SEQ ID NO: 4158560 - DNA, 16 bp, Homo sapiens
tgtgttagcctcttgc

SEQ ID NO: 4158561 - DNA, 12 bp, Homo sapiens
tgtgttcctggc

SEQ ID NO: 4158562 - DNA, 15 bp, Homo sapiens
tgtgttcctggcaat

SEQ ID NO: 4158563 - DNA, 24 bp, Homo sapiens
tgtgttcctggcaatagtgtgttc

SEQ ID NO: 4158564 - DNA, 13 bp, Homo sapiens
tgtgttcctggct

SEQ ID NO: 4158565 - DNA, 17 bp, Homo sapiens
tgtgttctgattagaaa

SEQ ID NO: 4158566 - DNA, 22 bp, Homo sapiens
tgtgttgccacagtagaactgt

SEQ ID NO: 4158567 - DNA, 17 bp, Homo sapiens
tgtgtttacagagatgt

SEQ ID NO: 4158568 - DNA, 15 bp, Homo sapiens
tgtgtttatttcact

SEQ ID NO: 4158569 - DNA, 12 bp, Homo sapiens
tgtgtttccaca

SEQ ID NO: 4158570 - DNA, 10 bp, Homo sapiens
tgtgtttcta

SEQ ID NO: 4158571 - DNA, 15 bp, Homo sapiens
tgtgtttgctgcctt

SEQ ID NO: 4158572 - DNA, 21 bp, Homo sapiens
tgtgtttgcttaaacaaagtg

SEQ ID NO: 4158573 - DNA, 12 bp, Homo sapiens
tgtgtttgcttg

SEQ ID NO: 4158574 - DNA, 18 bp, Homo sapiens
tgtgtttggtttacattt

SEQ ID NO: 4158575 - DNA, 23 bp, Homo sapiens
tgtgtttggtttacatttaaagc

SEQ ID NO: 4158576 - DNA, 17 bp, Homo sapiens
tgtgttttctctggaat

SEQ ID NO: 4158577 - DNA, 16 bp, Homo sapiens
tgtgtttttctttttc

SEQ ID NO: 4158578 - DNA, 18 bp, Homo sapiens
tgtgtttttctttttcca

SEQ ID NO: 4158579 - DNA, 14 bp, Homo sapiens
tgtgttttttaaga

SEQ ID NO: 4158580 - DNA, 16 bp, Homo sapiens
tgttaaaaataaatcc

SEQ ID NO: 4158581 - DNA, 21 bp, Homo sapiens
tgttaaaattatcaatatcta

SEQ ID NO: 4158582 - DNA, 12 bp, Homo sapiens
tgttaaacagta

SEQ ID NO: 4158583 - DNA, 23 bp, Homo sapiens
tgttaaataatatggctatgctt

SEQ ID NO: 4158584 - DNA, 12 bp, Homo sapiens
tgttaaatactg

SEQ ID NO: 4158585 - DNA, 18 bp, Homo sapiens
tgttaaatactgtgcaga

SEQ ID NO: 4158586 - DNA, 19 bp, Homo sapiens
tgttaaatttgtaagtttc

SEQ ID NO: 4158587 - DNA, 21 bp, Homo sapiens
tgttaaatttgtaagtttcag

SEQ ID NO: 4158588 - DNA, 17 bp, Homo sapiens
tgttaactatgacagat

SEQ ID NO: 4158589 - DNA, 22 bp, Homo sapiens
tgttaactatgacagatatatt

SEQ ID NO: 4158590 - DNA, 19 bp, Homo sapiens
tgttaactcttgtctattt

SEQ ID NO: 4158591 - DNA, 18 bp, Homo sapiens
tgttaactgttaactatg

SEQ ID NO: 4158592 - DNA, 19 bp, Homo sapiens
tgttaactgttaactatga

SEQ ID NO: 4158593 - DNA, 22 bp, Homo sapiens
tgttaacttaatagtatttatg

SEQ ID NO: 4158594 - DNA, 23 bp, Homo sapiens
tgttaagaattgaccatctgctt

SEQ ID NO: 4158595 - DNA, 16 bp, Homo sapiens
tgttaagagataattc

SEQ ID NO: 4158596 - DNA, 23 bp, Homo sapiens
tgttaagcagctaaattttctga

SEQ ID NO: 4158597 - DNA, 20 bp, Homo sapiens
tgttaaggaaactcttatct

SEQ ID NO: 4158598 - DNA, 21 bp, Homo sapiens
tgttaaggaaactcttatctc

SEQ ID NO: 4158599 - DNA, 21 bp, Homo sapiens
tgttaaggttgaactttgcca

SEQ ID NO: 4158600 - DNA, 15 bp, Homo sapiens
tgttaagtatgtgta

SEQ ID NO: 4158601 - DNA, 21 bp, Homo sapiens
tgttaagttatagtgaatact

SEQ ID NO: 4158602 - DNA, 14 bp, Homo sapiens
tgttaatgaaaatg

SEQ ID NO: 4158603 - DNA, 23 bp, Homo sapiens
tgttaatggatttcagaagccta

SEQ ID NO: 4158604 - DNA, 21 bp, Homo sapiens
tgttacaggcaccgagaatgt

SEQ ID NO: 4158605 - DNA, 23 bp, Homo sapiens
tgttacaggcaccgagaatgttg

SEQ ID NO: 4158606 - DNA, 18 bp, Homo sapiens
tgttaccctcctgtaaat

SEQ ID NO: 4158607 - DNA, 19 bp, Homo sapiens
tgttacctccaacagaact

SEQ ID NO: 4158608 - DNA, 17 bp, Homo sapiens
tgttacctgtgtgcttg

SEQ ID NO: 4158609 - DNA, 17 bp, Homo sapiens
tgttactgttaaccatt

SEQ ID NO: 4158610 - DNA, 12 bp, Homo sapiens
tgttacttacct

SEQ ID NO: 4158611 - DNA, 14 bp, Homo sapiens
tgttacttacctaa

SEQ ID NO: 4158612 - DNA, 22 bp, Homo sapiens
tgttagaaaatgacttatttct

SEQ ID NO: 4158613 - DNA, 19 bp, Homo sapiens
tgttagaaaatggacactg

SEQ ID NO: 4158614 - DNA, 16 bp, Homo sapiens
tgttagctacacagtg

SEQ ID NO: 4158615 - DNA, 19 bp, Homo sapiens
tgttagctacacagtgcag

SEQ ID NO: 4158616 - DNA, 15 bp, Homo sapiens
tgttagcttccttaa

SEQ ID NO: 4158617 - DNA, 20 bp, Homo sapiens
tgttagctttttaaaacatt

SEQ ID NO: 4158618 - DNA, 16 bp, Homo sapiens
tgttaggaacagcagt

SEQ ID NO: 4158619 - DNA, 18 bp, Homo sapiens
tgttaggaacagcagtgt

SEQ ID NO: 4158620 - DNA, 13 bp, Homo sapiens
tgttagtaacatg

SEQ ID NO: 4158621 - DNA, 20 bp, Homo sapiens
tgttagtagaaattttacaa

SEQ ID NO: 4158622 - DNA, 16 bp, Homo sapiens
tgttagtttacaatat

SEQ ID NO: 4158623 - DNA, 22 bp, Homo sapiens
tgttagtttacaatattatgaa

SEQ ID NO: 4158624 - DNA, 21 bp, Homo sapiens
tgttagtttagtgtgtgtgca

SEQ ID NO: 4158625 - DNA, 14 bp, Homo sapiens
tgttatatcaggga

SEQ ID NO: 4158626 - DNA, 17 bp, Homo sapiens
tgttatatcatatgtat

SEQ ID NO: 4158627 - DNA, 16 bp, Homo sapiens
tgttatattaagcaga

SEQ ID NO: 4158628 - DNA, 18 bp, Homo sapiens
tgttatcccaatcattgt

SEQ ID NO: 4158629 - DNA, 18 bp, Homo sapiens
tgttatgatttccttcaa

SEQ ID NO: 4158630 - DNA, 13 bp, Homo sapiens
tgttatgtatgaa

SEQ ID NO: 4158631 - DNA, 15 bp, Homo sapiens
tgttatgtatgaagg

SEQ ID NO: 4158632 - DNA, 13 bp, Homo sapiens
tgttattccatca

SEQ ID NO: 4158633 - DNA, 14 bp, Homo sapiens
tgttattccatcaa

SEQ ID NO: 4158634 - DNA, 20 bp, Homo sapiens
tgttattccatcaataaatg

SEQ ID NO: 4158635 - DNA, 22 bp, Homo sapiens
tgttattgttttgttaattaca

SEQ ID NO: 4158636 - DNA, 14 bp, Homo sapiens
tgttatttaaagaa

SEQ ID NO: 4158637 - DNA, 18 bp, Homo sapiens
tgttattttctgttgaag

SEQ ID NO: 4158638 - DNA, 19 bp, Homo sapiens
tgttattttctttgaaatt

SEQ ID NO: 4158639 - DNA, 17 bp, Homo sapiens
tgttatttttcaaggaa

SEQ ID NO: 4158640 - DNA, 19 bp, Homo sapiens
tgttcaaacaatatcatat

SEQ ID NO: 4158641 - DNA, 20 bp, Homo sapiens
tgttcaaacaatatcatatc

SEQ ID NO: 4158642 - DNA, 22 bp, Homo sapiens
tgttcaaacaatatcatatcat

SEQ ID NO: 4158643 - DNA, 22 bp, Homo sapiens
tgttcaagtgtccccagaccct

SEQ ID NO: 4158644 - DNA, 12 bp, Homo sapiens
tgttcagaaaaa

SEQ ID NO: 4158645 - DNA, 18 bp, Homo sapiens
tgttcagcactgtccctt

SEQ ID NO: 4158646 - DNA, 20 bp, Homo sapiens
tgttcagctcccccaggctg

SEQ ID NO: 4158647 - DNA, 15 bp, Homo sapiens
tgttcagtgagatat

SEQ ID NO: 4158648 - DNA, 14 bp, Homo sapiens
tgttcatgtgcctc

SEQ ID NO: 4158649 - DNA, 16 bp, Homo sapiens
tgttcatgtgcctctg

SEQ ID NO: 4158650 - DNA, 17 bp, Homo sapiens
tgttcatgtgcctctgc

SEQ ID NO: 4158651 - DNA, 22 bp, Homo sapiens
tgttcattaaagcatgaatggt

SEQ ID NO: 4158652 - DNA, 18 bp, Homo sapiens
tgttcattgtaatgttac

SEQ ID NO: 4158653 - DNA, 19 bp, Homo sapiens
tgttcattgtaatgttact

SEQ ID NO: 4158654 - DNA, 20 bp, Homo sapiens
tgttcattgtaatgttactg

SEQ ID NO: 4158655 - DNA, 13 bp, Homo sapiens
tgttccaaagcca

SEQ ID NO: 4158656 - DNA, 17 bp, Homo sapiens
tgttccaaagccagtga

SEQ ID NO: 4158657 - DNA, 18 bp, Homo sapiens
tgttccaaagccagtgaa

SEQ ID NO: 4158658 - DNA, 21 bp, Homo sapiens
tgttccaaattcagtttcata

SEQ ID NO: 4158659 - DNA, 15 bp, Homo sapiens
tgttccaagacattg

SEQ ID NO: 4158660 - DNA, 18 bp, Homo sapiens
tgttccaagacattgtca

SEQ ID NO: 4158661 - DNA, 17 bp, Homo sapiens
tgttccaatttcacgct

SEQ ID NO: 4158662 - DNA, 18 bp, Homo sapiens
tgttccaatttcacgctt

SEQ ID NO: 4158663 - DNA, 19 bp, Homo sapiens
tgttccacaagttaaataa

SEQ ID NO: 4158664 - DNA, 20 bp, Homo sapiens
tgttccacaagttaaataaa

SEQ ID NO: 4158665 - DNA, 21 bp, Homo sapiens
tgttccattgaagccgactct

SEQ ID NO: 4158666 - DNA, 13 bp, Homo sapiens
tgttccccagaga

SEQ ID NO: 4158667 - DNA, 18 bp, Homo sapiens
tgttccctctccctgttg

SEQ ID NO: 4158668 - DNA, 16 bp, Homo sapiens
tgttccctctgctcct

SEQ ID NO: 4158669 - DNA, 19 bp, Homo sapiens
tgttcctacagcccctttt

SEQ ID NO: 4158670 - DNA, 22 bp, Homo sapiens
tgttcctactcacacttcagct

SEQ ID NO: 4158671 - DNA, 21 bp, Homo sapiens
tgttcctgcagccccagaaga

SEQ ID NO: 4158672 - DNA, 21 bp, Homo sapiens
tgttcctggagttttgatttg

SEQ ID NO: 4158673 - DNA, 21 bp, Homo sapiens
tgttcctggcaatagtgtgtt

SEQ ID NO: 4158674 - DNA, 15 bp, Homo sapiens
tgttcctggcagttt

SEQ ID NO: 4158675 - DNA, 14 bp, Homo sapiens
tgttcctggctgat

SEQ ID NO: 4158676 - DNA, 17 bp, Homo sapiens
tgttcctttttaaatgt

SEQ ID NO: 4158677 - DNA, 20 bp, Homo sapiens
tgttcggaaggggttcctca

SEQ ID NO: 4158678 - DNA, 21 bp, Homo sapiens
tgttcggaaggggttcctcaa

SEQ ID NO: 4158679 - DNA, 16 bp, Homo sapiens
tgttctaacatgtaat

SEQ ID NO: 4158680 - DNA, 17 bp, Homo sapiens
tgttctacatggctttg

SEQ ID NO: 4158681 - DNA, 14 bp, Homo sapiens
tgttctagtttttt

SEQ ID NO: 4158682 - DNA, 17 bp, Homo sapiens
tgttctatggttatgaa

SEQ ID NO: 4158683 - DNA, 18 bp, Homo sapiens
tgttctatggttatgaaa

SEQ ID NO: 4158684 - DNA, 22 bp, Homo sapiens
tgttctcacactggtctgctgt

SEQ ID NO: 4158685 - DNA, 12 bp, Homo sapiens
tgttctcagatt

SEQ ID NO: 4158686 - DNA, 20 bp, Homo sapiens
tgttctccaggcttcacagt

SEQ ID NO: 4158687 - DNA, 19 bp, Homo sapiens
tgttctccattttcaagct

SEQ ID NO: 4158688 - DNA, 23 bp, Homo sapiens
tgttctccgggtgtggcctcagc

SEQ ID NO: 4158689 - DNA, 21 bp, Homo sapiens
tgttctccttttcctctctcc

SEQ ID NO: 4158690 - DNA, 15 bp, Homo sapiens
tgttctgacattaac

SEQ ID NO: 4158691 - DNA, 16 bp, Homo sapiens
tgttctgacattaaca

SEQ ID NO: 4158692 - DNA, 19 bp, Homo sapiens
tgttctgacattaacagtt

SEQ ID NO: 4158693 - DNA, 17 bp, Homo sapiens
tgttctgctccatacct

SEQ ID NO: 4158694 - DNA, 12 bp, Homo sapiens
tgttctgctggg

SEQ ID NO: 4158695 - DNA, 18 bp, Homo sapiens
tgttctggcctcagacca

SEQ ID NO: 4158696 - DNA, 12 bp, Homo sapiens
tgttctgggctc

SEQ ID NO: 4158697 - DNA, 13 bp, Homo sapiens
tgttctgtgtctt

SEQ ID NO: 4158698 - DNA, 13 bp, Homo sapiens
tgttctgttctgg

SEQ ID NO: 4158699 - DNA, 15 bp, Homo sapiens
tgttctgttctgggg

SEQ ID NO: 4158700 - DNA, 14 bp, Homo sapiens
tgttctgtttgtta

SEQ ID NO: 4158701 - DNA, 21 bp, Homo sapiens
tgttcttatagaataaaagct

SEQ ID NO: 4158702 - DNA, 20 bp, Homo sapiens
tgttcttatgcaaaatggaa

SEQ ID NO: 4158703 - DNA, 12 bp, Homo sapiens
tgttcttcttgg

SEQ ID NO: 4158704 - DNA, 15 bp, Homo sapiens
tgttctttcctgccc

SEQ ID NO: 4158705 - DNA, 17 bp, Homo sapiens
tgttgaagggaggtggc

SEQ ID NO: 4158706 - DNA, 22 bp, Homo sapiens
tgttgacaaaattttctcattt

SEQ ID NO: 4158707 - DNA, 18 bp, Homo sapiens
tgttgacaactgtgactg

SEQ ID NO: 4158708 - DNA, 18 bp, Homo sapiens
tgttgactggactgcttg

SEQ ID NO: 4158709 - DNA, 13 bp, Homo sapiens
tgttgacttattt

SEQ ID NO: 4158710 - DNA, 20 bp, Homo sapiens
tgttgacttattttctctgt

SEQ ID NO: 4158711 - DNA, 22 bp, Homo sapiens
tgttgacttattttctctgtgt

SEQ ID NO: 4158712 - DNA, 18 bp, Homo sapiens
tgttgagccttttccctc

SEQ ID NO: 4158713 - DNA, 16 bp, Homo sapiens
tgttgatgctgtattc

SEQ ID NO: 4158714 - DNA, 14 bp, Homo sapiens
tgttgattctctcc

SEQ ID NO: 4158715 - DNA, 14 bp, Homo sapiens
tgttgattttctgt

SEQ ID NO: 4158716 - DNA, 19 bp, Homo sapiens
tgttgcaagatgtgaatta

SEQ ID NO: 4158717 - DNA, 15 bp, Homo sapiens
tgttgcatgtttgaa

SEQ ID NO: 4158718 - DNA, 16 bp, Homo sapiens
tgttgcatttccagct

SEQ ID NO: 4158719 - DNA, 11 bp, Homo sapiens
tgttgccccag

SEQ ID NO: 4158720 - DNA, 21 bp, Homo sapiens
tgttgcccctttctcttttcc

SEQ ID NO: 4158721 - DNA, 16 bp, Homo sapiens
tgttgctataataaag

SEQ ID NO: 4158722 - DNA, 14 bp, Homo sapiens
tgttgctcagtctc

SEQ ID NO: 4158723 - DNA, 16 bp, Homo sapiens
tgttgctttcttacct

SEQ ID NO: 4158724 - DNA, 11 bp, Homo sapiens
tgttggatctt

SEQ ID NO: 4158725 - DNA, 21 bp, Homo sapiens
tgttggatcttcaatggcttt

SEQ ID NO: 4158726 - DNA, 17 bp, Homo sapiens
tgttggatttataaatg

SEQ ID NO: 4158727 - DNA, 19 bp, Homo sapiens
tgttggatttataaatgct

SEQ ID NO: 4158728 - DNA, 18 bp, Homo sapiens
tgttggcacatgcctgta

SEQ ID NO: 4158729 - DNA, 14 bp, Homo sapiens
tgttgggaaagtat

SEQ ID NO: 4158730 - DNA, 20 bp, Homo sapiens
tgttgggggggaccctgcct

SEQ ID NO: 4158731 - DNA, 13 bp, Homo sapiens
tgttggtcagagg

SEQ ID NO: 4158732 - DNA, 14 bp, Homo sapiens
tgttggtgttggct

SEQ ID NO: 4158733 - DNA, 20 bp, Homo sapiens
tgttggttgttttttccttt

SEQ ID NO: 4158734 - DNA, 21 bp, Homo sapiens
tgttgtaaatatttatgtaaa

SEQ ID NO: 4158735 - DNA, 18 bp, Homo sapiens
tgttgtaacctgctgtga

SEQ ID NO: 4158736 - DNA, 15 bp, Homo sapiens
tgttgtacatttatg

SEQ ID NO: 4158737 - DNA, 16 bp, Homo sapiens
tgttgtacatttatga

SEQ ID NO: 4158738 - DNA, 22 bp, Homo sapiens
tgttgtacatttatgatttaat

SEQ ID NO: 4158739 - DNA, 13 bp, Homo sapiens
tgttgtattttaa

SEQ ID NO: 4158740 - DNA, 14 bp, Homo sapiens
tgttgtcattgctg

SEQ ID NO: 4158741 - DNA, 15 bp, Homo sapiens
tgttgtcattgctgt

SEQ ID NO: 4158742 - DNA, 16 bp, Homo sapiens
tgttgtgatcttgcat

SEQ ID NO: 4158743 - DNA, 13 bp, Homo sapiens
tgttgtgatgtct

SEQ ID NO: 4158744 - DNA, 13 bp, Homo sapiens
tgttgtgcatttg

SEQ ID NO: 4158745 - DNA, 12 bp, Homo sapiens
tgttgtgtgtgc

SEQ ID NO: 4158746 - DNA, 23 bp, Homo sapiens
tgttgttcaaatgcattttgggg

SEQ ID NO: 4158747 - DNA, 13 bp, Homo sapiens
tgttgttggttgt

SEQ ID NO: 4158748 - DNA, 11 bp, Homo sapiens
tgttgttgtgt

SEQ ID NO: 4158749 - DNA, 13 bp, Homo sapiens
tgttgtttctttc

SEQ ID NO: 4158750 - DNA, 13 bp, Homo sapiens
tgttgtttgcttt

SEQ ID NO: 4158751 - DNA, 13 bp, Homo sapiens
tgttgtttgtaaa

SEQ ID NO: 4158752 - DNA, 15 bp, Homo sapiens
tgttgtttgtaaata

SEQ ID NO: 4158753 - DNA, 17 bp, Homo sapiens
tgtttaaaaagtaagtt

SEQ ID NO: 4158754 - DNA, 21 bp, Homo sapiens
tgtttaaaaagtaagttaata

SEQ ID NO: 4158755 - DNA, 15 bp, Homo sapiens
tgtttaaaataaaat

SEQ ID NO: 4158756 - DNA, 22 bp, Homo sapiens
tgtttaaaataaaatgaaaatt

SEQ ID NO: 4158757 - DNA, 15 bp, Homo sapiens
tgtttaaaattcagt

SEQ ID NO: 4158758 - DNA, 21 bp, Homo sapiens
tgtttaaagagaggttataga

SEQ ID NO: 4158759 - DNA, 14 bp, Homo sapiens
tgtttaagaaaagt

SEQ ID NO: 4158760 - DNA, 22 bp, Homo sapiens
tgtttaagaaaagtattttgaa

SEQ ID NO: 4158761 - DNA, 21 bp, Homo sapiens
tgtttaagtattaacttacaa

SEQ ID NO: 4158762 - DNA, 16 bp, Homo sapiens
tgtttaatattgagaa

SEQ ID NO: 4158763 - DNA, 14 bp, Homo sapiens
tgtttaatctgtta

SEQ ID NO: 4158764 - DNA, 21 bp, Homo sapiens
tgtttaatttttatttcttcc

SEQ ID NO: 4158765 - DNA, 15 bp, Homo sapiens
tgtttacatgtgtag

SEQ ID NO: 4158766 - DNA, 18 bp, Homo sapiens
tgtttactttaaacttgt

SEQ ID NO: 4158767 - DNA, 13 bp, Homo sapiens
tgtttagcagaac

SEQ ID NO: 4158768 - DNA, 19 bp, Homo sapiens
tgtttataatctgaagata

SEQ ID NO: 4158769 - DNA, 22 bp, Homo sapiens
tgtttatatctgcaaaaaacct

SEQ ID NO: 4158770 - DNA, 15 bp, Homo sapiens
tgtttatcagataca

SEQ ID NO: 4158771 - DNA, 18 bp, Homo sapiens
tgtttatcagatacatca

SEQ ID NO: 4158772 - DNA, 16 bp, Homo sapiens
tgtttatgagccagac

SEQ ID NO: 4158773 - DNA, 22 bp, Homo sapiens
tgtttatgatatttcttgcttt

SEQ ID NO: 4158774 - DNA, 19 bp, Homo sapiens
tgtttattaacaaattatg

SEQ ID NO: 4158775 - DNA, 16 bp, Homo sapiens
tgtttattcatccagc

SEQ ID NO: 4158776 - DNA, 23 bp, Homo sapiens
tgtttattcatccagcagtgttg

SEQ ID NO: 4158777 - DNA, 13 bp, Homo sapiens
tgtttattcctga

SEQ ID NO: 4158778 - DNA, 23 bp, Homo sapiens
tgtttattcttccagaatgctga

SEQ ID NO: 4158779 - DNA, 23 bp, Homo sapiens
tgtttcaaaataagtatttctga

SEQ ID NO: 4158780 - DNA, 20 bp, Homo sapiens
tgtttccagcagaagacaaa

SEQ ID NO: 4158781 - DNA, 19 bp, Homo sapiens
tgtttccatattttatagg

SEQ ID NO: 4158782 - DNA, 18 bp, Homo sapiens
tgtttcccttgctttgtt

SEQ ID NO: 4158783 - DNA, 19 bp, Homo sapiens
tgtttcccttgctttgttt

SEQ ID NO: 4158784 - DNA, 23 bp, Homo sapiens
tgtttcccttgctttgttttaat

SEQ ID NO: 4158785 - DNA, 20 bp, Homo sapiens
tgtttccctttcactggcat

SEQ ID NO: 4158786 - DNA, 16 bp, Homo sapiens
tgtttcctcttccaaa

SEQ ID NO: 4158787 - DNA, 15 bp, Homo sapiens
tgtttctaaaactat

SEQ ID NO: 4158788 - DNA, 16 bp, Homo sapiens
tgtttctagagttcct

SEQ ID NO: 4158789 - DNA, 16 bp, Homo sapiens
tgtttctcccgtgctt

SEQ ID NO: 4158790 - DNA, 21 bp, Homo sapiens
tgtttctccttagttggctgg

SEQ ID NO: 4158791 - DNA, 14 bp, Homo sapiens
tgtttctctgctgt

SEQ ID NO: 4158792 - DNA, 13 bp, Homo sapiens
tgtttctgaaaat

SEQ ID NO: 4158793 - DNA, 21 bp, Homo sapiens
tgtttctgaaaattccagaaa

SEQ ID NO: 4158794 - DNA, 20 bp, Homo sapiens
tgtttctgcagcccttgggc

SEQ ID NO: 4158795 - DNA, 11 bp, Homo sapiens
tgtttctgggg

SEQ ID NO: 4158796 - DNA, 20 bp, Homo sapiens
tgtttctgggtcctgaagaa

SEQ ID NO: 4158797 - DNA, 15 bp, Homo sapiens
tgtttctgttccaaa

SEQ ID NO: 4158798 - DNA, 18 bp, Homo sapiens
tgtttcttccaaagcaca

SEQ ID NO: 4158799 - DNA, 12 bp, Homo sapiens
tgtttctttgtg

SEQ ID NO: 4158800 - DNA, 13 bp, Homo sapiens
tgtttgaaatctt

SEQ ID NO: 4158801 - DNA, 22 bp, Homo sapiens
tgtttgagtttttcctcccagt

SEQ ID NO: 4158802 - DNA, 23 bp, Homo sapiens
tgtttgagtttttcctcccagtg

SEQ ID NO: 4158803 - DNA, 17 bp, Homo sapiens
tgtttgcagcctgctct

SEQ ID NO: 4158804 - DNA, 12 bp, Homo sapiens
tgtttgctcccc

SEQ ID NO: 4158805 - DNA, 23 bp, Homo sapiens
tgtttgctccccttccccttcct

SEQ ID NO: 4158806 - DNA, 14 bp, Homo sapiens
tgtttgcttaaaca

SEQ ID NO: 4158807 - DNA, 15 bp, Homo sapiens
tgtttgcttaaacaa

SEQ ID NO: 4158808 - DNA, 15 bp, Homo sapiens
tgtttgcttattgtt

SEQ ID NO: 4158809 - DNA, 18 bp, Homo sapiens
tgtttgcttattgttcca

SEQ ID NO: 4158810 - DNA, 18 bp, Homo sapiens
tgtttgcttcataaatga

SEQ ID NO: 4158811 - DNA, 13 bp, Homo sapiens
tgtttggacagct

SEQ ID NO: 4158812 - DNA, 12 bp, Homo sapiens
tgtttggagagc

SEQ ID NO: 4158813 - DNA, 17 bp, Homo sapiens
tgtttggcaaggaaagg

SEQ ID NO: 4158814 - DNA, 17 bp, Homo sapiens
tgtttggcttataaaca

SEQ ID NO: 4158815 - DNA, 17 bp, Homo sapiens
tgtttgggatgaccagg

SEQ ID NO: 4158816 - DNA, 22 bp, Homo sapiens
tgtttgggcagaagggagaagg

SEQ ID NO: 4158817 - DNA, 18 bp, Homo sapiens
tgtttgggtatcctgccc

SEQ ID NO: 4158818 - DNA, 23 bp, Homo sapiens
tgtttgggtatcctgcccagtgt

SEQ ID NO: 4158819 - DNA, 10 bp, Homo sapiens
tgtttgtaaa

SEQ ID NO: 4158820 - DNA, 11 bp, Homo sapiens
tgtttgtaaat

SEQ ID NO: 4158821 - DNA, 16 bp, Homo sapiens
tgtttgtaaataagag

SEQ ID NO: 4158822 - DNA, 17 bp, Homo sapiens
tgtttgtctgtcttcat

SEQ ID NO: 4158823 - DNA, 19 bp, Homo sapiens
tgtttgtcttttaatgctt

SEQ ID NO: 4158824 - DNA, 12 bp, Homo sapiens
tgtttgtggcct

SEQ ID NO: 4158825 - DNA, 14 bp, Homo sapiens
tgtttgtgtattta

SEQ ID NO: 4158826 - DNA, 13 bp, Homo sapiens
tgtttgtttaatt

SEQ ID NO: 4158827 - DNA, 15 bp, Homo sapiens
tgtttgtttcaagaa

SEQ ID NO: 4158828 - DNA, 15 bp, Homo sapiens
tgtttgtttctttgt

SEQ ID NO: 4158829 - DNA, 12 bp, Homo sapiens
tgttttaaattc

SEQ ID NO: 4158830 - DNA, 22 bp, Homo sapiens
tgttttaaattctgagacatgt

SEQ ID NO: 4158831 - DNA, 23 bp, Homo sapiens
tgttttaagactgaatgttttat

SEQ ID NO: 4158832 - DNA, 23 bp, Homo sapiens
tgttttaagcaaatgcattctat

SEQ ID NO: 4158833 - DNA, 20 bp, Homo sapiens
tgttttaatctgaaattcta

SEQ ID NO: 4158834 - DNA, 12 bp, Homo sapiens
tgttttccctga

SEQ ID NO: 4158835 - DNA, 16 bp, Homo sapiens
tgttttccgtgaaaac

SEQ ID NO: 4158836 - DNA, 21 bp, Homo sapiens
tgttttctttaaagatgtaat

SEQ ID NO: 4158837 - DNA, 20 bp, Homo sapiens
tgttttgaaaagtttcctag

SEQ ID NO: 4158838 - DNA, 19 bp, Homo sapiens
tgttttggacagtttacca

SEQ ID NO: 4158839 - DNA, 17 bp, Homo sapiens
tgttttgtatatacagt

SEQ ID NO: 4158840 - DNA, 20 bp, Homo sapiens
tgttttgtatatacagttat

SEQ ID NO: 4158841 - DNA, 18 bp, Homo sapiens
tgttttgtcccatttcct

SEQ ID NO: 4158842 - DNA, 17 bp, Homo sapiens
tgttttgttctttaaag

SEQ ID NO: 4158843 - DNA, 17 bp, Homo sapiens
tgtttttaagctgtttc

SEQ ID NO: 4158844 - DNA, 12 bp, Homo sapiens
tgtttttctggg

SEQ ID NO: 4158845 - DNA, 13 bp, Homo sapiens
tgtttttgaaata

SEQ ID NO: 4158846 - DNA, 20 bp, Homo sapiens
tgtttttgaatttaaataaa

SEQ ID NO: 4158847 - DNA, 12 bp, Homo sapiens
tgtttttgcttt

SEQ ID NO: 4158848 - DNA, 14 bp, Homo sapiens
tgttttttaaaaaa

SEQ ID NO: 4158849 - DNA, 11 bp, Homo sapiens
tgttttttaag

SEQ ID NO: 4158850 - DNA, 21 bp, Homo sapiens
tgttttttaagatagtgtaac

SEQ ID NO: 4158851 - DNA, 15 bp, Homo sapiens
tgttttttatgaagt

SEQ ID NO: 4158852 - DNA, 19 bp, Homo sapiens
tgttttttgaaaacatggt

SEQ ID NO: 4158853 - DNA, 18 bp, Homo sapiens
tgttttttgccacagctt

SEQ ID NO: 4158854 - DNA, 22 bp, Homo sapiens
tgtttttttctttttttataaa

SEQ ID NO: 4158855 - DNA, 19 bp, Homo sapiens
tgttttttttttccactta

SEQ ID NO: 4158856 - DNA, 16 bp, Homo sapiens
ttaaaaaaatttaagt

SEQ ID NO: 4158857 - DNA, 23 bp, Homo sapiens
ttaaaaaacagaaaaacagacaa

SEQ ID NO: 4158858 - DNA, 15 bp, Homo sapiens
ttaaaaaatatttat

SEQ ID NO: 4158859 - DNA, 19 bp, Homo sapiens
ttaaaaaatatttattaaa

SEQ ID NO: 4158860 - DNA, 17 bp, Homo sapiens
ttaaaaacaaaaggcaa

SEQ ID NO: 4158861 - DNA, 15 bp, Homo sapiens
ttaaaaactcctttt

SEQ ID NO: 4158862 - DNA, 16 bp, Homo sapiens
ttaaaaagcagtcctc

SEQ ID NO: 4158863 - DNA, 21 bp, Homo sapiens
ttaaaaagggaagaaactgct

SEQ ID NO: 4158864 - DNA, 15 bp, Homo sapiens
ttaaaaagtgagaaa

SEQ ID NO: 4158865 - DNA, 20 bp, Homo sapiens
ttaaaaagttaatcttcatg

SEQ ID NO: 4158866 - DNA, 11 bp, Homo sapiens
ttaaaaataaa

SEQ ID NO: 4158867 - DNA, 17 bp, Homo sapiens
ttaaaaatgtaaatatt

SEQ ID NO: 4158868 - DNA, 14 bp, Homo sapiens
ttaaaaatgttagt

SEQ ID NO: 4158869 - DNA, 21 bp, Homo sapiens
ttaaaacaattttttttttcc

SEQ ID NO: 4158870 - DNA, 16 bp, Homo sapiens
ttaaaacacattatgt

SEQ ID NO: 4158871 - DNA, 12 bp, Homo sapiens
ttaaaacagctg

SEQ ID NO: 4158872 - DNA, 14 bp, Homo sapiens
ttaaaaccaaagag

SEQ ID NO: 4158873 - DNA, 15 bp, Homo sapiens
ttaaaacgtcttaga

SEQ ID NO: 4158874 - DNA, 13 bp, Homo sapiens
ttaaaactaggta

SEQ ID NO: 4158875 - DNA, 15 bp, Homo sapiens
ttaaaacttcttaaa

SEQ ID NO: 4158876 - DNA, 12 bp, Homo sapiens
ttaaaagaatga

SEQ ID NO: 4158877 - DNA, 15 bp, Homo sapiens
ttaaaagaatgacta

SEQ ID NO: 4158878 - DNA, 11 bp, Homo sapiens
ttaaaagagag

SEQ ID NO: 4158879 - DNA, 23 bp, Homo sapiens
ttaaaagagagagagagaaaaaa

SEQ ID NO: 4158880 - DNA, 20 bp, Homo sapiens
ttaaaataaacagttgtgaa

SEQ ID NO: 4158881 - DNA, 14 bp, Homo sapiens
ttaaaataaatatt

SEQ ID NO: 4158882 - DNA, 12 bp, Homo sapiens
ttaaaataatat

SEQ ID NO: 4158883 - DNA, 20 bp, Homo sapiens
ttaaaatagaaattttgtaa

SEQ ID NO: 4158884 - DNA, 12 bp, Homo sapiens
ttaaaatattta

SEQ ID NO: 4158885 - DNA, 18 bp, Homo sapiens
ttaaaatatttagtctaa

SEQ ID NO: 4158886 - DNA, 17 bp, Homo sapiens
ttaaaatatttatttat

SEQ ID NO: 4158887 - DNA, 18 bp, Homo sapiens
ttaaaatatttgaatgaa

SEQ ID NO: 4158888 - DNA, 18 bp, Homo sapiens
ttaaaatctattctgtgt

SEQ ID NO: 4158889 - DNA, 19 bp, Homo sapiens
ttaaaatggtttgtcctga

SEQ ID NO: 4158890 - DNA, 13 bp, Homo sapiens
ttaaaattcagtt

SEQ ID NO: 4158891 - DNA, 14 bp, Homo sapiens
ttaaacacaaagtg

SEQ ID NO: 4158892 - DNA, 12 bp, Homo sapiens
ttaaacacacag

SEQ ID NO: 4158893 - DNA, 19 bp, Homo sapiens
ttaaacacatgccttaaat

SEQ ID NO: 4158894 - DNA, 14 bp, Homo sapiens
ttaaacacctgaca

SEQ ID NO: 4158895 - DNA, 16 bp, Homo sapiens
ttaaacagatttttac

SEQ ID NO: 4158896 - DNA, 12 bp, Homo sapiens
ttaaacagcagt

SEQ ID NO: 4158897 - DNA, 16 bp, Homo sapiens
ttaaacagtatttcat

SEQ ID NO: 4158898 - DNA, 19 bp, Homo sapiens
ttaaacagtatttcattgc

SEQ ID NO: 4158899 - DNA, 19 bp, Homo sapiens
ttaaacataagctaaatca

SEQ ID NO: 4158900 - DNA, 18 bp, Homo sapiens
ttaaacatttgttcctgg

SEQ ID NO: 4158901 - DNA, 22 bp, Homo sapiens
ttaaacggtgcccatcctgcca

SEQ ID NO: 4158902 - DNA, 12 bp, Homo sapiens
ttaaactaaata

SEQ ID NO: 4158903 - DNA, 14 bp, Homo sapiens
ttaaactatcttgt

SEQ ID NO: 4158904 - DNA, 16 bp, Homo sapiens
ttaaactatcttgtgt

SEQ ID NO: 4158905 - DNA, 13 bp, Homo sapiens
ttaaactcaggga

SEQ ID NO: 4158906 - DNA, 20 bp, Homo sapiens
ttaaactcagggacagagcc

SEQ ID NO: 4158907 - DNA, 19 bp, Homo sapiens
ttaaactcttcacaaaatc

SEQ ID NO: 4158908 - DNA, 13 bp, Homo sapiens
ttaaactgtacag

SEQ ID NO: 4158909 - DNA, 20 bp, Homo sapiens
ttaaactgtgtggactgtga

SEQ ID NO: 4158910 - DNA, 12 bp, Homo sapiens
ttaaacttacaa

SEQ ID NO: 4158911 - DNA, 23 bp, Homo sapiens
ttaaacttataaatcatattgat

SEQ ID NO: 4158912 - DNA, 15 bp, Homo sapiens
ttaaacttgtctttt

SEQ ID NO: 4158913 - DNA, 15 bp, Homo sapiens
ttaaacttttttaac

SEQ ID NO: 4158914 - DNA, 20 bp, Homo sapiens
ttaaagagaggttatagagt

SEQ ID NO: 4158915 - DNA, 17 bp, Homo sapiens
ttaaagatattgttcaa

SEQ ID NO: 4158916 - DNA, 18 bp, Homo sapiens
ttaaagatcatgacatat

SEQ ID NO: 4158917 - DNA, 16 bp, Homo sapiens
ttaaagcaaaaaatga

SEQ ID NO: 4158918 - DNA, 17 bp, Homo sapiens
ttaaagcaaaaaatgaa

SEQ ID NO: 4158919 - DNA, 16 bp, Homo sapiens
ttaaagcattgctttt

SEQ ID NO: 4158920 - DNA, 15 bp, Homo sapiens
ttaaagcatttccta

SEQ ID NO: 4158921 - DNA, 13 bp, Homo sapiens
ttaaagcctcctc

SEQ ID NO: 4158922 - DNA, 17 bp, Homo sapiens
ttaaaggaaaaaatgtt

SEQ ID NO: 4158923 - DNA, 16 bp, Homo sapiens
ttaaaggtcctgccct

SEQ ID NO: 4158924 - DNA, 17 bp, Homo sapiens
ttaaaggtcctgccctc

SEQ ID NO: 4158925 - DNA, 13 bp, Homo sapiens
ttaaagtatatat

SEQ ID NO: 4158926 - DNA, 12 bp, Homo sapiens
ttaaagtctgaa

SEQ ID NO: 4158927 - DNA, 17 bp, Homo sapiens
ttaaagtggcaatctca

SEQ ID NO: 4158928 - DNA, 14 bp, Homo sapiens
ttaaagtgtttcag

SEQ ID NO: 4158929 - DNA, 22 bp, Homo sapiens
ttaaagtgtttcagctaaggga

SEQ ID NO: 4158930 - DNA, 12 bp, Homo sapiens
ttaaagttgcac

SEQ ID NO: 4158931 - DNA, 15 bp, Homo sapiens
ttaaagttgcacatg

SEQ ID NO: 4158932 - DNA, 16 bp, Homo sapiens
ttaaagtttaaagttg

SEQ ID NO: 4158933 - DNA, 18 bp, Homo sapiens
ttaaagtttaaagttgca

SEQ ID NO: 4158934 - DNA, 13 bp, Homo sapiens
ttaaataaaagtg

SEQ ID NO: 4158935 - DNA, 14 bp, Homo sapiens
ttaaataaaagtga

SEQ ID NO: 4158936 - DNA, 20 bp, Homo sapiens
ttaaataaaagtgatcaata

SEQ ID NO: 4158937 - DNA, 18 bp, Homo sapiens
ttaaataatgcttcagat

SEQ ID NO: 4158938 - DNA, 18 bp, Homo sapiens
ttaaatacaaaacttcca

SEQ ID NO: 4158939 - DNA, 18 bp, Homo sapiens
ttaaatactgtgcagaat

SEQ ID NO: 4158940 - DNA, 20 bp, Homo sapiens
ttaaatactgtgcagaataa

SEQ ID NO: 4158941 - DNA, 22 bp, Homo sapiens
ttaaatactgtgcagaataatg

SEQ ID NO: 4158942 - DNA, 19 bp, Homo sapiens
ttaaatagagtatatgcac

SEQ ID NO: 4158943 - DNA, 13 bp, Homo sapiens
ttaaatagataca

SEQ ID NO: 4158944 - DNA, 14 bp, Homo sapiens
ttaaatataattct

SEQ ID NO: 4158945 - DNA, 17 bp, Homo sapiens
ttaaatataattctgta

SEQ ID NO: 4158946 - DNA, 14 bp, Homo sapiens
ttaaatatagatta

SEQ ID NO: 4158947 - DNA, 16 bp, Homo sapiens
ttaaatatcttttatg

SEQ ID NO: 4158948 - DNA, 20 bp, Homo sapiens
ttaaatatgtatatgacatt

SEQ ID NO: 4158949 - DNA, 15 bp, Homo sapiens
ttaaatcagaataaa

SEQ ID NO: 4158950 - DNA, 16 bp, Homo sapiens
ttaaatctcattgctt

SEQ ID NO: 4158951 - DNA, 16 bp, Homo sapiens
ttaaatctgtccctga

SEQ ID NO: 4158952 - DNA, 16 bp, Homo sapiens
ttaaatgcaataattt

SEQ ID NO: 4158953 - DNA, 20 bp, Homo sapiens
ttaaatgctcattttctggt

SEQ ID NO: 4158954 - DNA, 22 bp, Homo sapiens
ttaaatgctcattttctggttt

SEQ ID NO: 4158955 - DNA, 21 bp, Homo sapiens
ttaaatggcagtatttcattt

SEQ ID NO: 4158956 - DNA, 16 bp, Homo sapiens
ttaaatgtaaataatc

SEQ ID NO: 4158957 - DNA, 11 bp, Homo sapiens
ttaaatgtgaa

SEQ ID NO: 4158958 - DNA, 17 bp, Homo sapiens
ttaaatgtgtacaatgt

SEQ ID NO: 4158959 - DNA, 18 bp, Homo sapiens
ttaaatgtgtacaatgta

SEQ ID NO: 4158960 - DNA, 22 bp, Homo sapiens
ttaaatgttttataagttcaca

SEQ ID NO: 4158961 - DNA, 11 bp, Homo sapiens
ttaaattgtca

SEQ ID NO: 4158962 - DNA, 17 bp, Homo sapiens
ttaaattgtttcatatc

SEQ ID NO: 4158963 - DNA, 19 bp, Homo sapiens
ttaaattgtttcatatctg

SEQ ID NO: 4158964 - DNA, 23 bp, Homo sapiens
ttaaattgtttcatatctggtca

SEQ ID NO: 4158965 - DNA, 15 bp, Homo sapiens
ttaaatttaaagata

SEQ ID NO: 4158966 - DNA, 21 bp, Homo sapiens
ttaaatttgtaagtttcaggt

SEQ ID NO: 4158967 - DNA, 18 bp, Homo sapiens
ttaaattttttttacatt

SEQ ID NO: 4158968 - DNA, 20 bp, Homo sapiens
ttaaattttttttacatttt

SEQ ID NO: 4158969 - DNA, 21 bp, Homo sapiens
ttaacaaatatgctaatttgg

SEQ ID NO: 4158970 - DNA, 13 bp, Homo sapiens
ttaacaacatggc

SEQ ID NO: 4158971 - DNA, 20 bp, Homo sapiens
ttaacaaggaatgcctgtgc

SEQ ID NO: 4158972 - DNA, 23 bp, Homo sapiens
ttaacaataactactgtgttcct

SEQ ID NO: 4158973 - DNA, 16 bp, Homo sapiens
ttaacagtcatttaaa

SEQ ID NO: 4158974 - DNA, 21 bp, Homo sapiens
ttaacagttttccatgaaaac

SEQ ID NO: 4158975 - DNA, 22 bp, Homo sapiens
ttaacatgaacacccttagaaa

SEQ ID NO: 4158976 - DNA, 14 bp, Homo sapiens
ttaacattctgtaa

SEQ ID NO: 4158977 - DNA, 19 bp, Homo sapiens
ttaacattgaccaagaact

SEQ ID NO: 4158978 - DNA, 14 bp, Homo sapiens
ttaaccatttaagt

SEQ ID NO: 4158979 - DNA, 21 bp, Homo sapiens
ttaaccatttaataaagaaat

SEQ ID NO: 4158980 - DNA, 22 bp, Homo sapiens
ttaaccatttaataaagaaata

SEQ ID NO: 4158981 - DNA, 16 bp, Homo sapiens
ttaacccacctctcct

SEQ ID NO: 4158982 - DNA, 15 bp, Homo sapiens
ttaacctcagtgtca

SEQ ID NO: 4158983 - DNA, 19 bp, Homo sapiens
ttaacctcagtgtcattta

SEQ ID NO: 4158984 - DNA, 15 bp, Homo sapiens
ttaacctctgcacta

SEQ ID NO: 4158985 - DNA, 19 bp, Homo sapiens
ttaacggctccaggatttt

SEQ ID NO: 4158986 - DNA, 12 bp, Homo sapiens
ttaactagaatt

SEQ ID NO: 4158987 - DNA, 14 bp, Homo sapiens
ttaactattgcatt

SEQ ID NO: 4158988 - DNA, 19 bp, Homo sapiens
ttaactgaaaatgtaaatt

SEQ ID NO: 4158989 - DNA, 17 bp, Homo sapiens
ttaacttatttagagat

SEQ ID NO: 4158990 - DNA, 15 bp, Homo sapiens
ttaacttgagtttta

SEQ ID NO: 4158991 - DNA, 19 bp, Homo sapiens
ttaacttgtttggtagtta

SEQ ID NO: 4158992 - DNA, 16 bp, Homo sapiens
ttaactttaagtttca

SEQ ID NO: 4158993 - DNA, 21 bp, Homo sapiens
ttaagaaaaaataacacacat

SEQ ID NO: 4158994 - DNA, 14 bp, Homo sapiens
ttaagaaaagagat

SEQ ID NO: 4158995 - DNA, 14 bp, Homo sapiens
ttaagaaaagcact

SEQ ID NO: 4158996 - DNA, 17 bp, Homo sapiens
ttaagaaaagcactttt

SEQ ID NO: 4158997 - DNA, 18 bp, Homo sapiens
ttaagaaaagcacttttg

SEQ ID NO: 4158998 - DNA, 23 bp, Homo sapiens
ttaagaaaagcacttttgttatt

SEQ ID NO: 4158999 - DNA, 16 bp, Homo sapiens
ttaagaaaagtatttt

SEQ ID NO: 4159000 - DNA, 17 bp, Homo sapiens
ttaagaaaagtattttg

SEQ ID NO: 4159001 - DNA, 19 bp, Homo sapiens
ttaagaaaatacaataaac

SEQ ID NO: 4159002 - DNA, 16 bp, Homo sapiens
ttaagaacacaaagcg

SEQ ID NO: 4159003 - DNA, 13 bp, Homo sapiens
ttaagaagctgtt

SEQ ID NO: 4159004 - DNA, 14 bp, Homo sapiens
ttaagaagctgttg

SEQ ID NO: 4159005 - DNA, 16 bp, Homo sapiens
ttaagaagctgttgta

SEQ ID NO: 4159006 - DNA, 10 bp, Homo sapiens
ttaagaatat

SEQ ID NO: 4159007 - DNA, 16 bp, Homo sapiens
ttaagaatttcacaag

SEQ ID NO: 4159008 - DNA, 18 bp, Homo sapiens
ttaagacctggcagctct

SEQ ID NO: 4159009 - DNA, 16 bp, Homo sapiens
ttaagactgaatgttt

SEQ ID NO: 4159010 - DNA, 13 bp, Homo sapiens
ttaagagaaactt

SEQ ID NO: 4159011 - DNA, 14 bp, Homo sapiens
ttaagagaaacttt

SEQ ID NO: 4159012 - DNA, 20 bp, Homo sapiens
ttaagagtagcaagttctag

SEQ ID NO: 4159013 - DNA, 14 bp, Homo sapiens
ttaagatacaaatt

SEQ ID NO: 4159014 - DNA, 22 bp, Homo sapiens
ttaagatatccatctttttctt

SEQ ID NO: 4159015 - DNA, 18 bp, Homo sapiens
ttaagatggattctcaga

SEQ ID NO: 4159016 - DNA, 22 bp, Homo sapiens
ttaagatggattctcagatatt

SEQ ID NO: 4159017 - DNA, 15 bp, Homo sapiens
ttaagattttacaaa

SEQ ID NO: 4159018 - DNA, 16 bp, Homo sapiens
ttaagattttacaaaa

SEQ ID NO: 4159019 - DNA, 15 bp, Homo sapiens
ttaagatttttctca

SEQ ID NO: 4159020 - DNA, 16 bp, Homo sapiens
ttaagatttttctcaa

SEQ ID NO: 4159021 - DNA, 21 bp, Homo sapiens
ttaagatttttctcaaagttt

SEQ ID NO: 4159022 - DNA, 22 bp, Homo sapiens
ttaagatttttctcaaagtttt

SEQ ID NO: 4159023 - DNA, 19 bp, Homo sapiens
ttaagcaaaagaaaaagat

SEQ ID NO: 4159024 - DNA, 22 bp, Homo sapiens
ttaagcactacataaactgact

SEQ ID NO: 4159025 - DNA, 22 bp, Homo sapiens
ttaagcattgtttgcttattgt

SEQ ID NO: 4159026 - DNA, 23 bp, Homo sapiens
ttaagcattgtttgcttattgtt

SEQ ID NO: 4159027 - DNA, 14 bp, Homo sapiens
ttaagctgtttcca

SEQ ID NO: 4159028 - DNA, 23 bp, Homo sapiens
ttaaggaaatttgtaccatttca

SEQ ID NO: 4159029 - DNA, 19 bp, Homo sapiens
ttaaggacaaaaatgaact

SEQ ID NO: 4159030 - DNA, 20 bp, Homo sapiens
ttaaggattgtgatattttt

SEQ ID NO: 4159031 - DNA, 16 bp, Homo sapiens
ttaaggctaaaaagta

SEQ ID NO: 4159032 - DNA, 24 bp, Homo sapiens
ttaaggggaggaaccagagtgctg

SEQ ID NO: 4159033 - DNA, 23 bp, Homo sapiens
ttaaggggggcagggagtgatga

SEQ ID NO: 4159034 - DNA, 15 bp, Homo sapiens
ttaagggttaagaaa

SEQ ID NO: 4159035 - DNA, 22 bp, Homo sapiens
ttaaggtcaaactaattctcac

SEQ ID NO: 4159036 - DNA, 18 bp, Homo sapiens
ttaaggtgatatatttaa

SEQ ID NO: 4159037 - DNA, 14 bp, Homo sapiens
ttaaggttgaactt

SEQ ID NO: 4159038 - DNA, 15 bp, Homo sapiens
ttaaggttgaacttt

SEQ ID NO: 4159039 - DNA, 21 bp, Homo sapiens
ttaaggttgaactttgccaaa

SEQ ID NO: 4159040 - DNA, 11 bp, Homo sapiens
ttaagtaactt

SEQ ID NO: 4159041 - DNA, 14 bp, Homo sapiens
ttaagtatcttttt

SEQ ID NO: 4159042 - DNA, 14 bp, Homo sapiens
ttaagtatgtgtaa

SEQ ID NO: 4159043 - DNA, 20 bp, Homo sapiens
ttaagtgaaagagattactt

SEQ ID NO: 4159044 - DNA, 21 bp, Homo sapiens
ttaagtgcgtgtgtagagtta

SEQ ID NO: 4159045 - DNA, 21 bp, Homo sapiens
ttaagttctatgaagagtatt

SEQ ID NO: 4159046 - DNA, 15 bp, Homo sapiens
ttaagtttcaggata

SEQ ID NO: 4159047 - DNA, 20 bp, Homo sapiens
ttaataaaataattctaaag

SEQ ID NO: 4159048 - DNA, 19 bp, Homo sapiens
ttaataaagaaatatttac

SEQ ID NO: 4159049 - DNA, 13 bp, Homo sapiens
ttaataacattac

SEQ ID NO: 4159050 - DNA, 15 bp, Homo sapiens
ttaataacattacct

SEQ ID NO: 4159051 - DNA, 20 bp, Homo sapiens
ttaataacattaccttactg

SEQ ID NO: 4159052 - DNA, 21 bp, Homo sapiens
ttaataattagaaacaccaaa

SEQ ID NO: 4159053 - DNA, 17 bp, Homo sapiens
ttaatactaccttgaaa

SEQ ID NO: 4159054 - DNA, 21 bp, Homo sapiens
ttaatactcaaatgagtaaca

SEQ ID NO: 4159055 - DNA, 15 bp, Homo sapiens
ttaatagcagccttt

SEQ ID NO: 4159056 - DNA, 15 bp, Homo sapiens
ttaatagtttgtcta

SEQ ID NO: 4159057 - DNA, 21 bp, Homo sapiens
ttaatatatagtccagacact

SEQ ID NO: 4159058 - DNA, 20 bp, Homo sapiens
ttaatatccctacatgtatt

SEQ ID NO: 4159059 - DNA, 14 bp, Homo sapiens
ttaatatgaaaact

SEQ ID NO: 4159060 - DNA, 17 bp, Homo sapiens
ttaatatgaaaacttat

SEQ ID NO: 4159061 - DNA, 20 bp, Homo sapiens
ttaatattcttttgtttcca

SEQ ID NO: 4159062 - DNA, 23 bp, Homo sapiens
ttaatattcttttgtttccatgg

SEQ ID NO: 4159063 - DNA, 22 bp, Homo sapiens
ttaatattgatatgcttataca

SEQ ID NO: 4159064 - DNA, 21 bp, Homo sapiens
ttaatatttaaacagcagtgt

SEQ ID NO: 4159065 - DNA, 10 bp, Homo sapiens
ttaatcaaag

SEQ ID NO: 4159066 - DNA, 19 bp, Homo sapiens
ttaatcaaaggcatatctt

SEQ ID NO: 4159067 - DNA, 13 bp, Homo sapiens
ttaatcaactgta

SEQ ID NO: 4159068 - DNA, 18 bp, Homo sapiens
ttaatcatctataaagaa

SEQ ID NO: 4159069 - DNA, 17 bp, Homo sapiens
ttaatccttctttgtaa

SEQ ID NO: 4159070 - DNA, 22 bp, Homo sapiens
ttaatcctttgttttctgacta

SEQ ID NO: 4159071 - DNA, 19 bp, Homo sapiens
ttaatctgaaattctaaag

SEQ ID NO: 4159072 - DNA, 15 bp, Homo sapiens
ttaatcttcagtttt

SEQ ID NO: 4159073 - DNA, 22 bp, Homo sapiens
ttaatcttcagttttatcttta

SEQ ID NO: 4159074 - DNA, 17 bp, Homo sapiens
ttaatctttctttacct

SEQ ID NO: 4159075 - DNA, 24 bp, Homo sapiens
ttaatctttctttacctgagacca

SEQ ID NO: 4159076 - DNA, 14 bp, Homo sapiens
ttaatgaaaatgtc

SEQ ID NO: 4159077 - DNA, 16 bp, Homo sapiens
ttaatgaaaatgtcag

SEQ ID NO: 4159078 - DNA, 11 bp, Homo sapiens
ttaatgactta

SEQ ID NO: 4159079 - DNA, 14 bp, Homo sapiens
ttaatgcttcattc

SEQ ID NO: 4159080 - DNA, 15 bp, Homo sapiens
ttaatgcttcattca

SEQ ID NO: 4159081 - DNA, 20 bp, Homo sapiens
ttaatggaagtgtatttatt

SEQ ID NO: 4159082 - DNA, 18 bp, Homo sapiens
ttaatggacttatttctt

SEQ ID NO: 4159083 - DNA, 20 bp, Homo sapiens
ttaatggacttatttcttca

SEQ ID NO: 4159084 - DNA, 21 bp, Homo sapiens
ttaatggacttatttcttcaa

SEQ ID NO: 4159085 - DNA, 11 bp, Homo sapiens
ttaatgtgaag

SEQ ID NO: 4159086 - DNA, 12 bp, Homo sapiens
ttaatgtgaaga

SEQ ID NO: 4159087 - DNA, 13 bp, Homo sapiens
ttaattacaccat

SEQ ID NO: 4159088 - DNA, 14 bp, Homo sapiens
ttaattactggaat

SEQ ID NO: 4159089 - DNA, 20 bp, Homo sapiens
ttaattaggggttgctaaga

SEQ ID NO: 4159090 - DNA, 17 bp, Homo sapiens
ttaattattattcttca

SEQ ID NO: 4159091 - DNA, 14 bp, Homo sapiens
ttaattattattta

SEQ ID NO: 4159092 - DNA, 19 bp, Homo sapiens
ttaattcacctatgttatt

SEQ ID NO: 4159093 - DNA, 18 bp, Homo sapiens
ttaattcttcacctgtta

SEQ ID NO: 4159094 - DNA, 22 bp, Homo sapiens
ttaattgttgtttctttctagt

SEQ ID NO: 4159095 - DNA, 19 bp, Homo sapiens
ttaattgttttgcactttt

SEQ ID NO: 4159096 - DNA, 16 bp, Homo sapiens
ttaatttaaagcttac

SEQ ID NO: 4159097 - DNA, 18 bp, Homo sapiens
ttaatttaacaaactaaa

SEQ ID NO: 4159098 - DNA, 22 bp, Homo sapiens
ttaatttacaaaaatataaaat

SEQ ID NO: 4159099 - DNA, 14 bp, Homo sapiens
ttaatttatatgta

SEQ ID NO: 4159100 - DNA, 15 bp, Homo sapiens
ttaatttatctaaat

SEQ ID NO: 4159101 - DNA, 11 bp, Homo sapiens
ttaatttcctt

SEQ ID NO: 4159102 - DNA, 13 bp, Homo sapiens
ttaatttcctttt

SEQ ID NO: 4159103 - DNA, 18 bp, Homo sapiens
ttaatttcctttttgaca

SEQ ID NO: 4159104 - DNA, 19 bp, Homo sapiens
ttaatttcctttttgacac

SEQ ID NO: 4159105 - DNA, 20 bp, Homo sapiens
ttaatttgaaaccaggacat

SEQ ID NO: 4159106 - DNA, 21 bp, Homo sapiens
ttaatttgattaacaaatatg

SEQ ID NO: 4159107 - DNA, 17 bp, Homo sapiens
ttaattttactccataa

SEQ ID NO: 4159108 - DNA, 18 bp, Homo sapiens
ttaatttttcttagtgtt

SEQ ID NO: 4159109 - DNA, 18 bp, Homo sapiens
ttacaaaactacatgaga

SEQ ID NO: 4159110 - DNA, 18 bp, Homo sapiens
ttacaaaagatgtatcct

SEQ ID NO: 4159111 - DNA, 13 bp, Homo sapiens
ttacaaactgcaa

SEQ ID NO: 4159112 - DNA, 15 bp, Homo sapiens
ttacaaactgcaata

SEQ ID NO: 4159113 - DNA, 22 bp, Homo sapiens
ttacaaataaaattggcaccat

SEQ ID NO: 4159114 - DNA, 23 bp, Homo sapiens
ttacaactgcctcgaaacacaga

SEQ ID NO: 4159115 - DNA, 13 bp, Homo sapiens
ttacaacttccat

SEQ ID NO: 4159116 - DNA, 13 bp, Homo sapiens
ttacaagatccat

SEQ ID NO: 4159117 - DNA, 14 bp, Homo sapiens
ttacaagcaggcac

SEQ ID NO: 4159118 - DNA, 21 bp, Homo sapiens
ttacaataccgttaagataca

SEQ ID NO: 4159119 - DNA, 20 bp, Homo sapiens
ttacaataggtgcttattct

SEQ ID NO: 4159120 - DNA, 11 bp, Homo sapiens
ttacacactca

SEQ ID NO: 4159121 - DNA, 13 bp, Homo sapiens
ttacacactcagg

SEQ ID NO: 4159122 - DNA, 19 bp, Homo sapiens
ttacacagaaatgctgctg

SEQ ID NO: 4159123 - DNA, 16 bp, Homo sapiens
ttacaccaactcctaa

SEQ ID NO: 4159124 - DNA, 20 bp, Homo sapiens
ttacactttatgcacaaaat

SEQ ID NO: 4159125 - DNA, 15 bp, Homo sapiens
ttacagaaatactat

SEQ ID NO: 4159126 - DNA, 14 bp, Homo sapiens
ttacagagaggaga

SEQ ID NO: 4159127 - DNA, 20 bp, Homo sapiens
ttacagagaggagaaacaca

SEQ ID NO: 4159128 - DNA, 16 bp, Homo sapiens
ttacagagatgtctct

SEQ ID NO: 4159129 - DNA, 18 bp, Homo sapiens
ttacagatatttgtcatg

SEQ ID NO: 4159130 - DNA, 20 bp, Homo sapiens
ttacagatgaatgtatttat

SEQ ID NO: 4159131 - DNA, 16 bp, Homo sapiens
ttacagatttaataca

SEQ ID NO: 4159132 - DNA, 21 bp, Homo sapiens
ttacagcgagaggcagagaaa

SEQ ID NO: 4159133 - DNA, 15 bp, Homo sapiens
ttacaggaacttcat

SEQ ID NO: 4159134 - DNA, 15 bp, Homo sapiens
ttacaggcaccgaga

SEQ ID NO: 4159135 - DNA, 18 bp, Homo sapiens
ttacagggagctgggaca

SEQ ID NO: 4159136 - DNA, 17 bp, Homo sapiens
ttacaggtaccagttct

SEQ ID NO: 4159137 - DNA, 17 bp, Homo sapiens
ttacagtccttcaaaat

SEQ ID NO: 4159138 - DNA, 16 bp, Homo sapiens
ttacagtgcagacagg

SEQ ID NO: 4159139 - DNA, 19 bp, Homo sapiens
ttacagttagggttttgca

SEQ ID NO: 4159140 - DNA, 22 bp, Homo sapiens
ttacagttagggttttgcaata

SEQ ID NO: 4159141 - DNA, 15 bp, Homo sapiens
ttacataactgcctt

SEQ ID NO: 4159142 - DNA, 14 bp, Homo sapiens
ttacatctgtttta

SEQ ID NO: 4159143 - DNA, 18 bp, Homo sapiens
ttacatctgttttaaatt

SEQ ID NO: 4159144 - DNA, 17 bp, Homo sapiens
ttacatgaattgcattt

SEQ ID NO: 4159145 - DNA, 14 bp, Homo sapiens
ttacatgcataaaa

SEQ ID NO: 4159146 - DNA, 16 bp, Homo sapiens
ttacatgcataaaagg

SEQ ID NO: 4159147 - DNA, 16 bp, Homo sapiens
ttacattaatgttaat

SEQ ID NO: 4159148 - DNA, 17 bp, Homo sapiens
ttacattgtttgtctgt

SEQ ID NO: 4159149 - DNA, 15 bp, Homo sapiens
ttacatttaaagcat

SEQ ID NO: 4159150 - DNA, 22 bp, Homo sapiens
ttacatttaaagcattgctgtt

SEQ ID NO: 4159151 - DNA, 17 bp, Homo sapiens
ttacatttttacaataa

SEQ ID NO: 4159152 - DNA, 16 bp, Homo sapiens
ttaccaagagtaactt

SEQ ID NO: 4159153 - DNA, 17 bp, Homo sapiens
ttaccagagacgcccag

SEQ ID NO: 4159154 - DNA, 19 bp, Homo sapiens
ttaccagagacgcccagcc

SEQ ID NO: 4159155 - DNA, 21 bp, Homo sapiens
ttaccagggactatctttgct

SEQ ID NO: 4159156 - DNA, 24 bp, Homo sapiens
ttaccagtggcgttgttgcatgtt

SEQ ID NO: 4159157 - DNA, 19 bp, Homo sapiens
ttaccagttgccttttatc

SEQ ID NO: 4159158 - DNA, 16 bp, Homo sapiens
ttaccatcatctctga

SEQ ID NO: 4159159 - DNA, 11 bp, Homo sapiens
ttaccatgaga

SEQ ID NO: 4159160 - DNA, 21 bp, Homo sapiens
ttaccattcagttaattcaat

SEQ ID NO: 4159161 - DNA, 14 bp, Homo sapiens
ttaccatttacatg

SEQ ID NO: 4159162 - DNA, 20 bp, Homo sapiens
ttaccatttgtaataaagta

SEQ ID NO: 4159163 - DNA, 23 bp, Homo sapiens
ttaccatttgtaataaagtatat

SEQ ID NO: 4159164 - DNA, 18 bp, Homo sapiens
ttacccactcggtcccag

SEQ ID NO: 4159165 - DNA, 14 bp, Homo sapiens
ttaccccttagcct

SEQ ID NO: 4159166 - DNA, 18 bp, Homo sapiens
ttaccctaatgtcttcat

SEQ ID NO: 4159167 - DNA, 16 bp, Homo sapiens
ttaccctcctgtaaat

SEQ ID NO: 4159168 - DNA, 17 bp, Homo sapiens
ttaccctctttgctgca

SEQ ID NO: 4159169 - DNA, 13 bp, Homo sapiens
ttacccttccctg

SEQ ID NO: 4159170 - DNA, 22 bp, Homo sapiens
ttacccttttcccccttcccat

SEQ ID NO: 4159171 - DNA, 19 bp, Homo sapiens
ttacctaaacagatataaa

SEQ ID NO: 4159172 - DNA, 18 bp, Homo sapiens
ttacctaccacagtgtct

SEQ ID NO: 4159173 - DNA, 22 bp, Homo sapiens
ttacctctaaatttccatatcc

SEQ ID NO: 4159174 - DNA, 11 bp, Homo sapiens
ttacctctgat

SEQ ID NO: 4159175 - DNA, 16 bp, Homo sapiens
ttacctgacctcttgc

SEQ ID NO: 4159176 - DNA, 23 bp, Homo sapiens
ttacctgacctcttgctgtctct

SEQ ID NO: 4159177 - DNA, 14 bp, Homo sapiens
ttacctgcaggctg

SEQ ID NO: 4159178 - DNA, 15 bp, Homo sapiens
ttacctgtatacagt

SEQ ID NO: 4159179 - DNA, 11 bp, Homo sapiens
ttacctgtcac

SEQ ID NO: 4159180 - DNA, 18 bp, Homo sapiens
ttacctgtcacattgcat

SEQ ID NO: 4159181 - DNA, 13 bp, Homo sapiens
ttacctgtgtgct

SEQ ID NO: 4159182 - DNA, 20 bp, Homo sapiens
ttacctgttatatatctctt

SEQ ID NO: 4159183 - DNA, 23 bp, Homo sapiens
ttacctgttttcgcacctaccat

SEQ ID NO: 4159184 - DNA, 20 bp, Homo sapiens
ttacgcacacgtacttaaat

SEQ ID NO: 4159185 - DNA, 13 bp, Homo sapiens
ttacgctttgatt

SEQ ID NO: 4159186 - DNA, 12 bp, Homo sapiens
ttacgtgagcca

SEQ ID NO: 4159187 - DNA, 15 bp, Homo sapiens
ttacgtgagccaggt

SEQ ID NO: 4159188 - DNA, 13 bp, Homo sapiens
ttactaaaagatc

SEQ ID NO: 4159189 - DNA, 14 bp, Homo sapiens
ttactaggtaactt

SEQ ID NO: 4159190 - DNA, 16 bp, Homo sapiens
ttactaggtaacttca

SEQ ID NO: 4159191 - DNA, 23 bp, Homo sapiens
ttactattaagcagtaaaaactg

SEQ ID NO: 4159192 - DNA, 12 bp, Homo sapiens
ttactcagtgtt

SEQ ID NO: 4159193 - DNA, 20 bp, Homo sapiens
ttactcagtgttagagaaat

SEQ ID NO: 4159194 - DNA, 15 bp, Homo sapiens
ttactcagtttatgt

SEQ ID NO: 4159195 - DNA, 21 bp, Homo sapiens
ttactccacagcggaggagac

SEQ ID NO: 4159196 - DNA, 16 bp, Homo sapiens
ttactccataaacaga

SEQ ID NO: 4159197 - DNA, 21 bp, Homo sapiens
ttactccttaggtgcccagaa

SEQ ID NO: 4159198 - DNA, 14 bp, Homo sapiens
ttactctgcctaca

SEQ ID NO: 4159199 - DNA, 13 bp, Homo sapiens
ttactctttccta

SEQ ID NO: 4159200 - DNA, 13 bp, Homo sapiens
ttactgagcttct

SEQ ID NO: 4159201 - DNA, 16 bp, Homo sapiens
ttactgagcttctctg

SEQ ID NO: 4159202 - DNA, 14 bp, Homo sapiens
ttactgataatttt

SEQ ID NO: 4159203 - DNA, 13 bp, Homo sapiens
ttactgatcatgc

SEQ ID NO: 4159204 - DNA, 17 bp, Homo sapiens
ttactgatcatgcattg

SEQ ID NO: 4159205 - DNA, 20 bp, Homo sapiens
ttactgcttaattcaaataa

SEQ ID NO: 4159206 - DNA, 13 bp, Homo sapiens
ttactgcttcatt

SEQ ID NO: 4159207 - DNA, 16 bp, Homo sapiens
ttactggcttctcttg

SEQ ID NO: 4159208 - DNA, 23 bp, Homo sapiens
ttactgggccttagtgggccagg

SEQ ID NO: 4159209 - DNA, 14 bp, Homo sapiens
ttactgtcaataaa

SEQ ID NO: 4159210 - DNA, 20 bp, Homo sapiens
ttactgtcaataaacagctt

SEQ ID NO: 4159211 - DNA, 16 bp, Homo sapiens
ttactgtggaggaagg

SEQ ID NO: 4159212 - DNA, 20 bp, Homo sapiens
ttactgttgcatttactttt

SEQ ID NO: 4159213 - DNA, 16 bp, Homo sapiens
ttacttccattataca

SEQ ID NO: 4159214 - DNA, 18 bp, Homo sapiens
ttacttctaatcttaaat

SEQ ID NO: 4159215 - DNA, 19 bp, Homo sapiens
ttactttccaattctcctt

SEQ ID NO: 4159216 - DNA, 23 bp, Homo sapiens
ttacttttaccactatttaagtt

SEQ ID NO: 4159217 - DNA, 21 bp, Homo sapiens
ttacttttatttgcaacattt

SEQ ID NO: 4159218 - DNA, 23 bp, Homo sapiens
ttacttttatttgcaacatttac

SEQ ID NO: 4159219 - DNA, 17 bp, Homo sapiens
ttagaaaaattcctaag

SEQ ID NO: 4159220 - DNA, 14 bp, Homo sapiens
ttagaaaatgactt

SEQ ID NO: 4159221 - DNA, 19 bp, Homo sapiens
ttagaaaatgacttatttc

SEQ ID NO: 4159222 - DNA, 20 bp, Homo sapiens
ttagaaaatgacttatttct

SEQ ID NO: 4159223 - DNA, 13 bp, Homo sapiens
ttagaaacactgc

SEQ ID NO: 4159224 - DNA, 10 bp, Homo sapiens
ttagaaacta

SEQ ID NO: 4159225 - DNA, 21 bp, Homo sapiens
ttagaaagtagccacgtatgg

SEQ ID NO: 4159226 - DNA, 14 bp, Homo sapiens
ttagaaattagaaa

SEQ ID NO: 4159227 - DNA, 17 bp, Homo sapiens
ttagaaattgcatttcc

SEQ ID NO: 4159228 - DNA, 15 bp, Homo sapiens
ttagaattatttaaa

SEQ ID NO: 4159229 - DNA, 13 bp, Homo sapiens
ttagactcctcct

SEQ ID NO: 4159230 - DNA, 18 bp, Homo sapiens
ttagagataggaaactga

SEQ ID NO: 4159231 - DNA, 20 bp, Homo sapiens
ttagagataggaaactgaag

SEQ ID NO: 4159232 - DNA, 13 bp, Homo sapiens
ttagagatgaatt

SEQ ID NO: 4159233 - DNA, 17 bp, Homo sapiens
ttagaggaaaaaaatga

SEQ ID NO: 4159234 - DNA, 18 bp, Homo sapiens
ttagaggaaaaaaatgac

SEQ ID NO: 4159235 - DNA, 19 bp, Homo sapiens
ttagaggaaaaaaatgact

SEQ ID NO: 4159236 - DNA, 18 bp, Homo sapiens
ttagagggaggtgtttaa

SEQ ID NO: 4159237 - DNA, 18 bp, Homo sapiens
ttagagtcgtcactctct

SEQ ID NO: 4159238 - DNA, 23 bp, Homo sapiens
ttagatcaaatactttaaaggaa

SEQ ID NO: 4159239 - DNA, 15 bp, Homo sapiens
ttagatgtgagaaaa

SEQ ID NO: 4159240 - DNA, 20 bp, Homo sapiens
ttagatgtgccaataaccaa

SEQ ID NO: 4159241 - DNA, 20 bp, Homo sapiens
ttagattcttaattcatgag

SEQ ID NO: 4159242 - DNA, 21 bp, Homo sapiens
ttagattttattttactattg

SEQ ID NO: 4159243 - DNA, 21 bp, Homo sapiens
ttagcaaggtcatttcttcag

SEQ ID NO: 4159244 - DNA, 20 bp, Homo sapiens
ttagcagcaactgaagacaa

SEQ ID NO: 4159245 - DNA, 15 bp, Homo sapiens
ttagcagcttccaga

SEQ ID NO: 4159246 - DNA, 22 bp, Homo sapiens
ttagcaggttgggctagagaaa

SEQ ID NO: 4159247 - DNA, 18 bp, Homo sapiens
ttagcatagcttattatt

SEQ ID NO: 4159248 - DNA, 15 bp, Homo sapiens
ttagcatcctaagaa

SEQ ID NO: 4159249 - DNA, 17 bp, Homo sapiens
ttagcatcctaagaaat

SEQ ID NO: 4159250 - DNA, 19 bp, Homo sapiens
ttagcatgttgttgaaagg

SEQ ID NO: 4159251 - DNA, 20 bp, Homo sapiens
ttagccatctaatgcttgtt

SEQ ID NO: 4159252 - DNA, 14 bp, Homo sapiens
ttagccctgtctgc

SEQ ID NO: 4159253 - DNA, 18 bp, Homo sapiens
ttagctactgtatgcaaa

SEQ ID NO: 4159254 - DNA, 12 bp, Homo sapiens
ttagcttcctta

SEQ ID NO: 4159255 - DNA, 20 bp, Homo sapiens
ttagcttgcacatgaatgca

SEQ ID NO: 4159256 - DNA, 16 bp, Homo sapiens
ttagctttttaattgt

SEQ ID NO: 4159257 - DNA, 18 bp, Homo sapiens
ttaggaaaatcactttgt

SEQ ID NO: 4159258 - DNA, 20 bp, Homo sapiens
ttaggaacagcagtgttctc

SEQ ID NO: 4159259 - DNA, 13 bp, Homo sapiens
ttaggaagtgtaa

SEQ ID NO: 4159260 - DNA, 12 bp, Homo sapiens
ttaggagaagcc

SEQ ID NO: 4159261 - DNA, 14 bp, Homo sapiens
ttaggcctacctga

SEQ ID NO: 4159262 - DNA, 16 bp, Homo sapiens
ttaggccttcctctct

SEQ ID NO: 4159263 - DNA, 16 bp, Homo sapiens
ttaggctatttgtaaa

SEQ ID NO: 4159264 - DNA, 19 bp, Homo sapiens
ttaggctatttgtaaatct

SEQ ID NO: 4159265 - DNA, 20 bp, Homo sapiens
ttaggctatttgtaaatctg

SEQ ID NO: 4159266 - DNA, 13 bp, Homo sapiens
ttagggttttgca

SEQ ID NO: 4159267 - DNA, 15 bp, Homo sapiens
ttagggttttgcaat

SEQ ID NO: 4159268 - DNA, 23 bp, Homo sapiens
ttaggtaaccttatatttacaat

SEQ ID NO: 4159269 - DNA, 13 bp, Homo sapiens
ttaggtaattgta

SEQ ID NO: 4159270 - DNA, 13 bp, Homo sapiens
ttaggtactattc

SEQ ID NO: 4159271 - DNA, 18 bp, Homo sapiens
ttagtaaatttctgtgat

SEQ ID NO: 4159272 - DNA, 17 bp, Homo sapiens
ttagtaggtcctcaata

SEQ ID NO: 4159273 - DNA, 15 bp, Homo sapiens
ttagtatcagtgttt

SEQ ID NO: 4159274 - DNA, 19 bp, Homo sapiens
ttagtatcagtgttttaaa

SEQ ID NO: 4159275 - DNA, 15 bp, Homo sapiens
ttagtatctaacatg

SEQ ID NO: 4159276 - DNA, 17 bp, Homo sapiens
ttagtattcattctgca

SEQ ID NO: 4159277 - DNA, 14 bp, Homo sapiens
ttagtatttctcag

SEQ ID NO: 4159278 - DNA, 22 bp, Homo sapiens
ttagtattttaatcctgtacca

SEQ ID NO: 4159279 - DNA, 18 bp, Homo sapiens
ttagtctgaaactggctt

SEQ ID NO: 4159280 - DNA, 12 bp, Homo sapiens
ttagtgaagatg

SEQ ID NO: 4159281 - DNA, 14 bp, Homo sapiens
ttagtgagttattc

SEQ ID NO: 4159282 - DNA, 17 bp, Homo sapiens
ttagtgcggacaagttt

SEQ ID NO: 4159283 - DNA, 19 bp, Homo sapiens
ttagtgcggacaagtttta

SEQ ID NO: 4159284 - DNA, 15 bp, Homo sapiens
ttagtgttagttata

SEQ ID NO: 4159285 - DNA, 15 bp, Homo sapiens
ttagttaatgagcca

SEQ ID NO: 4159286 - DNA, 19 bp, Homo sapiens
ttagttccctgtctcttga

SEQ ID NO: 4159287 - DNA, 16 bp, Homo sapiens
ttagttctttttgcca

SEQ ID NO: 4159288 - DNA, 21 bp, Homo sapiens
ttagttgacaacctagaatgt

SEQ ID NO: 4159289 - DNA, 22 bp, Homo sapiens
ttagttgacaacctagaatgtc

SEQ ID NO: 4159290 - DNA, 18 bp, Homo sapiens
ttagttggacagtttaaa

SEQ ID NO: 4159291 - DNA, 13 bp, Homo sapiens
ttagtttagtgtg

SEQ ID NO: 4159292 - DNA, 14 bp, Homo sapiens
ttagtttagtgtgt

SEQ ID NO: 4159293 - DNA, 20 bp, Homo sapiens
ttagtttcctttttaatatg

SEQ ID NO: 4159294 - DNA, 22 bp, Homo sapiens
ttagtttgcagttacactaaaa

SEQ ID NO: 4159295 - DNA, 22 bp, Homo sapiens
ttagtttgtatgccaagtgaga

SEQ ID NO: 4159296 - DNA, 20 bp, Homo sapiens
ttagttttagaggcattgtt

SEQ ID NO: 4159297 - DNA, 15 bp, Homo sapiens
ttagttttagttgca

SEQ ID NO: 4159298 - DNA, 16 bp, Homo sapiens
ttagttttgatgagtt

SEQ ID NO: 4159299 - DNA, 15 bp, Homo sapiens
ttagtttttctgtcc

SEQ ID NO: 4159300 - DNA, 14 bp, Homo sapiens
ttataaaaaatggt

SEQ ID NO: 4159301 - DNA, 15 bp, Homo sapiens
ttataaaaaatggtt

SEQ ID NO: 4159302 - DNA, 12 bp, Homo sapiens
ttataaaacttc

SEQ ID NO: 4159303 - DNA, 17 bp, Homo sapiens
ttataaaattttgcttt

SEQ ID NO: 4159304 - DNA, 23 bp, Homo sapiens
ttataaacagacaatatgtgagt

SEQ ID NO: 4159305 - DNA, 14 bp, Homo sapiens
ttataaaccaatct

SEQ ID NO: 4159306 - DNA, 18 bp, Homo sapiens
ttataaactcattttgct

SEQ ID NO: 4159307 - DNA, 16 bp, Homo sapiens
ttataaatagccttca

SEQ ID NO: 4159308 - DNA, 18 bp, Homo sapiens
ttataaatataagccttt

SEQ ID NO: 4159309 - DNA, 17 bp, Homo sapiens
ttataaatcatattgat

SEQ ID NO: 4159310 - DNA, 14 bp, Homo sapiens
ttataaatgctatt

SEQ ID NO: 4159311 - DNA, 17 bp, Homo sapiens
ttataaatgttagttct

SEQ ID NO: 4159312 - DNA, 18 bp, Homo sapiens
ttataaatgttagttcta

SEQ ID NO: 4159313 - DNA, 23 bp, Homo sapiens
ttataaccatgagaattttactt

SEQ ID NO: 4159314 - DNA, 17 bp, Homo sapiens
ttataactcatcataaa

SEQ ID NO: 4159315 - DNA, 21 bp, Homo sapiens
ttataataaaaggaaaagcaa

SEQ ID NO: 4159316 - DNA, 18 bp, Homo sapiens
ttataataatgttaacat

SEQ ID NO: 4159317 - DNA, 21 bp, Homo sapiens
ttataatcctcaagagaaaat

SEQ ID NO: 4159318 - DNA, 21 bp, Homo sapiens
ttataatttttttattactga

SEQ ID NO: 4159319 - DNA, 20 bp, Homo sapiens
ttatacagatagagttccat

SEQ ID NO: 4159320 - DNA, 16 bp, Homo sapiens
ttataccattcagatc

SEQ ID NO: 4159321 - DNA, 22 bp, Homo sapiens
ttatacccccaggaaactagct

SEQ ID NO: 4159322 - DNA, 16 bp, Homo sapiens
ttatacctacctgtgt

SEQ ID NO: 4159323 - DNA, 16 bp, Homo sapiens
ttatacctgctatcag

SEQ ID NO: 4159324 - DNA, 18 bp, Homo sapiens
ttatactaacttatttat

SEQ ID NO: 4159325 - DNA, 16 bp, Homo sapiens
ttatactaagaaaaga

SEQ ID NO: 4159326 - DNA, 15 bp, Homo sapiens
ttatactgtgaagtt

SEQ ID NO: 4159327 - DNA, 15 bp, Homo sapiens
ttatagaaaaggaac

SEQ ID NO: 4159328 - DNA, 22 bp, Homo sapiens
ttatagaataaaagctgtggaa

SEQ ID NO: 4159329 - DNA, 14 bp, Homo sapiens
ttatagagaatgat

SEQ ID NO: 4159330 - DNA, 21 bp, Homo sapiens
ttatagaggctagcttctgct

SEQ ID NO: 4159331 - DNA, 20 bp, Homo sapiens
ttatagcaacaacaattggt

SEQ ID NO: 4159332 - DNA, 16 bp, Homo sapiens
ttatagcttaactaat

SEQ ID NO: 4159333 - DNA, 18 bp, Homo sapiens
ttatataaatgtaaaaat

SEQ ID NO: 4159334 - DNA, 14 bp, Homo sapiens
ttatatacagagga

SEQ ID NO: 4159335 - DNA, 21 bp, Homo sapiens
ttatatacctggcttttactt

SEQ ID NO: 4159336 - DNA, 18 bp, Homo sapiens
ttatatatgaaaactata

SEQ ID NO: 4159337 - DNA, 13 bp, Homo sapiens
ttatatatttata

SEQ ID NO: 4159338 - DNA, 14 bp, Homo sapiens
ttatatatttctaa

SEQ ID NO: 4159339 - DNA, 16 bp, Homo sapiens
ttatatcagcctgagt

SEQ ID NO: 4159340 - DNA, 18 bp, Homo sapiens
ttatatccagtaacacat

SEQ ID NO: 4159341 - DNA, 20 bp, Homo sapiens
ttatatcttttggttattct

SEQ ID NO: 4159342 - DNA, 15 bp, Homo sapiens
ttatattaaaatatg

SEQ ID NO: 4159343 - DNA, 19 bp, Homo sapiens
ttatattaatgtacttgtt

SEQ ID NO: 4159344 - DNA, 23 bp, Homo sapiens
ttatattagtgaagatggtttca

SEQ ID NO: 4159345 - DNA, 16 bp, Homo sapiens
ttatattatttacatt

SEQ ID NO: 4159346 - DNA, 15 bp, Homo sapiens
ttatattgaagacaa

SEQ ID NO: 4159347 - DNA, 16 bp, Homo sapiens
ttatatttaattatta

SEQ ID NO: 4159348 - DNA, 17 bp, Homo sapiens
ttatatttattgttaga

SEQ ID NO: 4159349 - DNA, 16 bp, Homo sapiens
ttatatttcctttatg

SEQ ID NO: 4159350 - DNA, 18 bp, Homo sapiens
ttatcaaaccctagcctt

SEQ ID NO: 4159351 - DNA, 15 bp, Homo sapiens
ttatcaaagcataga

SEQ ID NO: 4159352 - DNA, 17 bp, Homo sapiens
ttatcaaggactctggt

SEQ ID NO: 4159353 - DNA, 16 bp, Homo sapiens
ttatcaatatctaata

SEQ ID NO: 4159354 - DNA, 22 bp, Homo sapiens
ttatcaatatctaatatatatg

SEQ ID NO: 4159355 - DNA, 23 bp, Homo sapiens
ttatcagtcataactaaataaag

SEQ ID NO: 4159356 - DNA, 14 bp, Homo sapiens
ttatcataagaatt

SEQ ID NO: 4159357 - DNA, 18 bp, Homo sapiens
ttatccaaaatgtgtatt

SEQ ID NO: 4159358 - DNA, 21 bp, Homo sapiens
ttatccaaaatgtgtatttct

SEQ ID NO: 4159359 - DNA, 18 bp, Homo sapiens
ttatccaggactctgtca

SEQ ID NO: 4159360 - DNA, 23 bp, Homo sapiens
ttatcccaaagttgttgtaacct

SEQ ID NO: 4159361 - DNA, 17 bp, Homo sapiens
ttatccctcacctgtag

SEQ ID NO: 4159362 - DNA, 19 bp, Homo sapiens
ttatccctctcttcccctt

SEQ ID NO: 4159363 - DNA, 14 bp, Homo sapiens
ttatcgctttatgt

SEQ ID NO: 4159364 - DNA, 15 bp, Homo sapiens
ttatcggaagcagtg

SEQ ID NO: 4159365 - DNA, 18 bp, Homo sapiens
ttatcgggagcagtgtct

SEQ ID NO: 4159366 - DNA, 16 bp, Homo sapiens
ttatctatgcagcatg

SEQ ID NO: 4159367 - DNA, 19 bp, Homo sapiens
ttatctctatttaatattt

SEQ ID NO: 4159368 - DNA, 19 bp, Homo sapiens
ttatctcttttatatttgt

SEQ ID NO: 4159369 - DNA, 18 bp, Homo sapiens
ttatctgcaagtgaggtg

SEQ ID NO: 4159370 - DNA, 17 bp, Homo sapiens
ttatctgtgaattcaga

SEQ ID NO: 4159371 - DNA, 16 bp, Homo sapiens
ttatctgtgttaaaat

SEQ ID NO: 4159372 - DNA, 18 bp, Homo sapiens
ttatctgtgtttttgaaa

SEQ ID NO: 4159373 - DNA, 16 bp, Homo sapiens
ttatcttgtctctggg

SEQ ID NO: 4159374 - DNA, 17 bp, Homo sapiens
ttatcttgtctctgggc

SEQ ID NO: 4159375 - DNA, 23 bp, Homo sapiens
ttatctttccatgggagccagct

SEQ ID NO: 4159376 - DNA, 12 bp, Homo sapiens
ttatcttttcat

SEQ ID NO: 4159377 - DNA, 15 bp, Homo sapiens
ttatctttttacctt

SEQ ID NO: 4159378 - DNA, 21 bp, Homo sapiens
ttatgaaagcaacaaagaaat

SEQ ID NO: 4159379 - DNA, 23 bp, Homo sapiens
ttatgaagaattgccaatcttgt

SEQ ID NO: 4159380 - DNA, 16 bp, Homo sapiens
ttatgaagtttaaaac

SEQ ID NO: 4159381 - DNA, 22 bp, Homo sapiens
ttatgaagtttaaaacagtatt

SEQ ID NO: 4159382 - DNA, 15 bp, Homo sapiens
ttatgaataagcact

SEQ ID NO: 4159383 - DNA, 22 bp, Homo sapiens
ttatgaatatttataacagcat

SEQ ID NO: 4159384 - DNA, 14 bp, Homo sapiens
ttatgaatgaaaaa

SEQ ID NO: 4159385 - DNA, 23 bp, Homo sapiens
ttatgaatttttgtaagaaaccg

SEQ ID NO: 4159386 - DNA, 15 bp, Homo sapiens
ttatgagtaactatt

SEQ ID NO: 4159387 - DNA, 15 bp, Homo sapiens
ttatgagtttttgat

SEQ ID NO: 4159388 - DNA, 19 bp, Homo sapiens
ttatgatattgtttaaaat

SEQ ID NO: 4159389 - DNA, 15 bp, Homo sapiens
ttatgatcagtgttg

SEQ ID NO: 4159390 - DNA, 15 bp, Homo sapiens
ttatgattgttatgt

SEQ ID NO: 4159391 - DNA, 13 bp, Homo sapiens
ttatgatttaata

SEQ ID NO: 4159392 - DNA, 14 bp, Homo sapiens
ttatgcaaaatgga

SEQ ID NO: 4159393 - DNA, 20 bp, Homo sapiens
ttatgcaattaggtttttcc

SEQ ID NO: 4159394 - DNA, 23 bp, Homo sapiens
ttatgcaattaggtttttcctta

SEQ ID NO: 4159395 - DNA, 22 bp, Homo sapiens
ttatggaagattttaaattcac

SEQ ID NO: 4159396 - DNA, 19 bp, Homo sapiens
ttatggaattaaccattta

SEQ ID NO: 4159397 - DNA, 14 bp, Homo sapiens
ttatggaattgatt

SEQ ID NO: 4159398 - DNA, 11 bp, Homo sapiens
ttatggcctca

SEQ ID NO: 4159399 - DNA, 12 bp, Homo sapiens
ttatggcctcag

SEQ ID NO: 4159400 - DNA, 13 bp, Homo sapiens
ttatggcctcagc

SEQ ID NO: 4159401 - DNA, 15 bp, Homo sapiens
ttatggcctcagctg

SEQ ID NO: 4159402 - DNA, 18 bp, Homo sapiens
ttatggcctcagctgcct

SEQ ID NO: 4159403 - DNA, 16 bp, Homo sapiens
ttatggctgctgggct

SEQ ID NO: 4159404 - DNA, 21 bp, Homo sapiens
ttatggtaactgctttctgtt

SEQ ID NO: 4159405 - DNA, 18 bp, Homo sapiens
ttatgtaagagcaccttc

SEQ ID NO: 4159406 - DNA, 16 bp, Homo sapiens
ttatgtagcacataaa

SEQ ID NO: 4159407 - DNA, 16 bp, Homo sapiens
ttatgtataaacataa

SEQ ID NO: 4159408 - DNA, 19 bp, Homo sapiens
ttatgtatcttagttacat

SEQ ID NO: 4159409 - DNA, 13 bp, Homo sapiens
ttatgtcttttat

SEQ ID NO: 4159410 - DNA, 17 bp, Homo sapiens
ttatgtgaatttttaag

SEQ ID NO: 4159411 - DNA, 19 bp, Homo sapiens
ttatgtgaatttttaagct

SEQ ID NO: 4159412 - DNA, 14 bp, Homo sapiens
ttatgtgacatttt

SEQ ID NO: 4159413 - DNA, 16 bp, Homo sapiens
ttatgtgatcatgtgt

SEQ ID NO: 4159414 - DNA, 19 bp, Homo sapiens
ttatgtgtgaggagctgct

SEQ ID NO: 4159415 - DNA, 15 bp, Homo sapiens
ttatgttacatctgt

SEQ ID NO: 4159416 - DNA, 19 bp, Homo sapiens
ttatgttcttatagaataa

SEQ ID NO: 4159417 - DNA, 20 bp, Homo sapiens
ttatgttcttatagaataaa

SEQ ID NO: 4159418 - DNA, 23 bp, Homo sapiens
ttatgttcttatagaataaaagc

SEQ ID NO: 4159419 - DNA, 15 bp, Homo sapiens
ttatgttttgtttct

SEQ ID NO: 4159420 - DNA, 22 bp, Homo sapiens
ttatgttttttaaaatatttat

SEQ ID NO: 4159421 - DNA, 19 bp, Homo sapiens
ttattaaataaaatcaatt

SEQ ID NO: 4159422 - DNA, 21 bp, Homo sapiens
ttattaaataaaatcaatttt

SEQ ID NO: 4159423 - DNA, 18 bp, Homo sapiens
ttattaaatacaaaactt

SEQ ID NO: 4159424 - DNA, 21 bp, Homo sapiens
ttattaactaatatgggcatt

SEQ ID NO: 4159425 - DNA, 20 bp, Homo sapiens
ttattaagatggattctcag

SEQ ID NO: 4159426 - DNA, 21 bp, Homo sapiens
ttattaagatggattctcaga

SEQ ID NO: 4159427 - DNA, 18 bp, Homo sapiens
ttattaatatttaacatt

SEQ ID NO: 4159428 - DNA, 14 bp, Homo sapiens
ttattaatttgaaa

SEQ ID NO: 4159429 - DNA, 12 bp, Homo sapiens
ttattacaattt

SEQ ID NO: 4159430 - DNA, 19 bp, Homo sapiens
ttattaccccctccttcag

SEQ ID NO: 4159431 - DNA, 12 bp, Homo sapiens
ttattacctctg

SEQ ID NO: 4159432 - DNA, 12 bp, Homo sapiens
ttattactgtcc

SEQ ID NO: 4159433 - DNA, 13 bp, Homo sapiens
ttattataaatgt

SEQ ID NO: 4159434 - DNA, 21 bp, Homo sapiens
ttattataaatgttagttcta

SEQ ID NO: 4159435 - DNA, 16 bp, Homo sapiens
ttattattatttttta

SEQ ID NO: 4159436 - DNA, 22 bp, Homo sapiens
ttattatttgtgttttaattta

SEQ ID NO: 4159437 - DNA, 11 bp, Homo sapiens
ttattcagcag

SEQ ID NO: 4159438 - DNA, 16 bp, Homo sapiens
ttattcatttaaaatg

SEQ ID NO: 4159439 - DNA, 17 bp, Homo sapiens
ttattcatttaaaatga

SEQ ID NO: 4159440 - DNA, 20 bp, Homo sapiens
ttattccagaatgctgtaca

SEQ ID NO: 4159441 - DNA, 20 bp, Homo sapiens
ttattccatcaataaatgct

SEQ ID NO: 4159442 - DNA, 21 bp, Homo sapiens
ttattcctagtggatgactgt

SEQ ID NO: 4159443 - DNA, 16 bp, Homo sapiens
ttattccttgatcatt

SEQ ID NO: 4159444 - DNA, 18 bp, Homo sapiens
ttattcgtcctttgacaa

SEQ ID NO: 4159445 - DNA, 15 bp, Homo sapiens
ttattctcaaagcag

SEQ ID NO: 4159446 - DNA, 16 bp, Homo sapiens
ttattctcaaagcagg

SEQ ID NO: 4159447 - DNA, 19 bp, Homo sapiens
ttattctcttttatctgtt

SEQ ID NO: 4159448 - DNA, 22 bp, Homo sapiens
ttattgaaggaagccaaattta

SEQ ID NO: 4159449 - DNA, 19 bp, Homo sapiens
ttattgacacagaaaatgt

SEQ ID NO: 4159450 - DNA, 19 bp, Homo sapiens
ttattgagaattttaaatt

SEQ ID NO: 4159451 - DNA, 13 bp, Homo sapiens
ttattgcattata

SEQ ID NO: 4159452 - DNA, 14 bp, Homo sapiens
ttattgctagtatt

SEQ ID NO: 4159453 - DNA, 17 bp, Homo sapiens
ttattgctagtatttga

SEQ ID NO: 4159454 - DNA, 13 bp, Homo sapiens
ttattggcaaagt

SEQ ID NO: 4159455 - DNA, 14 bp, Homo sapiens
ttattggcaaagtt

SEQ ID NO: 4159456 - DNA, 22 bp, Homo sapiens
ttattggtttttttgtatagac

SEQ ID NO: 4159457 - DNA, 20 bp, Homo sapiens
ttattgtaagttgtacaaat

SEQ ID NO: 4159458 - DNA, 12 bp, Homo sapiens
ttattgtacctc

SEQ ID NO: 4159459 - DNA, 17 bp, Homo sapiens
ttattgtacctctctta

SEQ ID NO: 4159460 - DNA, 16 bp, Homo sapiens
ttattgtataaaaagt

SEQ ID NO: 4159461 - DNA, 17 bp, Homo sapiens
ttattgttccaagacat

SEQ ID NO: 4159462 - DNA, 23 bp, Homo sapiens
ttattgttccaagacattgtcaa

SEQ ID NO: 4159463 - DNA, 16 bp, Homo sapiens
ttatttaaaattccat

SEQ ID NO: 4159464 - DNA, 21 bp, Homo sapiens
ttatttaaaattccattatct

SEQ ID NO: 4159465 - DNA, 19 bp, Homo sapiens
ttatttaaataaaatcacc

SEQ ID NO: 4159466 - DNA, 14 bp, Homo sapiens
ttatttaaatttta

SEQ ID NO: 4159467 - DNA, 14 bp, Homo sapiens
ttatttaataacat

SEQ ID NO: 4159468 - DNA, 17 bp, Homo sapiens
ttatttactaattttct

SEQ ID NO: 4159469 - DNA, 21 bp, Homo sapiens
ttatttatatggggaatatat

SEQ ID NO: 4159470 - DNA, 16 bp, Homo sapiens
ttatttatcaaaatgt

SEQ ID NO: 4159471 - DNA, 14 bp, Homo sapiens
ttatttatgcctct

SEQ ID NO: 4159472 - DNA, 13 bp, Homo sapiens
ttatttattaaga

SEQ ID NO: 4159473 - DNA, 20 bp, Homo sapiens
ttatttcaataaatctttca

SEQ ID NO: 4159474 - DNA, 15 bp, Homo sapiens
ttatttccactaaaa

SEQ ID NO: 4159475 - DNA, 18 bp, Homo sapiens
ttatttctagtccaaaat

SEQ ID NO: 4159476 - DNA, 12 bp, Homo sapiens
ttatttctcctt

SEQ ID NO: 4159477 - DNA, 16 bp, Homo sapiens
ttatttctgctctgga

SEQ ID NO: 4159478 - DNA, 19 bp, Homo sapiens
ttatttctgctctggaata

SEQ ID NO: 4159479 - DNA, 12 bp, Homo sapiens
ttatttcttccc

SEQ ID NO: 4159480 - DNA, 17 bp, Homo sapiens
ttatttgccttctgaaa

SEQ ID NO: 4159481 - DNA, 22 bp, Homo sapiens
ttatttgtgttttaatttaaac

SEQ ID NO: 4159482 - DNA, 19 bp, Homo sapiens
ttatttgtttttcattcat

SEQ ID NO: 4159483 - DNA, 14 bp, Homo sapiens
ttattttaaaatat

SEQ ID NO: 4159484 - DNA, 20 bp, Homo sapiens
ttattttacagctcattaaa

SEQ ID NO: 4159485 - DNA, 18 bp, Homo sapiens
ttattttataatcaatga

SEQ ID NO: 4159486 - DNA, 16 bp, Homo sapiens
ttattttatcctctgg

SEQ ID NO: 4159487 - DNA, 12 bp, Homo sapiens
ttattttcaaga

SEQ ID NO: 4159488 - DNA, 14 bp, Homo sapiens
ttattttcacctgt

SEQ ID NO: 4159489 - DNA, 20 bp, Homo sapiens
ttattttcttttgaattgtt

SEQ ID NO: 4159490 - DNA, 22 bp, Homo sapiens
ttattttgaaaagcttcttaat

SEQ ID NO: 4159491 - DNA, 15 bp, Homo sapiens
ttattttggggtctc

SEQ ID NO: 4159492 - DNA, 13 bp, Homo sapiens
ttattttggtact

SEQ ID NO: 4159493 - DNA, 18 bp, Homo sapiens
ttattttggtacttttat

SEQ ID NO: 4159494 - DNA, 14 bp, Homo sapiens
ttatttttctgtga

SEQ ID NO: 4159495 - DNA, 14 bp, Homo sapiens
ttatttttcttgtc

SEQ ID NO: 4159496 - DNA, 13 bp, Homo sapiens
ttatttttgtaat

SEQ ID NO: 4159497 - DNA, 17 bp, Homo sapiens
ttatttttgtgtttcta

SEQ ID NO: 4159498 - DNA, 23 bp, Homo sapiens
ttatttttgtttcttccaaagca

SEQ ID NO: 4159499 - DNA, 16 bp, Homo sapiens
ttattttttaattatt

SEQ ID NO: 4159500 - DNA, 14 bp, Homo sapiens
ttatttttttctac

SEQ ID NO: 4159501 - DNA, 14 bp, Homo sapiens
ttcaaaaaaacact

SEQ ID NO: 4159502 - DNA, 12 bp, Homo sapiens
ttcaaaaataat

SEQ ID NO: 4159503 - DNA, 15 bp, Homo sapiens
ttcaaaaatataact

SEQ ID NO: 4159504 - DNA, 23 bp, Homo sapiens
ttcaaaacaaacagatgctctga

SEQ ID NO: 4159505 - DNA, 23 bp, Homo sapiens
ttcaaaagaaatttaagttctat

SEQ ID NO: 4159506 - DNA, 21 bp, Homo sapiens
ttcaaaagaatcagaaacagg

SEQ ID NO: 4159507 - DNA, 19 bp, Homo sapiens
ttcaaaatccttccaaaga

SEQ ID NO: 4159508 - DNA, 17 bp, Homo sapiens
ttcaaaattaaatctgt

SEQ ID NO: 4159509 - DNA, 15 bp, Homo sapiens
ttcaaactggggcct

SEQ ID NO: 4159510 - DNA, 16 bp, Homo sapiens
ttcaaactggggcctc

SEQ ID NO: 4159511 - DNA, 13 bp, Homo sapiens
ttcaaactttcac

SEQ ID NO: 4159512 - DNA, 19 bp, Homo sapiens
ttcaaagtagttttatttt

SEQ ID NO: 4159513 - DNA, 22 bp, Homo sapiens
ttcaaagtgttgtgttcctggc

SEQ ID NO: 4159514 - DNA, 23 bp, Homo sapiens
ttcaaagtgttgtgttcctggct

SEQ ID NO: 4159515 - DNA, 18 bp, Homo sapiens
ttcaaatacaaagtaaat

SEQ ID NO: 4159516 - DNA, 22 bp, Homo sapiens
ttcaaatcaatctgtaaaacta

SEQ ID NO: 4159517 - DNA, 16 bp, Homo sapiens
ttcaaatccttccaaa

SEQ ID NO: 4159518 - DNA, 13 bp, Homo sapiens
ttcaaatctggtc

SEQ ID NO: 4159519 - DNA, 18 bp, Homo sapiens
ttcaaattggactttcaa

SEQ ID NO: 4159520 - DNA, 19 bp, Homo sapiens
ttcaaattggactttcaaa

SEQ ID NO: 4159521 - DNA, 22 bp, Homo sapiens
ttcaacaaatattcactggccc

SEQ ID NO: 4159522 - DNA, 21 bp, Homo sapiens
ttcaacatcaatgttcattgt

SEQ ID NO: 4159523 - DNA, 22 bp, Homo sapiens
ttcaacatcaatgttcattgta

SEQ ID NO: 4159524 - DNA, 22 bp, Homo sapiens
ttcaaccaaggaggaattgaaa

SEQ ID NO: 4159525 - DNA, 17 bp, Homo sapiens
ttcaaccattccccatg

SEQ ID NO: 4159526 - DNA, 19 bp, Homo sapiens
ttcaacctggtggcaccag

SEQ ID NO: 4159527 - DNA, 16 bp, Homo sapiens
ttcaacgcagccctgc

SEQ ID NO: 4159528 - DNA, 20 bp, Homo sapiens
ttcaacgcagccctgctttg

SEQ ID NO: 4159529 - DNA, 15 bp, Homo sapiens
ttcaactatgtaggt

SEQ ID NO: 4159530 - DNA, 16 bp, Homo sapiens
ttcaactatgtaggta

SEQ ID NO: 4159531 - DNA, 17 bp, Homo sapiens
ttcaagcacttacagct

SEQ ID NO: 4159532 - DNA, 18 bp, Homo sapiens
ttcaaggagaatatgata

SEQ ID NO: 4159533 - DNA, 15 bp, Homo sapiens
ttcaaggcttccact

SEQ ID NO: 4159534 - DNA, 14 bp, Homo sapiens
ttcaagttcaatcc

SEQ ID NO: 4159535 - DNA, 22 bp, Homo sapiens
ttcaagttgtaaataatttatt

SEQ ID NO: 4159536 - DNA, 22 bp, Homo sapiens
ttcaagttttgggtatgtttaa

SEQ ID NO: 4159537 - DNA, 20 bp, Homo sapiens
ttcaataaagcatttataaa

SEQ ID NO: 4159538 - DNA, 18 bp, Homo sapiens
ttcaataaatctttcaaa

SEQ ID NO: 4159539 - DNA, 16 bp, Homo sapiens
ttcaataataaatatt

SEQ ID NO: 4159540 - DNA, 16 bp, Homo sapiens
ttcaatattgacattt

SEQ ID NO: 4159541 - DNA, 17 bp, Homo sapiens
ttcaatcctacttttcg

SEQ ID NO: 4159542 - DNA, 16 bp, Homo sapiens
ttcaatgtgcataatg

SEQ ID NO: 4159543 - DNA, 12 bp, Homo sapiens
ttcaattcctct

SEQ ID NO: 4159544 - DNA, 14 bp, Homo sapiens
ttcaattgtcactt

SEQ ID NO: 4159545 - DNA, 15 bp, Homo sapiens
ttcaattttaaagac

SEQ ID NO: 4159546 - DNA, 19 bp, Homo sapiens
ttcacaaaatgtctcagtt

SEQ ID NO: 4159547 - DNA, 15 bp, Homo sapiens
ttcacaaaatttcca

SEQ ID NO: 4159548 - DNA, 15 bp, Homo sapiens
ttcacaaacttttat

SEQ ID NO: 4159549 - DNA, 16 bp, Homo sapiens
ttcacaaacttttata

SEQ ID NO: 4159550 - DNA, 13 bp, Homo sapiens
ttcacaatagaaa

SEQ ID NO: 4159551 - DNA, 16 bp, Homo sapiens
ttcacaatgtcagtat

SEQ ID NO: 4159552 - DNA, 15 bp, Homo sapiens
ttcacagaaaaagca

SEQ ID NO: 4159553 - DNA, 17 bp, Homo sapiens
ttcacagaagcctagga

SEQ ID NO: 4159554 - DNA, 12 bp, Homo sapiens
ttcacagctcct

SEQ ID NO: 4159555 - DNA, 13 bp, Homo sapiens
ttcacagctcctc

SEQ ID NO: 4159556 - DNA, 12 bp, Homo sapiens
ttcacaggaggc

SEQ ID NO: 4159557 - DNA, 15 bp, Homo sapiens
ttcacaggaggccag

SEQ ID NO: 4159558 - DNA, 16 bp, Homo sapiens
ttcacagtctggtgct

SEQ ID NO: 4159559 - DNA, 19 bp, Homo sapiens
ttcacatgagctatttcca

SEQ ID NO: 4159560 - DNA, 17 bp, Homo sapiens
ttcacattgttaagaaa

SEQ ID NO: 4159561 - DNA, 21 bp, Homo sapiens
ttcacattgttaagaaaaata

SEQ ID NO: 4159562 - DNA, 19 bp, Homo sapiens
ttcacattgtttgctgcta

SEQ ID NO: 4159563 - DNA, 16 bp, Homo sapiens
ttcaccaaaattatcc

SEQ ID NO: 4159564 - DNA, 12 bp, Homo sapiens
ttcaccagagca

SEQ ID NO: 4159565 - DNA, 16 bp, Homo sapiens
ttcacccatcttatca

SEQ ID NO: 4159566 - DNA, 14 bp, Homo sapiens
ttcaccccaccctt

SEQ ID NO: 4159567 - DNA, 21 bp, Homo sapiens
ttcaccccagtggccactcag

SEQ ID NO: 4159568 - DNA, 22 bp, Homo sapiens
ttcaccccccactcaccagtgt

SEQ ID NO: 4159569 - DNA, 23 bp, Homo sapiens
ttcaccccccactcaccagtgtc

SEQ ID NO: 4159570 - DNA, 22 bp, Homo sapiens
ttcaccctgtcaagttaacaag

SEQ ID NO: 4159571 - DNA, 18 bp, Homo sapiens
ttcacctctatccaaaga

SEQ ID NO: 4159572 - DNA, 18 bp, Homo sapiens
ttcacctgttatgtatga

SEQ ID NO: 4159573 - DNA, 23 bp, Homo sapiens
ttcacctgttatgtatgaaggaa

SEQ ID NO: 4159574 - DNA, 19 bp, Homo sapiens
ttcacctgtttttaagctg

SEQ ID NO: 4159575 - DNA, 21 bp, Homo sapiens
ttcacctgtttttaagctgtt

SEQ ID NO: 4159576 - DNA, 23 bp, Homo sapiens
ttcacctgtttttaagctgtttc

SEQ ID NO: 4159577 - DNA, 16 bp, Homo sapiens
ttcacgcaacttgaaa

SEQ ID NO: 4159578 - DNA, 22 bp, Homo sapiens
ttcacgcaacttgaaattatat

SEQ ID NO: 4159579 - DNA, 22 bp, Homo sapiens
ttcacgctcacccagtcacctc

SEQ ID NO: 4159580 - DNA, 23 bp, Homo sapiens
ttcacgctcacccagtcacctcc

SEQ ID NO: 4159581 - DNA, 18 bp, Homo sapiens
ttcacgtcttggtgcctt

SEQ ID NO: 4159582 - DNA, 17 bp, Homo sapiens
ttcactactttaataaa

SEQ ID NO: 4159583 - DNA, 22 bp, Homo sapiens
ttcactagaagccgtgggaaga

SEQ ID NO: 4159584 - DNA, 14 bp, Homo sapiens
ttcactcaagcact

SEQ ID NO: 4159585 - DNA, 13 bp, Homo sapiens
ttcactccagcct

SEQ ID NO: 4159586 - DNA, 13 bp, Homo sapiens
ttcactgtataaa

SEQ ID NO: 4159587 - DNA, 16 bp, Homo sapiens
ttcactgttagctttt

SEQ ID NO: 4159588 - DNA, 12 bp, Homo sapiens
ttcacttcaaaa

SEQ ID NO: 4159589 - DNA, 19 bp, Homo sapiens
ttcacttctgactcttccc

SEQ ID NO: 4159590 - DNA, 21 bp, Homo sapiens
ttcacttgatgatacaatgaa

SEQ ID NO: 4159591 - DNA, 14 bp, Homo sapiens
ttcactttgaaaaa

SEQ ID NO: 4159592 - DNA, 11 bp, Homo sapiens
ttcagaaaaaa

SEQ ID NO: 4159593 - DNA, 15 bp, Homo sapiens
ttcagaaaaagaaat

SEQ ID NO: 4159594 - DNA, 23 bp, Homo sapiens
ttcagaaaacccttttctacagt

SEQ ID NO: 4159595 - DNA, 20 bp, Homo sapiens
ttcagaaaatattatgtgtt

SEQ ID NO: 4159596 - DNA, 19 bp, Homo sapiens
ttcagaaaatgttctgttt

SEQ ID NO: 4159597 - DNA, 13 bp, Homo sapiens
ttcagaaatatgt

SEQ ID NO: 4159598 - DNA, 17 bp, Homo sapiens
ttcagaagcaagccaga

SEQ ID NO: 4159599 - DNA, 19 bp, Homo sapiens
ttcagaaggttattttctt

SEQ ID NO: 4159600 - DNA, 16 bp, Homo sapiens
ttcagaattaaacttt

SEQ ID NO: 4159601 - DNA, 20 bp, Homo sapiens
ttcagacaagcaacaggttt

SEQ ID NO: 4159602 - DNA, 17 bp, Homo sapiens
ttcagacagggtctgaa

SEQ ID NO: 4159603 - DNA, 21 bp, Homo sapiens
ttcagagacagctgatacttc

SEQ ID NO: 4159604 - DNA, 13 bp, Homo sapiens
ttcagagagctgg

SEQ ID NO: 4159605 - DNA, 14 bp, Homo sapiens
ttcagagagctggt

SEQ ID NO: 4159606 - DNA, 15 bp, Homo sapiens
ttcagagagctggta

SEQ ID NO: 4159607 - DNA, 23 bp, Homo sapiens
ttcagagatttatataaatgtaa

SEQ ID NO: 4159608 - DNA, 17 bp, Homo sapiens
ttcagagggaaagtaaa

SEQ ID NO: 4159609 - DNA, 19 bp, Homo sapiens
ttcagagtacgtcctgcct

SEQ ID NO: 4159610 - DNA, 17 bp, Homo sapiens
ttcagatacaaactgca

SEQ ID NO: 4159611 - DNA, 16 bp, Homo sapiens
ttcagatatcaaaatt

SEQ ID NO: 4159612 - DNA, 17 bp, Homo sapiens
ttcagatatcaaaattc

SEQ ID NO: 4159613 - DNA, 18 bp, Homo sapiens
ttcagatattattgcttt

SEQ ID NO: 4159614 - DNA, 15 bp, Homo sapiens
ttcagatcactgaat

SEQ ID NO: 4159615 - DNA, 16 bp, Homo sapiens
ttcagatcactgaatt

SEQ ID NO: 4159616 - DNA, 21 bp, Homo sapiens
ttcagatcactgaatttataa

SEQ ID NO: 4159617 - DNA, 13 bp, Homo sapiens
ttcagcaaaccat

SEQ ID NO: 4159618 - DNA, 16 bp, Homo sapiens
ttcagcaccaccctag

SEQ ID NO: 4159619 - DNA, 13 bp, Homo sapiens
ttcagcaccccca

SEQ ID NO: 4159620 - DNA, 17 bp, Homo sapiens
ttcagcacccccaccca

SEQ ID NO: 4159621 - DNA, 19 bp, Homo sapiens
ttcagcacccccacccacc

SEQ ID NO: 4159622 - DNA, 13 bp, Homo sapiens
ttcagcactgtcc

SEQ ID NO: 4159623 - DNA, 14 bp, Homo sapiens
ttcagcactgtccc

SEQ ID NO: 4159624 - DNA, 16 bp, Homo sapiens
ttcagcagtcaataca

SEQ ID NO: 4159625 - DNA, 16 bp, Homo sapiens
ttcagcatatttatag

SEQ ID NO: 4159626 - DNA, 15 bp, Homo sapiens
ttcagcatcactaaa

SEQ ID NO: 4159627 - DNA, 19 bp, Homo sapiens
ttcagcatccgcaggtgct

SEQ ID NO: 4159628 - DNA, 13 bp, Homo sapiens
ttcagcccccagc

SEQ ID NO: 4159629 - DNA, 10 bp, Homo sapiens
ttcagcctgg

SEQ ID NO: 4159630 - DNA, 14 bp, Homo sapiens
ttcagcctggcctg

SEQ ID NO: 4159631 - DNA, 17 bp, Homo sapiens
ttcagcctggcctgccc

SEQ ID NO: 4159632 - DNA, 23 bp, Homo sapiens
ttcagcctggcctgcccgtgccc

SEQ ID NO: 4159633 - DNA, 13 bp, Homo sapiens
ttcagctaaggga

SEQ ID NO: 4159634 - DNA, 21 bp, Homo sapiens
ttcagctaagggaagacattt

SEQ ID NO: 4159635 - DNA, 23 bp, Homo sapiens
ttcagctaagggaagacatttct

SEQ ID NO: 4159636 - DNA, 19 bp, Homo sapiens
ttcagctagcttttaggaa

SEQ ID NO: 4159637 - DNA, 14 bp, Homo sapiens
ttcagctgagccct

SEQ ID NO: 4159638 - DNA, 19 bp, Homo sapiens
ttcagctgagccctgggga

SEQ ID NO: 4159639 - DNA, 19 bp, Homo sapiens
ttcagctgggtcacatcca

SEQ ID NO: 4159640 - DNA, 23 bp, Homo sapiens
ttcagctgggtcacatccatccc

SEQ ID NO: 4159641 - DNA, 14 bp, Homo sapiens
ttcagctgttgcag

SEQ ID NO: 4159642 - DNA, 16 bp, Homo sapiens
ttcagcttaaaataaa

SEQ ID NO: 4159643 - DNA, 14 bp, Homo sapiens
ttcaggaagatgaa

SEQ ID NO: 4159644 - DNA, 19 bp, Homo sapiens
ttcaggaatgtgtggcctg

SEQ ID NO: 4159645 - DNA, 21 bp, Homo sapiens
ttcaggacttaacggctccag

SEQ ID NO: 4159646 - DNA, 17 bp, Homo sapiens
ttcaggagtcccaagga

SEQ ID NO: 4159647 - DNA, 17 bp, Homo sapiens
ttcaggagttggaatgt

SEQ ID NO: 4159648 - DNA, 13 bp, Homo sapiens
ttcaggcaccagc

SEQ ID NO: 4159649 - DNA, 13 bp, Homo sapiens
ttcaggccagccc

SEQ ID NO: 4159650 - DNA, 14 bp, Homo sapiens
ttcaggccagccca

SEQ ID NO: 4159651 - DNA, 20 bp, Homo sapiens
ttcaggccagcccagccagg

SEQ ID NO: 4159652 - DNA, 14 bp, Homo sapiens
ttcaggctctgccc

SEQ ID NO: 4159653 - DNA, 13 bp, Homo sapiens
ttcaggctgcttg

SEQ ID NO: 4159654 - DNA, 19 bp, Homo sapiens
ttcaggggactcagccctg

SEQ ID NO: 4159655 - DNA, 16 bp, Homo sapiens
ttcaggtgacatgtga

SEQ ID NO: 4159656 - DNA, 18 bp, Homo sapiens
ttcaggtgacatgtgaaa

SEQ ID NO: 4159657 - DNA, 20 bp, Homo sapiens
ttcagtaataaactgtgttt

SEQ ID NO: 4159658 - DNA, 14 bp, Homo sapiens
ttcagtaataactc

SEQ ID NO: 4159659 - DNA, 23 bp, Homo sapiens
ttcagtataatttaacttcagag

SEQ ID NO: 4159660 - DNA, 13 bp, Homo sapiens
ttcagtgtacatg

SEQ ID NO: 4159661 - DNA, 24 bp, Homo sapiens
ttcagtgtagttaatttatctaaa

SEQ ID NO: 4159662 - DNA, 13 bp, Homo sapiens
ttcagtgtttctg

SEQ ID NO: 4159663 - DNA, 19 bp, Homo sapiens
ttcagttggttgtgtcttt

SEQ ID NO: 4159664 - DNA, 17 bp, Homo sapiens
ttcagttttatctttaa

SEQ ID NO: 4159665 - DNA, 17 bp, Homo sapiens
ttcagtttttgtatctt

SEQ ID NO: 4159666 - DNA, 16 bp, Homo sapiens
ttcagtttttgtgttt

SEQ ID NO: 4159667 - DNA, 16 bp, Homo sapiens
ttcataaagtacttga

SEQ ID NO: 4159668 - DNA, 16 bp, Homo sapiens
ttcataaatgaatttt

SEQ ID NO: 4159669 - DNA, 17 bp, Homo sapiens
ttcataaccaacaatat

SEQ ID NO: 4159670 - DNA, 21 bp, Homo sapiens
ttcataaccaacaatataaac

SEQ ID NO: 4159671 - DNA, 16 bp, Homo sapiens
ttcataacttcctgta

SEQ ID NO: 4159672 - DNA, 22 bp, Homo sapiens
ttcataattaaaatttatctta

SEQ ID NO: 4159673 - DNA, 19 bp, Homo sapiens
ttcatagagatttgtctaa

SEQ ID NO: 4159674 - DNA, 16 bp, Homo sapiens
ttcatagttcagaatt

SEQ ID NO: 4159675 - DNA, 14 bp, Homo sapiens
ttcatagtttatta

SEQ ID NO: 4159676 - DNA, 13 bp, Homo sapiens
ttcatatgttgct

SEQ ID NO: 4159677 - DNA, 18 bp, Homo sapiens
ttcatattgctgagagaa

SEQ ID NO: 4159678 - DNA, 17 bp, Homo sapiens
ttcatcattccctctca

SEQ ID NO: 4159679 - DNA, 23 bp, Homo sapiens
ttcatcattgtttctgcatgaat

SEQ ID NO: 4159680 - DNA, 18 bp, Homo sapiens
ttcatccaatcctcactg

SEQ ID NO: 4159681 - DNA, 21 bp, Homo sapiens
ttcatccaatcctcactgggt

SEQ ID NO: 4159682 - DNA, 16 bp, Homo sapiens
ttcatccagcagtgtt

SEQ ID NO: 4159683 - DNA, 16 bp, Homo sapiens
ttcatccttccatcca

SEQ ID NO: 4159684 - DNA, 17 bp, Homo sapiens
ttcatccttccatccat

SEQ ID NO: 4159685 - DNA, 12 bp, Homo sapiens
ttcatccttccc

SEQ ID NO: 4159686 - DNA, 23 bp, Homo sapiens
ttcatcgaatctactaattccac

SEQ ID NO: 4159687 - DNA, 14 bp, Homo sapiens
ttcatctacctttt

SEQ ID NO: 4159688 - DNA, 16 bp, Homo sapiens
ttcatctaccttttct

SEQ ID NO: 4159689 - DNA, 13 bp, Homo sapiens
ttcatctggggtt

SEQ ID NO: 4159690 - DNA, 22 bp, Homo sapiens
ttcatctgtccatggcctttct

SEQ ID NO: 4159691 - DNA, 14 bp, Homo sapiens
ttcatcttcctgtg

SEQ ID NO: 4159692 - DNA, 15 bp, Homo sapiens
ttcatcttcctgtgt

SEQ ID NO: 4159693 - DNA, 17 bp, Homo sapiens
ttcatcttcctgtgtcc

SEQ ID NO: 4159694 - DNA, 18 bp, Homo sapiens
ttcatcttcctgtgtcct

SEQ ID NO: 4159695 - DNA, 16 bp, Homo sapiens
ttcatgaccagtaaag

SEQ ID NO: 4159696 - DNA, 23 bp, Homo sapiens
ttcatgagcattcataattaaaa

SEQ ID NO: 4159697 - DNA, 14 bp, Homo sapiens
ttcatgcaatgaca

SEQ ID NO: 4159698 - DNA, 21 bp, Homo sapiens
ttcatgcaatgacatcttcaa

SEQ ID NO: 4159699 - DNA, 21 bp, Homo sapiens
ttcatgccagctacttcctcc

SEQ ID NO: 4159700 - DNA, 22 bp, Homo sapiens
ttcatgccagctacttcctcct

SEQ ID NO: 4159701 - DNA, 15 bp, Homo sapiens
ttcatgcctttcata

SEQ ID NO: 4159702 - DNA, 15 bp, Homo sapiens
ttcatgcctttgtaa

SEQ ID NO: 4159703 - DNA, 17 bp, Homo sapiens
ttcatgcctttgtaagt

SEQ ID NO: 4159704 - DNA, 20 bp, Homo sapiens
ttcatggaatggacatcctg

SEQ ID NO: 4159705 - DNA, 22 bp, Homo sapiens
ttcatgtcaacttctggctcct

SEQ ID NO: 4159706 - DNA, 21 bp, Homo sapiens
ttcatgtgcctctgcggggca

SEQ ID NO: 4159707 - DNA, 14 bp, Homo sapiens
ttcatgtggctgta

SEQ ID NO: 4159708 - DNA, 15 bp, Homo sapiens
ttcatgttcactgtg

SEQ ID NO: 4159709 - DNA, 18 bp, Homo sapiens
ttcatgttcactgtgagt

SEQ ID NO: 4159710 - DNA, 12 bp, Homo sapiens
ttcattaaactt

SEQ ID NO: 4159711 - DNA, 20 bp, Homo sapiens
ttcattaaacttgaagcagt

SEQ ID NO: 4159712 - DNA, 18 bp, Homo sapiens
ttcattattggaattaac

SEQ ID NO: 4159713 - DNA, 16 bp, Homo sapiens
ttcattcaatattgac

SEQ ID NO: 4159714 - DNA, 15 bp, Homo sapiens
ttcattcattggtga

SEQ ID NO: 4159715 - DNA, 21 bp, Homo sapiens
ttcattccttcagatttggct

SEQ ID NO: 4159716 - DNA, 13 bp, Homo sapiens
ttcattctcctgc

SEQ ID NO: 4159717 - DNA, 15 bp, Homo sapiens
ttcattctcctgcct

SEQ ID NO: 4159718 - DNA, 12 bp, Homo sapiens
ttcattctcctt

SEQ ID NO: 4159719 - DNA, 17 bp, Homo sapiens
ttcattctccttgttgt

SEQ ID NO: 4159720 - DNA, 19 bp, Homo sapiens
ttcattcttgaaagctgtg

SEQ ID NO: 4159721 - DNA, 18 bp, Homo sapiens
ttcattgcctgtgtatgg

SEQ ID NO: 4159722 - DNA, 15 bp, Homo sapiens
ttcatttaagggaaa

SEQ ID NO: 4159723 - DNA, 20 bp, Homo sapiens
ttcatttaagggaaagaaaa

SEQ ID NO: 4159724 - DNA, 18 bp, Homo sapiens
ttcatttagtgagttatt

SEQ ID NO: 4159725 - DNA, 12 bp, Homo sapiens
ttcattttggtt

SEQ ID NO: 4159726 - DNA, 16 bp, Homo sapiens
ttccaaaaaattaaaa

SEQ ID NO: 4159727 - DNA, 15 bp, Homo sapiens
ttccaaaaattatta

SEQ ID NO: 4159728 - DNA, 13 bp, Homo sapiens
ttccaaaataatt

SEQ ID NO: 4159729 - DNA, 21 bp, Homo sapiens
ttccaaaataattttaagaaa

SEQ ID NO: 4159730 - DNA, 18 bp, Homo sapiens
ttccaaaatctcccattt

SEQ ID NO: 4159731 - DNA, 20 bp, Homo sapiens
ttccaaaattcttatttttc

SEQ ID NO: 4159732 - DNA, 15 bp, Homo sapiens
ttccaaagaattctt

SEQ ID NO: 4159733 - DNA, 21 bp, Homo sapiens
ttccaaagagtagaattgcat

SEQ ID NO: 4159734 - DNA, 20 bp, Homo sapiens
ttccaaagcacattgaaaga

SEQ ID NO: 4159735 - DNA, 20 bp, Homo sapiens
ttccaaagccagtgaaatgt

SEQ ID NO: 4159736 - DNA, 22 bp, Homo sapiens
ttccaaagctttattaccagtg

SEQ ID NO: 4159737 - DNA, 19 bp, Homo sapiens
ttccaaattcagtttcata

SEQ ID NO: 4159738 - DNA, 20 bp, Homo sapiens
ttccaaattcagtttcataa

SEQ ID NO: 4159739 - DNA, 15 bp, Homo sapiens
ttccaaattctgctt

SEQ ID NO: 4159740 - DNA, 20 bp, Homo sapiens
ttccaacaccacagacacac

SEQ ID NO: 4159741 - DNA, 13 bp, Homo sapiens
ttccaaccaggca

SEQ ID NO: 4159742 - DNA, 16 bp, Homo sapiens
ttccaagcttcatatt

SEQ ID NO: 4159743 - DNA, 15 bp, Homo sapiens
ttccaagggtactaa

SEQ ID NO: 4159744 - DNA, 23 bp, Homo sapiens
ttccaattatttataataaatca

SEQ ID NO: 4159745 - DNA, 11 bp, Homo sapiens
ttccacaaaat

SEQ ID NO: 4159746 - DNA, 15 bp, Homo sapiens
ttccacaccttttat

SEQ ID NO: 4159747 - DNA, 13 bp, Homo sapiens
ttccacatttgtc

SEQ ID NO: 4159748 - DNA, 15 bp, Homo sapiens
ttccaccaggccgtg

SEQ ID NO: 4159749 - DNA, 12 bp, Homo sapiens
ttccacctccct

SEQ ID NO: 4159750 - DNA, 13 bp, Homo sapiens
ttccacctccctc

SEQ ID NO: 4159751 - DNA, 15 bp, Homo sapiens
ttccacctccctccc

SEQ ID NO: 4159752 - DNA, 17 bp, Homo sapiens
ttccacctgctctgctg

SEQ ID NO: 4159753 - DNA, 15 bp, Homo sapiens
ttccactacacctgg

SEQ ID NO: 4159754 - DNA, 12 bp, Homo sapiens
ttccactccact

SEQ ID NO: 4159755 - DNA, 18 bp, Homo sapiens
ttccacttcttcctttct

SEQ ID NO: 4159756 - DNA, 19 bp, Homo sapiens
ttccacttcttcctttctc

SEQ ID NO: 4159757 - DNA, 21 bp, Homo sapiens
ttccacttgagtgtcaagctg

SEQ ID NO: 4159758 - DNA, 14 bp, Homo sapiens
ttccagaaaggata

SEQ ID NO: 4159759 - DNA, 20 bp, Homo sapiens
ttccagaagaagagaagctg

SEQ ID NO: 4159760 - DNA, 23 bp, Homo sapiens
ttccagaagaagagaagctgctg

SEQ ID NO: 4159761 - DNA, 15 bp, Homo sapiens
ttccagaatgctgaa

SEQ ID NO: 4159762 - DNA, 20 bp, Homo sapiens
ttccagagacaaatatttct

SEQ ID NO: 4159763 - DNA, 19 bp, Homo sapiens
ttccagagagtggctcctc

SEQ ID NO: 4159764 - DNA, 21 bp, Homo sapiens
ttccagagcattccagtcagg

SEQ ID NO: 4159765 - DNA, 16 bp, Homo sapiens
ttccagaggtattcct

SEQ ID NO: 4159766 - DNA, 16 bp, Homo sapiens
ttccagagtgctgagg

SEQ ID NO: 4159767 - DNA, 14 bp, Homo sapiens
ttccagatgtggat

SEQ ID NO: 4159768 - DNA, 16 bp, Homo sapiens
ttccagcaataagaaa

SEQ ID NO: 4159769 - DNA, 19 bp, Homo sapiens
ttccagcaataagaaatga

SEQ ID NO: 4159770 - DNA, 22 bp, Homo sapiens
ttccagcaattctcctgcctca

SEQ ID NO: 4159771 - DNA, 11 bp, Homo sapiens
ttccagcccat

SEQ ID NO: 4159772 - DNA, 11 bp, Homo sapiens
ttccagctcct

SEQ ID NO: 4159773 - DNA, 14 bp, Homo sapiens
ttccagctcctgta

SEQ ID NO: 4159774 - DNA, 12 bp, Homo sapiens
ttccagctgctg

SEQ ID NO: 4159775 - DNA, 15 bp, Homo sapiens
ttccagctgctgtct

SEQ ID NO: 4159776 - DNA, 20 bp, Homo sapiens
ttccagctgtcactctgtgc

SEQ ID NO: 4159777 - DNA, 13 bp, Homo sapiens
ttccagctgtgca

SEQ ID NO: 4159778 - DNA, 17 bp, Homo sapiens
ttccagctgtgcagcac

SEQ ID NO: 4159779 - DNA, 15 bp, Homo sapiens
ttccagcttcaggca

SEQ ID NO: 4159780 - DNA, 18 bp, Homo sapiens
ttccagcttcaggcacca

SEQ ID NO: 4159781 - DNA, 21 bp, Homo sapiens
ttccagcttcaggcaccagca

SEQ ID NO: 4159782 - DNA, 23 bp, Homo sapiens
ttccaggaaactccacatctgcc

SEQ ID NO: 4159783 - DNA, 20 bp, Homo sapiens
ttccaggcctgatcttgcct

SEQ ID NO: 4159784 - DNA, 14 bp, Homo sapiens
ttccagggcaatca

SEQ ID NO: 4159785 - DNA, 17 bp, Homo sapiens
ttccaggtatctccagg

SEQ ID NO: 4159786 - DNA, 18 bp, Homo sapiens
ttccaggtatctccagga

SEQ ID NO: 4159787 - DNA, 18 bp, Homo sapiens
ttccagtacctttgtcac

SEQ ID NO: 4159788 - DNA, 22 bp, Homo sapiens
ttccagtcaggctctctgggct

SEQ ID NO: 4159789 - DNA, 18 bp, Homo sapiens
ttccagtggatcataaga

SEQ ID NO: 4159790 - DNA, 16 bp, Homo sapiens
ttccataatgtataaa

SEQ ID NO: 4159791 - DNA, 18 bp, Homo sapiens
ttccataattatgacagt

SEQ ID NO: 4159792 - DNA, 13 bp, Homo sapiens
ttccatagcaaca

SEQ ID NO: 4159793 - DNA, 14 bp, Homo sapiens
ttccatcaataaat

SEQ ID NO: 4159794 - DNA, 15 bp, Homo sapiens
ttccatcaataaatg

SEQ ID NO: 4159795 - DNA, 17 bp, Homo sapiens
ttccatccataaatcca

SEQ ID NO: 4159796 - DNA, 18 bp, Homo sapiens
ttccatcctttacgtgtt

SEQ ID NO: 4159797 - DNA, 13 bp, Homo sapiens
ttccatctttaca

SEQ ID NO: 4159798 - DNA, 22 bp, Homo sapiens
ttccatgaaaacgttttattgt

SEQ ID NO: 4159799 - DNA, 12 bp, Homo sapiens
ttccatgaatgt

SEQ ID NO: 4159800 - DNA, 20 bp, Homo sapiens
ttccatgaatgtatcaggaa

SEQ ID NO: 4159801 - DNA, 18 bp, Homo sapiens
ttccatgagaacagcagg

SEQ ID NO: 4159802 - DNA, 18 bp, Homo sapiens
ttccatgattctatttat

SEQ ID NO: 4159803 - DNA, 14 bp, Homo sapiens
ttccatgcaactgg

SEQ ID NO: 4159804 - DNA, 12 bp, Homo sapiens
ttccatgggaat

SEQ ID NO: 4159805 - DNA, 13 bp, Homo sapiens
ttccatgtgcctt

SEQ ID NO: 4159806 - DNA, 19 bp, Homo sapiens
ttccatgtgcctttctttg

SEQ ID NO: 4159807 - DNA, 20 bp, Homo sapiens
ttccatgtgcctttctttgc

SEQ ID NO: 4159808 - DNA, 23 bp, Homo sapiens
ttccatgtgcctttctttgcctc

SEQ ID NO: 4159809 - DNA, 14 bp, Homo sapiens
ttccattatcttat

SEQ ID NO: 4159810 - DNA, 16 bp, Homo sapiens
ttccattatgattctt

SEQ ID NO: 4159811 - DNA, 13 bp, Homo sapiens
ttccattccagaa

SEQ ID NO: 4159812 - DNA, 16 bp, Homo sapiens
ttccattccagaatat

SEQ ID NO: 4159813 - DNA, 19 bp, Homo sapiens
ttccatttcttcctcacta

SEQ ID NO: 4159814 - DNA, 14 bp, Homo sapiens
ttccattttccccc

SEQ ID NO: 4159815 - DNA, 23 bp, Homo sapiens
ttccattttggcgctattacaaa

SEQ ID NO: 4159816 - DNA, 16 bp, Homo sapiens
ttcccaaacgcctccc

SEQ ID NO: 4159817 - DNA, 17 bp, Homo sapiens
ttcccaacagccttagc

SEQ ID NO: 4159818 - DNA, 20 bp, Homo sapiens
ttcccaacttctcttgcttt

SEQ ID NO: 4159819 - DNA, 15 bp, Homo sapiens
ttcccaataaaagtg

SEQ ID NO: 4159820 - DNA, 22 bp, Homo sapiens
ttcccacatctttcctcaagta

SEQ ID NO: 4159821 - DNA, 19 bp, Homo sapiens
ttcccacccctacacacac

SEQ ID NO: 4159822 - DNA, 22 bp, Homo sapiens
ttcccacccctacacacacact

SEQ ID NO: 4159823 - DNA, 10 bp, Homo sapiens
ttcccaccct

SEQ ID NO: 4159824 - DNA, 12 bp, Homo sapiens
ttcccaccctcc

SEQ ID NO: 4159825 - DNA, 18 bp, Homo sapiens
ttcccaccctcctgcccc

SEQ ID NO: 4159826 - DNA, 20 bp, Homo sapiens
ttcccactctgtcgagcctg

SEQ ID NO: 4159827 - DNA, 15 bp, Homo sapiens
ttcccagaggcaggc

SEQ ID NO: 4159828 - DNA, 14 bp, Homo sapiens
ttcccagagggagc

SEQ ID NO: 4159829 - DNA, 15 bp, Homo sapiens
ttcccagagggagca

SEQ ID NO: 4159830 - DNA, 19 bp, Homo sapiens
ttcccagagtcatctgatt

SEQ ID NO: 4159831 - DNA, 11 bp, Homo sapiens
ttcccaggacc

SEQ ID NO: 4159832 - DNA, 19 bp, Homo sapiens
ttcccaggaccctgaaggg

SEQ ID NO: 4159833 - DNA, 20 bp, Homo sapiens
ttcccaggaccctgaagggg

SEQ ID NO: 4159834 - DNA, 21 bp, Homo sapiens
ttcccaggagatgggtccagg

SEQ ID NO: 4159835 - DNA, 19 bp, Homo sapiens
ttcccagtaagtttcccct

SEQ ID NO: 4159836 - DNA, 23 bp, Homo sapiens
ttcccagtaagtttcccctctgg

SEQ ID NO: 4159837 - DNA, 17 bp, Homo sapiens
ttcccagtgaattcttg

SEQ ID NO: 4159838 - DNA, 13 bp, Homo sapiens
ttcccatgactgc

SEQ ID NO: 4159839 - DNA, 16 bp, Homo sapiens
ttcccatgactgcacc

SEQ ID NO: 4159840 - DNA, 11 bp, Homo sapiens
ttcccattcca

SEQ ID NO: 4159841 - DNA, 19 bp, Homo sapiens
ttcccattttgcaaaattt

SEQ ID NO: 4159842 - DNA, 18 bp, Homo sapiens
ttccccaaccacttcatt

SEQ ID NO: 4159843 - DNA, 13 bp, Homo sapiens
ttccccaccgcag

SEQ ID NO: 4159844 - DNA, 12 bp, Homo sapiens
ttccccagagag

SEQ ID NO: 4159845 - DNA, 12 bp, Homo sapiens
ttccccaggtgt

SEQ ID NO: 4159846 - DNA, 19 bp, Homo sapiens
ttcccccaaaggcatccca

SEQ ID NO: 4159847 - DNA, 18 bp, Homo sapiens
ttcccccaccagctaagg

SEQ ID NO: 4159848 - DNA, 18 bp, Homo sapiens
ttcccccaccagctgcag

SEQ ID NO: 4159849 - DNA, 21 bp, Homo sapiens
ttccccccactctccccacac

SEQ ID NO: 4159850 - DNA, 16 bp, Homo sapiens
ttcccccttcccattt

SEQ ID NO: 4159851 - DNA, 13 bp, Homo sapiens
ttcccctacagaa

SEQ ID NO: 4159852 - DNA, 13 bp, Homo sapiens
ttcccctccagga

SEQ ID NO: 4159853 - DNA, 19 bp, Homo sapiens
ttcccctcccacctctcct

SEQ ID NO: 4159854 - DNA, 17 bp, Homo sapiens
ttcccctccctggctcc

SEQ ID NO: 4159855 - DNA, 17 bp, Homo sapiens
ttcccctccttctccct

SEQ ID NO: 4159856 - DNA, 18 bp, Homo sapiens
ttcccctccttctccctt

SEQ ID NO: 4159857 - DNA, 19 bp, Homo sapiens
ttcccctcttcccttcaac

SEQ ID NO: 4159858 - DNA, 12 bp, Homo sapiens
ttcccctgtgtc

SEQ ID NO: 4159859 - DNA, 19 bp, Homo sapiens
ttccccttagaaacactgc

SEQ ID NO: 4159860 - DNA, 12 bp, Homo sapiens
ttccccttccct

SEQ ID NO: 4159861 - DNA, 19 bp, Homo sapiens
ttccccttctgtgtcacag

SEQ ID NO: 4159862 - DNA, 14 bp, Homo sapiens
ttcccctttcccca

SEQ ID NO: 4159863 - DNA, 14 bp, Homo sapiens
ttcccgagcgctgg

SEQ ID NO: 4159864 - DNA, 21 bp, Homo sapiens
ttcccgccagagggcttgtga

SEQ ID NO: 4159865 - DNA, 15 bp, Homo sapiens
ttcccgctcagccct

SEQ ID NO: 4159866 - DNA, 18 bp, Homo sapiens
ttcccgggccagggctgc

SEQ ID NO: 4159867 - DNA, 17 bp, Homo sapiens
ttcccgtttctccacct

SEQ ID NO: 4159868 - DNA, 20 bp, Homo sapiens
ttccctccatttttctccca

SEQ ID NO: 4159869 - DNA, 23 bp, Homo sapiens
ttccctccatttttctcccaaga

SEQ ID NO: 4159870 - DNA, 13 bp, Homo sapiens
ttccctccccaga

SEQ ID NO: 4159871 - DNA, 15 bp, Homo sapiens
ttccctccccagaat

SEQ ID NO: 4159872 - DNA, 17 bp, Homo sapiens
ttccctcgtctttccca

SEQ ID NO: 4159873 - DNA, 20 bp, Homo sapiens
ttccctctctcagcacagcc

SEQ ID NO: 4159874 - DNA, 20 bp, Homo sapiens
ttccctctctgatgtcccag

SEQ ID NO: 4159875 - DNA, 23 bp, Homo sapiens
ttccctctgagaattccaaggag

SEQ ID NO: 4159876 - DNA, 15 bp, Homo sapiens
ttccctctgctcctg

SEQ ID NO: 4159877 - DNA, 19 bp, Homo sapiens
ttccctctgctcctggagc

SEQ ID NO: 4159878 - DNA, 20 bp, Homo sapiens
ttccctctgggcacgcctgc

SEQ ID NO: 4159879 - DNA, 24 bp, Homo sapiens
ttccctctgggcacgcctgctggc

SEQ ID NO: 4159880 - DNA, 18 bp, Homo sapiens
ttccctcttctaacccaa

SEQ ID NO: 4159881 - DNA, 14 bp, Homo sapiens
ttccctctttggct

SEQ ID NO: 4159882 - DNA, 16 bp, Homo sapiens
ttccctctttggctcc

SEQ ID NO: 4159883 - DNA, 20 bp, Homo sapiens
ttccctctttggctcccctg

SEQ ID NO: 4159884 - DNA, 13 bp, Homo sapiens
ttccctgaatctg

SEQ ID NO: 4159885 - DNA, 12 bp, Homo sapiens
ttccctgcacta

SEQ ID NO: 4159886 - DNA, 22 bp, Homo sapiens
ttccctgcactaaagccagcct

SEQ ID NO: 4159887 - DNA, 22 bp, Homo sapiens
ttccctgcgagacgcacacagc

SEQ ID NO: 4159888 - DNA, 13 bp, Homo sapiens
ttccctgcttcca

SEQ ID NO: 4159889 - DNA, 18 bp, Homo sapiens
ttccctgctttgcatctt

SEQ ID NO: 4159890 - DNA, 20 bp, Homo sapiens
ttccctggaactcctggcct

SEQ ID NO: 4159891 - DNA, 21 bp, Homo sapiens
ttccctggaactcctggcctt

SEQ ID NO: 4159892 - DNA, 17 bp, Homo sapiens
ttccctggtaagaaaaa

SEQ ID NO: 4159893 - DNA, 18 bp, Homo sapiens
ttccctgttcttcctcca

SEQ ID NO: 4159894 - DNA, 19 bp, Homo sapiens
ttccctgttcttcctccag

SEQ ID NO: 4159895 - DNA, 15 bp, Homo sapiens
ttcccttattcctaa

SEQ ID NO: 4159896 - DNA, 20 bp, Homo sapiens
ttcccttccagtttattcca

SEQ ID NO: 4159897 - DNA, 14 bp, Homo sapiens
ttcccttcctccat

SEQ ID NO: 4159898 - DNA, 17 bp, Homo sapiens
ttcccttcctccatcct

SEQ ID NO: 4159899 - DNA, 15 bp, Homo sapiens
ttcccttggcctcag

SEQ ID NO: 4159900 - DNA, 15 bp, Homo sapiens
ttccctttccccagc

SEQ ID NO: 4159901 - DNA, 23 bp, Homo sapiens
ttccctttgacttcagctgcctg

SEQ ID NO: 4159902 - DNA, 19 bp, Homo sapiens
ttcccttttaatcaactgt

SEQ ID NO: 4159903 - DNA, 15 bp, Homo sapiens
ttccgcactttccac

SEQ ID NO: 4159904 - DNA, 22 bp, Homo sapiens
ttccgcactttccacttcttcc

SEQ ID NO: 4159905 - DNA, 22 bp, Homo sapiens
ttccgctgtcgccccaggccct

SEQ ID NO: 4159906 - DNA, 21 bp, Homo sapiens
ttccgtcaccacgactggcca

SEQ ID NO: 4159907 - DNA, 17 bp, Homo sapiens
ttccgtgccgtgtattt

SEQ ID NO: 4159908 - DNA, 14 bp, Homo sapiens
ttccgttgtctgtg

SEQ ID NO: 4159909 - DNA, 16 bp, Homo sapiens
ttcctaaacccaatga

SEQ ID NO: 4159910 - DNA, 14 bp, Homo sapiens
ttcctaaactccct

SEQ ID NO: 4159911 - DNA, 14 bp, Homo sapiens
ttcctaaatgcagt

SEQ ID NO: 4159912 - DNA, 22 bp, Homo sapiens
ttcctaagccacttgaaatgtt

SEQ ID NO: 4159913 - DNA, 17 bp, Homo sapiens
ttcctaatcagaaattt

SEQ ID NO: 4159914 - DNA, 21 bp, Homo sapiens
ttcctaatggctatttttgaa

SEQ ID NO: 4159915 - DNA, 13 bp, Homo sapiens
ttcctacaactta

SEQ ID NO: 4159916 - DNA, 22 bp, Homo sapiens
ttcctacaagagcagcctgtgg

SEQ ID NO: 4159917 - DNA, 21 bp, Homo sapiens
ttcctacagcactactgggtg

SEQ ID NO: 4159918 - DNA, 16 bp, Homo sapiens
ttcctacccaaccact

SEQ ID NO: 4159919 - DNA, 20 bp, Homo sapiens
ttcctacccacacctctgcc

SEQ ID NO: 4159920 - DNA, 17 bp, Homo sapiens
ttcctactcacacttca

SEQ ID NO: 4159921 - DNA, 19 bp, Homo sapiens
ttcctactcttctctctgc

SEQ ID NO: 4159922 - DNA, 17 bp, Homo sapiens
ttcctagataaaaagat

SEQ ID NO: 4159923 - DNA, 20 bp, Homo sapiens
ttcctagtggatgactgttg

SEQ ID NO: 4159924 - DNA, 21 bp, Homo sapiens
ttcctagtggatgactgttga

SEQ ID NO: 4159925 - DNA, 18 bp, Homo sapiens
ttcctagttcatcccttc

SEQ ID NO: 4159926 - DNA, 21 bp, Homo sapiens
ttcctagttcatcccttctct

SEQ ID NO: 4159927 - DNA, 20 bp, Homo sapiens
ttcctataatataataaata

SEQ ID NO: 4159928 - DNA, 14 bp, Homo sapiens
ttcctatatcctgt

SEQ ID NO: 4159929 - DNA, 17 bp, Homo sapiens
ttcctattgtcattaaa

SEQ ID NO: 4159930 - DNA, 18 bp, Homo sapiens
ttcctatttgccatgggc

SEQ ID NO: 4159931 - DNA, 23 bp, Homo sapiens
ttcctatttgccatgggcttcac

SEQ ID NO: 4159932 - DNA, 19 bp, Homo sapiens
ttcctcaaaataaagaagt

SEQ ID NO: 4159933 - DNA, 20 bp, Homo sapiens
ttcctcaaaataaagaagta

SEQ ID NO: 4159934 - DNA, 21 bp, Homo sapiens
ttcctcaaaataaagaagtat

SEQ ID NO: 4159935 - DNA, 23 bp, Homo sapiens
ttcctcaagtatcttctattttt

SEQ ID NO: 4159936 - DNA, 22 bp, Homo sapiens
ttcctcacacccctgtcccacc

SEQ ID NO: 4159937 - DNA, 15 bp, Homo sapiens
ttcctcactatgaca

SEQ ID NO: 4159938 - DNA, 13 bp, Homo sapiens
ttcctcacttcca

SEQ ID NO: 4159939 - DNA, 22 bp, Homo sapiens
ttcctcagattagatgtgccaa

SEQ ID NO: 4159940 - DNA, 16 bp, Homo sapiens
ttcctcattcctgaaa

SEQ ID NO: 4159941 - DNA, 13 bp, Homo sapiens
ttcctccacccat

SEQ ID NO: 4159942 - DNA, 16 bp, Homo sapiens
ttcctccagctgcacc

SEQ ID NO: 4159943 - DNA, 14 bp, Homo sapiens
ttcctccatcctcc

SEQ ID NO: 4159944 - DNA, 18 bp, Homo sapiens
ttcctccatcctcctcct

SEQ ID NO: 4159945 - DNA, 22 bp, Homo sapiens
ttcctccatcctcctccttcct

SEQ ID NO: 4159946 - DNA, 24 bp, Homo sapiens
ttcctccatcctcctccttcctag

SEQ ID NO: 4159947 - DNA, 16 bp, Homo sapiens
ttcctcctccccactt

SEQ ID NO: 4159948 - DNA, 12 bp, Homo sapiens
ttcctcctctgc

SEQ ID NO: 4159949 - DNA, 14 bp, Homo sapiens
ttcctcctttatca

SEQ ID NO: 4159950 - DNA, 12 bp, Homo sapiens
ttcctctccact

SEQ ID NO: 4159951 - DNA, 14 bp, Homo sapiens
ttcctctccactgc

SEQ ID NO: 4159952 - DNA, 16 bp, Homo sapiens
ttcctctccactgcct

SEQ ID NO: 4159953 - DNA, 18 bp, Homo sapiens
ttcctctccactgccttc

SEQ ID NO: 4159954 - DNA, 16 bp, Homo sapiens
ttcctctgagcccagc

SEQ ID NO: 4159955 - DNA, 18 bp, Homo sapiens
ttcctctgagcccagctg

SEQ ID NO: 4159956 - DNA, 24 bp, Homo sapiens
ttcctctgagcccagctgcctgga

SEQ ID NO: 4159957 - DNA, 14 bp, Homo sapiens
ttcctctgcctgcc

SEQ ID NO: 4159958 - DNA, 16 bp, Homo sapiens
ttcctctgcctgcccc

SEQ ID NO: 4159959 - DNA, 14 bp, Homo sapiens
ttcctctgctcccc

SEQ ID NO: 4159960 - DNA, 21 bp, Homo sapiens
ttcctctgctcccccttttcc

SEQ ID NO: 4159961 - DNA, 13 bp, Homo sapiens
ttcctcttttgct

SEQ ID NO: 4159962 - DNA, 15 bp, Homo sapiens
ttcctgaaatgcagt

SEQ ID NO: 4159963 - DNA, 18 bp, Homo sapiens
ttcctgacttgagtgttc

SEQ ID NO: 4159964 - DNA, 18 bp, Homo sapiens
ttcctgagatttcctcct

SEQ ID NO: 4159965 - DNA, 20 bp, Homo sapiens
ttcctgcaactcaaggactt

SEQ ID NO: 4159966 - DNA, 20 bp, Homo sapiens
ttcctgcagccccagaagaa

SEQ ID NO: 4159967 - DNA, 18 bp, Homo sapiens
ttcctgcccagcctgggg

SEQ ID NO: 4159968 - DNA, 13 bp, Homo sapiens
ttcctgccctgtc

SEQ ID NO: 4159969 - DNA, 16 bp, Homo sapiens
ttcctgccctgtccaa

SEQ ID NO: 4159970 - DNA, 16 bp, Homo sapiens
ttcctgcccttccctc

SEQ ID NO: 4159971 - DNA, 18 bp, Homo sapiens
ttcctgccgcaacagttt

SEQ ID NO: 4159972 - DNA, 14 bp, Homo sapiens
ttcctgctgcaccc

SEQ ID NO: 4159973 - DNA, 21 bp, Homo sapiens
ttcctggaaaagaagaaactt

SEQ ID NO: 4159974 - DNA, 19 bp, Homo sapiens
ttcctggacactcagacct

SEQ ID NO: 4159975 - DNA, 12 bp, Homo sapiens
ttcctggacatc

SEQ ID NO: 4159976 - DNA, 14 bp, Homo sapiens
ttcctggcctgaga

SEQ ID NO: 4159977 - DNA, 21 bp, Homo sapiens
ttcctggctgatgatccagaa

SEQ ID NO: 4159978 - DNA, 17 bp, Homo sapiens
ttcctggtttgactcag

SEQ ID NO: 4159979 - DNA, 17 bp, Homo sapiens
ttcctgtccagctccaa

SEQ ID NO: 4159980 - DNA, 14 bp, Homo sapiens
ttcctgtccctgag

SEQ ID NO: 4159981 - DNA, 16 bp, Homo sapiens
ttcctgtgccaggtga

SEQ ID NO: 4159982 - DNA, 11 bp, Homo sapiens
ttcctgtgtcc

SEQ ID NO: 4159983 - DNA, 14 bp, Homo sapiens
ttcctgtgtcctga

SEQ ID NO: 4159984 - DNA, 23 bp, Homo sapiens
ttcctgttaggtattagaaagtg

SEQ ID NO: 4159985 - DNA, 13 bp, Homo sapiens
ttccttaaactgt

SEQ ID NO: 4159986 - DNA, 16 bp, Homo sapiens
ttccttaaactgtgtg

SEQ ID NO: 4159987 - DNA, 17 bp, Homo sapiens
ttccttaaactgtgtgg

SEQ ID NO: 4159988 - DNA, 18 bp, Homo sapiens
ttccttacagaactactt

SEQ ID NO: 4159989 - DNA, 12 bp, Homo sapiens
ttccttagtcat

SEQ ID NO: 4159990 - DNA, 17 bp, Homo sapiens
ttccttatccctctctt

SEQ ID NO: 4159991 - DNA, 23 bp, Homo sapiens
ttccttatccctctcttcccctt

SEQ ID NO: 4159992 - DNA, 12 bp, Homo sapiens
ttccttcagatt

SEQ ID NO: 4159993 - DNA, 14 bp, Homo sapiens
ttccttcatttcca

SEQ ID NO: 4159994 - DNA, 21 bp, Homo sapiens
ttccttcatttccaccaggcc

SEQ ID NO: 4159995 - DNA, 14 bp, Homo sapiens
ttccttccagccca

SEQ ID NO: 4159996 - DNA, 20 bp, Homo sapiens
ttccttccatccctaccccc

SEQ ID NO: 4159997 - DNA, 15 bp, Homo sapiens
ttccttccctctctg

SEQ ID NO: 4159998 - DNA, 12 bp, Homo sapiens
ttccttcctaaa

SEQ ID NO: 4159999 - DNA, 14 bp, Homo sapiens
ttccttctctgggt

SEQ ID NO: 4160000 - DNA, 20 bp, Homo sapiens
ttccttctgtgaaagtacat

SEQ ID NO: 4160001 - DNA, 13 bp, Homo sapiens
ttccttctttgat

SEQ ID NO: 4160002 - DNA, 20 bp, Homo sapiens
ttccttctttgccctttact

SEQ ID NO: 4160003 - DNA, 24 bp, Homo sapiens
ttccttgagacacggagcccagcc

SEQ ID NO: 4160004 - DNA, 20 bp, Homo sapiens
ttccttgaggggagccagga

SEQ ID NO: 4160005 - DNA, 22 bp, Homo sapiens
ttccttgaggggagccaggagg

SEQ ID NO: 4160006 - DNA, 15 bp, Homo sapiens
ttccttgcgcctcag

SEQ ID NO: 4160007 - DNA, 18 bp, Homo sapiens
ttccttgcgcctcagccc

SEQ ID NO: 4160008 - DNA, 14 bp, Homo sapiens
ttccttggaggcca

SEQ ID NO: 4160009 - DNA, 22 bp, Homo sapiens
ttccttgttggtcagaggagtg

SEQ ID NO: 4160010 - DNA, 13 bp, Homo sapiens
ttcctttaaaaaa

SEQ ID NO: 4160011 - DNA, 15 bp, Homo sapiens
ttcctttatactgtg

SEQ ID NO: 4160012 - DNA, 16 bp, Homo sapiens
ttcctttatactgtga

SEQ ID NO: 4160013 - DNA, 14 bp, Homo sapiens
ttcctttatgtgaa

SEQ ID NO: 4160014 - DNA, 19 bp, Homo sapiens
ttcctttatgtgaattttt

SEQ ID NO: 4160015 - DNA, 14 bp, Homo sapiens
ttcctttccttttc

SEQ ID NO: 4160016 - DNA, 13 bp, Homo sapiens
ttcctttctcttt

SEQ ID NO: 4160017 - DNA, 18 bp, Homo sapiens
ttcctttcttttccccct

SEQ ID NO: 4160018 - DNA, 13 bp, Homo sapiens
ttcctttgtgtgt

SEQ ID NO: 4160019 - DNA, 17 bp, Homo sapiens
ttcctttttaaatgtga

SEQ ID NO: 4160020 - DNA, 15 bp, Homo sapiens
ttcctttttcttcgc

SEQ ID NO: 4160021 - DNA, 11 bp, Homo sapiens
ttcgaggcctg

SEQ ID NO: 4160022 - DNA, 12 bp, Homo sapiens
ttcgaggcctga

SEQ ID NO: 4160023 - DNA, 13 bp, Homo sapiens
ttcgaggcctgaa

SEQ ID NO: 4160024 - DNA, 18 bp, Homo sapiens
ttcgatctcattcagtat

SEQ ID NO: 4160025 - DNA, 14 bp, Homo sapiens
ttcgcatggtcaca

SEQ ID NO: 4160026 - DNA, 16 bp, Homo sapiens
ttcgcatggtcacaca

SEQ ID NO: 4160027 - DNA, 17 bp, Homo sapiens
ttcgcatggtcacacac

SEQ ID NO: 4160028 - DNA, 21 bp, Homo sapiens
ttcgcatggtcacacactgat

SEQ ID NO: 4160029 - DNA, 23 bp, Homo sapiens
ttcgcatggtcacacactgatgc

SEQ ID NO: 4160030 - DNA, 16 bp, Homo sapiens
ttcgctggactattgt

SEQ ID NO: 4160031 - DNA, 20 bp, Homo sapiens
ttcgctggactattgtgcca

SEQ ID NO: 4160032 - DNA, 23 bp, Homo sapiens
ttcgctggactattgtgccaact

SEQ ID NO: 4160033 - DNA, 20 bp, Homo sapiens
ttcggaaggggttcctcaaa

SEQ ID NO: 4160034 - DNA, 15 bp, Homo sapiens
ttcgggccacagggc

SEQ ID NO: 4160035 - DNA, 16 bp, Homo sapiens
ttcgggtgctggaagt

SEQ ID NO: 4160036 - DNA, 17 bp, Homo sapiens
ttcgggtgtgcaatgtc

SEQ ID NO: 4160037 - DNA, 13 bp, Homo sapiens
ttcgtgagctggg

SEQ ID NO: 4160038 - DNA, 16 bp, Homo sapiens
ttcgtgcactctgcta

SEQ ID NO: 4160039 - DNA, 17 bp, Homo sapiens
ttcgtggtgatcaatta

SEQ ID NO: 4160040 - DNA, 22 bp, Homo sapiens
ttcgtggtgatcaattaaatgt

SEQ ID NO: 4160041 - DNA, 12 bp, Homo sapiens
ttcgttctgtgg

SEQ ID NO: 4160042 - DNA, 13 bp, Homo sapiens
ttctaaaaaacag

SEQ ID NO: 4160043 - DNA, 23 bp, Homo sapiens
ttctaaacccaatccaaatggcg

SEQ ID NO: 4160044 - DNA, 19 bp, Homo sapiens
ttctaaactaggctccttc

SEQ ID NO: 4160045 - DNA, 15 bp, Homo sapiens
ttctaaatgaatgtt

SEQ ID NO: 4160046 - DNA, 19 bp, Homo sapiens
ttctaacaaaaaaatatat

SEQ ID NO: 4160047 - DNA, 14 bp, Homo sapiens
ttctaacaagtcat

SEQ ID NO: 4160048 - DNA, 22 bp, Homo sapiens
ttctaaccttgaatgctgccag

SEQ ID NO: 4160049 - DNA, 23 bp, Homo sapiens
ttctaaccttgaatgctgccagt

SEQ ID NO: 4160050 - DNA, 12 bp, Homo sapiens
ttctaagagaag

SEQ ID NO: 4160051 - DNA, 19 bp, Homo sapiens
ttctaagttatttactttt

SEQ ID NO: 4160052 - DNA, 19 bp, Homo sapiens
ttctaatccttttccttat

SEQ ID NO: 4160053 - DNA, 16 bp, Homo sapiens
ttctaatggaatggtt

SEQ ID NO: 4160054 - DNA, 16 bp, Homo sapiens
ttctacaaccagagcc

SEQ ID NO: 4160055 - DNA, 20 bp, Homo sapiens
ttctacaactgattgcaaca

SEQ ID NO: 4160056 - DNA, 15 bp, Homo sapiens
ttctacaatgtgaac

SEQ ID NO: 4160057 - DNA, 17 bp, Homo sapiens
ttctacaattaatagtt

SEQ ID NO: 4160058 - DNA, 13 bp, Homo sapiens
ttctacagaataa

SEQ ID NO: 4160059 - DNA, 14 bp, Homo sapiens
ttctacagaataat

SEQ ID NO: 4160060 - DNA, 15 bp, Homo sapiens
ttctacagtggtttt

SEQ ID NO: 4160061 - DNA, 21 bp, Homo sapiens
ttctacagtggttttatactg

SEQ ID NO: 4160062 - DNA, 21 bp, Homo sapiens
ttctaccacacagcagcagtt

SEQ ID NO: 4160063 - DNA, 17 bp, Homo sapiens
ttctaccaggcaaattc

SEQ ID NO: 4160064 - DNA, 19 bp, Homo sapiens
ttctaccaggcaaattcac

SEQ ID NO: 4160065 - DNA, 13 bp, Homo sapiens
ttctacctgccct

SEQ ID NO: 4160066 - DNA, 19 bp, Homo sapiens
ttctaccttgaggtctttt

SEQ ID NO: 4160067 - DNA, 16 bp, Homo sapiens
ttctactcctgcctca

SEQ ID NO: 4160068 - DNA, 18 bp, Homo sapiens
ttctagaagtttcccttc

SEQ ID NO: 4160069 - DNA, 22 bp, Homo sapiens
ttctagaattataagtcacaaa

SEQ ID NO: 4160070 - DNA, 15 bp, Homo sapiens
ttctagaatttatca

SEQ ID NO: 4160071 - DNA, 14 bp, Homo sapiens
ttctagagaagagg

SEQ ID NO: 4160072 - DNA, 22 bp, Homo sapiens
ttctagagaagaggctggtgct

SEQ ID NO: 4160073 - DNA, 16 bp, Homo sapiens
ttctagctagaaatat

SEQ ID NO: 4160074 - DNA, 18 bp, Homo sapiens
ttctagctagaaatatga

SEQ ID NO: 4160075 - DNA, 19 bp, Homo sapiens
ttctagctagaaatatgat

SEQ ID NO: 4160076 - DNA, 14 bp, Homo sapiens
ttctagctgtatga

SEQ ID NO: 4160077 - DNA, 12 bp, Homo sapiens
ttctagctgttg

SEQ ID NO: 4160078 - DNA, 16 bp, Homo sapiens
ttctaggacctgtgtc

SEQ ID NO: 4160079 - DNA, 17 bp, Homo sapiens
ttctagtggtctttgta

SEQ ID NO: 4160080 - DNA, 20 bp, Homo sapiens
ttctagtggtctttgtaaga

SEQ ID NO: 4160081 - DNA, 21 bp, Homo sapiens
ttctagtggtctttgtaagag

SEQ ID NO: 4160082 - DNA, 22 bp, Homo sapiens
ttctagtggtctttgtaagagt

SEQ ID NO: 4160083 - DNA, 14 bp, Homo sapiens
ttctataaggccat

SEQ ID NO: 4160084 - DNA, 23 bp, Homo sapiens
ttctataaggccataaaacaggt

SEQ ID NO: 4160085 - DNA, 23 bp, Homo sapiens
ttctatagcagattgtgtaacaa

SEQ ID NO: 4160086 - DNA, 23 bp, Homo sapiens
ttctatatgaatttaaatataat

SEQ ID NO: 4160087 - DNA, 21 bp, Homo sapiens
ttctatcaggggtgcattctg

SEQ ID NO: 4160088 - DNA, 20 bp, Homo sapiens
ttctatccccaatcagctcc

SEQ ID NO: 4160089 - DNA, 15 bp, Homo sapiens
ttctatcgttattat

SEQ ID NO: 4160090 - DNA, 16 bp, Homo sapiens
ttctatgcaaagttct

SEQ ID NO: 4160091 - DNA, 22 bp, Homo sapiens
ttctatgtgacaattttgtaca

SEQ ID NO: 4160092 - DNA, 19 bp, Homo sapiens
ttctatgttaaatactgtg

SEQ ID NO: 4160093 - DNA, 15 bp, Homo sapiens
ttctattatggaaaa

SEQ ID NO: 4160094 - DNA, 14 bp, Homo sapiens
ttctattgaattcg

SEQ ID NO: 4160095 - DNA, 23 bp, Homo sapiens
ttctattgccttctttgaagaag

SEQ ID NO: 4160096 - DNA, 18 bp, Homo sapiens
ttctattgtattatttgg

SEQ ID NO: 4160097 - DNA, 22 bp, Homo sapiens
ttctattgttactctggttctt

SEQ ID NO: 4160098 - DNA, 15 bp, Homo sapiens
ttctattttcttaaa

SEQ ID NO: 4160099 - DNA, 20 bp, Homo sapiens
ttctatttttatcatgaatt

SEQ ID NO: 4160100 - DNA, 18 bp, Homo sapiens
ttctcaaaagcatttatc

SEQ ID NO: 4160101 - DNA, 20 bp, Homo sapiens
ttctcaaaagcatttatcat

SEQ ID NO: 4160102 - DNA, 22 bp, Homo sapiens
ttctcaaagttaattcacctat

SEQ ID NO: 4160103 - DNA, 13 bp, Homo sapiens
ttctcaagacttt

SEQ ID NO: 4160104 - DNA, 17 bp, Homo sapiens
ttctcaagactttagct

SEQ ID NO: 4160105 - DNA, 21 bp, Homo sapiens
ttctcacacacaactgtccat

SEQ ID NO: 4160106 - DNA, 21 bp, Homo sapiens
ttctcacactggtctgctgtc

SEQ ID NO: 4160107 - DNA, 13 bp, Homo sapiens
ttctcaccaggaa

SEQ ID NO: 4160108 - DNA, 16 bp, Homo sapiens
ttctcactcctacctg

SEQ ID NO: 4160109 - DNA, 17 bp, Homo sapiens
ttctcagagcatgtgtc

SEQ ID NO: 4160110 - DNA, 22 bp, Homo sapiens
ttctcagccacaaaccctgcct

SEQ ID NO: 4160111 - DNA, 16 bp, Homo sapiens
ttctcaggtgttgcca

SEQ ID NO: 4160112 - DNA, 17 bp, Homo sapiens
ttctcaggtgttgccaa

SEQ ID NO: 4160113 - DNA, 22 bp, Homo sapiens
ttctcagtcagtaattgccaaa

SEQ ID NO: 4160114 - DNA, 12 bp, Homo sapiens
ttctcagtgtgt

SEQ ID NO: 4160115 - DNA, 16 bp, Homo sapiens
ttctcataattcctac

SEQ ID NO: 4160116 - DNA, 22 bp, Homo sapiens
ttctcatagataagatataaat

SEQ ID NO: 4160117 - DNA, 13 bp, Homo sapiens
ttctcatagcatt

SEQ ID NO: 4160118 - DNA, 14 bp, Homo sapiens
ttctcatagcatta

SEQ ID NO: 4160119 - DNA, 17 bp, Homo sapiens
ttctcatagcattaact

SEQ ID NO: 4160120 - DNA, 22 bp, Homo sapiens
ttctcatagcattaactaatct

SEQ ID NO: 4160121 - DNA, 20 bp, Homo sapiens
ttctcataggaaaagtacat

SEQ ID NO: 4160122 - DNA, 17 bp, Homo sapiens
ttctcatgaagctaata

SEQ ID NO: 4160123 - DNA, 13 bp, Homo sapiens
ttctcattttctt

SEQ ID NO: 4160124 - DNA, 14 bp, Homo sapiens
ttctccaaatgaga

SEQ ID NO: 4160125 - DNA, 21 bp, Homo sapiens
ttctccacctagactgtaaac

SEQ ID NO: 4160126 - DNA, 13 bp, Homo sapiens
ttctccagccagc

SEQ ID NO: 4160127 - DNA, 12 bp, Homo sapiens
ttctccagctgg

SEQ ID NO: 4160128 - DNA, 13 bp, Homo sapiens
ttctccaggcttc

SEQ ID NO: 4160129 - DNA, 20 bp, Homo sapiens
ttctccaggtctcacgggca

SEQ ID NO: 4160130 - DNA, 22 bp, Homo sapiens
ttctcccacatgaggccatctc

SEQ ID NO: 4160131 - DNA, 23 bp, Homo sapiens
ttctccgactgctagggagtggt

SEQ ID NO: 4160132 - DNA, 13 bp, Homo sapiens
ttctccgccagcc

SEQ ID NO: 4160133 - DNA, 15 bp, Homo sapiens
ttctccgccagcctc

SEQ ID NO: 4160134 - DNA, 16 bp, Homo sapiens
ttctccgccagcctcc

SEQ ID NO: 4160135 - DNA, 17 bp, Homo sapiens
ttctccgccagcctcct

SEQ ID NO: 4160136 - DNA, 20 bp, Homo sapiens
ttctccgccagcctcctctg

SEQ ID NO: 4160137 - DNA, 17 bp, Homo sapiens
ttctccgggtgtggcct

SEQ ID NO: 4160138 - DNA, 14 bp, Homo sapiens
ttctcctctctggg

SEQ ID NO: 4160139 - DNA, 12 bp, Homo sapiens
ttctcctgtgct

SEQ ID NO: 4160140 - DNA, 20 bp, Homo sapiens
ttctcctgtttattcccatc

SEQ ID NO: 4160141 - DNA, 17 bp, Homo sapiens
ttctccttccccaggat

SEQ ID NO: 4160142 - DNA, 14 bp, Homo sapiens
ttctccttctcctt

SEQ ID NO: 4160143 - DNA, 18 bp, Homo sapiens
ttctcctttcacaacctt

SEQ ID NO: 4160144 - DNA, 13 bp, Homo sapiens
ttctccttttcct

SEQ ID NO: 4160145 - DNA, 23 bp, Homo sapiens
ttctcgcaaaaacgtatctccta

SEQ ID NO: 4160146 - DNA, 15 bp, Homo sapiens
ttctctaatgcttga

SEQ ID NO: 4160147 - DNA, 15 bp, Homo sapiens
ttctctattaaaatg

SEQ ID NO: 4160148 - DNA, 12 bp, Homo sapiens
ttctctccctcc

SEQ ID NO: 4160149 - DNA, 18 bp, Homo sapiens
ttctctccctgccagagg

SEQ ID NO: 4160150 - DNA, 19 bp, Homo sapiens
ttctctcccttcctctctc

SEQ ID NO: 4160151 - DNA, 15 bp, Homo sapiens
ttctctcctccccaa

SEQ ID NO: 4160152 - DNA, 18 bp, Homo sapiens
ttctctctccagggtgct

SEQ ID NO: 4160153 - DNA, 12 bp, Homo sapiens
ttctctctgctc

SEQ ID NO: 4160154 - DNA, 10 bp, Homo sapiens
ttctctcttt

SEQ ID NO: 4160155 - DNA, 20 bp, Homo sapiens
ttctctctttatacagctgt

SEQ ID NO: 4160156 - DNA, 21 bp, Homo sapiens
ttctctctttatacagctgta

SEQ ID NO: 4160157 - DNA, 11 bp, Homo sapiens
ttctctctttt

SEQ ID NO: 4160158 - DNA, 18 bp, Homo sapiens
ttctctgaacacaggcag

SEQ ID NO: 4160159 - DNA, 11 bp, Homo sapiens
ttctctgcaga

SEQ ID NO: 4160160 - DNA, 23 bp, Homo sapiens
ttctctgccgctacctccctccc

SEQ ID NO: 4160161 - DNA, 19 bp, Homo sapiens
ttctctgcctttgacattt

SEQ ID NO: 4160162 - DNA, 24 bp, Homo sapiens
ttctctggacactgccactctccc

SEQ ID NO: 4160163 - DNA, 23 bp, Homo sapiens
ttctctgggtctgattttctcac

SEQ ID NO: 4160164 - DNA, 22 bp, Homo sapiens
ttctctgttgtcgtaaagattt

SEQ ID NO: 4160165 - DNA, 22 bp, Homo sapiens
ttctctgttgtttggttcaggg

SEQ ID NO: 4160166 - DNA, 15 bp, Homo sapiens
ttctcttaatttaat

SEQ ID NO: 4160167 - DNA, 18 bp, Homo sapiens
ttctcttccagtttctgt

SEQ ID NO: 4160168 - DNA, 17 bp, Homo sapiens
ttctcttccccttagaa

SEQ ID NO: 4160169 - DNA, 14 bp, Homo sapiens
ttctcttgctttct

SEQ ID NO: 4160170 - DNA, 13 bp, Homo sapiens
ttctctttcaaag

SEQ ID NO: 4160171 - DNA, 22 bp, Homo sapiens
ttctcttttcccctttcctgtc

SEQ ID NO: 4160172 - DNA, 17 bp, Homo sapiens
ttctcttttctttctgt

SEQ ID NO: 4160173 - DNA, 16 bp, Homo sapiens
ttctgaaagaattatt

SEQ ID NO: 4160174 - DNA, 12 bp, Homo sapiens
ttctgaaatgtt

SEQ ID NO: 4160175 - DNA, 15 bp, Homo sapiens
ttctgaaatgttctt

SEQ ID NO: 4160176 - DNA, 19 bp, Homo sapiens
ttctgaactcaagctgcgt

SEQ ID NO: 4160177 - DNA, 17 bp, Homo sapiens
ttctgaataacatttgt

SEQ ID NO: 4160178 - DNA, 18 bp, Homo sapiens
ttctgaatgctgctactt

SEQ ID NO: 4160179 - DNA, 21 bp, Homo sapiens
ttctgacagtttttctgtttt

SEQ ID NO: 4160180 - DNA, 13 bp, Homo sapiens
ttctgacatgcat

SEQ ID NO: 4160181 - DNA, 16 bp, Homo sapiens
ttctgacatgcattgt

SEQ ID NO: 4160182 - DNA, 21 bp, Homo sapiens
ttctgacatgcattgttggct

SEQ ID NO: 4160183 - DNA, 20 bp, Homo sapiens
ttctgacattaacagttttc

SEQ ID NO: 4160184 - DNA, 22 bp, Homo sapiens
ttctgacattaacagttttcca

SEQ ID NO: 4160185 - DNA, 20 bp, Homo sapiens
ttctgagacatgtgtcaaca

SEQ ID NO: 4160186 - DNA, 16 bp, Homo sapiens
ttctgagtttcattct

SEQ ID NO: 4160187 - DNA, 19 bp, Homo sapiens
ttctgagtttcattctcct

SEQ ID NO: 4160188 - DNA, 18 bp, Homo sapiens
ttctgataaccatagcat

SEQ ID NO: 4160189 - DNA, 23 bp, Homo sapiens
ttctgatcagaggtgtacactaa

SEQ ID NO: 4160190 - DNA, 21 bp, Homo sapiens
ttctgatgtctctaaagcact

SEQ ID NO: 4160191 - DNA, 17 bp, Homo sapiens
ttctgattagaaatgac

SEQ ID NO: 4160192 - DNA, 13 bp, Homo sapiens
ttctgattagctt

SEQ ID NO: 4160193 - DNA, 20 bp, Homo sapiens
ttctgattagctttgtgttt

SEQ ID NO: 4160194 - DNA, 11 bp, Homo sapiens
ttctgattctt

SEQ ID NO: 4160195 - DNA, 17 bp, Homo sapiens
ttctgattggtgattca

SEQ ID NO: 4160196 - DNA, 21 bp, Homo sapiens
ttctgcaagcacatctgcatt

SEQ ID NO: 4160197 - DNA, 22 bp, Homo sapiens
ttctgcagcatgacctgtgacc

SEQ ID NO: 4160198 - DNA, 19 bp, Homo sapiens
ttctgcagcccttgggcag

SEQ ID NO: 4160199 - DNA, 18 bp, Homo sapiens
ttctgcagtaaatctttt

SEQ ID NO: 4160200 - DNA, 22 bp, Homo sapiens
ttctgcagtaaatcttttacaa

SEQ ID NO: 4160201 - DNA, 19 bp, Homo sapiens
ttctgcatagcgaaataaa

SEQ ID NO: 4160202 - DNA, 23 bp, Homo sapiens
ttctgcatatgttgaatactttt

SEQ ID NO: 4160203 - DNA, 20 bp, Homo sapiens
ttctgcatcatctgtagata

SEQ ID NO: 4160204 - DNA, 19 bp, Homo sapiens
ttctgcattcatttttata

SEQ ID NO: 4160205 - DNA, 15 bp, Homo sapiens
ttctgccagggagct

SEQ ID NO: 4160206 - DNA, 19 bp, Homo sapiens
ttctgccatctagccagcc

SEQ ID NO: 4160207 - DNA, 16 bp, Homo sapiens
ttctgccctggctgct

SEQ ID NO: 4160208 - DNA, 23 bp, Homo sapiens
ttctgcctgaggggcagcctgcc

SEQ ID NO: 4160209 - DNA, 17 bp, Homo sapiens
ttctgcctgccagctgc

SEQ ID NO: 4160210 - DNA, 15 bp, Homo sapiens
ttctgcctttgatgt

SEQ ID NO: 4160211 - DNA, 12 bp, Homo sapiens
ttctgccttttc

SEQ ID NO: 4160212 - DNA, 15 bp, Homo sapiens
ttctgctcagctctg

SEQ ID NO: 4160213 - DNA, 20 bp, Homo sapiens
ttctgctcagctctgggcca

SEQ ID NO: 4160214 - DNA, 13 bp, Homo sapiens
ttctgctccaccc

SEQ ID NO: 4160215 - DNA, 15 bp, Homo sapiens
ttctgctccaccctt

SEQ ID NO: 4160216 - DNA, 16 bp, Homo sapiens
ttctgctccacccttg

SEQ ID NO: 4160217 - DNA, 14 bp, Homo sapiens
ttctgctcctgctt

SEQ ID NO: 4160218 - DNA, 18 bp, Homo sapiens
ttctgctcctgcttttct

SEQ ID NO: 4160219 - DNA, 23 bp, Homo sapiens
ttctgctctggaataaagttgca

SEQ ID NO: 4160220 - DNA, 23 bp, Homo sapiens
ttctgctctggttgtttctgttc

SEQ ID NO: 4160221 - DNA, 15 bp, Homo sapiens
ttctgctcttttcct

SEQ ID NO: 4160222 - DNA, 21 bp, Homo sapiens
ttctgctggataaaatgaggt

SEQ ID NO: 4160223 - DNA, 12 bp, Homo sapiens
ttctgctggcct

SEQ ID NO: 4160224 - DNA, 19 bp, Homo sapiens
ttctgctggcctggatctc

SEQ ID NO: 4160225 - DNA, 20 bp, Homo sapiens
ttctgctgggagttctagaa

SEQ ID NO: 4160226 - DNA, 17 bp, Homo sapiens
ttctgctttatcttttc

SEQ ID NO: 4160227 - DNA, 18 bp, Homo sapiens
ttctggaaaagaggagtt

SEQ ID NO: 4160228 - DNA, 16 bp, Homo sapiens
ttctggaatgtaatca

SEQ ID NO: 4160229 - DNA, 20 bp, Homo sapiens
ttctggaatgtaatcaatgt

SEQ ID NO: 4160230 - DNA, 14 bp, Homo sapiens
ttctggaatttgtt

SEQ ID NO: 4160231 - DNA, 17 bp, Homo sapiens
ttctggaatttgttcaa

SEQ ID NO: 4160232 - DNA, 18 bp, Homo sapiens
ttctggacctgggcatga

SEQ ID NO: 4160233 - DNA, 10 bp, Homo sapiens
ttctggagtt

SEQ ID NO: 4160234 - DNA, 21 bp, Homo sapiens
ttctggcaaaaaggagccttt

SEQ ID NO: 4160235 - DNA, 12 bp, Homo sapiens
ttctggcctcag

SEQ ID NO: 4160236 - DNA, 14 bp, Homo sapiens
ttctggcctctgct

SEQ ID NO: 4160237 - DNA, 11 bp, Homo sapiens
ttctggctgcc

SEQ ID NO: 4160238 - DNA, 22 bp, Homo sapiens
ttctgggagcagaaacagccat

SEQ ID NO: 4160239 - DNA, 23 bp, Homo sapiens
ttctggggagctggacagtggag

SEQ ID NO: 4160240 - DNA, 20 bp, Homo sapiens
ttctggggcaggctgggcca

SEQ ID NO: 4160241 - DNA, 15 bp, Homo sapiens
ttctggggtttttct

SEQ ID NO: 4160242 - DNA, 18 bp, Homo sapiens
ttctgggtggcctcggga

SEQ ID NO: 4160243 - DNA, 16 bp, Homo sapiens
ttctggtcctttttgg

SEQ ID NO: 4160244 - DNA, 14 bp, Homo sapiens
ttctggtttggcat

SEQ ID NO: 4160245 - DNA, 20 bp, Homo sapiens
ttctgtagtactccttaaga

SEQ ID NO: 4160246 - DNA, 21 bp, Homo sapiens
ttctgtagtactccttaagaa

SEQ ID NO: 4160247 - DNA, 14 bp, Homo sapiens
ttctgtagtcattt

SEQ ID NO: 4160248 - DNA, 15 bp, Homo sapiens
ttctgtagtcattta

SEQ ID NO: 4160249 - DNA, 15 bp, Homo sapiens
ttctgtatatacttt

SEQ ID NO: 4160250 - DNA, 14 bp, Homo sapiens
ttctgtatttcctt

SEQ ID NO: 4160251 - DNA, 22 bp, Homo sapiens
ttctgtatttttttttctaaga

SEQ ID NO: 4160252 - DNA, 18 bp, Homo sapiens
ttctgtcaccaaatttgt

SEQ ID NO: 4160253 - DNA, 14 bp, Homo sapiens
ttctgtccccagcc

SEQ ID NO: 4160254 - DNA, 14 bp, Homo sapiens
ttctgtccttcaga

SEQ ID NO: 4160255 - DNA, 15 bp, Homo sapiens
ttctgtgaaatataa

SEQ ID NO: 4160256 - DNA, 12 bp, Homo sapiens
ttctgtgtcttt

SEQ ID NO: 4160257 - DNA, 13 bp, Homo sapiens
ttctgttaaaatc

SEQ ID NO: 4160258 - DNA, 17 bp, Homo sapiens
ttctgttccaaattcag

SEQ ID NO: 4160259 - DNA, 13 bp, Homo sapiens
ttctgttctagtt

SEQ ID NO: 4160260 - DNA, 21 bp, Homo sapiens
ttctgttctagttttttactt

SEQ ID NO: 4160261 - DNA, 15 bp, Homo sapiens
ttctgttctggagga

SEQ ID NO: 4160262 - DNA, 12 bp, Homo sapiens
ttctgttctggg

SEQ ID NO: 4160263 - DNA, 13 bp, Homo sapiens
ttctgttctgggg

SEQ ID NO: 4160264 - DNA, 14 bp, Homo sapiens
ttctgttctggggg

SEQ ID NO: 4160265 - DNA, 17 bp, Homo sapiens
ttctgtttattcttcca

SEQ ID NO: 4160266 - DNA, 20 bp, Homo sapiens
ttctgtttattcttccagaa

SEQ ID NO: 4160267 - DNA, 17 bp, Homo sapiens
ttctgtttcttcttgtg

SEQ ID NO: 4160268 - DNA, 13 bp, Homo sapiens
ttctgtttgtaaa

SEQ ID NO: 4160269 - DNA, 15 bp, Homo sapiens
ttctgtttgtaaatt

SEQ ID NO: 4160270 - DNA, 16 bp, Homo sapiens
ttctgtttgtaaatta

SEQ ID NO: 4160271 - DNA, 18 bp, Homo sapiens
ttctgtttgtaaattatt

SEQ ID NO: 4160272 - DNA, 17 bp, Homo sapiens
ttctgttttcccccagc

SEQ ID NO: 4160273 - DNA, 14 bp, Homo sapiens
ttctgttttctgtt

SEQ ID NO: 4160274 - DNA, 14 bp, Homo sapiens
ttcttaaaaaggaa

SEQ ID NO: 4160275 - DNA, 15 bp, Homo sapiens
ttcttaaaagggaaa

SEQ ID NO: 4160276 - DNA, 15 bp, Homo sapiens
ttcttaaaatatatt

SEQ ID NO: 4160277 - DNA, 13 bp, Homo sapiens
ttcttaaagagtt

SEQ ID NO: 4160278 - DNA, 15 bp, Homo sapiens
ttcttaaatatcttt

SEQ ID NO: 4160279 - DNA, 14 bp, Homo sapiens
ttcttaaggttttg

SEQ ID NO: 4160280 - DNA, 20 bp, Homo sapiens
ttcttaaggttttgttgcta

SEQ ID NO: 4160281 - DNA, 16 bp, Homo sapiens
ttcttacatgcatttg

SEQ ID NO: 4160282 - DNA, 17 bp, Homo sapiens
ttcttacccaatttccc

SEQ ID NO: 4160283 - DNA, 16 bp, Homo sapiens
ttcttaccgacaagca

SEQ ID NO: 4160284 - DNA, 20 bp, Homo sapiens
ttcttactgataattttgct

SEQ ID NO: 4160285 - DNA, 19 bp, Homo sapiens
ttcttagctttttaattgt

SEQ ID NO: 4160286 - DNA, 13 bp, Homo sapiens
ttcttagttctca

SEQ ID NO: 4160287 - DNA, 18 bp, Homo sapiens
ttcttagttctcactgtt

SEQ ID NO: 4160288 - DNA, 19 bp, Homo sapiens
ttcttagttctcactgttc

SEQ ID NO: 4160289 - DNA, 18 bp, Homo sapiens
ttcttagttgacaaccta

SEQ ID NO: 4160290 - DNA, 21 bp, Homo sapiens
ttcttagttgacaacctagaa

SEQ ID NO: 4160291 - DNA, 14 bp, Homo sapiens
ttcttatacacatt

SEQ ID NO: 4160292 - DNA, 16 bp, Homo sapiens
ttcttatacgcttttc

SEQ ID NO: 4160293 - DNA, 20 bp, Homo sapiens
ttcttatagaataaaagctg

SEQ ID NO: 4160294 - DNA, 15 bp, Homo sapiens
ttcttatcttctgca

SEQ ID NO: 4160295 - DNA, 16 bp, Homo sapiens
ttcttatcttctgcaa

SEQ ID NO: 4160296 - DNA, 16 bp, Homo sapiens
ttcttatgcaaaatgg

SEQ ID NO: 4160297 - DNA, 18 bp, Homo sapiens
ttcttatgcaaaatggaa

SEQ ID NO: 4160298 - DNA, 17 bp, Homo sapiens
ttcttatggaattgatt

SEQ ID NO: 4160299 - DNA, 18 bp, Homo sapiens
ttcttatggaattgattt

SEQ ID NO: 4160300 - DNA, 13 bp, Homo sapiens
ttcttatgtgaca

SEQ ID NO: 4160301 - DNA, 21 bp, Homo sapiens
ttcttatgtgacattaacaaa

SEQ ID NO: 4160302 - DNA, 19 bp, Homo sapiens
ttcttattgcgctgctacc

SEQ ID NO: 4160303 - DNA, 15 bp, Homo sapiens
ttcttattgctttta

SEQ ID NO: 4160304 - DNA, 19 bp, Homo sapiens
ttcttatttaatgaaagac

SEQ ID NO: 4160305 - DNA, 14 bp, Homo sapiens
ttcttatttttgtc

SEQ ID NO: 4160306 - DNA, 19 bp, Homo sapiens
ttcttcaaatacaaagtaa

SEQ ID NO: 4160307 - DNA, 21 bp, Homo sapiens
ttcttcaacatgctccaaata

SEQ ID NO: 4160308 - DNA, 18 bp, Homo sapiens
ttcttcacatgtttaact

SEQ ID NO: 4160309 - DNA, 14 bp, Homo sapiens
ttcttcagaagaca

SEQ ID NO: 4160310 - DNA, 20 bp, Homo sapiens
ttcttcagcgtaaaatggtg

SEQ ID NO: 4160311 - DNA, 13 bp, Homo sapiens
ttcttcaggaaaa

SEQ ID NO: 4160312 - DNA, 20 bp, Homo sapiens
ttcttcaggaaaataaatat

SEQ ID NO: 4160313 - DNA, 15 bp, Homo sapiens
ttcttcatgcaatga

SEQ ID NO: 4160314 - DNA, 18 bp, Homo sapiens
ttcttcatgcaatgacat

SEQ ID NO: 4160315 - DNA, 20 bp, Homo sapiens
ttcttcattcaatacaagtg

SEQ ID NO: 4160316 - DNA, 22 bp, Homo sapiens
ttcttcattctatcaagcccag

SEQ ID NO: 4160317 - DNA, 17 bp, Homo sapiens
ttcttccaaaaagattt

SEQ ID NO: 4160318 - DNA, 14 bp, Homo sapiens
ttcttccaaagcag

SEQ ID NO: 4160319 - DNA, 11 bp, Homo sapiens
ttcttccagtt

SEQ ID NO: 4160320 - DNA, 22 bp, Homo sapiens
ttcttccagttactttccaatt

SEQ ID NO: 4160321 - DNA, 21 bp, Homo sapiens
ttcttccctgctttgcatctt

SEQ ID NO: 4160322 - DNA, 17 bp, Homo sapiens
ttcttcctaggtccaag

SEQ ID NO: 4160323 - DNA, 21 bp, Homo sapiens
ttcttctaattatttaaataa

SEQ ID NO: 4160324 - DNA, 20 bp, Homo sapiens
ttcttctacaaccagagccc

SEQ ID NO: 4160325 - DNA, 18 bp, Homo sapiens
ttcttctaggttctaaaa

SEQ ID NO: 4160326 - DNA, 15 bp, Homo sapiens
ttcttcttcagaaga

SEQ ID NO: 4160327 - DNA, 16 bp, Homo sapiens
ttcttcttttacttga

SEQ ID NO: 4160328 - DNA, 22 bp, Homo sapiens
ttcttgaaaggtccaaatgttt

SEQ ID NO: 4160329 - DNA, 23 bp, Homo sapiens
ttcttgaatggcaatgttttgct

SEQ ID NO: 4160330 - DNA, 13 bp, Homo sapiens
ttcttgatcttaa

SEQ ID NO: 4160331 - DNA, 18 bp, Homo sapiens
ttcttgcagtcatcagaa

SEQ ID NO: 4160332 - DNA, 19 bp, Homo sapiens
ttcttgcagtcatcagaag

SEQ ID NO: 4160333 - DNA, 22 bp, Homo sapiens
ttcttgcataggctcttaagca

SEQ ID NO: 4160334 - DNA, 14 bp, Homo sapiens
ttcttgctgcagcc

SEQ ID NO: 4160335 - DNA, 15 bp, Homo sapiens
ttcttgctttcaatt

SEQ ID NO: 4160336 - DNA, 22 bp, Homo sapiens
ttcttggcaaaagccttgtgta

SEQ ID NO: 4160337 - DNA, 18 bp, Homo sapiens
ttcttgggatagtgttct

SEQ ID NO: 4160338 - DNA, 22 bp, Homo sapiens
ttcttgggatagtgttctgctc

SEQ ID NO: 4160339 - DNA, 16 bp, Homo sapiens
ttcttggtagagattc

SEQ ID NO: 4160340 - DNA, 21 bp, Homo sapiens
ttcttggtgcttacacatctc

SEQ ID NO: 4160341 - DNA, 23 bp, Homo sapiens
ttcttgtagccatggctgggcgt

SEQ ID NO: 4160342 - DNA, 13 bp, Homo sapiens
ttcttgtagtagt

SEQ ID NO: 4160343 - DNA, 13 bp, Homo sapiens
ttcttgtatttat

SEQ ID NO: 4160344 - DNA, 14 bp, Homo sapiens
ttcttgtctttatt

SEQ ID NO: 4160345 - DNA, 22 bp, Homo sapiens
ttcttgtggtgtaaagctggcc

SEQ ID NO: 4160346 - DNA, 16 bp, Homo sapiens
ttcttgttttgcttcc

SEQ ID NO: 4160347 - DNA, 18 bp, Homo sapiens
ttctttaaaagaatgact

SEQ ID NO: 4160348 - DNA, 20 bp, Homo sapiens
ttctttccattatgattctt

SEQ ID NO: 4160349 - DNA, 11 bp, Homo sapiens
ttctttcctcc

SEQ ID NO: 4160350 - DNA, 13 bp, Homo sapiens
ttctttcctgccc

SEQ ID NO: 4160351 - DNA, 13 bp, Homo sapiens
ttctttctctcag

SEQ ID NO: 4160352 - DNA, 22 bp, Homo sapiens
ttctttctgattttaagtttgc

SEQ ID NO: 4160353 - DNA, 13 bp, Homo sapiens
ttctttctttaaa

SEQ ID NO: 4160354 - DNA, 15 bp, Homo sapiens
ttctttgaatttact

SEQ ID NO: 4160355 - DNA, 17 bp, Homo sapiens
ttctttgagtaatgtga

SEQ ID NO: 4160356 - DNA, 12 bp, Homo sapiens
ttctttgcctct

SEQ ID NO: 4160357 - DNA, 11 bp, Homo sapiens
ttctttgtgtt

SEQ ID NO: 4160358 - DNA, 16 bp, Homo sapiens
ttctttgttacaggca

SEQ ID NO: 4160359 - DNA, 12 bp, Homo sapiens
ttcttttacttg

SEQ ID NO: 4160360 - DNA, 13 bp, Homo sapiens
ttcttttccccct

SEQ ID NO: 4160361 - DNA, 14 bp, Homo sapiens
ttcttttcttttta

SEQ ID NO: 4160362 - DNA, 21 bp, Homo sapiens
ttcttttgcccttcacagtgt

SEQ ID NO: 4160363 - DNA, 16 bp, Homo sapiens
ttctttttacataact

SEQ ID NO: 4160364 - DNA, 18 bp, Homo sapiens
ttctttttacataactgc

SEQ ID NO: 4160365 - DNA, 23 bp, Homo sapiens
ttctttttacataactgccttga

SEQ ID NO: 4160366 - DNA, 17 bp, Homo sapiens
ttctttttttttaagtt

SEQ ID NO: 4160367 - DNA, 22 bp, Homo sapiens
ttcttttttttttttttacagt

SEQ ID NO: 4160368 - DNA, 23 bp, Homo sapiens
ttctttttttttttttttgaaag

SEQ ID NO: 4160369 - DNA, 15 bp, Homo sapiens
ttgaaaaaaacttca

SEQ ID NO: 4160370 - DNA, 21 bp, Homo sapiens
ttgaaaaactctttattttcc

SEQ ID NO: 4160371 - DNA, 13 bp, Homo sapiens
ttgaaaagaaagt

SEQ ID NO: 4160372 - DNA, 21 bp, Homo sapiens
ttgaaaagcttcttaattaat

SEQ ID NO: 4160373 - DNA, 13 bp, Homo sapiens
ttgaaacctcagg

SEQ ID NO: 4160374 - DNA, 19 bp, Homo sapiens
ttgaaagagttaagaatgt

SEQ ID NO: 4160375 - DNA, 18 bp, Homo sapiens
ttgaaagattttattgta

SEQ ID NO: 4160376 - DNA, 21 bp, Homo sapiens
ttgaaaggtatatgactgagc

SEQ ID NO: 4160377 - DNA, 21 bp, Homo sapiens
ttgaaaggttttttttcagtt

SEQ ID NO: 4160378 - DNA, 17 bp, Homo sapiens
ttgaaagttttcagaac

SEQ ID NO: 4160379 - DNA, 14 bp, Homo sapiens
ttgaaatactaaaa

SEQ ID NO: 4160380 - DNA, 13 bp, Homo sapiens
ttgaaatctttta

SEQ ID NO: 4160381 - DNA, 21 bp, Homo sapiens
ttgaaatgaggtctgtttaaa

SEQ ID NO: 4160382 - DNA, 20 bp, Homo sapiens
ttgaaattaagaaggcaaaa

SEQ ID NO: 4160383 - DNA, 11 bp, Homo sapiens
ttgaaattata

SEQ ID NO: 4160384 - DNA, 16 bp, Homo sapiens
ttgaaattatatctgt

SEQ ID NO: 4160385 - DNA, 17 bp, Homo sapiens
ttgaaattatatctgtg

SEQ ID NO: 4160386 - DNA, 15 bp, Homo sapiens
ttgaaattttgcaaa

SEQ ID NO: 4160387 - DNA, 21 bp, Homo sapiens
ttgaacacaaactgtaaataa

SEQ ID NO: 4160388 - DNA, 12 bp, Homo sapiens
ttgaaccaataa

SEQ ID NO: 4160389 - DNA, 18 bp, Homo sapiens
ttgaacctttttttttga

SEQ ID NO: 4160390 - DNA, 23 bp, Homo sapiens
ttgaacctttttttttgaaacag

SEQ ID NO: 4160391 - DNA, 23 bp, Homo sapiens
ttgaactctgttcccccaccctc

SEQ ID NO: 4160392 - DNA, 19 bp, Homo sapiens
ttgaactcttcaatctctt

SEQ ID NO: 4160393 - DNA, 20 bp, Homo sapiens
ttgaactggcaattgtctat

SEQ ID NO: 4160394 - DNA, 23 bp, Homo sapiens
ttgaactggcaattgtctattta

SEQ ID NO: 4160395 - DNA, 17 bp, Homo sapiens
ttgaagaaacagagtgg

SEQ ID NO: 4160396 - DNA, 14 bp, Homo sapiens
ttgaagaaggtgga

SEQ ID NO: 4160397 - DNA, 14 bp, Homo sapiens
ttgaagaatattta

SEQ ID NO: 4160398 - DNA, 12 bp, Homo sapiens
ttgaagacaatt

SEQ ID NO: 4160399 - DNA, 22 bp, Homo sapiens
ttgaagacaatttgatacataa

SEQ ID NO: 4160400 - DNA, 20 bp, Homo sapiens
ttgaagagagatatatctga

SEQ ID NO: 4160401 - DNA, 22 bp, Homo sapiens
ttgaagattaggagaaacacat

SEQ ID NO: 4160402 - DNA, 14 bp, Homo sapiens
ttgaagccaaagaa

SEQ ID NO: 4160403 - DNA, 15 bp, Homo sapiens
ttgaagcctgctcct

SEQ ID NO: 4160404 - DNA, 14 bp, Homo sapiens
ttgaagctaagatt

SEQ ID NO: 4160405 - DNA, 17 bp, Homo sapiens
ttgaaggaaaatgatac

SEQ ID NO: 4160406 - DNA, 20 bp, Homo sapiens
ttgaaggaagccaaatttat

SEQ ID NO: 4160407 - DNA, 18 bp, Homo sapiens
ttgaaggaggtgagggat

SEQ ID NO: 4160408 - DNA, 12 bp, Homo sapiens
ttgaaggcaaaa

SEQ ID NO: 4160409 - DNA, 17 bp, Homo sapiens
ttgaaggcaaaattgca

SEQ ID NO: 4160410 - DNA, 15 bp, Homo sapiens
ttgaaggccctgctg

SEQ ID NO: 4160411 - DNA, 19 bp, Homo sapiens
ttgaagggtaaagaagttt

SEQ ID NO: 4160412 - DNA, 15 bp, Homo sapiens
ttgaagtaaactttt

SEQ ID NO: 4160413 - DNA, 16 bp, Homo sapiens
ttgaagtaatgaattt

SEQ ID NO: 4160414 - DNA, 17 bp, Homo sapiens
ttgaagtaatgaatttt

SEQ ID NO: 4160415 - DNA, 16 bp, Homo sapiens
ttgaagtagctctttt

SEQ ID NO: 4160416 - DNA, 19 bp, Homo sapiens
ttgaagtctataaaaaata

SEQ ID NO: 4160417 - DNA, 12 bp, Homo sapiens
ttgaatactttt

SEQ ID NO: 4160418 - DNA, 13 bp, Homo sapiens
ttgaatacttttt

SEQ ID NO: 4160419 - DNA, 22 bp, Homo sapiens
ttgaatcagtttttaaaatatt

SEQ ID NO: 4160420 - DNA, 14 bp, Homo sapiens
ttgaatctatttca

SEQ ID NO: 4160421 - DNA, 11 bp, Homo sapiens
ttgaatgaaaa

SEQ ID NO: 4160422 - DNA, 15 bp, Homo sapiens
ttgaatgaaaaattt

SEQ ID NO: 4160423 - DNA, 13 bp, Homo sapiens
ttgaatgctgcca

SEQ ID NO: 4160424 - DNA, 14 bp, Homo sapiens
ttgaatgctgccag

SEQ ID NO: 4160425 - DNA, 23 bp, Homo sapiens
ttgaatgctgccagtgtggagtg

SEQ ID NO: 4160426 - DNA, 16 bp, Homo sapiens
ttgaatgcttcctgac

SEQ ID NO: 4160427 - DNA, 19 bp, Homo sapiens
ttgaatgtggcttgagaaa

SEQ ID NO: 4160428 - DNA, 21 bp, Homo sapiens
ttgaatgtggcttgagaaata

SEQ ID NO: 4160429 - DNA, 14 bp, Homo sapiens
ttgaatgttaagca

SEQ ID NO: 4160430 - DNA, 23 bp, Homo sapiens
ttgaattaaattaggaataaata

SEQ ID NO: 4160431 - DNA, 23 bp, Homo sapiens
ttgaattaatatccctacatgta

SEQ ID NO: 4160432 - DNA, 15 bp, Homo sapiens
ttgaatttaaataaa

SEQ ID NO: 4160433 - DNA, 16 bp, Homo sapiens
ttgaatttaaataaag

SEQ ID NO: 4160434 - DNA, 17 bp, Homo sapiens
ttgaatttcactgtctt

SEQ ID NO: 4160435 - DNA, 22 bp, Homo sapiens
ttgaattttgtttttattttca

SEQ ID NO: 4160436 - DNA, 17 bp, Homo sapiens
ttgacaaaagtaaatgg

SEQ ID NO: 4160437 - DNA, 16 bp, Homo sapiens
ttgacaaaatttgttg

SEQ ID NO: 4160438 - DNA, 17 bp, Homo sapiens
ttgacaaaattttctca

SEQ ID NO: 4160439 - DNA, 22 bp, Homo sapiens
ttgacaagtcattttaacttta

SEQ ID NO: 4160440 - DNA, 21 bp, Homo sapiens
ttgacaagttgcgacggagag

SEQ ID NO: 4160441 - DNA, 17 bp, Homo sapiens
ttgacacaagtggacct

SEQ ID NO: 4160442 - DNA, 13 bp, Homo sapiens
ttgacacacagca

SEQ ID NO: 4160443 - DNA, 16 bp, Homo sapiens
ttgacacacagcactc

SEQ ID NO: 4160444 - DNA, 16 bp, Homo sapiens
ttgacacagaaaatgt

SEQ ID NO: 4160445 - DNA, 15 bp, Homo sapiens
ttgacacagtcagca

SEQ ID NO: 4160446 - DNA, 13 bp, Homo sapiens
ttgacactggtat

SEQ ID NO: 4160447 - DNA, 17 bp, Homo sapiens
ttgacactgtccctctt

SEQ ID NO: 4160448 - DNA, 19 bp, Homo sapiens
ttgacatgtgcaattgtga

SEQ ID NO: 4160449 - DNA, 22 bp, Homo sapiens
ttgacatgtggaaagtgaattt

SEQ ID NO: 4160450 - DNA, 14 bp, Homo sapiens
ttgacattgcgttt

SEQ ID NO: 4160451 - DNA, 11 bp, Homo sapiens
ttgacatttaa

SEQ ID NO: 4160452 - DNA, 16 bp, Homo sapiens
ttgacatttagaactt

SEQ ID NO: 4160453 - DNA, 17 bp, Homo sapiens
ttgaccaagaactgcat

SEQ ID NO: 4160454 - DNA, 18 bp, Homo sapiens
ttgaccaagaactgcatg

SEQ ID NO: 4160455 - DNA, 18 bp, Homo sapiens
ttgaccagataaatagaa

SEQ ID NO: 4160456 - DNA, 21 bp, Homo sapiens
ttgaccccaatccaacccggg

SEQ ID NO: 4160457 - DNA, 13 bp, Homo sapiens
ttgacctctcagg

SEQ ID NO: 4160458 - DNA, 15 bp, Homo sapiens
ttgacctctcagggc

SEQ ID NO: 4160459 - DNA, 18 bp, Homo sapiens
ttgacctctcagggcctg

SEQ ID NO: 4160460 - DNA, 17 bp, Homo sapiens
ttgacgattccttctct

SEQ ID NO: 4160461 - DNA, 23 bp, Homo sapiens
ttgactagatgatggatgccaat

SEQ ID NO: 4160462 - DNA, 21 bp, Homo sapiens
ttgactagggattcaggctgc

SEQ ID NO: 4160463 - DNA, 21 bp, Homo sapiens
ttgactcttttgccattaaac

SEQ ID NO: 4160464 - DNA, 21 bp, Homo sapiens
ttgacttaatgtgattactgc

SEQ ID NO: 4160465 - DNA, 15 bp, Homo sapiens
ttgacttattttctc

SEQ ID NO: 4160466 - DNA, 22 bp, Homo sapiens
ttgactttacgcccatctcagg

SEQ ID NO: 4160467 - DNA, 17 bp, Homo sapiens
ttgactttttttgtatg

SEQ ID NO: 4160468 - DNA, 11 bp, Homo sapiens
ttgagaaaaat

SEQ ID NO: 4160469 - DNA, 19 bp, Homo sapiens
ttgagaaaaatatatacta

SEQ ID NO: 4160470 - DNA, 17 bp, Homo sapiens
ttgagaaaataaagcta

SEQ ID NO: 4160471 - DNA, 22 bp, Homo sapiens
ttgagaaaccttattgtacctc

SEQ ID NO: 4160472 - DNA, 20 bp, Homo sapiens
ttgagaactgcttctaagat

SEQ ID NO: 4160473 - DNA, 15 bp, Homo sapiens
ttgagaactttccat

SEQ ID NO: 4160474 - DNA, 23 bp, Homo sapiens
ttgagaatcccaaatttgattga

SEQ ID NO: 4160475 - DNA, 20 bp, Homo sapiens
ttgagaatcccttaaaatta

SEQ ID NO: 4160476 - DNA, 17 bp, Homo sapiens
ttgagacagtttcttag

SEQ ID NO: 4160477 - DNA, 13 bp, Homo sapiens
ttgagaccagcct

SEQ ID NO: 4160478 - DNA, 16 bp, Homo sapiens
ttgagacccaggcctg

SEQ ID NO: 4160479 - DNA, 14 bp, Homo sapiens
ttgagactagtttt

SEQ ID NO: 4160480 - DNA, 23 bp, Homo sapiens
ttgagactatttaaacttataaa

SEQ ID NO: 4160481 - DNA, 13 bp, Homo sapiens
ttgagagaagcca

SEQ ID NO: 4160482 - DNA, 18 bp, Homo sapiens
ttgagagaagccacgctg

SEQ ID NO: 4160483 - DNA, 12 bp, Homo sapiens
ttgagagccagt

SEQ ID NO: 4160484 - DNA, 21 bp, Homo sapiens
ttgagatgctgtaggtggtat

SEQ ID NO: 4160485 - DNA, 11 bp, Homo sapiens
ttgagatttct

SEQ ID NO: 4160486 - DNA, 17 bp, Homo sapiens
ttgagatttttaagaac

SEQ ID NO: 4160487 - DNA, 17 bp, Homo sapiens
ttgagccaggcctgggt

SEQ ID NO: 4160488 - DNA, 12 bp, Homo sapiens
ttgagctgcctt

SEQ ID NO: 4160489 - DNA, 13 bp, Homo sapiens
ttgagctgccttc

SEQ ID NO: 4160490 - DNA, 15 bp, Homo sapiens
ttgaggaaatattaa

SEQ ID NO: 4160491 - DNA, 20 bp, Homo sapiens
ttgaggcttatatttgtgta

SEQ ID NO: 4160492 - DNA, 15 bp, Homo sapiens
ttgaggctttgtgtt

SEQ ID NO: 4160493 - DNA, 19 bp, Homo sapiens
ttgagggaaggttcttcat

SEQ ID NO: 4160494 - DNA, 21 bp, Homo sapiens
ttgagggacgctttgtctgtc

SEQ ID NO: 4160495 - DNA, 20 bp, Homo sapiens
ttgaggggattaatatgaaa

SEQ ID NO: 4160496 - DNA, 19 bp, Homo sapiens
ttgaggggccctggccagg

SEQ ID NO: 4160497 - DNA, 18 bp, Homo sapiens
ttgaggtagaaatgcaag

SEQ ID NO: 4160498 - DNA, 16 bp, Homo sapiens
ttgaggtcaagtaaga

SEQ ID NO: 4160499 - DNA, 22 bp, Homo sapiens
ttgaggtcaagtaagaagacat

SEQ ID NO: 4160500 - DNA, 22 bp, Homo sapiens
ttgaggtttttaaatatatatt

SEQ ID NO: 4160501 - DNA, 16 bp, Homo sapiens
ttgagtaatggtgtag

SEQ ID NO: 4160502 - DNA, 14 bp, Homo sapiens
ttgagtgactcgag

SEQ ID NO: 4160503 - DNA, 21 bp, Homo sapiens
ttgagtgctgtctccatgttt

SEQ ID NO: 4160504 - DNA, 14 bp, Homo sapiens
ttgagtgtcaagct

SEQ ID NO: 4160505 - DNA, 18 bp, Homo sapiens
ttgagtgtgtgtgtgcat

SEQ ID NO: 4160506 - DNA, 21 bp, Homo sapiens
ttgagtgttcctttttaaatg

SEQ ID NO: 4160507 - DNA, 23 bp, Homo sapiens
ttgagtttttcctcccagtgaga

SEQ ID NO: 4160508 - DNA, 12 bp, Homo sapiens
ttgataaagtaa

SEQ ID NO: 4160509 - DNA, 19 bp, Homo sapiens
ttgataataaattgaaatt

SEQ ID NO: 4160510 - DNA, 15 bp, Homo sapiens
ttgataatgctttca

SEQ ID NO: 4160511 - DNA, 14 bp, Homo sapiens
ttgataatgttaaa

SEQ ID NO: 4160512 - DNA, 23 bp, Homo sapiens
ttgatacataataaaaaattatg

SEQ ID NO: 4160513 - DNA, 15 bp, Homo sapiens
ttgatacccccctct

SEQ ID NO: 4160514 - DNA, 14 bp, Homo sapiens
ttgatagctttatt

SEQ ID NO: 4160515 - DNA, 16 bp, Homo sapiens
ttgatagggaactggg

SEQ ID NO: 4160516 - DNA, 17 bp, Homo sapiens
ttgatcaaattcatttt

SEQ ID NO: 4160517 - DNA, 18 bp, Homo sapiens
ttgatcattttcccccca

SEQ ID NO: 4160518 - DNA, 15 bp, Homo sapiens
ttgatgaaagctgat

SEQ ID NO: 4160519 - DNA, 16 bp, Homo sapiens
ttgatgaagcaaggaa

SEQ ID NO: 4160520 - DNA, 20 bp, Homo sapiens
ttgatgaccaaagtcctttt

SEQ ID NO: 4160521 - DNA, 15 bp, Homo sapiens
ttgatggaaaataaa

SEQ ID NO: 4160522 - DNA, 22 bp, Homo sapiens
ttgatgggggccaggacaccag

SEQ ID NO: 4160523 - DNA, 21 bp, Homo sapiens
ttgatggtgacagctgcaagc

SEQ ID NO: 4160524 - DNA, 21 bp, Homo sapiens
ttgatgtgactttttttggta

SEQ ID NO: 4160525 - DNA, 14 bp, Homo sapiens
ttgatgttacagat

SEQ ID NO: 4160526 - DNA, 18 bp, Homo sapiens
ttgatgtttgtggcctca

SEQ ID NO: 4160527 - DNA, 19 bp, Homo sapiens
ttgattcatagtaacttct

SEQ ID NO: 4160528 - DNA, 20 bp, Homo sapiens
ttgattctgcagtaaatctt

SEQ ID NO: 4160529 - DNA, 13 bp, Homo sapiens
ttgattgaggagc

SEQ ID NO: 4160530 - DNA, 13 bp, Homo sapiens
ttgattgatttga

SEQ ID NO: 4160531 - DNA, 14 bp, Homo sapiens
ttgattgatttgaa

SEQ ID NO: 4160532 - DNA, 12 bp, Homo sapiens
ttgattgctttt

SEQ ID NO: 4160533 - DNA, 22 bp, Homo sapiens
ttgatttacagcaagtagataa

SEQ ID NO: 4160534 - DNA, 23 bp, Homo sapiens
ttgatttccgtgaactctggtgc

SEQ ID NO: 4160535 - DNA, 16 bp, Homo sapiens
ttgatttcctgtgtgt

SEQ ID NO: 4160536 - DNA, 18 bp, Homo sapiens
ttgatttgatgtgacttt

SEQ ID NO: 4160537 - DNA, 11 bp, Homo sapiens
ttgatttgcat

SEQ ID NO: 4160538 - DNA, 16 bp, Homo sapiens
ttgatttgcatggatt

SEQ ID NO: 4160539 - DNA, 13 bp, Homo sapiens
ttgatttgcattg

SEQ ID NO: 4160540 - DNA, 17 bp, Homo sapiens
ttgatttgcattgaaca

SEQ ID NO: 4160541 - DNA, 19 bp, Homo sapiens
ttgatttgtcactgcttca

SEQ ID NO: 4160542 - DNA, 14 bp, Homo sapiens
ttgattttaataca

SEQ ID NO: 4160543 - DNA, 14 bp, Homo sapiens
ttgatttttcttct

SEQ ID NO: 4160544 - DNA, 18 bp, Homo sapiens
ttgatttttttaaacata

SEQ ID NO: 4160545 - DNA, 16 bp, Homo sapiens
ttgcaaaatttccagt

SEQ ID NO: 4160546 - DNA, 22 bp, Homo sapiens
ttgcaaaatttccagtaccttt

SEQ ID NO: 4160547 - DNA, 11 bp, Homo sapiens
ttgcaaagcaa

SEQ ID NO: 4160548 - DNA, 12 bp, Homo sapiens
ttgcaaagcaaa

SEQ ID NO: 4160549 - DNA, 17 bp, Homo sapiens
ttgcaaagggaaacagg

SEQ ID NO: 4160550 - DNA, 16 bp, Homo sapiens
ttgcaaatataaacat

SEQ ID NO: 4160551 - DNA, 12 bp, Homo sapiens
ttgcaaatcttg

SEQ ID NO: 4160552 - DNA, 21 bp, Homo sapiens
ttgcaacagactgttgagtta

SEQ ID NO: 4160553 - DNA, 12 bp, Homo sapiens
ttgcaacttcat

SEQ ID NO: 4160554 - DNA, 14 bp, Homo sapiens
ttgcaagatgtgaa

SEQ ID NO: 4160555 - DNA, 13 bp, Homo sapiens
ttgcaataacttc

SEQ ID NO: 4160556 - DNA, 15 bp, Homo sapiens
ttgcaataacttcta

SEQ ID NO: 4160557 - DNA, 18 bp, Homo sapiens
ttgcaataacttctatat

SEQ ID NO: 4160558 - DNA, 20 bp, Homo sapiens
ttgcaatggtgttgccctga

SEQ ID NO: 4160559 - DNA, 15 bp, Homo sapiens
ttgcacaattataaa

SEQ ID NO: 4160560 - DNA, 24 bp, Homo sapiens
ttgcacccctcactctggcctcag

SEQ ID NO: 4160561 - DNA, 13 bp, Homo sapiens
ttgcacctgtccc

SEQ ID NO: 4160562 - DNA, 16 bp, Homo sapiens
ttgcacctgtccccac

SEQ ID NO: 4160563 - DNA, 12 bp, Homo sapiens
ttgcactgaggg

SEQ ID NO: 4160564 - DNA, 17 bp, Homo sapiens
ttgcacttgtgattatt

SEQ ID NO: 4160565 - DNA, 16 bp, Homo sapiens
ttgcagaaaattctgt

SEQ ID NO: 4160566 - DNA, 15 bp, Homo sapiens
ttgcagaaacatttt

SEQ ID NO: 4160567 - DNA, 20 bp, Homo sapiens
ttgcagaagagggtgtgttt

SEQ ID NO: 4160568 - DNA, 13 bp, Homo sapiens
ttgcagatgaaat

SEQ ID NO: 4160569 - DNA, 14 bp, Homo sapiens
ttgcagcagtgagt

SEQ ID NO: 4160570 - DNA, 17 bp, Homo sapiens
ttgcagcatgagacttt

SEQ ID NO: 4160571 - DNA, 15 bp, Homo sapiens
ttgcagcctgctcta

SEQ ID NO: 4160572 - DNA, 21 bp, Homo sapiens
ttgcagctttatgttcatttg

SEQ ID NO: 4160573 - DNA, 13 bp, Homo sapiens
ttgcagggcagcc

SEQ ID NO: 4160574 - DNA, 14 bp, Homo sapiens
ttgcagggcagccc

SEQ ID NO: 4160575 - DNA, 17 bp, Homo sapiens
ttgcagggtcctcttct

SEQ ID NO: 4160576 - DNA, 20 bp, Homo sapiens
ttgcaggtggaactcagtca

SEQ ID NO: 4160577 - DNA, 23 bp, Homo sapiens
ttgcaggtgggggttgctgtata

SEQ ID NO: 4160578 - DNA, 13 bp, Homo sapiens
ttgcagtaactgt

SEQ ID NO: 4160579 - DNA, 17 bp, Homo sapiens
ttgcagtcatcagaagt

SEQ ID NO: 4160580 - DNA, 19 bp, Homo sapiens
ttgcagttggactctcagg

SEQ ID NO: 4160581 - DNA, 16 bp, Homo sapiens
ttgcatattctattgt

SEQ ID NO: 4160582 - DNA, 21 bp, Homo sapiens
ttgcatattttgagaaactgc

SEQ ID NO: 4160583 - DNA, 18 bp, Homo sapiens
ttgcatctaggtaatttt

SEQ ID NO: 4160584 - DNA, 18 bp, Homo sapiens
ttgcatctcaaaattatt

SEQ ID NO: 4160585 - DNA, 16 bp, Homo sapiens
ttgcatgaagagaagc

SEQ ID NO: 4160586 - DNA, 21 bp, Homo sapiens
ttgcatgaagagaagcaattt

SEQ ID NO: 4160587 - DNA, 13 bp, Homo sapiens
ttgcatgtttgaa

SEQ ID NO: 4160588 - DNA, 13 bp, Homo sapiens
ttgcattaaattc

SEQ ID NO: 4160589 - DNA, 20 bp, Homo sapiens
ttgcattagtaactttgaaa

SEQ ID NO: 4160590 - DNA, 12 bp, Homo sapiens
ttgcattcaaat

SEQ ID NO: 4160591 - DNA, 13 bp, Homo sapiens
ttgcattcatttt

SEQ ID NO: 4160592 - DNA, 12 bp, Homo sapiens
ttgcattctatt

SEQ ID NO: 4160593 - DNA, 20 bp, Homo sapiens
ttgcattctattgccttctt

SEQ ID NO: 4160594 - DNA, 22 bp, Homo sapiens
ttgcattctattgccttctttg

SEQ ID NO: 4160595 - DNA, 14 bp, Homo sapiens
ttgcattgaacaca

SEQ ID NO: 4160596 - DNA, 15 bp, Homo sapiens
ttgcattgaacacaa

SEQ ID NO: 4160597 - DNA, 18 bp, Homo sapiens
ttgcattgaacacaaact

SEQ ID NO: 4160598 - DNA, 23 bp, Homo sapiens
ttgcattgaacacaaactgtaaa

SEQ ID NO: 4160599 - DNA, 22 bp, Homo sapiens
ttgcattgaggaaatattaatt

SEQ ID NO: 4160600 - DNA, 20 bp, Homo sapiens
ttgcatttatatgtaccgta

SEQ ID NO: 4160601 - DNA, 15 bp, Homo sapiens
ttgcatttatggtca

SEQ ID NO: 4160602 - DNA, 17 bp, Homo sapiens
ttgcatttatttataca

SEQ ID NO: 4160603 - DNA, 23 bp, Homo sapiens
ttgcatttatttatacagtgcct

SEQ ID NO: 4160604 - DNA, 14 bp, Homo sapiens
ttgcatttgctttt

SEQ ID NO: 4160605 - DNA, 17 bp, Homo sapiens
ttgccaagctttcttct

SEQ ID NO: 4160606 - DNA, 18 bp, Homo sapiens
ttgccaaggcaaaaaact

SEQ ID NO: 4160607 - DNA, 23 bp, Homo sapiens
ttgccaatcttgttttaagcaaa

SEQ ID NO: 4160608 - DNA, 21 bp, Homo sapiens
ttgccaatgaggtctgaaatg

SEQ ID NO: 4160609 - DNA, 15 bp, Homo sapiens
ttgccacaaccctgt

SEQ ID NO: 4160610 - DNA, 18 bp, Homo sapiens
ttgccacagcttttgcaa

SEQ ID NO: 4160611 - DNA, 13 bp, Homo sapiens
ttgccacatttct

SEQ ID NO: 4160612 - DNA, 22 bp, Homo sapiens
ttgccacatttctgatcagagg

SEQ ID NO: 4160613 - DNA, 20 bp, Homo sapiens
ttgccagaaagcataaaatt

SEQ ID NO: 4160614 - DNA, 22 bp, Homo sapiens
ttgccagcttttcctcccttgg

SEQ ID NO: 4160615 - DNA, 17 bp, Homo sapiens
ttgccatcaatgatcat

SEQ ID NO: 4160616 - DNA, 21 bp, Homo sapiens
ttgccatgggcttcactgtat

SEQ ID NO: 4160617 - DNA, 19 bp, Homo sapiens
ttgcccaagtcacacagct

SEQ ID NO: 4160618 - DNA, 15 bp, Homo sapiens
ttgcccacccctcac

SEQ ID NO: 4160619 - DNA, 19 bp, Homo sapiens
ttgcccacccctcactccc

SEQ ID NO: 4160620 - DNA, 21 bp, Homo sapiens
ttgcccacccctcactcccca

SEQ ID NO: 4160621 - DNA, 17 bp, Homo sapiens
ttgcccactcctgctct

SEQ ID NO: 4160622 - DNA, 16 bp, Homo sapiens
ttgcccatcctgactg

SEQ ID NO: 4160623 - DNA, 22 bp, Homo sapiens
ttgccccatccagacctggctc

SEQ ID NO: 4160624 - DNA, 18 bp, Homo sapiens
ttgcccctggctttgcct

SEQ ID NO: 4160625 - DNA, 19 bp, Homo sapiens
ttgcccctggctttgcctc

SEQ ID NO: 4160626 - DNA, 16 bp, Homo sapiens
ttgccctagatagttt

SEQ ID NO: 4160627 - DNA, 15 bp, Homo sapiens
ttgccctagcccaga

SEQ ID NO: 4160628 - DNA, 20 bp, Homo sapiens
ttgcctaaaatataattttt

SEQ ID NO: 4160629 - DNA, 17 bp, Homo sapiens
ttgcctactatgccaga

SEQ ID NO: 4160630 - DNA, 19 bp, Homo sapiens
ttgcctctgcagtctcatt

SEQ ID NO: 4160631 - DNA, 15 bp, Homo sapiens
ttgcctctgccctgg

SEQ ID NO: 4160632 - DNA, 17 bp, Homo sapiens
ttgcctctgccctggat

SEQ ID NO: 4160633 - DNA, 18 bp, Homo sapiens
ttgcctgactaaaatgtt

SEQ ID NO: 4160634 - DNA, 23 bp, Homo sapiens
ttgcctgatttgttttcattata

SEQ ID NO: 4160635 - DNA, 13 bp, Homo sapiens
ttgcctgcagaga

SEQ ID NO: 4160636 - DNA, 15 bp, Homo sapiens
ttgcctgcagagaga

SEQ ID NO: 4160637 - DNA, 20 bp, Homo sapiens
ttgcctgcagagagaagcct

SEQ ID NO: 4160638 - DNA, 22 bp, Homo sapiens
ttgcctgcgttttggaagctct

SEQ ID NO: 4160639 - DNA, 12 bp, Homo sapiens
ttgcctgctggg

SEQ ID NO: 4160640 - DNA, 12 bp, Homo sapiens
ttgcctgtgcca

SEQ ID NO: 4160641 - DNA, 20 bp, Homo sapiens
ttgccttcctttctccagga

SEQ ID NO: 4160642 - DNA, 15 bp, Homo sapiens
ttgccttctactccc

SEQ ID NO: 4160643 - DNA, 20 bp, Homo sapiens
ttgccttctgaaatgtgacc

SEQ ID NO: 4160644 - DNA, 18 bp, Homo sapiens
ttgcctttatctctgagg

SEQ ID NO: 4160645 - DNA, 21 bp, Homo sapiens
ttgcctttctgggagcagaaa

SEQ ID NO: 4160646 - DNA, 19 bp, Homo sapiens
ttgcgacggagagaaaaaa

SEQ ID NO: 4160647 - DNA, 22 bp, Homo sapiens
ttgcgacggagagaaaaaagaa

SEQ ID NO: 4160648 - DNA, 19 bp, Homo sapiens
ttgcgcctcagccctcagt

SEQ ID NO: 4160649 - DNA, 13 bp, Homo sapiens
ttgcggccccagg

SEQ ID NO: 4160650 - DNA, 14 bp, Homo sapiens
ttgcgtatgtctgt

SEQ ID NO: 4160651 - DNA, 22 bp, Homo sapiens
ttgctaagtaaatctcttctgt

SEQ ID NO: 4160652 - DNA, 17 bp, Homo sapiens
ttgctagtatttgaatt

SEQ ID NO: 4160653 - DNA, 23 bp, Homo sapiens
ttgctatctggaggccttccagc

SEQ ID NO: 4160654 - DNA, 21 bp, Homo sapiens
ttgctatgttactattttcta

SEQ ID NO: 4160655 - DNA, 12 bp, Homo sapiens
ttgctattgtaa

SEQ ID NO: 4160656 - DNA, 21 bp, Homo sapiens
ttgctcaagttcattgatgac

SEQ ID NO: 4160657 - DNA, 23 bp, Homo sapiens
ttgctcagagaaggaaaagactg

SEQ ID NO: 4160658 - DNA, 20 bp, Homo sapiens
ttgctcagctcctacctctg

SEQ ID NO: 4160659 - DNA, 15 bp, Homo sapiens
ttgctcattcttgag

SEQ ID NO: 4160660 - DNA, 17 bp, Homo sapiens
ttgctcctagcagacag

SEQ ID NO: 4160661 - DNA, 21 bp, Homo sapiens
ttgctcctagcagacagaaac

SEQ ID NO: 4160662 - DNA, 14 bp, Homo sapiens
ttgctctacaatga

SEQ ID NO: 4160663 - DNA, 16 bp, Homo sapiens
ttgctctcaattaaag

SEQ ID NO: 4160664 - DNA, 12 bp, Homo sapiens
ttgctctcctca

SEQ ID NO: 4160665 - DNA, 14 bp, Homo sapiens
ttgctctgggtgga

SEQ ID NO: 4160666 - DNA, 20 bp, Homo sapiens
ttgctctgttacccaggctg

SEQ ID NO: 4160667 - DNA, 13 bp, Homo sapiens
ttgctctgttccc

SEQ ID NO: 4160668 - DNA, 16 bp, Homo sapiens
ttgctcttttaagcag

SEQ ID NO: 4160669 - DNA, 14 bp, Homo sapiens
ttgctgaacacaca

SEQ ID NO: 4160670 - DNA, 15 bp, Homo sapiens
ttgctgaacacacac

SEQ ID NO: 4160671 - DNA, 22 bp, Homo sapiens
ttgctgagcctctgctccccag

SEQ ID NO: 4160672 - DNA, 24 bp, Homo sapiens
ttgctgagctgtttatagagaatg

SEQ ID NO: 4160673 - DNA, 22 bp, Homo sapiens
ttgctgatggcttgacatgtgc

SEQ ID NO: 4160674 - DNA, 13 bp, Homo sapiens
ttgctgcagcctg

SEQ ID NO: 4160675 - DNA, 19 bp, Homo sapiens
ttgctgcagtcatctactt

SEQ ID NO: 4160676 - DNA, 19 bp, Homo sapiens
ttgctgcgcaccaatgccc

SEQ ID NO: 4160677 - DNA, 23 bp, Homo sapiens
ttgctgctaccgccctgggctgg

SEQ ID NO: 4160678 - DNA, 14 bp, Homo sapiens
ttgctgctgctgca

SEQ ID NO: 4160679 - DNA, 16 bp, Homo sapiens
ttgctgtataagttat

SEQ ID NO: 4160680 - DNA, 21 bp, Homo sapiens
ttgctgtcataagaatgaata

SEQ ID NO: 4160681 - DNA, 16 bp, Homo sapiens
ttgctgtcctgatctg

SEQ ID NO: 4160682 - DNA, 16 bp, Homo sapiens
ttgctgtctctgctcg

SEQ ID NO: 4160683 - DNA, 15 bp, Homo sapiens
ttgctgtgaggctgt

SEQ ID NO: 4160684 - DNA, 17 bp, Homo sapiens
ttgctgtgaggctgtcc

SEQ ID NO: 4160685 - DNA, 20 bp, Homo sapiens
ttgctgtgcttcaaactact

SEQ ID NO: 4160686 - DNA, 18 bp, Homo sapiens
ttgctgtgtttaatttga

SEQ ID NO: 4160687 - DNA, 22 bp, Homo sapiens
ttgctgttatgtctgtttaaga

SEQ ID NO: 4160688 - DNA, 19 bp, Homo sapiens
ttgctgttgtccctctgct

SEQ ID NO: 4160689 - DNA, 12 bp, Homo sapiens
ttgcttactaag

SEQ ID NO: 4160690 - DNA, 22 bp, Homo sapiens
ttgcttattgttccaagacatt

SEQ ID NO: 4160691 - DNA, 23 bp, Homo sapiens
ttgcttattgttccaagacattg

SEQ ID NO: 4160692 - DNA, 21 bp, Homo sapiens
ttgcttcatagtattggagca

SEQ ID NO: 4160693 - DNA, 18 bp, Homo sapiens
ttgcttcccctccaggag

SEQ ID NO: 4160694 - DNA, 17 bp, Homo sapiens
ttgcttccccttttgcc

SEQ ID NO: 4160695 - DNA, 12 bp, Homo sapiens
ttgcttctgtag

SEQ ID NO: 4160696 - DNA, 14 bp, Homo sapiens
ttgcttctgtagta

SEQ ID NO: 4160697 - DNA, 17 bp, Homo sapiens
ttgcttctgtatttcct

SEQ ID NO: 4160698 - DNA, 15 bp, Homo sapiens
ttgcttcttactgat

SEQ ID NO: 4160699 - DNA, 13 bp, Homo sapiens
ttgcttgaaacca

SEQ ID NO: 4160700 - DNA, 18 bp, Homo sapiens
ttgcttgagcccaggagt

SEQ ID NO: 4160701 - DNA, 13 bp, Homo sapiens
ttgcttgatccag

SEQ ID NO: 4160702 - DNA, 20 bp, Homo sapiens
ttgcttggtgctggtttatt

SEQ ID NO: 4160703 - DNA, 15 bp, Homo sapiens
ttgctttattccaga

SEQ ID NO: 4160704 - DNA, 15 bp, Homo sapiens
ttgctttctgaaatt

SEQ ID NO: 4160705 - DNA, 21 bp, Homo sapiens
ttgctttgaagtagctctttt

SEQ ID NO: 4160706 - DNA, 19 bp, Homo sapiens
ttgctttgatttacagcaa

SEQ ID NO: 4160707 - DNA, 12 bp, Homo sapiens
ttgcttttaatt

SEQ ID NO: 4160708 - DNA, 15 bp, Homo sapiens
ttgcttttattttga

SEQ ID NO: 4160709 - DNA, 15 bp, Homo sapiens
ttgctttttctaatg

SEQ ID NO: 4160710 - DNA, 13 bp, Homo sapiens
ttgctttttgccc

SEQ ID NO: 4160711 - DNA, 14 bp, Homo sapiens
ttggaaaagaatac

SEQ ID NO: 4160712 - DNA, 22 bp, Homo sapiens
ttggaaaagaatacagaaagat

SEQ ID NO: 4160713 - DNA, 18 bp, Homo sapiens
ttggaaagaagaaagact

SEQ ID NO: 4160714 - DNA, 21 bp, Homo sapiens
ttggaaagccattgaccaccc

SEQ ID NO: 4160715 - DNA, 21 bp, Homo sapiens
ttggaaagtacactctgctgt

SEQ ID NO: 4160716 - DNA, 18 bp, Homo sapiens
ttggaaatagaaagaagc

SEQ ID NO: 4160717 - DNA, 23 bp, Homo sapiens
ttggaaatagaaagaagccatat

SEQ ID NO: 4160718 - DNA, 16 bp, Homo sapiens
ttggaaccagccccat

SEQ ID NO: 4160719 - DNA, 21 bp, Homo sapiens
ttggaaccgtgtccagcacag

SEQ ID NO: 4160720 - DNA, 22 bp, Homo sapiens
ttggaaccgtgtccagcacaga

SEQ ID NO: 4160721 - DNA, 14 bp, Homo sapiens
ttggaaccttgttt

SEQ ID NO: 4160722 - DNA, 22 bp, Homo sapiens
ttggaagaaaaaaatcttctcc

SEQ ID NO: 4160723 - DNA, 17 bp, Homo sapiens
ttggaaggggccttgct

SEQ ID NO: 4160724 - DNA, 16 bp, Homo sapiens
ttggaagttttcagga

SEQ ID NO: 4160725 - DNA, 18 bp, Homo sapiens
ttggaattaacctggtgc

SEQ ID NO: 4160726 - DNA, 21 bp, Homo sapiens
ttggaatttgtaacctcagct

SEQ ID NO: 4160727 - DNA, 16 bp, Homo sapiens
ttggacagctgataaa

SEQ ID NO: 4160728 - DNA, 23 bp, Homo sapiens
ttggacatagatattttcacaat

SEQ ID NO: 4160729 - DNA, 15 bp, Homo sapiens
ttggactctcaggga

SEQ ID NO: 4160730 - DNA, 14 bp, Homo sapiens
ttggactgacattt

SEQ ID NO: 4160731 - DNA, 15 bp, Homo sapiens
ttggactgacattta

SEQ ID NO: 4160732 - DNA, 19 bp, Homo sapiens
ttggactgttttgaaaagt

SEQ ID NO: 4160733 - DNA, 14 bp, Homo sapiens
ttggactttcaaaa

SEQ ID NO: 4160734 - DNA, 20 bp, Homo sapiens
ttggacttttcgttaacatt

SEQ ID NO: 4160735 - DNA, 22 bp, Homo sapiens
ttggacttttcgttaacattga

SEQ ID NO: 4160736 - DNA, 18 bp, Homo sapiens
ttggagaaggttatcaaa

SEQ ID NO: 4160737 - DNA, 21 bp, Homo sapiens
ttggagaatactttgcttcat

SEQ ID NO: 4160738 - DNA, 22 bp, Homo sapiens
ttggagaccctgcaaacagaac

SEQ ID NO: 4160739 - DNA, 23 bp, Homo sapiens
ttggagaccctgcaaacagaaca

SEQ ID NO: 4160740 - DNA, 21 bp, Homo sapiens
ttggagacttaacagcatttg

SEQ ID NO: 4160741 - DNA, 14 bp, Homo sapiens
ttggagagaatcat

SEQ ID NO: 4160742 - DNA, 16 bp, Homo sapiens
ttggagagtttcctga

SEQ ID NO: 4160743 - DNA, 21 bp, Homo sapiens
ttggagagtttcctgaaacaa

SEQ ID NO: 4160744 - DNA, 11 bp, Homo sapiens
ttggagcattg

SEQ ID NO: 4160745 - DNA, 20 bp, Homo sapiens
ttggagccccaggggacaag

SEQ ID NO: 4160746 - DNA, 16 bp, Homo sapiens
ttggagctattcaaga

SEQ ID NO: 4160747 - DNA, 17 bp, Homo sapiens
ttggaggcctttcatcc

SEQ ID NO: 4160748 - DNA, 12 bp, Homo sapiens
ttggagggatgg

SEQ ID NO: 4160749 - DNA, 16 bp, Homo sapiens
ttggaggtcacagctg

SEQ ID NO: 4160750 - DNA, 17 bp, Homo sapiens
ttggaggtcacagctgg

SEQ ID NO: 4160751 - DNA, 17 bp, Homo sapiens
ttggataaatcatttca

SEQ ID NO: 4160752 - DNA, 19 bp, Homo sapiens
ttggataaatcatttcagt

SEQ ID NO: 4160753 - DNA, 16 bp, Homo sapiens
ttggatatattattgt

SEQ ID NO: 4160754 - DNA, 20 bp, Homo sapiens
ttggatatattattgtaagt

SEQ ID NO: 4160755 - DNA, 19 bp, Homo sapiens
ttggatcttcaatggcttt

SEQ ID NO: 4160756 - DNA, 16 bp, Homo sapiens
ttggatcttgaatgtg

SEQ ID NO: 4160757 - DNA, 20 bp, Homo sapiens
ttggatgggagtgagacaga

SEQ ID NO: 4160758 - DNA, 15 bp, Homo sapiens
ttggatgtaatttag

SEQ ID NO: 4160759 - DNA, 17 bp, Homo sapiens
ttggattattcatttaa

SEQ ID NO: 4160760 - DNA, 18 bp, Homo sapiens
ttggattattcatttaaa

SEQ ID NO: 4160761 - DNA, 14 bp, Homo sapiens
ttggattatttaat

SEQ ID NO: 4160762 - DNA, 18 bp, Homo sapiens
ttggattatttaataaca

SEQ ID NO: 4160763 - DNA, 16 bp, Homo sapiens
ttggatttagtttcag

SEQ ID NO: 4160764 - DNA, 22 bp, Homo sapiens
ttggcaaagtttaaatgtattt

SEQ ID NO: 4160765 - DNA, 22 bp, Homo sapiens
ttggcacccaaatcacatctca

SEQ ID NO: 4160766 - DNA, 22 bp, Homo sapiens
ttggcaccccagctaccccttc

SEQ ID NO: 4160767 - DNA, 19 bp, Homo sapiens
ttggcacctaatccaggca

SEQ ID NO: 4160768 - DNA, 21 bp, Homo sapiens
ttggcacctaatccaggcaga

SEQ ID NO: 4160769 - DNA, 22 bp, Homo sapiens
ttggcactgagatatttattgt

SEQ ID NO: 4160770 - DNA, 13 bp, Homo sapiens
ttggcagacagcc

SEQ ID NO: 4160771 - DNA, 21 bp, Homo sapiens
ttggcagatgcagctcttcct

SEQ ID NO: 4160772 - DNA, 22 bp, Homo sapiens
ttggcagatgcagctcttcctg

SEQ ID NO: 4160773 - DNA, 12 bp, Homo sapiens
ttggcagcccac

SEQ ID NO: 4160774 - DNA, 16 bp, Homo sapiens
ttggcaggtcctggcc

SEQ ID NO: 4160775 - DNA, 12 bp, Homo sapiens
ttggcagtgttt

SEQ ID NO: 4160776 - DNA, 16 bp, Homo sapiens
ttggccaaacatcaga

SEQ ID NO: 4160777 - DNA, 20 bp, Homo sapiens
ttggccacctgtagccatct

SEQ ID NO: 4160778 - DNA, 20 bp, Homo sapiens
ttggcccaggattattgtca

SEQ ID NO: 4160779 - DNA, 16 bp, Homo sapiens
ttggcccctgtgtgag

SEQ ID NO: 4160780 - DNA, 17 bp, Homo sapiens
ttggcctgatcagacca

SEQ ID NO: 4160781 - DNA, 19 bp, Homo sapiens
ttggcctgatcagaccacg

SEQ ID NO: 4160782 - DNA, 12 bp, Homo sapiens
ttggcctgctgt

SEQ ID NO: 4160783 - DNA, 13 bp, Homo sapiens
ttggcctgctgtg

SEQ ID NO: 4160784 - DNA, 15 bp, Homo sapiens
ttggcgctattacaa

SEQ ID NO: 4160785 - DNA, 17 bp, Homo sapiens
ttggctcaataaagatt

SEQ ID NO: 4160786 - DNA, 13 bp, Homo sapiens
ttggctcaatcct

SEQ ID NO: 4160787 - DNA, 22 bp, Homo sapiens
ttggctcacccaagcaaggcca

SEQ ID NO: 4160788 - DNA, 22 bp, Homo sapiens
ttggctcctgcccactgatagc

SEQ ID NO: 4160789 - DNA, 19 bp, Homo sapiens
ttggctgatttaaaaagtg

SEQ ID NO: 4160790 - DNA, 17 bp, Homo sapiens
ttggcttataaacacat

SEQ ID NO: 4160791 - DNA, 20 bp, Homo sapiens
ttggcttataaacacattga

SEQ ID NO: 4160792 - DNA, 17 bp, Homo sapiens
ttggctttatgcacatt

SEQ ID NO: 4160793 - DNA, 16 bp, Homo sapiens
ttggctttgtttggat

SEQ ID NO: 4160794 - DNA, 20 bp, Homo sapiens
ttgggaaaaaaacttggcac

SEQ ID NO: 4160795 - DNA, 19 bp, Homo sapiens
ttgggacaacagtgctttg

SEQ ID NO: 4160796 - DNA, 21 bp, Homo sapiens
ttgggacccaaaacacaggaa

SEQ ID NO: 4160797 - DNA, 18 bp, Homo sapiens
ttgggatcccaccctggg

SEQ ID NO: 4160798 - DNA, 19 bp, Homo sapiens
ttgggcagaagggagaagg

SEQ ID NO: 4160799 - DNA, 16 bp, Homo sapiens
ttgggcagtgccccag

SEQ ID NO: 4160800 - DNA, 14 bp, Homo sapiens
ttgggccagacatg

SEQ ID NO: 4160801 - DNA, 22 bp, Homo sapiens
ttgggccccagaccccagggca

SEQ ID NO: 4160802 - DNA, 16 bp, Homo sapiens
ttgggcccctcagagc

SEQ ID NO: 4160803 - DNA, 15 bp, Homo sapiens
ttgggccctgcacag

SEQ ID NO: 4160804 - DNA, 20 bp, Homo sapiens
ttgggcctgctccagacctg

SEQ ID NO: 4160805 - DNA, 16 bp, Homo sapiens
ttgggccttgctgctg

SEQ ID NO: 4160806 - DNA, 18 bp, Homo sapiens
ttggggaaaaaagcacat

SEQ ID NO: 4160807 - DNA, 23 bp, Homo sapiens
ttggggagcaggaggccaataaa

SEQ ID NO: 4160808 - DNA, 21 bp, Homo sapiens
ttggggagggaggggaaatgt

SEQ ID NO: 4160809 - DNA, 16 bp, Homo sapiens
ttggggatgtttttct

SEQ ID NO: 4160810 - DNA, 13 bp, Homo sapiens
ttggggccctgcc

SEQ ID NO: 4160811 - DNA, 17 bp, Homo sapiens
ttggggggactctgagc

SEQ ID NO: 4160812 - DNA, 20 bp, Homo sapiens
ttggggggccgggcaggtcc

SEQ ID NO: 4160813 - DNA, 19 bp, Homo sapiens
ttgggggggaccctgcctc

SEQ ID NO: 4160814 - DNA, 15 bp, Homo sapiens
ttgggggtttttaat

SEQ ID NO: 4160815 - DNA, 19 bp, Homo sapiens
ttggggtactcttgatgtg

SEQ ID NO: 4160816 - DNA, 23 bp, Homo sapiens
ttggggtactcttgatgtgaaga

SEQ ID NO: 4160817 - DNA, 23 bp, Homo sapiens
ttggggtcaagaaacagccagca

SEQ ID NO: 4160818 - DNA, 15 bp, Homo sapiens
ttggggtcagccagg

SEQ ID NO: 4160819 - DNA, 16 bp, Homo sapiens
ttggggtcagccaggg

SEQ ID NO: 4160820 - DNA, 22 bp, Homo sapiens
ttggggtctcttttgtaaatta

SEQ ID NO: 4160821 - DNA, 17 bp, Homo sapiens
ttggggtctggcagcct

SEQ ID NO: 4160822 - DNA, 19 bp, Homo sapiens
ttggggttctacagtcgta

SEQ ID NO: 4160823 - DNA, 12 bp, Homo sapiens
ttgggtcattga

SEQ ID NO: 4160824 - DNA, 23 bp, Homo sapiens
ttgggtcattgacctctcagggc

SEQ ID NO: 4160825 - DNA, 17 bp, Homo sapiens
ttgggttccaaccaggc

SEQ ID NO: 4160826 - DNA, 20 bp, Homo sapiens
ttgggttccaaccaggcagt

SEQ ID NO: 4160827 - DNA, 21 bp, Homo sapiens
ttggtagagaaggagcagaaa

SEQ ID NO: 4160828 - DNA, 19 bp, Homo sapiens
ttggtagatgcatgacttg

SEQ ID NO: 4160829 - DNA, 16 bp, Homo sapiens
ttggtataatgtttaa

SEQ ID NO: 4160830 - DNA, 18 bp, Homo sapiens
ttggtatagccatgattt

SEQ ID NO: 4160831 - DNA, 17 bp, Homo sapiens
ttggtccaaaaaaagga

SEQ ID NO: 4160832 - DNA, 22 bp, Homo sapiens
ttggtccaaaaaaaggaaaaat

SEQ ID NO: 4160833 - DNA, 15 bp, Homo sapiens
ttggtctgtgttcaa

SEQ ID NO: 4160834 - DNA, 15 bp, Homo sapiens
ttggtgaacagtttt

SEQ ID NO: 4160835 - DNA, 16 bp, Homo sapiens
ttggtgcaacccttac

SEQ ID NO: 4160836 - DNA, 13 bp, Homo sapiens
ttggtgctggttt

SEQ ID NO: 4160837 - DNA, 22 bp, Homo sapiens
ttggtggcacacgcctgtaatc

SEQ ID NO: 4160838 - DNA, 15 bp, Homo sapiens
ttggtggcttatggg

SEQ ID NO: 4160839 - DNA, 18 bp, Homo sapiens
ttggtgggtgaaaggaat

SEQ ID NO: 4160840 - DNA, 20 bp, Homo sapiens
ttggtgtaaagccaacaccc

SEQ ID NO: 4160841 - DNA, 19 bp, Homo sapiens
ttggtgtgattgcacagaa

SEQ ID NO: 4160842 - DNA, 14 bp, Homo sapiens
ttggtgtgctgagg

SEQ ID NO: 4160843 - DNA, 16 bp, Homo sapiens
ttggtgtgtggagatg

SEQ ID NO: 4160844 - DNA, 15 bp, Homo sapiens
ttggttcataaatga

SEQ ID NO: 4160845 - DNA, 20 bp, Homo sapiens
ttggttcattaattctataa

SEQ ID NO: 4160846 - DNA, 18 bp, Homo sapiens
ttggttcgatacctggag

SEQ ID NO: 4160847 - DNA, 19 bp, Homo sapiens
ttggttctaatagaactca

SEQ ID NO: 4160848 - DNA, 16 bp, Homo sapiens
ttggttctctccagga

SEQ ID NO: 4160849 - DNA, 14 bp, Homo sapiens
ttggttggaagcta

SEQ ID NO: 4160850 - DNA, 22 bp, Homo sapiens
ttggttggaagctaccagagct

SEQ ID NO: 4160851 - DNA, 22 bp, Homo sapiens
ttggttgtcaatattaaataca

SEQ ID NO: 4160852 - DNA, 15 bp, Homo sapiens
ttggttgtgtctttt

SEQ ID NO: 4160853 - DNA, 13 bp, Homo sapiens
ttggtttacattt

SEQ ID NO: 4160854 - DNA, 22 bp, Homo sapiens
ttggtttagcccaagtggagcc

SEQ ID NO: 4160855 - DNA, 18 bp, Homo sapiens
ttggtttatttttgtaat

SEQ ID NO: 4160856 - DNA, 19 bp, Homo sapiens
ttggtttatttttgtaatg

SEQ ID NO: 4160857 - DNA, 13 bp, Homo sapiens
ttggttttatggt

SEQ ID NO: 4160858 - DNA, 23 bp, Homo sapiens
ttgtaaaaaaaaatgcctttgag

SEQ ID NO: 4160859 - DNA, 21 bp, Homo sapiens
ttgtaaaaacagcattgcttt

SEQ ID NO: 4160860 - DNA, 12 bp, Homo sapiens
ttgtaaagactg

SEQ ID NO: 4160861 - DNA, 13 bp, Homo sapiens
ttgtaaagactgg

SEQ ID NO: 4160862 - DNA, 21 bp, Homo sapiens
ttgtaaagactggttttctgc

SEQ ID NO: 4160863 - DNA, 13 bp, Homo sapiens
ttgtaaataagag

SEQ ID NO: 4160864 - DNA, 13 bp, Homo sapiens
ttgtaaatacacc

SEQ ID NO: 4160865 - DNA, 11 bp, Homo sapiens
ttgtaaatgat

SEQ ID NO: 4160866 - DNA, 21 bp, Homo sapiens
ttgtaaatgattttaatttta

SEQ ID NO: 4160867 - DNA, 13 bp, Homo sapiens
ttgtaaattattt

SEQ ID NO: 4160868 - DNA, 12 bp, Homo sapiens
ttgtaaattgtg

SEQ ID NO: 4160869 - DNA, 19 bp, Homo sapiens
ttgtaaatttcagggtttt

SEQ ID NO: 4160870 - DNA, 16 bp, Homo sapiens
ttgtaacccagatttt

SEQ ID NO: 4160871 - DNA, 16 bp, Homo sapiens
ttgtaacctcagctct

SEQ ID NO: 4160872 - DNA, 17 bp, Homo sapiens
ttgtaacctgcattttt

SEQ ID NO: 4160873 - DNA, 19 bp, Homo sapiens
ttgtaagagtgtagaagca

SEQ ID NO: 4160874 - DNA, 17 bp, Homo sapiens
ttgtaagttgtacaaat

SEQ ID NO: 4160875 - DNA, 17 bp, Homo sapiens
ttgtaagtttcaggtga

SEQ ID NO: 4160876 - DNA, 13 bp, Homo sapiens
ttgtaataagcaa

SEQ ID NO: 4160877 - DNA, 20 bp, Homo sapiens
ttgtaataagcaatcaaggt

SEQ ID NO: 4160878 - DNA, 15 bp, Homo sapiens
ttgtaatctgaataa

SEQ ID NO: 4160879 - DNA, 19 bp, Homo sapiens
ttgtaatgtgaaaagtatc

SEQ ID NO: 4160880 - DNA, 17 bp, Homo sapiens
ttgtaatgtgtgaaaaa

SEQ ID NO: 4160881 - DNA, 14 bp, Homo sapiens
ttgtaattatgatt

SEQ ID NO: 4160882 - DNA, 17 bp, Homo sapiens
ttgtaattctaaatgaa

SEQ ID NO: 4160883 - DNA, 12 bp, Homo sapiens
ttgtaattgctt

SEQ ID NO: 4160884 - DNA, 23 bp, Homo sapiens
ttgtaattgtgtaaaaaatggaa

SEQ ID NO: 4160885 - DNA, 23 bp, Homo sapiens
ttgtaatttttttaatttacaaa

SEQ ID NO: 4160886 - DNA, 20 bp, Homo sapiens
ttgtacaaatgtattttgaa

SEQ ID NO: 4160887 - DNA, 15 bp, Homo sapiens
ttgtacactgctgta

SEQ ID NO: 4160888 - DNA, 18 bp, Homo sapiens
ttgtacagtgtctgtgcc

SEQ ID NO: 4160889 - DNA, 17 bp, Homo sapiens
ttgtacatttatgattt

SEQ ID NO: 4160890 - DNA, 21 bp, Homo sapiens
ttgtacctgtaggactctcat

SEQ ID NO: 4160891 - DNA, 14 bp, Homo sapiens
ttgtactgaatttt

SEQ ID NO: 4160892 - DNA, 22 bp, Homo sapiens
ttgtagaactcactctgggctg

SEQ ID NO: 4160893 - DNA, 18 bp, Homo sapiens
ttgtagagtgtagactgt

SEQ ID NO: 4160894 - DNA, 15 bp, Homo sapiens
ttgtagatttagtgt

SEQ ID NO: 4160895 - DNA, 14 bp, Homo sapiens
ttgtagcactgagg

SEQ ID NO: 4160896 - DNA, 17 bp, Homo sapiens
ttgtaggataagtgaaa

SEQ ID NO: 4160897 - DNA, 22 bp, Homo sapiens
ttgtagtagcgttttttaaatg

SEQ ID NO: 4160898 - DNA, 15 bp, Homo sapiens
ttgtagtagtctcat

SEQ ID NO: 4160899 - DNA, 19 bp, Homo sapiens
ttgtagtgttcagaaaaaa

SEQ ID NO: 4160900 - DNA, 21 bp, Homo sapiens
ttgtatatacagttattttgg

SEQ ID NO: 4160901 - DNA, 22 bp, Homo sapiens
ttgtatatagagattgtacatt

SEQ ID NO: 4160902 - DNA, 20 bp, Homo sapiens
ttgtatattatggaagattt

SEQ ID NO: 4160903 - DNA, 13 bp, Homo sapiens
ttgtatattgtgt

SEQ ID NO: 4160904 - DNA, 13 bp, Homo sapiens
ttgtatatttgta

SEQ ID NO: 4160905 - DNA, 15 bp, Homo sapiens
ttgtatatttgtaca

SEQ ID NO: 4160906 - DNA, 18 bp, Homo sapiens
ttgtatatttgtacaaaa

SEQ ID NO: 4160907 - DNA, 17 bp, Homo sapiens
ttgtatctagtgcagct

SEQ ID NO: 4160908 - DNA, 13 bp, Homo sapiens
ttgtattaaactc

SEQ ID NO: 4160909 - DNA, 14 bp, Homo sapiens
ttgtattaaagaca

SEQ ID NO: 4160910 - DNA, 13 bp, Homo sapiens
ttgtattatttgg

SEQ ID NO: 4160911 - DNA, 17 bp, Homo sapiens
ttgtattgctgctgtgc

SEQ ID NO: 4160912 - DNA, 16 bp, Homo sapiens
ttgtatttatgtgtat

SEQ ID NO: 4160913 - DNA, 22 bp, Homo sapiens
ttgtatttattaatttgaaacc

SEQ ID NO: 4160914 - DNA, 14 bp, Homo sapiens
ttgtcaatattaaa

SEQ ID NO: 4160915 - DNA, 18 bp, Homo sapiens
ttgtcaatattaaataca

SEQ ID NO: 4160916 - DNA, 18 bp, Homo sapiens
ttgtcagactttaaagaa

SEQ ID NO: 4160917 - DNA, 20 bp, Homo sapiens
ttgtcagactttaaagaata

SEQ ID NO: 4160918 - DNA, 15 bp, Homo sapiens
ttgtcagtgacagta

SEQ ID NO: 4160919 - DNA, 12 bp, Homo sapiens
ttgtcattaaag

SEQ ID NO: 4160920 - DNA, 15 bp, Homo sapiens
ttgtcattgctgttg

SEQ ID NO: 4160921 - DNA, 19 bp, Homo sapiens
ttgtccagagctgcttccc

SEQ ID NO: 4160922 - DNA, 19 bp, Homo sapiens
ttgtccagctgagcgccag

SEQ ID NO: 4160923 - DNA, 21 bp, Homo sapiens
ttgtcctaagtgtcaagtcct

SEQ ID NO: 4160924 - DNA, 17 bp, Homo sapiens
ttgtcctcagtccattt

SEQ ID NO: 4160925 - DNA, 19 bp, Homo sapiens
ttgtcctcctgctgccagt

SEQ ID NO: 4160926 - DNA, 15 bp, Homo sapiens
ttgtcctcttctgct

SEQ ID NO: 4160927 - DNA, 18 bp, Homo sapiens
ttgtcctcttctgctctt

SEQ ID NO: 4160928 - DNA, 19 bp, Homo sapiens
ttgtcctgatgcttttgtc

SEQ ID NO: 4160929 - DNA, 20 bp, Homo sapiens
ttgtcctttaaaaaagaaaa

SEQ ID NO: 4160930 - DNA, 19 bp, Homo sapiens
ttgtcgctttctcagtgtg

SEQ ID NO: 4160931 - DNA, 16 bp, Homo sapiens
ttgtctaaaatgtcag

SEQ ID NO: 4160932 - DNA, 11 bp, Homo sapiens
ttgtctatttt

SEQ ID NO: 4160933 - DNA, 16 bp, Homo sapiens
ttgtctattttaaaat

SEQ ID NO: 4160934 - DNA, 23 bp, Homo sapiens
ttgtctcaacgcctccccctccc

SEQ ID NO: 4160935 - DNA, 23 bp, Homo sapiens
ttgtctccactaaatgagctcct

SEQ ID NO: 4160936 - DNA, 18 bp, Homo sapiens
ttgtctcctactcctgac

SEQ ID NO: 4160937 - DNA, 13 bp, Homo sapiens
ttgtctctcctgg

SEQ ID NO: 4160938 - DNA, 18 bp, Homo sapiens
ttgtctgaagtcactgca

SEQ ID NO: 4160939 - DNA, 20 bp, Homo sapiens
ttgtctgaagtcactgcaca

SEQ ID NO: 4160940 - DNA, 20 bp, Homo sapiens
ttgtcttttcagaagcaagc

SEQ ID NO: 4160941 - DNA, 17 bp, Homo sapiens
ttgtgaaacacagctgt

SEQ ID NO: 4160942 - DNA, 17 bp, Homo sapiens
ttgtgaactttttgtag

SEQ ID NO: 4160943 - DNA, 19 bp, Homo sapiens
ttgtgaagaaaaataaagt

SEQ ID NO: 4160944 - DNA, 14 bp, Homo sapiens
ttgtgaagtacata

SEQ ID NO: 4160945 - DNA, 14 bp, Homo sapiens
ttgtgaatggattg

SEQ ID NO: 4160946 - DNA, 21 bp, Homo sapiens
ttgtgacaggaaagccctccc

SEQ ID NO: 4160947 - DNA, 23 bp, Homo sapiens
ttgtgacaggaaagccctccccc

SEQ ID NO: 4160948 - DNA, 15 bp, Homo sapiens
ttgtgagagcgaggc

SEQ ID NO: 4160949 - DNA, 23 bp, Homo sapiens
ttgtgaggattatgggtcctgca

SEQ ID NO: 4160950 - DNA, 13 bp, Homo sapiens
ttgtgataattta

SEQ ID NO: 4160951 - DNA, 14 bp, Homo sapiens
ttgtgataatttaa

SEQ ID NO: 4160952 - DNA, 15 bp, Homo sapiens
ttgtgatagcacttt

SEQ ID NO: 4160953 - DNA, 20 bp, Homo sapiens
ttgtgatgaatcaatgaaaa

SEQ ID NO: 4160954 - DNA, 16 bp, Homo sapiens
ttgtgatgatgctgtg

SEQ ID NO: 4160955 - DNA, 17 bp, Homo sapiens
ttgtgatgatgctgtga

SEQ ID NO: 4160956 - DNA, 16 bp, Homo sapiens
ttgtgatttttataat

SEQ ID NO: 4160957 - DNA, 15 bp, Homo sapiens
ttgtgcacaggcaga

SEQ ID NO: 4160958 - DNA, 16 bp, Homo sapiens
ttgtgcatttgttcag

SEQ ID NO: 4160959 - DNA, 14 bp, Homo sapiens
ttgtgctacagatg

SEQ ID NO: 4160960 - DNA, 20 bp, Homo sapiens
ttgtgctcctcttgattcct

SEQ ID NO: 4160961 - DNA, 23 bp, Homo sapiens
ttgtgctcctcttgattcctggt

SEQ ID NO: 4160962 - DNA, 21 bp, Homo sapiens
ttgtgctgtgggcagcaccct

SEQ ID NO: 4160963 - DNA, 22 bp, Homo sapiens
ttgtgctgtgggcagcaccctc

SEQ ID NO: 4160964 - DNA, 19 bp, Homo sapiens
ttgtgcttgtcattccaga

SEQ ID NO: 4160965 - DNA, 14 bp, Homo sapiens
ttgtgcttttcctg

SEQ ID NO: 4160966 - DNA, 22 bp, Homo sapiens
ttgtggaatggagattcagttt

SEQ ID NO: 4160967 - DNA, 15 bp, Homo sapiens
ttgtggcaattttat

SEQ ID NO: 4160968 - DNA, 20 bp, Homo sapiens
ttgtggccccttttactttt

SEQ ID NO: 4160969 - DNA, 14 bp, Homo sapiens
ttgtggctgggggc

SEQ ID NO: 4160970 - DNA, 19 bp, Homo sapiens
ttgtggtgtaaagctggcc

SEQ ID NO: 4160971 - DNA, 21 bp, Homo sapiens
ttgtggtgtaaagctggccct

SEQ ID NO: 4160972 - DNA, 20 bp, Homo sapiens
ttgtggttctattttacttt

SEQ ID NO: 4160973 - DNA, 23 bp, Homo sapiens
ttgtgtaatgaaaatgaatatct

SEQ ID NO: 4160974 - DNA, 19 bp, Homo sapiens
ttgtgtatttacgctttga

SEQ ID NO: 4160975 - DNA, 22 bp, Homo sapiens
ttgtgtatttacgctttgattc

SEQ ID NO: 4160976 - DNA, 23 bp, Homo sapiens
ttgtgtatttacgctttgattca

SEQ ID NO: 4160977 - DNA, 14 bp, Homo sapiens
ttgtgtctgttgct

SEQ ID NO: 4160978 - DNA, 19 bp, Homo sapiens
ttgtgtgtcttaattatta

SEQ ID NO: 4160979 - DNA, 20 bp, Homo sapiens
ttgtgtgtgtgtcagctgag

SEQ ID NO: 4160980 - DNA, 18 bp, Homo sapiens
ttgtgtgtttatttcact

SEQ ID NO: 4160981 - DNA, 20 bp, Homo sapiens
ttgtgttcctacagacactt

SEQ ID NO: 4160982 - DNA, 11 bp, Homo sapiens
ttgtgttcctg

SEQ ID NO: 4160983 - DNA, 12 bp, Homo sapiens
ttgtgttcctgg

SEQ ID NO: 4160984 - DNA, 15 bp, Homo sapiens
ttgtgttcctggctg

SEQ ID NO: 4160985 - DNA, 16 bp, Homo sapiens
ttgtgttcctggctga

SEQ ID NO: 4160986 - DNA, 20 bp, Homo sapiens
ttgtgttcctggctgatgat

SEQ ID NO: 4160987 - DNA, 13 bp, Homo sapiens
ttgtgttgtaatt

SEQ ID NO: 4160988 - DNA, 14 bp, Homo sapiens
ttgtgttgtaattc

SEQ ID NO: 4160989 - DNA, 13 bp, Homo sapiens
ttgtgttgtgaat

SEQ ID NO: 4160990 - DNA, 18 bp, Homo sapiens
ttgtgtttggtttacatt

SEQ ID NO: 4160991 - DNA, 17 bp, Homo sapiens
ttgtgtttgtgtattta

SEQ ID NO: 4160992 - DNA, 19 bp, Homo sapiens
ttgttaatgaaaatgtcag

SEQ ID NO: 4160993 - DNA, 22 bp, Homo sapiens
ttgttacacattaagtaatcaa

SEQ ID NO: 4160994 - DNA, 20 bp, Homo sapiens
ttgttaccactggtaacatg

SEQ ID NO: 4160995 - DNA, 23 bp, Homo sapiens
ttgttacctccaacagaactaaa

SEQ ID NO: 4160996 - DNA, 22 bp, Homo sapiens
ttgttagaaaacaaaattttat

SEQ ID NO: 4160997 - DNA, 16 bp, Homo sapiens
ttgttagcccttcaga

SEQ ID NO: 4160998 - DNA, 20 bp, Homo sapiens
ttgttagcttccttaagtat

SEQ ID NO: 4160999 - DNA, 16 bp, Homo sapiens
ttgttagtttacaata

SEQ ID NO: 4161000 - DNA, 16 bp, Homo sapiens
ttgttagtttagtgtg

SEQ ID NO: 4161001 - DNA, 17 bp, Homo sapiens
ttgttagtttagtgtgt

SEQ ID NO: 4161002 - DNA, 22 bp, Homo sapiens
ttgttagtttagtgtgtgtgca

SEQ ID NO: 4161003 - DNA, 21 bp, Homo sapiens
ttgttattccatcaataaatg

SEQ ID NO: 4161004 - DNA, 23 bp, Homo sapiens
ttgttatttgaaaacatgtttat

SEQ ID NO: 4161005 - DNA, 22 bp, Homo sapiens
ttgttcaataataaatattttt

SEQ ID NO: 4161006 - DNA, 15 bp, Homo sapiens
ttgttcactgaaggt

SEQ ID NO: 4161007 - DNA, 16 bp, Homo sapiens
ttgttcagctccccca

SEQ ID NO: 4161008 - DNA, 17 bp, Homo sapiens
ttgttcagctcccccag

SEQ ID NO: 4161009 - DNA, 21 bp, Homo sapiens
ttgttcatttcatcctttcac

SEQ ID NO: 4161010 - DNA, 12 bp, Homo sapiens
ttgttccagctc

SEQ ID NO: 4161011 - DNA, 22 bp, Homo sapiens
ttgttctccgggtgtggcctca

SEQ ID NO: 4161012 - DNA, 18 bp, Homo sapiens
ttgttgaaattttgcaaa

SEQ ID NO: 4161013 - DNA, 19 bp, Homo sapiens
ttgttgaacatacttcaaa

SEQ ID NO: 4161014 - DNA, 17 bp, Homo sapiens
ttgttgacttattttct

SEQ ID NO: 4161015 - DNA, 22 bp, Homo sapiens
ttgttgaggtggtctgaatgtt

SEQ ID NO: 4161016 - DNA, 21 bp, Homo sapiens
ttgttgatgggcacttgagaa

SEQ ID NO: 4161017 - DNA, 20 bp, Homo sapiens
ttgttgcaagatgtgaatta

SEQ ID NO: 4161018 - DNA, 16 bp, Homo sapiens
ttgttgcgttcctttc

SEQ ID NO: 4161019 - DNA, 20 bp, Homo sapiens
ttgttggagtgtttctaata

SEQ ID NO: 4161020 - DNA, 18 bp, Homo sapiens
ttgttgtaacctgctgtg

SEQ ID NO: 4161021 - DNA, 17 bp, Homo sapiens
ttgttgtataatttcga

SEQ ID NO: 4161022 - DNA, 16 bp, Homo sapiens
ttgttgtgatgtcttt

SEQ ID NO: 4161023 - DNA, 18 bp, Homo sapiens
ttgtttaaaattcagttt

SEQ ID NO: 4161024 - DNA, 16 bp, Homo sapiens
ttgtttaaagaataaa

SEQ ID NO: 4161025 - DNA, 12 bp, Homo sapiens
ttgtttatgtaa

SEQ ID NO: 4161026 - DNA, 23 bp, Homo sapiens
ttgtttcaatgaggtgtccaact

SEQ ID NO: 4161027 - DNA, 21 bp, Homo sapiens
ttgtttcctcttccaaagtaa

SEQ ID NO: 4161028 - DNA, 17 bp, Homo sapiens
ttgtttctctgttgtaa

SEQ ID NO: 4161029 - DNA, 21 bp, Homo sapiens
ttgtttctgaaaattccagaa

SEQ ID NO: 4161030 - DNA, 23 bp, Homo sapiens
ttgtttgctcttttaagcagtct

SEQ ID NO: 4161031 - DNA, 12 bp, Homo sapiens
ttgtttgctgct

SEQ ID NO: 4161032 - DNA, 15 bp, Homo sapiens
ttgtttgcttattgt

SEQ ID NO: 4161033 - DNA, 16 bp, Homo sapiens
ttgtttggcaaggaaa

SEQ ID NO: 4161034 - DNA, 17 bp, Homo sapiens
ttgtttggcaaggaaag

SEQ ID NO: 4161035 - DNA, 18 bp, Homo sapiens
ttgtttggcaaggaaagg

SEQ ID NO: 4161036 - DNA, 12 bp, Homo sapiens
ttgtttgtttct

SEQ ID NO: 4161037 - DNA, 15 bp, Homo sapiens
ttgttttaagcaaat

SEQ ID NO: 4161038 - DNA, 13 bp, Homo sapiens
ttgttttaatctg

SEQ ID NO: 4161039 - DNA, 17 bp, Homo sapiens
ttgttttctgactaatt

SEQ ID NO: 4161040 - DNA, 11 bp, Homo sapiens
ttgttttctgt

SEQ ID NO: 4161041 - DNA, 19 bp, Homo sapiens
ttgttttgacggatgattg

SEQ ID NO: 4161042 - DNA, 23 bp, Homo sapiens
ttgttttgatgtttgtggcctca

SEQ ID NO: 4161043 - DNA, 15 bp, Homo sapiens
ttgttttgcactttt

SEQ ID NO: 4161044 - DNA, 13 bp, Homo sapiens
ttgtttttcattc

SEQ ID NO: 4161045 - DNA, 16 bp, Homo sapiens
ttgtttttgctttctg

SEQ ID NO: 4161046 - DNA, 21 bp, Homo sapiens
ttgtttttgtatttattaatt

SEQ ID NO: 4161047 - DNA, 17 bp, Homo sapiens
tttaaaaaaatttaagt

SEQ ID NO: 4161048 - DNA, 18 bp, Homo sapiens
tttaaaaaaatttaagtg

SEQ ID NO: 4161049 - DNA, 18 bp, Homo sapiens
tttaaaaaatatttatta

SEQ ID NO: 4161050 - DNA, 19 bp, Homo sapiens
tttaaaaaatatttattaa

SEQ ID NO: 4161051 - DNA, 22 bp, Homo sapiens
tttaaaaaatatttattaaata

SEQ ID NO: 4161052 - DNA, 18 bp, Homo sapiens
tttaaaaacaaaaggcaa

SEQ ID NO: 4161053 - DNA, 18 bp, Homo sapiens
tttaaaaacatagaaaaa

SEQ ID NO: 4161054 - DNA, 13 bp, Homo sapiens
tttaaaaagaaaa

SEQ ID NO: 4161055 - DNA, 17 bp, Homo sapiens
tttaaaaagaaatctgg

SEQ ID NO: 4161056 - DNA, 17 bp, Homo sapiens
tttaaaaatagacactc

SEQ ID NO: 4161057 - DNA, 16 bp, Homo sapiens
tttaaaaatatttcag

SEQ ID NO: 4161058 - DNA, 14 bp, Homo sapiens
tttaaaaatatttt

SEQ ID NO: 4161059 - DNA, 15 bp, Homo sapiens
tttaaaacagtattt

SEQ ID NO: 4161060 - DNA, 17 bp, Homo sapiens
tttaaaaggaaagaaaa

SEQ ID NO: 4161061 - DNA, 16 bp, Homo sapiens
tttaaaataaaatgaa

SEQ ID NO: 4161062 - DNA, 19 bp, Homo sapiens
tttaaaataaaatgaaaat

SEQ ID NO: 4161063 - DNA, 19 bp, Homo sapiens
tttaaaataaattcctaca

SEQ ID NO: 4161064 - DNA, 18 bp, Homo sapiens
tttaaaatatttagtcta

SEQ ID NO: 4161065 - DNA, 14 bp, Homo sapiens
tttaaaatgattag

SEQ ID NO: 4161066 - DNA, 16 bp, Homo sapiens
tttaaaattacaacta

SEQ ID NO: 4161067 - DNA, 15 bp, Homo sapiens
tttaaaattcagttt

SEQ ID NO: 4161068 - DNA, 20 bp, Homo sapiens
tttaaaattccattatctta

SEQ ID NO: 4161069 - DNA, 14 bp, Homo sapiens
tttaaacaaattca

SEQ ID NO: 4161070 - DNA, 23 bp, Homo sapiens
tttaaacacacagatacacacac

SEQ ID NO: 4161071 - DNA, 17 bp, Homo sapiens
tttaaacagtatttcat

SEQ ID NO: 4161072 - DNA, 13 bp, Homo sapiens
tttaaagaataaa

SEQ ID NO: 4161073 - DNA, 15 bp, Homo sapiens
tttaaaggaaaaaat

SEQ ID NO: 4161074 - DNA, 21 bp, Homo sapiens
tttaaaggaaaaaatgttgga

SEQ ID NO: 4161075 - DNA, 20 bp, Homo sapiens
tttaaaggtttttaaattgt

SEQ ID NO: 4161076 - DNA, 18 bp, Homo sapiens
tttaaagtgtttcagcta

SEQ ID NO: 4161077 - DNA, 20 bp, Homo sapiens
tttaaagttgcacatgattg

SEQ ID NO: 4161078 - DNA, 16 bp, Homo sapiens
tttaaataaagaacaa

SEQ ID NO: 4161079 - DNA, 21 bp, Homo sapiens
tttaaatacttcatgagcatt

SEQ ID NO: 4161080 - DNA, 18 bp, Homo sapiens
tttaaatataattctgta

SEQ ID NO: 4161081 - DNA, 21 bp, Homo sapiens
tttaaatcatgtatgttatga

SEQ ID NO: 4161082 - DNA, 22 bp, Homo sapiens
tttaaatctaaatctatttatt

SEQ ID NO: 4161083 - DNA, 17 bp, Homo sapiens
tttaaatggcagtattt

SEQ ID NO: 4161084 - DNA, 18 bp, Homo sapiens
tttaaatgtgtacaatgt

SEQ ID NO: 4161085 - DNA, 23 bp, Homo sapiens
tttaaatgtgtacaatgtacaca

SEQ ID NO: 4161086 - DNA, 14 bp, Homo sapiens
tttaaattctgaga

SEQ ID NO: 4161087 - DNA, 14 bp, Homo sapiens
tttaaattgtttca

SEQ ID NO: 4161088 - DNA, 12 bp, Homo sapiens
tttaacaaacta

SEQ ID NO: 4161089 - DNA, 15 bp, Homo sapiens
tttaacaaactaaaa

SEQ ID NO: 4161090 - DNA, 17 bp, Homo sapiens
tttaacaaactaaaaat

SEQ ID NO: 4161091 - DNA, 20 bp, Homo sapiens
tttaacaataactactgtgt

SEQ ID NO: 4161092 - DNA, 20 bp, Homo sapiens
tttaacagctgaattatcta

SEQ ID NO: 4161093 - DNA, 17 bp, Homo sapiens
tttaacagtcatttaaa

SEQ ID NO: 4161094 - DNA, 17 bp, Homo sapiens
tttaactagaatttatt

SEQ ID NO: 4161095 - DNA, 19 bp, Homo sapiens
tttaactttatcacattat

SEQ ID NO: 4161096 - DNA, 20 bp, Homo sapiens
tttaagaaaagcacttttgt

SEQ ID NO: 4161097 - DNA, 17 bp, Homo sapiens
tttaagaaaagtatttt

SEQ ID NO: 4161098 - DNA, 23 bp, Homo sapiens
tttaagaaaagtattttgaagtt

SEQ ID NO: 4161099 - DNA, 20 bp, Homo sapiens
tttaagaaaatacaataaac

SEQ ID NO: 4161100 - DNA, 22 bp, Homo sapiens
tttaagaaaatacaataaacta

SEQ ID NO: 4161101 - DNA, 19 bp, Homo sapiens
tttaagaacttcattttta

SEQ ID NO: 4161102 - DNA, 21 bp, Homo sapiens
tttaagaatatctgtaatggt

SEQ ID NO: 4161103 - DNA, 17 bp, Homo sapiens
tttaagactgaatgttt

SEQ ID NO: 4161104 - DNA, 15 bp, Homo sapiens
tttaagataattata

SEQ ID NO: 4161105 - DNA, 14 bp, Homo sapiens
tttaagatagtgta

SEQ ID NO: 4161106 - DNA, 16 bp, Homo sapiens
tttaagatatccatct

SEQ ID NO: 4161107 - DNA, 23 bp, Homo sapiens
tttaagcaaatgcattctatcgt

SEQ ID NO: 4161108 - DNA, 11 bp, Homo sapiens
tttaagccata

SEQ ID NO: 4161109 - DNA, 12 bp, Homo sapiens
tttaagccttat

SEQ ID NO: 4161110 - DNA, 13 bp, Homo sapiens
tttaagctgtttc

SEQ ID NO: 4161111 - DNA, 15 bp, Homo sapiens
tttaaggaaaggcaa

SEQ ID NO: 4161112 - DNA, 19 bp, Homo sapiens
tttaagggcatgccttgtg

SEQ ID NO: 4161113 - DNA, 20 bp, Homo sapiens
tttaagggcatgccttgtgc

SEQ ID NO: 4161114 - DNA, 21 bp, Homo sapiens
tttaagtaacttaaggacctt

SEQ ID NO: 4161115 - DNA, 21 bp, Homo sapiens
tttaagtagaaaagttgcaga

SEQ ID NO: 4161116 - DNA, 23 bp, Homo sapiens
tttaagtagaaaagttgcagatg

SEQ ID NO: 4161117 - DNA, 15 bp, Homo sapiens
tttaagtatttatat

SEQ ID NO: 4161118 - DNA, 20 bp, Homo sapiens
tttaagtatttatatattta

SEQ ID NO: 4161119 - DNA, 20 bp, Homo sapiens
tttaagtcagtatggtctaa

SEQ ID NO: 4161120 - DNA, 15 bp, Homo sapiens
tttaagtctctcgta

SEQ ID NO: 4161121 - DNA, 18 bp, Homo sapiens
tttaagtgcgtgtgtaga

SEQ ID NO: 4161122 - DNA, 18 bp, Homo sapiens
tttaagtgctttgtaatg

SEQ ID NO: 4161123 - DNA, 19 bp, Homo sapiens
tttaagttcttatgaggag

SEQ ID NO: 4161124 - DNA, 14 bp, Homo sapiens
tttaataaacagta

SEQ ID NO: 4161125 - DNA, 14 bp, Homo sapiens
tttaataaactact

SEQ ID NO: 4161126 - DNA, 21 bp, Homo sapiens
tttaataaactactctttgat

SEQ ID NO: 4161127 - DNA, 14 bp, Homo sapiens
tttaataaagaaat

SEQ ID NO: 4161128 - DNA, 18 bp, Homo sapiens
tttaataaagaaatattt

SEQ ID NO: 4161129 - DNA, 23 bp, Homo sapiens
tttaataaagaaatatttaccta

SEQ ID NO: 4161130 - DNA, 14 bp, Homo sapiens
tttaatacagcagt

SEQ ID NO: 4161131 - DNA, 23 bp, Homo sapiens
tttaatagaaataaattcctaaa

SEQ ID NO: 4161132 - DNA, 19 bp, Homo sapiens
tttaatagaatataattat

SEQ ID NO: 4161133 - DNA, 11 bp, Homo sapiens
tttaatagact

SEQ ID NO: 4161134 - DNA, 15 bp, Homo sapiens
tttaatataaagcct

SEQ ID NO: 4161135 - DNA, 21 bp, Homo sapiens
tttaatattcttttgtttcca

SEQ ID NO: 4161136 - DNA, 19 bp, Homo sapiens
tttaatcaagttgtaactt

SEQ ID NO: 4161137 - DNA, 14 bp, Homo sapiens
tttaatccagaatt

SEQ ID NO: 4161138 - DNA, 15 bp, Homo sapiens
tttaatcctgtacca

SEQ ID NO: 4161139 - DNA, 18 bp, Homo sapiens
tttaatcctgtaccaaat

SEQ ID NO: 4161140 - DNA, 16 bp, Homo sapiens
tttaatccttctttgt

SEQ ID NO: 4161141 - DNA, 18 bp, Homo sapiens
tttaatctgttatgtact

SEQ ID NO: 4161142 - DNA, 17 bp, Homo sapiens
tttaatctttgtgacag

SEQ ID NO: 4161143 - DNA, 23 bp, Homo sapiens
tttaatgaaagactgtacaaagt

SEQ ID NO: 4161144 - DNA, 17 bp, Homo sapiens
tttaatgcttcattcaa

SEQ ID NO: 4161145 - DNA, 22 bp, Homo sapiens
tttaatggacttatttcttcaa

SEQ ID NO: 4161146 - DNA, 12 bp, Homo sapiens
tttaatgtaaag

SEQ ID NO: 4161147 - DNA, 21 bp, Homo sapiens
tttaatgtaaagaacttaaat

SEQ ID NO: 4161148 - DNA, 11 bp, Homo sapiens
tttaattatta

SEQ ID NO: 4161149 - DNA, 15 bp, Homo sapiens
tttaattattttaaa

SEQ ID NO: 4161150 - DNA, 14 bp, Homo sapiens
tttaattcagcaga

SEQ ID NO: 4161151 - DNA, 19 bp, Homo sapiens
tttaattgatttttcttct

SEQ ID NO: 4161152 - DNA, 19 bp, Homo sapiens
tttaatttgatgaaagctg

SEQ ID NO: 4161153 - DNA, 21 bp, Homo sapiens
tttaatttgatgaaagctgat

SEQ ID NO: 4161154 - DNA, 18 bp, Homo sapiens
tttaatttggcttttctt

SEQ ID NO: 4161155 - DNA, 18 bp, Homo sapiens
tttaattttcacaaaatg

SEQ ID NO: 4161156 - DNA, 20 bp, Homo sapiens
tttaattttcacaaaatgtc

SEQ ID NO: 4161157 - DNA, 21 bp, Homo sapiens
tttaattttcacaaaatgtct

SEQ ID NO: 4161158 - DNA, 20 bp, Homo sapiens
tttacaacttgattttttca

SEQ ID NO: 4161159 - DNA, 17 bp, Homo sapiens
tttacaagatccatttg

SEQ ID NO: 4161160 - DNA, 18 bp, Homo sapiens
tttacaagatccatttgc

SEQ ID NO: 4161161 - DNA, 15 bp, Homo sapiens
tttacaatgtcatat

SEQ ID NO: 4161162 - DNA, 15 bp, Homo sapiens
tttacacaattctta

SEQ ID NO: 4161163 - DNA, 16 bp, Homo sapiens
tttacactctttgtaa

SEQ ID NO: 4161164 - DNA, 17 bp, Homo sapiens
tttacagatgaatgtat

SEQ ID NO: 4161165 - DNA, 20 bp, Homo sapiens
tttacagcctcacttgaatg

SEQ ID NO: 4161166 - DNA, 18 bp, Homo sapiens
tttacagtgaccttttct

SEQ ID NO: 4161167 - DNA, 20 bp, Homo sapiens
tttacagttagggttttgca

SEQ ID NO: 4161168 - DNA, 19 bp, Homo sapiens
tttacataacggaaagttt

SEQ ID NO: 4161169 - DNA, 14 bp, Homo sapiens
tttacataactgcc

SEQ ID NO: 4161170 - DNA, 15 bp, Homo sapiens
tttacatgtagtagt

SEQ ID NO: 4161171 - DNA, 16 bp, Homo sapiens
tttacattctagttca

SEQ ID NO: 4161172 - DNA, 20 bp, Homo sapiens
tttacattgtaaatagtatt

SEQ ID NO: 4161173 - DNA, 16 bp, Homo sapiens
tttacattgttgagct

SEQ ID NO: 4161174 - DNA, 10 bp, Homo sapiens
tttacattta

SEQ ID NO: 4161175 - DNA, 17 bp, Homo sapiens
tttacatttaaagcatt

SEQ ID NO: 4161176 - DNA, 18 bp, Homo sapiens
tttacatttaaagcattg

SEQ ID NO: 4161177 - DNA, 13 bp, Homo sapiens
tttacatttttat

SEQ ID NO: 4161178 - DNA, 20 bp, Homo sapiens
tttacatttttatttatgaa

SEQ ID NO: 4161179 - DNA, 20 bp, Homo sapiens
tttaccagttaattactcag

SEQ ID NO: 4161180 - DNA, 14 bp, Homo sapiens
tttaccatttgtaa

SEQ ID NO: 4161181 - DNA, 20 bp, Homo sapiens
tttaccatttgtaataaagt

SEQ ID NO: 4161182 - DNA, 22 bp, Homo sapiens
tttacccagtgggacagaggag

SEQ ID NO: 4161183 - DNA, 22 bp, Homo sapiens
tttaccctaatgtcttcataaa

SEQ ID NO: 4161184 - DNA, 13 bp, Homo sapiens
tttacccttggct

SEQ ID NO: 4161185 - DNA, 17 bp, Homo sapiens
tttacccttttccccct

SEQ ID NO: 4161186 - DNA, 14 bp, Homo sapiens
tttacctagagaac

SEQ ID NO: 4161187 - DNA, 16 bp, Homo sapiens
tttacctgcaaaaaat

SEQ ID NO: 4161188 - DNA, 21 bp, Homo sapiens
tttacctgtgcgttactaatt

SEQ ID NO: 4161189 - DNA, 23 bp, Homo sapiens
tttacctgttctgaaatgttctt

SEQ ID NO: 4161190 - DNA, 13 bp, Homo sapiens
tttaccttgtata

SEQ ID NO: 4161191 - DNA, 13 bp, Homo sapiens
tttacgctttgat

SEQ ID NO: 4161192 - DNA, 13 bp, Homo sapiens
tttactaaacata

SEQ ID NO: 4161193 - DNA, 14 bp, Homo sapiens
tttactaaacatat

SEQ ID NO: 4161194 - DNA, 13 bp, Homo sapiens
tttactctttgaa

SEQ ID NO: 4161195 - DNA, 17 bp, Homo sapiens
tttactgtgaaactggc

SEQ ID NO: 4161196 - DNA, 21 bp, Homo sapiens
tttactgttatttaattgaaa

SEQ ID NO: 4161197 - DNA, 20 bp, Homo sapiens
tttactgttttgaaatcaat

SEQ ID NO: 4161198 - DNA, 16 bp, Homo sapiens
tttacttcacttcaaa

SEQ ID NO: 4161199 - DNA, 13 bp, Homo sapiens
tttacttcttata

SEQ ID NO: 4161200 - DNA, 18 bp, Homo sapiens
tttacttgcattgaatat

SEQ ID NO: 4161201 - DNA, 21 bp, Homo sapiens
tttacttgcattgaatatatt

SEQ ID NO: 4161202 - DNA, 22 bp, Homo sapiens
tttactttattaatatgagtta

SEQ ID NO: 4161203 - DNA, 12 bp, Homo sapiens
tttactttggcc

SEQ ID NO: 4161204 - DNA, 20 bp, Homo sapiens
tttagaaactgatttcttca

SEQ ID NO: 4161205 - DNA, 23 bp, Homo sapiens
tttagaaagaagcccaatattat

SEQ ID NO: 4161206 - DNA, 19 bp, Homo sapiens
tttagaaatactgcaagaa

SEQ ID NO: 4161207 - DNA, 15 bp, Homo sapiens
tttagaagtgcattt

SEQ ID NO: 4161208 - DNA, 19 bp, Homo sapiens
tttagaagtgcatttctga

SEQ ID NO: 4161209 - DNA, 19 bp, Homo sapiens
tttagagataggaaactga

SEQ ID NO: 4161210 - DNA, 14 bp, Homo sapiens
tttagcatgttgtt

SEQ ID NO: 4161211 - DNA, 15 bp, Homo sapiens
tttagcctagttcat

SEQ ID NO: 4161212 - DNA, 17 bp, Homo sapiens
tttagctagtatcttca

SEQ ID NO: 4161213 - DNA, 13 bp, Homo sapiens
tttagcttcattt

SEQ ID NO: 4161214 - DNA, 17 bp, Homo sapiens
tttaggaacttcagaga

SEQ ID NO: 4161215 - DNA, 13 bp, Homo sapiens
tttaggaagtgtt

SEQ ID NO: 4161216 - DNA, 16 bp, Homo sapiens
tttaggagaaaccagc

SEQ ID NO: 4161217 - DNA, 17 bp, Homo sapiens
tttaggagattttaggt

SEQ ID NO: 4161218 - DNA, 23 bp, Homo sapiens
tttaggcgtgggctgaccaggct

SEQ ID NO: 4161219 - DNA, 22 bp, Homo sapiens
tttagggtactaaatttaaatt

SEQ ID NO: 4161220 - DNA, 21 bp, Homo sapiens
tttaggtgaattaattaaaca

SEQ ID NO: 4161221 - DNA, 15 bp, Homo sapiens
tttagtattcattct

SEQ ID NO: 4161222 - DNA, 23 bp, Homo sapiens
tttagtcatccaacaagaagaaa

SEQ ID NO: 4161223 - DNA, 21 bp, Homo sapiens
tttagtctaagatgattcaaa

SEQ ID NO: 4161224 - DNA, 24 bp, Homo sapiens
tttagtgaaggcaagtgcaataat

SEQ ID NO: 4161225 - DNA, 22 bp, Homo sapiens
tttagtgccggctgtggagcaa

SEQ ID NO: 4161226 - DNA, 18 bp, Homo sapiens
tttagtgttagttataaa

SEQ ID NO: 4161227 - DNA, 12 bp, Homo sapiens
tttagtttttct

SEQ ID NO: 4161228 - DNA, 12 bp, Homo sapiens
tttataaacaga

SEQ ID NO: 4161229 - DNA, 23 bp, Homo sapiens
tttataaacagacaatatgtgag

SEQ ID NO: 4161230 - DNA, 24 bp, Homo sapiens
tttataaagtacccatctagtact

SEQ ID NO: 4161231 - DNA, 12 bp, Homo sapiens
tttataaatgct

SEQ ID NO: 4161232 - DNA, 16 bp, Homo sapiens
tttataaccccagcct

SEQ ID NO: 4161233 - DNA, 18 bp, Homo sapiens
tttataactcatcataaa

SEQ ID NO: 4161234 - DNA, 20 bp, Homo sapiens
tttataactcatcataaaat

SEQ ID NO: 4161235 - DNA, 15 bp, Homo sapiens
tttataatcaatgaa

SEQ ID NO: 4161236 - DNA, 12 bp, Homo sapiens
tttataatctga

SEQ ID NO: 4161237 - DNA, 15 bp, Homo sapiens
tttatacaaattaga

SEQ ID NO: 4161238 - DNA, 12 bp, Homo sapiens
tttatacagctg

SEQ ID NO: 4161239 - DNA, 13 bp, Homo sapiens
tttatacagctgt

SEQ ID NO: 4161240 - DNA, 18 bp, Homo sapiens
tttatacagctgtattgt

SEQ ID NO: 4161241 - DNA, 22 bp, Homo sapiens
tttatacagctgtattgtctga

SEQ ID NO: 4161242 - DNA, 16 bp, Homo sapiens
tttatactgaaggaaa

SEQ ID NO: 4161243 - DNA, 18 bp, Homo sapiens
tttatactgaatataaaa

SEQ ID NO: 4161244 - DNA, 21 bp, Homo sapiens
tttatactgtgaagttacatg

SEQ ID NO: 4161245 - DNA, 23 bp, Homo sapiens
tttatactgtgaagttacatgca

SEQ ID NO: 4161246 - DNA, 18 bp, Homo sapiens
tttataggtgagaaaaaa

SEQ ID NO: 4161247 - DNA, 15 bp, Homo sapiens
tttatatatatatct

SEQ ID NO: 4161248 - DNA, 13 bp, Homo sapiens
tttatatatttat

SEQ ID NO: 4161249 - DNA, 15 bp, Homo sapiens
tttatatcatgcaaa

SEQ ID NO: 4161250 - DNA, 21 bp, Homo sapiens
tttatatgtaccgtaggcttt

SEQ ID NO: 4161251 - DNA, 14 bp, Homo sapiens
tttatattaatgta

SEQ ID NO: 4161252 - DNA, 16 bp, Homo sapiens
tttatattaatgtact

SEQ ID NO: 4161253 - DNA, 21 bp, Homo sapiens
tttatattctaagccagtttt

SEQ ID NO: 4161254 - DNA, 17 bp, Homo sapiens
tttatatttaattatta

SEQ ID NO: 4161255 - DNA, 20 bp, Homo sapiens
tttatatttattgttagaaa

SEQ ID NO: 4161256 - DNA, 18 bp, Homo sapiens
tttatatttcctttatgt

SEQ ID NO: 4161257 - DNA, 20 bp, Homo sapiens
tttatatttcctttatgtga

SEQ ID NO: 4161258 - DNA, 21 bp, Homo sapiens
tttatatttcctttatgtgaa

SEQ ID NO: 4161259 - DNA, 12 bp, Homo sapiens
tttatattttta

SEQ ID NO: 4161260 - DNA, 22 bp, Homo sapiens
tttatcaaaccctagccttgct

SEQ ID NO: 4161261 - DNA, 13 bp, Homo sapiens
tttatcaagaagt

SEQ ID NO: 4161262 - DNA, 15 bp, Homo sapiens
tttatcacacttctg

SEQ ID NO: 4161263 - DNA, 16 bp, Homo sapiens
tttatcagatacatca

SEQ ID NO: 4161264 - DNA, 22 bp, Homo sapiens
tttatcagatacatcactgctt

SEQ ID NO: 4161265 - DNA, 21 bp, Homo sapiens
tttatcagtgacagagttcac

SEQ ID NO: 4161266 - DNA, 12 bp, Homo sapiens
tttatcattttc

SEQ ID NO: 4161267 - DNA, 16 bp, Homo sapiens
tttatccaaaatgtgt

SEQ ID NO: 4161268 - DNA, 18 bp, Homo sapiens
tttatccaaaatgtgtat

SEQ ID NO: 4161269 - DNA, 20 bp, Homo sapiens
tttatccaaaatgtgtattt

SEQ ID NO: 4161270 - DNA, 22 bp, Homo sapiens
tttatccaaaatgtgtatttct

SEQ ID NO: 4161271 - DNA, 12 bp, Homo sapiens
tttatctaaatt

SEQ ID NO: 4161272 - DNA, 13 bp, Homo sapiens
tttatctctattt

SEQ ID NO: 4161273 - DNA, 12 bp, Homo sapiens
tttatctgcaga

SEQ ID NO: 4161274 - DNA, 17 bp, Homo sapiens
tttatctgggattatgg

SEQ ID NO: 4161275 - DNA, 16 bp, Homo sapiens
tttatctgtagtaaac

SEQ ID NO: 4161276 - DNA, 13 bp, Homo sapiens
tttatctgtttaa

SEQ ID NO: 4161277 - DNA, 15 bp, Homo sapiens
tttatcttattttct

SEQ ID NO: 4161278 - DNA, 20 bp, Homo sapiens
tttatcttattttctcaatc

SEQ ID NO: 4161279 - DNA, 16 bp, Homo sapiens
tttatctttttacctt

SEQ ID NO: 4161280 - DNA, 13 bp, Homo sapiens
tttatgaaaagag

SEQ ID NO: 4161281 - DNA, 22 bp, Homo sapiens
tttatgagtaactattattata

SEQ ID NO: 4161282 - DNA, 14 bp, Homo sapiens
tttatgatgtatat

SEQ ID NO: 4161283 - DNA, 17 bp, Homo sapiens
tttatgcaaggaaggaa

SEQ ID NO: 4161284 - DNA, 20 bp, Homo sapiens
tttatgcatttgcatttgct

SEQ ID NO: 4161285 - DNA, 19 bp, Homo sapiens
tttatgccttcttattgct

SEQ ID NO: 4161286 - DNA, 22 bp, Homo sapiens
tttatggccacatttaatatct

SEQ ID NO: 4161287 - DNA, 15 bp, Homo sapiens
tttatgtgaattttt

SEQ ID NO: 4161288 - DNA, 22 bp, Homo sapiens
tttatgtgtgaggagctgctgg

SEQ ID NO: 4161289 - DNA, 15 bp, Homo sapiens
tttatgttaaaagat

SEQ ID NO: 4161290 - DNA, 17 bp, Homo sapiens
tttatgttcatttgttt

SEQ ID NO: 4161291 - DNA, 18 bp, Homo sapiens
tttatgttcttatagaat

SEQ ID NO: 4161292 - DNA, 22 bp, Homo sapiens
tttatgtttgtcttttaatgct

SEQ ID NO: 4161293 - DNA, 18 bp, Homo sapiens
tttattaaagcatttcct

SEQ ID NO: 4161294 - DNA, 21 bp, Homo sapiens
tttattaaatacaaaacttcc

SEQ ID NO: 4161295 - DNA, 12 bp, Homo sapiens
tttattaacaaa

SEQ ID NO: 4161296 - DNA, 12 bp, Homo sapiens
tttattaagatg

SEQ ID NO: 4161297 - DNA, 22 bp, Homo sapiens
tttattaagatggattctcaga

SEQ ID NO: 4161298 - DNA, 14 bp, Homo sapiens
tttattaatttgaa

SEQ ID NO: 4161299 - DNA, 14 bp, Homo sapiens
tttattataaactg

SEQ ID NO: 4161300 - DNA, 17 bp, Homo sapiens
tttattcaattcctctg

SEQ ID NO: 4161301 - DNA, 14 bp, Homo sapiens
tttattcacatata

SEQ ID NO: 4161302 - DNA, 17 bp, Homo sapiens
tttattcatctgtgaaa

SEQ ID NO: 4161303 - DNA, 18 bp, Homo sapiens
tttattccagaatgctgt

SEQ ID NO: 4161304 - DNA, 13 bp, Homo sapiens
tttattcctctgt

SEQ ID NO: 4161305 - DNA, 17 bp, Homo sapiens
tttattcctctgtccta

SEQ ID NO: 4161306 - DNA, 16 bp, Homo sapiens
tttattcttccagaat

SEQ ID NO: 4161307 - DNA, 12 bp, Homo sapiens
tttattgtaaaa

SEQ ID NO: 4161308 - DNA, 14 bp, Homo sapiens
tttattgttagaaa

SEQ ID NO: 4161309 - DNA, 15 bp, Homo sapiens
tttatttatcaaaat

SEQ ID NO: 4161310 - DNA, 14 bp, Homo sapiens
tttatttatcagtg

SEQ ID NO: 4161311 - DNA, 14 bp, Homo sapiens
tttatttatgaagt

SEQ ID NO: 4161312 - DNA, 14 bp, Homo sapiens
tttatttattaaga

SEQ ID NO: 4161313 - DNA, 17 bp, Homo sapiens
tttatttctccttttgt

SEQ ID NO: 4161314 - DNA, 21 bp, Homo sapiens
tttatttctccttttgtgttc

SEQ ID NO: 4161315 - DNA, 16 bp, Homo sapiens
tttatttgcaacattt

SEQ ID NO: 4161316 - DNA, 14 bp, Homo sapiens
tttattttaatgta

SEQ ID NO: 4161317 - DNA, 16 bp, Homo sapiens
tttattttcaaatctg

SEQ ID NO: 4161318 - DNA, 10 bp, Homo sapiens
tttattttct

SEQ ID NO: 4161319 - DNA, 23 bp, Homo sapiens
tttatttttacaagaagtttatt

SEQ ID NO: 4161320 - DNA, 15 bp, Homo sapiens
tttatttttctaaaa

SEQ ID NO: 4161321 - DNA, 14 bp, Homo sapiens
tttattttttaagt

SEQ ID NO: 4161322 - DNA, 13 bp, Homo sapiens
tttattttttggt

SEQ ID NO: 4161323 - DNA, 15 bp, Homo sapiens
tttatttttttaagt

SEQ ID NO: 4161324 - DNA, 17 bp, Homo sapiens
tttcaaaaatataactt

SEQ ID NO: 4161325 - DNA, 23 bp, Homo sapiens
tttcaaaagaaatttaagttcta

SEQ ID NO: 4161326 - DNA, 12 bp, Homo sapiens
tttcaaaatgct

SEQ ID NO: 4161327 - DNA, 22 bp, Homo sapiens
tttcaaacttactattttgaca

SEQ ID NO: 4161328 - DNA, 21 bp, Homo sapiens
tttcaaattggactttcaaaa

SEQ ID NO: 4161329 - DNA, 20 bp, Homo sapiens
tttcaaccagataacatacc

SEQ ID NO: 4161330 - DNA, 14 bp, Homo sapiens
tttcaagaacctgg

SEQ ID NO: 4161331 - DNA, 15 bp, Homo sapiens
tttcaagaacctgga

SEQ ID NO: 4161332 - DNA, 16 bp, Homo sapiens
tttcaagaacctggaa

SEQ ID NO: 4161333 - DNA, 20 bp, Homo sapiens
tttcaagcgtcactttattt

SEQ ID NO: 4161334 - DNA, 19 bp, Homo sapiens
tttcaagggctttcctgtg

SEQ ID NO: 4161335 - DNA, 16 bp, Homo sapiens
tttcaagttgtaaata

SEQ ID NO: 4161336 - DNA, 19 bp, Homo sapiens
tttcaataaagcatttata

SEQ ID NO: 4161337 - DNA, 17 bp, Homo sapiens
tttcaatatattgaact

SEQ ID NO: 4161338 - DNA, 19 bp, Homo sapiens
tttcaatatattgaacttt

SEQ ID NO: 4161339 - DNA, 12 bp, Homo sapiens
tttcaattcaga

SEQ ID NO: 4161340 - DNA, 21 bp, Homo sapiens
tttcaattcagattgtcttgc

SEQ ID NO: 4161341 - DNA, 22 bp, Homo sapiens
tttcaattcagattgtcttgca

SEQ ID NO: 4161342 - DNA, 13 bp, Homo sapiens
tttcacaacagat

SEQ ID NO: 4161343 - DNA, 13 bp, Homo sapiens
tttcacagttttt

SEQ ID NO: 4161344 - DNA, 15 bp, Homo sapiens
tttcacagtttttcc

SEQ ID NO: 4161345 - DNA, 14 bp, Homo sapiens
tttcacatagatgt

SEQ ID NO: 4161346 - DNA, 19 bp, Homo sapiens
tttcacattgtttgctgct

SEQ ID NO: 4161347 - DNA, 23 bp, Homo sapiens
tttcacctgtttttaagctgttt

SEQ ID NO: 4161348 - DNA, 19 bp, Homo sapiens
tttcactatcttcttcaaa

SEQ ID NO: 4161349 - DNA, 19 bp, Homo sapiens
tttcactatttttatttat

SEQ ID NO: 4161350 - DNA, 22 bp, Homo sapiens
tttcactgctggctgccttaga

SEQ ID NO: 4161351 - DNA, 24 bp, Homo sapiens
tttcactgctggctgccttagaac

SEQ ID NO: 4161352 - DNA, 21 bp, Homo sapiens
tttcactgtctttaattctgt

SEQ ID NO: 4161353 - DNA, 22 bp, Homo sapiens
tttcacttcaggagaaactgct

SEQ ID NO: 4161354 - DNA, 23 bp, Homo sapiens
tttcacttcaggagaaactgctg

SEQ ID NO: 4161355 - DNA, 23 bp, Homo sapiens
tttcacttgaaagattttattgt

SEQ ID NO: 4161356 - DNA, 22 bp, Homo sapiens
tttcagaaaatattatgtgttt

SEQ ID NO: 4161357 - DNA, 16 bp, Homo sapiens
tttcagaagcaagcca

SEQ ID NO: 4161358 - DNA, 18 bp, Homo sapiens
tttcagaagcaagccaga

SEQ ID NO: 4161359 - DNA, 11 bp, Homo sapiens
tttcagacagg

SEQ ID NO: 4161360 - DNA, 21 bp, Homo sapiens
tttcagactcccattcctgaa

SEQ ID NO: 4161361 - DNA, 12 bp, Homo sapiens
tttcagagattt

SEQ ID NO: 4161362 - DNA, 17 bp, Homo sapiens
tttcagatatcaaaatt

SEQ ID NO: 4161363 - DNA, 18 bp, Homo sapiens
tttcagatatcaaaattc

SEQ ID NO: 4161364 - DNA, 16 bp, Homo sapiens
tttcagcacccccacc

SEQ ID NO: 4161365 - DNA, 18 bp, Homo sapiens
tttcagcacccccaccca

SEQ ID NO: 4161366 - DNA, 19 bp, Homo sapiens
tttcagcacttaactactt

SEQ ID NO: 4161367 - DNA, 22 bp, Homo sapiens
tttcagcacttaactactttgt

SEQ ID NO: 4161368 - DNA, 22 bp, Homo sapiens
tttcagctaagggaagacattt

SEQ ID NO: 4161369 - DNA, 23 bp, Homo sapiens
tttcagctaagggaagacatttc

SEQ ID NO: 4161370 - DNA, 18 bp, Homo sapiens
tttcagctatacctgcac

SEQ ID NO: 4161371 - DNA, 16 bp, Homo sapiens
tttcaggatactctgt

SEQ ID NO: 4161372 - DNA, 20 bp, Homo sapiens
tttcaggatactctgtcaga

SEQ ID NO: 4161373 - DNA, 22 bp, Homo sapiens
tttcagggttttctgagggaaa

SEQ ID NO: 4161374 - DNA, 16 bp, Homo sapiens
tttcaggtgacatgtg

SEQ ID NO: 4161375 - DNA, 19 bp, Homo sapiens
tttcaggtgacatgtgaaa

SEQ ID NO: 4161376 - DNA, 20 bp, Homo sapiens
tttcaggtgacatgtgaaac

SEQ ID NO: 4161377 - DNA, 22 bp, Homo sapiens
tttcaggtgacatgtgaaacct

SEQ ID NO: 4161378 - DNA, 18 bp, Homo sapiens
tttcaggtgtttagttgc

SEQ ID NO: 4161379 - DNA, 15 bp, Homo sapiens
tttcatatgttgctc

SEQ ID NO: 4161380 - DNA, 13 bp, Homo sapiens
tttcatcactggg

SEQ ID NO: 4161381 - DNA, 17 bp, Homo sapiens
tttcatccagtttgttc

SEQ ID NO: 4161382 - DNA, 12 bp, Homo sapiens
tttcatctggtt

SEQ ID NO: 4161383 - DNA, 21 bp, Homo sapiens
tttcattaaacttgaagcagt

SEQ ID NO: 4161384 - DNA, 16 bp, Homo sapiens
tttcattccattgcct

SEQ ID NO: 4161385 - DNA, 23 bp, Homo sapiens
tttcattgcctgtgtatggaaaa

SEQ ID NO: 4161386 - DNA, 23 bp, Homo sapiens
tttcatttaagggaaagaaaatg

SEQ ID NO: 4161387 - DNA, 19 bp, Homo sapiens
tttcatttagtcatgtgac

SEQ ID NO: 4161388 - DNA, 22 bp, Homo sapiens
tttcatttcttacgttctttca

SEQ ID NO: 4161389 - DNA, 22 bp, Homo sapiens
tttcatttcttgtcaattatgt

SEQ ID NO: 4161390 - DNA, 19 bp, Homo sapiens
tttcatttggttcattaat

SEQ ID NO: 4161391 - DNA, 14 bp, Homo sapiens
tttccaaaataatt

SEQ ID NO: 4161392 - DNA, 19 bp, Homo sapiens
tttccaaaatctcccattt

SEQ ID NO: 4161393 - DNA, 15 bp, Homo sapiens
tttccaacaccacag

SEQ ID NO: 4161394 - DNA, 20 bp, Homo sapiens
tttccaacaccacagacaca

SEQ ID NO: 4161395 - DNA, 15 bp, Homo sapiens
tttccaagtaagagt

SEQ ID NO: 4161396 - DNA, 14 bp, Homo sapiens
tttccaattctcct

SEQ ID NO: 4161397 - DNA, 14 bp, Homo sapiens
tttccacgcagttc

SEQ ID NO: 4161398 - DNA, 16 bp, Homo sapiens
tttccacgcagttctt

SEQ ID NO: 4161399 - DNA, 21 bp, Homo sapiens
tttccactgtaattaaaacta

SEQ ID NO: 4161400 - DNA, 12 bp, Homo sapiens
tttccactttgt

SEQ ID NO: 4161401 - DNA, 19 bp, Homo sapiens
tttccagagcattccagtc

SEQ ID NO: 4161402 - DNA, 21 bp, Homo sapiens
tttccagcagaagacaaaaag

SEQ ID NO: 4161403 - DNA, 23 bp, Homo sapiens
tttccagcagaagacaaaaagac

SEQ ID NO: 4161404 - DNA, 19 bp, Homo sapiens
tttccatagcaacaggaaa

SEQ ID NO: 4161405 - DNA, 12 bp, Homo sapiens
tttccatatgtt

SEQ ID NO: 4161406 - DNA, 17 bp, Homo sapiens
tttccatcaactcccaa

SEQ ID NO: 4161407 - DNA, 14 bp, Homo sapiens
tttccatcatttta

SEQ ID NO: 4161408 - DNA, 16 bp, Homo sapiens
tttccatgaaaacgtt

SEQ ID NO: 4161409 - DNA, 23 bp, Homo sapiens
tttccatgcaccctcatacacag

SEQ ID NO: 4161410 - DNA, 18 bp, Homo sapiens
tttccatgggagccagct

SEQ ID NO: 4161411 - DNA, 13 bp, Homo sapiens
tttccatttacta

SEQ ID NO: 4161412 - DNA, 18 bp, Homo sapiens
tttccatttcttcctcac

SEQ ID NO: 4161413 - DNA, 15 bp, Homo sapiens
tttcccaattaggaa

SEQ ID NO: 4161414 - DNA, 20 bp, Homo sapiens
tttcccacaccgtgtaaacc

SEQ ID NO: 4161415 - DNA, 16 bp, Homo sapiens
tttcccaggaccctga

SEQ ID NO: 4161416 - DNA, 14 bp, Homo sapiens
tttcccataatttt

SEQ ID NO: 4161417 - DNA, 21 bp, Homo sapiens
tttcccatcatcctttgttct

SEQ ID NO: 4161418 - DNA, 21 bp, Homo sapiens
tttccccaggggaaaatgaag

SEQ ID NO: 4161419 - DNA, 23 bp, Homo sapiens
tttcccccagcaacgcccctcca

SEQ ID NO: 4161420 - DNA, 12 bp, Homo sapiens
tttccccccact

SEQ ID NO: 4161421 - DNA, 13 bp, Homo sapiens
tttcccccgagct

SEQ ID NO: 4161422 - DNA, 22 bp, Homo sapiens
tttcccccttcccatttcttcc

SEQ ID NO: 4161423 - DNA, 23 bp, Homo sapiens
tttcccccttcccatttcttccc

SEQ ID NO: 4161424 - DNA, 14 bp, Homo sapiens
tttccccctttctt

SEQ ID NO: 4161425 - DNA, 17 bp, Homo sapiens
tttccccctttcttcct

SEQ ID NO: 4161426 - DNA, 21 bp, Homo sapiens
tttccccctttcttcctcatt

SEQ ID NO: 4161427 - DNA, 18 bp, Homo sapiens
tttcccctatcatttatt

SEQ ID NO: 4161428 - DNA, 15 bp, Homo sapiens
tttcccctttcctgt

SEQ ID NO: 4161429 - DNA, 18 bp, Homo sapiens
tttccctcaggttctatt

SEQ ID NO: 4161430 - DNA, 14 bp, Homo sapiens
tttccctggaactc

SEQ ID NO: 4161431 - DNA, 22 bp, Homo sapiens
tttccctggaactcctggcctt

SEQ ID NO: 4161432 - DNA, 20 bp, Homo sapiens
tttcccttctggacactgag

SEQ ID NO: 4161433 - DNA, 23 bp, Homo sapiens
tttccgtttgatttgtcactgct

SEQ ID NO: 4161434 - DNA, 15 bp, Homo sapiens
tttcctaaatgcagt

SEQ ID NO: 4161435 - DNA, 13 bp, Homo sapiens
tttcctaacaaaa

SEQ ID NO: 4161436 - DNA, 24 bp, Homo sapiens
tttcctactctcaggatcaagaaa

SEQ ID NO: 4161437 - DNA, 23 bp, Homo sapiens
tttcctaggcccaggcctgggtt

SEQ ID NO: 4161438 - DNA, 21 bp, Homo sapiens
tttcctcaagtatcttctatt

SEQ ID NO: 4161439 - DNA, 16 bp, Homo sapiens
tttcctccccctgcaa

SEQ ID NO: 4161440 - DNA, 18 bp, Homo sapiens
tttcctcctcaggcacac

SEQ ID NO: 4161441 - DNA, 14 bp, Homo sapiens
tttcctcctctgcc

SEQ ID NO: 4161442 - DNA, 15 bp, Homo sapiens
tttcctcctctgcct

SEQ ID NO: 4161443 - DNA, 13 bp, Homo sapiens
tttcctctgagcc

SEQ ID NO: 4161444 - DNA, 16 bp, Homo sapiens
tttcctctgagcccag

SEQ ID NO: 4161445 - DNA, 23 bp, Homo sapiens
tttcctctgagcccagctgcctg

SEQ ID NO: 4161446 - DNA, 15 bp, Homo sapiens
tttcctcttccaaag

SEQ ID NO: 4161447 - DNA, 23 bp, Homo sapiens
tttcctgacagaaggactcaggt

SEQ ID NO: 4161448 - DNA, 21 bp, Homo sapiens
tttcctgataaagcacagctg

SEQ ID NO: 4161449 - DNA, 12 bp, Homo sapiens
tttcctgcccag

SEQ ID NO: 4161450 - DNA, 14 bp, Homo sapiens
tttcctgcccagcc

SEQ ID NO: 4161451 - DNA, 12 bp, Homo sapiens
tttcctgggcct

SEQ ID NO: 4161452 - DNA, 18 bp, Homo sapiens
tttcctgtgtgtgttgcc

SEQ ID NO: 4161453 - DNA, 16 bp, Homo sapiens
tttccttatttgcctt

SEQ ID NO: 4161454 - DNA, 18 bp, Homo sapiens
tttccttatttgccttct

SEQ ID NO: 4161455 - DNA, 14 bp, Homo sapiens
tttccttccatccc

SEQ ID NO: 4161456 - DNA, 15 bp, Homo sapiens
tttccttccatccct

SEQ ID NO: 4161457 - DNA, 19 bp, Homo sapiens
tttccttccatccctaccc

SEQ ID NO: 4161458 - DNA, 22 bp, Homo sapiens
tttcctttaaaaaaatttaagt

SEQ ID NO: 4161459 - DNA, 18 bp, Homo sapiens
tttcctttatactgtgaa

SEQ ID NO: 4161460 - DNA, 14 bp, Homo sapiens
tttcctttatgtga

SEQ ID NO: 4161461 - DNA, 23 bp, Homo sapiens
tttcctttatgtgaatttttaag

SEQ ID NO: 4161462 - DNA, 9 bp, Homo sapiens
tttcctttg

SEQ ID NO: 4161463 - DNA, 14 bp, Homo sapiens
tttcctttgtagct

SEQ ID NO: 4161464 - DNA, 13 bp, Homo sapiens
tttccttttcatt

SEQ ID NO: 4161465 - DNA, 13 bp, Homo sapiens
tttcctttttaat

SEQ ID NO: 4161466 - DNA, 16 bp, Homo sapiens
tttcctttttcttcgc

SEQ ID NO: 4161467 - DNA, 20 bp, Homo sapiens
tttcgacgcttaacctttcc

SEQ ID NO: 4161468 - DNA, 20 bp, Homo sapiens
tttcgataaacaacaaggtg

SEQ ID NO: 4161469 - DNA, 17 bp, Homo sapiens
tttcggattttttccaa

SEQ ID NO: 4161470 - DNA, 23 bp, Homo sapiens
tttcggcagaggaacccccacca

SEQ ID NO: 4161471 - DNA, 13 bp, Homo sapiens
tttcgttaacatt

SEQ ID NO: 4161472 - DNA, 15 bp, Homo sapiens
tttcgttaacattga

SEQ ID NO: 4161473 - DNA, 15 bp, Homo sapiens
tttctaaaaagatta

SEQ ID NO: 4161474 - DNA, 17 bp, Homo sapiens
tttctaaaaataaagct

SEQ ID NO: 4161475 - DNA, 13 bp, Homo sapiens
tttctaaaactat

SEQ ID NO: 4161476 - DNA, 13 bp, Homo sapiens
tttctaaatgttt

SEQ ID NO: 4161477 - DNA, 15 bp, Homo sapiens
tttctaaccttgaat

SEQ ID NO: 4161478 - DNA, 22 bp, Homo sapiens
tttctaaccttgaatgctgcca

SEQ ID NO: 4161479 - DNA, 15 bp, Homo sapiens
tttctaactatataa

SEQ ID NO: 4161480 - DNA, 13 bp, Homo sapiens
tttctaataaact

SEQ ID NO: 4161481 - DNA, 20 bp, Homo sapiens
tttctaatccttttccttat

SEQ ID NO: 4161482 - DNA, 19 bp, Homo sapiens
tttctacatgactgggcct

SEQ ID NO: 4161483 - DNA, 23 bp, Homo sapiens
tttctaccagctcatacaaaata

SEQ ID NO: 4161484 - DNA, 16 bp, Homo sapiens
tttctaccttgaggtc

SEQ ID NO: 4161485 - DNA, 13 bp, Homo sapiens
tttctactgtaag

SEQ ID NO: 4161486 - DNA, 18 bp, Homo sapiens
tttctagacactttttct

SEQ ID NO: 4161487 - DNA, 21 bp, Homo sapiens
tttctagaggtgctacatagt

SEQ ID NO: 4161488 - DNA, 19 bp, Homo sapiens
tttctagcatatatgtgtc

SEQ ID NO: 4161489 - DNA, 15 bp, Homo sapiens
tttctagtccaaaat

SEQ ID NO: 4161490 - DNA, 18 bp, Homo sapiens
tttctagtggtctttgta

SEQ ID NO: 4161491 - DNA, 20 bp, Homo sapiens
tttctagtggtctttgtaag

SEQ ID NO: 4161492 - DNA, 16 bp, Homo sapiens
tttctataacagatat

SEQ ID NO: 4161493 - DNA, 14 bp, Homo sapiens
tttctatcacatat

SEQ ID NO: 4161494 - DNA, 22 bp, Homo sapiens
tttctattctgtcagtgttaaa

SEQ ID NO: 4161495 - DNA, 13 bp, Homo sapiens
tttctattgttac

SEQ ID NO: 4161496 - DNA, 14 bp, Homo sapiens
tttctcaaaagcat

SEQ ID NO: 4161497 - DNA, 16 bp, Homo sapiens
tttctcaaaagcattt

SEQ ID NO: 4161498 - DNA, 13 bp, Homo sapiens
tttctcaaagttt

SEQ ID NO: 4161499 - DNA, 23 bp, Homo sapiens
tttctcagccgcttctgactgct

SEQ ID NO: 4161500 - DNA, 15 bp, Homo sapiens
tttctccaagtactt

SEQ ID NO: 4161501 - DNA, 19 bp, Homo sapiens
tttctccctttatgtatct

SEQ ID NO: 4161502 - DNA, 20 bp, Homo sapiens
tttctccctttatgtatctc

SEQ ID NO: 4161503 - DNA, 15 bp, Homo sapiens
tttctcctcccttcc

SEQ ID NO: 4161504 - DNA, 21 bp, Homo sapiens
tttctcctgtttattcccatc

SEQ ID NO: 4161505 - DNA, 23 bp, Homo sapiens
tttctccttgaatatctttcgat

SEQ ID NO: 4161506 - DNA, 19 bp, Homo sapiens
tttctccttttcctatcct

SEQ ID NO: 4161507 - DNA, 22 bp, Homo sapiens
tttctctaacttcaaggcccat

SEQ ID NO: 4161508 - DNA, 19 bp, Homo sapiens
tttctctcagccttacatt

SEQ ID NO: 4161509 - DNA, 16 bp, Homo sapiens
tttctctctacagtgc

SEQ ID NO: 4161510 - DNA, 11 bp, Homo sapiens
tttctctgcca

SEQ ID NO: 4161511 - DNA, 23 bp, Homo sapiens
tttctctgccgctacctccctcc

SEQ ID NO: 4161512 - DNA, 18 bp, Homo sapiens
tttctcttccccttagaa

SEQ ID NO: 4161513 - DNA, 14 bp, Homo sapiens
tttctctttctcct

SEQ ID NO: 4161514 - DNA, 20 bp, Homo sapiens
tttctcttttcccctttcct

SEQ ID NO: 4161515 - DNA, 13 bp, Homo sapiens
tttctgaaattca

SEQ ID NO: 4161516 - DNA, 17 bp, Homo sapiens
tttctgaaattcacaga

SEQ ID NO: 4161517 - DNA, 15 bp, Homo sapiens
tttctgaatagaaat

SEQ ID NO: 4161518 - DNA, 16 bp, Homo sapiens
tttctgacatgcattg

SEQ ID NO: 4161519 - DNA, 15 bp, Homo sapiens
tttctgatcagaggt

SEQ ID NO: 4161520 - DNA, 18 bp, Homo sapiens
tttctgattagctttgtg

SEQ ID NO: 4161521 - DNA, 13 bp, Homo sapiens
tttctgcagccct

SEQ ID NO: 4161522 - DNA, 15 bp, Homo sapiens
tttctgccctggctg

SEQ ID NO: 4161523 - DNA, 16 bp, Homo sapiens
tttctgccttttgttc

SEQ ID NO: 4161524 - DNA, 15 bp, Homo sapiens
tttctggattctggg

SEQ ID NO: 4161525 - DNA, 21 bp, Homo sapiens
tttctggccaaaagcagtaaa

SEQ ID NO: 4161526 - DNA, 16 bp, Homo sapiens
tttctgggggaaaaag

SEQ ID NO: 4161527 - DNA, 21 bp, Homo sapiens
tttctggttgttatgtgatca

SEQ ID NO: 4161528 - DNA, 16 bp, Homo sapiens
tttctggtttggcatg

SEQ ID NO: 4161529 - DNA, 17 bp, Homo sapiens
tttctgtatatactttt

SEQ ID NO: 4161530 - DNA, 14 bp, Homo sapiens
tttctgtcctgggc

SEQ ID NO: 4161531 - DNA, 23 bp, Homo sapiens
tttctgtccttttggcactgaga

SEQ ID NO: 4161532 - DNA, 12 bp, Homo sapiens
tttctgtgaata

SEQ ID NO: 4161533 - DNA, 13 bp, Homo sapiens
tttctgtgcccta

SEQ ID NO: 4161534 - DNA, 17 bp, Homo sapiens
tttctgtggctggctct

SEQ ID NO: 4161535 - DNA, 9 bp, Homo sapiens
tttctgttc

SEQ ID NO: 4161536 - DNA, 15 bp, Homo sapiens
tttctgttgaagttt

SEQ ID NO: 4161537 - DNA, 13 bp, Homo sapiens
tttctgttgtcat

SEQ ID NO: 4161538 - DNA, 17 bp, Homo sapiens
tttctgttgtcattgct

SEQ ID NO: 4161539 - DNA, 18 bp, Homo sapiens
tttctgttgtcattgctg

SEQ ID NO: 4161540 - DNA, 21 bp, Homo sapiens
tttcttaaataatgcttcaga

SEQ ID NO: 4161541 - DNA, 20 bp, Homo sapiens
tttcttaaatatgtatatga

SEQ ID NO: 4161542 - DNA, 18 bp, Homo sapiens
tttcttacccaatttccc

SEQ ID NO: 4161543 - DNA, 12 bp, Homo sapiens
tttcttagcttt

SEQ ID NO: 4161544 - DNA, 13 bp, Homo sapiens
tttcttagctttt

SEQ ID NO: 4161545 - DNA, 20 bp, Homo sapiens
tttcttagctttttaattgt

SEQ ID NO: 4161546 - DNA, 21 bp, Homo sapiens
tttcttagctttttaattgtt

SEQ ID NO: 4161547 - DNA, 19 bp, Homo sapiens
tttcttagttactttttcc

SEQ ID NO: 4161548 - DNA, 13 bp, Homo sapiens
tttcttatgtgac

SEQ ID NO: 4161549 - DNA, 16 bp, Homo sapiens
tttcttatgtgacatt

SEQ ID NO: 4161550 - DNA, 17 bp, Homo sapiens
tttcttatgtgacatta

SEQ ID NO: 4161551 - DNA, 17 bp, Homo sapiens
tttcttattgcgctgct

SEQ ID NO: 4161552 - DNA, 21 bp, Homo sapiens
tttcttcaacatcaatgttca

SEQ ID NO: 4161553 - DNA, 13 bp, Homo sapiens
tttcttcagaatt

SEQ ID NO: 4161554 - DNA, 13 bp, Homo sapiens
tttcttcatccaa

SEQ ID NO: 4161555 - DNA, 12 bp, Homo sapiens
tttcttccctgc

SEQ ID NO: 4161556 - DNA, 13 bp, Homo sapiens
tttcttcctcagc

SEQ ID NO: 4161557 - DNA, 23 bp, Homo sapiens
tttcttccttgttgtttgctttg

SEQ ID NO: 4161558 - DNA, 14 bp, Homo sapiens
tttcttctgccctt

SEQ ID NO: 4161559 - DNA, 16 bp, Homo sapiens
tttcttcttttacttg

SEQ ID NO: 4161560 - DNA, 22 bp, Homo sapiens
tttcttggggtactcttgatgt

SEQ ID NO: 4161561 - DNA, 20 bp, Homo sapiens
tttcttgtagccatggctgg

SEQ ID NO: 4161562 - DNA, 15 bp, Homo sapiens
tttctttaagaaagt

SEQ ID NO: 4161563 - DNA, 13 bp, Homo sapiens
tttctttaatgct

SEQ ID NO: 4161564 - DNA, 13 bp, Homo sapiens
tttctttctagtg

SEQ ID NO: 4161565 - DNA, 16 bp, Homo sapiens
tttctttgagttttaa

SEQ ID NO: 4161566 - DNA, 13 bp, Homo sapiens
tttctttgcctct

SEQ ID NO: 4161567 - DNA, 22 bp, Homo sapiens
tttcttttccttcattcatagg

SEQ ID NO: 4161568 - DNA, 12 bp, Homo sapiens
tttctttttaca

SEQ ID NO: 4161569 - DNA, 14 bp, Homo sapiens
tttctttttacata

SEQ ID NO: 4161570 - DNA, 13 bp, Homo sapiens
tttgaaaagctat

SEQ ID NO: 4161571 - DNA, 15 bp, Homo sapiens
tttgaaaagctatta

SEQ ID NO: 4161572 - DNA, 13 bp, Homo sapiens
tttgaaaagcttc

SEQ ID NO: 4161573 - DNA, 22 bp, Homo sapiens
tttgaaaagcttcttaattaat

SEQ ID NO: 4161574 - DNA, 22 bp, Homo sapiens
tttgaaaagtttcctaggatgt

SEQ ID NO: 4161575 - DNA, 17 bp, Homo sapiens
tttgaaaattttacttc

SEQ ID NO: 4161576 - DNA, 14 bp, Homo sapiens
tttgaaatactaaa

SEQ ID NO: 4161577 - DNA, 22 bp, Homo sapiens
tttgaacaactaggcttcagca

SEQ ID NO: 4161578 - DNA, 12 bp, Homo sapiens
tttgaacactgg

SEQ ID NO: 4161579 - DNA, 20 bp, Homo sapiens
tttgaacatgtttaatgggt

SEQ ID NO: 4161580 - DNA, 23 bp, Homo sapiens
tttgaacctttttttttgaaaca

SEQ ID NO: 4161581 - DNA, 21 bp, Homo sapiens
tttgaactcagatctgtctga

SEQ ID NO: 4161582 - DNA, 19 bp, Homo sapiens
tttgaactggtattgttta

SEQ ID NO: 4161583 - DNA, 17 bp, Homo sapiens
tttgaagaacatgtgag

SEQ ID NO: 4161584 - DNA, 22 bp, Homo sapiens
tttgaagatgccgcatttggat

SEQ ID NO: 4161585 - DNA, 20 bp, Homo sapiens
tttgaagcagtcttgctctg

SEQ ID NO: 4161586 - DNA, 16 bp, Homo sapiens
tttgaagcctgtgcct

SEQ ID NO: 4161587 - DNA, 18 bp, Homo sapiens
tttgaagctactgtgtgt

SEQ ID NO: 4161588 - DNA, 19 bp, Homo sapiens
tttgaaggaggtgagggat

SEQ ID NO: 4161589 - DNA, 10 bp, Homo sapiens
tttgaagtgt

SEQ ID NO: 4161590 - DNA, 17 bp, Homo sapiens
tttgaagtttacatttt

SEQ ID NO: 4161591 - DNA, 24 bp, Homo sapiens
tttgaatgaaaaatttaagcattg

SEQ ID NO: 4161592 - DNA, 13 bp, Homo sapiens
tttgaatgaaaac

SEQ ID NO: 4161593 - DNA, 14 bp, Homo sapiens
tttgaatgaaaaca

SEQ ID NO: 4161594 - DNA, 19 bp, Homo sapiens
tttgaattaaaacttctta

SEQ ID NO: 4161595 - DNA, 14 bp, Homo sapiens
tttgaattttgttt

SEQ ID NO: 4161596 - DNA, 17 bp, Homo sapiens
tttgacaactaaaatta

SEQ ID NO: 4161597 - DNA, 20 bp, Homo sapiens
tttgacaattcctagataaa

SEQ ID NO: 4161598 - DNA, 13 bp, Homo sapiens
tttgacatgtgga

SEQ ID NO: 4161599 - DNA, 13 bp, Homo sapiens
tttgaccttttat

SEQ ID NO: 4161600 - DNA, 14 bp, Homo sapiens
tttgacggatgatt

SEQ ID NO: 4161601 - DNA, 19 bp, Homo sapiens
tttgactctggcaaagctt

SEQ ID NO: 4161602 - DNA, 16 bp, Homo sapiens
tttgacttaatgtgat

SEQ ID NO: 4161603 - DNA, 12 bp, Homo sapiens
tttgacttcagc

SEQ ID NO: 4161604 - DNA, 14 bp, Homo sapiens
tttgacttcagctg

SEQ ID NO: 4161605 - DNA, 17 bp, Homo sapiens
tttgacttgcatgaaga

SEQ ID NO: 4161606 - DNA, 15 bp, Homo sapiens
tttgactttcttctg

SEQ ID NO: 4161607 - DNA, 13 bp, Homo sapiens
tttgagaaactgc

SEQ ID NO: 4161608 - DNA, 16 bp, Homo sapiens
tttgagacagtttctt

SEQ ID NO: 4161609 - DNA, 22 bp, Homo sapiens
tttgagacagtttcttagcttt

SEQ ID NO: 4161610 - DNA, 14 bp, Homo sapiens
tttgagagttctaa

SEQ ID NO: 4161611 - DNA, 17 bp, Homo sapiens
tttgagctgccttccct

SEQ ID NO: 4161612 - DNA, 18 bp, Homo sapiens
tttgagtgtgtgtgtgca

SEQ ID NO: 4161613 - DNA, 14 bp, Homo sapiens
tttgagtgttttaa

SEQ ID NO: 4161614 - DNA, 13 bp, Homo sapiens
tttgagttctaca

SEQ ID NO: 4161615 - DNA, 19 bp, Homo sapiens
tttgagtttttcctcccag

SEQ ID NO: 4161616 - DNA, 14 bp, Homo sapiens
tttgataatgttaa

SEQ ID NO: 4161617 - DNA, 19 bp, Homo sapiens
tttgatattaaaggagtta

SEQ ID NO: 4161618 - DNA, 21 bp, Homo sapiens
tttgatctggacagaacattt

SEQ ID NO: 4161619 - DNA, 18 bp, Homo sapiens
tttgatgctggagaggtt

SEQ ID NO: 4161620 - DNA, 17 bp, Homo sapiens
tttgatgtttgtggcct

SEQ ID NO: 4161621 - DNA, 14 bp, Homo sapiens
tttgattaacaaat

SEQ ID NO: 4161622 - DNA, 16 bp, Homo sapiens
tttgattaacaaatat

SEQ ID NO: 4161623 - DNA, 15 bp, Homo sapiens
tttgattcatagtaa

SEQ ID NO: 4161624 - DNA, 20 bp, Homo sapiens
tttgattcattttcctgttc

SEQ ID NO: 4161625 - DNA, 18 bp, Homo sapiens
tttgatttacagcaagta

SEQ ID NO: 4161626 - DNA, 14 bp, Homo sapiens
tttgatttcattaa

SEQ ID NO: 4161627 - DNA, 18 bp, Homo sapiens
tttgcaaaatcacttagc

SEQ ID NO: 4161628 - DNA, 19 bp, Homo sapiens
tttgcaaacccgaaaataa

SEQ ID NO: 4161629 - DNA, 20 bp, Homo sapiens
tttgcaactaggtatttcta

SEQ ID NO: 4161630 - DNA, 21 bp, Homo sapiens
tttgcaaggtgcatttttact

SEQ ID NO: 4161631 - DNA, 21 bp, Homo sapiens
tttgcacttgtgattatttat

SEQ ID NO: 4161632 - DNA, 20 bp, Homo sapiens
tttgcagatttatttagtga

SEQ ID NO: 4161633 - DNA, 14 bp, Homo sapiens
tttgcagggcagcc

SEQ ID NO: 4161634 - DNA, 16 bp, Homo sapiens
tttgcagggcagcccc

SEQ ID NO: 4161635 - DNA, 22 bp, Homo sapiens
tttgcagggtcctcttctgggc

SEQ ID NO: 4161636 - DNA, 10 bp, Homo sapiens
tttgcagtaa

SEQ ID NO: 4161637 - DNA, 12 bp, Homo sapiens
tttgcagtaact

SEQ ID NO: 4161638 - DNA, 17 bp, Homo sapiens
tttgcagtaactgtttt

SEQ ID NO: 4161639 - DNA, 17 bp, Homo sapiens
tttgcatattctattgt

SEQ ID NO: 4161640 - DNA, 20 bp, Homo sapiens
tttgcatattttgagaaact

SEQ ID NO: 4161641 - DNA, 22 bp, Homo sapiens
tttgcatattttgagaaactgc

SEQ ID NO: 4161642 - DNA, 13 bp, Homo sapiens
tttgcatctttgt

SEQ ID NO: 4161643 - DNA, 12 bp, Homo sapiens
tttgcattcaaa

SEQ ID NO: 4161644 - DNA, 19 bp, Homo sapiens
tttgcattgaacacaaact

SEQ ID NO: 4161645 - DNA, 23 bp, Homo sapiens
tttgcatttatttatacagtgcc

SEQ ID NO: 4161646 - DNA, 17 bp, Homo sapiens
tttgccaaaaaaaaaag

SEQ ID NO: 4161647 - DNA, 18 bp, Homo sapiens
tttgccacagcttttgca

SEQ ID NO: 4161648 - DNA, 20 bp, Homo sapiens
tttgccactaattttagtat

SEQ ID NO: 4161649 - DNA, 22 bp, Homo sapiens
tttgcccccaaacccccattct

SEQ ID NO: 4161650 - DNA, 23 bp, Homo sapiens
tttgcccccaaacccccattctg

SEQ ID NO: 4161651 - DNA, 18 bp, Homo sapiens
tttgcccgttgaccagat

SEQ ID NO: 4161652 - DNA, 14 bp, Homo sapiens
tttgcctctaccag

SEQ ID NO: 4161653 - DNA, 21 bp, Homo sapiens
tttgcctcttctttgtgcctt

SEQ ID NO: 4161654 - DNA, 11 bp, Homo sapiens
tttgcctgtgc

SEQ ID NO: 4161655 - DNA, 22 bp, Homo sapiens
tttgccttcctttctccaggac

SEQ ID NO: 4161656 - DNA, 12 bp, Homo sapiens
tttgccttctct

SEQ ID NO: 4161657 - DNA, 21 bp, Homo sapiens
tttgccttgggctgctcctca

SEQ ID NO: 4161658 - DNA, 19 bp, Homo sapiens
tttgcctttcttctgccct

SEQ ID NO: 4161659 - DNA, 16 bp, Homo sapiens
tttgcgaaaagataaa

SEQ ID NO: 4161660 - DNA, 13 bp, Homo sapiens
tttgctaattaaa

SEQ ID NO: 4161661 - DNA, 14 bp, Homo sapiens
tttgctaattaaaa

SEQ ID NO: 4161662 - DNA, 14 bp, Homo sapiens
tttgctactaagtt

SEQ ID NO: 4161663 - DNA, 15 bp, Homo sapiens
tttgctagcagtaaa

SEQ ID NO: 4161664 - DNA, 20 bp, Homo sapiens
tttgctataatcattagttt

SEQ ID NO: 4161665 - DNA, 16 bp, Homo sapiens
tttgctattgtaaata

SEQ ID NO: 4161666 - DNA, 21 bp, Homo sapiens
tttgctccccttccccttcct

SEQ ID NO: 4161667 - DNA, 22 bp, Homo sapiens
tttgctctctgtgaccctaaga

SEQ ID NO: 4161668 - DNA, 18 bp, Homo sapiens
tttgctgcgcaccaatgc

SEQ ID NO: 4161669 - DNA, 22 bp, Homo sapiens
tttgctgctgcccatgtttcaa

SEQ ID NO: 4161670 - DNA, 18 bp, Homo sapiens
tttgctgtatatttgtga

SEQ ID NO: 4161671 - DNA, 17 bp, Homo sapiens
tttgctgtgaggctgtc

SEQ ID NO: 4161672 - DNA, 17 bp, Homo sapiens
tttgcttggtgctggtt

SEQ ID NO: 4161673 - DNA, 20 bp, Homo sapiens
tttgcttggtgctggtttat

SEQ ID NO: 4161674 - DNA, 17 bp, Homo sapiens
tttgcttgttatattaa

SEQ ID NO: 4161675 - DNA, 9 bp, Homo sapiens
tttgctttc

SEQ ID NO: 4161676 - DNA, 18 bp, Homo sapiens
tttgctttcttgtctttt

SEQ ID NO: 4161677 - DNA, 15 bp, Homo sapiens
tttgctttggtctgt

SEQ ID NO: 4161678 - DNA, 15 bp, Homo sapiens
tttggaaatctcttt

SEQ ID NO: 4161679 - DNA, 22 bp, Homo sapiens
tttggaagaaaaaaatcttctc

SEQ ID NO: 4161680 - DNA, 14 bp, Homo sapiens
tttggaagttttca

SEQ ID NO: 4161681 - DNA, 13 bp, Homo sapiens
tttggaatacttt

SEQ ID NO: 4161682 - DNA, 15 bp, Homo sapiens
tttggaatacttttt

SEQ ID NO: 4161683 - DNA, 17 bp, Homo sapiens
tttggaatactttttgt

SEQ ID NO: 4161684 - DNA, 22 bp, Homo sapiens
tttggaatcttctctttgacaa

SEQ ID NO: 4161685 - DNA, 16 bp, Homo sapiens
tttggacagtttacca

SEQ ID NO: 4161686 - DNA, 17 bp, Homo sapiens
tttggagtcccctcacc

SEQ ID NO: 4161687 - DNA, 17 bp, Homo sapiens
tttggatcttgaatgtg

SEQ ID NO: 4161688 - DNA, 17 bp, Homo sapiens
tttggatttcctttata

SEQ ID NO: 4161689 - DNA, 21 bp, Homo sapiens
tttggctgacttcatctgggg

SEQ ID NO: 4161690 - DNA, 20 bp, Homo sapiens
tttggctgaggggcttggga

SEQ ID NO: 4161691 - DNA, 18 bp, Homo sapiens
tttggcttataaacacat

SEQ ID NO: 4161692 - DNA, 21 bp, Homo sapiens
tttgggaagaaaacctgtatt

SEQ ID NO: 4161693 - DNA, 21 bp, Homo sapiens
tttgggaagaatccagtatta

SEQ ID NO: 4161694 - DNA, 22 bp, Homo sapiens
tttgggaagtgaagactggaag

SEQ ID NO: 4161695 - DNA, 18 bp, Homo sapiens
tttgggagacatgtgaca

SEQ ID NO: 4161696 - DNA, 20 bp, Homo sapiens
tttgggcagaagggagaagg

SEQ ID NO: 4161697 - DNA, 21 bp, Homo sapiens
tttgggcttagtatttctcag

SEQ ID NO: 4161698 - DNA, 14 bp, Homo sapiens
tttggggaaaaaag

SEQ ID NO: 4161699 - DNA, 16 bp, Homo sapiens
tttggggaaaaaagca

SEQ ID NO: 4161700 - DNA, 17 bp, Homo sapiens
tttggggaaaaaagcac

SEQ ID NO: 4161701 - DNA, 18 bp, Homo sapiens
tttggggaaacctagaga

SEQ ID NO: 4161702 - DNA, 22 bp, Homo sapiens
tttgggggaaaatttagaaata

SEQ ID NO: 4161703 - DNA, 14 bp, Homo sapiens
tttggtataatgtt

SEQ ID NO: 4161704 - DNA, 18 bp, Homo sapiens
tttggtataatgtttaaa

SEQ ID NO: 4161705 - DNA, 20 bp, Homo sapiens
tttggtcagttgggttttta

SEQ ID NO: 4161706 - DNA, 13 bp, Homo sapiens
tttggtccaaaaa

SEQ ID NO: 4161707 - DNA, 14 bp, Homo sapiens
tttggtccaaaaaa

SEQ ID NO: 4161708 - DNA, 17 bp, Homo sapiens
tttggtctgtgttcaat

SEQ ID NO: 4161709 - DNA, 16 bp, Homo sapiens
tttggtgtctttctct

SEQ ID NO: 4161710 - DNA, 16 bp, Homo sapiens
tttggttattggtttt

SEQ ID NO: 4161711 - DNA, 20 bp, Homo sapiens
tttggttccttctctgggtc

SEQ ID NO: 4161712 - DNA, 14 bp, Homo sapiens
tttggtttattttt

SEQ ID NO: 4161713 - DNA, 19 bp, Homo sapiens
tttgtaaagttgcctttat

SEQ ID NO: 4161714 - DNA, 14 bp, Homo sapiens
tttgtaaataagag

SEQ ID NO: 4161715 - DNA, 15 bp, Homo sapiens
tttgtaaataagaga

SEQ ID NO: 4161716 - DNA, 13 bp, Homo sapiens
tttgtaaatgatt

SEQ ID NO: 4161717 - DNA, 14 bp, Homo sapiens
tttgtaaatgattt

SEQ ID NO: 4161718 - DNA, 22 bp, Homo sapiens
tttgtaaattaaacataaaaca

SEQ ID NO: 4161719 - DNA, 18 bp, Homo sapiens
tttgtaaattatttatgt

SEQ ID NO: 4161720 - DNA, 15 bp, Homo sapiens
tttgtaacctcagct

SEQ ID NO: 4161721 - DNA, 19 bp, Homo sapiens
tttgtaacctcagctctgg

SEQ ID NO: 4161722 - DNA, 13 bp, Homo sapiens
tttgtaagttatt

SEQ ID NO: 4161723 - DNA, 14 bp, Homo sapiens
tttgtaagtttcag

SEQ ID NO: 4161724 - DNA, 23 bp, Homo sapiens
tttgtaataagcaatcaaggtta

SEQ ID NO: 4161725 - DNA, 18 bp, Homo sapiens
tttgtaatgtgaaaagta

SEQ ID NO: 4161726 - DNA, 13 bp, Homo sapiens
tttgtaattgctt

SEQ ID NO: 4161727 - DNA, 16 bp, Homo sapiens
tttgtaattgtgtaaa

SEQ ID NO: 4161728 - DNA, 14 bp, Homo sapiens
tttgtacactgctg

SEQ ID NO: 4161729 - DNA, 12 bp, Homo sapiens
tttgtacagaat

SEQ ID NO: 4161730 - DNA, 21 bp, Homo sapiens
tttgtaggagaaactcccatg

SEQ ID NO: 4161731 - DNA, 12 bp, Homo sapiens
tttgtagttttt

SEQ ID NO: 4161732 - DNA, 15 bp, Homo sapiens
tttgtatatacagtt

SEQ ID NO: 4161733 - DNA, 16 bp, Homo sapiens
tttgtatatacagtta

SEQ ID NO: 4161734 - DNA, 14 bp, Homo sapiens
tttgtatattacac

SEQ ID NO: 4161735 - DNA, 19 bp, Homo sapiens
tttgtatattacacatttg

SEQ ID NO: 4161736 - DNA, 17 bp, Homo sapiens
tttgtatcttaaatttg

SEQ ID NO: 4161737 - DNA, 18 bp, Homo sapiens
tttgtatttattaatttg

SEQ ID NO: 4161738 - DNA, 16 bp, Homo sapiens
tttgtcaaactgtaga

SEQ ID NO: 4161739 - DNA, 17 bp, Homo sapiens
tttgtcaaactgtagaa

SEQ ID NO: 4161740 - DNA, 23 bp, Homo sapiens
tttgtcaaactgtagaaatgatg

SEQ ID NO: 4161741 - DNA, 11 bp, Homo sapiens
tttgtcaatga

SEQ ID NO: 4161742 - DNA, 22 bp, Homo sapiens
tttgtcatcagatggaaatatt

SEQ ID NO: 4161743 - DNA, 13 bp, Homo sapiens
tttgtcccttcta

SEQ ID NO: 4161744 - DNA, 18 bp, Homo sapiens
tttgtctattttaaaata

SEQ ID NO: 4161745 - DNA, 12 bp, Homo sapiens
tttgtctcctct

SEQ ID NO: 4161746 - DNA, 19 bp, Homo sapiens
tttgtctcttagaaatact

SEQ ID NO: 4161747 - DNA, 19 bp, Homo sapiens
tttgtcttatatatatttc

SEQ ID NO: 4161748 - DNA, 20 bp, Homo sapiens
tttgtcttatatatatttct

SEQ ID NO: 4161749 - DNA, 13 bp, Homo sapiens
tttgtgataattt

SEQ ID NO: 4161750 - DNA, 13 bp, Homo sapiens
tttgtgccagccg

SEQ ID NO: 4161751 - DNA, 15 bp, Homo sapiens
tttgtgcctttggcc

SEQ ID NO: 4161752 - DNA, 17 bp, Homo sapiens
tttgtgcctttggcctg

SEQ ID NO: 4161753 - DNA, 14 bp, Homo sapiens
tttgtgctcattta

SEQ ID NO: 4161754 - DNA, 21 bp, Homo sapiens
tttgtgctcatttaagtttca

SEQ ID NO: 4161755 - DNA, 13 bp, Homo sapiens
tttgtgctgtggg

SEQ ID NO: 4161756 - DNA, 17 bp, Homo sapiens
tttgtgctgtgggcagc

SEQ ID NO: 4161757 - DNA, 15 bp, Homo sapiens
tttgtggcctcagaa

SEQ ID NO: 4161758 - DNA, 19 bp, Homo sapiens
tttgtgtatctcatttaat

SEQ ID NO: 4161759 - DNA, 12 bp, Homo sapiens
tttgtgtatgtt

SEQ ID NO: 4161760 - DNA, 11 bp, Homo sapiens
tttgtgtcctc

SEQ ID NO: 4161761 - DNA, 18 bp, Homo sapiens
tttgtgtcctccaggagc

SEQ ID NO: 4161762 - DNA, 12 bp, Homo sapiens
tttgtgtttcta

SEQ ID NO: 4161763 - DNA, 22 bp, Homo sapiens
tttgttaaaattatcaatatct

SEQ ID NO: 4161764 - DNA, 24 bp, Homo sapiens
tttgttacctccaacagaactaaa

SEQ ID NO: 4161765 - DNA, 17 bp, Homo sapiens
tttgttataccatttcc

SEQ ID NO: 4161766 - DNA, 15 bp, Homo sapiens
tttgttattccatca

SEQ ID NO: 4161767 - DNA, 23 bp, Homo sapiens
tttgttattccatcaataaatgc

SEQ ID NO: 4161768 - DNA, 14 bp, Homo sapiens
tttgttattcctag

SEQ ID NO: 4161769 - DNA, 16 bp, Homo sapiens
tttgttctgttctggg

SEQ ID NO: 4161770 - DNA, 22 bp, Homo sapiens
tttgttgcgttcctttcttttc

SEQ ID NO: 4161771 - DNA, 23 bp, Homo sapiens
tttgttggaaggtttggtgtgtg

SEQ ID NO: 4161772 - DNA, 19 bp, Homo sapiens
tttgttggagtgtttctaa

SEQ ID NO: 4161773 - DNA, 13 bp, Homo sapiens
tttgtttaaagaa

SEQ ID NO: 4161774 - DNA, 16 bp, Homo sapiens
tttgtttaaagaataa

SEQ ID NO: 4161775 - DNA, 11 bp, Homo sapiens
tttgtttgttt

SEQ ID NO: 4161776 - DNA, 16 bp, Homo sapiens
tttgttttaataaaca

SEQ ID NO: 4161777 - DNA, 14 bp, Homo sapiens
tttgtttttcattc

SEQ ID NO: 4161778 - DNA, 16 bp, Homo sapiens
tttgtttttgcttgtt

SEQ ID NO: 4161779 - DNA, 17 bp, Homo sapiens
tttgtttttgctttctg

SEQ ID NO: 4161780 - DNA, 18 bp, Homo sapiens
tttgtttttgctttctga

SEQ ID NO: 4161781 - DNA, 15 bp, Homo sapiens
tttgtttttttgcca

SEQ ID NO: 4161782 - DNA, 19 bp, Homo sapiens
tttgttttttttgactaaa

SEQ ID NO: 4161783 - DNA, 11 bp, Homo sapiens
ttttaaaaaca

SEQ ID NO: 4161784 - DNA, 19 bp, Homo sapiens
ttttaaaaacatagaaaaa

SEQ ID NO: 4161785 - DNA, 14 bp, Homo sapiens
ttttaaaaatacat

SEQ ID NO: 4161786 - DNA, 21 bp, Homo sapiens
ttttaaaaatacatatcgctg

SEQ ID NO: 4161787 - DNA, 21 bp, Homo sapiens
ttttaaaatattacacaggag

SEQ ID NO: 4161788 - DNA, 19 bp, Homo sapiens
ttttaaaatgagagtcact

SEQ ID NO: 4161789 - DNA, 19 bp, Homo sapiens
ttttaaacataagctaaat

SEQ ID NO: 4161790 - DNA, 23 bp, Homo sapiens
ttttaaacattaatagcagcctt

SEQ ID NO: 4161791 - DNA, 12 bp, Homo sapiens
ttttaaactcat

SEQ ID NO: 4161792 - DNA, 13 bp, Homo sapiens
ttttaaagtgatt

SEQ ID NO: 4161793 - DNA, 17 bp, Homo sapiens
ttttaaataaaagcagc

SEQ ID NO: 4161794 - DNA, 21 bp, Homo sapiens
ttttaaatcgccttgaacaaa

SEQ ID NO: 4161795 - DNA, 18 bp, Homo sapiens
ttttaaatctaaatctat

SEQ ID NO: 4161796 - DNA, 16 bp, Homo sapiens
ttttaaatgtatacta

SEQ ID NO: 4161797 - DNA, 13 bp, Homo sapiens
ttttaaattttat

SEQ ID NO: 4161798 - DNA, 12 bp, Homo sapiens
ttttaactcacc

SEQ ID NO: 4161799 - DNA, 19 bp, Homo sapiens
ttttaactgaaaatgtaaa

SEQ ID NO: 4161800 - DNA, 16 bp, Homo sapiens
ttttaagaattgttta

SEQ ID NO: 4161801 - DNA, 13 bp, Homo sapiens
ttttaagatagtg

SEQ ID NO: 4161802 - DNA, 14 bp, Homo sapiens
ttttaagatagtgt

SEQ ID NO: 4161803 - DNA, 12 bp, Homo sapiens
ttttaagatttt

SEQ ID NO: 4161804 - DNA, 15 bp, Homo sapiens
ttttaagcaaaatat

SEQ ID NO: 4161805 - DNA, 21 bp, Homo sapiens
ttttaagcaaatgcattctat

SEQ ID NO: 4161806 - DNA, 12 bp, Homo sapiens
ttttaagctgtt

SEQ ID NO: 4161807 - DNA, 23 bp, Homo sapiens
ttttaatacaggacttttaaatg

SEQ ID NO: 4161808 - DNA, 23 bp, Homo sapiens
ttttaatagaaataaattcctaa

SEQ ID NO: 4161809 - DNA, 20 bp, Homo sapiens
ttttaatattcttttgtttc

SEQ ID NO: 4161810 - DNA, 21 bp, Homo sapiens
ttttaatattcttttgtttcc

SEQ ID NO: 4161811 - DNA, 21 bp, Homo sapiens
ttttaatcctgtaccaaatct

SEQ ID NO: 4161812 - DNA, 17 bp, Homo sapiens
ttttaatctgaaattct

SEQ ID NO: 4161813 - DNA, 20 bp, Homo sapiens
ttttaatgtgaagacatttt

SEQ ID NO: 4161814 - DNA, 16 bp, Homo sapiens
ttttaattattattct

SEQ ID NO: 4161815 - DNA, 17 bp, Homo sapiens
ttttaattattattctt

SEQ ID NO: 4161816 - DNA, 19 bp, Homo sapiens
ttttaattgaaactagtta

SEQ ID NO: 4161817 - DNA, 15 bp, Homo sapiens
ttttaatttaaagct

SEQ ID NO: 4161818 - DNA, 16 bp, Homo sapiens
ttttacaagatccatt

SEQ ID NO: 4161819 - DNA, 22 bp, Homo sapiens
ttttacagttagggttttgcaa

SEQ ID NO: 4161820 - DNA, 15 bp, Homo sapiens
ttttaccaagagtaa

SEQ ID NO: 4161821 - DNA, 17 bp, Homo sapiens
ttttaccaagagtaact

SEQ ID NO: 4161822 - DNA, 17 bp, Homo sapiens
ttttactattgttacat

SEQ ID NO: 4161823 - DNA, 15 bp, Homo sapiens
ttttactccagtggt

SEQ ID NO: 4161824 - DNA, 14 bp, Homo sapiens
ttttactctgccta

SEQ ID NO: 4161825 - DNA, 22 bp, Homo sapiens
ttttactctgcctacagaactt

SEQ ID NO: 4161826 - DNA, 15 bp, Homo sapiens
ttttactctttgaaa

SEQ ID NO: 4161827 - DNA, 22 bp, Homo sapiens
ttttacttgcattgaatatatt

SEQ ID NO: 4161828 - DNA, 12 bp, Homo sapiens
ttttacttttgt

SEQ ID NO: 4161829 - DNA, 20 bp, Homo sapiens
ttttagaatgttgaaaagta

SEQ ID NO: 4161830 - DNA, 19 bp, Homo sapiens
ttttagatcaaatacttta

SEQ ID NO: 4161831 - DNA, 15 bp, Homo sapiens
ttttaggattctgtc

SEQ ID NO: 4161832 - DNA, 15 bp, Homo sapiens
ttttaggcactctta

SEQ ID NO: 4161833 - DNA, 19 bp, Homo sapiens
ttttaggtgttgattttct

SEQ ID NO: 4161834 - DNA, 15 bp, Homo sapiens
ttttagtattcattc

SEQ ID NO: 4161835 - DNA, 17 bp, Homo sapiens
ttttataaaattttgct

SEQ ID NO: 4161836 - DNA, 18 bp, Homo sapiens
ttttataaataaactgtt

SEQ ID NO: 4161837 - DNA, 19 bp, Homo sapiens
ttttataagttcacaaaat

SEQ ID NO: 4161838 - DNA, 13 bp, Homo sapiens
ttttatactcttt

SEQ ID NO: 4161839 - DNA, 15 bp, Homo sapiens
ttttatactgaatat

SEQ ID NO: 4161840 - DNA, 15 bp, Homo sapiens
ttttatactgtactt

SEQ ID NO: 4161841 - DNA, 19 bp, Homo sapiens
ttttatagcttaactaatt

SEQ ID NO: 4161842 - DNA, 22 bp, Homo sapiens
ttttatatacagaggaaatctg

SEQ ID NO: 4161843 - DNA, 13 bp, Homo sapiens
ttttatatctttt

SEQ ID NO: 4161844 - DNA, 9 bp, Homo sapiens
ttttatatt

SEQ ID NO: 4161845 - DNA, 20 bp, Homo sapiens
ttttatatttattgttagaa

SEQ ID NO: 4161846 - DNA, 13 bp, Homo sapiens
ttttatatttgta

SEQ ID NO: 4161847 - DNA, 17 bp, Homo sapiens
ttttatatttgtatcga

SEQ ID NO: 4161848 - DNA, 12 bp, Homo sapiens
ttttatgtttga

SEQ ID NO: 4161849 - DNA, 12 bp, Homo sapiens
ttttattactct

SEQ ID NO: 4161850 - DNA, 22 bp, Homo sapiens
ttttattataatcctcaagaga

SEQ ID NO: 4161851 - DNA, 12 bp, Homo sapiens
ttttattgctag

SEQ ID NO: 4161852 - DNA, 23 bp, Homo sapiens
ttttattgctagtatttgaatta

SEQ ID NO: 4161853 - DNA, 12 bp, Homo sapiens
ttttatttatca

SEQ ID NO: 4161854 - DNA, 11 bp, Homo sapiens
ttttattttaa

SEQ ID NO: 4161855 - DNA, 15 bp, Homo sapiens
ttttattttactatt

SEQ ID NO: 4161856 - DNA, 11 bp, Homo sapiens
ttttattttat

SEQ ID NO: 4161857 - DNA, 20 bp, Homo sapiens
ttttcaaaaaagtcaacaaa

SEQ ID NO: 4161858 - DNA, 23 bp, Homo sapiens
ttttcaaccagataacatacctt

SEQ ID NO: 4161859 - DNA, 20 bp, Homo sapiens
ttttcaatatattgaacttt

SEQ ID NO: 4161860 - DNA, 21 bp, Homo sapiens
ttttcaatatattgaactttt

SEQ ID NO: 4161861 - DNA, 16 bp, Homo sapiens
ttttcaatatttatta

SEQ ID NO: 4161862 - DNA, 18 bp, Homo sapiens
ttttcaatgaattttata

SEQ ID NO: 4161863 - DNA, 20 bp, Homo sapiens
ttttcacaatgtcagtattt

SEQ ID NO: 4161864 - DNA, 20 bp, Homo sapiens
ttttcaccccacccttcccc

SEQ ID NO: 4161865 - DNA, 17 bp, Homo sapiens
ttttcacccttctactc

SEQ ID NO: 4161866 - DNA, 15 bp, Homo sapiens
ttttcagaaaatatt

SEQ ID NO: 4161867 - DNA, 22 bp, Homo sapiens
ttttcagaacctcttccccaga

SEQ ID NO: 4161868 - DNA, 19 bp, Homo sapiens
ttttcagttacaagattgt

SEQ ID NO: 4161869 - DNA, 13 bp, Homo sapiens
ttttcagttactt

SEQ ID NO: 4161870 - DNA, 15 bp, Homo sapiens
ttttcagttgttctt

SEQ ID NO: 4161871 - DNA, 18 bp, Homo sapiens
ttttcatacttttacctt

SEQ ID NO: 4161872 - DNA, 14 bp, Homo sapiens
ttttcatttcatga

SEQ ID NO: 4161873 - DNA, 15 bp, Homo sapiens
ttttccaaaataatt

SEQ ID NO: 4161874 - DNA, 17 bp, Homo sapiens
ttttccacgcagttctt

SEQ ID NO: 4161875 - DNA, 19 bp, Homo sapiens
ttttccagagcattccagt

SEQ ID NO: 4161876 - DNA, 17 bp, Homo sapiens
ttttccatcattttaca

SEQ ID NO: 4161877 - DNA, 19 bp, Homo sapiens
ttttccccaaccacagaga

SEQ ID NO: 4161878 - DNA, 18 bp, Homo sapiens
ttttccccccactctccc

SEQ ID NO: 4161879 - DNA, 12 bp, Homo sapiens
ttttcccccttc

SEQ ID NO: 4161880 - DNA, 15 bp, Homo sapiens
ttttcccccttccca

SEQ ID NO: 4161881 - DNA, 19 bp, Homo sapiens
ttttcccccttttctgcat

SEQ ID NO: 4161882 - DNA, 19 bp, Homo sapiens
ttttcccctacagaatttt

SEQ ID NO: 4161883 - DNA, 15 bp, Homo sapiens
ttttcccctgttaaa

SEQ ID NO: 4161884 - DNA, 19 bp, Homo sapiens
ttttcccctgttaaacagt

SEQ ID NO: 4161885 - DNA, 19 bp, Homo sapiens
ttttccctggaactcctgg

SEQ ID NO: 4161886 - DNA, 22 bp, Homo sapiens
ttttcctcccttgggttctgat

SEQ ID NO: 4161887 - DNA, 19 bp, Homo sapiens
ttttccttcccttttctgt

SEQ ID NO: 4161888 - DNA, 16 bp, Homo sapiens
ttttcctttgtagcta

SEQ ID NO: 4161889 - DNA, 20 bp, Homo sapiens
ttttcctttttcttcgctgg

SEQ ID NO: 4161890 - DNA, 17 bp, Homo sapiens
ttttcgtgcactctgct

SEQ ID NO: 4161891 - DNA, 16 bp, Homo sapiens
ttttcgtgtggatctt

SEQ ID NO: 4161892 - DNA, 14 bp, Homo sapiens
ttttctaaccttga

SEQ ID NO: 4161893 - DNA, 15 bp, Homo sapiens
ttttctaatgtggtt

SEQ ID NO: 4161894 - DNA, 13 bp, Homo sapiens
ttttctacagtgg

SEQ ID NO: 4161895 - DNA, 13 bp, Homo sapiens
ttttctacagtta

SEQ ID NO: 4161896 - DNA, 22 bp, Homo sapiens
ttttctagcctatttacctgca

SEQ ID NO: 4161897 - DNA, 19 bp, Homo sapiens
ttttctattatggaaaact

SEQ ID NO: 4161898 - DNA, 15 bp, Homo sapiens
ttttctcaaaagcat

SEQ ID NO: 4161899 - DNA, 22 bp, Homo sapiens
ttttctcaaaagcatttatcat

SEQ ID NO: 4161900 - DNA, 19 bp, Homo sapiens
ttttctcaaagttttgaaa

SEQ ID NO: 4161901 - DNA, 16 bp, Homo sapiens
ttttctcaatctcctc

SEQ ID NO: 4161902 - DNA, 14 bp, Homo sapiens
ttttctcccaagaa

SEQ ID NO: 4161903 - DNA, 20 bp, Homo sapiens
ttttctctatacatagagct

SEQ ID NO: 4161904 - DNA, 21 bp, Homo sapiens
ttttctcttagaacattgtat

SEQ ID NO: 4161905 - DNA, 17 bp, Homo sapiens
ttttctgaataacattt

SEQ ID NO: 4161906 - DNA, 18 bp, Homo sapiens
ttttctgacatgcattgt

SEQ ID NO: 4161907 - DNA, 13 bp, Homo sapiens
ttttctgactaat

SEQ ID NO: 4161908 - DNA, 15 bp, Homo sapiens
ttttctgagcgatta

SEQ ID NO: 4161909 - DNA, 23 bp, Homo sapiens
ttttctgaggtccttatgtcctg

SEQ ID NO: 4161910 - DNA, 18 bp, Homo sapiens
ttttctgggggaaaaagc

SEQ ID NO: 4161911 - DNA, 16 bp, Homo sapiens
ttttctggtttggcat

SEQ ID NO: 4161912 - DNA, 14 bp, Homo sapiens
ttttctgtagtcat

SEQ ID NO: 4161913 - DNA, 13 bp, Homo sapiens
ttttctgtcctgg

SEQ ID NO: 4161914 - DNA, 14 bp, Homo sapiens
ttttctgtttgtaa

SEQ ID NO: 4161915 - DNA, 20 bp, Homo sapiens
ttttcttaaaccaaccttta

SEQ ID NO: 4161916 - DNA, 13 bp, Homo sapiens
ttttcttatttaa

SEQ ID NO: 4161917 - DNA, 19 bp, Homo sapiens
ttttcttcttttacttgaa

SEQ ID NO: 4161918 - DNA, 21 bp, Homo sapiens
ttttcttggcaaaagccttgt

SEQ ID NO: 4161919 - DNA, 12 bp, Homo sapiens
ttttctttcagt

SEQ ID NO: 4161920 - DNA, 14 bp, Homo sapiens
ttttctttgaaatt

SEQ ID NO: 4161921 - DNA, 23 bp, Homo sapiens
ttttctttttacataactgcctt

SEQ ID NO: 4161922 - DNA, 15 bp, Homo sapiens
ttttgaaaagctatt

SEQ ID NO: 4161923 - DNA, 23 bp, Homo sapiens
ttttgaaaagctattagccagga

SEQ ID NO: 4161924 - DNA, 21 bp, Homo sapiens
ttttgaaaagcttcttaatta

SEQ ID NO: 4161925 - DNA, 14 bp, Homo sapiens
ttttgaaacagcag

SEQ ID NO: 4161926 - DNA, 23 bp, Homo sapiens
ttttgaaatcaatgcaagagtga

SEQ ID NO: 4161927 - DNA, 21 bp, Homo sapiens
ttttgaactaataaaagcata

SEQ ID NO: 4161928 - DNA, 17 bp, Homo sapiens
ttttgaagaatatttaa

SEQ ID NO: 4161929 - DNA, 21 bp, Homo sapiens
ttttgaagcagtcttgctctg

SEQ ID NO: 4161930 - DNA, 17 bp, Homo sapiens
ttttgaagccttttgtt

SEQ ID NO: 4161931 - DNA, 11 bp, Homo sapiens
ttttgaagtgt

SEQ ID NO: 4161932 - DNA, 15 bp, Homo sapiens
ttttgaagtttacat

SEQ ID NO: 4161933 - DNA, 17 bp, Homo sapiens
ttttgaagtttacattt

SEQ ID NO: 4161934 - DNA, 22 bp, Homo sapiens
ttttgaatgcttcctgacaatc

SEQ ID NO: 4161935 - DNA, 20 bp, Homo sapiens
ttttgactaaagctatgtta

SEQ ID NO: 4161936 - DNA, 18 bp, Homo sapiens
ttttgactgtagccacag

SEQ ID NO: 4161937 - DNA, 14 bp, Homo sapiens
ttttgacttaatgt

SEQ ID NO: 4161938 - DNA, 15 bp, Homo sapiens
ttttgacttaatgtg

SEQ ID NO: 4161939 - DNA, 17 bp, Homo sapiens
ttttgacttaatgtgat

SEQ ID NO: 4161940 - DNA, 15 bp, Homo sapiens
ttttgaggtagaaat

SEQ ID NO: 4161941 - DNA, 18 bp, Homo sapiens
ttttgataataaattgaa

SEQ ID NO: 4161942 - DNA, 15 bp, Homo sapiens
ttttgatgtttgtgg

SEQ ID NO: 4161943 - DNA, 12 bp, Homo sapiens
ttttgattatgt

SEQ ID NO: 4161944 - DNA, 21 bp, Homo sapiens
ttttgatttggtggatgtgat

SEQ ID NO: 4161945 - DNA, 19 bp, Homo sapiens
ttttgcaataacttctata

SEQ ID NO: 4161946 - DNA, 12 bp, Homo sapiens
ttttgcactttt

SEQ ID NO: 4161947 - DNA, 9 bp, Homo sapiens
ttttgcagt

SEQ ID NO: 4161948 - DNA, 13 bp, Homo sapiens
ttttgcagtaact

SEQ ID NO: 4161949 - DNA, 16 bp, Homo sapiens
ttttgcagtaactgtt

SEQ ID NO: 4161950 - DNA, 22 bp, Homo sapiens
ttttgcagtagagtcatctcca

SEQ ID NO: 4161951 - DNA, 20 bp, Homo sapiens
ttttgccacagcttttgcaa

SEQ ID NO: 4161952 - DNA, 22 bp, Homo sapiens
ttttgccactaattttagtatt

SEQ ID NO: 4161953 - DNA, 19 bp, Homo sapiens
ttttgccagttttccctgg

SEQ ID NO: 4161954 - DNA, 18 bp, Homo sapiens
ttttgcccttcacagtgt

SEQ ID NO: 4161955 - DNA, 22 bp, Homo sapiens
ttttgctaagtaaatctcttct

SEQ ID NO: 4161956 - DNA, 23 bp, Homo sapiens
ttttgctggaattcctaactttt

SEQ ID NO: 4161957 - DNA, 19 bp, Homo sapiens
ttttgcttttaattaaata

SEQ ID NO: 4161958 - DNA, 11 bp, Homo sapiens
ttttgcttttg

SEQ ID NO: 4161959 - DNA, 13 bp, Homo sapiens
ttttggaatttgc

SEQ ID NO: 4161960 - DNA, 17 bp, Homo sapiens
ttttggatcttgaatgt

SEQ ID NO: 4161961 - DNA, 17 bp, Homo sapiens
ttttggccaaagtgtta

SEQ ID NO: 4161962 - DNA, 18 bp, Homo sapiens
ttttggggaaaaaagcac

SEQ ID NO: 4161963 - DNA, 17 bp, Homo sapiens
ttttggtagattaaata

SEQ ID NO: 4161964 - DNA, 16 bp, Homo sapiens
ttttggttcttagttc

SEQ ID NO: 4161965 - DNA, 12 bp, Homo sapiens
ttttgtaaaaga

SEQ ID NO: 4161966 - DNA, 13 bp, Homo sapiens
ttttgtaaattaa

SEQ ID NO: 4161967 - DNA, 22 bp, Homo sapiens
ttttgtaataagcaatcaaggt

SEQ ID NO: 4161968 - DNA, 14 bp, Homo sapiens
ttttgtaattgctt

SEQ ID NO: 4161969 - DNA, 15 bp, Homo sapiens
ttttgtaattgtgta

SEQ ID NO: 4161970 - DNA, 19 bp, Homo sapiens
ttttgtatatacagttatt

SEQ ID NO: 4161971 - DNA, 22 bp, Homo sapiens
ttttgtatatacagttattttg

SEQ ID NO: 4161972 - DNA, 14 bp, Homo sapiens
ttttgtatgtgtgt

SEQ ID NO: 4161973 - DNA, 18 bp, Homo sapiens
ttttgtattttttaaaac

SEQ ID NO: 4161974 - DNA, 16 bp, Homo sapiens
ttttgtcatataagat

SEQ ID NO: 4161975 - DNA, 13 bp, Homo sapiens
ttttgtcattaaa

SEQ ID NO: 4161976 - DNA, 14 bp, Homo sapiens
ttttgtcttttatg

SEQ ID NO: 4161977 - DNA, 22 bp, Homo sapiens
ttttgtgaaatgaaaacatgta

SEQ ID NO: 4161978 - DNA, 12 bp, Homo sapiens
ttttgtgcattt

SEQ ID NO: 4161979 - DNA, 12 bp, Homo sapiens
ttttgtggggct

SEQ ID NO: 4161980 - DNA, 13 bp, Homo sapiens
ttttgtgtacagt

SEQ ID NO: 4161981 - DNA, 11 bp, Homo sapiens
ttttgtgtatg

SEQ ID NO: 4161982 - DNA, 23 bp, Homo sapiens
ttttgttattccatcaataaatg

SEQ ID NO: 4161983 - DNA, 19 bp, Homo sapiens
ttttgttgattaaaacatt

SEQ ID NO: 4161984 - DNA, 11 bp, Homo sapiens
ttttgtttatg

SEQ ID NO: 4161985 - DNA, 14 bp, Homo sapiens
ttttgtttgtttct

SEQ ID NO: 4161986 - DNA, 13 bp, Homo sapiens
ttttgttttacaa

SEQ ID NO: 4161987 - DNA, 16 bp, Homo sapiens
ttttgttttacaatgt

SEQ ID NO: 4161988 - DNA, 13 bp, Homo sapiens
ttttgttttgctt

SEQ ID NO: 4161989 - DNA, 20 bp, Homo sapiens
ttttgtttttattttcaaga

SEQ ID NO: 4161990 - DNA, 13 bp, Homo sapiens
tttttaaaacact

SEQ ID NO: 4161991 - DNA, 12 bp, Homo sapiens
tttttaaaatat

SEQ ID NO: 4161992 - DNA, 16 bp, Homo sapiens
tttttaaaatatttat

SEQ ID NO: 4161993 - DNA, 18 bp, Homo sapiens
tttttaaagttactttgt

SEQ ID NO: 4161994 - DNA, 15 bp, Homo sapiens
tttttaaatgtatac

SEQ ID NO: 4161995 - DNA, 14 bp, Homo sapiens
tttttaaatgtgaa

SEQ ID NO: 4161996 - DNA, 20 bp, Homo sapiens
tttttaaattttatttcctg

SEQ ID NO: 4161997 - DNA, 12 bp, Homo sapiens
tttttaactgat

SEQ ID NO: 4161998 - DNA, 20 bp, Homo sapiens
tttttaagaacttcattttt

SEQ ID NO: 4161999 - DNA, 16 bp, Homo sapiens
tttttaagaatatctg

SEQ ID NO: 4162000 - DNA, 23 bp, Homo sapiens
tttttaagggttatcttagatgt

SEQ ID NO: 4162001 - DNA, 12 bp, Homo sapiens
tttttaataaac

SEQ ID NO: 4162002 - DNA, 11 bp, Homo sapiens
tttttaattta

SEQ ID NO: 4162003 - DNA, 16 bp, Homo sapiens
tttttaatttatttat

SEQ ID NO: 4162004 - DNA, 12 bp, Homo sapiens
tttttacatttt

SEQ ID NO: 4162005 - DNA, 17 bp, Homo sapiens
tttttacctgtcacatt

SEQ ID NO: 4162006 - DNA, 16 bp, Homo sapiens
tttttactacagttgt

SEQ ID NO: 4162007 - DNA, 14 bp, Homo sapiens
tttttagatcaaat

SEQ ID NO: 4162008 - DNA, 15 bp, Homo sapiens
tttttagatcaaata

SEQ ID NO: 4162009 - DNA, 16 bp, Homo sapiens
tttttaggcaaagata

SEQ ID NO: 4162010 - DNA, 21 bp, Homo sapiens
tttttagtggaagcttctaaa

SEQ ID NO: 4162011 - DNA, 18 bp, Homo sapiens
tttttatagcaacaacaa

SEQ ID NO: 4162012 - DNA, 15 bp, Homo sapiens
tttttatatttcctt

SEQ ID NO: 4162013 - DNA, 16 bp, Homo sapiens
tttttatgctatttct

SEQ ID NO: 4162014 - DNA, 12 bp, Homo sapiens
tttttattgcta

SEQ ID NO: 4162015 - DNA, 13 bp, Homo sapiens
tttttattgtaaa

SEQ ID NO: 4162016 - DNA, 13 bp, Homo sapiens
tttttatttaatt

SEQ ID NO: 4162017 - DNA, 13 bp, Homo sapiens
tttttcaaaagaa

SEQ ID NO: 4162018 - DNA, 20 bp, Homo sapiens
tttttcaatatattgaactt

SEQ ID NO: 4162019 - DNA, 11 bp, Homo sapiens
tttttcagttg

SEQ ID NO: 4162020 - DNA, 16 bp, Homo sapiens
tttttcagttgttctt

SEQ ID NO: 4162021 - DNA, 20 bp, Homo sapiens
tttttcagttgttcttttta

SEQ ID NO: 4162022 - DNA, 21 bp, Homo sapiens
tttttccacaaggaataaatg

SEQ ID NO: 4162023 - DNA, 14 bp, Homo sapiens
tttttccactttgt

SEQ ID NO: 4162024 - DNA, 23 bp, Homo sapiens
tttttcctcttcagaacttgtca

SEQ ID NO: 4162025 - DNA, 11 bp, Homo sapiens
tttttcctttt

SEQ ID NO: 4162026 - DNA, 16 bp, Homo sapiens
tttttcctttttctga

SEQ ID NO: 4162027 - DNA, 15 bp, Homo sapiens
tttttctaagagaag

SEQ ID NO: 4162028 - DNA, 16 bp, Homo sapiens
tttttctaagagaagt

SEQ ID NO: 4162029 - DNA, 22 bp, Homo sapiens
tttttctacctgtacacattcc

SEQ ID NO: 4162030 - DNA, 18 bp, Homo sapiens
tttttctcaaagttttga

SEQ ID NO: 4162031 - DNA, 16 bp, Homo sapiens
tttttctgattagctt

SEQ ID NO: 4162032 - DNA, 19 bp, Homo sapiens
tttttcttaaatatgtata

SEQ ID NO: 4162033 - DNA, 13 bp, Homo sapiens
tttttcttggggt

SEQ ID NO: 4162034 - DNA, 23 bp, Homo sapiens
tttttgactttttttgtatgtgt

SEQ ID NO: 4162035 - DNA, 14 bp, Homo sapiens
tttttgatagcttt

SEQ ID NO: 4162036 - DNA, 19 bp, Homo sapiens
tttttgcaactaggtattt

SEQ ID NO: 4162037 - DNA, 14 bp, Homo sapiens
tttttgcagtaact

SEQ ID NO: 4162038 - DNA, 16 bp, Homo sapiens
tttttgccacagcttt

SEQ ID NO: 4162039 - DNA, 18 bp, Homo sapiens
tttttgccagttttccct

SEQ ID NO: 4162040 - DNA, 20 bp, Homo sapiens
tttttgggcagcaatttaaa

SEQ ID NO: 4162041 - DNA, 23 bp, Homo sapiens
tttttgggcagcaatttaaatgt

SEQ ID NO: 4162042 - DNA, 15 bp, Homo sapiens
tttttggtaataaca

SEQ ID NO: 4162043 - DNA, 23 bp, Homo sapiens
tttttggtaataacaaacgtgtt

SEQ ID NO: 4162044 - DNA, 20 bp, Homo sapiens
tttttggtataatgtttaaa

SEQ ID NO: 4162045 - DNA, 22 bp, Homo sapiens
tttttggtcgaggagtaacaat

SEQ ID NO: 4162046 - DNA, 12 bp, Homo sapiens
tttttgtacatg

SEQ ID NO: 4162047 - DNA, 12 bp, Homo sapiens
tttttgtacttt

SEQ ID NO: 4162048 - DNA, 18 bp, Homo sapiens
tttttgtataaaatagac

SEQ ID NO: 4162049 - DNA, 12 bp, Homo sapiens
tttttgtatgtg

SEQ ID NO: 4162050 - DNA, 20 bp, Homo sapiens
tttttgtatgttatgaacat

SEQ ID NO: 4162051 - DNA, 13 bp, Homo sapiens
tttttgtgtttct

SEQ ID NO: 4162052 - DNA, 22 bp, Homo sapiens
tttttgtgttttgttctttaaa

SEQ ID NO: 4162053 - DNA, 22 bp, Homo sapiens
tttttgttccacaagttaaata

SEQ ID NO: 4162054 - DNA, 19 bp, Homo sapiens
tttttgttggagtgtttct

SEQ ID NO: 4162055 - DNA, 22 bp, Homo sapiens
tttttgtttctttgtgtttgct

SEQ ID NO: 4162056 - DNA, 11 bp, Homo sapiens
tttttgtttgt

SEQ ID NO: 4162057 - DNA, 15 bp, Homo sapiens
tttttgtttgtttgt

SEQ ID NO: 4162058 - DNA, 14 bp, Homo sapiens
ttttttaaaataga

SEQ ID NO: 4162059 - DNA, 17 bp, Homo sapiens
ttttttaagaatatctg

SEQ ID NO: 4162060 - DNA, 12 bp, Homo sapiens
ttttttaattta

SEQ ID NO: 4162061 - DNA, 13 bp, Homo sapiens
ttttttactcttt

SEQ ID NO: 4162062 - DNA, 13 bp, Homo sapiens
ttttttatgctaa

SEQ ID NO: 4162063 - DNA, 16 bp, Homo sapiens
ttttttatgctaatca

SEQ ID NO: 4162064 - DNA, 11 bp, Homo sapiens
ttttttctacc

SEQ ID NO: 4162065 - DNA, 12 bp, Homo sapiens
ttttttgaaaac

SEQ ID NO: 4162066 - DNA, 16 bp, Homo sapiens
ttttttgggcagcaat

SEQ ID NO: 4162067 - DNA, 21 bp, Homo sapiens
ttttttggtataatgtttaaa

SEQ ID NO: 4162068 - DNA, 12 bp, Homo sapiens
ttttttgtagtt

SEQ ID NO: 4162069 - DNA, 13 bp, Homo sapiens
ttttttgtttgtt

SEQ ID NO: 4162070 - DNA, 14 bp, Homo sapiens
tttttttctaagag

SEQ ID NO: 4162071 - DNA, 10 bp, Homo sapiens
tttttttgca

SEQ ID NO: 4162072 - DNA, 13 bp, Homo sapiens
tttttttgtttgt

SEQ ID NO: 4162073 - DNA, 18 bp, Homo sapiens
ctcaattgttcttttcct

SEQ ID NO: 4162074 - DNA, 18 bp, Homo sapiens
ctcacagcctctccctta

SEQ ID NO: 4162075 - DNA, 13 bp, Homo sapiens
ctcaccaggaagg

SEQ ID NO: 4162076 - DNA, 14 bp, Homo sapiens
ctcacctctctcta

SEQ ID NO: 4162077 - DNA, 14 bp, Homo sapiens
ctcactccattcct

SEQ ID NO: 4162078 - DNA, 12 bp, Homo sapiens
ctcactgctgtc

SEQ ID NO: 4162079 - DNA, 21 bp, Homo sapiens
ctcactgctgtcagccaagtc

SEQ ID NO: 4162080 - DNA, 17 bp, Homo sapiens
ctcactggtccatttct

SEQ ID NO: 4162081 - DNA, 21 bp, Homo sapiens
ctcactggtccatttctcagt

SEQ ID NO: 4162082 - DNA, 20 bp, Homo sapiens
ctcacttttttacaactcca

SEQ ID NO: 4162083 - DNA, 22 bp, Homo sapiens
ctcacttttttacaactccaac

SEQ ID NO: 4162084 - DNA, 22 bp, Homo sapiens
ctcagaaaagaaaaccatttta

SEQ ID NO: 4162085 - DNA, 19 bp, Homo sapiens
ctcagaaaatggggcttgc

SEQ ID NO: 4162086 - DNA, 11 bp, Homo sapiens
ctcagaagcct

SEQ ID NO: 4162087 - DNA, 17 bp, Homo sapiens
ctcagaagcctgaggct

SEQ ID NO: 4162088 - DNA, 15 bp, Homo sapiens
ctcagagcaggctca

SEQ ID NO: 4162089 - DNA, 15 bp, Homo sapiens
ctcagattacacttc

SEQ ID NO: 4162090 - DNA, 20 bp, Homo sapiens
ctcagattacacttctccag

SEQ ID NO: 4162091 - DNA, 18 bp, Homo sapiens
ctcagcagccccctgccc

SEQ ID NO: 4162092 - DNA, 17 bp, Homo sapiens
ctcagcataagtaaaca

SEQ ID NO: 4162093 - DNA, 18 bp, Homo sapiens
ctcagcataagtaaacaa

SEQ ID NO: 4162094 - DNA, 22 bp, Homo sapiens
ctcagccacaaaactctgtcag

SEQ ID NO: 4162095 - DNA, 13 bp, Homo sapiens
ctcagccacaccc

SEQ ID NO: 4162096 - DNA, 14 bp, Homo sapiens
ctcagccacacccc

SEQ ID NO: 4162097 - DNA, 19 bp, Homo sapiens
ctcagccgcagacaagtaa

SEQ ID NO: 4162098 - DNA, 13 bp, Homo sapiens
ctcagctccagaa

SEQ ID NO: 4162099 - DNA, 23 bp, Homo sapiens
ctcagctccagaataccttcttc

SEQ ID NO: 4162100 - DNA, 19 bp, Homo sapiens
ctcagctcgctgcccaggg

SEQ ID NO: 4162101 - DNA, 14 bp, Homo sapiens
ctcagcttttttct

SEQ ID NO: 4162102 - DNA, 11 bp, Homo sapiens
ctcaggaacag

SEQ ID NO: 4162103 - DNA, 13 bp, Homo sapiens
ctcaggaacagaa

SEQ ID NO: 4162104 - DNA, 15 bp, Homo sapiens
ctcaggaacagaaca

SEQ ID NO: 4162105 - DNA, 13 bp, Homo sapiens
ctcaggagcctcc

SEQ ID NO: 4162106 - DNA, 18 bp, Homo sapiens
ctcaggaggcgaataaat

SEQ ID NO: 4162107 - DNA, 19 bp, Homo sapiens
ctcaggaggcgaataaatg

SEQ ID NO: 4162108 - DNA, 16 bp, Homo sapiens
ctcaggcagttactat

SEQ ID NO: 4162109 - DNA, 13 bp, Homo sapiens
ctcaggccagagc

SEQ ID NO: 4162110 - DNA, 16 bp, Homo sapiens
ctcaggccagagccaa

SEQ ID NO: 4162111 - DNA, 15 bp, Homo sapiens
ctcaggccaggtgca

SEQ ID NO: 4162112 - DNA, 20 bp, Homo sapiens
ctcagggctgtcttggtgga

SEQ ID NO: 4162113 - DNA, 22 bp, Homo sapiens
ctcaggggccagtgagggctgg

SEQ ID NO: 4162114 - DNA, 22 bp, Homo sapiens
ctcagtaatttagaaatcattt

SEQ ID NO: 4162115 - DNA, 16 bp, Homo sapiens
ctcagtcatattctta

SEQ ID NO: 4162116 - DNA, 15 bp, Homo sapiens
ctcagtccagatgcc

SEQ ID NO: 4162117 - DNA, 20 bp, Homo sapiens
ctcagtccagatgccttcct

SEQ ID NO: 4162118 - DNA, 21 bp, Homo sapiens
ctcagtctagtgaagatgttg

SEQ ID NO: 4162119 - DNA, 16 bp, Homo sapiens
ctcagtctcaggagca

SEQ ID NO: 4162120 - DNA, 13 bp, Homo sapiens
ctcagtgctctcc

SEQ ID NO: 4162121 - DNA, 15 bp, Homo sapiens
ctcagtgggctccct

SEQ ID NO: 4162122 - DNA, 22 bp, Homo sapiens
ctcagtgggctccctggcccag

SEQ ID NO: 4162123 - DNA, 23 bp, Homo sapiens
ctcagtgggctccctggcccagc

SEQ ID NO: 4162124 - DNA, 15 bp, Homo sapiens
ctcagttgattttct

SEQ ID NO: 4162125 - DNA, 18 bp, Homo sapiens
ctcataagtttgtttaaa

SEQ ID NO: 4162126 - DNA, 23 bp, Homo sapiens
ctcatataaaaggtgagctcagc

SEQ ID NO: 4162127 - DNA, 13 bp, Homo sapiens
ctcatattttgta

SEQ ID NO: 4162128 - DNA, 21 bp, Homo sapiens
ctcatattttgtatatatctg

SEQ ID NO: 4162129 - DNA, 19 bp, Homo sapiens
ctcatctactcattgtctc

SEQ ID NO: 4162130 - DNA, 21 bp, Homo sapiens
ctcatgcctggcccccctcca

SEQ ID NO: 4162131 - DNA, 23 bp, Homo sapiens
ctcatgcttcttctcatggggtg

SEQ ID NO: 4162132 - DNA, 18 bp, Homo sapiens
ctcattccaacagtgagt

SEQ ID NO: 4162133 - DNA, 17 bp, Homo sapiens
ctcattccttctggagg

SEQ ID NO: 4162134 - DNA, 15 bp, Homo sapiens
ctcattgtttttccc

SEQ ID NO: 4162135 - DNA, 23 bp, Homo sapiens
ctcatttgtcatttaccctggtg

SEQ ID NO: 4162136 - DNA, 20 bp, Homo sapiens
ctccaagagctacataattt

SEQ ID NO: 4162137 - DNA, 17 bp, Homo sapiens
ctccaaggtgctctgtg

SEQ ID NO: 4162138 - DNA, 20 bp, Homo sapiens
ctccacattaagtggctttt

SEQ ID NO: 4162139 - DNA, 14 bp, Homo sapiens
ctccacccactgtc

SEQ ID NO: 4162140 - DNA, 16 bp, Homo sapiens
ctccaccccctccagc

SEQ ID NO: 4162141 - DNA, 16 bp, Homo sapiens
ctccaccgcagaagga

SEQ ID NO: 4162142 - DNA, 18 bp, Homo sapiens
ctccaccgcagaaggaag

SEQ ID NO: 4162143 - DNA, 19 bp, Homo sapiens
ctccagagacaggaaagaa

SEQ ID NO: 4162144 - DNA, 17 bp, Homo sapiens
ctccagatctgcactgg

SEQ ID NO: 4162145 - DNA, 18 bp, Homo sapiens
ctccagatctgcactggg

SEQ ID NO: 4162146 - DNA, 19 bp, Homo sapiens
ctccagatctgcactgggt

SEQ ID NO: 4162147 - DNA, 21 bp, Homo sapiens
ctccagatctgcactgggtgt

SEQ ID NO: 4162148 - DNA, 21 bp, Homo sapiens
ctccagcaggtaggggcacag

SEQ ID NO: 4162149 - DNA, 22 bp, Homo sapiens
ctccagcaggtaggggcacagt

SEQ ID NO: 4162150 - DNA, 12 bp, Homo sapiens
ctccagcctggg

SEQ ID NO: 4162151 - DNA, 13 bp, Homo sapiens
ctccagcctgggc

SEQ ID NO: 4162152 - DNA, 14 bp, Homo sapiens
ctccagcctggggt

SEQ ID NO: 4162153 - DNA, 12 bp, Homo sapiens
ctccagctccag

SEQ ID NO: 4162154 - DNA, 15 bp, Homo sapiens
ctccaggatctttga

SEQ ID NO: 4162155 - DNA, 15 bp, Homo sapiens
ctccaggctttacag

SEQ ID NO: 4162156 - DNA, 21 bp, Homo sapiens
ctccagggtctaaagagaaca

SEQ ID NO: 4162157 - DNA, 19 bp, Homo sapiens
ctccaggtccggaggggtt

SEQ ID NO: 4162158 - DNA, 18 bp, Homo sapiens
ctccagtgctggatttga

SEQ ID NO: 4162159 - DNA, 19 bp, Homo sapiens
ctccatttcaactccagaa

SEQ ID NO: 4162160 - DNA, 18 bp, Homo sapiens
ctcccagcaagtttcacc

SEQ ID NO: 4162161 - DNA, 21 bp, Homo sapiens
ctcccagcgtgtgtatccgac

SEQ ID NO: 4162162 - DNA, 19 bp, Homo sapiens
ctcccagggccagggccct

SEQ ID NO: 4162163 - DNA, 16 bp, Homo sapiens
ctcccagggtcctggg

SEQ ID NO: 4162164 - DNA, 22 bp, Homo sapiens
ctcccagggtcctgggggctgc

SEQ ID NO: 4162165 - DNA, 14 bp, Homo sapiens
ctccccacagtcct

SEQ ID NO: 4162166 - DNA, 19 bp, Homo sapiens
ctccccacagtcctcacag

SEQ ID NO: 4162167 - DNA, 22 bp, Homo sapiens
ctccccacagtcctcacagcct

SEQ ID NO: 4162168 - DNA, 21 bp, Homo sapiens
ctccccaggccaggccaccag

SEQ ID NO: 4162169 - DNA, 12 bp, Homo sapiens
ctcccccagagc

SEQ ID NO: 4162170 - DNA, 13 bp, Homo sapiens
ctcccccagagcc

SEQ ID NO: 4162171 - DNA, 20 bp, Homo sapiens
ctccccctagcaaggtccag

SEQ ID NO: 4162172 - DNA, 13 bp, Homo sapiens
ctccccctgggct

SEQ ID NO: 4162173 - DNA, 19 bp, Homo sapiens
ctcccctccctcttccttc

SEQ ID NO: 4162174 - DNA, 20 bp, Homo sapiens
ctcccctccctcttccttcc

SEQ ID NO: 4162175 - DNA, 16 bp, Homo sapiens
ctcccctctcctccgc

SEQ ID NO: 4162176 - DNA, 14 bp, Homo sapiens
ctcccctgccctgc

SEQ ID NO: 4162177 - DNA, 16 bp, Homo sapiens
ctcccctggtcctgca

SEQ ID NO: 4162178 - DNA, 19 bp, Homo sapiens
ctcccctggtcctgcactg

SEQ ID NO: 4162179 - DNA, 16 bp, Homo sapiens
ctcccgccaccctcaa

SEQ ID NO: 4162180 - DNA, 14 bp, Homo sapiens
ctccctaaactgta

SEQ ID NO: 4162181 - DNA, 12 bp, Homo sapiens
ctccctcctgga

SEQ ID NO: 4162182 - DNA, 19 bp, Homo sapiens
ctccctcctggagcatccc

SEQ ID NO: 4162183 - DNA, 22 bp, Homo sapiens
ctccctcctggagcatcccagg

SEQ ID NO: 4162184 - DNA, 18 bp, Homo sapiens
ctccctctgacctgcagg

SEQ ID NO: 4162185 - DNA, 12 bp, Homo sapiens
ctccctcttcct

SEQ ID NO: 4162186 - DNA, 15 bp, Homo sapiens
ctccctgctgccagg

SEQ ID NO: 4162187 - DNA, 13 bp, Homo sapiens
ctccctggcccag

SEQ ID NO: 4162188 - DNA, 14 bp, Homo sapiens
ctccctggcccagc

SEQ ID NO: 4162189 - DNA, 15 bp, Homo sapiens
ctccctggctctcag

SEQ ID NO: 4162190 - DNA, 19 bp, Homo sapiens
ctccctgttatctgctaga

SEQ ID NO: 4162191 - DNA, 20 bp, Homo sapiens
ctccctgttatctgctagat

SEQ ID NO: 4162192 - DNA, 16 bp, Homo sapiens
ctccgactgctaggga

SEQ ID NO: 4162193 - DNA, 14 bp, Homo sapiens
ctccgccattccaa

SEQ ID NO: 4162194 - DNA, 14 bp, Homo sapiens
ctccgcccttccct

SEQ ID NO: 4162195 - DNA, 20 bp, Homo sapiens
ctccgcccttccctgacact

SEQ ID NO: 4162196 - DNA, 21 bp, Homo sapiens
ctccgcgagggctactcagca

SEQ ID NO: 4162197 - DNA, 23 bp, Homo sapiens
ctccgcgagggctactcagcagt

SEQ ID NO: 4162198 - DNA, 22 bp, Homo sapiens
ctccggaggggacccagctcct

SEQ ID NO: 4162199 - DNA, 11 bp, Homo sapiens
ctgccccaccc

SEQ ID NO: 4162200 - DNA, 13 bp, Homo sapiens
ctgccccagaggc

SEQ ID NO: 4162201 - DNA, 15 bp, Homo sapiens
ctgccccagctctgg

SEQ ID NO: 4162202 - DNA, 17 bp, Homo sapiens
ctgcccccgacagccca

SEQ ID NO: 4162203 - DNA, 19 bp, Homo sapiens
ctgcccccgacagcccagc

SEQ ID NO: 4162204 - DNA, 14 bp, Homo sapiens
ctgccccctggtgg

SEQ ID NO: 4162205 - DNA, 22 bp, Homo sapiens
ctgccccctggtggacagtcct

SEQ ID NO: 4162206 - DNA, 15 bp, Homo sapiens
ctgccccgcccagct

SEQ ID NO: 4162207 - DNA, 16 bp, Homo sapiens
ctgccccgcccagctg

SEQ ID NO: 4162208 - DNA, 17 bp, Homo sapiens
ctgccccgcccagctgc

SEQ ID NO: 4162209 - DNA, 19 bp, Homo sapiens
ctgccccgggtgcctcaga

SEQ ID NO: 4162210 - DNA, 18 bp, Homo sapiens
ctgcccctccccagccct

SEQ ID NO: 4162211 - DNA, 17 bp, Homo sapiens
ctgcccgcagagcccac

SEQ ID NO: 4162212 - DNA, 13 bp, Homo sapiens
ctgccctgccacc

SEQ ID NO: 4162213 - DNA, 17 bp, Homo sapiens
ctgccctgccacctgtc

SEQ ID NO: 4162214 - DNA, 16 bp, Homo sapiens
ctgccctgccactttg

SEQ ID NO: 4162215 - DNA, 11 bp, Homo sapiens
ctgccctgccc

SEQ ID NO: 4162216 - DNA, 18 bp, Homo sapiens
ctgccgcctcccagcctg

SEQ ID NO: 4162217 - DNA, 13 bp, Homo sapiens
ctgccgtcagtgc

SEQ ID NO: 4162218 - DNA, 16 bp, Homo sapiens
ctgcctcccattctga

SEQ ID NO: 4162219 - DNA, 15 bp, Homo sapiens
ctgcctctctgctcc

SEQ ID NO: 4162220 - DNA, 16 bp, Homo sapiens
ctgcctctctgctcca

SEQ ID NO: 4162221 - DNA, 20 bp, Homo sapiens
ctgcctctctgctccagaga

SEQ ID NO: 4162222 - DNA, 22 bp, Homo sapiens
ctgcctggaggatccctccatc

SEQ ID NO: 4162223 - DNA, 16 bp, Homo sapiens
ctgcctgtagttagga

SEQ ID NO: 4162224 - DNA, 17 bp, Homo sapiens
ctgcctgtagttaggaa

SEQ ID NO: 4162225 - DNA, 22 bp, Homo sapiens
ctgcctgtagttaggaaataaa

SEQ ID NO: 4162226 - DNA, 18 bp, Homo sapiens
ctgcctgtggagacagcc

SEQ ID NO: 4162227 - DNA, 23 bp, Homo sapiens
ctgcctgtggagacagccctgcc

SEQ ID NO: 4162228 - DNA, 19 bp, Homo sapiens
ctgcctgtggtgaggtcct

SEQ ID NO: 4162229 - DNA, 18 bp, Homo sapiens
ctgccttttgctgctgct

SEQ ID NO: 4162230 - DNA, 21 bp, Homo sapiens
ctgccttttttcacagcccgg

SEQ ID NO: 4162231 - DNA, 20 bp, Homo sapiens
ctgcgatcttcagagcaggg

SEQ ID NO: 4162232 - DNA, 16 bp, Homo sapiens
ctgcggctgctgtgtg

SEQ ID NO: 4162233 - DNA, 19 bp, Homo sapiens
ctgcggctgctgtgtgcct

SEQ ID NO: 4162234 - DNA, 18 bp, Homo sapiens
ctgcgggatggtcctggg

SEQ ID NO: 4162235 - DNA, 20 bp, Homo sapiens
ctgcgggatggtcctggggc

SEQ ID NO: 4162236 - DNA, 16 bp, Homo sapiens
ctgctacctctgagaa

SEQ ID NO: 4162237 - DNA, 20 bp, Homo sapiens
ctgctacctctgagaagaca

SEQ ID NO: 4162238 - DNA, 18 bp, Homo sapiens
ctgctaggcgagtgccag

SEQ ID NO: 4162239 - DNA, 13 bp, Homo sapiens
ctgctagggcccc

SEQ ID NO: 4162240 - DNA, 20 bp, Homo sapiens
ctgctatatgccttaagcca

SEQ ID NO: 4162241 - DNA, 17 bp, Homo sapiens
ctgctatattttcatga

SEQ ID NO: 4162242 - DNA, 15 bp, Homo sapiens
ctgctcattccttct

SEQ ID NO: 4162243 - DNA, 19 bp, Homo sapiens
ctgctcattccttctggag

SEQ ID NO: 4162244 - DNA, 11 bp, Homo sapiens
ctgctccagag

SEQ ID NO: 4162245 - DNA, 16 bp, Homo sapiens
ctgctcctccagccct

SEQ ID NO: 4162246 - DNA, 11 bp, Homo sapiens
ctgctctgcta

SEQ ID NO: 4162247 - DNA, 13 bp, Homo sapiens
ctgctctggaaaa

SEQ ID NO: 4162248 - DNA, 17 bp, Homo sapiens
ctgctgagcagcccagc

SEQ ID NO: 4162249 - DNA, 13 bp, Homo sapiens
ctgctgcactgcc

SEQ ID NO: 4162250 - DNA, 22 bp, Homo sapiens
ctgctgccatggcgtgtccctc

SEQ ID NO: 4162251 - DNA, 14 bp, Homo sapiens
ctgctgccgcctcc

SEQ ID NO: 4162252 - DNA, 20 bp, Homo sapiens
ctgctgccgcctcccagcct

SEQ ID NO: 4162253 - DNA, 16 bp, Homo sapiens
ctgctgcgtcagacca

SEQ ID NO: 4162254 - DNA, 17 bp, Homo sapiens
ctgctgggactggccag

SEQ ID NO: 4162255 - DNA, 22 bp, Homo sapiens
ctgctgggagatgccattctcc

SEQ ID NO: 4162256 - DNA, 17 bp, Homo sapiens
ctgcttctcctcccagc

SEQ ID NO: 4162257 - DNA, 14 bp, Homo sapiens
ctggaaaagaggag

SEQ ID NO: 4162258 - DNA, 23 bp, Homo sapiens
ctggaaaataatactgctgagat

SEQ ID NO: 4162259 - DNA, 21 bp, Homo sapiens
ctggaaaggctcagtctcagg

SEQ ID NO: 4162260 - DNA, 22 bp, Homo sapiens
ctggaaaggctcagtctcagga

SEQ ID NO: 4162261 - DNA, 20 bp, Homo sapiens
ctggaaataaacctggagat

SEQ ID NO: 4162262 - DNA, 21 bp, Homo sapiens
ctggaaataaacctggagatg

SEQ ID NO: 4162263 - DNA, 22 bp, Homo sapiens
ctggaacactagacaagccaga

SEQ ID NO: 4162264 - DNA, 13 bp, Homo sapiens
ctggaaccactga

SEQ ID NO: 4162265 - DNA, 12 bp, Homo sapiens
ctggaagcacat

SEQ ID NO: 4162266 - DNA, 15 bp, Homo sapiens
ctggaagcacatgtt

SEQ ID NO: 4162267 - DNA, 15 bp, Homo sapiens
ctggaagtttctggt

SEQ ID NO: 4162268 - DNA, 20 bp, Homo sapiens
ctggaatcaaggaatcctga

SEQ ID NO: 4162269 - DNA, 19 bp, Homo sapiens
ctggaccagatcctactct

SEQ ID NO: 4162270 - DNA, 21 bp, Homo sapiens
ctggaccgcttcccagaggcc

SEQ ID NO: 4162271 - DNA, 17 bp, Homo sapiens
ctggacggcattcctgc

SEQ ID NO: 4162272 - DNA, 20 bp, Homo sapiens
ctggactgggttttgtctct

SEQ ID NO: 4162273 - DNA, 13 bp, Homo sapiens
ctggacttgagct

SEQ ID NO: 4162274 - DNA, 18 bp, Homo sapiens
ctggacttgagcttggca

SEQ ID NO: 4162275 - DNA, 13 bp, Homo sapiens
ctggagaagctga

SEQ ID NO: 4162276 - DNA, 15 bp, Homo sapiens
ctggagaagctgatg

SEQ ID NO: 4162277 - DNA, 14 bp, Homo sapiens
ctggagatgatgat

SEQ ID NO: 4162278 - DNA, 16 bp, Homo sapiens
ctggagatgatgatga

SEQ ID NO: 4162279 - DNA, 14 bp, Homo sapiens
ctggagccaaggca

SEQ ID NO: 4162280 - DNA, 17 bp, Homo sapiens
ctggagccaaggcagag

SEQ ID NO: 4162281 - DNA, 21 bp, Homo sapiens
ctggagccaaggcagagggga

SEQ ID NO: 4162282 - DNA, 13 bp, Homo sapiens
ctggagcccagga

SEQ ID NO: 4162283 - DNA, 20 bp, Homo sapiens
ctggagcccgcttcaagctc

SEQ ID NO: 4162284 - DNA, 15 bp, Homo sapiens
ctggagcccttgggt

SEQ ID NO: 4162285 - DNA, 22 bp, Homo sapiens
ctggagcggagcttgcctgcct

SEQ ID NO: 4162286 - DNA, 12 bp, Homo sapiens
ctggaggacaca

SEQ ID NO: 4162287 - DNA, 19 bp, Homo sapiens
ctggaggatccctccatcc

SEQ ID NO: 4162288 - DNA, 14 bp, Homo sapiens
ctggagggaggctc

SEQ ID NO: 4162289 - DNA, 19 bp, Homo sapiens
ctggaggtcacattcagga

SEQ ID NO: 4162290 - DNA, 21 bp, Homo sapiens
ctggaggtcacattcaggaag

SEQ ID NO: 4162291 - DNA, 20 bp, Homo sapiens
ctggagtcccctgggcctgg

SEQ ID NO: 4162292 - DNA, 22 bp, Homo sapiens
ctggagtcccctgggcctggac

SEQ ID NO: 4162293 - DNA, 13 bp, Homo sapiens
ctggagtgcagtt

SEQ ID NO: 4162294 - DNA, 18 bp, Homo sapiens
ctggatgcagtggctcat

SEQ ID NO: 4162295 - DNA, 22 bp, Homo sapiens
ctggatggtagaataagttgga

SEQ ID NO: 4162296 - DNA, 20 bp, Homo sapiens
ctggattccccatctcaggc

SEQ ID NO: 4162297 - DNA, 21 bp, Homo sapiens
ctggattccccatctcaggcc

SEQ ID NO: 4162298 - DNA, 13 bp, Homo sapiens
ctggatttgatga

SEQ ID NO: 4162299 - DNA, 21 bp, Homo sapiens
ctggcaaaggtggctctccag

SEQ ID NO: 4162300 - DNA, 17 bp, Homo sapiens
ctggcaaggcattcctc

SEQ ID NO: 4162301 - DNA, 22 bp, Homo sapiens
ctggcagtttatatttaactct

SEQ ID NO: 4162302 - DNA, 21 bp, Homo sapiens
ctggcatgacactctagtgac

SEQ ID NO: 4162303 - DNA, 22 bp, Homo sapiens
ctggcatggtgctttcaggtct

SEQ ID NO: 4162304 - DNA, 21 bp, Homo sapiens
ctggcatgtcagagccaggct

SEQ ID NO: 4162305 - DNA, 16 bp, Homo sapiens
ctggcattggtctgct

SEQ ID NO: 4162306 - DNA, 20 bp, Homo sapiens
ctggcattggtctgctgacc

SEQ ID NO: 4162307 - DNA, 13 bp, Homo sapiens
ctggccatcccca

SEQ ID NO: 4162308 - DNA, 11 bp, Homo sapiens
ctggcccagcc

SEQ ID NO: 4162309 - DNA, 13 bp, Homo sapiens
ctggcccagccag

SEQ ID NO: 4162310 - DNA, 14 bp, Homo sapiens
ctggcccagccagc

SEQ ID NO: 4162311 - DNA, 23 bp, Homo sapiens
ctggccccaccctcgtggacacc

SEQ ID NO: 4162312 - DNA, 15 bp, Homo sapiens
ctggcccccctccag

SEQ ID NO: 4162313 - DNA, 22 bp, Homo sapiens
ctggcccgtcatgttcctcaaa

SEQ ID NO: 4162314 - DNA, 16 bp, Homo sapiens
ctggccctccactcct

SEQ ID NO: 4162315 - DNA, 12 bp, Homo sapiens
ctggccctggct

SEQ ID NO: 4162316 - DNA, 13 bp, Homo sapiens
ctggcctccacag

SEQ ID NO: 4162317 - DNA, 18 bp, Homo sapiens
ctggcctcccaataaagc

SEQ ID NO: 4162318 - DNA, 19 bp, Homo sapiens
ctggctccaaggtgctctg

SEQ ID NO: 4162319 - DNA, 21 bp, Homo sapiens
ctggctccaaggtgctctgtg

SEQ ID NO: 4162320 - DNA, 13 bp, Homo sapiens
ctggctccagaat

SEQ ID NO: 4162321 - DNA, 20 bp, Homo sapiens
ctggctcctccttcccctgt

SEQ ID NO: 4162322 - DNA, 15 bp, Homo sapiens
ctggctcctttgcct

SEQ ID NO: 4162323 - DNA, 18 bp, Homo sapiens
ctggctcctttgcctctg

SEQ ID NO: 4162324 - DNA, 16 bp, Homo sapiens
ctggctgacctgggcc

SEQ ID NO: 4162325 - DNA, 18 bp, Homo sapiens
ctggctgacctgggccca

SEQ ID NO: 4162326 - DNA, 17 bp, Homo sapiens
ctggctggctgcagtga

SEQ ID NO: 4162327 - DNA, 19 bp, Homo sapiens
gaatataattgttttatct

SEQ ID NO: 4162328 - DNA, 15 bp, Homo sapiens
gaatatgactgtttt

SEQ ID NO: 4162329 - DNA, 18 bp, Homo sapiens
gaatatttcaaatgaaca

SEQ ID NO: 4162330 - DNA, 14 bp, Homo sapiens
gaatcaaggaatcc

SEQ ID NO: 4162331 - DNA, 16 bp, Homo sapiens
gaatcagctggtggct

SEQ ID NO: 4162332 - DNA, 14 bp, Homo sapiens
gaatcattgtgctt

SEQ ID NO: 4162333 - DNA, 15 bp, Homo sapiens
gaatccgcctgcaga

SEQ ID NO: 4162334 - DNA, 13 bp, Homo sapiens
gaatcctgctgcc

SEQ ID NO: 4162335 - DNA, 14 bp, Homo sapiens
gaatcggctgggga

SEQ ID NO: 4162336 - DNA, 17 bp, Homo sapiens
gaatcgtttcaaatgga

SEQ ID NO: 4162337 - DNA, 17 bp, Homo sapiens
gaatctgcagggagcaa

SEQ ID NO: 4162338 - DNA, 18 bp, Homo sapiens
gaatctgccattactctg

SEQ ID NO: 4162339 - DNA, 23 bp, Homo sapiens
gaatcttggtttgccttccagaa

SEQ ID NO: 4162340 - DNA, 19 bp, Homo sapiens
gaatctttaaaagatgctt

SEQ ID NO: 4162341 - DNA, 15 bp, Homo sapiens
gaatgacaagcatca

SEQ ID NO: 4162342 - DNA, 14 bp, Homo sapiens
gaatgagtctgctt

SEQ ID NO: 4162343 - DNA, 16 bp, Homo sapiens
gaatgatttttagatg

SEQ ID NO: 4162344 - DNA, 21 bp, Homo sapiens
gaatgcctcaatgtgaccagg

SEQ ID NO: 4162345 - DNA, 18 bp, Homo sapiens
gaatgctttttgaatgtt

SEQ ID NO: 4162346 - DNA, 17 bp, Homo sapiens
gaatggcctgccttgaa

SEQ ID NO: 4162347 - DNA, 19 bp, Homo sapiens
gaatggctatgtttttaat

SEQ ID NO: 4162348 - DNA, 17 bp, Homo sapiens
gaatgggctgcagaaga

SEQ ID NO: 4162349 - DNA, 21 bp, Homo sapiens
gaatggggcgatcaagtccag

SEQ ID NO: 4162350 - DNA, 14 bp, Homo sapiens
gaatgtgtgtatgt

SEQ ID NO: 4162351 - DNA, 14 bp, Homo sapiens
gaatgtttattcct

SEQ ID NO: 4162352 - DNA, 17 bp, Homo sapiens
gaattaactccattcca

SEQ ID NO: 4162353 - DNA, 13 bp, Homo sapiens
gaattaagttatt

SEQ ID NO: 4162354 - DNA, 14 bp, Homo sapiens
gaattaagttattg

SEQ ID NO: 4162355 - DNA, 17 bp, Homo sapiens
gaattattatgtctcaa

SEQ ID NO: 4162356 - DNA, 16 bp, Homo sapiens
gaattccaaggagttc

SEQ ID NO: 4162357 - DNA, 21 bp, Homo sapiens
gaattcttatgcttataatat

SEQ ID NO: 4162358 - DNA, 18 bp, Homo sapiens
gaattcttgagtttacat

SEQ ID NO: 4162359 - DNA, 22 bp, Homo sapiens
gaattgcctgcagagagaagcc

SEQ ID NO: 4162360 - DNA, 17 bp, Homo sapiens
gaattggcctcagtgta

SEQ ID NO: 4162361 - DNA, 18 bp, Homo sapiens
gaattgtccatgtgcttc

SEQ ID NO: 4162362 - DNA, 15 bp, Homo sapiens
gaatttaaaaatatc

SEQ ID NO: 4162363 - DNA, 21 bp, Homo sapiens
gaatttaatgcttaaaaatgt

SEQ ID NO: 4162364 - DNA, 14 bp, Homo sapiens
gaatttaatttatg

SEQ ID NO: 4162365 - DNA, 14 bp, Homo sapiens
gaatttgtaagttt

SEQ ID NO: 4162366 - DNA, 14 bp, Homo sapiens
gaatttgtattttg

SEQ ID NO: 4162367 - DNA, 23 bp, Homo sapiens
gacaaatattgttaccatgaaga

SEQ ID NO: 4162368 - DNA, 22 bp, Homo sapiens
gacaaatttgcaaaactgtgct

SEQ ID NO: 4162369 - DNA, 23 bp, Homo sapiens
gacaaatttgcaaaactgtgctt

SEQ ID NO: 4162370 - DNA, 12 bp, Homo sapiens
gacaacagaagc

SEQ ID NO: 4162371 - DNA, 22 bp, Homo sapiens
gacaacatttttggtgtatttg

SEQ ID NO: 4162372 - DNA, 14 bp, Homo sapiens
gacaacctgcccct

SEQ ID NO: 4162373 - DNA, 13 bp, Homo sapiens
gacaagaagctgc

SEQ ID NO: 4162374 - DNA, 14 bp, Homo sapiens
gacaagaagctgct

SEQ ID NO: 4162375 - DNA, 15 bp, Homo sapiens
gacaagaagctgcta

SEQ ID NO: 4162376 - DNA, 19 bp, Homo sapiens
gacaagataaaggaagtca

SEQ ID NO: 4162377 - DNA, 14 bp, Homo sapiens
gacaagtagggcac

SEQ ID NO: 4162378 - DNA, 19 bp, Homo sapiens
gacaatcctgaagaaacca

SEQ ID NO: 4162379 - DNA, 21 bp, Homo sapiens
gacaatcctgaagaaaccaca

SEQ ID NO: 4162380 - DNA, 13 bp, Homo sapiens
gacaatgccttgg

SEQ ID NO: 4162381 - DNA, 14 bp, Homo sapiens
gacaatgccttggg

SEQ ID NO: 4162382 - DNA, 16 bp, Homo sapiens
gacacaggctcagcat

SEQ ID NO: 4162383 - DNA, 23 bp, Homo sapiens
gacacagtgttccagctgcctgg

SEQ ID NO: 4162384 - DNA, 22 bp, Homo sapiens
gacaccatcttttgtgagatgt

SEQ ID NO: 4162385 - DNA, 11 bp, Homo sapiens
gacacctgccc

SEQ ID NO: 4162386 - DNA, 16 bp, Homo sapiens
gacacctgccctgccc

SEQ ID NO: 4162387 - DNA, 18 bp, Homo sapiens
gacacctgggagaaatct

SEQ ID NO: 4162388 - DNA, 14 bp, Homo sapiens
gacactgtctgctg

SEQ ID NO: 4162389 - DNA, 16 bp, Homo sapiens
gacagaccccttggct

SEQ ID NO: 4162390 - DNA, 20 bp, Homo sapiens
gacagagaggagttgccagg

SEQ ID NO: 4162391 - DNA, 16 bp, Homo sapiens
gacagagctggctgtc

SEQ ID NO: 4162392 - DNA, 20 bp, Homo sapiens
gacagagctggctgtcttcc

SEQ ID NO: 4162393 - DNA, 15 bp, Homo sapiens
gacagatgaggcttt

SEQ ID NO: 4162394 - DNA, 17 bp, Homo sapiens
gacaggagggcaagggc

SEQ ID NO: 4162395 - DNA, 20 bp, Homo sapiens
gacaggagggcaagggccat

SEQ ID NO: 4162396 - DNA, 19 bp, Homo sapiens
gacaggatgtgtttgcttt

SEQ ID NO: 4162397 - DNA, 15 bp, Homo sapiens
gacaggtctagactt

SEQ ID NO: 4162398 - DNA, 20 bp, Homo sapiens
gacaggtctagactttctca

SEQ ID NO: 4162399 - DNA, 18 bp, Homo sapiens
gacagtcccttgctgaca

SEQ ID NO: 4162400 - DNA, 18 bp, Homo sapiens
gacagtcctgggagaacc

SEQ ID NO: 4162401 - DNA, 18 bp, Homo sapiens
gacagtgcttcagcctga

SEQ ID NO: 4162402 - DNA, 19 bp, Homo sapiens
gacagtgcttcagcctgag

SEQ ID NO: 4162403 - DNA, 17 bp, Homo sapiens
gacagtggtgggcgggg

SEQ ID NO: 4162404 - DNA, 19 bp, Homo sapiens
gacagtggtgggcggggag

SEQ ID NO: 4162405 - DNA, 16 bp, Homo sapiens
gacataaagcctctga

SEQ ID NO: 4162406 - DNA, 20 bp, Homo sapiens
gacataaagttgataaagat

SEQ ID NO: 4162407 - DNA, 16 bp, Homo sapiens
gacatatatattaaaa

SEQ ID NO: 4162408 - DNA, 17 bp, Homo sapiens
gacatatatattaaaat

SEQ ID NO: 4162409 - DNA, 22 bp, Homo sapiens
gacatgacttttctggaagaca

SEQ ID NO: 4162410 - DNA, 23 bp, Homo sapiens
gacatgatttagggaagcaggga

SEQ ID NO: 4162411 - DNA, 12 bp, Homo sapiens
gacatggaaggt

SEQ ID NO: 4162412 - DNA, 20 bp, Homo sapiens
gacatggaaggttagaggtt

SEQ ID NO: 4162413 - DNA, 12 bp, Homo sapiens
gacatggctttg

SEQ ID NO: 4162414 - DNA, 18 bp, Homo sapiens
gacatgttatatattttt

SEQ ID NO: 4162415 - DNA, 14 bp, Homo sapiens
gacattaaacctgg

SEQ ID NO: 4162416 - DNA, 13 bp, Homo sapiens
gaccacatgtgtt

SEQ ID NO: 4162417 - DNA, 16 bp, Homo sapiens
gaccacctctcaatat

SEQ ID NO: 4162418 - DNA, 11 bp, Homo sapiens
gaccagaatgc

SEQ ID NO: 4162419 - DNA, 18 bp, Homo sapiens
gaccagccgtgagcatgt

SEQ ID NO: 4162420 - DNA, 12 bp, Homo sapiens
gaccagcctggc

SEQ ID NO: 4162421 - DNA, 23 bp, Homo sapiens
gaccaggggtgatttcagagagg

SEQ ID NO: 4162422 - DNA, 21 bp, Homo sapiens
gaccaggttattttaaaaaga

SEQ ID NO: 4162423 - DNA, 15 bp, Homo sapiens
gaccagtactgggaa

SEQ ID NO: 4162424 - DNA, 20 bp, Homo sapiens
gaccagtactgggaaggagg

SEQ ID NO: 4162425 - DNA, 15 bp, Homo sapiens
gaccatcgtccagcc

SEQ ID NO: 4162426 - DNA, 18 bp, Homo sapiens
gacccagctcctctgagc

SEQ ID NO: 4162427 - DNA, 19 bp, Homo sapiens
gacccagctcctctgagcc

SEQ ID NO: 4162428 - DNA, 12 bp, Homo sapiens
gacccagtgaga

SEQ ID NO: 4162429 - DNA, 19 bp, Homo sapiens
gaccccaaagagcctggag

SEQ ID NO: 4162430 - DNA, 22 bp, Homo sapiens
gaccccttcctttcctctgcag

SEQ ID NO: 4162431 - DNA, 16 bp, Homo sapiens
gacccctttcccccac

SEQ ID NO: 4162432 - DNA, 14 bp, Homo sapiens
gaccctacaggaga

SEQ ID NO: 4162433 - DNA, 15 bp, Homo sapiens
gaccctacaggagag

SEQ ID NO: 4162434 - DNA, 19 bp, Homo sapiens
gaccctccaccgcagaagg

SEQ ID NO: 4162435 - DNA, 18 bp, Homo sapiens
gaccctcctccactccac

SEQ ID NO: 4162436 - DNA, 20 bp, Homo sapiens
gaccctctgaatggtccagg

SEQ ID NO: 4162437 - DNA, 16 bp, Homo sapiens
gaccctgagctgacca

SEQ ID NO: 4162438 - DNA, 22 bp, Homo sapiens
gaccctgcgaaggggccctggt

SEQ ID NO: 4162439 - DNA, 12 bp, Homo sapiens
gaccctgtctct

SEQ ID NO: 4162440 - DNA, 15 bp, Homo sapiens
gaccgcttcccagag

SEQ ID NO: 4162441 - DNA, 23 bp, Homo sapiens
gaccgtgatttggaagagaggca

SEQ ID NO: 4162442 - DNA, 21 bp, Homo sapiens
gacctgaatgacctgcagtca

SEQ ID NO: 4162443 - DNA, 15 bp, Homo sapiens
gacctgcagtcaggg

SEQ ID NO: 4162444 - DNA, 21 bp, Homo sapiens
gacctgccccgcccagctgca

SEQ ID NO: 4162445 - DNA, 16 bp, Homo sapiens
gacctgcggctgctgt

SEQ ID NO: 4162446 - DNA, 15 bp, Homo sapiens
gacctgggcccacag

SEQ ID NO: 4162447 - DNA, 16 bp, Homo sapiens
gacctgggcccacaga

SEQ ID NO: 4162448 - DNA, 20 bp, Homo sapiens
gacgccgagggcagccccga

SEQ ID NO: 4162449 - DNA, 22 bp, Homo sapiens
gacgcgcacacacaccggtcac

SEQ ID NO: 4162450 - DNA, 23 bp, Homo sapiens
gacggtcctttaggcagcctgcc

SEQ ID NO: 4162451 - DNA, 18 bp, Homo sapiens
gacgtcaagtctccttcc

SEQ ID NO: 4162452 - DNA, 21 bp, Homo sapiens
gacgttcggggcatgctgggg

SEQ ID NO: 4162453 - DNA, 16 bp, Homo sapiens
gactaatggcatgaga

SEQ ID NO: 4162454 - DNA, 12 bp, Homo sapiens
gactagcaggca

SEQ ID NO: 4162455 - DNA, 16 bp, Homo sapiens
gactagcaggcatgcc

SEQ ID NO: 4162456 - DNA, 16 bp, Homo sapiens
gactagggagccatgt

SEQ ID NO: 4162457 - DNA, 17 bp, Homo sapiens
gactatcttactatttc

SEQ ID NO: 4162458 - DNA, 15 bp, Homo sapiens
gactatgaaaagcta

SEQ ID NO: 4162459 - DNA, 19 bp, Homo sapiens
gactcaaatctccagtatt

SEQ ID NO: 4162460 - DNA, 17 bp, Homo sapiens
gactcatggcttagaaa

SEQ ID NO: 4162461 - DNA, 16 bp, Homo sapiens
gactccccaggccagg

SEQ ID NO: 4162462 - DNA, 20 bp, Homo sapiens
gaggagtttcgaggtagagt

SEQ ID NO: 4162463 - DNA, 21 bp, Homo sapiens
gaggatccctccatccggctc

SEQ ID NO: 4162464 - DNA, 15 bp, Homo sapiens
gaggcacctgctgga

SEQ ID NO: 4162465 - DNA, 16 bp, Homo sapiens
gaggcagagaaagaag

SEQ ID NO: 4162466 - DNA, 16 bp, Homo sapiens
gaggcagagaagaaag

SEQ ID NO: 4162467 - DNA, 21 bp, Homo sapiens
gaggcagcgtgaaagcagatg

SEQ ID NO: 4162468 - DNA, 11 bp, Homo sapiens
gaggcagggga

SEQ ID NO: 4162469 - DNA, 16 bp, Homo sapiens
gaggcagtgctgatcc

SEQ ID NO: 4162470 - DNA, 15 bp, Homo sapiens
gaggcatagagggag

SEQ ID NO: 4162471 - DNA, 19 bp, Homo sapiens
gaggcatagagggagagga

SEQ ID NO: 4162472 - DNA, 12 bp, Homo sapiens
gaggccaaggtg

SEQ ID NO: 4162473 - DNA, 11 bp, Homo sapiens
gaggcccagcc

SEQ ID NO: 4162474 - DNA, 22 bp, Homo sapiens
gaggccctgtgccccttgacaa

SEQ ID NO: 4162475 - DNA, 16 bp, Homo sapiens
gaggcctggccaggca

SEQ ID NO: 4162476 - DNA, 17 bp, Homo sapiens
gaggcctggccaggcac

SEQ ID NO: 4162477 - DNA, 15 bp, Homo sapiens
gaggcgaataaatgt

SEQ ID NO: 4162478 - DNA, 17 bp, Homo sapiens
gaggcgaataaatgttc

SEQ ID NO: 4162479 - DNA, 20 bp, Homo sapiens
gaggcgaataaatgttcaaa

SEQ ID NO: 4162480 - DNA, 19 bp, Homo sapiens
gaggcggagagtacagtga

SEQ ID NO: 4162481 - DNA, 20 bp, Homo sapiens
gaggcggaggttgcagtgag

SEQ ID NO: 4162482 - DNA, 16 bp, Homo sapiens
gaggctatttaaaagt

SEQ ID NO: 4162483 - DNA, 23 bp, Homo sapiens
gaggctctattgagccaagacca

SEQ ID NO: 4162484 - DNA, 16 bp, Homo sapiens
gaggctctttctgggc

SEQ ID NO: 4162485 - DNA, 13 bp, Homo sapiens
gaggctgaggcag

SEQ ID NO: 4162486 - DNA, 14 bp, Homo sapiens
gaggcttcttgccc

SEQ ID NO: 4162487 - DNA, 16 bp, Homo sapiens
gaggcttcttgcccag

SEQ ID NO: 4162488 - DNA, 16 bp, Homo sapiens
gagggaaggagctgtt

SEQ ID NO: 4162489 - DNA, 14 bp, Homo sapiens
gagggacaatgcca

SEQ ID NO: 4162490 - DNA, 14 bp, Homo sapiens
gagggagctgctgg

SEQ ID NO: 4162491 - DNA, 17 bp, Homo sapiens
gagggagctgctggctg

SEQ ID NO: 4162492 - DNA, 16 bp, Homo sapiens
gagggagttggctgga

SEQ ID NO: 4162493 - DNA, 21 bp, Homo sapiens
gagggattttagcctcttccc

SEQ ID NO: 4162494 - DNA, 18 bp, Homo sapiens
gagggcaagggccatgct

SEQ ID NO: 4162495 - DNA, 16 bp, Homo sapiens
gagggcccttcccaac

SEQ ID NO: 4162496 - DNA, 20 bp, Homo sapiens
gagggctactcagcagtaag

SEQ ID NO: 4162497 - DNA, 22 bp, Homo sapiens
gagggctactcagcagtaagca

SEQ ID NO: 4162498 - DNA, 13 bp, Homo sapiens
gaggggacccagc

SEQ ID NO: 4162499 - DNA, 17 bp, Homo sapiens
gaggggacccagctcct

SEQ ID NO: 4162500 - DNA, 15 bp, Homo sapiens
gaggggctcctggaa

SEQ ID NO: 4162501 - DNA, 21 bp, Homo sapiens
gagggggacgcgcacacacac

SEQ ID NO: 4162502 - DNA, 16 bp, Homo sapiens
gagggtaataaactta

SEQ ID NO: 4162503 - DNA, 18 bp, Homo sapiens
gagggtgggagagcccag

SEQ ID NO: 4162504 - DNA, 20 bp, Homo sapiens
gagggttgggttcatctgag

SEQ ID NO: 4162505 - DNA, 18 bp, Homo sapiens
gaggtagagtttgaagga

SEQ ID NO: 4162506 - DNA, 23 bp, Homo sapiens
gaggtagagtttgaaggaggtga

SEQ ID NO: 4162507 - DNA, 16 bp, Homo sapiens
gaggtagcgagctgct

SEQ ID NO: 4162508 - DNA, 19 bp, Homo sapiens
gaggtagcgagctgctctg

SEQ ID NO: 4162509 - DNA, 20 bp, Homo sapiens
gaggtcaagcctgcagcgag

SEQ ID NO: 4162510 - DNA, 19 bp, Homo sapiens
gaggtcacattcaggaaga

SEQ ID NO: 4162511 - DNA, 21 bp, Homo sapiens
gaggtcacattcaggaagatg

SEQ ID NO: 4162512 - DNA, 14 bp, Homo sapiens
gaggtcactgggtt

SEQ ID NO: 4162513 - DNA, 14 bp, Homo sapiens
gaggtccaggcagg

SEQ ID NO: 4162514 - DNA, 16 bp, Homo sapiens
gaggtgagaccacctc

SEQ ID NO: 4162515 - DNA, 13 bp, Homo sapiens
gaggtgctagctc

SEQ ID NO: 4162516 - DNA, 19 bp, Homo sapiens
gaggtggaggttgcagtga

SEQ ID NO: 4162517 - DNA, 15 bp, Homo sapiens
gaggtggattcctgg

SEQ ID NO: 4162518 - DNA, 21 bp, Homo sapiens
gaggtggattcctgggcaaga

SEQ ID NO: 4162519 - DNA, 22 bp, Homo sapiens
gaggtggattcctgggcaagaa

SEQ ID NO: 4162520 - DNA, 18 bp, Homo sapiens
gaggtgtcaccctgcaga

SEQ ID NO: 4162521 - DNA, 19 bp, Homo sapiens
gaggtgtcaccctgcagag

SEQ ID NO: 4162522 - DNA, 20 bp, Homo sapiens
gaggtgtcaccctgcagagc

SEQ ID NO: 4162523 - DNA, 13 bp, Homo sapiens
gaggttgcagtga

SEQ ID NO: 4162524 - DNA, 12 bp, Homo sapiens
gaggttgggctt

SEQ ID NO: 4162525 - DNA, 12 bp, Homo sapiens
gaggtttgtcaa

SEQ ID NO: 4162526 - DNA, 22 bp, Homo sapiens
gaggtttgtcaacacaaagaca

SEQ ID NO: 4162527 - DNA, 15 bp, Homo sapiens
gagtacctcaaagga

SEQ ID NO: 4162528 - DNA, 21 bp, Homo sapiens
gagtactagaatttgtatttt

SEQ ID NO: 4162529 - DNA, 20 bp, Homo sapiens
gagtcacccatgaagacagg

SEQ ID NO: 4162530 - DNA, 22 bp, Homo sapiens
gagtcagcccttggcttctgct

SEQ ID NO: 4162531 - DNA, 15 bp, Homo sapiens
gagtcaggaaagaca

SEQ ID NO: 4162532 - DNA, 15 bp, Homo sapiens
gagtctacctcttca

SEQ ID NO: 4162533 - DNA, 23 bp, Homo sapiens
gagtctgggcaatgaaaccaaag

SEQ ID NO: 4162534 - DNA, 12 bp, Homo sapiens
gagtctgtctca

SEQ ID NO: 4162535 - DNA, 17 bp, Homo sapiens
gagtcttgtacacttaa

SEQ ID NO: 4162536 - DNA, 18 bp, Homo sapiens
gagtgactcgagggttgg

SEQ ID NO: 4162537 - DNA, 17 bp, Homo sapiens
gagtgagtttaggcagc

SEQ ID NO: 4162538 - DNA, 20 bp, Homo sapiens
gagtgatctcaaatccactg

SEQ ID NO: 4162539 - DNA, 17 bp, Homo sapiens
gagtgcactcctggtga

SEQ ID NO: 4162540 - DNA, 17 bp, Homo sapiens
gagtgggaaataaatca

SEQ ID NO: 4162541 - DNA, 17 bp, Homo sapiens
gagttatagtttgcttt

SEQ ID NO: 4162542 - DNA, 20 bp, Homo sapiens
gagttcgagaccagcctggc

SEQ ID NO: 4162543 - DNA, 19 bp, Homo sapiens
gagttgacgcatcctgcag

SEQ ID NO: 4162544 - DNA, 23 bp, Homo sapiens
gagttggacttcagtcttgccta

SEQ ID NO: 4162545 - DNA, 20 bp, Homo sapiens
gagttgtggaaagcctctgc

SEQ ID NO: 4162546 - DNA, 12 bp, Homo sapiens
gagttttcacct

SEQ ID NO: 4162547 - DNA, 21 bp, Homo sapiens
gagttttccatggcaggaagg

SEQ ID NO: 4162548 - DNA, 15 bp, Homo sapiens
gataaactaaaagca

SEQ ID NO: 4162549 - DNA, 14 bp, Homo sapiens
gataactatttaca

SEQ ID NO: 4162550 - DNA, 20 bp, Homo sapiens
gataactgaaaattatttaa

SEQ ID NO: 4162551 - DNA, 21 bp, Homo sapiens
gataactgaaaattatttaaa

SEQ ID NO: 4162552 - DNA, 16 bp, Homo sapiens
gataatcagcctctta

SEQ ID NO: 4162553 - DNA, 13 bp, Homo sapiens
gataatgaacaga

SEQ ID NO: 4162554 - DNA, 21 bp, Homo sapiens
gatacatcttataaactgact

SEQ ID NO: 4162555 - DNA, 16 bp, Homo sapiens
gatacattagcagcta

SEQ ID NO: 4162556 - DNA, 13 bp, Homo sapiens
gatacgtgtgtga

SEQ ID NO: 4162557 - DNA, 16 bp, Homo sapiens
gatacgtgtgtgaagt

SEQ ID NO: 4162558 - DNA, 22 bp, Homo sapiens
gatactaaaagttcttctccaa

SEQ ID NO: 4162559 - DNA, 13 bp, Homo sapiens
gatactctgtcag

SEQ ID NO: 4162560 - DNA, 17 bp, Homo sapiens
gatactctgtcagatgg

SEQ ID NO: 4162561 - DNA, 22 bp, Homo sapiens
gatagacagtgctgccctgcga

SEQ ID NO: 4162562 - DNA, 14 bp, Homo sapiens
gatagagtgatttt

SEQ ID NO: 4162563 - DNA, 22 bp, Homo sapiens
gatagcagaggaaaaagaaaaa

SEQ ID NO: 4162564 - DNA, 13 bp, Homo sapiens
gatagtgtgattt

SEQ ID NO: 4162565 - DNA, 14 bp, Homo sapiens
gatagtgtgatttt

SEQ ID NO: 4162566 - DNA, 15 bp, Homo sapiens
gatatatttttcaca

SEQ ID NO: 4162567 - DNA, 14 bp, Homo sapiens
gatatgcagaagga

SEQ ID NO: 4162568 - DNA, 16 bp, Homo sapiens
gatatgtaaaacattt

SEQ ID NO: 4162569 - DNA, 22 bp, Homo sapiens
gatcaaggccttattggaaagc

SEQ ID NO: 4162570 - DNA, 23 bp, Homo sapiens
gatcaaggccttattggaaagca

SEQ ID NO: 4162571 - DNA, 15 bp, Homo sapiens
gatcaagtccagagc

SEQ ID NO: 4162572 - DNA, 14 bp, Homo sapiens
gatcacaccactgc

SEQ ID NO: 4162573 - DNA, 24 bp, Homo sapiens
gatcacgccactgcactccagcct

SEQ ID NO: 4162574 - DNA, 18 bp, Homo sapiens
gatcacttgggcccagga

SEQ ID NO: 4162575 - DNA, 19 bp, Homo sapiens
gatcacttgggcccaggag

SEQ ID NO: 4162576 - DNA, 20 bp, Homo sapiens
gatcacttgggcccaggagg

SEQ ID NO: 4162577 - DNA, 22 bp, Homo sapiens
gatcagaagtaggaaggaaaaa

SEQ ID NO: 4162578 - DNA, 18 bp, Homo sapiens
gatcaggaagagaaggag

SEQ ID NO: 4162579 - DNA, 18 bp, Homo sapiens
gatcataggtatttcaaa

SEQ ID NO: 4162580 - DNA, 18 bp, Homo sapiens
gatcattacatggctgtg

SEQ ID NO: 4162581 - DNA, 20 bp, Homo sapiens
gatcattgaaagtaaaaaat

SEQ ID NO: 4162582 - DNA, 23 bp, Homo sapiens
gatcattttcttatcttctgcaa

SEQ ID NO: 4162583 - DNA, 16 bp, Homo sapiens
gatccggctgctcctc

SEQ ID NO: 4162584 - DNA, 22 bp, Homo sapiens
gatccggctgctcctccagccc

SEQ ID NO: 4162585 - DNA, 19 bp, Homo sapiens
gatcctactcttcctttct

SEQ ID NO: 4162586 - DNA, 18 bp, Homo sapiens
gatcctattctcaccagg

SEQ ID NO: 4162587 - DNA, 20 bp, Homo sapiens
gatcctattctcaccaggaa

SEQ ID NO: 4162588 - DNA, 16 bp, Homo sapiens
gatcctgaaaaaatga

SEQ ID NO: 4162589 - DNA, 20 bp, Homo sapiens
gatcctgtattcagacagat

SEQ ID NO: 4162590 - DNA, 15 bp, Homo sapiens
gatcctgtttcagct

SEQ ID NO: 4162591 - DNA, 22 bp, Homo sapiens
gatctagaatgtgttttctgaa

SEQ ID NO: 4162592 - DNA, 21 bp, Homo sapiens
gatctagttctcaatcactgc

SEQ ID NO: 4162593 - DNA, 15 bp, Homo sapiens
gatctatagatgacc

SEQ ID NO: 4162594 - DNA, 14 bp, Homo sapiens
gatctccctccagg

SEQ ID NO: 4162595 - DNA, 23 bp, Homo sapiens
gatctgaaattggtgggaagcaa

SEQ ID NO: 4162596 - DNA, 19 bp, Homo sapiens
gcacttagctatcagaaga

SEQ ID NO: 4162597 - DNA, 18 bp, Homo sapiens
gcactttaaccctctctt

SEQ ID NO: 4162598 - DNA, 21 bp, Homo sapiens
gcactttaaccctctcttccc

SEQ ID NO: 4162599 - DNA, 18 bp, Homo sapiens
gcactttttaaaaagtac

SEQ ID NO: 4162600 - DNA, 22 bp, Homo sapiens
gcagaaaacggagagtgcttgg

SEQ ID NO: 4162601 - DNA, 20 bp, Homo sapiens
gcagaaaatataaatggtaa

SEQ ID NO: 4162602 - DNA, 12 bp, Homo sapiens
gcagaaggaagg

SEQ ID NO: 4162603 - DNA, 13 bp, Homo sapiens
gcagaaggaaggc

SEQ ID NO: 4162604 - DNA, 16 bp, Homo sapiens
gcagaaggaaggcagg

SEQ ID NO: 4162605 - DNA, 22 bp, Homo sapiens
gcagaaggaaggcagggaggag

SEQ ID NO: 4162606 - DNA, 16 bp, Homo sapiens
gcagaaggggaagata

SEQ ID NO: 4162607 - DNA, 15 bp, Homo sapiens
gcagagaaagaagag

SEQ ID NO: 4162608 - DNA, 16 bp, Homo sapiens
gcagagaaagaagaga

SEQ ID NO: 4162609 - DNA, 12 bp, Homo sapiens
gcagagagaagc

SEQ ID NO: 4162610 - DNA, 13 bp, Homo sapiens
gcagagagaagcc

SEQ ID NO: 4162611 - DNA, 16 bp, Homo sapiens
gcagagcacagcccac

SEQ ID NO: 4162612 - DNA, 18 bp, Homo sapiens
gcagagcacagcccacgg

SEQ ID NO: 4162613 - DNA, 21 bp, Homo sapiens
gcagagctggggctgccagcc

SEQ ID NO: 4162614 - DNA, 17 bp, Homo sapiens
gcagaggaaaaagaaaa

SEQ ID NO: 4162615 - DNA, 19 bp, Homo sapiens
gcagaggaaaaagaaaaac

SEQ ID NO: 4162616 - DNA, 18 bp, Homo sapiens
gcagaggggagcttgagg

SEQ ID NO: 4162617 - DNA, 22 bp, Homo sapiens
gcagaggggagcttgagggaca

SEQ ID NO: 4162618 - DNA, 21 bp, Homo sapiens
gcagaggggctttctggagag

SEQ ID NO: 4162619 - DNA, 19 bp, Homo sapiens
gcagaggggtaggcagagc

SEQ ID NO: 4162620 - DNA, 20 bp, Homo sapiens
gcagaggtaaaagtgtgagc

SEQ ID NO: 4162621 - DNA, 21 bp, Homo sapiens
gcagaggtaaaagtgtgagca

SEQ ID NO: 4162622 - DNA, 23 bp, Homo sapiens
gcagaggtaaaagtgtgagcagt

SEQ ID NO: 4162623 - DNA, 22 bp, Homo sapiens
gcagagtcagccattcctgttc

SEQ ID NO: 4162624 - DNA, 17 bp, Homo sapiens
gcagataatcagcctct

SEQ ID NO: 4162625 - DNA, 19 bp, Homo sapiens
gcagataatcagcctctta

SEQ ID NO: 4162626 - DNA, 13 bp, Homo sapiens
gcagatgggacaa

SEQ ID NO: 4162627 - DNA, 12 bp, Homo sapiens
gcagcaactccc

SEQ ID NO: 4162628 - DNA, 13 bp, Homo sapiens
gcagcaactccca

SEQ ID NO: 4162629 - DNA, 14 bp, Homo sapiens
gcagcaactcccac

SEQ ID NO: 4162630 - DNA, 16 bp, Homo sapiens
gcagcaactcccacga

SEQ ID NO: 4162631 - DNA, 11 bp, Homo sapiens
gcagcacttta

SEQ ID NO: 4162632 - DNA, 22 bp, Homo sapiens
gcagcagaggacagtctggaga

SEQ ID NO: 4162633 - DNA, 13 bp, Homo sapiens
gcagcagtgagct

SEQ ID NO: 4162634 - DNA, 20 bp, Homo sapiens
gcagcagttccatgaagaca

SEQ ID NO: 4162635 - DNA, 20 bp, Homo sapiens
gcagccagccggtgcctggc

SEQ ID NO: 4162636 - DNA, 21 bp, Homo sapiens
gcagccccgacccctgtccag

SEQ ID NO: 4162637 - DNA, 14 bp, Homo sapiens
gcagccgccgggca

SEQ ID NO: 4162638 - DNA, 16 bp, Homo sapiens
gcagccgccgggcagg

SEQ ID NO: 4162639 - DNA, 17 bp, Homo sapiens
gcagccgccgggcaggc

SEQ ID NO: 4162640 - DNA, 16 bp, Homo sapiens
gcagcctccctctgac

SEQ ID NO: 4162641 - DNA, 16 bp, Homo sapiens
gcagccttcttttcaa

SEQ ID NO: 4162642 - DNA, 15 bp, Homo sapiens
gcagcgagctgagat

SEQ ID NO: 4162643 - DNA, 17 bp, Homo sapiens
gcagctgtcattcagga

SEQ ID NO: 4162644 - DNA, 19 bp, Homo sapiens
gcagctgttttcaaagccc

SEQ ID NO: 4162645 - DNA, 15 bp, Homo sapiens
gcaggaccaggacta

SEQ ID NO: 4162646 - DNA, 12 bp, Homo sapiens
gcaggcaggcac

SEQ ID NO: 4162647 - DNA, 14 bp, Homo sapiens
gcaggcaggcactg

SEQ ID NO: 4162648 - DNA, 18 bp, Homo sapiens
gcaggcaggctcccaggg

SEQ ID NO: 4162649 - DNA, 22 bp, Homo sapiens
gcaggccaagagcagaggcagc

SEQ ID NO: 4162650 - DNA, 24 bp, Homo sapiens
gcaggccaagagcagaggcagcga

SEQ ID NO: 4162651 - DNA, 23 bp, Homo sapiens
gcaggccttagtacggctgctgc

SEQ ID NO: 4162652 - DNA, 17 bp, Homo sapiens
gcaggctcagactctgg

SEQ ID NO: 4162653 - DNA, 16 bp, Homo sapiens
gcaggcttgggaactg

SEQ ID NO: 4162654 - DNA, 19 bp, Homo sapiens
gcaggggtccttggtgtga

SEQ ID NO: 4162655 - DNA, 17 bp, Homo sapiens
gcaggggtgggagagcc

SEQ ID NO: 4162656 - DNA, 18 bp, Homo sapiens
gcaggggtgggagagcca

SEQ ID NO: 4162657 - DNA, 19 bp, Homo sapiens
gcaggggtgggagagccag

SEQ ID NO: 4162658 - DNA, 17 bp, Homo sapiens
gcaggtaggggcacagt

SEQ ID NO: 4162659 - DNA, 15 bp, Homo sapiens
gcaggtgcctggctt

SEQ ID NO: 4162660 - DNA, 21 bp, Homo sapiens
gcaggttgaggggctcctgga

SEQ ID NO: 4162661 - DNA, 21 bp, Homo sapiens
gcagtaacactggccttccct

SEQ ID NO: 4162662 - DNA, 21 bp, Homo sapiens
gcagtaggaacccagctctca

SEQ ID NO: 4162663 - DNA, 18 bp, Homo sapiens
gcagtatctcttgctggg

SEQ ID NO: 4162664 - DNA, 21 bp, Homo sapiens
gcagtattccatgggatgtta

SEQ ID NO: 4162665 - DNA, 23 bp, Homo sapiens
gcagtgaacacactcagcagccc

SEQ ID NO: 4162666 - DNA, 13 bp, Homo sapiens
gcagtgagctgag

SEQ ID NO: 4162667 - DNA, 21 bp, Homo sapiens
gcagtgaggggagatgctggg

SEQ ID NO: 4162668 - DNA, 20 bp, Homo sapiens
gcagtgagttacagcgagag

SEQ ID NO: 4162669 - DNA, 22 bp, Homo sapiens
gcagtgcaagagactctggcct

SEQ ID NO: 4162670 - DNA, 17 bp, Homo sapiens
gcagtgcccccacccag

SEQ ID NO: 4162671 - DNA, 14 bp, Homo sapiens
gcagtggcaggacc

SEQ ID NO: 4162672 - DNA, 19 bp, Homo sapiens
gcagtgtacactgttccca

SEQ ID NO: 4162673 - DNA, 22 bp, Homo sapiens
gcagttgaatgacaacagaagc

SEQ ID NO: 4162674 - DNA, 15 bp, Homo sapiens
gcagttgacagcagg

SEQ ID NO: 4162675 - DNA, 15 bp, Homo sapiens
gcagtttatatttaa

SEQ ID NO: 4162676 - DNA, 16 bp, Homo sapiens
gcataaattagagaaa

SEQ ID NO: 4162677 - DNA, 13 bp, Homo sapiens
gcataagattaaa

SEQ ID NO: 4162678 - DNA, 21 bp, Homo sapiens
gcatagagggagaggaagcac

SEQ ID NO: 4162679 - DNA, 23 bp, Homo sapiens
gcatagagggagaggaagcacac

SEQ ID NO: 4162680 - DNA, 15 bp, Homo sapiens
gcatcacagggcaga

SEQ ID NO: 4162681 - DNA, 21 bp, Homo sapiens
gcatcacagggcagagccggg

SEQ ID NO: 4162682 - DNA, 13 bp, Homo sapiens
gcatcacctcagg

SEQ ID NO: 4162683 - DNA, 18 bp, Homo sapiens
gcatccacgcacacatgg

SEQ ID NO: 4162684 - DNA, 13 bp, Homo sapiens
gcatccttctgcc

SEQ ID NO: 4162685 - DNA, 21 bp, Homo sapiens
gcatctcattgtagagcttgg

SEQ ID NO: 4162686 - DNA, 16 bp, Homo sapiens
gcatctgggattccca

SEQ ID NO: 4162687 - DNA, 20 bp, Homo sapiens
gcatgaacagggtccctgga

SEQ ID NO: 4162688 - DNA, 17 bp, Homo sapiens
gcatgagaaatacaaaa

SEQ ID NO: 4162689 - DNA, 22 bp, Homo sapiens
gcatgcctgggaatcctgctgc

SEQ ID NO: 4162690 - DNA, 13 bp, Homo sapiens
gcatgcgcaggct

SEQ ID NO: 4162691 - DNA, 13 bp, Homo sapiens
gcatggaatttgt

SEQ ID NO: 4162692 - DNA, 14 bp, Homo sapiens
gcatggtgctttca

SEQ ID NO: 4162693 - DNA, 17 bp, Homo sapiens
gcatggttttacagtga

SEQ ID NO: 4162694 - DNA, 21 bp, Homo sapiens
gcatgtttgtctgtgtgctgt

SEQ ID NO: 4162695 - DNA, 23 bp, Homo sapiens
gcatgtttgtctgtgtgctgtaa

SEQ ID NO: 4162696 - DNA, 16 bp, Homo sapiens
gcattagcacatattt

SEQ ID NO: 4162697 - DNA, 22 bp, Homo sapiens
gcattattggaatataattgtt

SEQ ID NO: 4162698 - DNA, 23 bp, Homo sapiens
gcattattggaatataattgttt

SEQ ID NO: 4162699 - DNA, 16 bp, Homo sapiens
gcattcagaagaaaaa

SEQ ID NO: 4162700 - DNA, 15 bp, Homo sapiens
gcattctgagctggg

SEQ ID NO: 4162701 - DNA, 19 bp, Homo sapiens
gcattgaatggctatgttt

SEQ ID NO: 4162702 - DNA, 17 bp, Homo sapiens
gcattggtctgctgacc

SEQ ID NO: 4162703 - DNA, 13 bp, Homo sapiens
gcatttaataaat

SEQ ID NO: 4162704 - DNA, 14 bp, Homo sapiens
gcatttaataaatg

SEQ ID NO: 4162705 - DNA, 16 bp, Homo sapiens
gcatttgccattcctg

SEQ ID NO: 4162706 - DNA, 14 bp, Homo sapiens
gcattttcccagat

SEQ ID NO: 4162707 - DNA, 19 bp, Homo sapiens
gccaaaacacttaggaaga

SEQ ID NO: 4162708 - DNA, 19 bp, Homo sapiens
gccaaaaggtttcatgtag

SEQ ID NO: 4162709 - DNA, 18 bp, Homo sapiens
gccaaaataccagagcct

SEQ ID NO: 4162710 - DNA, 14 bp, Homo sapiens
gccaaacactccac

SEQ ID NO: 4162711 - DNA, 17 bp, Homo sapiens
gccaaactctgccagcc

SEQ ID NO: 4162712 - DNA, 23 bp, Homo sapiens
gccaaattatttgtgtaatagaa

SEQ ID NO: 4162713 - DNA, 13 bp, Homo sapiens
gccaacagccccc

SEQ ID NO: 4162714 - DNA, 23 bp, Homo sapiens
gccaacaggtggcaggaccagga

SEQ ID NO: 4162715 - DNA, 14 bp, Homo sapiens
gccaacttggcttt

SEQ ID NO: 4162716 - DNA, 20 bp, Homo sapiens
gccaagagcagaggcagcga

SEQ ID NO: 4162717 - DNA, 14 bp, Homo sapiens
gccaaggagtcaga

SEQ ID NO: 4162718 - DNA, 16 bp, Homo sapiens
gccaaggcagagggga

SEQ ID NO: 4162719 - DNA, 20 bp, Homo sapiens
gccaaggtgaatagcacagg

SEQ ID NO: 4162720 - DNA, 21 bp, Homo sapiens
gccaaggtgaatagcacaggt

SEQ ID NO: 4162721 - DNA, 22 bp, Homo sapiens
gccaaggtgggctgagccctgg

SEQ ID NO: 4162722 - DNA, 23 bp, Homo sapiens
gccaaggtgggctgagccctggc

SEQ ID NO: 4162723 - DNA, 16 bp, Homo sapiens
gccaagtctcagaaga

SEQ ID NO: 4162724 - DNA, 17 bp, Homo sapiens
gccaagtggccctcaga

SEQ ID NO: 4162725 - DNA, 22 bp, Homo sapiens
gccacaaagggacacacagtga

SEQ ID NO: 4162726 - DNA, 21 bp, Homo sapiens
gccacaaccctgttttatact

SEQ ID NO: 4162727 - DNA, 23 bp, Homo sapiens
gccacaagaaatttgatttctat

SEQ ID NO: 4162728 - DNA, 18 bp, Homo sapiens
gccacaccaatcagagag

SEQ ID NO: 4162729 - DNA, 16 bp, Homo sapiens
gccacaccaggataga

SEQ ID NO: 4162730 - DNA, 19 bp, Homo sapiens
gcctctgctttctcctgta

SEQ ID NO: 4162731 - DNA, 22 bp, Homo sapiens
gcctctgctttctcctgtagca

SEQ ID NO: 4162732 - DNA, 18 bp, Homo sapiens
gcctctgtcttctggact

SEQ ID NO: 4162733 - DNA, 19 bp, Homo sapiens
gcctctgtcttctggactg

SEQ ID NO: 4162734 - DNA, 20 bp, Homo sapiens
gcctcttaaagctgcctgta

SEQ ID NO: 4162735 - DNA, 22 bp, Homo sapiens
gcctcttaaagctgcctgtagt

SEQ ID NO: 4162736 - DNA, 15 bp, Homo sapiens
gcctcttcagcagca

SEQ ID NO: 4162737 - DNA, 13 bp, Homo sapiens
gcctcttcctctg

SEQ ID NO: 4162738 - DNA, 15 bp, Homo sapiens
gcctcttcctctggg

SEQ ID NO: 4162739 - DNA, 13 bp, Homo sapiens
gcctgaggctgag

SEQ ID NO: 4162740 - DNA, 14 bp, Homo sapiens
gcctgaggctgaga

SEQ ID NO: 4162741 - DNA, 13 bp, Homo sapiens
gcctgaggctggg

SEQ ID NO: 4162742 - DNA, 14 bp, Homo sapiens
gcctgaggctggga

SEQ ID NO: 4162743 - DNA, 12 bp, Homo sapiens
gcctgcagagag

SEQ ID NO: 4162744 - DNA, 18 bp, Homo sapiens
gcctgcagcgagctgaga

SEQ ID NO: 4162745 - DNA, 14 bp, Homo sapiens
gcctgccctcaggg

SEQ ID NO: 4162746 - DNA, 12 bp, Homo sapiens
gcctgccctgga

SEQ ID NO: 4162747 - DNA, 22 bp, Homo sapiens
gcctgcctccttcagtgacaag

SEQ ID NO: 4162748 - DNA, 13 bp, Homo sapiens
gcctgcctgcctg

SEQ ID NO: 4162749 - DNA, 18 bp, Homo sapiens
gcctgcctgtggagacag

SEQ ID NO: 4162750 - DNA, 13 bp, Homo sapiens
gcctggccaggca

SEQ ID NO: 4162751 - DNA, 15 bp, Homo sapiens
gcctggcccccctcc

SEQ ID NO: 4162752 - DNA, 18 bp, Homo sapiens
gcctggcttctggagccc

SEQ ID NO: 4162753 - DNA, 21 bp, Homo sapiens
gcctggctttggtccccagca

SEQ ID NO: 4162754 - DNA, 20 bp, Homo sapiens
gcctgggcgacagagcaaga

SEQ ID NO: 4162755 - DNA, 19 bp, Homo sapiens
gcctgtagctttcctggtc

SEQ ID NO: 4162756 - DNA, 15 bp, Homo sapiens
gcctgtcctgcctct

SEQ ID NO: 4162757 - DNA, 12 bp, Homo sapiens
gcctgtcctggt

SEQ ID NO: 4162758 - DNA, 15 bp, Homo sapiens
gcctgtgggaagaga

SEQ ID NO: 4162759 - DNA, 18 bp, Homo sapiens
gcctgtgggaagagaagg

SEQ ID NO: 4162760 - DNA, 19 bp, Homo sapiens
gcctgtggtgaggtcctgt

SEQ ID NO: 4162761 - DNA, 19 bp, Homo sapiens
gcctgttgttcccatctgc

SEQ ID NO: 4162762 - DNA, 15 bp, Homo sapiens
gccttactcacctct

SEQ ID NO: 4162763 - DNA, 14 bp, Homo sapiens
gccttcaagtgcca

SEQ ID NO: 4162764 - DNA, 22 bp, Homo sapiens
gccttcgcggtggaaggcccga

SEQ ID NO: 4162765 - DNA, 18 bp, Homo sapiens
gccttggttcccttgtgt

SEQ ID NO: 4162766 - DNA, 18 bp, Homo sapiens
gcctttaaggagaagaga

SEQ ID NO: 4162767 - DNA, 22 bp, Homo sapiens
gcctttctcgtggtagaagcca

SEQ ID NO: 4162768 - DNA, 14 bp, Homo sapiens
gccttttatagcta

SEQ ID NO: 4162769 - DNA, 16 bp, Homo sapiens
gccttttttcacagcc

SEQ ID NO: 4162770 - DNA, 21 bp, Homo sapiens
gcgaaaacgttgacccctttc

SEQ ID NO: 4162771 - DNA, 17 bp, Homo sapiens
gcgaagtggctctcagg

SEQ ID NO: 4162772 - DNA, 15 bp, Homo sapiens
gcgaataaatgttca

SEQ ID NO: 4162773 - DNA, 21 bp, Homo sapiens
gcgaataaatgttcaaactgt

SEQ ID NO: 4162774 - DNA, 23 bp, Homo sapiens
gcgacagagcgagagtctgtctc

SEQ ID NO: 4162775 - DNA, 15 bp, Homo sapiens
gcgagaggcagagaa

SEQ ID NO: 4162776 - DNA, 15 bp, Homo sapiens
gcgagctgctctgct

SEQ ID NO: 4162777 - DNA, 15 bp, Homo sapiens
gcgatcaagtccaga

SEQ ID NO: 4162778 - DNA, 18 bp, Homo sapiens
gcgcacctgccccctggt

SEQ ID NO: 4162779 - DNA, 18 bp, Homo sapiens
gcgcagcgcgtgcacagc

SEQ ID NO: 4162780 - DNA, 21 bp, Homo sapiens
gcgccactacactccagcctg

SEQ ID NO: 4162781 - DNA, 15 bp, Homo sapiens
gcgcctccttccttg

SEQ ID NO: 4162782 - DNA, 14 bp, Homo sapiens
gcgcctcttcctct

SEQ ID NO: 4162783 - DNA, 16 bp, Homo sapiens
gcgcctcttcctctgg

SEQ ID NO: 4162784 - DNA, 20 bp, Homo sapiens
gcgcctcttcctctgggcag

SEQ ID NO: 4162785 - DNA, 22 bp, Homo sapiens
gcgcctcttcctctgggcagcg

SEQ ID NO: 4162786 - DNA, 23 bp, Homo sapiens
gcgcctcttcctctgggcagcgc

SEQ ID NO: 4162787 - DNA, 19 bp, Homo sapiens
gcgcgcagcgcgtgcacag

SEQ ID NO: 4162788 - DNA, 13 bp, Homo sapiens
gcgcggctcccgc

SEQ ID NO: 4162789 - DNA, 13 bp, Homo sapiens
gcgcgtctgcccc

SEQ ID NO: 4162790 - DNA, 19 bp, Homo sapiens
gcgctcccgcatttctcat

SEQ ID NO: 4162791 - DNA, 16 bp, Homo sapiens
gcggagagtacagtga

SEQ ID NO: 4162792 - DNA, 20 bp, Homo sapiens
gcggagagtacagtgagcca

SEQ ID NO: 4162793 - DNA, 15 bp, Homo sapiens
gcggagcttgcctgc

SEQ ID NO: 4162794 - DNA, 16 bp, Homo sapiens
gcggagcttgcctgcc

SEQ ID NO: 4162795 - DNA, 16 bp, Homo sapiens
gcggaggttgcaggga

SEQ ID NO: 4162796 - DNA, 18 bp, Homo sapiens
gcggcacgccaacagccc

SEQ ID NO: 4162797 - DNA, 22 bp, Homo sapiens
gcggcgaccgccgcagggacgg

SEQ ID NO: 4162798 - DNA, 13 bp, Homo sapiens
gcggctccaggtc

SEQ ID NO: 4162799 - DNA, 23 bp, Homo sapiens
gcgggacgagaccctacaggaga

SEQ ID NO: 4162800 - DNA, 15 bp, Homo sapiens
gcgggatggtcctgg

SEQ ID NO: 4162801 - DNA, 15 bp, Homo sapiens
gcgggctgtgcctta

SEQ ID NO: 4162802 - DNA, 19 bp, Homo sapiens
gcggtggctcttgcctgta

SEQ ID NO: 4162803 - DNA, 14 bp, Homo sapiens
gcggtggtgccaga

SEQ ID NO: 4162804 - DNA, 15 bp, Homo sapiens
gcgtagagagccggg

SEQ ID NO: 4162805 - DNA, 16 bp, Homo sapiens
gcgtcccaagcagccg

SEQ ID NO: 4162806 - DNA, 19 bp, Homo sapiens
gcgtccctgagggcccttc

SEQ ID NO: 4162807 - DNA, 16 bp, Homo sapiens
gcgtctcggcccttgc

SEQ ID NO: 4162808 - DNA, 13 bp, Homo sapiens
gcgtctgccccac

SEQ ID NO: 4162809 - DNA, 17 bp, Homo sapiens
gcgtctgccccaccctc

SEQ ID NO: 4162810 - DNA, 15 bp, Homo sapiens
gctaaaagaaacttt

SEQ ID NO: 4162811 - DNA, 16 bp, Homo sapiens
gctaaaagaaactttc

SEQ ID NO: 4162812 - DNA, 20 bp, Homo sapiens
gctaattcccagagtgtgaa

SEQ ID NO: 4162813 - DNA, 12 bp, Homo sapiens
gctacccaggag

SEQ ID NO: 4162814 - DNA, 13 bp, Homo sapiens
gctacccaggagg

SEQ ID NO: 4162815 - DNA, 15 bp, Homo sapiens
gctacccaggaggct

SEQ ID NO: 4162816 - DNA, 21 bp, Homo sapiens
gctacctctctcttccctagg

SEQ ID NO: 4162817 - DNA, 14 bp, Homo sapiens
gctacgtatttaat

SEQ ID NO: 4162818 - DNA, 14 bp, Homo sapiens
gctactcagaagcc

SEQ ID NO: 4162819 - DNA, 15 bp, Homo sapiens
gctactcagaagcct

SEQ ID NO: 4162820 - DNA, 16 bp, Homo sapiens
gctactcagaagcctg

SEQ ID NO: 4162821 - DNA, 18 bp, Homo sapiens
gctactcagcagtaagca

SEQ ID NO: 4162822 - DNA, 21 bp, Homo sapiens
gctactgaggcaggggagtag

SEQ ID NO: 4162823 - DNA, 18 bp, Homo sapiens
gctactgcagctttacat

SEQ ID NO: 4162824 - DNA, 22 bp, Homo sapiens
gctactgccgtcagtgctgtgc

SEQ ID NO: 4162825 - DNA, 14 bp, Homo sapiens
gctaggatggttct

SEQ ID NO: 4162826 - DNA, 16 bp, Homo sapiens
gctaggcatgcctggg

SEQ ID NO: 4162827 - DNA, 16 bp, Homo sapiens
gctaggcgagtgccag

SEQ ID NO: 4162828 - DNA, 19 bp, Homo sapiens
gctaggcgagtgccaggac

SEQ ID NO: 4162829 - DNA, 20 bp, Homo sapiens
gctagggcccctagaaacca

SEQ ID NO: 4162830 - DNA, 18 bp, Homo sapiens
gctatggtgctctgtcta

SEQ ID NO: 4162831 - DNA, 16 bp, Homo sapiens
gctatgtttttaatgt

SEQ ID NO: 4162832 - DNA, 23 bp, Homo sapiens
gctatttctagtagaaagaaaat

SEQ ID NO: 4162833 - DNA, 19 bp, Homo sapiens
gctcaagcaggaagttcaa

SEQ ID NO: 4162834 - DNA, 20 bp, Homo sapiens
gctcacccaataaacattaa

SEQ ID NO: 4162835 - DNA, 19 bp, Homo sapiens
gctcacgactcttcctgca

SEQ ID NO: 4162836 - DNA, 21 bp, Homo sapiens
gctcacgcctgtaatcccagc

SEQ ID NO: 4162837 - DNA, 22 bp, Homo sapiens
gctcacgcctgtaatcccagca

SEQ ID NO: 4162838 - DNA, 21 bp, Homo sapiens
gctcagccctgactggtgcta

SEQ ID NO: 4162839 - DNA, 13 bp, Homo sapiens
gctcaggaggcga

SEQ ID NO: 4162840 - DNA, 19 bp, Homo sapiens
gctcaggaggcgaataaat

SEQ ID NO: 4162841 - DNA, 21 bp, Homo sapiens
gctcaggaggcgaataaatgt

SEQ ID NO: 4162842 - DNA, 23 bp, Homo sapiens
gctcaggaggcgaataaatgttc

SEQ ID NO: 4162843 - DNA, 17 bp, Homo sapiens
gctcaggaggcttggaa

SEQ ID NO: 4162844 - DNA, 16 bp, Homo sapiens
gctcaggtacttgtaa

SEQ ID NO: 4162845 - DNA, 17 bp, Homo sapiens
gctcagtctcaggagca

SEQ ID NO: 4162846 - DNA, 14 bp, Homo sapiens
gctcatattttgta

SEQ ID NO: 4162847 - DNA, 13 bp, Homo sapiens
gctcatcactgtg

SEQ ID NO: 4162848 - DNA, 16 bp, Homo sapiens
gctcatcactgtgcct

SEQ ID NO: 4162849 - DNA, 16 bp, Homo sapiens
gctccaaggtgctctg

SEQ ID NO: 4162850 - DNA, 17 bp, Homo sapiens
gctccaaggtgctctgt

SEQ ID NO: 4162851 - DNA, 15 bp, Homo sapiens
gctccagatctgcac

SEQ ID NO: 4162852 - DNA, 16 bp, Homo sapiens
gctccaggatctttga

SEQ ID NO: 4162853 - DNA, 18 bp, Homo sapiens
gctccaggtccggagggg

SEQ ID NO: 4162854 - DNA, 21 bp, Homo sapiens
gctccaggtccggaggggttg

SEQ ID NO: 4162855 - DNA, 15 bp, Homo sapiens
gctcccgccaccctc

SEQ ID NO: 4162856 - DNA, 16 bp, Homo sapiens
gctccctcctggagca

SEQ ID NO: 4162857 - DNA, 15 bp, Homo sapiens
gctccctggcccagc

SEQ ID NO: 4162858 - DNA, 17 bp, Homo sapiens
gctccctggcccagcca

SEQ ID NO: 4162859 - DNA, 20 bp, Homo sapiens
gctccggaggggacccagct

SEQ ID NO: 4162860 - DNA, 20 bp, Homo sapiens
gctcctaaacccccgctcca

SEQ ID NO: 4162861 - DNA, 21 bp, Homo sapiens
gctcctaaacccccgctccag

SEQ ID NO: 4162862 - DNA, 15 bp, Homo sapiens
gctcctccagccctt

SEQ ID NO: 4162863 - DNA, 23 bp, Homo sapiens
gctcctccagcccttcagacgag

SEQ ID NO: 4162864 - DNA, 12 bp, Homo sapiens
gctcctctgagc

SEQ ID NO: 4162865 - DNA, 12 bp, Homo sapiens
ctgaaccactgt

SEQ ID NO: 4162866 - DNA, 18 bp, Homo sapiens
aaaaacacggcagctgta

SEQ ID NO: 4162867 - DNA, 18 bp, Homo sapiens
aaaaaccactgaacattt

SEQ ID NO: 4162868 - DNA, 17 bp, Homo sapiens
aaaaactaaaaactaga

SEQ ID NO: 4162869 - DNA, 20 bp, Homo sapiens
aaaaactaaatctctaatat

SEQ ID NO: 4162870 - DNA, 19 bp, Homo sapiens
aaaaagaaaaacatttcct

SEQ ID NO: 4162871 - DNA, 19 bp, Homo sapiens
aaaaagctcatattttgta

SEQ ID NO: 4162872 - DNA, 17 bp, Homo sapiens
aaaaagcttaaaacttt

SEQ ID NO: 4162873 - DNA, 20 bp, Homo sapiens
aaaaaggaaagaaaactaac

SEQ ID NO: 4162874 - DNA, 20 bp, Homo sapiens
aaaaaggctagtttattttg

SEQ ID NO: 4162875 - DNA, 14 bp, Homo sapiens
aaaaagtatttttt

SEQ ID NO: 4162876 - DNA, 20 bp, Homo sapiens
aaaaagtatttttttaagtt

SEQ ID NO: 4162877 - DNA, 16 bp, Homo sapiens
aaaaagtgaaataaga

SEQ ID NO: 4162878 - DNA, 11 bp, Homo sapiens
aaaaagttcaa

SEQ ID NO: 4162879 - DNA, 20 bp, Homo sapiens
aaaaatactatgaaatgaaa

SEQ ID NO: 4162880 - DNA, 23 bp, Homo sapiens
aaaaatagtttggatatgtaaaa

SEQ ID NO: 4162881 - DNA, 18 bp, Homo sapiens
aaaaatgtagaatgattt

SEQ ID NO: 4162882 - DNA, 21 bp, Homo sapiens
aaaaatgtagaatgatttttg

SEQ ID NO: 4162883 - DNA, 12 bp, Homo sapiens
aaaaatgtgaat

SEQ ID NO: 4162884 - DNA, 14 bp, Homo sapiens
aaaacaaaaataaa

SEQ ID NO: 4162885 - DNA, 16 bp, Homo sapiens
aaaacaaaaataaata

SEQ ID NO: 4162886 - DNA, 19 bp, Homo sapiens
aaaacaatcatttgctttt

SEQ ID NO: 4162887 - DNA, 17 bp, Homo sapiens
aaaacaatgaaggaaaa

SEQ ID NO: 4162888 - DNA, 19 bp, Homo sapiens
aaaacagatggtagagaga

SEQ ID NO: 4162889 - DNA, 16 bp, Homo sapiens
aaaacatttacatcaa

SEQ ID NO: 4162890 - DNA, 18 bp, Homo sapiens
aaaaccactgaacatttg

SEQ ID NO: 4162891 - DNA, 20 bp, Homo sapiens
aaaaccactgaacatttgct

SEQ ID NO: 4162892 - DNA, 18 bp, Homo sapiens
aaaaccattatttaataa

SEQ ID NO: 4162893 - DNA, 22 bp, Homo sapiens
aaaacctagaacttcaaaatgt

SEQ ID NO: 4162894 - DNA, 13 bp, Homo sapiens
aaaacctttcaaa

SEQ ID NO: 4162895 - DNA, 20 bp, Homo sapiens
aaaacctttcaaatttcaca

SEQ ID NO: 4162896 - DNA, 22 bp, Homo sapiens
aaaactagaggtgagaaattta

SEQ ID NO: 4162897 - DNA, 19 bp, Homo sapiens
aaaactcttggcctctgct

SEQ ID NO: 4162898 - DNA, 18 bp, Homo sapiens
aaaactgaaaatctaata

SEQ ID NO: 4162899 - DNA, 14 bp, Homo sapiens
aaaactgcatttca

SEQ ID NO: 4162900 - DNA, 15 bp, Homo sapiens
aaaacttcagaaaaa

SEQ ID NO: 4162901 - DNA, 13 bp, Homo sapiens
aaaactttaaagc

SEQ ID NO: 4162902 - DNA, 17 bp, Homo sapiens
aaaagaaaaccatttta

SEQ ID NO: 4162903 - DNA, 12 bp, Homo sapiens
aaaagaaacttt

SEQ ID NO: 4162904 - DNA, 17 bp, Homo sapiens
aaaagaacactagagtc

SEQ ID NO: 4162905 - DNA, 11 bp, Homo sapiens
aaaagaagtaa

SEQ ID NO: 4162906 - DNA, 18 bp, Homo sapiens
aaaagacatggaaggtta

SEQ ID NO: 4162907 - DNA, 22 bp, Homo sapiens
aaaagactattaagagcaataa

SEQ ID NO: 4162908 - DNA, 13 bp, Homo sapiens
aaaagatgctttt

SEQ ID NO: 4162909 - DNA, 19 bp, Homo sapiens
aaaagatgcttttaacaga

SEQ ID NO: 4162910 - DNA, 11 bp, Homo sapiens
aaaagctaatt

SEQ ID NO: 4162911 - DNA, 14 bp, Homo sapiens
aaaagctagaattg

SEQ ID NO: 4162912 - DNA, 14 bp, Homo sapiens
aaaaggctagttta

SEQ ID NO: 4162913 - DNA, 15 bp, Homo sapiens
aaaaggctgagaagg

SEQ ID NO: 4162914 - DNA, 17 bp, Homo sapiens
aaaaggctgagaaggaa

SEQ ID NO: 4162915 - DNA, 20 bp, Homo sapiens
aaaagggaagttgtgccttt

SEQ ID NO: 4162916 - DNA, 14 bp, Homo sapiens
aaaaggtttacaga

SEQ ID NO: 4162917 - DNA, 19 bp, Homo sapiens
aaaagtatttttttaagtt

SEQ ID NO: 4162918 - DNA, 19 bp, Homo sapiens
aaaagtcagactgctggga

SEQ ID NO: 4162919 - DNA, 14 bp, Homo sapiens
aaaagttagctgag

SEQ ID NO: 4162920 - DNA, 15 bp, Homo sapiens
aaaagttatatctaa

SEQ ID NO: 4162921 - DNA, 21 bp, Homo sapiens
aaaagtttttgtcactatctt

SEQ ID NO: 4162922 - DNA, 15 bp, Homo sapiens
aaaataaactgggga

SEQ ID NO: 4162923 - DNA, 15 bp, Homo sapiens
aaaataaattttgaa

SEQ ID NO: 4162924 - DNA, 18 bp, Homo sapiens
aaaataaattttgaatgt

SEQ ID NO: 4162925 - DNA, 18 bp, Homo sapiens
aaaataagagatagcaga

SEQ ID NO: 4162926 - DNA, 14 bp, Homo sapiens
aaaataagtatttc

SEQ ID NO: 4162927 - DNA, 13 bp, Homo sapiens
aaaatacaaacaa

SEQ ID NO: 4162928 - DNA, 11 bp, Homo sapiens
aaaatacaact

SEQ ID NO: 4162929 - DNA, 16 bp, Homo sapiens
aaaatacaactagaga

SEQ ID NO: 4162930 - DNA, 17 bp, Homo sapiens
aaaatacataagaccat

SEQ ID NO: 4162931 - DNA, 10 bp, Homo sapiens
aaaatacatg

SEQ ID NO: 4162932 - DNA, 21 bp, Homo sapiens
aaaataccagagccttcaagt

SEQ ID NO: 4162933 - DNA, 23 bp, Homo sapiens
aaaataccagagccttcaagtgc

SEQ ID NO: 4162934 - DNA, 17 bp, Homo sapiens
aaaatagcaaaagaaga

SEQ ID NO: 4162935 - DNA, 12 bp, Homo sapiens
aaaatattttct

SEQ ID NO: 4162936 - DNA, 12 bp, Homo sapiens
aaaatccactca

SEQ ID NO: 4162937 - DNA, 14 bp, Homo sapiens
aaaatccctattta

SEQ ID NO: 4162938 - DNA, 15 bp, Homo sapiens
aaaatctaatattaa

SEQ ID NO: 4162939 - DNA, 23 bp, Homo sapiens
aaaatctaatattaaaaatatgg

SEQ ID NO: 4162940 - DNA, 19 bp, Homo sapiens
aaaatgaaagcatgtctca

SEQ ID NO: 4162941 - DNA, 23 bp, Homo sapiens
aaaatgatacgctggtctggatg

SEQ ID NO: 4162942 - DNA, 20 bp, Homo sapiens
aaaatgattgtaaaatagct

SEQ ID NO: 4162943 - DNA, 23 bp, Homo sapiens
aaaatgccatgatgcctctgtct

SEQ ID NO: 4162944 - DNA, 18 bp, Homo sapiens
aaaatgggtaattttctt

SEQ ID NO: 4162945 - DNA, 22 bp, Homo sapiens
aaaatgtcaaagagaaaactta

SEQ ID NO: 4162946 - DNA, 19 bp, Homo sapiens
aaaatgtgacccagatcct

SEQ ID NO: 4162947 - DNA, 13 bp, Homo sapiens
aaaattatttaaa

SEQ ID NO: 4162948 - DNA, 19 bp, Homo sapiens
aaaattattttaaacaaaa

SEQ ID NO: 4162949 - DNA, 13 bp, Homo sapiens
aaaattccactca

SEQ ID NO: 4162950 - DNA, 14 bp, Homo sapiens
aaaattgaatgcaa

SEQ ID NO: 4162951 - DNA, 21 bp, Homo sapiens
aaaattgtatagagatatgca

SEQ ID NO: 4162952 - DNA, 18 bp, Homo sapiens
aaaattgttagtaaacat

SEQ ID NO: 4162953 - DNA, 12 bp, Homo sapiens
aaacaaaaagac

SEQ ID NO: 4162954 - DNA, 13 bp, Homo sapiens
aaacaaaaataaa

SEQ ID NO: 4162955 - DNA, 18 bp, Homo sapiens
aaacaaagagttcaagaa

SEQ ID NO: 4162956 - DNA, 13 bp, Homo sapiens
aaacaacaacaat

SEQ ID NO: 4162957 - DNA, 22 bp, Homo sapiens
aaacaagtatttgttaatttag

SEQ ID NO: 4162958 - DNA, 23 bp, Homo sapiens
aaacaagtatttgttaatttaga

SEQ ID NO: 4162959 - DNA, 19 bp, Homo sapiens
aaacaccaacataaaaatg

SEQ ID NO: 4162960 - DNA, 22 bp, Homo sapiens
aaacactccaccccctccagct

SEQ ID NO: 4162961 - DNA, 15 bp, Homo sapiens
aaacacttaggaaga

SEQ ID NO: 4162962 - DNA, 17 bp, Homo sapiens
aaacacttaggaagaaa

SEQ ID NO: 4162963 - DNA, 20 bp, Homo sapiens
aaacacttaggaagaaatca

SEQ ID NO: 4162964 - DNA, 19 bp, Homo sapiens
aaacacttatcttctggat

SEQ ID NO: 4162965 - DNA, 21 bp, Homo sapiens
aaacacttatcttctggatta

SEQ ID NO: 4162966 - DNA, 13 bp, Homo sapiens
aaacagactattt

SEQ ID NO: 4162967 - DNA, 16 bp, Homo sapiens
aaacagatggtagaga

SEQ ID NO: 4162968 - DNA, 11 bp, Homo sapiens
aaacaggacca

SEQ ID NO: 4162969 - DNA, 17 bp, Homo sapiens
aaacataggtataatta

SEQ ID NO: 4162970 - DNA, 21 bp, Homo sapiens
aaacatttattttgacataaa

SEQ ID NO: 4162971 - DNA, 12 bp, Homo sapiens
aaacatttcctc

SEQ ID NO: 4162972 - DNA, 18 bp, Homo sapiens
aaaccaaaacagaacaat

SEQ ID NO: 4162973 - DNA, 13 bp, Homo sapiens
aaaccaaagccag

SEQ ID NO: 4162974 - DNA, 14 bp, Homo sapiens
aaaccaagatagat

SEQ ID NO: 4162975 - DNA, 22 bp, Homo sapiens
aaaccaagtctacttcactaat

SEQ ID NO: 4162976 - DNA, 16 bp, Homo sapiens
aaaccacacttcttga

SEQ ID NO: 4162977 - DNA, 13 bp, Homo sapiens
aaaccacagaaca

SEQ ID NO: 4162978 - DNA, 20 bp, Homo sapiens
aaaccacaggttccatagaa

SEQ ID NO: 4162979 - DNA, 23 bp, Homo sapiens
aaaccaccagtgcccaaagtctg

SEQ ID NO: 4162980 - DNA, 18 bp, Homo sapiens
aaaccagttaagaatgga

SEQ ID NO: 4162981 - DNA, 14 bp, Homo sapiens
aaacccaaggaaca

SEQ ID NO: 4162982 - DNA, 14 bp, Homo sapiens
aaaccgctaaaaga

SEQ ID NO: 4162983 - DNA, 18 bp, Homo sapiens
aaaccgctaaaagaaact

SEQ ID NO: 4162984 - DNA, 15 bp, Homo sapiens
aaacctggagatgat

SEQ ID NO: 4162985 - DNA, 16 bp, Homo sapiens
aaacctggagatgatg

SEQ ID NO: 4162986 - DNA, 12 bp, Homo sapiens
aaacctggttca

SEQ ID NO: 4162987 - DNA, 19 bp, Homo sapiens
aaacctttcaaatttcaca

SEQ ID NO: 4162988 - DNA, 17 bp, Homo sapiens
aaacctttcttcaccaa

SEQ ID NO: 4162989 - DNA, 18 bp, Homo sapiens
aaacgactccgagaacaa

SEQ ID NO: 4162990 - DNA, 21 bp, Homo sapiens
aaacgtgggtatttcctgcta

SEQ ID NO: 4162991 - DNA, 19 bp, Homo sapiens
aaacgttgacccctttccc

SEQ ID NO: 4162992 - DNA, 22 bp, Homo sapiens
aaactagaggtgagaaatttaa

SEQ ID NO: 4162993 - DNA, 19 bp, Homo sapiens
aaactagtatctctggcct

SEQ ID NO: 4162994 - DNA, 20 bp, Homo sapiens
aaactatttgtctttcagga

SEQ ID NO: 4162995 - DNA, 21 bp, Homo sapiens
aaactctaaacattaatcaat

SEQ ID NO: 4162996 - DNA, 19 bp, Homo sapiens
aaactctacaccctctgcc

SEQ ID NO: 4162997 - DNA, 14 bp, Homo sapiens
aaactgaaaatcta

SEQ ID NO: 4162998 - DNA, 18 bp, Homo sapiens
aaactgaaaatctaatat

SEQ ID NO: 4162999 - DNA, 22 bp, Homo sapiens
aaactggggagttataaaaata

SEQ ID NO: 4163000 - DNA, 17 bp, Homo sapiens
aaactgtgccctgcctt

SEQ ID NO: 4163001 - DNA, 19 bp, Homo sapiens
aaactgtgccctgccttca

SEQ ID NO: 4163002 - DNA, 18 bp, Homo sapiens
aaacttagaataaaattg

SEQ ID NO: 4163003 - DNA, 16 bp, Homo sapiens
aaactttgaagttagc

SEQ ID NO: 4163004 - DNA, 19 bp, Homo sapiens
aaactttgatctctgctta

SEQ ID NO: 4163005 - DNA, 12 bp, Homo sapiens
aaacttttttat

SEQ ID NO: 4163006 - DNA, 17 bp, Homo sapiens
aaacttttttatttaaa

SEQ ID NO: 4163007 - DNA, 19 bp, Homo sapiens
aaacttttttatttaaaaa

SEQ ID NO: 4163008 - DNA, 15 bp, Homo sapiens
aaagaaaaacatttc

SEQ ID NO: 4163009 - DNA, 13 bp, Homo sapiens
aaagaaaaagtat

SEQ ID NO: 4163010 - DNA, 19 bp, Homo sapiens
aaagaaaaccattttagtt

SEQ ID NO: 4163011 - DNA, 13 bp, Homo sapiens
aaagaaaatgtct

SEQ ID NO: 4163012 - DNA, 14 bp, Homo sapiens
aaagaacaagaaat

SEQ ID NO: 4163013 - DNA, 13 bp, Homo sapiens
aaagaactgcccc

SEQ ID NO: 4163014 - DNA, 21 bp, Homo sapiens
aaagacacagatttcggtcat

SEQ ID NO: 4163015 - DNA, 17 bp, Homo sapiens
aaagacatggaaggtta

SEQ ID NO: 4163016 - DNA, 20 bp, Homo sapiens
aaagactaatttaaaaaata

SEQ ID NO: 4163017 - DNA, 23 bp, Homo sapiens
aaagactaatttaaaaaataact

SEQ ID NO: 4163018 - DNA, 22 bp, Homo sapiens
aaagactattaagagcaataaa

SEQ ID NO: 4163019 - DNA, 22 bp, Homo sapiens
aaagagctttagtcctagagga

SEQ ID NO: 4163020 - DNA, 21 bp, Homo sapiens
aaagaggtggattcctgggca

SEQ ID NO: 4163021 - DNA, 14 bp, Homo sapiens
aaagagtcagccct

SEQ ID NO: 4163022 - DNA, 12 bp, Homo sapiens
aaagagttagaa

SEQ ID NO: 4163023 - DNA, 16 bp, Homo sapiens
aaagagttcaagaaat

SEQ ID NO: 4163024 - DNA, 22 bp, Homo sapiens
aaagataacaagatctttcagg

SEQ ID NO: 4163025 - DNA, 22 bp, Homo sapiens
aaagatagtatcttttaaaatg

SEQ ID NO: 4163026 - DNA, 13 bp, Homo sapiens
aaagatgtgttgt

SEQ ID NO: 4163027 - DNA, 20 bp, Homo sapiens
aaagatgtgttgttggtttc

SEQ ID NO: 4163028 - DNA, 16 bp, Homo sapiens
aaagatttaacaaata

SEQ ID NO: 4163029 - DNA, 18 bp, Homo sapiens
aaagatttgtgaactgga

SEQ ID NO: 4163030 - DNA, 21 bp, Homo sapiens
aaagatttgtgaactggaaga

SEQ ID NO: 4163031 - DNA, 14 bp, Homo sapiens
aaagattttttaat

SEQ ID NO: 4163032 - DNA, 16 bp, Homo sapiens
aaagcaaaaaagaaaa

SEQ ID NO: 4163033 - DNA, 21 bp, Homo sapiens
aaagcaaaaaagaaaaccttt

SEQ ID NO: 4163034 - DNA, 14 bp, Homo sapiens
aaagcaaaagaagt

SEQ ID NO: 4163035 - DNA, 19 bp, Homo sapiens
aaagcaaaagaagtaaaag

SEQ ID NO: 4163036 - DNA, 16 bp, Homo sapiens
aaagcaaaagcaaggg

SEQ ID NO: 4163037 - DNA, 13 bp, Homo sapiens
aaagcaaatgaga

SEQ ID NO: 4163038 - DNA, 17 bp, Homo sapiens
aaagcatcacctcaggc

SEQ ID NO: 4163039 - DNA, 17 bp, Homo sapiens
aaagccaaactctgcca

SEQ ID NO: 4163040 - DNA, 10 bp, Homo sapiens
aaagcctcct

SEQ ID NO: 4163041 - DNA, 21 bp, Homo sapiens
aaagcggttgcttctggctcc

SEQ ID NO: 4163042 - DNA, 15 bp, Homo sapiens
aaagctgcctgtagt

SEQ ID NO: 4163043 - DNA, 23 bp, Homo sapiens
aaagctgcctgtagttaggaaat

SEQ ID NO: 4163044 - DNA, 19 bp, Homo sapiens
aaagctggacaagaagctg

SEQ ID NO: 4163045 - DNA, 20 bp, Homo sapiens
aaagctggacaagaagctgc

SEQ ID NO: 4163046 - DNA, 21 bp, Homo sapiens
aaagctggacaagaagctgct

SEQ ID NO: 4163047 - DNA, 15 bp, Homo sapiens
aaagctggtttaatg

SEQ ID NO: 4163048 - DNA, 16 bp, Homo sapiens
aaagcttaaaactttg

SEQ ID NO: 4163049 - DNA, 18 bp, Homo sapiens
aaagctttatatgtaatt

SEQ ID NO: 4163050 - DNA, 20 bp, Homo sapiens
aaagctttctgacaagataa

SEQ ID NO: 4163051 - DNA, 21 bp, Homo sapiens
aaaggcgcagtgcttctctac

SEQ ID NO: 4163052 - DNA, 19 bp, Homo sapiens
aaaggctcagtctcaggag

SEQ ID NO: 4163053 - DNA, 13 bp, Homo sapiens
aaaggctgagaag

SEQ ID NO: 4163054 - DNA, 14 bp, Homo sapiens
aaagggaagcctga

SEQ ID NO: 4163055 - DNA, 14 bp, Homo sapiens
aaaggtcaagactg

SEQ ID NO: 4163056 - DNA, 22 bp, Homo sapiens
aaaggtttatgaaaaagaagaa

SEQ ID NO: 4163057 - DNA, 21 bp, Homo sapiens
aaagtatttttttaagttaga

SEQ ID NO: 4163058 - DNA, 21 bp, Homo sapiens
aaagtcagaccctaggaagct

SEQ ID NO: 4163059 - DNA, 12 bp, Homo sapiens
aaagtctaaagt

SEQ ID NO: 4163060 - DNA, 22 bp, Homo sapiens
aaagtctgtgtgatgaactttc

SEQ ID NO: 4163061 - DNA, 23 bp, Homo sapiens
aaagtctgtgtgatgaactttct

SEQ ID NO: 4163062 - DNA, 23 bp, Homo sapiens
aaagtgctgggattacagacatg

SEQ ID NO: 4163063 - DNA, 21 bp, Homo sapiens
aaagtggggggtggacacaga

SEQ ID NO: 4163064 - DNA, 15 bp, Homo sapiens
aaagtgtaacagata

SEQ ID NO: 4163065 - DNA, 16 bp, Homo sapiens
aaagtgtagcaccctg

SEQ ID NO: 4163066 - DNA, 19 bp, Homo sapiens
aaagttgggaaaagtgtta

SEQ ID NO: 4163067 - DNA, 14 bp, Homo sapiens
aaataaaacctttc

SEQ ID NO: 4163068 - DNA, 17 bp, Homo sapiens
aaataaaacctttcaaa

SEQ ID NO: 4163069 - DNA, 21 bp, Homo sapiens
aaataaaagaacacattagat

SEQ ID NO: 4163070 - DNA, 22 bp, Homo sapiens
aaataaacctggagatgatgat

SEQ ID NO: 4163071 - DNA, 22 bp, Homo sapiens
aaataaatcagcacatttgaaa

SEQ ID NO: 4163072 - DNA, 17 bp, Homo sapiens
aaataaattatattaat

SEQ ID NO: 4163073 - DNA, 15 bp, Homo sapiens
aaataaattgtttga

SEQ ID NO: 4163074 - DNA, 20 bp, Homo sapiens
aaataagaagaatgcttaat

SEQ ID NO: 4163075 - DNA, 13 bp, Homo sapiens
aaataagtttttg

SEQ ID NO: 4163076 - DNA, 11 bp, Homo sapiens
aaatacaaaaa

SEQ ID NO: 4163077 - DNA, 15 bp, Homo sapiens
aaatacaaaaatact

SEQ ID NO: 4163078 - DNA, 19 bp, Homo sapiens
aaatacaaacaagcacaga

SEQ ID NO: 4163079 - DNA, 23 bp, Homo sapiens
aaatacacagatgattaaacaga

SEQ ID NO: 4163080 - DNA, 16 bp, Homo sapiens
aaatacagtggatctc

SEQ ID NO: 4163081 - DNA, 18 bp, Homo sapiens
aaatacatgctaagagaa

SEQ ID NO: 4163082 - DNA, 19 bp, Homo sapiens
aaataccacaagcctgaga

SEQ ID NO: 4163083 - DNA, 16 bp, Homo sapiens
aaatagaaattttgtt

SEQ ID NO: 4163084 - DNA, 20 bp, Homo sapiens
aaatagagattaattttaac

SEQ ID NO: 4163085 - DNA, 16 bp, Homo sapiens
aaatagcttgtatagt

SEQ ID NO: 4163086 - DNA, 18 bp, Homo sapiens
aaataggcttagagagga

SEQ ID NO: 4163087 - DNA, 21 bp, Homo sapiens
aaatagtgcagaatctcatag

SEQ ID NO: 4163088 - DNA, 15 bp, Homo sapiens
aaatatcctttggaa

SEQ ID NO: 4163089 - DNA, 15 bp, Homo sapiens
aaatatgatgttaaa

SEQ ID NO: 4163090 - DNA, 21 bp, Homo sapiens
aaatatgatgttaaaaaaata

SEQ ID NO: 4163091 - DNA, 18 bp, Homo sapiens
aaatatggaacttctaat

SEQ ID NO: 4163092 - DNA, 14 bp, Homo sapiens
aaatatgtgaaaat

SEQ ID NO: 4163093 - DNA, 15 bp, Homo sapiens
aaatatgtgaatctg

SEQ ID NO: 4163094 - DNA, 16 bp, Homo sapiens
aaatattatgagatgc

SEQ ID NO: 4163095 - DNA, 22 bp, Homo sapiens
aaatattgacttctcttgaatt

SEQ ID NO: 4163096 - DNA, 15 bp, Homo sapiens
aaatattttaaagaa

SEQ ID NO: 4163097 - DNA, 17 bp, Homo sapiens
aaatattttaaagaatt

SEQ ID NO: 4163098 - DNA, 17 bp, Homo sapiens
aaatattttttaaagtc

SEQ ID NO: 4163099 - DNA, 12 bp, Homo sapiens
aaatcaaagaaa

SEQ ID NO: 4163100 - DNA, 21 bp, Homo sapiens
aaatcaataaaagttgatcat

SEQ ID NO: 4163101 - DNA, 20 bp, Homo sapiens
aaatcacgctttttgaaaaa

SEQ ID NO: 4163102 - DNA, 17 bp, Homo sapiens
aaatcacttaaatacct

SEQ ID NO: 4163103 - DNA, 15 bp, Homo sapiens
aaatcatgaatattt

SEQ ID NO: 4163104 - DNA, 14 bp, Homo sapiens
aaatcattttgcaa

SEQ ID NO: 4163105 - DNA, 16 bp, Homo sapiens
aaatccagtttcccac

SEQ ID NO: 4163106 - DNA, 18 bp, Homo sapiens
aaatcctttttctttata

SEQ ID NO: 4163107 - DNA, 13 bp, Homo sapiens
aaatcgaatgaaa

SEQ ID NO: 4163108 - DNA, 14 bp, Homo sapiens
aaatctaactacaa

SEQ ID NO: 4163109 - DNA, 13 bp, Homo sapiens
aaatctctaatat

SEQ ID NO: 4163110 - DNA, 18 bp, Homo sapiens
aagttcctgcactccaga

SEQ ID NO: 4163111 - DNA, 19 bp, Homo sapiens
aagttcctgcactccagaa

SEQ ID NO: 4163112 - DNA, 21 bp, Homo sapiens
aagttctagagaagaggctgg

SEQ ID NO: 4163113 - DNA, 18 bp, Homo sapiens
aagttgaaaaataaagtt

SEQ ID NO: 4163114 - DNA, 20 bp, Homo sapiens
aagttgtgccttttatagct

SEQ ID NO: 4163115 - DNA, 20 bp, Homo sapiens
aagttgttcacatatatgta

SEQ ID NO: 4163116 - DNA, 15 bp, Homo sapiens
aagtttaataaaata

SEQ ID NO: 4163117 - DNA, 23 bp, Homo sapiens
aagtttacaagtgtatatcagaa

SEQ ID NO: 4163118 - DNA, 22 bp, Homo sapiens
aagtttacagtaaataaattgt

SEQ ID NO: 4163119 - DNA, 20 bp, Homo sapiens
aagtttctggtgccatttct

SEQ ID NO: 4163120 - DNA, 19 bp, Homo sapiens
aagtttgcactatctttca

SEQ ID NO: 4163121 - DNA, 21 bp, Homo sapiens
aagtttgcactgtatgctgga

SEQ ID NO: 4163122 - DNA, 13 bp, Homo sapiens
aagttttcctgag

SEQ ID NO: 4163123 - DNA, 22 bp, Homo sapiens
aataaaaagactattaagagca

SEQ ID NO: 4163124 - DNA, 14 bp, Homo sapiens
aataaaacctttca

SEQ ID NO: 4163125 - DNA, 23 bp, Homo sapiens
aataaaacctttcaaatttcaca

SEQ ID NO: 4163126 - DNA, 16 bp, Homo sapiens
aataaaaggaaaacca

SEQ ID NO: 4163127 - DNA, 19 bp, Homo sapiens
aataaaatagcaattagca

SEQ ID NO: 4163128 - DNA, 14 bp, Homo sapiens
aataaaatcctgct

SEQ ID NO: 4163129 - DNA, 19 bp, Homo sapiens
aataaaatgaggacatgtt

SEQ ID NO: 4163130 - DNA, 12 bp, Homo sapiens
aataaaattgta

SEQ ID NO: 4163131 - DNA, 21 bp, Homo sapiens
aataaacctggagatgatgat

SEQ ID NO: 4163132 - DNA, 19 bp, Homo sapiens
aataaacttagaataaaat

SEQ ID NO: 4163133 - DNA, 14 bp, Homo sapiens
aataaagctgctga

SEQ ID NO: 4163134 - DNA, 11 bp, Homo sapiens
aataaagctgg

SEQ ID NO: 4163135 - DNA, 18 bp, Homo sapiens
aataaatagaaattttgt

SEQ ID NO: 4163136 - DNA, 13 bp, Homo sapiens
aataaatgttcaa

SEQ ID NO: 4163137 - DNA, 15 bp, Homo sapiens
aataaattatattaa

SEQ ID NO: 4163138 - DNA, 13 bp, Homo sapiens
aataagaaacttt

SEQ ID NO: 4163139 - DNA, 20 bp, Homo sapiens
aataagtttttgtttcacag

SEQ ID NO: 4163140 - DNA, 15 bp, Homo sapiens
aataataccaagact

SEQ ID NO: 4163141 - DNA, 16 bp, Homo sapiens
aataatactgctgaga

SEQ ID NO: 4163142 - DNA, 20 bp, Homo sapiens
aataatatgtgatgattaat

SEQ ID NO: 4163143 - DNA, 15 bp, Homo sapiens
aataatattgtatat

SEQ ID NO: 4163144 - DNA, 15 bp, Homo sapiens
aataatatttcaagt

SEQ ID NO: 4163145 - DNA, 16 bp, Homo sapiens
aataatatttcaagtg

SEQ ID NO: 4163146 - DNA, 19 bp, Homo sapiens
aataatatttcaagtgcct

SEQ ID NO: 4163147 - DNA, 22 bp, Homo sapiens
aataatatttcaagtgcctaga

SEQ ID NO: 4163148 - DNA, 20 bp, Homo sapiens
aataattatgagtttgctta

SEQ ID NO: 4163149 - DNA, 23 bp, Homo sapiens
aataattcttccagtgcaacaaa

SEQ ID NO: 4163150 - DNA, 12 bp, Homo sapiens
aataatttagac

SEQ ID NO: 4163151 - DNA, 14 bp, Homo sapiens
aataatttttctta

SEQ ID NO: 4163152 - DNA, 17 bp, Homo sapiens
aataatttttcttacac

SEQ ID NO: 4163153 - DNA, 19 bp, Homo sapiens
aatacaacaagaacaacaa

SEQ ID NO: 4163154 - DNA, 14 bp, Homo sapiens
aatacaatattaat

SEQ ID NO: 4163155 - DNA, 19 bp, Homo sapiens
aatacagaaattagccggg

SEQ ID NO: 4163156 - DNA, 22 bp, Homo sapiens
aatacatgctaagagaagtaga

SEQ ID NO: 4163157 - DNA, 14 bp, Homo sapiens
aataccacaagcct

SEQ ID NO: 4163158 - DNA, 13 bp, Homo sapiens
aataccagagcct

SEQ ID NO: 4163159 - DNA, 23 bp, Homo sapiens
aataccagagccttcaagtgcca

SEQ ID NO: 4163160 - DNA, 14 bp, Homo sapiens
aatactaatgtaaa

SEQ ID NO: 4163161 - DNA, 22 bp, Homo sapiens
aatactatgaaatgaaagaact

SEQ ID NO: 4163162 - DNA, 15 bp, Homo sapiens
aatactgctgagata

SEQ ID NO: 4163163 - DNA, 11 bp, Homo sapiens
aatacttcatg

SEQ ID NO: 4163164 - DNA, 14 bp, Homo sapiens
aatacttctcattt

SEQ ID NO: 4163165 - DNA, 22 bp, Homo sapiens
aatacttctcattttttaaaaa

SEQ ID NO: 4163166 - DNA, 16 bp, Homo sapiens
aatacttttccttaat

SEQ ID NO: 4163167 - DNA, 20 bp, Homo sapiens
aatagaaaactgaaaatcta

SEQ ID NO: 4163168 - DNA, 20 bp, Homo sapiens
aatagacagtatatttatag

SEQ ID NO: 4163169 - DNA, 21 bp, Homo sapiens
aatagagagtatgtaatcttt

SEQ ID NO: 4163170 - DNA, 19 bp, Homo sapiens
aatagagattaattttaac

SEQ ID NO: 4163171 - DNA, 15 bp, Homo sapiens
aatagattatagttg

SEQ ID NO: 4163172 - DNA, 16 bp, Homo sapiens
aatagcaaaagaagaa

SEQ ID NO: 4163173 - DNA, 17 bp, Homo sapiens
aatagcttttattgtat

SEQ ID NO: 4163174 - DNA, 23 bp, Homo sapiens
aatagcttttcatcaattcttaa

SEQ ID NO: 4163175 - DNA, 14 bp, Homo sapiens
aatagtatatgcat

SEQ ID NO: 4163176 - DNA, 15 bp, Homo sapiens
aatagtatttcccat

SEQ ID NO: 4163177 - DNA, 14 bp, Homo sapiens
aatatacaatctat

SEQ ID NO: 4163178 - DNA, 14 bp, Homo sapiens
aatatagttctgat

SEQ ID NO: 4163179 - DNA, 23 bp, Homo sapiens
aatatatgattgtataatgtgat

SEQ ID NO: 4163180 - DNA, 13 bp, Homo sapiens
aatatatggtctg

SEQ ID NO: 4163181 - DNA, 15 bp, Homo sapiens
aatatatttttatat

SEQ ID NO: 4163182 - DNA, 19 bp, Homo sapiens
aatatatttttatatttag

SEQ ID NO: 4163183 - DNA, 20 bp, Homo sapiens
aatatatttttatatttagt

SEQ ID NO: 4163184 - DNA, 18 bp, Homo sapiens
aatatcctaaacatcatt

SEQ ID NO: 4163185 - DNA, 14 bp, Homo sapiens
aatatcctttggaa

SEQ ID NO: 4163186 - DNA, 13 bp, Homo sapiens
aatatgctctcat

SEQ ID NO: 4163187 - DNA, 19 bp, Homo sapiens
aatatgtaccaagaatctt

SEQ ID NO: 4163188 - DNA, 12 bp, Homo sapiens
aatatgtagcct

SEQ ID NO: 4163189 - DNA, 13 bp, Homo sapiens
aatattaccaaaa

SEQ ID NO: 4163190 - DNA, 15 bp, Homo sapiens
aatattcaataaagc

SEQ ID NO: 4163191 - DNA, 14 bp, Homo sapiens
aatatttgagaata

SEQ ID NO: 4163192 - DNA, 13 bp, Homo sapiens
aatattttaaaga

SEQ ID NO: 4163193 - DNA, 20 bp, Homo sapiens
aatatttttagctctgttct

SEQ ID NO: 4163194 - DNA, 22 bp, Homo sapiens
aatatttttagctctgttcttt

SEQ ID NO: 4163195 - DNA, 17 bp, Homo sapiens
aatcaacttgcttatca

SEQ ID NO: 4163196 - DNA, 21 bp, Homo sapiens
aatcaacttgcttatcaactt

SEQ ID NO: 4163197 - DNA, 12 bp, Homo sapiens
aatcaagacact

SEQ ID NO: 4163198 - DNA, 21 bp, Homo sapiens
aatcaagacactagttcagag

SEQ ID NO: 4163199 - DNA, 15 bp, Homo sapiens
aatcaaggaatcctg

SEQ ID NO: 4163200 - DNA, 21 bp, Homo sapiens
aatcaagtctgtttactgcaa

SEQ ID NO: 4163201 - DNA, 13 bp, Homo sapiens
aatcaataaaaat

SEQ ID NO: 4163202 - DNA, 18 bp, Homo sapiens
aatcaccacaaactgtaa

SEQ ID NO: 4163203 - DNA, 21 bp, Homo sapiens
aatcagactcttggggaagcg

SEQ ID NO: 4163204 - DNA, 20 bp, Homo sapiens
aatcagagagcctagaacat

SEQ ID NO: 4163205 - DNA, 21 bp, Homo sapiens
aatcagatagatattcctatt

SEQ ID NO: 4163206 - DNA, 22 bp, Homo sapiens
aatcatgaatatttcaaaataa

SEQ ID NO: 4163207 - DNA, 18 bp, Homo sapiens
aatcatgagtcagacatt

SEQ ID NO: 4163208 - DNA, 20 bp, Homo sapiens
aatcatgtgtttaaattatt

SEQ ID NO: 4163209 - DNA, 15 bp, Homo sapiens
aatcattgtgcttaa

SEQ ID NO: 4163210 - DNA, 16 bp, Homo sapiens
aatccaatctgtaatt

SEQ ID NO: 4163211 - DNA, 18 bp, Homo sapiens
aatccacaaagccgtgcc

SEQ ID NO: 4163212 - DNA, 21 bp, Homo sapiens
aatccatggacctatgacagg

SEQ ID NO: 4163213 - DNA, 23 bp, Homo sapiens
aatccctggttttaagtatcaat

SEQ ID NO: 4163214 - DNA, 22 bp, Homo sapiens
aatcctgaagaaaccacaggtt

SEQ ID NO: 4163215 - DNA, 20 bp, Homo sapiens
aatcctttttctttataaac

SEQ ID NO: 4163216 - DNA, 14 bp, Homo sapiens
aatcgagtctacct

SEQ ID NO: 4163217 - DNA, 19 bp, Homo sapiens
aatctaacaataatatttc

SEQ ID NO: 4163218 - DNA, 20 bp, Homo sapiens
aatctaacaataatatttca

SEQ ID NO: 4163219 - DNA, 15 bp, Homo sapiens
aatctagaaaattga

SEQ ID NO: 4163220 - DNA, 22 bp, Homo sapiens
aatctcagttgattttctggat

SEQ ID NO: 4163221 - DNA, 23 bp, Homo sapiens
aatctcataggttgccaataata

SEQ ID NO: 4163222 - DNA, 17 bp, Homo sapiens
aatctcatctcagtgaa

SEQ ID NO: 4163223 - DNA, 15 bp, Homo sapiens
aatctctcctctctc

SEQ ID NO: 4163224 - DNA, 20 bp, Homo sapiens
aatctgagatctccctccag

SEQ ID NO: 4163225 - DNA, 11 bp, Homo sapiens
aatctgcaggg

SEQ ID NO: 4163226 - DNA, 18 bp, Homo sapiens
aatctgcagggagcaact

SEQ ID NO: 4163227 - DNA, 16 bp, Homo sapiens
aatctgcattattgga

SEQ ID NO: 4163228 - DNA, 18 bp, Homo sapiens
aatctgcattattggaat

SEQ ID NO: 4163229 - DNA, 20 bp, Homo sapiens
aatcttaaggtgtagccaca

SEQ ID NO: 4163230 - DNA, 15 bp, Homo sapiens
aatcttatgcttaaa

SEQ ID NO: 4163231 - DNA, 17 bp, Homo sapiens
aatctttaaaagatgct

SEQ ID NO: 4163232 - DNA, 15 bp, Homo sapiens
aatctttgattcaga

SEQ ID NO: 4163233 - DNA, 15 bp, Homo sapiens
aatgaaagtttgcac

SEQ ID NO: 4163234 - DNA, 15 bp, Homo sapiens
aatgaaatgtttttg

SEQ ID NO: 4163235 - DNA, 15 bp, Homo sapiens
aatgaattgtatttt

SEQ ID NO: 4163236 - DNA, 22 bp, Homo sapiens
aatgaattgtattttttgttga

SEQ ID NO: 4163237 - DNA, 14 bp, Homo sapiens
aatgacaacagaag

SEQ ID NO: 4163238 - DNA, 16 bp, Homo sapiens
aatgacagaatgctgt

SEQ ID NO: 4163239 - DNA, 15 bp, Homo sapiens
aatgagaaaatggct

SEQ ID NO: 4163240 - DNA, 23 bp, Homo sapiens
aatgataagcaggaaggatggca

SEQ ID NO: 4163241 - DNA, 18 bp, Homo sapiens
aatgatatccagtaagca

SEQ ID NO: 4163242 - DNA, 23 bp, Homo sapiens
aatgattatgtgtcctttcttga

SEQ ID NO: 4163243 - DNA, 20 bp, Homo sapiens
aatgattgtaaaatagcttg

SEQ ID NO: 4163244 - DNA, 14 bp, Homo sapiens
aatgatttttagat

SEQ ID NO: 4163245 - DNA, 18 bp, Homo sapiens
aatgcaatataaaaatgt

SEQ ID NO: 4163246 - DNA, 21 bp, Homo sapiens
aatgcatgtaaggtcttcttg

SEQ ID NO: 4163247 - DNA, 19 bp, Homo sapiens
aatgcccgtaatgcttaga

SEQ ID NO: 4163248 - DNA, 14 bp, Homo sapiens
aatgcctcctccct

SEQ ID NO: 4163249 - DNA, 19 bp, Homo sapiens
aagattaaaggaaggaaaa

SEQ ID NO: 4163250 - DNA, 16 bp, Homo sapiens
aagattagaggtttgt

SEQ ID NO: 4163251 - DNA, 17 bp, Homo sapiens
aagattagaggtttgtc

SEQ ID NO: 4163252 - DNA, 13 bp, Homo sapiens
aagattgttttat

SEQ ID NO: 4163253 - DNA, 14 bp, Homo sapiens
aagatttaacaaat

SEQ ID NO: 4163254 - DNA, 19 bp, Homo sapiens
aagatttgtgaactggaag

SEQ ID NO: 4163255 - DNA, 20 bp, Homo sapiens
aagatttgtgaactggaaga

SEQ ID NO: 4163256 - DNA, 15 bp, Homo sapiens
aagcaaaaaagaaaa

SEQ ID NO: 4163257 - DNA, 16 bp, Homo sapiens
aagcaaaggaaaccaa

SEQ ID NO: 4163258 - DNA, 18 bp, Homo sapiens
aagcaaatcgaatgaaat

SEQ ID NO: 4163259 - DNA, 13 bp, Homo sapiens
aagcaagcagggg

SEQ ID NO: 4163260 - DNA, 23 bp, Homo sapiens
aagcaagctggatgcagtggctc

SEQ ID NO: 4163261 - DNA, 13 bp, Homo sapiens
aagcaagcttaat

SEQ ID NO: 4163262 - DNA, 15 bp, Homo sapiens
aagcacatgtttatt

SEQ ID NO: 4163263 - DNA, 12 bp, Homo sapiens
aagcacccttga

SEQ ID NO: 4163264 - DNA, 23 bp, Homo sapiens
aagcactgctaggcgagtgccag

SEQ ID NO: 4163265 - DNA, 13 bp, Homo sapiens
aagcagagcttcc

SEQ ID NO: 4163266 - DNA, 17 bp, Homo sapiens
aagcaggaaggatggca

SEQ ID NO: 4163267 - DNA, 14 bp, Homo sapiens
aagcaggcagggca

SEQ ID NO: 4163268 - DNA, 23 bp, Homo sapiens
aagcaggccttagtacggctgct

SEQ ID NO: 4163269 - DNA, 19 bp, Homo sapiens
aagcatcacctcaggccag

SEQ ID NO: 4163270 - DNA, 19 bp, Homo sapiens
aagcatcttgtcaagaaat

SEQ ID NO: 4163271 - DNA, 21 bp, Homo sapiens
aagcattcagaagaaaaagaa

SEQ ID NO: 4163272 - DNA, 16 bp, Homo sapiens
aagccaacgacaaagc

SEQ ID NO: 4163273 - DNA, 19 bp, Homo sapiens
aagccaagggctaggctct

SEQ ID NO: 4163274 - DNA, 21 bp, Homo sapiens
aagccaatatttactcatcag

SEQ ID NO: 4163275 - DNA, 18 bp, Homo sapiens
aagccacaagaaatttga

SEQ ID NO: 4163276 - DNA, 13 bp, Homo sapiens
aagccactgaagc

SEQ ID NO: 4163277 - DNA, 17 bp, Homo sapiens
aagccactgaagctggg

SEQ ID NO: 4163278 - DNA, 20 bp, Homo sapiens
aagccattttttgaggagag

SEQ ID NO: 4163279 - DNA, 16 bp, Homo sapiens
aagcctgactgctcgg

SEQ ID NO: 4163280 - DNA, 16 bp, Homo sapiens
aagcctgcagcgagct

SEQ ID NO: 4163281 - DNA, 19 bp, Homo sapiens
aagcctgttttgttggaag

SEQ ID NO: 4163282 - DNA, 21 bp, Homo sapiens
aagcggaggttgcagggagcc

SEQ ID NO: 4163283 - DNA, 22 bp, Homo sapiens
aagcgggggcgtggctggcctt

SEQ ID NO: 4163284 - DNA, 14 bp, Homo sapiens
aagcgggtggtggc

SEQ ID NO: 4163285 - DNA, 14 bp, Homo sapiens
aagctgcctgtagt

SEQ ID NO: 4163286 - DNA, 19 bp, Homo sapiens
aagctgcctgtagttagga

SEQ ID NO: 4163287 - DNA, 14 bp, Homo sapiens
aagctggaagcaca

SEQ ID NO: 4163288 - DNA, 19 bp, Homo sapiens
aagctggacaagaagctgc

SEQ ID NO: 4163289 - DNA, 20 bp, Homo sapiens
aagctggagggaggtggggc

SEQ ID NO: 4163290 - DNA, 20 bp, Homo sapiens
aagctgggcatgaacgcact

SEQ ID NO: 4163291 - DNA, 17 bp, Homo sapiens
aagctgtaaaaagagag

SEQ ID NO: 4163292 - DNA, 18 bp, Homo sapiens
aagctgtaaaaagagaga

SEQ ID NO: 4163293 - DNA, 23 bp, Homo sapiens
aagctgtagtagccctttctgtg

SEQ ID NO: 4163294 - DNA, 14 bp, Homo sapiens
aagctgtgtgcagg

SEQ ID NO: 4163295 - DNA, 21 bp, Homo sapiens
aagcttaatggctgataattt

SEQ ID NO: 4163296 - DNA, 19 bp, Homo sapiens
aagctttggtgagaacctg

SEQ ID NO: 4163297 - DNA, 14 bp, Homo sapiens
aaggaaaccaaagg

SEQ ID NO: 4163298 - DNA, 18 bp, Homo sapiens
aaggaaaccttttcatgc

SEQ ID NO: 4163299 - DNA, 22 bp, Homo sapiens
aaggaaagaaaactaacaacca

SEQ ID NO: 4163300 - DNA, 17 bp, Homo sapiens
aaggaaagatttgtgaa

SEQ ID NO: 4163301 - DNA, 18 bp, Homo sapiens
aaggaactctggcttcca

SEQ ID NO: 4163302 - DNA, 22 bp, Homo sapiens
aaggaactctggcttccaggta

SEQ ID NO: 4163303 - DNA, 22 bp, Homo sapiens
aaggaagggcatccttctgcct

SEQ ID NO: 4163304 - DNA, 16 bp, Homo sapiens
aaggaagtcaccaaaa

SEQ ID NO: 4163305 - DNA, 18 bp, Homo sapiens
aaggaatcgtttcaaatg

SEQ ID NO: 4163306 - DNA, 22 bp, Homo sapiens
aaggacaatgccttgggagaga

SEQ ID NO: 4163307 - DNA, 14 bp, Homo sapiens
aaggagagcaagaa

SEQ ID NO: 4163308 - DNA, 19 bp, Homo sapiens
aaggagtgtagcaactaca

SEQ ID NO: 4163309 - DNA, 17 bp, Homo sapiens
aaggatagcctcagcca

SEQ ID NO: 4163310 - DNA, 14 bp, Homo sapiens
aaggatcctggaac

SEQ ID NO: 4163311 - DNA, 22 bp, Homo sapiens
aaggattgttgggcttggggga

SEQ ID NO: 4163312 - DNA, 12 bp, Homo sapiens
aaggatttgttc

SEQ ID NO: 4163313 - DNA, 20 bp, Homo sapiens
aaggcccaggtcaacatcta

SEQ ID NO: 4163314 - DNA, 21 bp, Homo sapiens
aaggcctcactcaagcctgag

SEQ ID NO: 4163315 - DNA, 17 bp, Homo sapiens
aaggctcagtctcagga

SEQ ID NO: 4163316 - DNA, 14 bp, Homo sapiens
aaggctgagaagga

SEQ ID NO: 4163317 - DNA, 17 bp, Homo sapiens
aaggcttgttgtgcttt

SEQ ID NO: 4163318 - DNA, 13 bp, Homo sapiens
aagggaagcctga

SEQ ID NO: 4163319 - DNA, 16 bp, Homo sapiens
aagggaagcctgactg

SEQ ID NO: 4163320 - DNA, 18 bp, Homo sapiens
aagggaaggaactctggc

SEQ ID NO: 4163321 - DNA, 17 bp, Homo sapiens
aagggaagttgtgcctt

SEQ ID NO: 4163322 - DNA, 17 bp, Homo sapiens
aagggcatccttctgcc

SEQ ID NO: 4163323 - DNA, 17 bp, Homo sapiens
aagggccatgctgaagg

SEQ ID NO: 4163324 - DNA, 19 bp, Homo sapiens
aagggccatgctgaaggga

SEQ ID NO: 4163325 - DNA, 22 bp, Homo sapiens
aaggggcttcaggtccaggctg

SEQ ID NO: 4163326 - DNA, 18 bp, Homo sapiens
aagggtatgggaagccat

SEQ ID NO: 4163327 - DNA, 20 bp, Homo sapiens
aagggttggtgggctggccc

SEQ ID NO: 4163328 - DNA, 21 bp, Homo sapiens
aagggttttccaccctggaat

SEQ ID NO: 4163329 - DNA, 14 bp, Homo sapiens
aaggtaaaatgcca

SEQ ID NO: 4163330 - DNA, 18 bp, Homo sapiens
aaggtaaaatgccatgat

SEQ ID NO: 4163331 - DNA, 19 bp, Homo sapiens
aaggtaatttctgtgtatt

SEQ ID NO: 4163332 - DNA, 15 bp, Homo sapiens
aaggtattagcaaag

SEQ ID NO: 4163333 - DNA, 18 bp, Homo sapiens
aaggtattccttttgtgt

SEQ ID NO: 4163334 - DNA, 23 bp, Homo sapiens
aaggtcacataaactttataaat

SEQ ID NO: 4163335 - DNA, 19 bp, Homo sapiens
aaggtcttcttgtgtcctg

SEQ ID NO: 4163336 - DNA, 14 bp, Homo sapiens
aaggtgatttcaga

SEQ ID NO: 4163337 - DNA, 14 bp, Homo sapiens
aaggtgctctgtgt

SEQ ID NO: 4163338 - DNA, 16 bp, Homo sapiens
aaggtgggctgagccc

SEQ ID NO: 4163339 - DNA, 20 bp, Homo sapiens
aaggtgtagccacaccagga

SEQ ID NO: 4163340 - DNA, 20 bp, Homo sapiens
aaggttagaggtttgtcaac

SEQ ID NO: 4163341 - DNA, 15 bp, Homo sapiens
aaggttaggtttgtc

SEQ ID NO: 4163342 - DNA, 19 bp, Homo sapiens
aaggttaggtttgtcaaca

SEQ ID NO: 4163343 - DNA, 16 bp, Homo sapiens
aaggttccctctgaga

SEQ ID NO: 4163344 - DNA, 17 bp, Homo sapiens
aaggtttatgaaaaaga

SEQ ID NO: 4163345 - DNA, 13 bp, Homo sapiens
aaggtttggtgtg

SEQ ID NO: 4163346 - DNA, 14 bp, Homo sapiens
aagtaaaaaataac

SEQ ID NO: 4163347 - DNA, 18 bp, Homo sapiens
aagtaaaagcaaaaaaga

SEQ ID NO: 4163348 - DNA, 22 bp, Homo sapiens
aagtaaaagctaattaggattt

SEQ ID NO: 4163349 - DNA, 13 bp, Homo sapiens
aagtaaaccaaaa

SEQ ID NO: 4163350 - DNA, 18 bp, Homo sapiens
aagtaagtaccactcagg

SEQ ID NO: 4163351 - DNA, 16 bp, Homo sapiens
aagtaatcactaaccc

SEQ ID NO: 4163352 - DNA, 14 bp, Homo sapiens
aagtaattcctctc

SEQ ID NO: 4163353 - DNA, 18 bp, Homo sapiens
aagtaatttgtaaaaaag

SEQ ID NO: 4163354 - DNA, 21 bp, Homo sapiens
aagtagaagtaatatgctctc

SEQ ID NO: 4163355 - DNA, 18 bp, Homo sapiens
aagtaggaaggaaaaaat

SEQ ID NO: 4163356 - DNA, 22 bp, Homo sapiens
aagtaggactttcctaaatgtt

SEQ ID NO: 4163357 - DNA, 12 bp, Homo sapiens
aagtagttctat

SEQ ID NO: 4163358 - DNA, 12 bp, Homo sapiens
aagtagtttgta

SEQ ID NO: 4163359 - DNA, 23 bp, Homo sapiens
aagtatctaactcttctggaaac

SEQ ID NO: 4163360 - DNA, 21 bp, Homo sapiens
aagtatgtaaacaggagacag

SEQ ID NO: 4163361 - DNA, 22 bp, Homo sapiens
aagtattaggggtaatatattg

SEQ ID NO: 4163362 - DNA, 20 bp, Homo sapiens
aagtatttgttaatttagaa

SEQ ID NO: 4163363 - DNA, 18 bp, Homo sapiens
aagtatttttttaagtta

SEQ ID NO: 4163364 - DNA, 17 bp, Homo sapiens
aagtcaacactcttctt

SEQ ID NO: 4163365 - DNA, 18 bp, Homo sapiens
aagtcaagatcaacattc

SEQ ID NO: 4163366 - DNA, 16 bp, Homo sapiens
aagtcagactgctggg

SEQ ID NO: 4163367 - DNA, 17 bp, Homo sapiens
aagtcagactgctggga

SEQ ID NO: 4163368 - DNA, 23 bp, Homo sapiens
aagtcctatcgactttatacaga

SEQ ID NO: 4163369 - DNA, 14 bp, Homo sapiens
aagtctaaagttta

SEQ ID NO: 4163370 - DNA, 19 bp, Homo sapiens
aagtctaaagtttacagta

SEQ ID NO: 4163371 - DNA, 23 bp, Homo sapiens
aagtctattgtttgttgtgcttg

SEQ ID NO: 4163372 - DNA, 15 bp, Homo sapiens
aagtctcagaagagg

SEQ ID NO: 4163373 - DNA, 14 bp, Homo sapiens
aagtctccttcccc

SEQ ID NO: 4163374 - DNA, 17 bp, Homo sapiens
aagtctgggaaattcta

SEQ ID NO: 4163375 - DNA, 16 bp, Homo sapiens
aagtcttttttgatca

SEQ ID NO: 4163376 - DNA, 13 bp, Homo sapiens
aagtgaccaaatt

SEQ ID NO: 4163377 - DNA, 20 bp, Homo sapiens
aagtgaccaaattgggagat

SEQ ID NO: 4163378 - DNA, 20 bp, Homo sapiens
aagtgccactcattcctgta

SEQ ID NO: 4163379 - DNA, 21 bp, Homo sapiens
aagtgccactcattcctgtag

SEQ ID NO: 4163380 - DNA, 16 bp, Homo sapiens
aagtggatggcccagc

SEQ ID NO: 4163381 - DNA, 15 bp, Homo sapiens
aagtggggctctggg

SEQ ID NO: 4163382 - DNA, 14 bp, Homo sapiens
aagtgggggcgggg

SEQ ID NO: 4163383 - DNA, 24 bp, Homo sapiens
aagtgtcatatgtaggtgtctgca

SEQ ID NO: 4163384 - DNA, 13 bp, Homo sapiens
aagttagctcagg

SEQ ID NO: 4163385 - DNA, 16 bp, Homo sapiens
aagttcaacatgttat

SEQ ID NO: 4163386 - DNA, 19 bp, Homo sapiens
aagttcaatctgtttttca

SEQ ID NO: 4163387 - DNA, 13 bp, Homo sapiens
aagttcctgcact

SEQ ID NO: 4163388 - DNA, 20 bp, Homo sapiens
aactagaggtgagaaattta

SEQ ID NO: 4163389 - DNA, 22 bp, Homo sapiens
aactagaggtgagaaatttaaa

SEQ ID NO: 4163390 - DNA, 19 bp, Homo sapiens
aactagtatctctggcctc

SEQ ID NO: 4163391 - DNA, 16 bp, Homo sapiens
aactatattttcttta

SEQ ID NO: 4163392 - DNA, 15 bp, Homo sapiens
aactatgctgaagag

SEQ ID NO: 4163393 - DNA, 12 bp, Homo sapiens
aactattttcag

SEQ ID NO: 4163394 - DNA, 14 bp, Homo sapiens
aactattttcagat

SEQ ID NO: 4163395 - DNA, 17 bp, Homo sapiens
aactcacgatgaaattg

SEQ ID NO: 4163396 - DNA, 16 bp, Homo sapiens
aactcagacattccaa

SEQ ID NO: 4163397 - DNA, 15 bp, Homo sapiens
aactcctgccattct

SEQ ID NO: 4163398 - DNA, 13 bp, Homo sapiens
aactcgaggagct

SEQ ID NO: 4163399 - DNA, 19 bp, Homo sapiens
aactcgtatagcatgcatc

SEQ ID NO: 4163400 - DNA, 18 bp, Homo sapiens
aactctacaccctctgcc

SEQ ID NO: 4163401 - DNA, 22 bp, Homo sapiens
aactctacaccctctgccccag

SEQ ID NO: 4163402 - DNA, 15 bp, Homo sapiens
aactctccactccat

SEQ ID NO: 4163403 - DNA, 14 bp, Homo sapiens
aactctgccagcca

SEQ ID NO: 4163404 - DNA, 20 bp, Homo sapiens
aactctggcttccaggtatc

SEQ ID NO: 4163405 - DNA, 23 bp, Homo sapiens
aactcttcactcttcaaatgcct

SEQ ID NO: 4163406 - DNA, 15 bp, Homo sapiens
aactcttctccaagt

SEQ ID NO: 4163407 - DNA, 21 bp, Homo sapiens
aactcttctggaaaccaaata

SEQ ID NO: 4163408 - DNA, 17 bp, Homo sapiens
aactcttggcctctgct

SEQ ID NO: 4163409 - DNA, 16 bp, Homo sapiens
aactgaataggaaaat

SEQ ID NO: 4163410 - DNA, 23 bp, Homo sapiens
aactgaataggaaaatgtacata

SEQ ID NO: 4163411 - DNA, 20 bp, Homo sapiens
aactgaatgtttattccttg

SEQ ID NO: 4163412 - DNA, 23 bp, Homo sapiens
aactgagagcagatggtcctcca

SEQ ID NO: 4163413 - DNA, 14 bp, Homo sapiens
aactgcagaaagcc

SEQ ID NO: 4163414 - DNA, 22 bp, Homo sapiens
aactggcaggcaggctcccagg

SEQ ID NO: 4163415 - DNA, 18 bp, Homo sapiens
aactggctcctttgcctc

SEQ ID NO: 4163416 - DNA, 20 bp, Homo sapiens
aactggctcctttgcctctg

SEQ ID NO: 4163417 - DNA, 23 bp, Homo sapiens
aactggctcctttgcctctgcta

SEQ ID NO: 4163418 - DNA, 19 bp, Homo sapiens
aactggttcaagagacact

SEQ ID NO: 4163419 - DNA, 16 bp, Homo sapiens
aactgtacaaatgaaa

SEQ ID NO: 4163420 - DNA, 14 bp, Homo sapiens
aactgtatgtcaga

SEQ ID NO: 4163421 - DNA, 14 bp, Homo sapiens
aactgtgtgaacgc

SEQ ID NO: 4163422 - DNA, 17 bp, Homo sapiens
aactgtgttcattagaa

SEQ ID NO: 4163423 - DNA, 14 bp, Homo sapiens
aactgttacaactt

SEQ ID NO: 4163424 - DNA, 14 bp, Homo sapiens
aactgttggaagtt

SEQ ID NO: 4163425 - DNA, 16 bp, Homo sapiens
aacttaacatatttac

SEQ ID NO: 4163426 - DNA, 20 bp, Homo sapiens
aacttaacatggaagatatt

SEQ ID NO: 4163427 - DNA, 18 bp, Homo sapiens
aacttagaataaaattgt

SEQ ID NO: 4163428 - DNA, 19 bp, Homo sapiens
aacttagaataaaattgta

SEQ ID NO: 4163429 - DNA, 21 bp, Homo sapiens
aacttagaataaaattgtaaa

SEQ ID NO: 4163430 - DNA, 18 bp, Homo sapiens
aacttaggatggctagga

SEQ ID NO: 4163431 - DNA, 20 bp, Homo sapiens
aacttatatactatttccct

SEQ ID NO: 4163432 - DNA, 19 bp, Homo sapiens
aacttatttgagtgattat

SEQ ID NO: 4163433 - DNA, 18 bp, Homo sapiens
aacttcagaaggcctcac

SEQ ID NO: 4163434 - DNA, 15 bp, Homo sapiens
aacttcataaatgtt

SEQ ID NO: 4163435 - DNA, 12 bp, Homo sapiens
aacttctttgaa

SEQ ID NO: 4163436 - DNA, 17 bp, Homo sapiens
aacttctttgaagttat

SEQ ID NO: 4163437 - DNA, 15 bp, Homo sapiens
aacttgaccctgagc

SEQ ID NO: 4163438 - DNA, 13 bp, Homo sapiens
aacttgaggacac

SEQ ID NO: 4163439 - DNA, 14 bp, Homo sapiens
aacttgaggacaca

SEQ ID NO: 4163440 - DNA, 16 bp, Homo sapiens
aacttgaggacacatg

SEQ ID NO: 4163441 - DNA, 20 bp, Homo sapiens
aacttgaggacacatgtcca

SEQ ID NO: 4163442 - DNA, 16 bp, Homo sapiens
aacttgagggtaataa

SEQ ID NO: 4163443 - DNA, 17 bp, Homo sapiens
aacttggaaaaagaaag

SEQ ID NO: 4163444 - DNA, 22 bp, Homo sapiens
aacttggaaaaagaaagaaaca

SEQ ID NO: 4163445 - DNA, 16 bp, Homo sapiens
aacttggtcagagcca

SEQ ID NO: 4163446 - DNA, 23 bp, Homo sapiens
aacttggtcagagccactctatg

SEQ ID NO: 4163447 - DNA, 14 bp, Homo sapiens
aacttgtatttcca

SEQ ID NO: 4163448 - DNA, 22 bp, Homo sapiens
aacttgttttgacttgaataaa

SEQ ID NO: 4163449 - DNA, 19 bp, Homo sapiens
aactttcggagcctgcctc

SEQ ID NO: 4163450 - DNA, 11 bp, Homo sapiens
aactttctgta

SEQ ID NO: 4163451 - DNA, 18 bp, Homo sapiens
aactttgtgccagcgctg

SEQ ID NO: 4163452 - DNA, 14 bp, Homo sapiens
aagaaaactaacaa

SEQ ID NO: 4163453 - DNA, 20 bp, Homo sapiens
aagaaaactaacaaccaacc

SEQ ID NO: 4163454 - DNA, 19 bp, Homo sapiens
aagaaaagcactttttaaa

SEQ ID NO: 4163455 - DNA, 14 bp, Homo sapiens
aagaaacactcaac

SEQ ID NO: 4163456 - DNA, 11 bp, Homo sapiens
aagaaacagaa

SEQ ID NO: 4163457 - DNA, 15 bp, Homo sapiens
aagaaacctactgcc

SEQ ID NO: 4163458 - DNA, 16 bp, Homo sapiens
aagaaacctactgccc

SEQ ID NO: 4163459 - DNA, 18 bp, Homo sapiens
aagaaactcacgatgaaa

SEQ ID NO: 4163460 - DNA, 14 bp, Homo sapiens
aagaaactttttta

SEQ ID NO: 4163461 - DNA, 14 bp, Homo sapiens
aagaaagaaacact

SEQ ID NO: 4163462 - DNA, 15 bp, Homo sapiens
aagaaataatttttc

SEQ ID NO: 4163463 - DNA, 17 bp, Homo sapiens
aagaaatactaatgtaa

SEQ ID NO: 4163464 - DNA, 20 bp, Homo sapiens
aagaaatcacttaaatacct

SEQ ID NO: 4163465 - DNA, 16 bp, Homo sapiens
aagaaattgtttcttt

SEQ ID NO: 4163466 - DNA, 14 bp, Homo sapiens
aagaacggaagaag

SEQ ID NO: 4163467 - DNA, 18 bp, Homo sapiens
aagaactttgagctactg

SEQ ID NO: 4163468 - DNA, 20 bp, Homo sapiens
aagaactttgagctactgcc

SEQ ID NO: 4163469 - DNA, 16 bp, Homo sapiens
aagaagaaagcaaaag

SEQ ID NO: 4163470 - DNA, 15 bp, Homo sapiens
aagaagaagaagaag

SEQ ID NO: 4163471 - DNA, 13 bp, Homo sapiens
aagaagaagaagg

SEQ ID NO: 4163472 - DNA, 15 bp, Homo sapiens
aagaagaaggagagc

SEQ ID NO: 4163473 - DNA, 13 bp, Homo sapiens
aagaagaggagga

SEQ ID NO: 4163474 - DNA, 15 bp, Homo sapiens
aagaagaggaggaag

SEQ ID NO: 4163475 - DNA, 16 bp, Homo sapiens
aagaaggacacttgta

SEQ ID NO: 4163476 - DNA, 19 bp, Homo sapiens
aagaaggcaaaaatagttt

SEQ ID NO: 4163477 - DNA, 14 bp, Homo sapiens
aagaagtaaaagca

SEQ ID NO: 4163478 - DNA, 22 bp, Homo sapiens
aagaagtaaaagcaaaaaagaa

SEQ ID NO: 4163479 - DNA, 14 bp, Homo sapiens
aagaagtaaaagct

SEQ ID NO: 4163480 - DNA, 18 bp, Homo sapiens
aagaagtttcatcatttt

SEQ ID NO: 4163481 - DNA, 17 bp, Homo sapiens
aagaatacttctcattt

SEQ ID NO: 4163482 - DNA, 16 bp, Homo sapiens
aagaatattcaaatgt

SEQ ID NO: 4163483 - DNA, 22 bp, Homo sapiens
aagaatcattgtgcttaataat

SEQ ID NO: 4163484 - DNA, 20 bp, Homo sapiens
aagaatcttggtttgccttc

SEQ ID NO: 4163485 - DNA, 21 bp, Homo sapiens
aagaatcttggtttgccttcc

SEQ ID NO: 4163486 - DNA, 19 bp, Homo sapiens
aagaatgggctgcagaaga

SEQ ID NO: 4163487 - DNA, 17 bp, Homo sapiens
aagacactagttcagag

SEQ ID NO: 4163488 - DNA, 14 bp, Homo sapiens
aagacagtgtgtgt

SEQ ID NO: 4163489 - DNA, 23 bp, Homo sapiens
aagacatggaagattagaggttt

SEQ ID NO: 4163490 - DNA, 23 bp, Homo sapiens
aagacatggaaggttagaggttt

SEQ ID NO: 4163491 - DNA, 20 bp, Homo sapiens
aagaccaagtcctcaaagca

SEQ ID NO: 4163492 - DNA, 21 bp, Homo sapiens
aagactattaagagcaataaa

SEQ ID NO: 4163493 - DNA, 17 bp, Homo sapiens
aagactcattccctaga

SEQ ID NO: 4163494 - DNA, 16 bp, Homo sapiens
aagacttggcaacaga

SEQ ID NO: 4163495 - DNA, 12 bp, Homo sapiens
aagagaaatttt

SEQ ID NO: 4163496 - DNA, 13 bp, Homo sapiens
aagagaagtagaa

SEQ ID NO: 4163497 - DNA, 15 bp, Homo sapiens
aagagactctggcct

SEQ ID NO: 4163498 - DNA, 15 bp, Homo sapiens
aagagagaaacattt

SEQ ID NO: 4163499 - DNA, 16 bp, Homo sapiens
aagagaggcacctgct

SEQ ID NO: 4163500 - DNA, 17 bp, Homo sapiens
aagagaggcacctgctg

SEQ ID NO: 4163501 - DNA, 17 bp, Homo sapiens
aagagagtaccatgctg

SEQ ID NO: 4163502 - DNA, 16 bp, Homo sapiens
aagagatttcaacata

SEQ ID NO: 4163503 - DNA, 13 bp, Homo sapiens
aagagcctggaga

SEQ ID NO: 4163504 - DNA, 16 bp, Homo sapiens
aagagcctggagaagc

SEQ ID NO: 4163505 - DNA, 17 bp, Homo sapiens
aagagcctggagaagct

SEQ ID NO: 4163506 - DNA, 21 bp, Homo sapiens
aagagcctggagaagctgatg

SEQ ID NO: 4163507 - DNA, 16 bp, Homo sapiens
aagagctacataattt

SEQ ID NO: 4163508 - DNA, 21 bp, Homo sapiens
aagaggagtttcgaggtagag

SEQ ID NO: 4163509 - DNA, 17 bp, Homo sapiens
aagaggcaagagacaga

SEQ ID NO: 4163510 - DNA, 19 bp, Homo sapiens
aagagggagttggctggat

SEQ ID NO: 4163511 - DNA, 21 bp, Homo sapiens
aagaggttagaaatacttttc

SEQ ID NO: 4163512 - DNA, 14 bp, Homo sapiens
aagagtcagccctt

SEQ ID NO: 4163513 - DNA, 14 bp, Homo sapiens
aagagtgcattttc

SEQ ID NO: 4163514 - DNA, 14 bp, Homo sapiens
aagagttcaagaaa

SEQ ID NO: 4163515 - DNA, 16 bp, Homo sapiens
aagagttcaagaaata

SEQ ID NO: 4163516 - DNA, 21 bp, Homo sapiens
aagataacaagatctttcagg

SEQ ID NO: 4163517 - DNA, 18 bp, Homo sapiens
aagataacccttattcca

SEQ ID NO: 4163518 - DNA, 20 bp, Homo sapiens
aagataatggataatcttcg

SEQ ID NO: 4163519 - DNA, 23 bp, Homo sapiens
aagataatgttatacatcctatt

SEQ ID NO: 4163520 - DNA, 16 bp, Homo sapiens
aagataattttatgtg

SEQ ID NO: 4163521 - DNA, 17 bp, Homo sapiens
aagatacttaagtgctg

SEQ ID NO: 4163522 - DNA, 14 bp, Homo sapiens
aagatagaacaggc

SEQ ID NO: 4163523 - DNA, 18 bp, Homo sapiens
aagatagaacaggctggt

SEQ ID NO: 4163524 - DNA, 13 bp, Homo sapiens
aagatattccttt

SEQ ID NO: 4163525 - DNA, 20 bp, Homo sapiens
aagatattcctttttaactt

SEQ ID NO: 4163526 - DNA, 12 bp, Homo sapiens
aagatctgaaag

SEQ ID NO: 4163527 - DNA, 12 bp, Homo sapiens
aagatgctttta

SEQ ID NO: 4163528 - DNA, 15 bp, Homo sapiens
aaatctctaatatgg

SEQ ID NO: 4163529 - DNA, 23 bp, Homo sapiens
aaatctgagatctccctccaggg

SEQ ID NO: 4163530 - DNA, 14 bp, Homo sapiens
aaatctggcttctg

SEQ ID NO: 4163531 - DNA, 18 bp, Homo sapiens
aaatctggcttctggcca

SEQ ID NO: 4163532 - DNA, 18 bp, Homo sapiens
aaatcttttataggattt

SEQ ID NO: 4163533 - DNA, 16 bp, Homo sapiens
aaatgaggacatgttt

SEQ ID NO: 4163534 - DNA, 13 bp, Homo sapiens
aaatgatctaaac

SEQ ID NO: 4163535 - DNA, 14 bp, Homo sapiens
aaatgcctcttaaa

SEQ ID NO: 4163536 - DNA, 17 bp, Homo sapiens
aaatgcctcttaaatta

SEQ ID NO: 4163537 - DNA, 22 bp, Homo sapiens
aaatgcctcttaaattatatat

SEQ ID NO: 4163538 - DNA, 21 bp, Homo sapiens
aaatgccttttcccaaaatgt

SEQ ID NO: 4163539 - DNA, 17 bp, Homo sapiens
aaatggggcttgccctg

SEQ ID NO: 4163540 - DNA, 18 bp, Homo sapiens
aaatggtatcatttggaa

SEQ ID NO: 4163541 - DNA, 12 bp, Homo sapiens
aaatgtaataat

SEQ ID NO: 4163542 - DNA, 15 bp, Homo sapiens
aaatgtccaaaatgt

SEQ ID NO: 4163543 - DNA, 21 bp, Homo sapiens
aaatgtgtgttgtaacaaata

SEQ ID NO: 4163544 - DNA, 15 bp, Homo sapiens
aaatgttcaaactgt

SEQ ID NO: 4163545 - DNA, 19 bp, Homo sapiens
aaattaccagagttgttct

SEQ ID NO: 4163546 - DNA, 16 bp, Homo sapiens
aaattataagatgtca

SEQ ID NO: 4163547 - DNA, 14 bp, Homo sapiens
aaattatacataat

SEQ ID NO: 4163548 - DNA, 20 bp, Homo sapiens
aaattatacataataaagtg

SEQ ID NO: 4163549 - DNA, 20 bp, Homo sapiens
aaattatgagatgatgaaaa

SEQ ID NO: 4163550 - DNA, 15 bp, Homo sapiens
aaattatttaataaa

SEQ ID NO: 4163551 - DNA, 16 bp, Homo sapiens
aaattatttgtgtaat

SEQ ID NO: 4163552 - DNA, 22 bp, Homo sapiens
aaattatttgtgtaatagaaaa

SEQ ID NO: 4163553 - DNA, 16 bp, Homo sapiens
aaattattttaaacaa

SEQ ID NO: 4163554 - DNA, 17 bp, Homo sapiens
aaattattttaaacaaa

SEQ ID NO: 4163555 - DNA, 19 bp, Homo sapiens
aaattatttttaagaaatc

SEQ ID NO: 4163556 - DNA, 19 bp, Homo sapiens
aaattccatgtccctgtat

SEQ ID NO: 4163557 - DNA, 14 bp, Homo sapiens
aaattctagaagca

SEQ ID NO: 4163558 - DNA, 23 bp, Homo sapiens
aaattgaagagatttcaacatat

SEQ ID NO: 4163559 - DNA, 15 bp, Homo sapiens
aaattgatgcactac

SEQ ID NO: 4163560 - DNA, 14 bp, Homo sapiens
aaatttaataaaaa

SEQ ID NO: 4163561 - DNA, 18 bp, Homo sapiens
aaattttctagactttct

SEQ ID NO: 4163562 - DNA, 20 bp, Homo sapiens
aaattttctagactttctgt

SEQ ID NO: 4163563 - DNA, 20 bp, Homo sapiens
aaattttttgatgtcagcct

SEQ ID NO: 4163564 - DNA, 20 bp, Homo sapiens
aacaaaacaacaacaataca

SEQ ID NO: 4163565 - DNA, 12 bp, Homo sapiens
aacaaaatagaa

SEQ ID NO: 4163566 - DNA, 20 bp, Homo sapiens
aacaaactcgttttttacaa

SEQ ID NO: 4163567 - DNA, 17 bp, Homo sapiens
aacaaagagttcaagaa

SEQ ID NO: 4163568 - DNA, 14 bp, Homo sapiens
aacaaagattgaga

SEQ ID NO: 4163569 - DNA, 20 bp, Homo sapiens
aacaaagtctgggaaattct

SEQ ID NO: 4163570 - DNA, 15 bp, Homo sapiens
aacaacaaaccaaaa

SEQ ID NO: 4163571 - DNA, 15 bp, Homo sapiens
aacaacaacaacaat

SEQ ID NO: 4163572 - DNA, 12 bp, Homo sapiens
aacaacaacaat

SEQ ID NO: 4163573 - DNA, 15 bp, Homo sapiens
aacaacaacaataac

SEQ ID NO: 4163574 - DNA, 12 bp, Homo sapiens
aacaacaataac

SEQ ID NO: 4163575 - DNA, 23 bp, Homo sapiens
aacaacaatggtttacatgaaca

SEQ ID NO: 4163576 - DNA, 16 bp, Homo sapiens
aacaactaggcttcag

SEQ ID NO: 4163577 - DNA, 12 bp, Homo sapiens
aacaagtatttg

SEQ ID NO: 4163578 - DNA, 20 bp, Homo sapiens
aacaagtatttgttaattta

SEQ ID NO: 4163579 - DNA, 15 bp, Homo sapiens
aacaataatatttca

SEQ ID NO: 4163580 - DNA, 20 bp, Homo sapiens
aacaataatatttcaagtgc

SEQ ID NO: 4163581 - DNA, 15 bp, Homo sapiens
aacaatctaacaata

SEQ ID NO: 4163582 - DNA, 12 bp, Homo sapiens
aacaatggagat

SEQ ID NO: 4163583 - DNA, 21 bp, Homo sapiens
aacaatggtttacatgaacac

SEQ ID NO: 4163584 - DNA, 12 bp, Homo sapiens
aacaattctaaa

SEQ ID NO: 4163585 - DNA, 11 bp, Homo sapiens
aacacaaagac

SEQ ID NO: 4163586 - DNA, 20 bp, Homo sapiens
aacacaaagacacaggaaga

SEQ ID NO: 4163587 - DNA, 15 bp, Homo sapiens
aacacaagctggaag

SEQ ID NO: 4163588 - DNA, 18 bp, Homo sapiens
aacacaagctggaagcac

SEQ ID NO: 4163589 - DNA, 21 bp, Homo sapiens
aacacagagctggcgactgca

SEQ ID NO: 4163590 - DNA, 17 bp, Homo sapiens
aacacagctgctgaaga

SEQ ID NO: 4163591 - DNA, 21 bp, Homo sapiens
aacacctttgttttgcactga

SEQ ID NO: 4163592 - DNA, 14 bp, Homo sapiens
aacacgcattgtac

SEQ ID NO: 4163593 - DNA, 12 bp, Homo sapiens
aacactcaccat

SEQ ID NO: 4163594 - DNA, 20 bp, Homo sapiens
aacactccaccccctccagc

SEQ ID NO: 4163595 - DNA, 17 bp, Homo sapiens
aacacttaggaagaaat

SEQ ID NO: 4163596 - DNA, 18 bp, Homo sapiens
aacacttaggaagaaatc

SEQ ID NO: 4163597 - DNA, 17 bp, Homo sapiens
aacacttatcttctgga

SEQ ID NO: 4163598 - DNA, 18 bp, Homo sapiens
aacacttatcttctggat

SEQ ID NO: 4163599 - DNA, 18 bp, Homo sapiens
aacagaacatagacagaa

SEQ ID NO: 4163600 - DNA, 19 bp, Homo sapiens
aacagaaggtatacctggg

SEQ ID NO: 4163601 - DNA, 13 bp, Homo sapiens
aacagaattttaa

SEQ ID NO: 4163602 - DNA, 19 bp, Homo sapiens
aacagacaccatcttttgt

SEQ ID NO: 4163603 - DNA, 17 bp, Homo sapiens
aacagactatttaactt

SEQ ID NO: 4163604 - DNA, 21 bp, Homo sapiens
aacagagagaaccaggagggt

SEQ ID NO: 4163605 - DNA, 19 bp, Homo sapiens
aacagagtgagaccctgtc

SEQ ID NO: 4163606 - DNA, 13 bp, Homo sapiens
aacagataaagtt

SEQ ID NO: 4163607 - DNA, 17 bp, Homo sapiens
aacagatggtagagaga

SEQ ID NO: 4163608 - DNA, 18 bp, Homo sapiens
aacagatggtagagagag

SEQ ID NO: 4163609 - DNA, 22 bp, Homo sapiens
aacagccaaataaaacctcagg

SEQ ID NO: 4163610 - DNA, 16 bp, Homo sapiens
aacagccaacaggtgg

SEQ ID NO: 4163611 - DNA, 19 bp, Homo sapiens
aacagccccccccttgaat

SEQ ID NO: 4163612 - DNA, 16 bp, Homo sapiens
aacaggtggcaggacc

SEQ ID NO: 4163613 - DNA, 16 bp, Homo sapiens
aacagttagctggagc

SEQ ID NO: 4163614 - DNA, 19 bp, Homo sapiens
aacagttgggctgtcaaca

SEQ ID NO: 4163615 - DNA, 14 bp, Homo sapiens
aacataaaaatgat

SEQ ID NO: 4163616 - DNA, 21 bp, Homo sapiens
aacatagacagaagaaacaag

SEQ ID NO: 4163617 - DNA, 15 bp, Homo sapiens
aacatatatatacta

SEQ ID NO: 4163618 - DNA, 16 bp, Homo sapiens
aacatatctttatctt

SEQ ID NO: 4163619 - DNA, 23 bp, Homo sapiens
aacatgaaaaacacggcagctgt

SEQ ID NO: 4163620 - DNA, 14 bp, Homo sapiens
aacatgatgtgaga

SEQ ID NO: 4163621 - DNA, 22 bp, Homo sapiens
aacatgcaattggggaagaaaa

SEQ ID NO: 4163622 - DNA, 19 bp, Homo sapiens
aacatggaagatattcctt

SEQ ID NO: 4163623 - DNA, 20 bp, Homo sapiens
aacatggaatttaatttatg

SEQ ID NO: 4163624 - DNA, 21 bp, Homo sapiens
aacatggaatttaatttatgt

SEQ ID NO: 4163625 - DNA, 20 bp, Homo sapiens
aacatgttatttgtaataga

SEQ ID NO: 4163626 - DNA, 15 bp, Homo sapiens
aacattcacagccca

SEQ ID NO: 4163627 - DNA, 16 bp, Homo sapiens
aacatttacatcaaat

SEQ ID NO: 4163628 - DNA, 15 bp, Homo sapiens
aacatttattttgac

SEQ ID NO: 4163629 - DNA, 22 bp, Homo sapiens
aacatttcctcttataacttct

SEQ ID NO: 4163630 - DNA, 21 bp, Homo sapiens
aacatttgctttgttttctaa

SEQ ID NO: 4163631 - DNA, 16 bp, Homo sapiens
aacatttttggtgtat

SEQ ID NO: 4163632 - DNA, 19 bp, Homo sapiens
aaccaaataggctttagaa

SEQ ID NO: 4163633 - DNA, 20 bp, Homo sapiens
aaccacaagagatcagcagt

SEQ ID NO: 4163634 - DNA, 22 bp, Homo sapiens
aaccacaagagatcagcagtgg

SEQ ID NO: 4163635 - DNA, 14 bp, Homo sapiens
aaccactgaacatt

SEQ ID NO: 4163636 - DNA, 11 bp, Homo sapiens
aaccactttgc

SEQ ID NO: 4163637 - DNA, 22 bp, Homo sapiens
aaccatagcacaggctaatttt

SEQ ID NO: 4163638 - DNA, 22 bp, Homo sapiens
aaccatagttatttacttgaaa

SEQ ID NO: 4163639 - DNA, 17 bp, Homo sapiens
aacccagagtcaggaag

SEQ ID NO: 4163640 - DNA, 13 bp, Homo sapiens
aacccagctctca

SEQ ID NO: 4163641 - DNA, 14 bp, Homo sapiens
aaccccagcatcct

SEQ ID NO: 4163642 - DNA, 17 bp, Homo sapiens
aacccccagtgccacag

SEQ ID NO: 4163643 - DNA, 19 bp, Homo sapiens
aacccccagtgccacagag

SEQ ID NO: 4163644 - DNA, 20 bp, Homo sapiens
aacccccagtgccacagaga

SEQ ID NO: 4163645 - DNA, 14 bp, Homo sapiens
aacccccgctccag

SEQ ID NO: 4163646 - DNA, 16 bp, Homo sapiens
aacccccgctccagat

SEQ ID NO: 4163647 - DNA, 16 bp, Homo sapiens
aaccctctcttcccta

SEQ ID NO: 4163648 - DNA, 16 bp, Homo sapiens
aaccctgttttatact

SEQ ID NO: 4163649 - DNA, 18 bp, Homo sapiens
aaccgcactcacccatgt

SEQ ID NO: 4163650 - DNA, 16 bp, Homo sapiens
aacctatatgatttat

SEQ ID NO: 4163651 - DNA, 20 bp, Homo sapiens
aacctcagggacaacatttt

SEQ ID NO: 4163652 - DNA, 17 bp, Homo sapiens
aacctcatggtcatgga

SEQ ID NO: 4163653 - DNA, 18 bp, Homo sapiens
aacctcccctggtcctgc

SEQ ID NO: 4163654 - DNA, 19 bp, Homo sapiens
aacctcccctggtcctgca

SEQ ID NO: 4163655 - DNA, 11 bp, Homo sapiens
aacctgaaaaa

SEQ ID NO: 4163656 - DNA, 22 bp, Homo sapiens
aacctgcccctccccagccctt

SEQ ID NO: 4163657 - DNA, 19 bp, Homo sapiens
aacctggagatgatgatga

SEQ ID NO: 4163658 - DNA, 16 bp, Homo sapiens
aacctggccagaggca

SEQ ID NO: 4163659 - DNA, 22 bp, Homo sapiens
aacctgggaggcggagagtaca

SEQ ID NO: 4163660 - DNA, 17 bp, Homo sapiens
aacgactccgagaacaa

SEQ ID NO: 4163661 - DNA, 19 bp, Homo sapiens
aacgactccgagaacaaca

SEQ ID NO: 4163662 - DNA, 23 bp, Homo sapiens
aacggaagggttggtgggctggc

SEQ ID NO: 4163663 - DNA, 15 bp, Homo sapiens
aacgtgataaatata

SEQ ID NO: 4163664 - DNA, 20 bp, Homo sapiens
aacgttgacccctttccccc

SEQ ID NO: 4163665 - DNA, 15 bp, Homo sapiens
aacgttgccacacca

SEQ ID NO: 4163666 - DNA, 20 bp, Homo sapiens
aacgtttaagccaaaacaat

SEQ ID NO: 4163667 - DNA, 20 bp, Homo sapiens
atccaaccccccacctgcca

SEQ ID NO: 4163668 - DNA, 17 bp, Homo sapiens
atccaatctgtaatttc

SEQ ID NO: 4163669 - DNA, 17 bp, Homo sapiens
atccacaaagccgtgcc

SEQ ID NO: 4163670 - DNA, 22 bp, Homo sapiens
atccacaaagccgtgcctttct

SEQ ID NO: 4163671 - DNA, 19 bp, Homo sapiens
atccacacacgcaggaact

SEQ ID NO: 4163672 - DNA, 18 bp, Homo sapiens
atccacagtatgttacat

SEQ ID NO: 4163673 - DNA, 23 bp, Homo sapiens
atccacccatgtttattaagaat

SEQ ID NO: 4163674 - DNA, 12 bp, Homo sapiens
atccaccctgca

SEQ ID NO: 4163675 - DNA, 20 bp, Homo sapiens
atccagcacaactcagtctg

SEQ ID NO: 4163676 - DNA, 21 bp, Homo sapiens
atccagcacaactcagtctgt

SEQ ID NO: 4163677 - DNA, 15 bp, Homo sapiens
atccagtaagcacat

SEQ ID NO: 4163678 - DNA, 17 bp, Homo sapiens
atccatttggacaaaat

SEQ ID NO: 4163679 - DNA, 20 bp, Homo sapiens
atcccaacacttttgggagg

SEQ ID NO: 4163680 - DNA, 18 bp, Homo sapiens
atcccaagcgtcccgtcc

SEQ ID NO: 4163681 - DNA, 13 bp, Homo sapiens
atcccagaaatta

SEQ ID NO: 4163682 - DNA, 17 bp, Homo sapiens
atcccagaaattagaaa

SEQ ID NO: 4163683 - DNA, 21 bp, Homo sapiens
atcccagctacccaggaggct

SEQ ID NO: 4163684 - DNA, 19 bp, Homo sapiens
atcccagcttgctgagggg

SEQ ID NO: 4163685 - DNA, 18 bp, Homo sapiens
atccccaagctggcagct

SEQ ID NO: 4163686 - DNA, 14 bp, Homo sapiens
atcccctttcctcc

SEQ ID NO: 4163687 - DNA, 22 bp, Homo sapiens
atcccgcctcttcttcttcaga

SEQ ID NO: 4163688 - DNA, 17 bp, Homo sapiens
atccctctcctctcctc

SEQ ID NO: 4163689 - DNA, 21 bp, Homo sapiens
atcccttaatatcctaaacat

SEQ ID NO: 4163690 - DNA, 18 bp, Homo sapiens
atccgactctaagctgtg

SEQ ID NO: 4163691 - DNA, 23 bp, Homo sapiens
atccgcctgcagaggacagagct

SEQ ID NO: 4163692 - DNA, 16 bp, Homo sapiens
atccggctgctcctcc

SEQ ID NO: 4163693 - DNA, 22 bp, Homo sapiens
atccggctgctcctccagccct

SEQ ID NO: 4163694 - DNA, 23 bp, Homo sapiens
atcctattttgtaatttttttga

SEQ ID NO: 4163695 - DNA, 14 bp, Homo sapiens
atcctcaacaacaa

SEQ ID NO: 4163696 - DNA, 20 bp, Homo sapiens
atcctcaacaacaaaccaaa

SEQ ID NO: 4163697 - DNA, 22 bp, Homo sapiens
atcctcaggtagtactgggaat

SEQ ID NO: 4163698 - DNA, 15 bp, Homo sapiens
atcctcatttgcaaa

SEQ ID NO: 4163699 - DNA, 22 bp, Homo sapiens
atcctcatttgcaaacctcaga

SEQ ID NO: 4163700 - DNA, 13 bp, Homo sapiens
atcctgaaaaaat

SEQ ID NO: 4163701 - DNA, 18 bp, Homo sapiens
atcctgaagaaaccacag

SEQ ID NO: 4163702 - DNA, 14 bp, Homo sapiens
atcctgctgccaga

SEQ ID NO: 4163703 - DNA, 12 bp, Homo sapiens
atcctgcttgat

SEQ ID NO: 4163704 - DNA, 18 bp, Homo sapiens
atcctgtattcagacaga

SEQ ID NO: 4163705 - DNA, 13 bp, Homo sapiens
atccttctgcctt

SEQ ID NO: 4163706 - DNA, 20 bp, Homo sapiens
atccttcttatgtttgcttt

SEQ ID NO: 4163707 - DNA, 15 bp, Homo sapiens
atccttggagagcag

SEQ ID NO: 4163708 - DNA, 20 bp, Homo sapiens
atccttggagagcagctggc

SEQ ID NO: 4163709 - DNA, 18 bp, Homo sapiens
atcctttttctttataaa

SEQ ID NO: 4163710 - DNA, 19 bp, Homo sapiens
atcgagtctacctcttcag

SEQ ID NO: 4163711 - DNA, 19 bp, Homo sapiens
atcgcttgaaccggggagg

SEQ ID NO: 4163712 - DNA, 17 bp, Homo sapiens
atcggggcactgcaggg

SEQ ID NO: 4163713 - DNA, 18 bp, Homo sapiens
atcgtctcctttgacatt

SEQ ID NO: 4163714 - DNA, 19 bp, Homo sapiens
atctaacaataatatttca

SEQ ID NO: 4163715 - DNA, 14 bp, Homo sapiens
atctaatattaaaa

SEQ ID NO: 4163716 - DNA, 13 bp, Homo sapiens
atctagagatttt

SEQ ID NO: 4163717 - DNA, 23 bp, Homo sapiens
atctagataggtaagtgggggcg

SEQ ID NO: 4163718 - DNA, 18 bp, Homo sapiens
atctaggcaacatagtat

SEQ ID NO: 4163719 - DNA, 22 bp, Homo sapiens
atctatcttttccacaaatatg

SEQ ID NO: 4163720 - DNA, 14 bp, Homo sapiens
atctcaaatccact

SEQ ID NO: 4163721 - DNA, 22 bp, Homo sapiens
atctcaatcttcggggtgtgat

SEQ ID NO: 4163722 - DNA, 14 bp, Homo sapiens
atctcactttgccc

SEQ ID NO: 4163723 - DNA, 15 bp, Homo sapiens
atctcagtgaagaat

SEQ ID NO: 4163724 - DNA, 20 bp, Homo sapiens
atctcagtgaagaatacttc

SEQ ID NO: 4163725 - DNA, 17 bp, Homo sapiens
atctcataggttgccaa

SEQ ID NO: 4163726 - DNA, 20 bp, Homo sapiens
atctcatctcagtgaagaat

SEQ ID NO: 4163727 - DNA, 22 bp, Homo sapiens
atctcattcaggtgttctcttc

SEQ ID NO: 4163728 - DNA, 20 bp, Homo sapiens
atctcattgaaaaaaatata

SEQ ID NO: 4163729 - DNA, 20 bp, Homo sapiens
atctccaggattgaagagca

SEQ ID NO: 4163730 - DNA, 20 bp, Homo sapiens
atctccagggctgcccctgt

SEQ ID NO: 4163731 - DNA, 15 bp, Homo sapiens
atctccagtattctt

SEQ ID NO: 4163732 - DNA, 23 bp, Homo sapiens
atctccccttgcactaaagtatg

SEQ ID NO: 4163733 - DNA, 20 bp, Homo sapiens
atctcctcccatggccttcc

SEQ ID NO: 4163734 - DNA, 15 bp, Homo sapiens
atctctaatatggca

SEQ ID NO: 4163735 - DNA, 22 bp, Homo sapiens
atctctaatatggcaaaaatgg

SEQ ID NO: 4163736 - DNA, 14 bp, Homo sapiens
atctctgaaacata

SEQ ID NO: 4163737 - DNA, 18 bp, Homo sapiens
atctctgaaacatattta

SEQ ID NO: 4163738 - DNA, 12 bp, Homo sapiens
atctgaattttt

SEQ ID NO: 4163739 - DNA, 19 bp, Homo sapiens
atctgaatttttaaacaag

SEQ ID NO: 4163740 - DNA, 19 bp, Homo sapiens
atctgagatctccctccag

SEQ ID NO: 4163741 - DNA, 14 bp, Homo sapiens
atctgcactgggtg

SEQ ID NO: 4163742 - DNA, 12 bp, Homo sapiens
atctgcagggag

SEQ ID NO: 4163743 - DNA, 14 bp, Homo sapiens
atctgcagggagca

SEQ ID NO: 4163744 - DNA, 12 bp, Homo sapiens
atctgcttcagt

SEQ ID NO: 4163745 - DNA, 14 bp, Homo sapiens
atctgcttcagtgg

SEQ ID NO: 4163746 - DNA, 23 bp, Homo sapiens
atctggcttagtgccacccacct

SEQ ID NO: 4163747 - DNA, 12 bp, Homo sapiens
atctggcttctg

SEQ ID NO: 4163748 - DNA, 20 bp, Homo sapiens
atctggcttctggccaggaa

SEQ ID NO: 4163749 - DNA, 23 bp, Homo sapiens
atctggcttttcgcttgcttctg

SEQ ID NO: 4163750 - DNA, 14 bp, Homo sapiens
atctgggactttca

SEQ ID NO: 4163751 - DNA, 23 bp, Homo sapiens
atctgggtaagaagaaagcaaaa

SEQ ID NO: 4163752 - DNA, 23 bp, Homo sapiens
atctggtttttaaaagataaaca

SEQ ID NO: 4163753 - DNA, 13 bp, Homo sapiens
atctgtaatttca

SEQ ID NO: 4163754 - DNA, 15 bp, Homo sapiens
atctgtaatttcact

SEQ ID NO: 4163755 - DNA, 21 bp, Homo sapiens
atctgtagtaatttattgtct

SEQ ID NO: 4163756 - DNA, 22 bp, Homo sapiens
atctgtagtaatttattgtctg

SEQ ID NO: 4163757 - DNA, 17 bp, Homo sapiens
atctgtgtgaaaatggg

SEQ ID NO: 4163758 - DNA, 14 bp, Homo sapiens
atcttcagagcagg

SEQ ID NO: 4163759 - DNA, 18 bp, Homo sapiens
atcttcagagcaggggtc

SEQ ID NO: 4163760 - DNA, 23 bp, Homo sapiens
atcttccgtggtcagagtgccac

SEQ ID NO: 4163761 - DNA, 21 bp, Homo sapiens
atcttcctagtgggccacccc

SEQ ID NO: 4163762 - DNA, 15 bp, Homo sapiens
atcttcggggtgtga

SEQ ID NO: 4163763 - DNA, 19 bp, Homo sapiens
atcttcggggtgtgatgaa

SEQ ID NO: 4163764 - DNA, 14 bp, Homo sapiens
atcttcgtcctgcc

SEQ ID NO: 4163765 - DNA, 14 bp, Homo sapiens
atcttgacatgtaa

SEQ ID NO: 4163766 - DNA, 20 bp, Homo sapiens
atcttggttgatgccaaaaa

SEQ ID NO: 4163767 - DNA, 14 bp, Homo sapiens
atcttggtttgcct

SEQ ID NO: 4163768 - DNA, 16 bp, Homo sapiens
atctttgattcagaca

SEQ ID NO: 4163769 - DNA, 17 bp, Homo sapiens
atcttttccacaaatat

SEQ ID NO: 4163770 - DNA, 17 bp, Homo sapiens
atcttttgaaacagatt

SEQ ID NO: 4163771 - DNA, 14 bp, Homo sapiens
atcttttgtgagat

SEQ ID NO: 4163772 - DNA, 23 bp, Homo sapiens
atcttttgtgagatgtaattgtt

SEQ ID NO: 4163773 - DNA, 20 bp, Homo sapiens
atgaaaaacacggcagctgt

SEQ ID NO: 4163774 - DNA, 16 bp, Homo sapiens
atgaaaaagaagaatc

SEQ ID NO: 4163775 - DNA, 17 bp, Homo sapiens
atgaaaaagaagaatct

SEQ ID NO: 4163776 - DNA, 23 bp, Homo sapiens
atgaaaattatctcccttagtaa

SEQ ID NO: 4163777 - DNA, 12 bp, Homo sapiens
atgaaacattca

SEQ ID NO: 4163778 - DNA, 13 bp, Homo sapiens
atgaaagaggagg

SEQ ID NO: 4163779 - DNA, 12 bp, Homo sapiens
atgaaagcatgt

SEQ ID NO: 4163780 - DNA, 23 bp, Homo sapiens
atgaaattgtctagcagagcagg

SEQ ID NO: 4163781 - DNA, 23 bp, Homo sapiens
atgaaattttctagactttctgt

SEQ ID NO: 4163782 - DNA, 20 bp, Homo sapiens
atgaacacagctgctgaaga

SEQ ID NO: 4163783 - DNA, 21 bp, Homo sapiens
atgaacagaacatagacagaa

SEQ ID NO: 4163784 - DNA, 17 bp, Homo sapiens
atgaacttgaggacaca

SEQ ID NO: 4163785 - DNA, 20 bp, Homo sapiens
atgaacttgaggacacatgt

SEQ ID NO: 4163786 - DNA, 21 bp, Homo sapiens
atgaacttgaggacacatgtc

SEQ ID NO: 4163787 - DNA, 22 bp, Homo sapiens
atgaacttgaggacacatgtcc

SEQ ID NO: 4163788 - DNA, 22 bp, Homo sapiens
atgaagctttggccctcagtgg

SEQ ID NO: 4163789 - DNA, 15 bp, Homo sapiens
atgaagtgttagata

SEQ ID NO: 4163790 - DNA, 22 bp, Homo sapiens
atgaatgataagcaggaaggat

SEQ ID NO: 4163791 - DNA, 15 bp, Homo sapiens
atgaatgcacactag

SEQ ID NO: 4163792 - DNA, 13 bp, Homo sapiens
atgaattgtattt

SEQ ID NO: 4163793 - DNA, 15 bp, Homo sapiens
atgaatttggagact

SEQ ID NO: 4163794 - DNA, 19 bp, Homo sapiens
atgacaacagaagcttcag

SEQ ID NO: 4163795 - DNA, 20 bp, Homo sapiens
atgacctgcagtcagggccc

SEQ ID NO: 4163796 - DNA, 17 bp, Homo sapiens
atgactgtgattttcag

SEQ ID NO: 4163797 - DNA, 14 bp, Homo sapiens
atgagaaaatggct

SEQ ID NO: 4163798 - DNA, 15 bp, Homo sapiens
atgagaaagccttct

SEQ ID NO: 4163799 - DNA, 19 bp, Homo sapiens
atgagatcccgcctcttct

SEQ ID NO: 4163800 - DNA, 17 bp, Homo sapiens
atgagcgtcctaaggca

SEQ ID NO: 4163801 - DNA, 17 bp, Homo sapiens
atgagggtttcattgtg

SEQ ID NO: 4163802 - DNA, 17 bp, Homo sapiens
atgagttaactgtgaaa

SEQ ID NO: 4163803 - DNA, 17 bp, Homo sapiens
atgagttggacttcagt

SEQ ID NO: 4163804 - DNA, 17 bp, Homo sapiens
atgataactatttacat

SEQ ID NO: 4163805 - DNA, 22 bp, Homo sapiens
atagcctcaacaacaattttaa

SEQ ID NO: 4163806 - DNA, 20 bp, Homo sapiens
atagcgggttactttcacat

SEQ ID NO: 4163807 - DNA, 20 bp, Homo sapiens
atagcgtgggttatcagtta

SEQ ID NO: 4163808 - DNA, 14 bp, Homo sapiens
atagctctcatcac

SEQ ID NO: 4163809 - DNA, 17 bp, Homo sapiens
atagcttttattgtata

SEQ ID NO: 4163810 - DNA, 21 bp, Homo sapiens
ataggatttatttaaaatagc

SEQ ID NO: 4163811 - DNA, 22 bp, Homo sapiens
ataggatttatttaaaatagca

SEQ ID NO: 4163812 - DNA, 18 bp, Homo sapiens
ataggcagtagactcatc

SEQ ID NO: 4163813 - DNA, 23 bp, Homo sapiens
atagggaagagagaaacatttat

SEQ ID NO: 4163814 - DNA, 17 bp, Homo sapiens
ataggtgcaaaaataaa

SEQ ID NO: 4163815 - DNA, 13 bp, Homo sapiens
atagtaaatggta

SEQ ID NO: 4163816 - DNA, 14 bp, Homo sapiens
atagtgtaaaataa

SEQ ID NO: 4163817 - DNA, 12 bp, Homo sapiens
atagtgtgattt

SEQ ID NO: 4163818 - DNA, 13 bp, Homo sapiens
atagtgtgatttt

SEQ ID NO: 4163819 - DNA, 23 bp, Homo sapiens
atagttaggatagcatttttgat

SEQ ID NO: 4163820 - DNA, 19 bp, Homo sapiens
atagttatttacttgaaag

SEQ ID NO: 4163821 - DNA, 21 bp, Homo sapiens
atagtttcagatatatatcat

SEQ ID NO: 4163822 - DNA, 23 bp, Homo sapiens
atagtttggatatgtaaaacatt

SEQ ID NO: 4163823 - DNA, 15 bp, Homo sapiens
atagtttgtacatgc

SEQ ID NO: 4163824 - DNA, 19 bp, Homo sapiens
atataaaatatatttatga

SEQ ID NO: 4163825 - DNA, 24 bp, Homo sapiens
atataaagtatcatcagtgtagaa

SEQ ID NO: 4163826 - DNA, 14 bp, Homo sapiens
atataataatatgt

SEQ ID NO: 4163827 - DNA, 14 bp, Homo sapiens
atataatgaacacg

SEQ ID NO: 4163828 - DNA, 13 bp, Homo sapiens
atatactatacaa

SEQ ID NO: 4163829 - DNA, 18 bp, Homo sapiens
atatactatacaacaatg

SEQ ID NO: 4163830 - DNA, 22 bp, Homo sapiens
atataggttgtgcaaattaaca

SEQ ID NO: 4163831 - DNA, 13 bp, Homo sapiens
atatatactacat

SEQ ID NO: 4163832 - DNA, 13 bp, Homo sapiens
atatatcatattg

SEQ ID NO: 4163833 - DNA, 20 bp, Homo sapiens
atatatcatattggtattca

SEQ ID NO: 4163834 - DNA, 12 bp, Homo sapiens
atatatcttatg

SEQ ID NO: 4163835 - DNA, 18 bp, Homo sapiens
atatatgctcaaccagaa

SEQ ID NO: 4163836 - DNA, 19 bp, Homo sapiens
atatatggaagataatttt

SEQ ID NO: 4163837 - DNA, 20 bp, Homo sapiens
atatatggaagataatttta

SEQ ID NO: 4163838 - DNA, 21 bp, Homo sapiens
atatatggaagataattttat

SEQ ID NO: 4163839 - DNA, 22 bp, Homo sapiens
atatatggaagataattttatg

SEQ ID NO: 4163840 - DNA, 17 bp, Homo sapiens
atatatgtaaatagctt

SEQ ID NO: 4163841 - DNA, 20 bp, Homo sapiens
atatattgcaaaaacatagt

SEQ ID NO: 4163842 - DNA, 18 bp, Homo sapiens
atatatttactaaaagaa

SEQ ID NO: 4163843 - DNA, 19 bp, Homo sapiens
atatatttactaaaagaat

SEQ ID NO: 4163844 - DNA, 21 bp, Homo sapiens
atatatttgaatatcattaaa

SEQ ID NO: 4163845 - DNA, 14 bp, Homo sapiens
atatatttttatat

SEQ ID NO: 4163846 - DNA, 18 bp, Homo sapiens
atatcagaatcgctaata

SEQ ID NO: 4163847 - DNA, 13 bp, Homo sapiens
atatctgcttcag

SEQ ID NO: 4163848 - DNA, 16 bp, Homo sapiens
atatctgcttcagtgg

SEQ ID NO: 4163849 - DNA, 13 bp, Homo sapiens
atatctttatctt

SEQ ID NO: 4163850 - DNA, 20 bp, Homo sapiens
atatgaaaaaaatgcatttt

SEQ ID NO: 4163851 - DNA, 18 bp, Homo sapiens
atatgacaatcctgaaga

SEQ ID NO: 4163852 - DNA, 16 bp, Homo sapiens
atatgactcaggagcc

SEQ ID NO: 4163853 - DNA, 15 bp, Homo sapiens
atatgactgttttta

SEQ ID NO: 4163854 - DNA, 19 bp, Homo sapiens
atatgattgtataatgtga

SEQ ID NO: 4163855 - DNA, 13 bp, Homo sapiens
atatgatttatag

SEQ ID NO: 4163856 - DNA, 18 bp, Homo sapiens
atatggaagataatttta

SEQ ID NO: 4163857 - DNA, 17 bp, Homo sapiens
atatggacaaatggact

SEQ ID NO: 4163858 - DNA, 16 bp, Homo sapiens
atatggcaaaaatggc

SEQ ID NO: 4163859 - DNA, 15 bp, Homo sapiens
atatggcaagaaagc

SEQ ID NO: 4163860 - DNA, 18 bp, Homo sapiens
atatggcaagaaagctgg

SEQ ID NO: 4163861 - DNA, 15 bp, Homo sapiens
atatggtgcaaaaat

SEQ ID NO: 4163862 - DNA, 11 bp, Homo sapiens
atatgtaccaa

SEQ ID NO: 4163863 - DNA, 17 bp, Homo sapiens
atatgtgaatctggata

SEQ ID NO: 4163864 - DNA, 22 bp, Homo sapiens
atatgtgccaatgtgacaacat

SEQ ID NO: 4163865 - DNA, 17 bp, Homo sapiens
atatgttaatttgttat

SEQ ID NO: 4163866 - DNA, 23 bp, Homo sapiens
atattaaaaatatggaacttcta

SEQ ID NO: 4163867 - DNA, 14 bp, Homo sapiens
atattaaaggagtt

SEQ ID NO: 4163868 - DNA, 20 bp, Homo sapiens
atattaaggggatcagaagt

SEQ ID NO: 4163869 - DNA, 22 bp, Homo sapiens
atattaatttttgaaacccatt

SEQ ID NO: 4163870 - DNA, 12 bp, Homo sapiens
atattaccaaaa

SEQ ID NO: 4163871 - DNA, 19 bp, Homo sapiens
atattaccaaaaaagtatt

SEQ ID NO: 4163872 - DNA, 18 bp, Homo sapiens
atattaggggatggagag

SEQ ID NO: 4163873 - DNA, 17 bp, Homo sapiens
atattattcattcattt

SEQ ID NO: 4163874 - DNA, 15 bp, Homo sapiens
atattcaataaagct

SEQ ID NO: 4163875 - DNA, 20 bp, Homo sapiens
atattcatgcttcttcctta

SEQ ID NO: 4163876 - DNA, 22 bp, Homo sapiens
atattcctattgtgcaatgtaa

SEQ ID NO: 4163877 - DNA, 18 bp, Homo sapiens
atattgcaaaaacatagt

SEQ ID NO: 4163878 - DNA, 16 bp, Homo sapiens
atattgggacacacat

SEQ ID NO: 4163879 - DNA, 13 bp, Homo sapiens
atattggtattca

SEQ ID NO: 4163880 - DNA, 21 bp, Homo sapiens
atattgtgggtgttaattttt

SEQ ID NO: 4163881 - DNA, 19 bp, Homo sapiens
atatttaactctctttatg

SEQ ID NO: 4163882 - DNA, 15 bp, Homo sapiens
atatttatactttgc

SEQ ID NO: 4163883 - DNA, 15 bp, Homo sapiens
atatttcaaaataaa

SEQ ID NO: 4163884 - DNA, 14 bp, Homo sapiens
atattttaaagaat

SEQ ID NO: 4163885 - DNA, 23 bp, Homo sapiens
atattttcatgacttttccatgt

SEQ ID NO: 4163886 - DNA, 18 bp, Homo sapiens
atattttctattacacaa

SEQ ID NO: 4163887 - DNA, 14 bp, Homo sapiens
atattttgtatata

SEQ ID NO: 4163888 - DNA, 18 bp, Homo sapiens
atatttttatatttagtt

SEQ ID NO: 4163889 - DNA, 22 bp, Homo sapiens
atcaaacaccaacataaaaatg

SEQ ID NO: 4163890 - DNA, 15 bp, Homo sapiens
atcaaacttgtgctg

SEQ ID NO: 4163891 - DNA, 18 bp, Homo sapiens
atcaacaagagttgtctt

SEQ ID NO: 4163892 - DNA, 17 bp, Homo sapiens
atcaactagcagaaaat

SEQ ID NO: 4163893 - DNA, 21 bp, Homo sapiens
atcaacttaccaggcaccaaa

SEQ ID NO: 4163894 - DNA, 14 bp, Homo sapiens
atcaactttatgta

SEQ ID NO: 4163895 - DNA, 23 bp, Homo sapiens
atcaagtctgtttactgcaaggt

SEQ ID NO: 4163896 - DNA, 16 bp, Homo sapiens
atcaagtgtgcatata

SEQ ID NO: 4163897 - DNA, 12 bp, Homo sapiens
atcaataaaaat

SEQ ID NO: 4163898 - DNA, 15 bp, Homo sapiens
atcaataaaaatctt

SEQ ID NO: 4163899 - DNA, 19 bp, Homo sapiens
atcaatcatctgtgtgaaa

SEQ ID NO: 4163900 - DNA, 20 bp, Homo sapiens
atcaatcatctgtgtgaaaa

SEQ ID NO: 4163901 - DNA, 16 bp, Homo sapiens
atcaatccttgttcag

SEQ ID NO: 4163902 - DNA, 12 bp, Homo sapiens
atcacaaactta

SEQ ID NO: 4163903 - DNA, 17 bp, Homo sapiens
atcacagcgtttcagga

SEQ ID NO: 4163904 - DNA, 15 bp, Homo sapiens
atcacagggcagagc

SEQ ID NO: 4163905 - DNA, 17 bp, Homo sapiens
atcacctattacatttt

SEQ ID NO: 4163906 - DNA, 15 bp, Homo sapiens
atcacctcaggccag

SEQ ID NO: 4163907 - DNA, 12 bp, Homo sapiens
atcacctgaggt

SEQ ID NO: 4163908 - DNA, 19 bp, Homo sapiens
atcactacctttatagctc

SEQ ID NO: 4163909 - DNA, 23 bp, Homo sapiens
atcactacctttatagctcatca

SEQ ID NO: 4163910 - DNA, 15 bp, Homo sapiens
atcactgagttttcc

SEQ ID NO: 4163911 - DNA, 14 bp, Homo sapiens
atcactggagccca

SEQ ID NO: 4163912 - DNA, 17 bp, Homo sapiens
atcactggagcccagga

SEQ ID NO: 4163913 - DNA, 13 bp, Homo sapiens
atcactgtatttt

SEQ ID NO: 4163914 - DNA, 16 bp, Homo sapiens
atcactttgttaaaaa

SEQ ID NO: 4163915 - DNA, 13 bp, Homo sapiens
atcacttttcagt

SEQ ID NO: 4163916 - DNA, 15 bp, Homo sapiens
atcagaaaagggaag

SEQ ID NO: 4163917 - DNA, 15 bp, Homo sapiens
atcagaaataggaag

SEQ ID NO: 4163918 - DNA, 17 bp, Homo sapiens
atcagaaataggaagat

SEQ ID NO: 4163919 - DNA, 20 bp, Homo sapiens
atcagaaatgtcatcaaata

SEQ ID NO: 4163920 - DNA, 23 bp, Homo sapiens
atcagaagaccacaaaaattgac

SEQ ID NO: 4163921 - DNA, 13 bp, Homo sapiens
atcagaagcacaa

SEQ ID NO: 4163922 - DNA, 13 bp, Homo sapiens
atcagaatggaaa

SEQ ID NO: 4163923 - DNA, 13 bp, Homo sapiens
atcagagaataaa

SEQ ID NO: 4163924 - DNA, 16 bp, Homo sapiens
atcagagaataaacat

SEQ ID NO: 4163925 - DNA, 14 bp, Homo sapiens
atcagagagcctag

SEQ ID NO: 4163926 - DNA, 15 bp, Homo sapiens
atcagcagtggcagg

SEQ ID NO: 4163927 - DNA, 20 bp, Homo sapiens
atcagcctccgccattccaa

SEQ ID NO: 4163928 - DNA, 21 bp, Homo sapiens
atcaggtcattattttttaca

SEQ ID NO: 4163929 - DNA, 15 bp, Homo sapiens
atcagtcatgaggaa

SEQ ID NO: 4163930 - DNA, 18 bp, Homo sapiens
atcagtcatgaggaaaga

SEQ ID NO: 4163931 - DNA, 19 bp, Homo sapiens
atcagtcatgaggaaagac

SEQ ID NO: 4163932 - DNA, 16 bp, Homo sapiens
atcagtctcagaatgt

SEQ ID NO: 4163933 - DNA, 23 bp, Homo sapiens
atcagtgtggaaaaaaattctga

SEQ ID NO: 4163934 - DNA, 15 bp, Homo sapiens
atcatcagtgtagaa

SEQ ID NO: 4163935 - DNA, 18 bp, Homo sapiens
atcatctggtttttaaaa

SEQ ID NO: 4163936 - DNA, 18 bp, Homo sapiens
atcatgacatgttatata

SEQ ID NO: 4163937 - DNA, 12 bp, Homo sapiens
atcatggagtga

SEQ ID NO: 4163938 - DNA, 16 bp, Homo sapiens
atcattaaattggaat

SEQ ID NO: 4163939 - DNA, 23 bp, Homo sapiens
atcattaaattggaattttctta

SEQ ID NO: 4163940 - DNA, 13 bp, Homo sapiens
atcattactataa

SEQ ID NO: 4163941 - DNA, 15 bp, Homo sapiens
atcattcatttttgt

SEQ ID NO: 4163942 - DNA, 22 bp, Homo sapiens
atcattttcttatcttctgcaa

SEQ ID NO: 4163943 - DNA, 14 bp, Homo sapiens
atcattttttactt

SEQ ID NO: 4163944 - DNA, 14 bp, Homo sapiens
atcatttttttaac

SEQ ID NO: 4163945 - DNA, 20 bp, Homo sapiens
agttggtgaacagagagaac

SEQ ID NO: 4163946 - DNA, 21 bp, Homo sapiens
agttgtaaaattgttagtaaa

SEQ ID NO: 4163947 - DNA, 17 bp, Homo sapiens
agttgtacgtaatgtat

SEQ ID NO: 4163948 - DNA, 13 bp, Homo sapiens
agttgtctggctt

SEQ ID NO: 4163949 - DNA, 18 bp, Homo sapiens
agttgtgccttttatagc

SEQ ID NO: 4163950 - DNA, 21 bp, Homo sapiens
agttgtggaaagcctctgctg

SEQ ID NO: 4163951 - DNA, 17 bp, Homo sapiens
agttgtgggtgggagag

SEQ ID NO: 4163952 - DNA, 19 bp, Homo sapiens
agtttacaagtgtatatca

SEQ ID NO: 4163953 - DNA, 13 bp, Homo sapiens
agtttacagtaaa

SEQ ID NO: 4163954 - DNA, 16 bp, Homo sapiens
agtttagaagcgctca

SEQ ID NO: 4163955 - DNA, 15 bp, Homo sapiens
agtttatgtctaaag

SEQ ID NO: 4163956 - DNA, 16 bp, Homo sapiens
agtttatgtctaaaga

SEQ ID NO: 4163957 - DNA, 21 bp, Homo sapiens
agtttatgtctaaagagcttt

SEQ ID NO: 4163958 - DNA, 22 bp, Homo sapiens
agtttatttccaaataaaatga

SEQ ID NO: 4163959 - DNA, 17 bp, Homo sapiens
agtttattttgttacac

SEQ ID NO: 4163960 - DNA, 16 bp, Homo sapiens
agtttcagaagcaggc

SEQ ID NO: 4163961 - DNA, 19 bp, Homo sapiens
agtttcaggagattgttaa

SEQ ID NO: 4163962 - DNA, 17 bp, Homo sapiens
agtttcctagaacgcaa

SEQ ID NO: 4163963 - DNA, 17 bp, Homo sapiens
agtttgaggctgcagcg

SEQ ID NO: 4163964 - DNA, 14 bp, Homo sapiens
agtttggatatgta

SEQ ID NO: 4163965 - DNA, 17 bp, Homo sapiens
agtttggatatgtaaaa

SEQ ID NO: 4163966 - DNA, 15 bp, Homo sapiens
agtttgtacatgcat

SEQ ID NO: 4163967 - DNA, 17 bp, Homo sapiens
agttttgggaggggatg

SEQ ID NO: 4163968 - DNA, 21 bp, Homo sapiens
agttttgggaggggatggcag

SEQ ID NO: 4163969 - DNA, 23 bp, Homo sapiens
agtttttaccttgttttctctat

SEQ ID NO: 4163970 - DNA, 16 bp, Homo sapiens
ataaaaatactatgaa

SEQ ID NO: 4163971 - DNA, 17 bp, Homo sapiens
ataaaaatgatctaaac

SEQ ID NO: 4163972 - DNA, 15 bp, Homo sapiens
ataaaacctttcaaa

SEQ ID NO: 4163973 - DNA, 19 bp, Homo sapiens
ataaaagcttaggctgata

SEQ ID NO: 4163974 - DNA, 18 bp, Homo sapiens
ataaaatgaggacatgtt

SEQ ID NO: 4163975 - DNA, 21 bp, Homo sapiens
ataaaattgtaaaattgtata

SEQ ID NO: 4163976 - DNA, 19 bp, Homo sapiens
ataaacaaatgaattgtat

SEQ ID NO: 4163977 - DNA, 14 bp, Homo sapiens
ataaacctggagat

SEQ ID NO: 4163978 - DNA, 16 bp, Homo sapiens
ataaacctggagatga

SEQ ID NO: 4163979 - DNA, 14 bp, Homo sapiens
ataaacttagaata

SEQ ID NO: 4163980 - DNA, 17 bp, Homo sapiens
ataaactttataaattc

SEQ ID NO: 4163981 - DNA, 21 bp, Homo sapiens
ataaagataacccttattcca

SEQ ID NO: 4163982 - DNA, 17 bp, Homo sapiens
ataaagattttttaata

SEQ ID NO: 4163983 - DNA, 16 bp, Homo sapiens
ataaagcaagctcaac

SEQ ID NO: 4163984 - DNA, 12 bp, Homo sapiens
ataaagcaggga

SEQ ID NO: 4163985 - DNA, 11 bp, Homo sapiens
ataaagctgga

SEQ ID NO: 4163986 - DNA, 13 bp, Homo sapiens
ataaagtgtaata

SEQ ID NO: 4163987 - DNA, 20 bp, Homo sapiens
ataaagttgataaagatttt

SEQ ID NO: 4163988 - DNA, 15 bp, Homo sapiens
ataaatatgtgaaaa

SEQ ID NO: 4163989 - DNA, 15 bp, Homo sapiens
ataaatcagactctt

SEQ ID NO: 4163990 - DNA, 10 bp, Homo sapiens
ataaatgttc

SEQ ID NO: 4163991 - DNA, 13 bp, Homo sapiens
ataaatgttcaaa

SEQ ID NO: 4163992 - DNA, 16 bp, Homo sapiens
ataaattagagaaatg

SEQ ID NO: 4163993 - DNA, 21 bp, Homo sapiens
ataaattagagaaatggttct

SEQ ID NO: 4163994 - DNA, 19 bp, Homo sapiens
ataaattatttttaagaaa

SEQ ID NO: 4163995 - DNA, 16 bp, Homo sapiens
ataaattcagatatat

SEQ ID NO: 4163996 - DNA, 22 bp, Homo sapiens
ataaattcagatatatttttca

SEQ ID NO: 4163997 - DNA, 22 bp, Homo sapiens
ataaattttgacttgaaaaata

SEQ ID NO: 4163998 - DNA, 12 bp, Homo sapiens
ataacaacaatg

SEQ ID NO: 4163999 - DNA, 20 bp, Homo sapiens
ataacaactatttttgttgt

SEQ ID NO: 4164000 - DNA, 21 bp, Homo sapiens
ataacaactatttttgttgtt

SEQ ID NO: 4164001 - DNA, 17 bp, Homo sapiens
ataacaagatctttcag

SEQ ID NO: 4164002 - DNA, 21 bp, Homo sapiens
ataacaaggttcttctaaaat

SEQ ID NO: 4164003 - DNA, 23 bp, Homo sapiens
ataaccaagaaatactaatgtaa

SEQ ID NO: 4164004 - DNA, 20 bp, Homo sapiens
ataacgtttaagccaaaaca

SEQ ID NO: 4164005 - DNA, 22 bp, Homo sapiens
ataacgtttaagccaaaacaat

SEQ ID NO: 4164006 - DNA, 18 bp, Homo sapiens
ataactatttacatataa

SEQ ID NO: 4164007 - DNA, 14 bp, Homo sapiens
ataactgaaaatta

SEQ ID NO: 4164008 - DNA, 17 bp, Homo sapiens
ataactgaaaattattt

SEQ ID NO: 4164009 - DNA, 20 bp, Homo sapiens
ataactgaaaattatttaaa

SEQ ID NO: 4164010 - DNA, 12 bp, Homo sapiens
ataactgagaat

SEQ ID NO: 4164011 - DNA, 17 bp, Homo sapiens
ataacttcttaaaagtt

SEQ ID NO: 4164012 - DNA, 16 bp, Homo sapiens
ataacttgttttgact

SEQ ID NO: 4164013 - DNA, 18 bp, Homo sapiens
ataagaaacatgatgtga

SEQ ID NO: 4164014 - DNA, 13 bp, Homo sapiens
ataagaaactttt

SEQ ID NO: 4164015 - DNA, 22 bp, Homo sapiens
ataagaaacttttttatttaaa

SEQ ID NO: 4164016 - DNA, 19 bp, Homo sapiens
ataagaagaatgcttaatc

SEQ ID NO: 4164017 - DNA, 16 bp, Homo sapiens
ataagattaaaggaag

SEQ ID NO: 4164018 - DNA, 21 bp, Homo sapiens
ataagcaagaaggcaaaaata

SEQ ID NO: 4164019 - DNA, 15 bp, Homo sapiens
ataagctgaaattgt

SEQ ID NO: 4164020 - DNA, 13 bp, Homo sapiens
ataataaagccag

SEQ ID NO: 4164021 - DNA, 12 bp, Homo sapiens
ataataatgaat

SEQ ID NO: 4164022 - DNA, 17 bp, Homo sapiens
ataataccaagactaag

SEQ ID NO: 4164023 - DNA, 22 bp, Homo sapiens
ataatactgctgagatacatac

SEQ ID NO: 4164024 - DNA, 18 bp, Homo sapiens
ataatataccaatgcttt

SEQ ID NO: 4164025 - DNA, 15 bp, Homo sapiens
ataatatattaggca

SEQ ID NO: 4164026 - DNA, 20 bp, Homo sapiens
ataatatgtgatgattaata

SEQ ID NO: 4164027 - DNA, 14 bp, Homo sapiens
ataatatttcaagt

SEQ ID NO: 4164028 - DNA, 18 bp, Homo sapiens
ataatatttcaagtgcct

SEQ ID NO: 4164029 - DNA, 18 bp, Homo sapiens
ataatcgctcttttccac

SEQ ID NO: 4164030 - DNA, 21 bp, Homo sapiens
ataatcgctcttttccactcc

SEQ ID NO: 4164031 - DNA, 13 bp, Homo sapiens
ataattaaatata

SEQ ID NO: 4164032 - DNA, 14 bp, Homo sapiens
ataattaaatatat

SEQ ID NO: 4164033 - DNA, 23 bp, Homo sapiens
ataattgctttgccaaaatacca

SEQ ID NO: 4164034 - DNA, 20 bp, Homo sapiens
ataatttagtttcatataaa

SEQ ID NO: 4164035 - DNA, 17 bp, Homo sapiens
ataattttttattcaag

SEQ ID NO: 4164036 - DNA, 14 bp, Homo sapiens
atacaacaagaaca

SEQ ID NO: 4164037 - DNA, 20 bp, Homo sapiens
atacaacatgtagctgagtt

SEQ ID NO: 4164038 - DNA, 21 bp, Homo sapiens
atacacagaaaagggagctaa

SEQ ID NO: 4164039 - DNA, 16 bp, Homo sapiens
atacacagatgattaa

SEQ ID NO: 4164040 - DNA, 22 bp, Homo sapiens
atacagattctagccaaactat

SEQ ID NO: 4164041 - DNA, 13 bp, Homo sapiens
atacataataaag

SEQ ID NO: 4164042 - DNA, 12 bp, Homo sapiens
atacatacagaa

SEQ ID NO: 4164043 - DNA, 17 bp, Homo sapiens
atacatacagaattact

SEQ ID NO: 4164044 - DNA, 16 bp, Homo sapiens
atacatagtaaatggt

SEQ ID NO: 4164045 - DNA, 13 bp, Homo sapiens
atacatcaaaaat

SEQ ID NO: 4164046 - DNA, 21 bp, Homo sapiens
atacatcctattttgtaattt

SEQ ID NO: 4164047 - DNA, 16 bp, Homo sapiens
atacattcataaggaa

SEQ ID NO: 4164048 - DNA, 23 bp, Homo sapiens
atacattcataaggaaatgtgtg

SEQ ID NO: 4164049 - DNA, 21 bp, Homo sapiens
atacctgtcctagcaggatct

SEQ ID NO: 4164050 - DNA, 22 bp, Homo sapiens
atacgtgttcctataaaatcaa

SEQ ID NO: 4164051 - DNA, 15 bp, Homo sapiens
atacgtgttctatag

SEQ ID NO: 4164052 - DNA, 21 bp, Homo sapiens
atactaaaagttcttctccaa

SEQ ID NO: 4164053 - DNA, 23 bp, Homo sapiens
atactaccctgggctctggtctg

SEQ ID NO: 4164054 - DNA, 15 bp, Homo sapiens
atactatacaacaat

SEQ ID NO: 4164055 - DNA, 13 bp, Homo sapiens
atactatgttcat

SEQ ID NO: 4164056 - DNA, 21 bp, Homo sapiens
atactctagtgaatgtgcctt

SEQ ID NO: 4164057 - DNA, 12 bp, Homo sapiens
atactctgtcag

SEQ ID NO: 4164058 - DNA, 15 bp, Homo sapiens
atactctgtcagatg

SEQ ID NO: 4164059 - DNA, 18 bp, Homo sapiens
atactgctgagatacata

SEQ ID NO: 4164060 - DNA, 21 bp, Homo sapiens
atactgctgagatacatacag

SEQ ID NO: 4164061 - DNA, 21 bp, Homo sapiens
atactgcttggagctgagcaa

SEQ ID NO: 4164062 - DNA, 17 bp, Homo sapiens
atagaaaactgaaaatc

SEQ ID NO: 4164063 - DNA, 15 bp, Homo sapiens
atagaaatacctcat

SEQ ID NO: 4164064 - DNA, 12 bp, Homo sapiens
atagaaatgcca

SEQ ID NO: 4164065 - DNA, 19 bp, Homo sapiens
atagaaatgccaagcactt

SEQ ID NO: 4164066 - DNA, 17 bp, Homo sapiens
atagaacaagaccctgt

SEQ ID NO: 4164067 - DNA, 14 bp, Homo sapiens
atagaagctgtagt

SEQ ID NO: 4164068 - DNA, 16 bp, Homo sapiens
atagaagctgtagtag

SEQ ID NO: 4164069 - DNA, 17 bp, Homo sapiens
atagacagaagaaacaa

SEQ ID NO: 4164070 - DNA, 19 bp, Homo sapiens
atagacagaagaaacaagg

SEQ ID NO: 4164071 - DNA, 16 bp, Homo sapiens
atagagtatactaaaa

SEQ ID NO: 4164072 - DNA, 13 bp, Homo sapiens
atagagtgatttt

SEQ ID NO: 4164073 - DNA, 22 bp, Homo sapiens
atagatccatttggacaaaatg

SEQ ID NO: 4164074 - DNA, 17 bp, Homo sapiens
atagatttgtattttaa

SEQ ID NO: 4164075 - DNA, 19 bp, Homo sapiens
atagcaaaagaagaagttt

SEQ ID NO: 4164076 - DNA, 14 bp, Homo sapiens
atagcaaagaattg

SEQ ID NO: 4164077 - DNA, 15 bp, Homo sapiens
atagcaaagaattga

SEQ ID NO: 4164078 - DNA, 17 bp, Homo sapiens
atagcaattagcagaag

SEQ ID NO: 4164079 - DNA, 19 bp, Homo sapiens
atagcagaggaaaaagaaa

SEQ ID NO: 4164080 - DNA, 19 bp, Homo sapiens
atagcaggtgtaataagac

SEQ ID NO: 4164081 - DNA, 16 bp, Homo sapiens
atagcattctctatca

SEQ ID NO: 4164082 - DNA, 18 bp, Homo sapiens
atagccaaaaatagctaa

SEQ ID NO: 4164083 - DNA, 20 bp, Homo sapiens
atagccatttccatggctct

SEQ ID NO: 4164084 - DNA, 11 bp, Homo sapiens
agtcagccctt

SEQ ID NO: 4164085 - DNA, 23 bp, Homo sapiens
agtcaggaaagacaggctgagct

SEQ ID NO: 4164086 - DNA, 15 bp, Homo sapiens
agtcatgaggaaaga

SEQ ID NO: 4164087 - DNA, 22 bp, Homo sapiens
agtcatgaggaaagacacagat

SEQ ID NO: 4164088 - DNA, 12 bp, Homo sapiens
agtccaacctgc

SEQ ID NO: 4164089 - DNA, 18 bp, Homo sapiens
agtccaacctgcctgtgc

SEQ ID NO: 4164090 - DNA, 22 bp, Homo sapiens
agtccacctgcctatccatcct

SEQ ID NO: 4164091 - DNA, 13 bp, Homo sapiens
agtccagagccgg

SEQ ID NO: 4164092 - DNA, 16 bp, Homo sapiens
agtccagatgccttcc

SEQ ID NO: 4164093 - DNA, 21 bp, Homo sapiens
agtccagatgccttcctgtct

SEQ ID NO: 4164094 - DNA, 13 bp, Homo sapiens
agtcccctgggcc

SEQ ID NO: 4164095 - DNA, 14 bp, Homo sapiens
agtcccctgggcct

SEQ ID NO: 4164096 - DNA, 19 bp, Homo sapiens
agtccctaggagggaagga

SEQ ID NO: 4164097 - DNA, 22 bp, Homo sapiens
agtcctcaaagcacctgaacca

SEQ ID NO: 4164098 - DNA, 16 bp, Homo sapiens
agtcctcacagcctct

SEQ ID NO: 4164099 - DNA, 15 bp, Homo sapiens
agtcctcgtagccat

SEQ ID NO: 4164100 - DNA, 17 bp, Homo sapiens
agtcctcgtagccatct

SEQ ID NO: 4164101 - DNA, 17 bp, Homo sapiens
agtcctgcagaggattt

SEQ ID NO: 4164102 - DNA, 16 bp, Homo sapiens
agtcctgtgaatttct

SEQ ID NO: 4164103 - DNA, 20 bp, Homo sapiens
agtccttattatcccagctt

SEQ ID NO: 4164104 - DNA, 24 bp, Homo sapiens
agtccttattatcccagcttgctg

SEQ ID NO: 4164105 - DNA, 17 bp, Homo sapiens
agtcgtccgctcagcca

SEQ ID NO: 4164106 - DNA, 13 bp, Homo sapiens
agtctaaagttta

SEQ ID NO: 4164107 - DNA, 14 bp, Homo sapiens
agtctaaagtttac

SEQ ID NO: 4164108 - DNA, 17 bp, Homo sapiens
agtctaaagtttacagt

SEQ ID NO: 4164109 - DNA, 15 bp, Homo sapiens
agtctacctcttcag

SEQ ID NO: 4164110 - DNA, 18 bp, Homo sapiens
agtctagtgaagatgttg

SEQ ID NO: 4164111 - DNA, 19 bp, Homo sapiens
agtctagtgaagatgttgt

SEQ ID NO: 4164112 - DNA, 13 bp, Homo sapiens
agtctcaggagca

SEQ ID NO: 4164113 - DNA, 13 bp, Homo sapiens
agtctcagtccag

SEQ ID NO: 4164114 - DNA, 22 bp, Homo sapiens
agtctcttggtgatggagtgtg

SEQ ID NO: 4164115 - DNA, 16 bp, Homo sapiens
agtctgctatattttc

SEQ ID NO: 4164116 - DNA, 20 bp, Homo sapiens
agtctgctttcactgtgact

SEQ ID NO: 4164117 - DNA, 21 bp, Homo sapiens
agtctggaagaagaggaggaa

SEQ ID NO: 4164118 - DNA, 18 bp, Homo sapiens
agtctgggaaattctata

SEQ ID NO: 4164119 - DNA, 21 bp, Homo sapiens
agtctgggcaatgaaaccaaa

SEQ ID NO: 4164120 - DNA, 14 bp, Homo sapiens
agtctgtgggagct

SEQ ID NO: 4164121 - DNA, 22 bp, Homo sapiens
agtctgtgtgatgaactttctc

SEQ ID NO: 4164122 - DNA, 13 bp, Homo sapiens
agtcttgtcagaa

SEQ ID NO: 4164123 - DNA, 15 bp, Homo sapiens
agtcttgtcagaatt

SEQ ID NO: 4164124 - DNA, 22 bp, Homo sapiens
agtgaaataattaaaaaccact

SEQ ID NO: 4164125 - DNA, 14 bp, Homo sapiens
agtgaagaatactt

SEQ ID NO: 4164126 - DNA, 14 bp, Homo sapiens
agtgaagacagaag

SEQ ID NO: 4164127 - DNA, 15 bp, Homo sapiens
agtgaagacagaagt

SEQ ID NO: 4164128 - DNA, 14 bp, Homo sapiens
agtgaatttctgat

SEQ ID NO: 4164129 - DNA, 18 bp, Homo sapiens
agtgaccaaattgggaga

SEQ ID NO: 4164130 - DNA, 19 bp, Homo sapiens
agtgaccaaattgggagat

SEQ ID NO: 4164131 - DNA, 14 bp, Homo sapiens
agtgacgtgcacct

SEQ ID NO: 4164132 - DNA, 15 bp, Homo sapiens
agtgactaatggcat

SEQ ID NO: 4164133 - DNA, 16 bp, Homo sapiens
agtgactaatggcatg

SEQ ID NO: 4164134 - DNA, 17 bp, Homo sapiens
agtgactaatggcatga

SEQ ID NO: 4164135 - DNA, 13 bp, Homo sapiens
agtgacttcctgg

SEQ ID NO: 4164136 - DNA, 15 bp, Homo sapiens
agtgacttcctggtg

SEQ ID NO: 4164137 - DNA, 15 bp, Homo sapiens
agtgagctgagatca

SEQ ID NO: 4164138 - DNA, 12 bp, Homo sapiens
agtgataaatct

SEQ ID NO: 4164139 - DNA, 22 bp, Homo sapiens
agtgataaatctagaaaattga

SEQ ID NO: 4164140 - DNA, 20 bp, Homo sapiens
agtgatcctcaaacacacaa

SEQ ID NO: 4164141 - DNA, 18 bp, Homo sapiens
agtgatctcaaatccact

SEQ ID NO: 4164142 - DNA, 21 bp, Homo sapiens
agtgatctcaaatccactgac

SEQ ID NO: 4164143 - DNA, 15 bp, Homo sapiens
agtgattgtcttaat

SEQ ID NO: 4164144 - DNA, 16 bp, Homo sapiens
agtgcaacaaaatcaa

SEQ ID NO: 4164145 - DNA, 11 bp, Homo sapiens
agtgcaacaag

SEQ ID NO: 4164146 - DNA, 15 bp, Homo sapiens
agtgcactcctggtg

SEQ ID NO: 4164147 - DNA, 22 bp, Homo sapiens
agtgcataaaggttctggggct

SEQ ID NO: 4164148 - DNA, 21 bp, Homo sapiens
agtgcatgaacagggtccctg

SEQ ID NO: 4164149 - DNA, 15 bp, Homo sapiens
agtgcattttcccag

SEQ ID NO: 4164150 - DNA, 10 bp, Homo sapiens
agtgccacag

SEQ ID NO: 4164151 - DNA, 12 bp, Homo sapiens
agtgccacagag

SEQ ID NO: 4164152 - DNA, 20 bp, Homo sapiens
agtgccacccacctttgcca

SEQ ID NO: 4164153 - DNA, 22 bp, Homo sapiens
agtgccacccacctttgccaca

SEQ ID NO: 4164154 - DNA, 19 bp, Homo sapiens
agtgccactcattcctgta

SEQ ID NO: 4164155 - DNA, 19 bp, Homo sapiens
agtgccaggactccccagg

SEQ ID NO: 4164156 - DNA, 20 bp, Homo sapiens
agtgccagtcttgtgtctgc

SEQ ID NO: 4164157 - DNA, 13 bp, Homo sapiens
agtgctgccctgc

SEQ ID NO: 4164158 - DNA, 19 bp, Homo sapiens
agtgctgggattacagaca

SEQ ID NO: 4164159 - DNA, 16 bp, Homo sapiens
agtgctgtggcctggg

SEQ ID NO: 4164160 - DNA, 14 bp, Homo sapiens
agtgcttctctaca

SEQ ID NO: 4164161 - DNA, 19 bp, Homo sapiens
agtggaaaaatcagaagca

SEQ ID NO: 4164162 - DNA, 19 bp, Homo sapiens
agtggcttttttcctcctg

SEQ ID NO: 4164163 - DNA, 18 bp, Homo sapiens
agtgggctccctggccca

SEQ ID NO: 4164164 - DNA, 19 bp, Homo sapiens
agtggggtagactgaggga

SEQ ID NO: 4164165 - DNA, 14 bp, Homo sapiens
agtgtaaatccttt

SEQ ID NO: 4164166 - DNA, 18 bp, Homo sapiens
agtgtaacagatatcagt

SEQ ID NO: 4164167 - DNA, 18 bp, Homo sapiens
agtgtagccttgcccgga

SEQ ID NO: 4164168 - DNA, 14 bp, Homo sapiens
agtgtatgtgaatt

SEQ ID NO: 4164169 - DNA, 20 bp, Homo sapiens
agtgtcatatgtaggtgtct

SEQ ID NO: 4164170 - DNA, 17 bp, Homo sapiens
agtgtctccccgtgtcc

SEQ ID NO: 4164171 - DNA, 13 bp, Homo sapiens
agtgtgcgtgtgt

SEQ ID NO: 4164172 - DNA, 16 bp, Homo sapiens
agtgtgcgtgtgtgca

SEQ ID NO: 4164173 - DNA, 11 bp, Homo sapiens
agtgtgtaaag

SEQ ID NO: 4164174 - DNA, 18 bp, Homo sapiens
agtgtgtgtttaacattc

SEQ ID NO: 4164175 - DNA, 19 bp, Homo sapiens
agtgtgtgtttaacattca

SEQ ID NO: 4164176 - DNA, 23 bp, Homo sapiens
agtgtgtgtttaacattcacagc

SEQ ID NO: 4164177 - DNA, 18 bp, Homo sapiens
agtgttccagctgcctgg

SEQ ID NO: 4164178 - DNA, 19 bp, Homo sapiens
agtgttccagctgcctggg

SEQ ID NO: 4164179 - DNA, 20 bp, Homo sapiens
agtgttcctatttggggctt

SEQ ID NO: 4164180 - DNA, 21 bp, Homo sapiens
agtgttttatgagaaagcctt

SEQ ID NO: 4164181 - DNA, 18 bp, Homo sapiens
agttaaatagctatattt

SEQ ID NO: 4164182 - DNA, 19 bp, Homo sapiens
agttaacattaacatctat

SEQ ID NO: 4164183 - DNA, 14 bp, Homo sapiens
agttaagagtagca

SEQ ID NO: 4164184 - DNA, 18 bp, Homo sapiens
agttaattttgaccaaaa

SEQ ID NO: 4164185 - DNA, 22 bp, Homo sapiens
agttacataattcactctgagt

SEQ ID NO: 4164186 - DNA, 16 bp, Homo sapiens
agttagagaatatatt

SEQ ID NO: 4164187 - DNA, 14 bp, Homo sapiens
agttagctcaggag

SEQ ID NO: 4164188 - DNA, 19 bp, Homo sapiens
agttagctcaggaggcttg

SEQ ID NO: 4164189 - DNA, 22 bp, Homo sapiens
agttagctcaggaggcttggaa

SEQ ID NO: 4164190 - DNA, 12 bp, Homo sapiens
agttaggaaata

SEQ ID NO: 4164191 - DNA, 14 bp, Homo sapiens
agttataaaaatac

SEQ ID NO: 4164192 - DNA, 15 bp, Homo sapiens
agttatagtttcaga

SEQ ID NO: 4164193 - DNA, 16 bp, Homo sapiens
agttatagtttcagat

SEQ ID NO: 4164194 - DNA, 18 bp, Homo sapiens
agttatagtttcagatat

SEQ ID NO: 4164195 - DNA, 18 bp, Homo sapiens
agttattgtacagctgtt

SEQ ID NO: 4164196 - DNA, 23 bp, Homo sapiens
agttattgttttatgttctagtg

SEQ ID NO: 4164197 - DNA, 17 bp, Homo sapiens
agttatttacttgaaag

SEQ ID NO: 4164198 - DNA, 20 bp, Homo sapiens
agttatttacttgaaagatg

SEQ ID NO: 4164199 - DNA, 21 bp, Homo sapiens
agttatttacttgaaagatgg

SEQ ID NO: 4164200 - DNA, 20 bp, Homo sapiens
agttatttagaaatatcctt

SEQ ID NO: 4164201 - DNA, 19 bp, Homo sapiens
agttcaccccttatcctga

SEQ ID NO: 4164202 - DNA, 20 bp, Homo sapiens
agttcactgttgtacacagt

SEQ ID NO: 4164203 - DNA, 22 bp, Homo sapiens
agttcactgttgtacacagtct

SEQ ID NO: 4164204 - DNA, 15 bp, Homo sapiens
agttcagaggaagca

SEQ ID NO: 4164205 - DNA, 16 bp, Homo sapiens
agttcagaggaagcac

SEQ ID NO: 4164206 - DNA, 19 bp, Homo sapiens
agttcataatatatggaag

SEQ ID NO: 4164207 - DNA, 12 bp, Homo sapiens
agttccctgttg

SEQ ID NO: 4164208 - DNA, 16 bp, Homo sapiens
agttcctctttgcatg

SEQ ID NO: 4164209 - DNA, 18 bp, Homo sapiens
agttcgagaccagcctgg

SEQ ID NO: 4164210 - DNA, 21 bp, Homo sapiens
agttcgagaccagcctggcca

SEQ ID NO: 4164211 - DNA, 13 bp, Homo sapiens
agttctagagaag

SEQ ID NO: 4164212 - DNA, 15 bp, Homo sapiens
agttctagagaagag

SEQ ID NO: 4164213 - DNA, 17 bp, Homo sapiens
agttctagagaagaggc

SEQ ID NO: 4164214 - DNA, 17 bp, Homo sapiens
agttctctcgtaactgg

SEQ ID NO: 4164215 - DNA, 11 bp, Homo sapiens
agttctggtga

SEQ ID NO: 4164216 - DNA, 22 bp, Homo sapiens
agttcttgtctgattggctcac

SEQ ID NO: 4164217 - DNA, 15 bp, Homo sapiens
agttctttactggtg

SEQ ID NO: 4164218 - DNA, 16 bp, Homo sapiens
agttctttactggtga

SEQ ID NO: 4164219 - DNA, 21 bp, Homo sapiens
agttgaacctgatgagcaaga

SEQ ID NO: 4164220 - DNA, 18 bp, Homo sapiens
agttgacgcatcctgcag

SEQ ID NO: 4164221 - DNA, 17 bp, Homo sapiens
agttgataaagattttt

SEQ ID NO: 4164222 - DNA, 15 bp, Homo sapiens
agttgattctgaatc

SEQ ID NO: 4164223 - DNA, 18 bp, Homo sapiens
agttggctggatgaaatt

SEQ ID NO: 4164224 - DNA, 20 bp, Homo sapiens
aggggaaaccagtgtagcct

SEQ ID NO: 4164225 - DNA, 17 bp, Homo sapiens
aggggaaagacttccat

SEQ ID NO: 4164226 - DNA, 15 bp, Homo sapiens
aggggacccagctcc

SEQ ID NO: 4164227 - DNA, 19 bp, Homo sapiens
aggggagcttgagggacaa

SEQ ID NO: 4164228 - DNA, 24 bp, Homo sapiens
aggggatggcagacagtcaaggag

SEQ ID NO: 4164229 - DNA, 19 bp, Homo sapiens
aggggcaaagaactgcccc

SEQ ID NO: 4164230 - DNA, 21 bp, Homo sapiens
aggggccagatgattttcctc

SEQ ID NO: 4164231 - DNA, 18 bp, Homo sapiens
aggggccagtgagggctg

SEQ ID NO: 4164232 - DNA, 14 bp, Homo sapiens
aggggctcctggaa

SEQ ID NO: 4164233 - DNA, 17 bp, Homo sapiens
aggggctttctggagag

SEQ ID NO: 4164234 - DNA, 15 bp, Homo sapiens
agggggaagagaaat

SEQ ID NO: 4164235 - DNA, 21 bp, Homo sapiens
agggggacgcgcacacacacc

SEQ ID NO: 4164236 - DNA, 15 bp, Homo sapiens
agggggcggggcggg

SEQ ID NO: 4164237 - DNA, 21 bp, Homo sapiens
aggggggttgtgaggcctggc

SEQ ID NO: 4164238 - DNA, 20 bp, Homo sapiens
aggggtcagtgcagcagagg

SEQ ID NO: 4164239 - DNA, 13 bp, Homo sapiens
aggggtctccctg

SEQ ID NO: 4164240 - DNA, 16 bp, Homo sapiens
aggggtctccctggag

SEQ ID NO: 4164241 - DNA, 18 bp, Homo sapiens
aggggtgacagtggagga

SEQ ID NO: 4164242 - DNA, 17 bp, Homo sapiens
aggggttgcgggggagc

SEQ ID NO: 4164243 - DNA, 21 bp, Homo sapiens
aggggttgcgggggagctgga

SEQ ID NO: 4164244 - DNA, 17 bp, Homo sapiens
agggtaacagaagagga

SEQ ID NO: 4164245 - DNA, 16 bp, Homo sapiens
agggtatgggaagcca

SEQ ID NO: 4164246 - DNA, 13 bp, Homo sapiens
agggtgcatagct

SEQ ID NO: 4164247 - DNA, 16 bp, Homo sapiens
agggtgggagagccca

SEQ ID NO: 4164248 - DNA, 20 bp, Homo sapiens
agggtgtgtgccacacccca

SEQ ID NO: 4164249 - DNA, 19 bp, Homo sapiens
agggtttgaggattcctga

SEQ ID NO: 4164250 - DNA, 18 bp, Homo sapiens
agggttttccaccctgga

SEQ ID NO: 4164251 - DNA, 19 bp, Homo sapiens
agggttttccaccctggaa

SEQ ID NO: 4164252 - DNA, 13 bp, Homo sapiens
aggtaagtggcag

SEQ ID NO: 4164253 - DNA, 14 bp, Homo sapiens
aggtaagtggcagg

SEQ ID NO: 4164254 - DNA, 15 bp, Homo sapiens
aggtaagtggcagga

SEQ ID NO: 4164255 - DNA, 18 bp, Homo sapiens
aggtaagtgggggcgggg

SEQ ID NO: 4164256 - DNA, 16 bp, Homo sapiens
aggtaatttttcacct

SEQ ID NO: 4164257 - DNA, 15 bp, Homo sapiens
aggtagagatgtgtg

SEQ ID NO: 4164258 - DNA, 20 bp, Homo sapiens
aggtagagtttgaaggaggt

SEQ ID NO: 4164259 - DNA, 14 bp, Homo sapiens
aggtagcgagctgc

SEQ ID NO: 4164260 - DNA, 15 bp, Homo sapiens
aggtagcgagctgct

SEQ ID NO: 4164261 - DNA, 19 bp, Homo sapiens
aggtagcgagctgctctgc

SEQ ID NO: 4164262 - DNA, 21 bp, Homo sapiens
aggtagcgagctgctctgcta

SEQ ID NO: 4164263 - DNA, 22 bp, Homo sapiens
aggtagttggtgaacagagaga

SEQ ID NO: 4164264 - DNA, 18 bp, Homo sapiens
aggtatacctgggaagat

SEQ ID NO: 4164265 - DNA, 15 bp, Homo sapiens
aggtatctccaggat

SEQ ID NO: 4164266 - DNA, 19 bp, Homo sapiens
aggtattaaagatgtgttg

SEQ ID NO: 4164267 - DNA, 17 bp, Homo sapiens
aggtattttaactgtgt

SEQ ID NO: 4164268 - DNA, 21 bp, Homo sapiens
aggtcaacatctaagcctgtt

SEQ ID NO: 4164269 - DNA, 22 bp, Homo sapiens
aggtcaagctatttctctggat

SEQ ID NO: 4164270 - DNA, 18 bp, Homo sapiens
aggtcacattcaggaaga

SEQ ID NO: 4164271 - DNA, 19 bp, Homo sapiens
aggtcacattcaggaagat

SEQ ID NO: 4164272 - DNA, 15 bp, Homo sapiens
aggtcaccagcctga

SEQ ID NO: 4164273 - DNA, 19 bp, Homo sapiens
aggtcacttgaagccaaac

SEQ ID NO: 4164274 - DNA, 18 bp, Homo sapiens
aggtcatgatttctgtga

SEQ ID NO: 4164275 - DNA, 21 bp, Homo sapiens
aggtcatgatttctgtgaagc

SEQ ID NO: 4164276 - DNA, 20 bp, Homo sapiens
aggtcctctgatacccagag

SEQ ID NO: 4164277 - DNA, 14 bp, Homo sapiens
aggtcctggcttct

SEQ ID NO: 4164278 - DNA, 15 bp, Homo sapiens
aggtcctgtcctggc

SEQ ID NO: 4164279 - DNA, 22 bp, Homo sapiens
aggtcctgtcctggctcccagg

SEQ ID NO: 4164280 - DNA, 21 bp, Homo sapiens
aggtcgaccccaaagcccctt

SEQ ID NO: 4164281 - DNA, 13 bp, Homo sapiens
aggtctagacttt

SEQ ID NO: 4164282 - DNA, 19 bp, Homo sapiens
aggtctccactgaggatgt

SEQ ID NO: 4164283 - DNA, 21 bp, Homo sapiens
aggtctccactgaggatgtga

SEQ ID NO: 4164284 - DNA, 16 bp, Homo sapiens
aggtcttcagccatca

SEQ ID NO: 4164285 - DNA, 17 bp, Homo sapiens
aggtcttcttgtgtcct

SEQ ID NO: 4164286 - DNA, 21 bp, Homo sapiens
aggtcttcttgtgtcctgatg

SEQ ID NO: 4164287 - DNA, 20 bp, Homo sapiens
aggtgagaccaaaggatcca

SEQ ID NO: 4164288 - DNA, 15 bp, Homo sapiens
aggtgagaccacctc

SEQ ID NO: 4164289 - DNA, 11 bp, Homo sapiens
aggtgcagtgg

SEQ ID NO: 4164290 - DNA, 16 bp, Homo sapiens
aggtgcagtggctcac

SEQ ID NO: 4164291 - DNA, 20 bp, Homo sapiens
aggtgcctggcttgctgtgg

SEQ ID NO: 4164292 - DNA, 23 bp, Homo sapiens
aggtgctgatgtcaaagtgtaac

SEQ ID NO: 4164293 - DNA, 21 bp, Homo sapiens
aggtggaggttgcagtgagct

SEQ ID NO: 4164294 - DNA, 16 bp, Homo sapiens
aggtgggctgagccct

SEQ ID NO: 4164295 - DNA, 19 bp, Homo sapiens
aggtgggctgagccctggc

SEQ ID NO: 4164296 - DNA, 19 bp, Homo sapiens
aggtggttctaatattttt

SEQ ID NO: 4164297 - DNA, 13 bp, Homo sapiens
aggtgtaataaga

SEQ ID NO: 4164298 - DNA, 20 bp, Homo sapiens
aggtgtagccacaccaggat

SEQ ID NO: 4164299 - DNA, 15 bp, Homo sapiens
aggtgtcaccctgca

SEQ ID NO: 4164300 - DNA, 18 bp, Homo sapiens
aggtgtcaccctgcagag

SEQ ID NO: 4164301 - DNA, 21 bp, Homo sapiens
aggtgtcaccctgcagagcta

SEQ ID NO: 4164302 - DNA, 14 bp, Homo sapiens
aggtgtctgcaccc

SEQ ID NO: 4164303 - DNA, 14 bp, Homo sapiens
aggttcaacttatt

SEQ ID NO: 4164304 - DNA, 13 bp, Homo sapiens
aggttctaggtcc

SEQ ID NO: 4164305 - DNA, 16 bp, Homo sapiens
aggttctaggtcctgg

SEQ ID NO: 4164306 - DNA, 19 bp, Homo sapiens
aggttctggggctgggcct

SEQ ID NO: 4164307 - DNA, 23 bp, Homo sapiens
aggttctggggctgggcctgagc

SEQ ID NO: 4164308 - DNA, 17 bp, Homo sapiens
aggttgaggggctcctg

SEQ ID NO: 4164309 - DNA, 12 bp, Homo sapiens
aggttgcagtga

SEQ ID NO: 4164310 - DNA, 18 bp, Homo sapiens
aggttgccaatgtctgat

SEQ ID NO: 4164311 - DNA, 13 bp, Homo sapiens
aggtttaaaacag

SEQ ID NO: 4164312 - DNA, 14 bp, Homo sapiens
aggtttatgaaaaa

SEQ ID NO: 4164313 - DNA, 18 bp, Homo sapiens
aggtttcaagacttgata

SEQ ID NO: 4164314 - DNA, 13 bp, Homo sapiens
aggtttgctgtgt

SEQ ID NO: 4164315 - DNA, 18 bp, Homo sapiens
aggtttgctgtgtctcac

SEQ ID NO: 4164316 - DNA, 22 bp, Homo sapiens
aggtttggggagggggaagaga

SEQ ID NO: 4164317 - DNA, 13 bp, Homo sapiens
aggtttgtcaaca

SEQ ID NO: 4164318 - DNA, 17 bp, Homo sapiens
aggtttgtcaacaaaaa

SEQ ID NO: 4164319 - DNA, 21 bp, Homo sapiens
aggtttgtcaacacaaagaca

SEQ ID NO: 4164320 - DNA, 17 bp, Homo sapiens
aggttttgttgttttat

SEQ ID NO: 4164321 - DNA, 12 bp, Homo sapiens
agtaaaagttat

SEQ ID NO: 4164322 - DNA, 17 bp, Homo sapiens
agtaaaagttatatcta

SEQ ID NO: 4164323 - DNA, 19 bp, Homo sapiens
agtaaataaattgtttgac

SEQ ID NO: 4164324 - DNA, 15 bp, Homo sapiens
agtaacactggcctt

SEQ ID NO: 4164325 - DNA, 20 bp, Homo sapiens
agtaagtaccactcaggcca

SEQ ID NO: 4164326 - DNA, 23 bp, Homo sapiens
agtaatttagaaatcattttgca

SEQ ID NO: 4164327 - DNA, 22 bp, Homo sapiens
agtaatttattgtctgtctaca

SEQ ID NO: 4164328 - DNA, 20 bp, Homo sapiens
agtacaataataaatcctca

SEQ ID NO: 4164329 - DNA, 21 bp, Homo sapiens
agtacagacgtctcaagactg

SEQ ID NO: 4164330 - DNA, 20 bp, Homo sapiens
agtaccaaatccacaagcca

SEQ ID NO: 4164331 - DNA, 15 bp, Homo sapiens
agtaccactcaggcc

SEQ ID NO: 4164332 - DNA, 15 bp, Homo sapiens
agtacggctgctgca

SEQ ID NO: 4164333 - DNA, 13 bp, Homo sapiens
agtagaaagaaaa

SEQ ID NO: 4164334 - DNA, 15 bp, Homo sapiens
agtagaaagaaaatg

SEQ ID NO: 4164335 - DNA, 19 bp, Homo sapiens
agtagaaagaaaatgtctg

SEQ ID NO: 4164336 - DNA, 20 bp, Homo sapiens
agtagaacaagcaacataaa

SEQ ID NO: 4164337 - DNA, 21 bp, Homo sapiens
agtagaatctcagttgatttt

SEQ ID NO: 4164338 - DNA, 18 bp, Homo sapiens
agtagatcatggcagcat

SEQ ID NO: 4164339 - DNA, 14 bp, Homo sapiens
agtagctttgggca

SEQ ID NO: 4164340 - DNA, 14 bp, Homo sapiens
agtataaaagacaa

SEQ ID NO: 4164341 - DNA, 18 bp, Homo sapiens
agtataaatggttgtctg

SEQ ID NO: 4164342 - DNA, 21 bp, Homo sapiens
agtatatgcatttttaataca

SEQ ID NO: 4164343 - DNA, 14 bp, Homo sapiens
agtatatttatagt

SEQ ID NO: 4164344 - DNA, 18 bp, Homo sapiens
agtatatttatagtcaca

SEQ ID NO: 4164345 - DNA, 15 bp, Homo sapiens
agtatatttctgaaa

SEQ ID NO: 4164346 - DNA, 22 bp, Homo sapiens
agtatctcggacctttcagctg

SEQ ID NO: 4164347 - DNA, 14 bp, Homo sapiens
agtatctctggcct

SEQ ID NO: 4164348 - DNA, 14 bp, Homo sapiens
agtatcttttaaaa

SEQ ID NO: 4164349 - DNA, 19 bp, Homo sapiens
agtatgatttttacaataa

SEQ ID NO: 4164350 - DNA, 16 bp, Homo sapiens
agtatgtaaagtatgt

SEQ ID NO: 4164351 - DNA, 12 bp, Homo sapiens
agtattcttcat

SEQ ID NO: 4164352 - DNA, 20 bp, Homo sapiens
agtattttagtgaacttgaa

SEQ ID NO: 4164353 - DNA, 14 bp, Homo sapiens
agtattttatttgt

SEQ ID NO: 4164354 - DNA, 22 bp, Homo sapiens
agtcaaatttgaaaataattgt

SEQ ID NO: 4164355 - DNA, 21 bp, Homo sapiens
agtcaacactcttcttgagca

SEQ ID NO: 4164356 - DNA, 15 bp, Homo sapiens
agtcaagatacatag

SEQ ID NO: 4164357 - DNA, 17 bp, Homo sapiens
agtcaagatcaacattc

SEQ ID NO: 4164358 - DNA, 13 bp, Homo sapiens
agtcaaggagatg

SEQ ID NO: 4164359 - DNA, 12 bp, Homo sapiens
agtcacaaagac

SEQ ID NO: 4164360 - DNA, 16 bp, Homo sapiens
agtcacccatgaagac

SEQ ID NO: 4164361 - DNA, 21 bp, Homo sapiens
agtcagacatttggtatatta

SEQ ID NO: 4164362 - DNA, 14 bp, Homo sapiens
agtcagatgcccag

SEQ ID NO: 4164363 - DNA, 15 bp, Homo sapiens
aggagctctctgctg

SEQ ID NO: 4164364 - DNA, 14 bp, Homo sapiens
aggaggaaaagaca

SEQ ID NO: 4164365 - DNA, 15 bp, Homo sapiens
aggaggaaaagacag

SEQ ID NO: 4164366 - DNA, 17 bp, Homo sapiens
aggaggcgaataaatgt

SEQ ID NO: 4164367 - DNA, 20 bp, Homo sapiens
aggaggcttggaaagcatca

SEQ ID NO: 4164368 - DNA, 23 bp, Homo sapiens
aggagggacctactgaacccaga

SEQ ID NO: 4164369 - DNA, 17 bp, Homo sapiens
aggagggtaacagaaga

SEQ ID NO: 4164370 - DNA, 15 bp, Homo sapiens
aggaggtcaagcctg

SEQ ID NO: 4164371 - DNA, 14 bp, Homo sapiens
aggagtcagatggc

SEQ ID NO: 4164372 - DNA, 21 bp, Homo sapiens
aggagtgagatcattttctta

SEQ ID NO: 4164373 - DNA, 16 bp, Homo sapiens
aggagttaagagtagc

SEQ ID NO: 4164374 - DNA, 14 bp, Homo sapiens
aggatagagactgg

SEQ ID NO: 4164375 - DNA, 19 bp, Homo sapiens
aggatcactggagcccagg

SEQ ID NO: 4164376 - DNA, 13 bp, Homo sapiens
aggatcctggaac

SEQ ID NO: 4164377 - DNA, 22 bp, Homo sapiens
aggatctagaatgtgttttctg

SEQ ID NO: 4164378 - DNA, 16 bp, Homo sapiens
aggatctctgaaacat

SEQ ID NO: 4164379 - DNA, 22 bp, Homo sapiens
aggatctgcccacacctcggcc

SEQ ID NO: 4164380 - DNA, 16 bp, Homo sapiens
aggatggttctgtgac

SEQ ID NO: 4164381 - DNA, 18 bp, Homo sapiens
aggatgtgtttgctttct

SEQ ID NO: 4164382 - DNA, 14 bp, Homo sapiens
aggatgtttttcat

SEQ ID NO: 4164383 - DNA, 13 bp, Homo sapiens
aggattaatttat

SEQ ID NO: 4164384 - DNA, 22 bp, Homo sapiens
aggattgaagagcattgcatgg

SEQ ID NO: 4164385 - DNA, 16 bp, Homo sapiens
aggattgcaggtgcct

SEQ ID NO: 4164386 - DNA, 20 bp, Homo sapiens
aggattgcaggtgcctggct

SEQ ID NO: 4164387 - DNA, 14 bp, Homo sapiens
aggcaagagacaga

SEQ ID NO: 4164388 - DNA, 19 bp, Homo sapiens
aggcactgcaaaccgccac

SEQ ID NO: 4164389 - DNA, 15 bp, Homo sapiens
aggcactgtggccct

SEQ ID NO: 4164390 - DNA, 19 bp, Homo sapiens
aggcactgtggcccttctg

SEQ ID NO: 4164391 - DNA, 18 bp, Homo sapiens
aggcagacgtggggaggg

SEQ ID NO: 4164392 - DNA, 13 bp, Homo sapiens
aggcagagaaaga

SEQ ID NO: 4164393 - DNA, 17 bp, Homo sapiens
aggcagagaaagaagag

SEQ ID NO: 4164394 - DNA, 22 bp, Homo sapiens
aggcagagaaagaagagacagg

SEQ ID NO: 4164395 - DNA, 11 bp, Homo sapiens
aggcagcctgc

SEQ ID NO: 4164396 - DNA, 14 bp, Homo sapiens
aggcagcttctctg

SEQ ID NO: 4164397 - DNA, 15 bp, Homo sapiens
aggcaggctcccagg

SEQ ID NO: 4164398 - DNA, 18 bp, Homo sapiens
aggcagggacagagatgg

SEQ ID NO: 4164399 - DNA, 18 bp, Homo sapiens
aggcaggggtgggagagc

SEQ ID NO: 4164400 - DNA, 19 bp, Homo sapiens
aggcaggggtgggagagcc

SEQ ID NO: 4164401 - DNA, 16 bp, Homo sapiens
aggcagttgaacctga

SEQ ID NO: 4164402 - DNA, 23 bp, Homo sapiens
aggcatacctgtcctagcaggat

SEQ ID NO: 4164403 - DNA, 13 bp, Homo sapiens
aggcatagaggga

SEQ ID NO: 4164404 - DNA, 21 bp, Homo sapiens
aggcatccatagtgcactagc

SEQ ID NO: 4164405 - DNA, 14 bp, Homo sapiens
aggcatgcctggga

SEQ ID NO: 4164406 - DNA, 14 bp, Homo sapiens
aggcatgctggcct

SEQ ID NO: 4164407 - DNA, 14 bp, Homo sapiens
aggccaagagcaga

SEQ ID NO: 4164408 - DNA, 20 bp, Homo sapiens
aggccaagagcagaggcagc

SEQ ID NO: 4164409 - DNA, 21 bp, Homo sapiens
aggccacaccatctcctttca

SEQ ID NO: 4164410 - DNA, 22 bp, Homo sapiens
aggccacaccatctcctttcag

SEQ ID NO: 4164411 - DNA, 22 bp, Homo sapiens
aggccaccatattcagtgctgt

SEQ ID NO: 4164412 - DNA, 19 bp, Homo sapiens
aggccacgctcaggcccgg

SEQ ID NO: 4164413 - DNA, 18 bp, Homo sapiens
aggccaggccaccaggat

SEQ ID NO: 4164414 - DNA, 14 bp, Homo sapiens
aggccagtgggcct

SEQ ID NO: 4164415 - DNA, 17 bp, Homo sapiens
aggccagtgggcctggt

SEQ ID NO: 4164416 - DNA, 13 bp, Homo sapiens
aggcccagcagac

SEQ ID NO: 4164417 - DNA, 13 bp, Homo sapiens
aggcccagcctgt

SEQ ID NO: 4164418 - DNA, 21 bp, Homo sapiens
aggcccagcctgtcctggtac

SEQ ID NO: 4164419 - DNA, 19 bp, Homo sapiens
aggcctcactcaagcctga

SEQ ID NO: 4164420 - DNA, 21 bp, Homo sapiens
aggcctcgtaccagccaggat

SEQ ID NO: 4164421 - DNA, 14 bp, Homo sapiens
aggcctggccaggc

SEQ ID NO: 4164422 - DNA, 12 bp, Homo sapiens
aggcgaataaat

SEQ ID NO: 4164423 - DNA, 14 bp, Homo sapiens
aggcgaataaatgt

SEQ ID NO: 4164424 - DNA, 16 bp, Homo sapiens
aggcgaataaatgttc

SEQ ID NO: 4164425 - DNA, 21 bp, Homo sapiens
aggcgaataaatgttcaaact

SEQ ID NO: 4164426 - DNA, 17 bp, Homo sapiens
aggcgagtgccaggact

SEQ ID NO: 4164427 - DNA, 17 bp, Homo sapiens
aggcgattttgtctacc

SEQ ID NO: 4164428 - DNA, 21 bp, Homo sapiens
aggcgcagtgcttctctacag

SEQ ID NO: 4164429 - DNA, 20 bp, Homo sapiens
aggcgcgtctgccccaccct

SEQ ID NO: 4164430 - DNA, 16 bp, Homo sapiens
aggcggctccaggtcc

SEQ ID NO: 4164431 - DNA, 21 bp, Homo sapiens
aggcgggaggggcagaacaga

SEQ ID NO: 4164432 - DNA, 12 bp, Homo sapiens
aggctaattttt

SEQ ID NO: 4164433 - DNA, 19 bp, Homo sapiens
aggctatgtaatgtaaata

SEQ ID NO: 4164434 - DNA, 20 bp, Homo sapiens
aggctcccactgcccctgca

SEQ ID NO: 4164435 - DNA, 21 bp, Homo sapiens
aggctcggccgtgggccggga

SEQ ID NO: 4164436 - DNA, 16 bp, Homo sapiens
aggctctattgagcca

SEQ ID NO: 4164437 - DNA, 17 bp, Homo sapiens
aggctctattgagccaa

SEQ ID NO: 4164438 - DNA, 15 bp, Homo sapiens
aggctctgcctggag

SEQ ID NO: 4164439 - DNA, 16 bp, Homo sapiens
aggctctgcctggagg

SEQ ID NO: 4164440 - DNA, 22 bp, Homo sapiens
aggctctttggggtcagccagg

SEQ ID NO: 4164441 - DNA, 15 bp, Homo sapiens
aggctgagacaggag

SEQ ID NO: 4164442 - DNA, 18 bp, Homo sapiens
aggctgagacaggagaat

SEQ ID NO: 4164443 - DNA, 18 bp, Homo sapiens
aggctgcccaatctgagc

SEQ ID NO: 4164444 - DNA, 18 bp, Homo sapiens
aggctgtggggtctggct

SEQ ID NO: 4164445 - DNA, 20 bp, Homo sapiens
aggctgtggggtctggctgt

SEQ ID NO: 4164446 - DNA, 20 bp, Homo sapiens
aggctgtgtttggctttcag

SEQ ID NO: 4164447 - DNA, 14 bp, Homo sapiens
aggcttagagagga

SEQ ID NO: 4164448 - DNA, 17 bp, Homo sapiens
aggcttaggtgccaggc

SEQ ID NO: 4164449 - DNA, 13 bp, Homo sapiens
aggcttccttggc

SEQ ID NO: 4164450 - DNA, 14 bp, Homo sapiens
aggctttagaagag

SEQ ID NO: 4164451 - DNA, 15 bp, Homo sapiens
aggctttagaagaga

SEQ ID NO: 4164452 - DNA, 13 bp, Homo sapiens
agggaaagaaatt

SEQ ID NO: 4164453 - DNA, 18 bp, Homo sapiens
agggaacactcatccctg

SEQ ID NO: 4164454 - DNA, 20 bp, Homo sapiens
agggaaccgtctgtttttaa

SEQ ID NO: 4164455 - DNA, 19 bp, Homo sapiens
agggaacggggtccttcaa

SEQ ID NO: 4164456 - DNA, 15 bp, Homo sapiens
agggaagacaggtct

SEQ ID NO: 4164457 - DNA, 13 bp, Homo sapiens
agggaagcaggga

SEQ ID NO: 4164458 - DNA, 13 bp, Homo sapiens
agggaagcctgac

SEQ ID NO: 4164459 - DNA, 14 bp, Homo sapiens
agggaagcctgact

SEQ ID NO: 4164460 - DNA, 15 bp, Homo sapiens
agggaagcctgactg

SEQ ID NO: 4164461 - DNA, 16 bp, Homo sapiens
agggaagcctgactgc

SEQ ID NO: 4164462 - DNA, 12 bp, Homo sapiens
agggaaggagct

SEQ ID NO: 4164463 - DNA, 15 bp, Homo sapiens
agggaaggagctgtt

SEQ ID NO: 4164464 - DNA, 19 bp, Homo sapiens
agggaatccgcctgcagag

SEQ ID NO: 4164465 - DNA, 15 bp, Homo sapiens
agggaatttcaggaa

SEQ ID NO: 4164466 - DNA, 21 bp, Homo sapiens
agggacacacagtgacaaaag

SEQ ID NO: 4164467 - DNA, 16 bp, Homo sapiens
agggacagtattctca

SEQ ID NO: 4164468 - DNA, 16 bp, Homo sapiens
agggaccttcatgccc

SEQ ID NO: 4164469 - DNA, 22 bp, Homo sapiens
agggaccttcatgcccttctga

SEQ ID NO: 4164470 - DNA, 18 bp, Homo sapiens
agggactggaaccaggga

SEQ ID NO: 4164471 - DNA, 14 bp, Homo sapiens
agggagaggaagca

SEQ ID NO: 4164472 - DNA, 16 bp, Homo sapiens
agggagcaactctcca

SEQ ID NO: 4164473 - DNA, 13 bp, Homo sapiens
agggagctgctgg

SEQ ID NO: 4164474 - DNA, 19 bp, Homo sapiens
agggatcttgcattcccag

SEQ ID NO: 4164475 - DNA, 22 bp, Homo sapiens
agggatcttgcattcccagtgg

SEQ ID NO: 4164476 - DNA, 17 bp, Homo sapiens
agggatgctgcctgagt

SEQ ID NO: 4164477 - DNA, 19 bp, Homo sapiens
agggatgctgcctgagtca

SEQ ID NO: 4164478 - DNA, 21 bp, Homo sapiens
agggattctggtcttcactgc

SEQ ID NO: 4164479 - DNA, 22 bp, Homo sapiens
agggattctggtcttcactgcc

SEQ ID NO: 4164480 - DNA, 13 bp, Homo sapiens
agggcaagggcca

SEQ ID NO: 4164481 - DNA, 14 bp, Homo sapiens
agggcaagggccat

SEQ ID NO: 4164482 - DNA, 14 bp, Homo sapiens
agggcaatcagcaa

SEQ ID NO: 4164483 - DNA, 11 bp, Homo sapiens
agggcacaaaa

SEQ ID NO: 4164484 - DNA, 18 bp, Homo sapiens
agggcactgtctgcgtga

SEQ ID NO: 4164485 - DNA, 17 bp, Homo sapiens
agggcagaaggggaaga

SEQ ID NO: 4164486 - DNA, 15 bp, Homo sapiens
agggcagagccggga

SEQ ID NO: 4164487 - DNA, 15 bp, Homo sapiens
agggcagccctgcct

SEQ ID NO: 4164488 - DNA, 20 bp, Homo sapiens
agggccaagcgggggcgtgg

SEQ ID NO: 4164489 - DNA, 12 bp, Homo sapiens
agggccagggcc

SEQ ID NO: 4164490 - DNA, 15 bp, Homo sapiens
agggccagggccctg

SEQ ID NO: 4164491 - DNA, 21 bp, Homo sapiens
agggccaggggtctccctgga

SEQ ID NO: 4164492 - DNA, 14 bp, Homo sapiens
agggcccaggcagg

SEQ ID NO: 4164493 - DNA, 15 bp, Homo sapiens
agggcccaggcaggc

SEQ ID NO: 4164494 - DNA, 14 bp, Homo sapiens
agggctactcagca

SEQ ID NO: 4164495 - DNA, 14 bp, Homo sapiens
agggctccctcctg

SEQ ID NO: 4164496 - DNA, 17 bp, Homo sapiens
agggctccctcctggag

SEQ ID NO: 4164497 - DNA, 18 bp, Homo sapiens
agggctccctcctggagc

SEQ ID NO: 4164498 - DNA, 19 bp, Homo sapiens
agggctccctcctggagca

SEQ ID NO: 4164499 - DNA, 22 bp, Homo sapiens
agggctccctcctggagcatcc

SEQ ID NO: 4164500 - DNA, 14 bp, Homo sapiens
agggctgcccctgt

SEQ ID NO: 4164501 - DNA, 12 bp, Homo sapiens
agggctgctgtg

SEQ ID NO: 4164502 - DNA, 23 bp, Homo sapiens
agggcttggtggccaagcctggc

SEQ ID NO: 4164503 - DNA, 17 bp, Homo sapiens
agcgggtgggtgggtgt

SEQ ID NO: 4164504 - DNA, 13 bp, Homo sapiens
agcggttgcttct

SEQ ID NO: 4164505 - DNA, 13 bp, Homo sapiens
agcgtgtgtatcc

SEQ ID NO: 4164506 - DNA, 18 bp, Homo sapiens
agcgtgtgtatccgactc

SEQ ID NO: 4164507 - DNA, 20 bp, Homo sapiens
agctacccaggaggctgagg

SEQ ID NO: 4164508 - DNA, 15 bp, Homo sapiens
agctactcagaagcc

SEQ ID NO: 4164509 - DNA, 20 bp, Homo sapiens
agctactcagaagcctgagg

SEQ ID NO: 4164510 - DNA, 16 bp, Homo sapiens
agctactgatttttgt

SEQ ID NO: 4164511 - DNA, 20 bp, Homo sapiens
agctagaattgagtgtttaa

SEQ ID NO: 4164512 - DNA, 20 bp, Homo sapiens
agctaggatggttctgtgac

SEQ ID NO: 4164513 - DNA, 15 bp, Homo sapiens
agctaggcatgcctg

SEQ ID NO: 4164514 - DNA, 13 bp, Homo sapiens
agctatggtgagg

SEQ ID NO: 4164515 - DNA, 21 bp, Homo sapiens
agctcacccaataaacattaa

SEQ ID NO: 4164516 - DNA, 11 bp, Homo sapiens
agctcagctca

SEQ ID NO: 4164517 - DNA, 14 bp, Homo sapiens
agctcagctcactg

SEQ ID NO: 4164518 - DNA, 19 bp, Homo sapiens
agctcagctcgctgcccag

SEQ ID NO: 4164519 - DNA, 22 bp, Homo sapiens
agctcaggaggcgaataaatgt

SEQ ID NO: 4164520 - DNA, 16 bp, Homo sapiens
agctcaggccctggtg

SEQ ID NO: 4164521 - DNA, 14 bp, Homo sapiens
agctcctctgagcc

SEQ ID NO: 4164522 - DNA, 17 bp, Homo sapiens
agctcctctgctgctcc

SEQ ID NO: 4164523 - DNA, 17 bp, Homo sapiens
agctctcagggctgtct

SEQ ID NO: 4164524 - DNA, 12 bp, Homo sapiens
agctctctgctg

SEQ ID NO: 4164525 - DNA, 13 bp, Homo sapiens
agctctctgctga

SEQ ID NO: 4164526 - DNA, 14 bp, Homo sapiens
agctctctgctgag

SEQ ID NO: 4164527 - DNA, 19 bp, Homo sapiens
agctctgtatggtcaggat

SEQ ID NO: 4164528 - DNA, 15 bp, Homo sapiens
agctcttaccaaaac

SEQ ID NO: 4164529 - DNA, 17 bp, Homo sapiens
agctcttaccaaaacag

SEQ ID NO: 4164530 - DNA, 23 bp, Homo sapiens
agctcttcactcagccacacccc

SEQ ID NO: 4164531 - DNA, 17 bp, Homo sapiens
agctctttcatctttta

SEQ ID NO: 4164532 - DNA, 20 bp, Homo sapiens
agctgaatgagtctgctttc

SEQ ID NO: 4164533 - DNA, 14 bp, Homo sapiens
agctgagagacttt

SEQ ID NO: 4164534 - DNA, 15 bp, Homo sapiens
agctgagagactttt

SEQ ID NO: 4164535 - DNA, 16 bp, Homo sapiens
agctgagcaaatcacc

SEQ ID NO: 4164536 - DNA, 16 bp, Homo sapiens
agctgatggagaagga

SEQ ID NO: 4164537 - DNA, 18 bp, Homo sapiens
agctgcacctgccagcct

SEQ ID NO: 4164538 - DNA, 21 bp, Homo sapiens
agctgcacctgccagcctggc

SEQ ID NO: 4164539 - DNA, 13 bp, Homo sapiens
agctgccagccgg

SEQ ID NO: 4164540 - DNA, 20 bp, Homo sapiens
agctgcctgtagttaggaaa

SEQ ID NO: 4164541 - DNA, 23 bp, Homo sapiens
agctgcctgtagttaggaaataa

SEQ ID NO: 4164542 - DNA, 12 bp, Homo sapiens
agctgctctgct

SEQ ID NO: 4164543 - DNA, 15 bp, Homo sapiens
agctgctctggaaaa

SEQ ID NO: 4164544 - DNA, 13 bp, Homo sapiens
agctgctgaagag

SEQ ID NO: 4164545 - DNA, 16 bp, Homo sapiens
agctgctgaagaggca

SEQ ID NO: 4164546 - DNA, 19 bp, Homo sapiens
agctgctggctgacctggg

SEQ ID NO: 4164547 - DNA, 21 bp, Homo sapiens
agctgctggctgacctgggcc

SEQ ID NO: 4164548 - DNA, 12 bp, Homo sapiens
agctggaaataa

SEQ ID NO: 4164549 - DNA, 19 bp, Homo sapiens
agctggaaataaacctgga

SEQ ID NO: 4164550 - DNA, 12 bp, Homo sapiens
agctggaagcac

SEQ ID NO: 4164551 - DNA, 14 bp, Homo sapiens
agctggacaagaag

SEQ ID NO: 4164552 - DNA, 17 bp, Homo sapiens
agctggacaagaagctg

SEQ ID NO: 4164553 - DNA, 20 bp, Homo sapiens
agctggacaagaagctgcta

SEQ ID NO: 4164554 - DNA, 15 bp, Homo sapiens
agctggatgcagtgg

SEQ ID NO: 4164555 - DNA, 17 bp, Homo sapiens
agctggggctgccagcc

SEQ ID NO: 4164556 - DNA, 15 bp, Homo sapiens
agctgggggaagggt

SEQ ID NO: 4164557 - DNA, 15 bp, Homo sapiens
agctggtggctaggt

SEQ ID NO: 4164558 - DNA, 15 bp, Homo sapiens
agctgtaaaaagaga

SEQ ID NO: 4164559 - DNA, 17 bp, Homo sapiens
agctgtagctcccgagc

SEQ ID NO: 4164560 - DNA, 21 bp, Homo sapiens
agctgtagtagccctttctgt

SEQ ID NO: 4164561 - DNA, 14 bp, Homo sapiens
agctgtcattcagg

SEQ ID NO: 4164562 - DNA, 17 bp, Homo sapiens
agctgtgaacatggact

SEQ ID NO: 4164563 - DNA, 19 bp, Homo sapiens
agctgtgcttatggtacca

SEQ ID NO: 4164564 - DNA, 13 bp, Homo sapiens
agctgtgtgcagg

SEQ ID NO: 4164565 - DNA, 16 bp, Homo sapiens
agctgttggggcaggg

SEQ ID NO: 4164566 - DNA, 17 bp, Homo sapiens
agctgttggggcagggg

SEQ ID NO: 4164567 - DNA, 19 bp, Homo sapiens
agctgttttagctgaggga

SEQ ID NO: 4164568 - DNA, 14 bp, Homo sapiens
agcttaaaactttg

SEQ ID NO: 4164569 - DNA, 22 bp, Homo sapiens
agcttaaaactttgaagttagc

SEQ ID NO: 4164570 - DNA, 22 bp, Homo sapiens
agcttaatggctgataatttta

SEQ ID NO: 4164571 - DNA, 16 bp, Homo sapiens
agcttcagaagtttgg

SEQ ID NO: 4164572 - DNA, 16 bp, Homo sapiens
agcttccccaggagct

SEQ ID NO: 4164573 - DNA, 17 bp, Homo sapiens
agcttctattaaatgta

SEQ ID NO: 4164574 - DNA, 12 bp, Homo sapiens
agcttctccagg

SEQ ID NO: 4164575 - DNA, 23 bp, Homo sapiens
agcttctccaggctctttggggt

SEQ ID NO: 4164576 - DNA, 13 bp, Homo sapiens
agcttgagcctga

SEQ ID NO: 4164577 - DNA, 16 bp, Homo sapiens
agcttgagggacaatg

SEQ ID NO: 4164578 - DNA, 14 bp, Homo sapiens
agcttgctgagggg

SEQ ID NO: 4164579 - DNA, 21 bp, Homo sapiens
agcttgctgaggggcagggag

SEQ ID NO: 4164580 - DNA, 21 bp, Homo sapiens
agctttcccaaataaactcta

SEQ ID NO: 4164581 - DNA, 13 bp, Homo sapiens
agctttctccttt

SEQ ID NO: 4164582 - DNA, 17 bp, Homo sapiens
agcttttattgtataaa

SEQ ID NO: 4164583 - DNA, 19 bp, Homo sapiens
agcttttattgtataaact

SEQ ID NO: 4164584 - DNA, 18 bp, Homo sapiens
aggaaaaaataagagata

SEQ ID NO: 4164585 - DNA, 23 bp, Homo sapiens
aggaaaaagaaaaacatttcctc

SEQ ID NO: 4164586 - DNA, 22 bp, Homo sapiens
aggaaaactcttggcctctgct

SEQ ID NO: 4164587 - DNA, 17 bp, Homo sapiens
aggaaaatgtacatact

SEQ ID NO: 4164588 - DNA, 14 bp, Homo sapiens
aggaaaattgaatg

SEQ ID NO: 4164589 - DNA, 12 bp, Homo sapiens
aggaaacctggc

SEQ ID NO: 4164590 - DNA, 18 bp, Homo sapiens
aggaaagaaaactaacaa

SEQ ID NO: 4164591 - DNA, 14 bp, Homo sapiens
aggaaagggaagcc

SEQ ID NO: 4164592 - DNA, 16 bp, Homo sapiens
aggaaagggaagcctg

SEQ ID NO: 4164593 - DNA, 17 bp, Homo sapiens
aggaaagggaagcctga

SEQ ID NO: 4164594 - DNA, 16 bp, Homo sapiens
aggaaataaaaccttt

SEQ ID NO: 4164595 - DNA, 17 bp, Homo sapiens
aggaaataaaacctttc

SEQ ID NO: 4164596 - DNA, 22 bp, Homo sapiens
aggaaataaaacctttcaaatt

SEQ ID NO: 4164597 - DNA, 12 bp, Homo sapiens
aggaaatatcat

SEQ ID NO: 4164598 - DNA, 23 bp, Homo sapiens
aggaacactggaaaataaatttt

SEQ ID NO: 4164599 - DNA, 13 bp, Homo sapiens
aggaacagaacac

SEQ ID NO: 4164600 - DNA, 14 bp, Homo sapiens
aggaactcccagca

SEQ ID NO: 4164601 - DNA, 13 bp, Homo sapiens
aggaactctggct

SEQ ID NO: 4164602 - DNA, 19 bp, Homo sapiens
aggaactctggcttccagg

SEQ ID NO: 4164603 - DNA, 21 bp, Homo sapiens
aggaactctggcttccaggta

SEQ ID NO: 4164604 - DNA, 13 bp, Homo sapiens
aggaactggctcc

SEQ ID NO: 4164605 - DNA, 23 bp, Homo sapiens
aggaagaatgggctgcagaagat

SEQ ID NO: 4164606 - DNA, 14 bp, Homo sapiens
aggaagagaaggag

SEQ ID NO: 4164607 - DNA, 16 bp, Homo sapiens
aggaagagaaggagca

SEQ ID NO: 4164608 - DNA, 19 bp, Homo sapiens
aggaagattaaaaccacag

SEQ ID NO: 4164609 - DNA, 15 bp, Homo sapiens
aggaagcaagcttaa

SEQ ID NO: 4164610 - DNA, 11 bp, Homo sapiens
aggaaggaaaa

SEQ ID NO: 4164611 - DNA, 16 bp, Homo sapiens
aggaaggcagggagga

SEQ ID NO: 4164612 - DNA, 20 bp, Homo sapiens
aggaaggcagggaggaggca

SEQ ID NO: 4164613 - DNA, 19 bp, Homo sapiens
aggaaggcttgttgtgctt

SEQ ID NO: 4164614 - DNA, 18 bp, Homo sapiens
aggaagggcatccttctg

SEQ ID NO: 4164615 - DNA, 20 bp, Homo sapiens
aggaagggcatccttctgcc

SEQ ID NO: 4164616 - DNA, 15 bp, Homo sapiens
aggaataggcaaaat

SEQ ID NO: 4164617 - DNA, 17 bp, Homo sapiens
aggaatatgactcagga

SEQ ID NO: 4164618 - DNA, 20 bp, Homo sapiens
aggaatatgactcaggagcc

SEQ ID NO: 4164619 - DNA, 16 bp, Homo sapiens
aggaatcggctgggga

SEQ ID NO: 4164620 - DNA, 23 bp, Homo sapiens
aggaatcggctggggactgctac

SEQ ID NO: 4164621 - DNA, 16 bp, Homo sapiens
aggaatctttaaaaga

SEQ ID NO: 4164622 - DNA, 22 bp, Homo sapiens
aggaatctttaaaagatgcttt

SEQ ID NO: 4164623 - DNA, 14 bp, Homo sapiens
aggaatgatcctag

SEQ ID NO: 4164624 - DNA, 24 bp, Homo sapiens
aggaatgcctcctccctgggcaga

SEQ ID NO: 4164625 - DNA, 21 bp, Homo sapiens
aggacaacctgcccctcccca

SEQ ID NO: 4164626 - DNA, 19 bp, Homo sapiens
aggacaatgccttgggaga

SEQ ID NO: 4164627 - DNA, 12 bp, Homo sapiens
aggacacatgtc

SEQ ID NO: 4164628 - DNA, 13 bp, Homo sapiens
aggacacatgtcc

SEQ ID NO: 4164629 - DNA, 19 bp, Homo sapiens
aggacagaacattgccttc

SEQ ID NO: 4164630 - DNA, 22 bp, Homo sapiens
aggacagaacattgccttcctc

SEQ ID NO: 4164631 - DNA, 19 bp, Homo sapiens
aggacagagctggctgtct

SEQ ID NO: 4164632 - DNA, 18 bp, Homo sapiens
aggacagtctggagaagg

SEQ ID NO: 4164633 - DNA, 15 bp, Homo sapiens
aggacagtgcttcag

SEQ ID NO: 4164634 - DNA, 16 bp, Homo sapiens
aggactatagcccagg

SEQ ID NO: 4164635 - DNA, 19 bp, Homo sapiens
aggactatagcccaggtcc

SEQ ID NO: 4164636 - DNA, 16 bp, Homo sapiens
aggactatgggtacat

SEQ ID NO: 4164637 - DNA, 16 bp, Homo sapiens
aggactccccaggcca

SEQ ID NO: 4164638 - DNA, 17 bp, Homo sapiens
aggactctgaggctctt

SEQ ID NO: 4164639 - DNA, 21 bp, Homo sapiens
aggactgtgataatcagaagc

SEQ ID NO: 4164640 - DNA, 20 bp, Homo sapiens
aggagcagcttcagttgttt

SEQ ID NO: 4164641 - DNA, 12 bp, Homo sapiens
aggagctctctg

SEQ ID NO: 4164642 - DNA, 14 bp, Homo sapiens
aggagctctctgct

SEQ ID NO: 4164643 - DNA, 14 bp, Homo sapiens
agcagaagtgacca

SEQ ID NO: 4164644 - DNA, 14 bp, Homo sapiens
agcagagcaggggc

SEQ ID NO: 4164645 - DNA, 17 bp, Homo sapiens
agcagagctgatggaga

SEQ ID NO: 4164646 - DNA, 21 bp, Homo sapiens
agcagagctgatggagaagga

SEQ ID NO: 4164647 - DNA, 13 bp, Homo sapiens
agcagatgggaca

SEQ ID NO: 4164648 - DNA, 18 bp, Homo sapiens
agcagatggtcctccatt

SEQ ID NO: 4164649 - DNA, 16 bp, Homo sapiens
agcagccccctgcccg

SEQ ID NO: 4164650 - DNA, 17 bp, Homo sapiens
agcagcttcagttgttt

SEQ ID NO: 4164651 - DNA, 19 bp, Homo sapiens
agcaggaaggatggcaagc

SEQ ID NO: 4164652 - DNA, 17 bp, Homo sapiens
agcaggagcagaaagat

SEQ ID NO: 4164653 - DNA, 20 bp, Homo sapiens
agcaggcacttgattccttg

SEQ ID NO: 4164654 - DNA, 11 bp, Homo sapiens
agcaggcaggg

SEQ ID NO: 4164655 - DNA, 21 bp, Homo sapiens
agcaggccttagtacggctgc

SEQ ID NO: 4164656 - DNA, 18 bp, Homo sapiens
agcaggctcagactctgg

SEQ ID NO: 4164657 - DNA, 17 bp, Homo sapiens
agcaggtgtaataagac

SEQ ID NO: 4164658 - DNA, 22 bp, Homo sapiens
agcaggttgaggggctcctgga

SEQ ID NO: 4164659 - DNA, 14 bp, Homo sapiens
agcagtaagcaggc

SEQ ID NO: 4164660 - DNA, 14 bp, Homo sapiens
agcagtactctgaa

SEQ ID NO: 4164661 - DNA, 15 bp, Homo sapiens
agcagttaactttaa

SEQ ID NO: 4164662 - DNA, 22 bp, Homo sapiens
agcagttaactttaagactgag

SEQ ID NO: 4164663 - DNA, 14 bp, Homo sapiens
agcatcacctcagg

SEQ ID NO: 4164664 - DNA, 15 bp, Homo sapiens
agcatcacctcaggc

SEQ ID NO: 4164665 - DNA, 19 bp, Homo sapiens
agcatcacctcaggccagg

SEQ ID NO: 4164666 - DNA, 20 bp, Homo sapiens
agcatcacctcaggccaggt

SEQ ID NO: 4164667 - DNA, 20 bp, Homo sapiens
agcatccccttgaactcttc

SEQ ID NO: 4164668 - DNA, 19 bp, Homo sapiens
agcatcttgtcaagaaata

SEQ ID NO: 4164669 - DNA, 15 bp, Homo sapiens
agcatgcatctgttt

SEQ ID NO: 4164670 - DNA, 21 bp, Homo sapiens
agcatgggactgtgcctttgg

SEQ ID NO: 4164671 - DNA, 17 bp, Homo sapiens
agcattagcacatattt

SEQ ID NO: 4164672 - DNA, 19 bp, Homo sapiens
agcattcagaagaaaaaga

SEQ ID NO: 4164673 - DNA, 21 bp, Homo sapiens
agcattcagaagaaaaagaag

SEQ ID NO: 4164674 - DNA, 20 bp, Homo sapiens
agcattcagggttatacaca

SEQ ID NO: 4164675 - DNA, 14 bp, Homo sapiens
agcattcttagact

SEQ ID NO: 4164676 - DNA, 21 bp, Homo sapiens
agcattcttagactagttgaa

SEQ ID NO: 4164677 - DNA, 19 bp, Homo sapiens
agcattttatatccacatc

SEQ ID NO: 4164678 - DNA, 20 bp, Homo sapiens
agcattttattactgtaata

SEQ ID NO: 4164679 - DNA, 18 bp, Homo sapiens
agcatttttgatttatgc

SEQ ID NO: 4164680 - DNA, 15 bp, Homo sapiens
agccaaaaatagcta

SEQ ID NO: 4164681 - DNA, 22 bp, Homo sapiens
agccaaaaatagctaaatacct

SEQ ID NO: 4164682 - DNA, 18 bp, Homo sapiens
agccaaaatgcagtctta

SEQ ID NO: 4164683 - DNA, 16 bp, Homo sapiens
agccaaattagaaaat

SEQ ID NO: 4164684 - DNA, 12 bp, Homo sapiens
agccaactccat

SEQ ID NO: 4164685 - DNA, 19 bp, Homo sapiens
agccaaggtgggctgagcc

SEQ ID NO: 4164686 - DNA, 19 bp, Homo sapiens
agccaatatttactcatca

SEQ ID NO: 4164687 - DNA, 14 bp, Homo sapiens
agccacaccaggat

SEQ ID NO: 4164688 - DNA, 11 bp, Homo sapiens
agccacatccc

SEQ ID NO: 4164689 - DNA, 20 bp, Homo sapiens
agccaccctgcccagtctgg

SEQ ID NO: 4164690 - DNA, 21 bp, Homo sapiens
agccactctatgagttggact

SEQ ID NO: 4164691 - DNA, 12 bp, Homo sapiens
agccactgaagc

SEQ ID NO: 4164692 - DNA, 22 bp, Homo sapiens
agccagaatcttcgtcctgccc

SEQ ID NO: 4164693 - DNA, 17 bp, Homo sapiens
agccaggatggtctgga

SEQ ID NO: 4164694 - DNA, 13 bp, Homo sapiens
agccaggctctgc

SEQ ID NO: 4164695 - DNA, 13 bp, Homo sapiens
agccagggccagg

SEQ ID NO: 4164696 - DNA, 14 bp, Homo sapiens
agccagggccaggg

SEQ ID NO: 4164697 - DNA, 18 bp, Homo sapiens
agccaggtaatgagggac

SEQ ID NO: 4164698 - DNA, 23 bp, Homo sapiens
agccaggtaatgagggactggaa

SEQ ID NO: 4164699 - DNA, 22 bp, Homo sapiens
agccatctctctactcctacct

SEQ ID NO: 4164700 - DNA, 15 bp, Homo sapiens
agccatgtttcacaa

SEQ ID NO: 4164701 - DNA, 18 bp, Homo sapiens
agccattaccatggagac

SEQ ID NO: 4164702 - DNA, 17 bp, Homo sapiens
agccattcctgttctct

SEQ ID NO: 4164703 - DNA, 22 bp, Homo sapiens
agccattcctgttctctttgcc

SEQ ID NO: 4164704 - DNA, 19 bp, Homo sapiens
agccatttccatggctctg

SEQ ID NO: 4164705 - DNA, 18 bp, Homo sapiens
agccatttgttggggcag

SEQ ID NO: 4164706 - DNA, 19 bp, Homo sapiens
agccattttttgaggagag

SEQ ID NO: 4164707 - DNA, 23 bp, Homo sapiens
agcccaacagacaccatcttttg

SEQ ID NO: 4164708 - DNA, 22 bp, Homo sapiens
agcccaccccttctccatcttt

SEQ ID NO: 4164709 - DNA, 23 bp, Homo sapiens
agcccaccccttctccatctttg

SEQ ID NO: 4164710 - DNA, 22 bp, Homo sapiens
agcccacgcccgactagcaggc

SEQ ID NO: 4164711 - DNA, 20 bp, Homo sapiens
agcccacggggatcacagcg

SEQ ID NO: 4164712 - DNA, 23 bp, Homo sapiens
agcccacggggatcacagcgttt

SEQ ID NO: 4164713 - DNA, 16 bp, Homo sapiens
agcccagaaccacaga

SEQ ID NO: 4164714 - DNA, 20 bp, Homo sapiens
agcccagcagggcctcaaag

SEQ ID NO: 4164715 - DNA, 19 bp, Homo sapiens
agcccagctctttgttcag

SEQ ID NO: 4164716 - DNA, 23 bp, Homo sapiens
agcccaggtcctctgatacccag

SEQ ID NO: 4164717 - DNA, 21 bp, Homo sapiens
agcccatctctccagagagca

SEQ ID NO: 4164718 - DNA, 13 bp, Homo sapiens
agcccatttcaat

SEQ ID NO: 4164719 - DNA, 21 bp, Homo sapiens
agccccgacccctgtccagcg

SEQ ID NO: 4164720 - DNA, 15 bp, Homo sapiens
agccccgcgcctcct

SEQ ID NO: 4164721 - DNA, 23 bp, Homo sapiens
agccccttgctctcccctgccct

SEQ ID NO: 4164722 - DNA, 15 bp, Homo sapiens
agcccgcttcaagct

SEQ ID NO: 4164723 - DNA, 24 bp, Homo sapiens
agcccgcttcaagctctctgttgc

SEQ ID NO: 4164724 - DNA, 14 bp, Homo sapiens
agccctaaacatca

SEQ ID NO: 4164725 - DNA, 23 bp, Homo sapiens
agccctccctggcatgtcagagc

SEQ ID NO: 4164726 - DNA, 13 bp, Homo sapiens
agccctggcagga

SEQ ID NO: 4164727 - DNA, 14 bp, Homo sapiens
agcccttccctgcc

SEQ ID NO: 4164728 - DNA, 18 bp, Homo sapiens
agcccttggcttctgctt

SEQ ID NO: 4164729 - DNA, 16 bp, Homo sapiens
agccctttctgtgtgc

SEQ ID NO: 4164730 - DNA, 18 bp, Homo sapiens
agccctttctgtgtgcac

SEQ ID NO: 4164731 - DNA, 18 bp, Homo sapiens
agccgagatcacgccact

SEQ ID NO: 4164732 - DNA, 18 bp, Homo sapiens
agccgcagcctccctctg

SEQ ID NO: 4164733 - DNA, 15 bp, Homo sapiens
agccgcagcgcagcc

SEQ ID NO: 4164734 - DNA, 19 bp, Homo sapiens
agccgggcacccccaacct

SEQ ID NO: 4164735 - DNA, 22 bp, Homo sapiens
agccgggcgtggtggcgggcac

SEQ ID NO: 4164736 - DNA, 13 bp, Homo sapiens
agccgtgagcatg

SEQ ID NO: 4164737 - DNA, 21 bp, Homo sapiens
agccgtgcctttctctggctc

SEQ ID NO: 4164738 - DNA, 15 bp, Homo sapiens
agcctaatacaacat

SEQ ID NO: 4164739 - DNA, 14 bp, Homo sapiens
agcctacagcagtg

SEQ ID NO: 4164740 - DNA, 15 bp, Homo sapiens
agcctacagcagtgt

SEQ ID NO: 4164741 - DNA, 18 bp, Homo sapiens
agcctagaacatccctgg

SEQ ID NO: 4164742 - DNA, 19 bp, Homo sapiens
agcctagaacatccctggg

SEQ ID NO: 4164743 - DNA, 20 bp, Homo sapiens
agcctagaacatccctgggc

SEQ ID NO: 4164744 - DNA, 17 bp, Homo sapiens
agcctattagctgggat

SEQ ID NO: 4164745 - DNA, 13 bp, Homo sapiens
agcctccctctga

SEQ ID NO: 4164746 - DNA, 22 bp, Homo sapiens
agcctccctctgacctgcaggc

SEQ ID NO: 4164747 - DNA, 23 bp, Homo sapiens
agcctctccaggaatgcctcctc

SEQ ID NO: 4164748 - DNA, 22 bp, Homo sapiens
agcctctgcagcggaatctgtt

SEQ ID NO: 4164749 - DNA, 21 bp, Homo sapiens
agcctgcctccttcagtgaca

SEQ ID NO: 4164750 - DNA, 11 bp, Homo sapiens
agcctggagaa

SEQ ID NO: 4164751 - DNA, 20 bp, Homo sapiens
agcctggagcggagcttgcc

SEQ ID NO: 4164752 - DNA, 22 bp, Homo sapiens
agcctggagcggagcttgcctg

SEQ ID NO: 4164753 - DNA, 17 bp, Homo sapiens
agcctggagggatgcca

SEQ ID NO: 4164754 - DNA, 9 bp, Homo sapiens
agcctggca

SEQ ID NO: 4164755 - DNA, 21 bp, Homo sapiens
agcctggcttctggagccctt

SEQ ID NO: 4164756 - DNA, 14 bp, Homo sapiens
agcctgggcgacag

SEQ ID NO: 4164757 - DNA, 18 bp, Homo sapiens
agcctggggtgatagaac

SEQ ID NO: 4164758 - DNA, 17 bp, Homo sapiens
agcctggttttcacata

SEQ ID NO: 4164759 - DNA, 13 bp, Homo sapiens
agcctgtcctggt

SEQ ID NO: 4164760 - DNA, 23 bp, Homo sapiens
agcctgtcctggtacagcagggt

SEQ ID NO: 4164761 - DNA, 14 bp, Homo sapiens
agcctgttgagact

SEQ ID NO: 4164762 - DNA, 20 bp, Homo sapiens
agcctgttgttcccatctgc

SEQ ID NO: 4164763 - DNA, 13 bp, Homo sapiens
agccttcaagtgc

SEQ ID NO: 4164764 - DNA, 16 bp, Homo sapiens
agccttcaagtgccaa

SEQ ID NO: 4164765 - DNA, 24 bp, Homo sapiens
agccttcaagtgccaaacagagta

SEQ ID NO: 4164766 - DNA, 21 bp, Homo sapiens
agccttgccttttaaaagaaa

SEQ ID NO: 4164767 - DNA, 19 bp, Homo sapiens
agcctttattattactgtt

SEQ ID NO: 4164768 - DNA, 16 bp, Homo sapiens
agcgaatcatctcaaa

SEQ ID NO: 4164769 - DNA, 23 bp, Homo sapiens
agcgagctgagatcacaccactg

SEQ ID NO: 4164770 - DNA, 16 bp, Homo sapiens
agcgagctgctctgct

SEQ ID NO: 4164771 - DNA, 17 bp, Homo sapiens
agcgagctgctctgcta

SEQ ID NO: 4164772 - DNA, 14 bp, Homo sapiens
agcgagttgtggaa

SEQ ID NO: 4164773 - DNA, 18 bp, Homo sapiens
agcgcacctgccccctgg

SEQ ID NO: 4164774 - DNA, 16 bp, Homo sapiens
agcgcctcttcctctg

SEQ ID NO: 4164775 - DNA, 20 bp, Homo sapiens
agcgcctcttcctctgggca

SEQ ID NO: 4164776 - DNA, 14 bp, Homo sapiens
agcgcgggcggagg

SEQ ID NO: 4164777 - DNA, 19 bp, Homo sapiens
agcgcgggcggaggcggct

SEQ ID NO: 4164778 - DNA, 18 bp, Homo sapiens
agcgctggcgagatacca

SEQ ID NO: 4164779 - DNA, 19 bp, Homo sapiens
agcggagcttgcctgcctg

SEQ ID NO: 4164780 - DNA, 20 bp, Homo sapiens
agcggagcttgcctgcctgc

SEQ ID NO: 4164781 - DNA, 15 bp, Homo sapiens
agaggcacctgctgg

SEQ ID NO: 4164782 - DNA, 18 bp, Homo sapiens
agaggcagagaaagaaga

SEQ ID NO: 4164783 - DNA, 16 bp, Homo sapiens
agaggcgcgtctgccc

SEQ ID NO: 4164784 - DNA, 15 bp, Homo sapiens
agaggctatttaaaa

SEQ ID NO: 4164785 - DNA, 21 bp, Homo sapiens
agaggctggtgctgtggccag

SEQ ID NO: 4164786 - DNA, 22 bp, Homo sapiens
agaggctggtgctgtggccagg

SEQ ID NO: 4164787 - DNA, 18 bp, Homo sapiens
agagggccaagacttggc

SEQ ID NO: 4164788 - DNA, 22 bp, Homo sapiens
agaggggctaggggctggtcct

SEQ ID NO: 4164789 - DNA, 18 bp, Homo sapiens
agaggtaaaagtgtgagc

SEQ ID NO: 4164790 - DNA, 22 bp, Homo sapiens
agaggtaaaagtgtgagcagtg

SEQ ID NO: 4164791 - DNA, 17 bp, Homo sapiens
agaggtagcgagctgct

SEQ ID NO: 4164792 - DNA, 16 bp, Homo sapiens
agaggtgagaaattta

SEQ ID NO: 4164793 - DNA, 17 bp, Homo sapiens
agaggtgagaaatttaa

SEQ ID NO: 4164794 - DNA, 17 bp, Homo sapiens
agaggtgctagctctta

SEQ ID NO: 4164795 - DNA, 17 bp, Homo sapiens
agaggtggattcctggg

SEQ ID NO: 4164796 - DNA, 14 bp, Homo sapiens
agaggtttgtcaac

SEQ ID NO: 4164797 - DNA, 23 bp, Homo sapiens
agaggtttgtcaacaaaaagaca

SEQ ID NO: 4164798 - DNA, 18 bp, Homo sapiens
agaggtttgtcaacacaa

SEQ ID NO: 4164799 - DNA, 19 bp, Homo sapiens
agaggtttgtcaacacaaa

SEQ ID NO: 4164800 - DNA, 21 bp, Homo sapiens
agaggtttgtcaacacaaaga

SEQ ID NO: 4164801 - DNA, 16 bp, Homo sapiens
agagtacagtgagcca

SEQ ID NO: 4164802 - DNA, 19 bp, Homo sapiens
agagtacagtgagccaaga

SEQ ID NO: 4164803 - DNA, 12 bp, Homo sapiens
agagtagcaagt

SEQ ID NO: 4164804 - DNA, 12 bp, Homo sapiens
agagtcaggaag

SEQ ID NO: 4164805 - DNA, 18 bp, Homo sapiens
agagtctaagataaaagc

SEQ ID NO: 4164806 - DNA, 16 bp, Homo sapiens
agagtctgaacctatt

SEQ ID NO: 4164807 - DNA, 15 bp, Homo sapiens
agagtgagaccctgt

SEQ ID NO: 4164808 - DNA, 20 bp, Homo sapiens
agagtgagactcgtctcaaa

SEQ ID NO: 4164809 - DNA, 18 bp, Homo sapiens
agagtgccactgcgggag

SEQ ID NO: 4164810 - DNA, 18 bp, Homo sapiens
agagtgggctgcatctgg

SEQ ID NO: 4164811 - DNA, 23 bp, Homo sapiens
agagtgtccccagagacatgcaa

SEQ ID NO: 4164812 - DNA, 13 bp, Homo sapiens
agagttcttgccc

SEQ ID NO: 4164813 - DNA, 22 bp, Homo sapiens
agagtttaacacaagtcctgtg

SEQ ID NO: 4164814 - DNA, 13 bp, Homo sapiens
agagtttgaagga

SEQ ID NO: 4164815 - DNA, 15 bp, Homo sapiens
agataaaagcttagg

SEQ ID NO: 4164816 - DNA, 20 bp, Homo sapiens
agataaattttgacttgaaa

SEQ ID NO: 4164817 - DNA, 17 bp, Homo sapiens
agataacccttattcca

SEQ ID NO: 4164818 - DNA, 18 bp, Homo sapiens
agataactgaaaattatt

SEQ ID NO: 4164819 - DNA, 16 bp, Homo sapiens
agataatcagcctctt

SEQ ID NO: 4164820 - DNA, 17 bp, Homo sapiens
agataatcagcctctta

SEQ ID NO: 4164821 - DNA, 17 bp, Homo sapiens
agataattatcagtcat

SEQ ID NO: 4164822 - DNA, 16 bp, Homo sapiens
agatacatacagaatt

SEQ ID NO: 4164823 - DNA, 17 bp, Homo sapiens
agatacatcttataaac

SEQ ID NO: 4164824 - DNA, 23 bp, Homo sapiens
agataccagctttttctctcagg

SEQ ID NO: 4164825 - DNA, 16 bp, Homo sapiens
agatacttaagtgctg

SEQ ID NO: 4164826 - DNA, 19 bp, Homo sapiens
agatagcagaggaaaaaga

SEQ ID NO: 4164827 - DNA, 23 bp, Homo sapiens
agatatatatttactaaaagaat

SEQ ID NO: 4164828 - DNA, 15 bp, Homo sapiens
agatatatttttcac

SEQ ID NO: 4164829 - DNA, 14 bp, Homo sapiens
agatatcagtgtct

SEQ ID NO: 4164830 - DNA, 17 bp, Homo sapiens
agatattggacaaagaa

SEQ ID NO: 4164831 - DNA, 16 bp, Homo sapiens
agatcacaccactgca

SEQ ID NO: 4164832 - DNA, 17 bp, Homo sapiens
agatcagcagtggcagg

SEQ ID NO: 4164833 - DNA, 17 bp, Homo sapiens
agatcaggaagagaagg

SEQ ID NO: 4164834 - DNA, 22 bp, Homo sapiens
agatcccaagtagaatctcagt

SEQ ID NO: 4164835 - DNA, 15 bp, Homo sapiens
agatcccgcctcttc

SEQ ID NO: 4164836 - DNA, 19 bp, Homo sapiens
agatcccgcctcttcttct

SEQ ID NO: 4164837 - DNA, 23 bp, Homo sapiens
agatctctggattctaattttgg

SEQ ID NO: 4164838 - DNA, 13 bp, Homo sapiens
agatctgcttctt

SEQ ID NO: 4164839 - DNA, 23 bp, Homo sapiens
agatctgcttcttcatcttgaca

SEQ ID NO: 4164840 - DNA, 13 bp, Homo sapiens
agatctggcatgt

SEQ ID NO: 4164841 - DNA, 17 bp, Homo sapiens
agatctgggattatgta

SEQ ID NO: 4164842 - DNA, 18 bp, Homo sapiens
agatcttccgtggtcaga

SEQ ID NO: 4164843 - DNA, 22 bp, Homo sapiens
agatcttccgtggtcagagtgc

SEQ ID NO: 4164844 - DNA, 13 bp, Homo sapiens
agatctttcagga

SEQ ID NO: 4164845 - DNA, 22 bp, Homo sapiens
agatgagcgtcctaaggcatgt

SEQ ID NO: 4164846 - DNA, 12 bp, Homo sapiens
agatgatgatga

SEQ ID NO: 4164847 - DNA, 14 bp, Homo sapiens
agatgatgatgatg

SEQ ID NO: 4164848 - DNA, 17 bp, Homo sapiens
agatgatgatgatgatg

SEQ ID NO: 4164849 - DNA, 21 bp, Homo sapiens
agatgcccagagggcccaggc

SEQ ID NO: 4164850 - DNA, 18 bp, Homo sapiens
agatgctggcttgggcag

SEQ ID NO: 4164851 - DNA, 18 bp, Homo sapiens
agatgctgtcactggcag

SEQ ID NO: 4164852 - DNA, 18 bp, Homo sapiens
agatgcttttaacagagt

SEQ ID NO: 4164853 - DNA, 17 bp, Homo sapiens
agatggaaaaataacaa

SEQ ID NO: 4164854 - DNA, 15 bp, Homo sapiens
agatggaggccgagc

SEQ ID NO: 4164855 - DNA, 24 bp, Homo sapiens
agatggcaatgggtactccagcag

SEQ ID NO: 4164856 - DNA, 14 bp, Homo sapiens
agatggggtcttgc

SEQ ID NO: 4164857 - DNA, 23 bp, Homo sapiens
agatgggtctggctgagctgaac

SEQ ID NO: 4164858 - DNA, 18 bp, Homo sapiens
agatgtcagactggctgg

SEQ ID NO: 4164859 - DNA, 19 bp, Homo sapiens
agatgtgcaagtcttgtca

SEQ ID NO: 4164860 - DNA, 14 bp, Homo sapiens
agatgttactgtgt

SEQ ID NO: 4164861 - DNA, 17 bp, Homo sapiens
agattaaaaccacagaa

SEQ ID NO: 4164862 - DNA, 20 bp, Homo sapiens
agattaaaaccacagaacag

SEQ ID NO: 4164863 - DNA, 18 bp, Homo sapiens
agattaaaggaaggaaaa

SEQ ID NO: 4164864 - DNA, 13 bp, Homo sapiens
agattgagaagcc

SEQ ID NO: 4164865 - DNA, 23 bp, Homo sapiens
agattgttttatatgtagtacta

SEQ ID NO: 4164866 - DNA, 22 bp, Homo sapiens
agattgttttatcatgacatgt

SEQ ID NO: 4164867 - DNA, 14 bp, Homo sapiens
agatttaacaaata

SEQ ID NO: 4164868 - DNA, 23 bp, Homo sapiens
agatttcggtcataaagaatgta

SEQ ID NO: 4164869 - DNA, 16 bp, Homo sapiens
agatttgtgaactgga

SEQ ID NO: 4164870 - DNA, 12 bp, Homo sapiens
agattttagttc

SEQ ID NO: 4164871 - DNA, 16 bp, Homo sapiens
agattttctgctactt

SEQ ID NO: 4164872 - DNA, 13 bp, Homo sapiens
agattttttaata

SEQ ID NO: 4164873 - DNA, 14 bp, Homo sapiens
agattttttaataa

SEQ ID NO: 4164874 - DNA, 16 bp, Homo sapiens
agcaaaaggctgagaa

SEQ ID NO: 4164875 - DNA, 15 bp, Homo sapiens
agcaaagcaccagct

SEQ ID NO: 4164876 - DNA, 18 bp, Homo sapiens
agcaaaggaaaccaaagg

SEQ ID NO: 4164877 - DNA, 15 bp, Homo sapiens
agcaaagtctaaagt

SEQ ID NO: 4164878 - DNA, 18 bp, Homo sapiens
agcaaatcaccacaaact

SEQ ID NO: 4164879 - DNA, 21 bp, Homo sapiens
agcaaatcaccacaaactgta

SEQ ID NO: 4164880 - DNA, 20 bp, Homo sapiens
agcaaatcgaatgaaattaa

SEQ ID NO: 4164881 - DNA, 22 bp, Homo sapiens
agcaacaaagattgagaagcca

SEQ ID NO: 4164882 - DNA, 20 bp, Homo sapiens
agcaacagagtgagaccctg

SEQ ID NO: 4164883 - DNA, 23 bp, Homo sapiens
agcaacagagtgagaccctgtct

SEQ ID NO: 4164884 - DNA, 21 bp, Homo sapiens
agcaactacagtctaaagctg

SEQ ID NO: 4164885 - DNA, 18 bp, Homo sapiens
agcaactctccactccat

SEQ ID NO: 4164886 - DNA, 16 bp, Homo sapiens
agcaagaaggaaagat

SEQ ID NO: 4164887 - DNA, 15 bp, Homo sapiens
agcaagcattcagaa

SEQ ID NO: 4164888 - DNA, 18 bp, Homo sapiens
agcaagcattcagaagaa

SEQ ID NO: 4164889 - DNA, 22 bp, Homo sapiens
agcaagcattcagaagaaaaag

SEQ ID NO: 4164890 - DNA, 15 bp, Homo sapiens
agcaagctggatgca

SEQ ID NO: 4164891 - DNA, 13 bp, Homo sapiens
agcaaggaaacat

SEQ ID NO: 4164892 - DNA, 23 bp, Homo sapiens
agcaagggaccttcatgcccttc

SEQ ID NO: 4164893 - DNA, 20 bp, Homo sapiens
agcaagttctagagaagagg

SEQ ID NO: 4164894 - DNA, 17 bp, Homo sapiens
agcaatccatgttagtt

SEQ ID NO: 4164895 - DNA, 20 bp, Homo sapiens
agcaatccatgttagttttt

SEQ ID NO: 4164896 - DNA, 21 bp, Homo sapiens
agcaatggacctttggggaag

SEQ ID NO: 4164897 - DNA, 19 bp, Homo sapiens
agcaattagcagaagtgac

SEQ ID NO: 4164898 - DNA, 14 bp, Homo sapiens
agcaattttcgaac

SEQ ID NO: 4164899 - DNA, 20 bp, Homo sapiens
agcacactgcagggctgctg

SEQ ID NO: 4164900 - DNA, 21 bp, Homo sapiens
agcacactgcagggctgctgt

SEQ ID NO: 4164901 - DNA, 23 bp, Homo sapiens
agcacagcccacggggatcacag

SEQ ID NO: 4164902 - DNA, 12 bp, Homo sapiens
agcacaggctaa

SEQ ID NO: 4164903 - DNA, 16 bp, Homo sapiens
agcacaggctaatttt

SEQ ID NO: 4164904 - DNA, 19 bp, Homo sapiens
agcacaggttagggtgtgt

SEQ ID NO: 4164905 - DNA, 19 bp, Homo sapiens
agcacagtctgatgacaca

SEQ ID NO: 4164906 - DNA, 18 bp, Homo sapiens
agcaccccctcattcccc

SEQ ID NO: 4164907 - DNA, 21 bp, Homo sapiens
agcaccccctcattcccctcg

SEQ ID NO: 4164908 - DNA, 15 bp, Homo sapiens
agcacccctgtctct

SEQ ID NO: 4164909 - DNA, 18 bp, Homo sapiens
agcacctagtccagtgac

SEQ ID NO: 4164910 - DNA, 18 bp, Homo sapiens
agcacctgaaccactgtg

SEQ ID NO: 4164911 - DNA, 20 bp, Homo sapiens
agcactcagtctagtgaaga

SEQ ID NO: 4164912 - DNA, 14 bp, Homo sapiens
agcactgatgttgt

SEQ ID NO: 4164913 - DNA, 21 bp, Homo sapiens
agcactgctaggcgagtgcca

SEQ ID NO: 4164914 - DNA, 12 bp, Homo sapiens
agcactgctcca

SEQ ID NO: 4164915 - DNA, 21 bp, Homo sapiens
agcactttaaccctctcttcc

SEQ ID NO: 4164916 - DNA, 23 bp, Homo sapiens
agcactttaaccctctcttccct

SEQ ID NO: 4164917 - DNA, 19 bp, Homo sapiens
agcactttgggaggccaag

SEQ ID NO: 4164918 - DNA, 21 bp, Homo sapiens
agcactttgggaggccaaggt

SEQ ID NO: 4164919 - DNA, 19 bp, Homo sapiens
agaaggaaggcagggagga

SEQ ID NO: 4164920 - DNA, 20 bp, Homo sapiens
agaaggaaggcagggaggag

SEQ ID NO: 4164921 - DNA, 20 bp, Homo sapiens
agaaggagtcagaaactgtt

SEQ ID NO: 4164922 - DNA, 19 bp, Homo sapiens
agaaggcaaaaatagtttg

SEQ ID NO: 4164923 - DNA, 13 bp, Homo sapiens
agaagggaagcct

SEQ ID NO: 4164924 - DNA, 13 bp, Homo sapiens
agaagtaaaagct

SEQ ID NO: 4164925 - DNA, 16 bp, Homo sapiens
agaagtaaaagctaat

SEQ ID NO: 4164926 - DNA, 21 bp, Homo sapiens
agaagtactgcccttttgtgt

SEQ ID NO: 4164927 - DNA, 20 bp, Homo sapiens
agaagtaggaaggaaaaaat

SEQ ID NO: 4164928 - DNA, 19 bp, Homo sapiens
agaagtccctaggagggaa

SEQ ID NO: 4164929 - DNA, 20 bp, Homo sapiens
agaagtcctatcgactttat

SEQ ID NO: 4164930 - DNA, 19 bp, Homo sapiens
agaagtttcatcatttttt

SEQ ID NO: 4164931 - DNA, 21 bp, Homo sapiens
agaagtttcatcattttttac

SEQ ID NO: 4164932 - DNA, 20 bp, Homo sapiens
agaagtttgatattaaagga

SEQ ID NO: 4164933 - DNA, 15 bp, Homo sapiens
agaatacttctcatt

SEQ ID NO: 4164934 - DNA, 18 bp, Homo sapiens
agaatatggacttaaatg

SEQ ID NO: 4164935 - DNA, 15 bp, Homo sapiens
agaatattcaaatgt

SEQ ID NO: 4164936 - DNA, 16 bp, Homo sapiens
agaatatttcaaatga

SEQ ID NO: 4164937 - DNA, 17 bp, Homo sapiens
agaatcattgtgcttaa

SEQ ID NO: 4164938 - DNA, 18 bp, Homo sapiens
agaatcattgtgcttaat

SEQ ID NO: 4164939 - DNA, 12 bp, Homo sapiens
agaatccctgca

SEQ ID NO: 4164940 - DNA, 19 bp, Homo sapiens
agaatcttggtttgccttc

SEQ ID NO: 4164941 - DNA, 20 bp, Homo sapiens
agaatcttggtttgccttcc

SEQ ID NO: 4164942 - DNA, 23 bp, Homo sapiens
agaatgatatccagtaagcacat

SEQ ID NO: 4164943 - DNA, 21 bp, Homo sapiens
agaatggttgccttaaagaaa

SEQ ID NO: 4164944 - DNA, 13 bp, Homo sapiens
agaattactgtaa

SEQ ID NO: 4164945 - DNA, 13 bp, Homo sapiens
agaattatatagg

SEQ ID NO: 4164946 - DNA, 23 bp, Homo sapiens
agaattatttttgagcaggagca

SEQ ID NO: 4164947 - DNA, 17 bp, Homo sapiens
agaattgagtgtttaaa

SEQ ID NO: 4164948 - DNA, 14 bp, Homo sapiens
agaattgggaagct

SEQ ID NO: 4164949 - DNA, 15 bp, Homo sapiens
agaattgtatcattt

SEQ ID NO: 4164950 - DNA, 23 bp, Homo sapiens
agaattgtccatgtgcttcccta

SEQ ID NO: 4164951 - DNA, 23 bp, Homo sapiens
agaattgtgtcagactgtttagt

SEQ ID NO: 4164952 - DNA, 17 bp, Homo sapiens
agaatttgtattttgct

SEQ ID NO: 4164953 - DNA, 18 bp, Homo sapiens
agaatttgtattttgctt

SEQ ID NO: 4164954 - DNA, 19 bp, Homo sapiens
agaatttgtattttgctta

SEQ ID NO: 4164955 - DNA, 15 bp, Homo sapiens
agacaagccagaact

SEQ ID NO: 4164956 - DNA, 17 bp, Homo sapiens
agacaagccagaacttg

SEQ ID NO: 4164957 - DNA, 16 bp, Homo sapiens
agacacatactcattt

SEQ ID NO: 4164958 - DNA, 14 bp, Homo sapiens
agacactgggagaa

SEQ ID NO: 4164959 - DNA, 12 bp, Homo sapiens
agacagaagaaa

SEQ ID NO: 4164960 - DNA, 17 bp, Homo sapiens
agacagcacttggctcc

SEQ ID NO: 4164961 - DNA, 19 bp, Homo sapiens
agacaggagggcaagggcc

SEQ ID NO: 4164962 - DNA, 17 bp, Homo sapiens
agacaggtcaaatgctg

SEQ ID NO: 4164963 - DNA, 15 bp, Homo sapiens
agacagtatatttat

SEQ ID NO: 4164964 - DNA, 13 bp, Homo sapiens
agacatggaaggt

SEQ ID NO: 4164965 - DNA, 13 bp, Homo sapiens
agacccacacatg

SEQ ID NO: 4164966 - DNA, 15 bp, Homo sapiens
agaccctaggaagct

SEQ ID NO: 4164967 - DNA, 13 bp, Homo sapiens
agacctccacatt

SEQ ID NO: 4164968 - DNA, 14 bp, Homo sapiens
agacgagatcctgt

SEQ ID NO: 4164969 - DNA, 18 bp, Homo sapiens
agacgagatcctgtttca

SEQ ID NO: 4164970 - DNA, 13 bp, Homo sapiens
agacggctggacc

SEQ ID NO: 4164971 - DNA, 23 bp, Homo sapiens
agacgggatttgaagctgtaccc

SEQ ID NO: 4164972 - DNA, 15 bp, Homo sapiens
agactaatttaaaaa

SEQ ID NO: 4164973 - DNA, 17 bp, Homo sapiens
agactatcttactattt

SEQ ID NO: 4164974 - DNA, 20 bp, Homo sapiens
agactatcttactatttcac

SEQ ID NO: 4164975 - DNA, 17 bp, Homo sapiens
agactcatcttttgaaa

SEQ ID NO: 4164976 - DNA, 21 bp, Homo sapiens
agactccttcaacaattctaa

SEQ ID NO: 4164977 - DNA, 14 bp, Homo sapiens
agactctggagcca

SEQ ID NO: 4164978 - DNA, 20 bp, Homo sapiens
agactctgggtccctcggag

SEQ ID NO: 4164979 - DNA, 22 bp, Homo sapiens
agactcttggggaagcgggtgg

SEQ ID NO: 4164980 - DNA, 17 bp, Homo sapiens
agactgagcacctgctt

SEQ ID NO: 4164981 - DNA, 15 bp, Homo sapiens
agactggaacactag

SEQ ID NO: 4164982 - DNA, 15 bp, Homo sapiens
agactggtcctgtgt

SEQ ID NO: 4164983 - DNA, 17 bp, Homo sapiens
agactggtcctgtgtgc

SEQ ID NO: 4164984 - DNA, 18 bp, Homo sapiens
agactggtcctgtgtgca

SEQ ID NO: 4164985 - DNA, 22 bp, Homo sapiens
agactggtttatccacccacaa

SEQ ID NO: 4164986 - DNA, 13 bp, Homo sapiens
agactgtgtatgt

SEQ ID NO: 4164987 - DNA, 17 bp, Homo sapiens
agactgttaaatgaaac

SEQ ID NO: 4164988 - DNA, 15 bp, Homo sapiens
agactgttactttgg

SEQ ID NO: 4164989 - DNA, 18 bp, Homo sapiens
agacttggcaacagaagc

SEQ ID NO: 4164990 - DNA, 17 bp, Homo sapiens
agacttgtgctcaagga

SEQ ID NO: 4164991 - DNA, 18 bp, Homo sapiens
agacttttatcaaaatcc

SEQ ID NO: 4164992 - DNA, 16 bp, Homo sapiens
agagaaagaagagaca

SEQ ID NO: 4164993 - DNA, 21 bp, Homo sapiens
agagaaatttttatttttgaa

SEQ ID NO: 4164994 - DNA, 22 bp, Homo sapiens
agagaaatttttatttttgaac

SEQ ID NO: 4164995 - DNA, 15 bp, Homo sapiens
agagaacctcaaact

SEQ ID NO: 4164996 - DNA, 22 bp, Homo sapiens
agagaacctcaaactaggagga

SEQ ID NO: 4164997 - DNA, 23 bp, Homo sapiens
agagaacctcaaactaggaggaa

SEQ ID NO: 4164998 - DNA, 20 bp, Homo sapiens
agagaactttcggagcctgc

SEQ ID NO: 4164999 - DNA, 22 bp, Homo sapiens
agagaactttcggagcctgcct

SEQ ID NO: 4165000 - DNA, 12 bp, Homo sapiens
agagaagaggct

SEQ ID NO: 4165001 - DNA, 17 bp, Homo sapiens
agagaatatatttttga

SEQ ID NO: 4165002 - DNA, 21 bp, Homo sapiens
agagaatatttcaaatgaaca

SEQ ID NO: 4165003 - DNA, 13 bp, Homo sapiens
agagacagaatga

SEQ ID NO: 4165004 - DNA, 14 bp, Homo sapiens
agagaccacagcaa

SEQ ID NO: 4165005 - DNA, 14 bp, Homo sapiens
agagaccccttcct

SEQ ID NO: 4165006 - DNA, 15 bp, Homo sapiens
agagacttagaagca

SEQ ID NO: 4165007 - DNA, 17 bp, Homo sapiens
agagacttttaatcaga

SEQ ID NO: 4165008 - DNA, 21 bp, Homo sapiens
agagagaaaacttatttgagt

SEQ ID NO: 4165009 - DNA, 15 bp, Homo sapiens
agagagcaaacatag

SEQ ID NO: 4165010 - DNA, 15 bp, Homo sapiens
agagaggcacctgct

SEQ ID NO: 4165011 - DNA, 19 bp, Homo sapiens
agagaggcacctgctggaa

SEQ ID NO: 4165012 - DNA, 12 bp, Homo sapiens
agagatcagcag

SEQ ID NO: 4165013 - DNA, 14 bp, Homo sapiens
agagatcagcagtg

SEQ ID NO: 4165014 - DNA, 21 bp, Homo sapiens
agagatcccaagtagaatctc

SEQ ID NO: 4165015 - DNA, 16 bp, Homo sapiens
agagatttcaacatat

SEQ ID NO: 4165016 - DNA, 21 bp, Homo sapiens
agagatttcaacatatcattt

SEQ ID NO: 4165017 - DNA, 20 bp, Homo sapiens
agagattttgtcgggacaga

SEQ ID NO: 4165018 - DNA, 22 bp, Homo sapiens
agagattttgtcgggacagaga

SEQ ID NO: 4165019 - DNA, 12 bp, Homo sapiens
agagcaagaagg

SEQ ID NO: 4165020 - DNA, 21 bp, Homo sapiens
agagcaagaaggaaagatttg

SEQ ID NO: 4165021 - DNA, 13 bp, Homo sapiens
agagcacagccca

SEQ ID NO: 4165022 - DNA, 19 bp, Homo sapiens
agagcacctagtccagtga

SEQ ID NO: 4165023 - DNA, 13 bp, Homo sapiens
agagcactgccac

SEQ ID NO: 4165024 - DNA, 15 bp, Homo sapiens
agagcactgccacca

SEQ ID NO: 4165025 - DNA, 13 bp, Homo sapiens
agagcaggctcag

SEQ ID NO: 4165026 - DNA, 20 bp, Homo sapiens
agagcaggctcagactctgg

SEQ ID NO: 4165027 - DNA, 22 bp, Homo sapiens
agagcaggggtccttggtgtga

SEQ ID NO: 4165028 - DNA, 17 bp, Homo sapiens
agagcattacgtgagcc

SEQ ID NO: 4165029 - DNA, 20 bp, Homo sapiens
agagcattacgtgagccagg

SEQ ID NO: 4165030 - DNA, 17 bp, Homo sapiens
agagcattgcatggaca

SEQ ID NO: 4165031 - DNA, 12 bp, Homo sapiens
agagccagctct

SEQ ID NO: 4165032 - DNA, 13 bp, Homo sapiens
agagccagctctc

SEQ ID NO: 4165033 - DNA, 21 bp, Homo sapiens
agagcccagcagggcctcaaa

SEQ ID NO: 4165034 - DNA, 22 bp, Homo sapiens
agagccccccgtgtggcttaca

SEQ ID NO: 4165035 - DNA, 13 bp, Homo sapiens
agagccgggaagc

SEQ ID NO: 4165036 - DNA, 14 bp, Homo sapiens
agagcctggagaag

SEQ ID NO: 4165037 - DNA, 16 bp, Homo sapiens
agagcctggagaagct

SEQ ID NO: 4165038 - DNA, 12 bp, Homo sapiens
agagcctggctt

SEQ ID NO: 4165039 - DNA, 15 bp, Homo sapiens
agagcctggctttgg

SEQ ID NO: 4165040 - DNA, 18 bp, Homo sapiens
agagcctgtgctaaagaa

SEQ ID NO: 4165041 - DNA, 21 bp, Homo sapiens
agagcctttggatgaccagaa

SEQ ID NO: 4165042 - DNA, 23 bp, Homo sapiens
agagcctttggatgaccagaaca

SEQ ID NO: 4165043 - DNA, 17 bp, Homo sapiens
agagcgagagtctgtct

SEQ ID NO: 4165044 - DNA, 19 bp, Homo sapiens
agagcgcctcttcctctgg

SEQ ID NO: 4165045 - DNA, 21 bp, Homo sapiens
agagcgcctcttcctctgggc

SEQ ID NO: 4165046 - DNA, 14 bp, Homo sapiens
agagctacataatt

SEQ ID NO: 4165047 - DNA, 20 bp, Homo sapiens
agagctgatggagaaggaag

SEQ ID NO: 4165048 - DNA, 15 bp, Homo sapiens
agagctgctctggaa

SEQ ID NO: 4165049 - DNA, 15 bp, Homo sapiens
agagctggcaaaggt

SEQ ID NO: 4165050 - DNA, 14 bp, Homo sapiens
agagctggctgtct

SEQ ID NO: 4165051 - DNA, 17 bp, Homo sapiens
agagctggctgtcttcc

SEQ ID NO: 4165052 - DNA, 19 bp, Homo sapiens
agagcttggtggctgagct

SEQ ID NO: 4165053 - DNA, 13 bp, Homo sapiens
agaggaaaaagaa

SEQ ID NO: 4165054 - DNA, 16 bp, Homo sapiens
agaggaaaaagaaaaa

SEQ ID NO: 4165055 - DNA, 17 bp, Homo sapiens
agaggacagtctggaga

SEQ ID NO: 4165056 - DNA, 19 bp, Homo sapiens
agaggacagtctggagaag

SEQ ID NO: 4165057 - DNA, 20 bp, Homo sapiens
agaggcaagagacagaatga

SEQ ID NO: 4165058 - DNA, 16 bp, Homo sapiens
actgggttctagaacc

SEQ ID NO: 4165059 - DNA, 15 bp, Homo sapiens
actggtcctgtgtgc

SEQ ID NO: 4165060 - DNA, 16 bp, Homo sapiens
actggtgatttctgag

SEQ ID NO: 4165061 - DNA, 14 bp, Homo sapiens
actggttttcacat

SEQ ID NO: 4165062 - DNA, 21 bp, Homo sapiens
actgtaagactcattccctag

SEQ ID NO: 4165063 - DNA, 15 bp, Homo sapiens
actgtacaaatgaaa

SEQ ID NO: 4165064 - DNA, 17 bp, Homo sapiens
actgtacttaataaatt

SEQ ID NO: 4165065 - DNA, 15 bp, Homo sapiens
actgtatctaggcaa

SEQ ID NO: 4165066 - DNA, 13 bp, Homo sapiens
actgtatgctgga

SEQ ID NO: 4165067 - DNA, 22 bp, Homo sapiens
actgtccgcctctgcccgcaga

SEQ ID NO: 4165068 - DNA, 22 bp, Homo sapiens
actgtgacccaaagaagtttaa

SEQ ID NO: 4165069 - DNA, 23 bp, Homo sapiens
actgtgcctttttttctttccta

SEQ ID NO: 4165070 - DNA, 15 bp, Homo sapiens
actgtggccttctca

SEQ ID NO: 4165071 - DNA, 22 bp, Homo sapiens
actgttacaacttgtatttcca

SEQ ID NO: 4165072 - DNA, 23 bp, Homo sapiens
actgttacaacttgtatttccaa

SEQ ID NO: 4165073 - DNA, 15 bp, Homo sapiens
actgttactttggca

SEQ ID NO: 4165074 - DNA, 22 bp, Homo sapiens
actgttactttggcaatttcct

SEQ ID NO: 4165075 - DNA, 15 bp, Homo sapiens
actgttcttggtaac

SEQ ID NO: 4165076 - DNA, 23 bp, Homo sapiens
actgttgaaaattattttaaaca

SEQ ID NO: 4165077 - DNA, 15 bp, Homo sapiens
actgttgtacaagct

SEQ ID NO: 4165078 - DNA, 18 bp, Homo sapiens
actgtttttgctattaca

SEQ ID NO: 4165079 - DNA, 19 bp, Homo sapiens
acttaaatgttaatgagaa

SEQ ID NO: 4165080 - DNA, 16 bp, Homo sapiens
acttaagtagaagtaa

SEQ ID NO: 4165081 - DNA, 13 bp, Homo sapiens
acttaataaattc

SEQ ID NO: 4165082 - DNA, 19 bp, Homo sapiens
acttaattacatccagaaa

SEQ ID NO: 4165083 - DNA, 16 bp, Homo sapiens
acttaattagaaacgt

SEQ ID NO: 4165084 - DNA, 22 bp, Homo sapiens
acttaccaggcaccaaaagaag

SEQ ID NO: 4165085 - DNA, 15 bp, Homo sapiens
acttactttaatgcg

SEQ ID NO: 4165086 - DNA, 16 bp, Homo sapiens
acttactttaatgcga

SEQ ID NO: 4165087 - DNA, 15 bp, Homo sapiens
acttagctggagaac

SEQ ID NO: 4165088 - DNA, 14 bp, Homo sapiens
acttaggaagaaat

SEQ ID NO: 4165089 - DNA, 15 bp, Homo sapiens
acttaggaagaaatc

SEQ ID NO: 4165090 - DNA, 19 bp, Homo sapiens
acttagttttgggagggga

SEQ ID NO: 4165091 - DNA, 19 bp, Homo sapiens
acttattacctaattaact

SEQ ID NO: 4165092 - DNA, 22 bp, Homo sapiens
acttatttgagtgattatttgt

SEQ ID NO: 4165093 - DNA, 15 bp, Homo sapiens
acttcagaaggcctc

SEQ ID NO: 4165094 - DNA, 17 bp, Homo sapiens
acttcagaaggcctcac

SEQ ID NO: 4165095 - DNA, 17 bp, Homo sapiens
acttccatgatacttta

SEQ ID NO: 4165096 - DNA, 19 bp, Homo sapiens
acttccatgatactttaat

SEQ ID NO: 4165097 - DNA, 13 bp, Homo sapiens
acttccatgttgt

SEQ ID NO: 4165098 - DNA, 19 bp, Homo sapiens
acttcccattttggaagtt

SEQ ID NO: 4165099 - DNA, 20 bp, Homo sapiens
acttcctaaatattatgaga

SEQ ID NO: 4165100 - DNA, 22 bp, Homo sapiens
acttcctggtgaggcccagcct

SEQ ID NO: 4165101 - DNA, 13 bp, Homo sapiens
acttccttggttt

SEQ ID NO: 4165102 - DNA, 21 bp, Homo sapiens
acttctaggactgggggtctt

SEQ ID NO: 4165103 - DNA, 19 bp, Homo sapiens
acttctcattttttaaaaa

SEQ ID NO: 4165104 - DNA, 15 bp, Homo sapiens
acttctttgaagtta

SEQ ID NO: 4165105 - DNA, 20 bp, Homo sapiens
acttgaaatatcctgcttga

SEQ ID NO: 4165106 - DNA, 15 bp, Homo sapiens
acttgaagcaagctt

SEQ ID NO: 4165107 - DNA, 11 bp, Homo sapiens
acttgaggaca

SEQ ID NO: 4165108 - DNA, 12 bp, Homo sapiens
acttgaggacac

SEQ ID NO: 4165109 - DNA, 13 bp, Homo sapiens
acttgaggacaca

SEQ ID NO: 4165110 - DNA, 18 bp, Homo sapiens
acttgaggacacatgtcc

SEQ ID NO: 4165111 - DNA, 18 bp, Homo sapiens
acttgagggtaataaact

SEQ ID NO: 4165112 - DNA, 23 bp, Homo sapiens
acttggaaaaagaaagaaacact

SEQ ID NO: 4165113 - DNA, 15 bp, Homo sapiens
acttggcaacagaag

SEQ ID NO: 4165114 - DNA, 16 bp, Homo sapiens
acttggcaacagaagc

SEQ ID NO: 4165115 - DNA, 19 bp, Homo sapiens
acttgggcccaggaggtca

SEQ ID NO: 4165116 - DNA, 14 bp, Homo sapiens
acttggggaccaga

SEQ ID NO: 4165117 - DNA, 15 bp, Homo sapiens
acttggtcagagcca

SEQ ID NO: 4165118 - DNA, 15 bp, Homo sapiens
acttgttcacaggtt

SEQ ID NO: 4165119 - DNA, 15 bp, Homo sapiens
actttaaccctctct

SEQ ID NO: 4165120 - DNA, 18 bp, Homo sapiens
actttaaccctctcttcc

SEQ ID NO: 4165121 - DNA, 17 bp, Homo sapiens
actttaagactgagcac

SEQ ID NO: 4165122 - DNA, 21 bp, Homo sapiens
actttacactctctgtacaaa

SEQ ID NO: 4165123 - DNA, 22 bp, Homo sapiens
actttacactctctgtacaaaa

SEQ ID NO: 4165124 - DNA, 17 bp, Homo sapiens
actttacccaaaaacta

SEQ ID NO: 4165125 - DNA, 17 bp, Homo sapiens
actttcctacaaaatgg

SEQ ID NO: 4165126 - DNA, 17 bp, Homo sapiens
actttcggagcctgcct

SEQ ID NO: 4165127 - DNA, 18 bp, Homo sapiens
actttctcactgctgtca

SEQ ID NO: 4165128 - DNA, 14 bp, Homo sapiens
actttctgtaaact

SEQ ID NO: 4165129 - DNA, 14 bp, Homo sapiens
actttgaagttagc

SEQ ID NO: 4165130 - DNA, 21 bp, Homo sapiens
actttgccccagttacaaaaa

SEQ ID NO: 4165131 - DNA, 18 bp, Homo sapiens
actttggccaagcaagag

SEQ ID NO: 4165132 - DNA, 21 bp, Homo sapiens
actttgtggtaacttctttga

SEQ ID NO: 4165133 - DNA, 19 bp, Homo sapiens
acttttgatgtttgaagtt

SEQ ID NO: 4165134 - DNA, 22 bp, Homo sapiens
actttttattttattttattaa

SEQ ID NO: 4165135 - DNA, 13 bp, Homo sapiens
acttttttacaac

SEQ ID NO: 4165136 - DNA, 23 bp, Homo sapiens
acttttttatttaaaaaactaaa

SEQ ID NO: 4165137 - DNA, 14 bp, Homo sapiens
agaaaaaatgtaga

SEQ ID NO: 4165138 - DNA, 12 bp, Homo sapiens
agaaaaacattt

SEQ ID NO: 4165139 - DNA, 19 bp, Homo sapiens
agaaaacatagcactagca

SEQ ID NO: 4165140 - DNA, 21 bp, Homo sapiens
agaaaacggagagtgcttggg

SEQ ID NO: 4165141 - DNA, 13 bp, Homo sapiens
agaaaactaacaa

SEQ ID NO: 4165142 - DNA, 20 bp, Homo sapiens
agaaaagggagctaaattga

SEQ ID NO: 4165143 - DNA, 16 bp, Homo sapiens
agaaaatataaatggt

SEQ ID NO: 4165144 - DNA, 14 bp, Homo sapiens
agaaaattagtaat

SEQ ID NO: 4165145 - DNA, 21 bp, Homo sapiens
agaaaatttgaagtaaaggat

SEQ ID NO: 4165146 - DNA, 22 bp, Homo sapiens
agaaacaaaggggatgcccagt

SEQ ID NO: 4165147 - DNA, 18 bp, Homo sapiens
agaaacaaggttttcagt

SEQ ID NO: 4165148 - DNA, 19 bp, Homo sapiens
agaaacacaaatgtaaaat

SEQ ID NO: 4165149 - DNA, 15 bp, Homo sapiens
agaaacctactgccc

SEQ ID NO: 4165150 - DNA, 23 bp, Homo sapiens
agaaacctgaggatgcaacaaat

SEQ ID NO: 4165151 - DNA, 19 bp, Homo sapiens
agaaacgtgataaatatat

SEQ ID NO: 4165152 - DNA, 21 bp, Homo sapiens
agaaactagtatctctggcct

SEQ ID NO: 4165153 - DNA, 17 bp, Homo sapiens
agaaactcacgatgaaa

SEQ ID NO: 4165154 - DNA, 22 bp, Homo sapiens
agaaactttgatctctgcttac

SEQ ID NO: 4165155 - DNA, 19 bp, Homo sapiens
agaaacttttttatttaaa

SEQ ID NO: 4165156 - DNA, 13 bp, Homo sapiens
agaaagaaacact

SEQ ID NO: 4165157 - DNA, 21 bp, Homo sapiens
agaaagaaggacacttgtatg

SEQ ID NO: 4165158 - DNA, 18 bp, Homo sapiens
agaaagagagagatacat

SEQ ID NO: 4165159 - DNA, 20 bp, Homo sapiens
agaaagctggtaaactattt

SEQ ID NO: 4165160 - DNA, 13 bp, Homo sapiens
agaaagtgcagaa

SEQ ID NO: 4165161 - DNA, 18 bp, Homo sapiens
agaaataatttttcttac

SEQ ID NO: 4165162 - DNA, 23 bp, Homo sapiens
agaaatacaaaaatactcagata

SEQ ID NO: 4165163 - DNA, 14 bp, Homo sapiens
agaaatcatagctg

SEQ ID NO: 4165164 - DNA, 13 bp, Homo sapiens
agaaatttaaact

SEQ ID NO: 4165165 - DNA, 20 bp, Homo sapiens
agaaatttaaactataagca

SEQ ID NO: 4165166 - DNA, 20 bp, Homo sapiens
agaaatttgatttctattca

SEQ ID NO: 4165167 - DNA, 14 bp, Homo sapiens
agaaattttgttaa

SEQ ID NO: 4165168 - DNA, 18 bp, Homo sapiens
agaacaacaacaacaata

SEQ ID NO: 4165169 - DNA, 11 bp, Homo sapiens
agaacaccttt

SEQ ID NO: 4165170 - DNA, 21 bp, Homo sapiens
agaacacctttgttttgcact

SEQ ID NO: 4165171 - DNA, 15 bp, Homo sapiens
agaacaggctggttc

SEQ ID NO: 4165172 - DNA, 16 bp, Homo sapiens
agaacaggctggttct

SEQ ID NO: 4165173 - DNA, 21 bp, Homo sapiens
agaacatagacagaagaaaca

SEQ ID NO: 4165174 - DNA, 16 bp, Homo sapiens
agaacatccctgggca

SEQ ID NO: 4165175 - DNA, 18 bp, Homo sapiens
agaaccaaaagttttcct

SEQ ID NO: 4165176 - DNA, 14 bp, Homo sapiens
agaacctaattcaa

SEQ ID NO: 4165177 - DNA, 19 bp, Homo sapiens
agaacctcaggcttccttg

SEQ ID NO: 4165178 - DNA, 18 bp, Homo sapiens
agaaccttctctatgggg

SEQ ID NO: 4165179 - DNA, 24 bp, Homo sapiens
agaacgcaacttaggatggctagg

SEQ ID NO: 4165180 - DNA, 15 bp, Homo sapiens
agaacttgaccctga

SEQ ID NO: 4165181 - DNA, 16 bp, Homo sapiens
agaactttgtgccagc

SEQ ID NO: 4165182 - DNA, 18 bp, Homo sapiens
agaagaaagaacggaaga

SEQ ID NO: 4165183 - DNA, 12 bp, Homo sapiens
agaagaaggaga

SEQ ID NO: 4165184 - DNA, 21 bp, Homo sapiens
agaagacgggatttgaagctg

SEQ ID NO: 4165185 - DNA, 14 bp, Homo sapiens
agaagaggagggac

SEQ ID NO: 4165186 - DNA, 17 bp, Homo sapiens
agaagatagggaacact

SEQ ID NO: 4165187 - DNA, 18 bp, Homo sapiens
agaagatagggaacactc

SEQ ID NO: 4165188 - DNA, 16 bp, Homo sapiens
agaagatttagatgtt

SEQ ID NO: 4165189 - DNA, 21 bp, Homo sapiens
agaagcaacctcagtaattta

SEQ ID NO: 4165190 - DNA, 23 bp, Homo sapiens
agaagcaacctcagtaatttaga

SEQ ID NO: 4165191 - DNA, 19 bp, Homo sapiens
agaagcattttgtaagttg

SEQ ID NO: 4165192 - DNA, 15 bp, Homo sapiens
agaagccctgctggg

SEQ ID NO: 4165193 - DNA, 16 bp, Homo sapiens
agaagcgctcatctgg

SEQ ID NO: 4165194 - DNA, 18 bp, Homo sapiens
agaagcgctcatctggct

SEQ ID NO: 4165195 - DNA, 13 bp, Homo sapiens
agaagctgtagta

SEQ ID NO: 4165196 - DNA, 17 bp, Homo sapiens
agaagcttcagaagttt

SEQ ID NO: 4165197 - DNA, 14 bp, Homo sapiens
actaaaagaatttg

SEQ ID NO: 4165198 - DNA, 18 bp, Homo sapiens
actaaacacgtgacacaa

SEQ ID NO: 4165199 - DNA, 13 bp, Homo sapiens
actaaactttacc

SEQ ID NO: 4165200 - DNA, 12 bp, Homo sapiens
actaaagagaca

SEQ ID NO: 4165201 - DNA, 17 bp, Homo sapiens
actaaagccaaacatat

SEQ ID NO: 4165202 - DNA, 13 bp, Homo sapiens
actaaatctttta

SEQ ID NO: 4165203 - DNA, 19 bp, Homo sapiens
actaatctgggaagggaag

SEQ ID NO: 4165204 - DNA, 15 bp, Homo sapiens
actaatttaaaaaat

SEQ ID NO: 4165205 - DNA, 18 bp, Homo sapiens
actaatttcttagagaat

SEQ ID NO: 4165206 - DNA, 15 bp, Homo sapiens
actacactccagcct

SEQ ID NO: 4165207 - DNA, 17 bp, Homo sapiens
actacactccagcctga

SEQ ID NO: 4165208 - DNA, 18 bp, Homo sapiens
actacatgtggtttatag

SEQ ID NO: 4165209 - DNA, 19 bp, Homo sapiens
actacatgtggtttataga

SEQ ID NO: 4165210 - DNA, 14 bp, Homo sapiens
actaccctgggctc

SEQ ID NO: 4165211 - DNA, 18 bp, Homo sapiens
actaccctgggctctggt

SEQ ID NO: 4165212 - DNA, 20 bp, Homo sapiens
actacctttatagctctcat

SEQ ID NO: 4165213 - DNA, 19 bp, Homo sapiens
actacctttgtccaggcct

SEQ ID NO: 4165214 - DNA, 20 bp, Homo sapiens
actacctttgtccaggcctg

SEQ ID NO: 4165215 - DNA, 17 bp, Homo sapiens
actactttgcctcttca

SEQ ID NO: 4165216 - DNA, 17 bp, Homo sapiens
actagacaagccagaac

SEQ ID NO: 4165217 - DNA, 18 bp, Homo sapiens
actagaggtgagaaattt

SEQ ID NO: 4165218 - DNA, 23 bp, Homo sapiens
actagcattcagggttatacaca

SEQ ID NO: 4165219 - DNA, 15 bp, Homo sapiens
actagcctctccagg

SEQ ID NO: 4165220 - DNA, 14 bp, Homo sapiens
actagggagccatg

SEQ ID NO: 4165221 - DNA, 18 bp, Homo sapiens
actagggagccatgtttc

SEQ ID NO: 4165222 - DNA, 19 bp, Homo sapiens
actagggagccatgtttca

SEQ ID NO: 4165223 - DNA, 22 bp, Homo sapiens
actagggtcctggccctcttct

SEQ ID NO: 4165224 - DNA, 20 bp, Homo sapiens
actagtatctctggcctcct

SEQ ID NO: 4165225 - DNA, 18 bp, Homo sapiens
actagttcagaggaagca

SEQ ID NO: 4165226 - DNA, 20 bp, Homo sapiens
actagttgtgtctggcagtt

SEQ ID NO: 4165227 - DNA, 20 bp, Homo sapiens
actataagcaagaaggcaaa

SEQ ID NO: 4165228 - DNA, 15 bp, Homo sapiens
actatacaacaatgt

SEQ ID NO: 4165229 - DNA, 22 bp, Homo sapiens
actatagtttaatactcagagg

SEQ ID NO: 4165230 - DNA, 22 bp, Homo sapiens
actatcagtttgtcctgtagag

SEQ ID NO: 4165231 - DNA, 20 bp, Homo sapiens
actatcttactatttcacaa

SEQ ID NO: 4165232 - DNA, 18 bp, Homo sapiens
actatctttcagctccag

SEQ ID NO: 4165233 - DNA, 16 bp, Homo sapiens
actatgaaaagctaga

SEQ ID NO: 4165234 - DNA, 19 bp, Homo sapiens
actatgccacagattgtta

SEQ ID NO: 4165235 - DNA, 24 bp, Homo sapiens
actatggataaactaaacacgtga

SEQ ID NO: 4165236 - DNA, 22 bp, Homo sapiens
actattaaaaaggtttacagaa

SEQ ID NO: 4165237 - DNA, 17 bp, Homo sapiens
actattaagagcaataa

SEQ ID NO: 4165238 - DNA, 13 bp, Homo sapiens
actattcaagtat

SEQ ID NO: 4165239 - DNA, 15 bp, Homo sapiens
actatttaacttgag

SEQ ID NO: 4165240 - DNA, 18 bp, Homo sapiens
actatttaacttgagggt

SEQ ID NO: 4165241 - DNA, 16 bp, Homo sapiens
actatttgtctttcag

SEQ ID NO: 4165242 - DNA, 18 bp, Homo sapiens
actatttgtctttcagga

SEQ ID NO: 4165243 - DNA, 12 bp, Homo sapiens
actattttcaga

SEQ ID NO: 4165244 - DNA, 14 bp, Homo sapiens
actcaataaaagaa

SEQ ID NO: 4165245 - DNA, 21 bp, Homo sapiens
actcactttcccttgtgtcaa

SEQ ID NO: 4165246 - DNA, 13 bp, Homo sapiens
actcagaagcctg

SEQ ID NO: 4165247 - DNA, 15 bp, Homo sapiens
actcagaagcctgag

SEQ ID NO: 4165248 - DNA, 15 bp, Homo sapiens
actcagacattccaa

SEQ ID NO: 4165249 - DNA, 14 bp, Homo sapiens
actcagccacaccc

SEQ ID NO: 4165250 - DNA, 22 bp, Homo sapiens
actcagctccagaataccttct

SEQ ID NO: 4165251 - DNA, 17 bp, Homo sapiens
actcaggatgccaagtg

SEQ ID NO: 4165252 - DNA, 15 bp, Homo sapiens
actcagtctgtggga

SEQ ID NO: 4165253 - DNA, 18 bp, Homo sapiens
actccaaaataggtgctg

SEQ ID NO: 4165254 - DNA, 16 bp, Homo sapiens
actccaagatgccctc

SEQ ID NO: 4165255 - DNA, 15 bp, Homo sapiens
actccagcctgagca

SEQ ID NO: 4165256 - DNA, 16 bp, Homo sapiens
actccagtggtgaaga

SEQ ID NO: 4165257 - DNA, 12 bp, Homo sapiens
actccccaggcc

SEQ ID NO: 4165258 - DNA, 15 bp, Homo sapiens
actccccaggccagg

SEQ ID NO: 4165259 - DNA, 19 bp, Homo sapiens
actccggcctgatgacaga

SEQ ID NO: 4165260 - DNA, 14 bp, Homo sapiens
actcctacctcagc

SEQ ID NO: 4165261 - DNA, 18 bp, Homo sapiens
actcctcggtactcccat

SEQ ID NO: 4165262 - DNA, 22 bp, Homo sapiens
actccttcaacaattctaaaat

SEQ ID NO: 4165263 - DNA, 12 bp, Homo sapiens
actctaagctgt

SEQ ID NO: 4165264 - DNA, 16 bp, Homo sapiens
actctaagctgtgtgc

SEQ ID NO: 4165265 - DNA, 19 bp, Homo sapiens
actctaagctgtgtgcagg

SEQ ID NO: 4165266 - DNA, 16 bp, Homo sapiens
actctacaccctctgc

SEQ ID NO: 4165267 - DNA, 18 bp, Homo sapiens
actctacaccctctgccc

SEQ ID NO: 4165268 - DNA, 20 bp, Homo sapiens
actctagtgacttcctggtg

SEQ ID NO: 4165269 - DNA, 22 bp, Homo sapiens
actctagtgacttcctggtgag

SEQ ID NO: 4165270 - DNA, 18 bp, Homo sapiens
actctatactaccctggg

SEQ ID NO: 4165271 - DNA, 14 bp, Homo sapiens
actctatagacttt

SEQ ID NO: 4165272 - DNA, 11 bp, Homo sapiens
actctcccctc

SEQ ID NO: 4165273 - DNA, 14 bp, Homo sapiens
actctcccctccct

SEQ ID NO: 4165274 - DNA, 17 bp, Homo sapiens
actctcccctccctctt

SEQ ID NO: 4165275 - DNA, 16 bp, Homo sapiens
actctctgtacaaaaa

SEQ ID NO: 4165276 - DNA, 22 bp, Homo sapiens
actctctgtacaaaaacaaaac

SEQ ID NO: 4165277 - DNA, 14 bp, Homo sapiens
actctgagtgtttt

SEQ ID NO: 4165278 - DNA, 13 bp, Homo sapiens
actctgccagcca

SEQ ID NO: 4165279 - DNA, 17 bp, Homo sapiens
actctggagccaaggca

SEQ ID NO: 4165280 - DNA, 20 bp, Homo sapiens
actcttcaaggtctgctttt

SEQ ID NO: 4165281 - DNA, 15 bp, Homo sapiens
actcttcactcttca

SEQ ID NO: 4165282 - DNA, 16 bp, Homo sapiens
actcttcactcttcaa

SEQ ID NO: 4165283 - DNA, 15 bp, Homo sapiens
actcttccatttatt

SEQ ID NO: 4165284 - DNA, 15 bp, Homo sapiens
actcttcctgcaagg

SEQ ID NO: 4165285 - DNA, 17 bp, Homo sapiens
actctttatgcttgcaa

SEQ ID NO: 4165286 - DNA, 18 bp, Homo sapiens
actctttatgcttgcaaa

SEQ ID NO: 4165287 - DNA, 21 bp, Homo sapiens
actgaaaaaaaaaaagaagaa

SEQ ID NO: 4165288 - DNA, 15 bp, Homo sapiens
actgaaaatctaata

SEQ ID NO: 4165289 - DNA, 16 bp, Homo sapiens
actgaaaatctaatat

SEQ ID NO: 4165290 - DNA, 23 bp, Homo sapiens
actgaaaatctaatattaaaaat

SEQ ID NO: 4165291 - DNA, 17 bp, Homo sapiens
actgaaaattatttaaa

SEQ ID NO: 4165292 - DNA, 20 bp, Homo sapiens
actgaacatttgctttgttt

SEQ ID NO: 4165293 - DNA, 12 bp, Homo sapiens
actgaacccaga

SEQ ID NO: 4165294 - DNA, 13 bp, Homo sapiens
actgaacccagag

SEQ ID NO: 4165295 - DNA, 17 bp, Homo sapiens
actgaacccagagtcag

SEQ ID NO: 4165296 - DNA, 18 bp, Homo sapiens
actgaacccagagtcagg

SEQ ID NO: 4165297 - DNA, 19 bp, Homo sapiens
actgaacccagagtcagga

SEQ ID NO: 4165298 - DNA, 18 bp, Homo sapiens
actgaagacctccacatt

SEQ ID NO: 4165299 - DNA, 11 bp, Homo sapiens
actgaagattg

SEQ ID NO: 4165300 - DNA, 15 bp, Homo sapiens
actgaattttgggac

SEQ ID NO: 4165301 - DNA, 19 bp, Homo sapiens
actgaggtcactgggttct

SEQ ID NO: 4165302 - DNA, 18 bp, Homo sapiens
actgattaacaaataaat

SEQ ID NO: 4165303 - DNA, 14 bp, Homo sapiens
actgatttttgtga

SEQ ID NO: 4165304 - DNA, 15 bp, Homo sapiens
actgcaaaggcgcag

SEQ ID NO: 4165305 - DNA, 15 bp, Homo sapiens
actgcactccagcct

SEQ ID NO: 4165306 - DNA, 18 bp, Homo sapiens
actgcactccagcctggg

SEQ ID NO: 4165307 - DNA, 20 bp, Homo sapiens
actgcactccagcctgggcg

SEQ ID NO: 4165308 - DNA, 17 bp, Homo sapiens
actgcagaaagcccttc

SEQ ID NO: 4165309 - DNA, 21 bp, Homo sapiens
actgcagaggggaaagacttc

SEQ ID NO: 4165310 - DNA, 15 bp, Homo sapiens
actgcagctttacat

SEQ ID NO: 4165311 - DNA, 23 bp, Homo sapiens
actgcagggctgctgtggcccag

SEQ ID NO: 4165312 - DNA, 14 bp, Homo sapiens
actgccccatctcc

SEQ ID NO: 4165313 - DNA, 16 bp, Homo sapiens
actgcctatatatgta

SEQ ID NO: 4165314 - DNA, 18 bp, Homo sapiens
actgcgatcttcagagca

SEQ ID NO: 4165315 - DNA, 23 bp, Homo sapiens
actgcgggagctctgtatggtca

SEQ ID NO: 4165316 - DNA, 19 bp, Homo sapiens
actgcgggatggtcctggg

SEQ ID NO: 4165317 - DNA, 21 bp, Homo sapiens
actgcgggatggtcctggggc

SEQ ID NO: 4165318 - DNA, 19 bp, Homo sapiens
actgcgggcaccagaatgc

SEQ ID NO: 4165319 - DNA, 15 bp, Homo sapiens
actgctacctctgag

SEQ ID NO: 4165320 - DNA, 17 bp, Homo sapiens
actgctacctctgagaa

SEQ ID NO: 4165321 - DNA, 18 bp, Homo sapiens
actgctaggcgagtgcca

SEQ ID NO: 4165322 - DNA, 19 bp, Homo sapiens
actgctaggcgagtgccag

SEQ ID NO: 4165323 - DNA, 20 bp, Homo sapiens
actgctgagatacatacaga

SEQ ID NO: 4165324 - DNA, 13 bp, Homo sapiens
actgctgaggaat

SEQ ID NO: 4165325 - DNA, 20 bp, Homo sapiens
actgctgatcaatgaaatgc

SEQ ID NO: 4165326 - DNA, 13 bp, Homo sapiens
actgctgggactg

SEQ ID NO: 4165327 - DNA, 23 bp, Homo sapiens
actggaggtcacattcaggaaga

SEQ ID NO: 4165328 - DNA, 16 bp, Homo sapiens
actggcagagcacagc

SEQ ID NO: 4165329 - DNA, 19 bp, Homo sapiens
actggcagagcacagccca

SEQ ID NO: 4165330 - DNA, 12 bp, Homo sapiens
actggccccacc

SEQ ID NO: 4165331 - DNA, 15 bp, Homo sapiens
actggcctcaaagca

SEQ ID NO: 4165332 - DNA, 19 bp, Homo sapiens
actggctcctttgcctctg

SEQ ID NO: 4165333 - DNA, 20 bp, Homo sapiens
actggctcctttgcctctgc

SEQ ID NO: 4165334 - DNA, 17 bp, Homo sapiens
actggctggctgcagtg

SEQ ID NO: 4165335 - DNA, 21 bp, Homo sapiens
actgggacctgaatgacctgc

SEQ ID NO: 4165336 - DNA, 21 bp, Homo sapiens
actggggagttataaaaatac

SEQ ID NO: 4165337 - DNA, 18 bp, Homo sapiens
accccatgcacctcaggg

SEQ ID NO: 4165338 - DNA, 20 bp, Homo sapiens
accccatgcacctcagggcc

SEQ ID NO: 4165339 - DNA, 17 bp, Homo sapiens
acccccagtgccacaga

SEQ ID NO: 4165340 - DNA, 18 bp, Homo sapiens
acccccagtgccacagag

SEQ ID NO: 4165341 - DNA, 20 bp, Homo sapiens
acccccatggccccaggccc

SEQ ID NO: 4165342 - DNA, 18 bp, Homo sapiens
accccctcattcccctcg

SEQ ID NO: 4165343 - DNA, 15 bp, Homo sapiens
accccctccagctcc

SEQ ID NO: 4165344 - DNA, 18 bp, Homo sapiens
accccctccagctccagt

SEQ ID NO: 4165345 - DNA, 17 bp, Homo sapiens
acccctgtctctagcca

SEQ ID NO: 4165346 - DNA, 10 bp, Homo sapiens
acccctgtgt

SEQ ID NO: 4165347 - DNA, 18 bp, Homo sapiens
accccttatccaggactc

SEQ ID NO: 4165348 - DNA, 16 bp, Homo sapiens
accccttcctttcctc

SEQ ID NO: 4165349 - DNA, 17 bp, Homo sapiens
accccttcctttcctct

SEQ ID NO: 4165350 - DNA, 18 bp, Homo sapiens
accccttcctttcctctg

SEQ ID NO: 4165351 - DNA, 15 bp, Homo sapiens
acccctttcccccac

SEQ ID NO: 4165352 - DNA, 23 bp, Homo sapiens
acccctttcccccaccccagagt

SEQ ID NO: 4165353 - DNA, 22 bp, Homo sapiens
acccggcccagagaccccttcc

SEQ ID NO: 4165354 - DNA, 15 bp, Homo sapiens
accctaaaatgacag

SEQ ID NO: 4165355 - DNA, 16 bp, Homo sapiens
accctaagcctccttt

SEQ ID NO: 4165356 - DNA, 18 bp, Homo sapiens
accctcaaaccctgtggg

SEQ ID NO: 4165357 - DNA, 21 bp, Homo sapiens
accctccaccgcagaaggaag

SEQ ID NO: 4165358 - DNA, 16 bp, Homo sapiens
accctccagtgctgga

SEQ ID NO: 4165359 - DNA, 23 bp, Homo sapiens
accctcccccaggaggtcgaccc

SEQ ID NO: 4165360 - DNA, 18 bp, Homo sapiens
accctcgtggacacctgc

SEQ ID NO: 4165361 - DNA, 21 bp, Homo sapiens
accctctgaatggtccagggt

SEQ ID NO: 4165362 - DNA, 22 bp, Homo sapiens
accctctgaatggtccagggtt

SEQ ID NO: 4165363 - DNA, 13 bp, Homo sapiens
accctgcagagct

SEQ ID NO: 4165364 - DNA, 19 bp, Homo sapiens
accctgcgaaggggccctg

SEQ ID NO: 4165365 - DNA, 22 bp, Homo sapiens
accctgcgaaggggccctggtc

SEQ ID NO: 4165366 - DNA, 13 bp, Homo sapiens
accctgggctctg

SEQ ID NO: 4165367 - DNA, 21 bp, Homo sapiens
accctgtctcttaaagaaaaa

SEQ ID NO: 4165368 - DNA, 16 bp, Homo sapiens
accctgttttatactg

SEQ ID NO: 4165369 - DNA, 19 bp, Homo sapiens
accgaccatcgtccagccc

SEQ ID NO: 4165370 - DNA, 22 bp, Homo sapiens
accgaccatcgtccagccctcc

SEQ ID NO: 4165371 - DNA, 20 bp, Homo sapiens
accgagcgctttctggaaaa

SEQ ID NO: 4165372 - DNA, 13 bp, Homo sapiens
accgcagaaggaa

SEQ ID NO: 4165373 - DNA, 14 bp, Homo sapiens
accgcagaaggaag

SEQ ID NO: 4165374 - DNA, 15 bp, Homo sapiens
accgcagaaggaagg

SEQ ID NO: 4165375 - DNA, 16 bp, Homo sapiens
accgccgcagggacgg

SEQ ID NO: 4165376 - DNA, 13 bp, Homo sapiens
accgctaaaagaa

SEQ ID NO: 4165377 - DNA, 19 bp, Homo sapiens
accgctatttctccttgga

SEQ ID NO: 4165378 - DNA, 19 bp, Homo sapiens
accgctcccctctcctccg

SEQ ID NO: 4165379 - DNA, 20 bp, Homo sapiens
accgctgccttttgctgctg

SEQ ID NO: 4165380 - DNA, 14 bp, Homo sapiens
accgcttcccagag

SEQ ID NO: 4165381 - DNA, 13 bp, Homo sapiens
acctaaagaaaaa

SEQ ID NO: 4165382 - DNA, 17 bp, Homo sapiens
acctaaagaaaaacaaa

SEQ ID NO: 4165383 - DNA, 21 bp, Homo sapiens
acctacataggcaaattggaa

SEQ ID NO: 4165384 - DNA, 17 bp, Homo sapiens
acctacctgttgagcat

SEQ ID NO: 4165385 - DNA, 23 bp, Homo sapiens
acctactgcccaggcactgcaaa

SEQ ID NO: 4165386 - DNA, 22 bp, Homo sapiens
acctagctggttaatggcagca

SEQ ID NO: 4165387 - DNA, 13 bp, Homo sapiens
acctataaaacaa

SEQ ID NO: 4165388 - DNA, 17 bp, Homo sapiens
acctatatgatttatag

SEQ ID NO: 4165389 - DNA, 15 bp, Homo sapiens
acctatgtgacagac

SEQ ID NO: 4165390 - DNA, 23 bp, Homo sapiens
acctatttcttaaacacttgcaa

SEQ ID NO: 4165391 - DNA, 17 bp, Homo sapiens
acctcaaactaggagga

SEQ ID NO: 4165392 - DNA, 10 bp, Homo sapiens
acctcagcct

SEQ ID NO: 4165393 - DNA, 20 bp, Homo sapiens
acctcaggccaggtgcagtg

SEQ ID NO: 4165394 - DNA, 16 bp, Homo sapiens
acctcagggacaacat

SEQ ID NO: 4165395 - DNA, 18 bp, Homo sapiens
acctcatgcctggccccc

SEQ ID NO: 4165396 - DNA, 23 bp, Homo sapiens
acctcatgcctggcccccctcca

SEQ ID NO: 4165397 - DNA, 18 bp, Homo sapiens
acctccacccactgtccg

SEQ ID NO: 4165398 - DNA, 16 bp, Homo sapiens
acctcctatccttgga

SEQ ID NO: 4165399 - DNA, 19 bp, Homo sapiens
acctctcaatattcaataa

SEQ ID NO: 4165400 - DNA, 20 bp, Homo sapiens
acctctcaatattcaataaa

SEQ ID NO: 4165401 - DNA, 13 bp, Homo sapiens
acctctgagaaga

SEQ ID NO: 4165402 - DNA, 13 bp, Homo sapiens
acctcttccttcc

SEQ ID NO: 4165403 - DNA, 19 bp, Homo sapiens
acctgaatgacctgcagtc

SEQ ID NO: 4165404 - DNA, 15 bp, Homo sapiens
acctgacaaatggaa

SEQ ID NO: 4165405 - DNA, 16 bp, Homo sapiens
acctgaggctcctgtg

SEQ ID NO: 4165406 - DNA, 18 bp, Homo sapiens
acctgcagtcagggccca

SEQ ID NO: 4165407 - DNA, 16 bp, Homo sapiens
acctgccagcctggct

SEQ ID NO: 4165408 - DNA, 19 bp, Homo sapiens
acctgccatttgcaccctc

SEQ ID NO: 4165409 - DNA, 13 bp, Homo sapiens
acctgccccctgg

SEQ ID NO: 4165410 - DNA, 15 bp, Homo sapiens
acctgccccctggtg

SEQ ID NO: 4165411 - DNA, 14 bp, Homo sapiens
acctgcccctcccc

SEQ ID NO: 4165412 - DNA, 16 bp, Homo sapiens
acctgccctgccctgc

SEQ ID NO: 4165413 - DNA, 17 bp, Homo sapiens
acctgccctgccctgcc

SEQ ID NO: 4165414 - DNA, 21 bp, Homo sapiens
acctgccctgccctgccacct

SEQ ID NO: 4165415 - DNA, 23 bp, Homo sapiens
acctggaattttcagtcatctca

SEQ ID NO: 4165416 - DNA, 14 bp, Homo sapiens
acctggagatgatg

SEQ ID NO: 4165417 - DNA, 23 bp, Homo sapiens
acctggagcccgcttcaagctct

SEQ ID NO: 4165418 - DNA, 23 bp, Homo sapiens
acctgggcgccaactgctgatca

SEQ ID NO: 4165419 - DNA, 19 bp, Homo sapiens
acctgtcaccgtgagcagc

SEQ ID NO: 4165420 - DNA, 20 bp, Homo sapiens
acctgttgagcatcacagaa

SEQ ID NO: 4165421 - DNA, 13 bp, Homo sapiens
accttaaaaagta

SEQ ID NO: 4165422 - DNA, 15 bp, Homo sapiens
accttaccaactttc

SEQ ID NO: 4165423 - DNA, 17 bp, Homo sapiens
accttaccaactttctg

SEQ ID NO: 4165424 - DNA, 17 bp, Homo sapiens
accttcaattcctgggc

SEQ ID NO: 4165425 - DNA, 14 bp, Homo sapiens
accttccccagact

SEQ ID NO: 4165426 - DNA, 23 bp, Homo sapiens
accttctctatggggcatcctct

SEQ ID NO: 4165427 - DNA, 18 bp, Homo sapiens
accttgccgagagaggcg

SEQ ID NO: 4165428 - DNA, 18 bp, Homo sapiens
accttggactcctcccac

SEQ ID NO: 4165429 - DNA, 18 bp, Homo sapiens
accttgggtttgtatttt

SEQ ID NO: 4165430 - DNA, 21 bp, Homo sapiens
accttgggtttgtattttaaa

SEQ ID NO: 4165431 - DNA, 17 bp, Homo sapiens
acctttcagctgtgaac

SEQ ID NO: 4165432 - DNA, 21 bp, Homo sapiens
acctttgggatcagcctccgc

SEQ ID NO: 4165433 - DNA, 22 bp, Homo sapiens
acctttgttttgcactgacaag

SEQ ID NO: 4165434 - DNA, 15 bp, Homo sapiens
acctttttttctctc

SEQ ID NO: 4165435 - DNA, 18 bp, Homo sapiens
acctttttttctctccta

SEQ ID NO: 4165436 - DNA, 19 bp, Homo sapiens
acctttttttctctcctaa

SEQ ID NO: 4165437 - DNA, 12 bp, Homo sapiens
acgacactgaag

SEQ ID NO: 4165438 - DNA, 19 bp, Homo sapiens
acgactgttgtacaagctc

SEQ ID NO: 4165439 - DNA, 17 bp, Homo sapiens
acgcaaagggctgaaag

SEQ ID NO: 4165440 - DNA, 22 bp, Homo sapiens
acgcagatgctgtcactggcag

SEQ ID NO: 4165441 - DNA, 17 bp, Homo sapiens
acgcaggaactcccagc

SEQ ID NO: 4165442 - DNA, 20 bp, Homo sapiens
acgccactgcactccagcct

SEQ ID NO: 4165443 - DNA, 21 bp, Homo sapiens
acgccattgtactccagcctg

SEQ ID NO: 4165444 - DNA, 13 bp, Homo sapiens
acgccctattttt

SEQ ID NO: 4165445 - DNA, 18 bp, Homo sapiens
acgcctgtaatcccagca

SEQ ID NO: 4165446 - DNA, 12 bp, Homo sapiens
acgcgcacacac

SEQ ID NO: 4165447 - DNA, 14 bp, Homo sapiens
acgcgcacacacac

SEQ ID NO: 4165448 - DNA, 17 bp, Homo sapiens
acggagaccccggtggc

SEQ ID NO: 4165449 - DNA, 15 bp, Homo sapiens
acggagtacagacgt

SEQ ID NO: 4165450 - DNA, 11 bp, Homo sapiens
acggcagctgt

SEQ ID NO: 4165451 - DNA, 13 bp, Homo sapiens
acggggaggggga

SEQ ID NO: 4165452 - DNA, 14 bp, Homo sapiens
acggggtccttcaa

SEQ ID NO: 4165453 - DNA, 19 bp, Homo sapiens
acgggttaagatctgaaag

SEQ ID NO: 4165454 - DNA, 21 bp, Homo sapiens
acggtcctttaggcagcctgc

SEQ ID NO: 4165455 - DNA, 15 bp, Homo sapiens
acggttgcttcacct

SEQ ID NO: 4165456 - DNA, 21 bp, Homo sapiens
acggttgcttcaccttggagc

SEQ ID NO: 4165457 - DNA, 21 bp, Homo sapiens
acgtaatgattatatgacaat

SEQ ID NO: 4165458 - DNA, 15 bp, Homo sapiens
acgtaatgtatttat

SEQ ID NO: 4165459 - DNA, 23 bp, Homo sapiens
acgtaatgtatttatatgttaat

SEQ ID NO: 4165460 - DNA, 21 bp, Homo sapiens
acgtatttaatagcaaagaat

SEQ ID NO: 4165461 - DNA, 21 bp, Homo sapiens
acgtatttatatttggaaaga

SEQ ID NO: 4165462 - DNA, 18 bp, Homo sapiens
acgtccagaatttttcat

SEQ ID NO: 4165463 - DNA, 17 bp, Homo sapiens
acgtctcaagactgaaa

SEQ ID NO: 4165464 - DNA, 13 bp, Homo sapiens
acgtgacacaaac

SEQ ID NO: 4165465 - DNA, 20 bp, Homo sapiens
acgtgacacaaacacacaca

SEQ ID NO: 4165466 - DNA, 21 bp, Homo sapiens
acgtgggtatttcctgctaca

SEQ ID NO: 4165467 - DNA, 13 bp, Homo sapiens
acgtgtgtgaagt

SEQ ID NO: 4165468 - DNA, 22 bp, Homo sapiens
acgtgttcctataaaatcaaag

SEQ ID NO: 4165469 - DNA, 16 bp, Homo sapiens
acgttgacccctttcc

SEQ ID NO: 4165470 - DNA, 21 bp, Homo sapiens
acgttgacccctttcccccac

SEQ ID NO: 4165471 - DNA, 13 bp, Homo sapiens
acgttgccacacc

SEQ ID NO: 4165472 - DNA, 22 bp, Homo sapiens
acgttgccacaccaatcagaga

SEQ ID NO: 4165473 - DNA, 23 bp, Homo sapiens
acgtttaagccaaaacaatgttt

SEQ ID NO: 4165474 - DNA, 23 bp, Homo sapiens
acgttttctcttccttgtgattg

SEQ ID NO: 4165475 - DNA, 18 bp, Homo sapiens
acagtaaataaattgttt

SEQ ID NO: 4165476 - DNA, 18 bp, Homo sapiens
acagtcctaactggtata

SEQ ID NO: 4165477 - DNA, 12 bp, Homo sapiens
acagtcctggga

SEQ ID NO: 4165478 - DNA, 21 bp, Homo sapiens
acagtcctgggagaacctcag

SEQ ID NO: 4165479 - DNA, 22 bp, Homo sapiens
acagtctagattagaagtgttt

SEQ ID NO: 4165480 - DNA, 16 bp, Homo sapiens
acagtctcagtccaga

SEQ ID NO: 4165481 - DNA, 16 bp, Homo sapiens
acagtgaatttctgat

SEQ ID NO: 4165482 - DNA, 15 bp, Homo sapiens
acagtgctgccctgc

SEQ ID NO: 4165483 - DNA, 18 bp, Homo sapiens
acagtgcttcagcctgag

SEQ ID NO: 4165484 - DNA, 20 bp, Homo sapiens
acagtgcttcagcctgaggc

SEQ ID NO: 4165485 - DNA, 12 bp, Homo sapiens
acagttcagttc

SEQ ID NO: 4165486 - DNA, 16 bp, Homo sapiens
acagttcagttcctct

SEQ ID NO: 4165487 - DNA, 14 bp, Homo sapiens
acagtttgctctag

SEQ ID NO: 4165488 - DNA, 23 bp, Homo sapiens
acagttttgtcagtctttcttag

SEQ ID NO: 4165489 - DNA, 18 bp, Homo sapiens
acataaactttataaatt

SEQ ID NO: 4165490 - DNA, 22 bp, Homo sapiens
acataaagcctctgactcaaac

SEQ ID NO: 4165491 - DNA, 15 bp, Homo sapiens
acataaagttgataa

SEQ ID NO: 4165492 - DNA, 14 bp, Homo sapiens
acataatggaaaac

SEQ ID NO: 4165493 - DNA, 17 bp, Homo sapiens
acataattatccaggaa

SEQ ID NO: 4165494 - DNA, 18 bp, Homo sapiens
acataattcactctgagt

SEQ ID NO: 4165495 - DNA, 12 bp, Homo sapiens
acataatttttt

SEQ ID NO: 4165496 - DNA, 18 bp, Homo sapiens
acataattttttattcaa

SEQ ID NO: 4165497 - DNA, 21 bp, Homo sapiens
acatagcactagcattcaggg

SEQ ID NO: 4165498 - DNA, 17 bp, Homo sapiens
acataggcaaattggaa

SEQ ID NO: 4165499 - DNA, 14 bp, Homo sapiens
acataggtataatt

SEQ ID NO: 4165500 - DNA, 17 bp, Homo sapiens
acatagtttgtaaaggc

SEQ ID NO: 4165501 - DNA, 14 bp, Homo sapiens
acatataataaata

SEQ ID NO: 4165502 - DNA, 13 bp, Homo sapiens
acatatcattttt

SEQ ID NO: 4165503 - DNA, 21 bp, Homo sapiens
acatatgtgccaatgtgacaa

SEQ ID NO: 4165504 - DNA, 18 bp, Homo sapiens
acatatttcacatgttta

SEQ ID NO: 4165505 - DNA, 19 bp, Homo sapiens
acatcaactttatgtagca

SEQ ID NO: 4165506 - DNA, 17 bp, Homo sapiens
acatcacatccctctcc

SEQ ID NO: 4165507 - DNA, 14 bp, Homo sapiens
acatcatagtttct

SEQ ID NO: 4165508 - DNA, 15 bp, Homo sapiens
acatcattcattttt

SEQ ID NO: 4165509 - DNA, 15 bp, Homo sapiens
acatcctattttgta

SEQ ID NO: 4165510 - DNA, 14 bp, Homo sapiens
acatctttcctgtc

SEQ ID NO: 4165511 - DNA, 20 bp, Homo sapiens
acatgaaaaacacggcagct

SEQ ID NO: 4165512 - DNA, 17 bp, Homo sapiens
acatgaacacagctgct

SEQ ID NO: 4165513 - DNA, 22 bp, Homo sapiens
acatgaacacagctgctgaaga

SEQ ID NO: 4165514 - DNA, 14 bp, Homo sapiens
acatgatgtgagat

SEQ ID NO: 4165515 - DNA, 20 bp, Homo sapiens
acatgcaattggggaagaaa

SEQ ID NO: 4165516 - DNA, 17 bp, Homo sapiens
acatgcatcatcagcct

SEQ ID NO: 4165517 - DNA, 13 bp, Homo sapiens
acatggaaaagtt

SEQ ID NO: 4165518 - DNA, 20 bp, Homo sapiens
acatggaatttaatttatgt

SEQ ID NO: 4165519 - DNA, 21 bp, Homo sapiens
acatgtacatgcatttttcta

SEQ ID NO: 4165520 - DNA, 21 bp, Homo sapiens
acatgtccttgtgtgttttga

SEQ ID NO: 4165521 - DNA, 14 bp, Homo sapiens
acatgtctgtcctc

SEQ ID NO: 4165522 - DNA, 19 bp, Homo sapiens
acatgtgaggactgggggc

SEQ ID NO: 4165523 - DNA, 16 bp, Homo sapiens
acatgtggtttataga

SEQ ID NO: 4165524 - DNA, 23 bp, Homo sapiens
acatgtgttagtgtatgtgaatt

SEQ ID NO: 4165525 - DNA, 15 bp, Homo sapiens
acattaagtggcttt

SEQ ID NO: 4165526 - DNA, 21 bp, Homo sapiens
acattaatcaatcatctgtgt

SEQ ID NO: 4165527 - DNA, 14 bp, Homo sapiens
acattagaagacaa

SEQ ID NO: 4165528 - DNA, 12 bp, Homo sapiens
acattcacagcc

SEQ ID NO: 4165529 - DNA, 13 bp, Homo sapiens
acattcataagga

SEQ ID NO: 4165530 - DNA, 14 bp, Homo sapiens
acattcataaggaa

SEQ ID NO: 4165531 - DNA, 22 bp, Homo sapiens
acattccaactcgtatagcatg

SEQ ID NO: 4165532 - DNA, 17 bp, Homo sapiens
acattcccatctgtcac

SEQ ID NO: 4165533 - DNA, 13 bp, Homo sapiens
acattgccttcct

SEQ ID NO: 4165534 - DNA, 14 bp, Homo sapiens
acattgccttcctc

SEQ ID NO: 4165535 - DNA, 22 bp, Homo sapiens
acattggtatatttccattcat

SEQ ID NO: 4165536 - DNA, 14 bp, Homo sapiens
acattgtgatgatt

SEQ ID NO: 4165537 - DNA, 15 bp, Homo sapiens
acatttcctcttata

SEQ ID NO: 4165538 - DNA, 21 bp, Homo sapiens
acatttgctttgttttctaaa

SEQ ID NO: 4165539 - DNA, 13 bp, Homo sapiens
acattttacatat

SEQ ID NO: 4165540 - DNA, 21 bp, Homo sapiens
acattttacttagctggagaa

SEQ ID NO: 4165541 - DNA, 13 bp, Homo sapiens
accaaaacagatg

SEQ ID NO: 4165542 - DNA, 20 bp, Homo sapiens
accaaaccccacttcccctc

SEQ ID NO: 4165543 - DNA, 20 bp, Homo sapiens
accaaaggaatcgtttcaaa

SEQ ID NO: 4165544 - DNA, 15 bp, Homo sapiens
accaacataaaaatg

SEQ ID NO: 4165545 - DNA, 13 bp, Homo sapiens
accaactttctgt

SEQ ID NO: 4165546 - DNA, 18 bp, Homo sapiens
accaactttctgtaaact

SEQ ID NO: 4165547 - DNA, 23 bp, Homo sapiens
accaagctgagcaacctcttcag

SEQ ID NO: 4165548 - DNA, 17 bp, Homo sapiens
accaaggaaagaacaaa

SEQ ID NO: 4165549 - DNA, 20 bp, Homo sapiens
accaaggataattaaatata

SEQ ID NO: 4165550 - DNA, 15 bp, Homo sapiens
accaaggtcttcagc

SEQ ID NO: 4165551 - DNA, 17 bp, Homo sapiens
accaagtcctcaaagca

SEQ ID NO: 4165552 - DNA, 19 bp, Homo sapiens
accaatcagagagcctaga

SEQ ID NO: 4165553 - DNA, 14 bp, Homo sapiens
accacaaaaattga

SEQ ID NO: 4165554 - DNA, 14 bp, Homo sapiens
accacaaactgtaa

SEQ ID NO: 4165555 - DNA, 22 bp, Homo sapiens
accacaaactgtaatacaatga

SEQ ID NO: 4165556 - DNA, 18 bp, Homo sapiens
accacaagagatcagcag

SEQ ID NO: 4165557 - DNA, 20 bp, Homo sapiens
accacactccccgcctgtcc

SEQ ID NO: 4165558 - DNA, 23 bp, Homo sapiens
accacagatgtgtctgggagagc

SEQ ID NO: 4165559 - DNA, 21 bp, Homo sapiens
accacagcagctgaacagcca

SEQ ID NO: 4165560 - DNA, 14 bp, Homo sapiens
accacatctacaat

SEQ ID NO: 4165561 - DNA, 18 bp, Homo sapiens
accacctaatcaggctga

SEQ ID NO: 4165562 - DNA, 18 bp, Homo sapiens
accacctgggttcagcct

SEQ ID NO: 4165563 - DNA, 19 bp, Homo sapiens
accaccttggactcctccc

SEQ ID NO: 4165564 - DNA, 22 bp, Homo sapiens
accaccttggactcctcccaca

SEQ ID NO: 4165565 - DNA, 17 bp, Homo sapiens
accactaggactctgag

SEQ ID NO: 4165566 - DNA, 18 bp, Homo sapiens
accactcctcaggaacag

SEQ ID NO: 4165567 - DNA, 14 bp, Homo sapiens
accacttggctgct

SEQ ID NO: 4165568 - DNA, 16 bp, Homo sapiens
accacttggctgctca

SEQ ID NO: 4165569 - DNA, 15 bp, Homo sapiens
accagacccacctgg

SEQ ID NO: 4165570 - DNA, 20 bp, Homo sapiens
accagagccttcaagtgcca

SEQ ID NO: 4165571 - DNA, 21 bp, Homo sapiens
accagagccttcaagtgccaa

SEQ ID NO: 4165572 - DNA, 23 bp, Homo sapiens
accagagccttcaagtgccaaac

SEQ ID NO: 4165573 - DNA, 17 bp, Homo sapiens
accagcaatatgtaaat

SEQ ID NO: 4165574 - DNA, 14 bp, Homo sapiens
accagccgtgagca

SEQ ID NO: 4165575 - DNA, 13 bp, Homo sapiens
accagcctgactg

SEQ ID NO: 4165576 - DNA, 17 bp, Homo sapiens
accagcctgactgcaca

SEQ ID NO: 4165577 - DNA, 15 bp, Homo sapiens
accagcttctccagg

SEQ ID NO: 4165578 - DNA, 16 bp, Homo sapiens
accagcttctccaggc

SEQ ID NO: 4165579 - DNA, 20 bp, Homo sapiens
accagcttctccaggctctt

SEQ ID NO: 4165580 - DNA, 15 bp, Homo sapiens
accaggactttaatc

SEQ ID NO: 4165581 - DNA, 19 bp, Homo sapiens
accaggatagagactggaa

SEQ ID NO: 4165582 - DNA, 22 bp, Homo sapiens
accagtgcccaaagtctgtgtg

SEQ ID NO: 4165583 - DNA, 13 bp, Homo sapiens
accatcactgagt

SEQ ID NO: 4165584 - DNA, 17 bp, Homo sapiens
accatcgtccagccctc

SEQ ID NO: 4165585 - DNA, 15 bp, Homo sapiens
accatgaattcttga

SEQ ID NO: 4165586 - DNA, 16 bp, Homo sapiens
accatgaattcttgag

SEQ ID NO: 4165587 - DNA, 20 bp, Homo sapiens
accatgaattcttgagttta

SEQ ID NO: 4165588 - DNA, 18 bp, Homo sapiens
accatgagcaattctcct

SEQ ID NO: 4165589 - DNA, 13 bp, Homo sapiens
accattaaccaga

SEQ ID NO: 4165590 - DNA, 12 bp, Homo sapiens
accattaatgaa

SEQ ID NO: 4165591 - DNA, 18 bp, Homo sapiens
accattatttaataagag

SEQ ID NO: 4165592 - DNA, 22 bp, Homo sapiens
accattttagttcctttattta

SEQ ID NO: 4165593 - DNA, 20 bp, Homo sapiens
acccaactttctcactgctg

SEQ ID NO: 4165594 - DNA, 21 bp, Homo sapiens
acccacctttgccacaaagct

SEQ ID NO: 4165595 - DNA, 16 bp, Homo sapiens
acccactgtccgcctc

SEQ ID NO: 4165596 - DNA, 17 bp, Homo sapiens
acccactgtccgcctct

SEQ ID NO: 4165597 - DNA, 11 bp, Homo sapiens
acccagctcct

SEQ ID NO: 4165598 - DNA, 15 bp, Homo sapiens
acccagctcctctga

SEQ ID NO: 4165599 - DNA, 17 bp, Homo sapiens
acccagctcctctgagc

SEQ ID NO: 4165600 - DNA, 21 bp, Homo sapiens
acccagctcctctgagccata

SEQ ID NO: 4165601 - DNA, 23 bp, Homo sapiens
acccagctcctctgagccatacc

SEQ ID NO: 4165602 - DNA, 15 bp, Homo sapiens
acccagctctcaggg

SEQ ID NO: 4165603 - DNA, 22 bp, Homo sapiens
acccaggaggctgaggcaggag

SEQ ID NO: 4165604 - DNA, 22 bp, Homo sapiens
acccagggctccctcctggagc

SEQ ID NO: 4165605 - DNA, 16 bp, Homo sapiens
acccatatatcttatg

SEQ ID NO: 4165606 - DNA, 23 bp, Homo sapiens
acccatggagaggtttgtcaaca

SEQ ID NO: 4165607 - DNA, 15 bp, Homo sapiens
accccaaagcccctt

SEQ ID NO: 4165608 - DNA, 18 bp, Homo sapiens
accccaaagccccttgct

SEQ ID NO: 4165609 - DNA, 19 bp, Homo sapiens
accccacattggacttcct

SEQ ID NO: 4165610 - DNA, 22 bp, Homo sapiens
accccacctcatgcctggcccc

SEQ ID NO: 4165611 - DNA, 10 bp, Homo sapiens
accccagagt

SEQ ID NO: 4165612 - DNA, 11 bp, Homo sapiens
accccagagtt

SEQ ID NO: 4165613 - DNA, 14 bp, Homo sapiens
accccatgcacctc

SEQ ID NO: 4165614 - DNA, 14 bp, Homo sapiens
acaagaagctgcta

SEQ ID NO: 4165615 - DNA, 16 bp, Homo sapiens
acaagagatcagcagt

SEQ ID NO: 4165616 - DNA, 19 bp, Homo sapiens
acaagagatcagcagtggc

SEQ ID NO: 4165617 - DNA, 18 bp, Homo sapiens
acaagagtttatttccaa

SEQ ID NO: 4165618 - DNA, 18 bp, Homo sapiens
acaagataaaggaagtca

SEQ ID NO: 4165619 - DNA, 22 bp, Homo sapiens
acaagcacagacattaaacctg

SEQ ID NO: 4165620 - DNA, 22 bp, Homo sapiens
acaagccagaacttgaccctga

SEQ ID NO: 4165621 - DNA, 17 bp, Homo sapiens
acaagcctgagaactga

SEQ ID NO: 4165622 - DNA, 19 bp, Homo sapiens
acaaggttccctctgagaa

SEQ ID NO: 4165623 - DNA, 17 bp, Homo sapiens
acaagtatttgttaatt

SEQ ID NO: 4165624 - DNA, 20 bp, Homo sapiens
acaagtatttgttaatttag

SEQ ID NO: 4165625 - DNA, 14 bp, Homo sapiens
acaagtttaaaaat

SEQ ID NO: 4165626 - DNA, 13 bp, Homo sapiens
acaataaagactg

SEQ ID NO: 4165627 - DNA, 13 bp, Homo sapiens
acaataatatttc

SEQ ID NO: 4165628 - DNA, 15 bp, Homo sapiens
acaataatatttcaa

SEQ ID NO: 4165629 - DNA, 11 bp, Homo sapiens
acaataattaa

SEQ ID NO: 4165630 - DNA, 18 bp, Homo sapiens
acaatacaacaagaacaa

SEQ ID NO: 4165631 - DNA, 20 bp, Homo sapiens
acaatattaattataataaa

SEQ ID NO: 4165632 - DNA, 18 bp, Homo sapiens
acaatcatttgctttttg

SEQ ID NO: 4165633 - DNA, 13 bp, Homo sapiens
acaatcctgaaga

SEQ ID NO: 4165634 - DNA, 19 bp, Homo sapiens
acaatctggcttagtgcca

SEQ ID NO: 4165635 - DNA, 23 bp, Homo sapiens
acaatgaaggaaaacctcacttg

SEQ ID NO: 4165636 - DNA, 23 bp, Homo sapiens
acaatgcctagactgtgtatgtc

SEQ ID NO: 4165637 - DNA, 17 bp, Homo sapiens
acaatggtttacatgaa

SEQ ID NO: 4165638 - DNA, 21 bp, Homo sapiens
acaattaggcagactctttat

SEQ ID NO: 4165639 - DNA, 17 bp, Homo sapiens
acaattattgtacacta

SEQ ID NO: 4165640 - DNA, 12 bp, Homo sapiens
acaattctaaaa

SEQ ID NO: 4165641 - DNA, 17 bp, Homo sapiens
acaattctaaaatgatt

SEQ ID NO: 4165642 - DNA, 24 bp, Homo sapiens
acaattctaaaatgattgtagtaa

SEQ ID NO: 4165643 - DNA, 16 bp, Homo sapiens
acaatttcctttatat

SEQ ID NO: 4165644 - DNA, 20 bp, Homo sapiens
acaatttcctttatatttag

SEQ ID NO: 4165645 - DNA, 23 bp, Homo sapiens
acaatttcctttatatttagtga

SEQ ID NO: 4165646 - DNA, 13 bp, Homo sapiens
acacaaaagccaa

SEQ ID NO: 4165647 - DNA, 21 bp, Homo sapiens
acacaaatggggtccaggtca

SEQ ID NO: 4165648 - DNA, 13 bp, Homo sapiens
acacaacatttat

SEQ ID NO: 4165649 - DNA, 14 bp, Homo sapiens
acacaagctggaag

SEQ ID NO: 4165650 - DNA, 17 bp, Homo sapiens
acacaaggtgatttcag

SEQ ID NO: 4165651 - DNA, 18 bp, Homo sapiens
acacaaggtgatttcaga

SEQ ID NO: 4165652 - DNA, 16 bp, Homo sapiens
acacaccggtcaccga

SEQ ID NO: 4165653 - DNA, 17 bp, Homo sapiens
acacaccggtcaccgag

SEQ ID NO: 4165654 - DNA, 16 bp, Homo sapiens
acacacgcaggaactc

SEQ ID NO: 4165655 - DNA, 20 bp, Homo sapiens
acacacgcaggaactcccag

SEQ ID NO: 4165656 - DNA, 21 bp, Homo sapiens
acacacgtatttatatttgga

SEQ ID NO: 4165657 - DNA, 18 bp, Homo sapiens
acacagctaggcatgcct

SEQ ID NO: 4165658 - DNA, 21 bp, Homo sapiens
acacagctaggcatgcctggg

SEQ ID NO: 4165659 - DNA, 13 bp, Homo sapiens
acacaggaagaat

SEQ ID NO: 4165660 - DNA, 19 bp, Homo sapiens
acacaggtgttggaagcca

SEQ ID NO: 4165661 - DNA, 14 bp, Homo sapiens
acacagtgacaaaa

SEQ ID NO: 4165662 - DNA, 21 bp, Homo sapiens
acacagtgttccagctgcctg

SEQ ID NO: 4165663 - DNA, 20 bp, Homo sapiens
acacatccctaatgtgtgcc

SEQ ID NO: 4165664 - DNA, 19 bp, Homo sapiens
acacattatgttagagagg

SEQ ID NO: 4165665 - DNA, 17 bp, Homo sapiens
acaccaacataaaaatg

SEQ ID NO: 4165666 - DNA, 15 bp, Homo sapiens
acaccaatcagagag

SEQ ID NO: 4165667 - DNA, 16 bp, Homo sapiens
acaccaatcagagagc

SEQ ID NO: 4165668 - DNA, 17 bp, Homo sapiens
acaccaatcagagagcc

SEQ ID NO: 4165669 - DNA, 17 bp, Homo sapiens
acaccccttatccagga

SEQ ID NO: 4165670 - DNA, 18 bp, Homo sapiens
acaccccttatccaggac

SEQ ID NO: 4165671 - DNA, 16 bp, Homo sapiens
acacccttggacttga

SEQ ID NO: 4165672 - DNA, 22 bp, Homo sapiens
acacctcggccgtacatctctg

SEQ ID NO: 4165673 - DNA, 13 bp, Homo sapiens
acacctgccctgc

SEQ ID NO: 4165674 - DNA, 15 bp, Homo sapiens
acacctgccctgccc

SEQ ID NO: 4165675 - DNA, 19 bp, Homo sapiens
acacgcaggaactcccagc

SEQ ID NO: 4165676 - DNA, 13 bp, Homo sapiens
acacggcagctgt

SEQ ID NO: 4165677 - DNA, 17 bp, Homo sapiens
acacgtgacacaaacac

SEQ ID NO: 4165678 - DNA, 20 bp, Homo sapiens
acactaaacagactatttaa

SEQ ID NO: 4165679 - DNA, 14 bp, Homo sapiens
acactacattagaa

SEQ ID NO: 4165680 - DNA, 16 bp, Homo sapiens
acactagacaagccag

SEQ ID NO: 4165681 - DNA, 15 bp, Homo sapiens
acactagcctctcca

SEQ ID NO: 4165682 - DNA, 15 bp, Homo sapiens
acactagttcagagg

SEQ ID NO: 4165683 - DNA, 14 bp, Homo sapiens
acactcagcagccc

SEQ ID NO: 4165684 - DNA, 18 bp, Homo sapiens
acactccaccccctccag

SEQ ID NO: 4165685 - DNA, 23 bp, Homo sapiens
acactccaccccctccagctcca

SEQ ID NO: 4165686 - DNA, 15 bp, Homo sapiens
acactccagcctgag

SEQ ID NO: 4165687 - DNA, 23 bp, Homo sapiens
acactccccgcctgtcctgcctc

SEQ ID NO: 4165688 - DNA, 19 bp, Homo sapiens
acactctagtgacttcctg

SEQ ID NO: 4165689 - DNA, 22 bp, Homo sapiens
acactctagtgacttcctggtg

SEQ ID NO: 4165690 - DNA, 13 bp, Homo sapiens
acactcttcttga

SEQ ID NO: 4165691 - DNA, 20 bp, Homo sapiens
acactcttcttgagcagacc

SEQ ID NO: 4165692 - DNA, 17 bp, Homo sapiens
acactgcagggctgctg

SEQ ID NO: 4165693 - DNA, 18 bp, Homo sapiens
acactgggagaagagaac

SEQ ID NO: 4165694 - DNA, 19 bp, Homo sapiens
acactgggagaagagaacc

SEQ ID NO: 4165695 - DNA, 16 bp, Homo sapiens
acactgtctgctgccc

SEQ ID NO: 4165696 - DNA, 15 bp, Homo sapiens
acactgttggaatgt

SEQ ID NO: 4165697 - DNA, 13 bp, Homo sapiens
acacttaagcaga

SEQ ID NO: 4165698 - DNA, 20 bp, Homo sapiens
acacttcttgaaacagcctg

SEQ ID NO: 4165699 - DNA, 21 bp, Homo sapiens
acactttggccaagcaagagg

SEQ ID NO: 4165700 - DNA, 22 bp, Homo sapiens
acacttttgggaggtccaggca

SEQ ID NO: 4165701 - DNA, 22 bp, Homo sapiens
acagaacacttctaggactggg

SEQ ID NO: 4165702 - DNA, 16 bp, Homo sapiens
acagaacatagacaga

SEQ ID NO: 4165703 - DNA, 14 bp, Homo sapiens
acagaagaaacaag

SEQ ID NO: 4165704 - DNA, 13 bp, Homo sapiens
acagaagcttcag

SEQ ID NO: 4165705 - DNA, 19 bp, Homo sapiens
acagaagcttcagaagttt

SEQ ID NO: 4165706 - DNA, 22 bp, Homo sapiens
acagaatgatatccagtaagca

SEQ ID NO: 4165707 - DNA, 16 bp, Homo sapiens
acagaatgctgtttta

SEQ ID NO: 4165708 - DNA, 18 bp, Homo sapiens
acagaatgtgataaggaa

SEQ ID NO: 4165709 - DNA, 18 bp, Homo sapiens
acagaccccttggctttt

SEQ ID NO: 4165710 - DNA, 18 bp, Homo sapiens
acagagaaattctgtggt

SEQ ID NO: 4165711 - DNA, 21 bp, Homo sapiens
acagagaaattctgtggtggg

SEQ ID NO: 4165712 - DNA, 20 bp, Homo sapiens
acagagaggagttgccaggg

SEQ ID NO: 4165713 - DNA, 21 bp, Homo sapiens
acagagatgcatgcgcaggct

SEQ ID NO: 4165714 - DNA, 12 bp, Homo sapiens
acagagcctggc

SEQ ID NO: 4165715 - DNA, 14 bp, Homo sapiens
acagagcctggctt

SEQ ID NO: 4165716 - DNA, 14 bp, Homo sapiens
acagatataaaata

SEQ ID NO: 4165717 - DNA, 20 bp, Homo sapiens
acagatgtgtctgggagagc

SEQ ID NO: 4165718 - DNA, 22 bp, Homo sapiens
acagattctagccaaactattc

SEQ ID NO: 4165719 - DNA, 18 bp, Homo sapiens
acagatttcggtcataaa

SEQ ID NO: 4165720 - DNA, 13 bp, Homo sapiens
acagcaaggaaac

SEQ ID NO: 4165721 - DNA, 18 bp, Homo sapiens
acagcactacagatatca

SEQ ID NO: 4165722 - DNA, 14 bp, Homo sapiens
acagcagctgaaca

SEQ ID NO: 4165723 - DNA, 18 bp, Homo sapiens
acagcagggtcttgctgt

SEQ ID NO: 4165724 - DNA, 21 bp, Homo sapiens
acagccaccctgcccagtctg

SEQ ID NO: 4165725 - DNA, 15 bp, Homo sapiens
acagcccagcctagc

SEQ ID NO: 4165726 - DNA, 14 bp, Homo sapiens
acagcccaggtcct

SEQ ID NO: 4165727 - DNA, 17 bp, Homo sapiens
acagcccaggtcctccc

SEQ ID NO: 4165728 - DNA, 13 bp, Homo sapiens
acagcctctccct

SEQ ID NO: 4165729 - DNA, 20 bp, Homo sapiens
acagcctgacaacatttcta

SEQ ID NO: 4165730 - DNA, 20 bp, Homo sapiens
acagcctgggtgacggtcct

SEQ ID NO: 4165731 - DNA, 14 bp, Homo sapiens
acagcgagaggcag

SEQ ID NO: 4165732 - DNA, 15 bp, Homo sapiens
acagcgagaggcaga

SEQ ID NO: 4165733 - DNA, 17 bp, Homo sapiens
acagcgcgggcggaggc

SEQ ID NO: 4165734 - DNA, 19 bp, Homo sapiens
acagctaggcatgcctggg

SEQ ID NO: 4165735 - DNA, 20 bp, Homo sapiens
acagctaggcatgcctggga

SEQ ID NO: 4165736 - DNA, 17 bp, Homo sapiens
acagctcatgttttcta

SEQ ID NO: 4165737 - DNA, 17 bp, Homo sapiens
acagctcttcactcagc

SEQ ID NO: 4165738 - DNA, 19 bp, Homo sapiens
acagctcttcactcagcca

SEQ ID NO: 4165739 - DNA, 23 bp, Homo sapiens
acagctcttcactcagccacacc

SEQ ID NO: 4165740 - DNA, 14 bp, Homo sapiens
acagctgctgaaga

SEQ ID NO: 4165741 - DNA, 15 bp, Homo sapiens
acagctgctgaagag

SEQ ID NO: 4165742 - DNA, 20 bp, Homo sapiens
acaggagccccacccccatg

SEQ ID NO: 4165743 - DNA, 22 bp, Homo sapiens
acaggagccccacccccatgca

SEQ ID NO: 4165744 - DNA, 17 bp, Homo sapiens
acaggaggggcccacaa

SEQ ID NO: 4165745 - DNA, 21 bp, Homo sapiens
acaggatcctattctcaccag

SEQ ID NO: 4165746 - DNA, 18 bp, Homo sapiens
acaggatgtgtttgcttt

SEQ ID NO: 4165747 - DNA, 21 bp, Homo sapiens
acaggatgtgtttgctttctg

SEQ ID NO: 4165748 - DNA, 22 bp, Homo sapiens
acaggatgtgtttgctttctga

SEQ ID NO: 4165749 - DNA, 14 bp, Homo sapiens
acaggtcaaatgct

SEQ ID NO: 4165750 - DNA, 13 bp, Homo sapiens
acaggtggttttt

SEQ ID NO: 4165751 - DNA, 16 bp, Homo sapiens
acaggtgttggaagcc

SEQ ID NO: 4165752 - DNA, 13 bp, Homo sapiens
acagtaaataaat

SEQ ID NO: 4165753 - DNA, 15 bp, Homo sapiens
aatgcctcctccctg

SEQ ID NO: 4165754 - DNA, 23 bp, Homo sapiens
aatgcctcttaaattatatattt

SEQ ID NO: 4165755 - DNA, 12 bp, Homo sapiens
aatgctcctgga

SEQ ID NO: 4165756 - DNA, 13 bp, Homo sapiens
aatgctgcttctc

SEQ ID NO: 4165757 - DNA, 15 bp, Homo sapiens
aatgctttccaaaac

SEQ ID NO: 4165758 - DNA, 11 bp, Homo sapiens
aatgctttttg

SEQ ID NO: 4165759 - DNA, 13 bp, Homo sapiens
aatggaaatgtaa

SEQ ID NO: 4165760 - DNA, 21 bp, Homo sapiens
aatggaatgtgatgttcatgg

SEQ ID NO: 4165761 - DNA, 17 bp, Homo sapiens
aatggaattcagtaaca

SEQ ID NO: 4165762 - DNA, 14 bp, Homo sapiens
aatggacttcaaat

SEQ ID NO: 4165763 - DNA, 20 bp, Homo sapiens
aatggcatgagaaatacaaa

SEQ ID NO: 4165764 - DNA, 22 bp, Homo sapiens
aatggccaaatggtttttgcaa

SEQ ID NO: 4165765 - DNA, 22 bp, Homo sapiens
aatggcctgccttgaagccact

SEQ ID NO: 4165766 - DNA, 18 bp, Homo sapiens
aatggctgataattttaa

SEQ ID NO: 4165767 - DNA, 17 bp, Homo sapiens
aatggtatcatttggaa

SEQ ID NO: 4165768 - DNA, 18 bp, Homo sapiens
aatggtttacatgaacac

SEQ ID NO: 4165769 - DNA, 20 bp, Homo sapiens
aatgtaaatattttaaagaa

SEQ ID NO: 4165770 - DNA, 21 bp, Homo sapiens
aatgtaaatattttaaagaat

SEQ ID NO: 4165771 - DNA, 15 bp, Homo sapiens
aatgtaagaaaattt

SEQ ID NO: 4165772 - DNA, 23 bp, Homo sapiens
aatgtaagggctataagtagaaa

SEQ ID NO: 4165773 - DNA, 23 bp, Homo sapiens
aatgtagtggagagatcatagct

SEQ ID NO: 4165774 - DNA, 13 bp, Homo sapiens
aatgtatttatat

SEQ ID NO: 4165775 - DNA, 19 bp, Homo sapiens
aatgtcattttggtacttt

SEQ ID NO: 4165776 - DNA, 12 bp, Homo sapiens
aatgtctgtttt

SEQ ID NO: 4165777 - DNA, 17 bp, Homo sapiens
aatgtgaccaggggtga

SEQ ID NO: 4165778 - DNA, 21 bp, Homo sapiens
aatgtgtgtctgaagactatc

SEQ ID NO: 4165779 - DNA, 18 bp, Homo sapiens
aatgttaatgagaaaatg

SEQ ID NO: 4165780 - DNA, 21 bp, Homo sapiens
aatgttctttataaaaagtga

SEQ ID NO: 4165781 - DNA, 22 bp, Homo sapiens
aatgttgaaatatgatgttaaa

SEQ ID NO: 4165782 - DNA, 15 bp, Homo sapiens
aatgtttatgttctc

SEQ ID NO: 4165783 - DNA, 15 bp, Homo sapiens
aatgtttattccttg

SEQ ID NO: 4165784 - DNA, 21 bp, Homo sapiens
aattaaaaaccactgaacatt

SEQ ID NO: 4165785 - DNA, 16 bp, Homo sapiens
aattaactatgtgatg

SEQ ID NO: 4165786 - DNA, 20 bp, Homo sapiens
aattaactatgtgatgttaa

SEQ ID NO: 4165787 - DNA, 22 bp, Homo sapiens
aattaactgggtaatgaaacaa

SEQ ID NO: 4165788 - DNA, 12 bp, Homo sapiens
aattaagttatt

SEQ ID NO: 4165789 - DNA, 13 bp, Homo sapiens
aattaatagcttt

SEQ ID NO: 4165790 - DNA, 21 bp, Homo sapiens
aattaatgtgtgtctgaagac

SEQ ID NO: 4165791 - DNA, 22 bp, Homo sapiens
aattagaaacgtgataaatata

SEQ ID NO: 4165792 - DNA, 18 bp, Homo sapiens
aattagccaaaacactta

SEQ ID NO: 4165793 - DNA, 21 bp, Homo sapiens
aattatataggttgtgcaaat

SEQ ID NO: 4165794 - DNA, 15 bp, Homo sapiens
aattatatttttgta

SEQ ID NO: 4165795 - DNA, 19 bp, Homo sapiens
aattatatttttgtaaata

SEQ ID NO: 4165796 - DNA, 22 bp, Homo sapiens
aattatatttttgtaaatagta

SEQ ID NO: 4165797 - DNA, 13 bp, Homo sapiens
aattatgagatga

SEQ ID NO: 4165798 - DNA, 18 bp, Homo sapiens
aattatggaaatatagtt

SEQ ID NO: 4165799 - DNA, 14 bp, Homo sapiens
aattattgtacact

SEQ ID NO: 4165800 - DNA, 18 bp, Homo sapiens
aattattgtacactaaca

SEQ ID NO: 4165801 - DNA, 14 bp, Homo sapiens
aattatttgtgtaa

SEQ ID NO: 4165802 - DNA, 15 bp, Homo sapiens
aattatttgtgtaat

SEQ ID NO: 4165803 - DNA, 17 bp, Homo sapiens
aattatttttaagaaat

SEQ ID NO: 4165804 - DNA, 20 bp, Homo sapiens
aattcaaaccaattcaccca

SEQ ID NO: 4165805 - DNA, 12 bp, Homo sapiens
aattcacacctt

SEQ ID NO: 4165806 - DNA, 23 bp, Homo sapiens
aattcactcccacacccaagaag

SEQ ID NO: 4165807 - DNA, 20 bp, Homo sapiens
aattcagatatatttttcac

SEQ ID NO: 4165808 - DNA, 13 bp, Homo sapiens
aattccactggac

SEQ ID NO: 4165809 - DNA, 21 bp, Homo sapiens
aattccactggacttgagctt

SEQ ID NO: 4165810 - DNA, 17 bp, Homo sapiens
aattccatatgctccag

SEQ ID NO: 4165811 - DNA, 14 bp, Homo sapiens
aattctaaaatgat

SEQ ID NO: 4165812 - DNA, 22 bp, Homo sapiens
aattctacaggatggggacact

SEQ ID NO: 4165813 - DNA, 18 bp, Homo sapiens
aattctcgggaaattatt

SEQ ID NO: 4165814 - DNA, 15 bp, Homo sapiens
aattctgagatccag

SEQ ID NO: 4165815 - DNA, 15 bp, Homo sapiens
aattcttatgcttat

SEQ ID NO: 4165816 - DNA, 17 bp, Homo sapiens
aattctttacaataaac

SEQ ID NO: 4165817 - DNA, 19 bp, Homo sapiens
aattctttacaataaacat

SEQ ID NO: 4165818 - DNA, 15 bp, Homo sapiens
aattgaatacacaaa

SEQ ID NO: 4165819 - DNA, 23 bp, Homo sapiens
aattgatagcaggtgtaataaga

SEQ ID NO: 4165820 - DNA, 15 bp, Homo sapiens
aattgctttgccaaa

SEQ ID NO: 4165821 - DNA, 18 bp, Homo sapiens
aattgctttgccaaaata

SEQ ID NO: 4165822 - DNA, 14 bp, Homo sapiens
aattggctcctcca

SEQ ID NO: 4165823 - DNA, 16 bp, Homo sapiens
aattggtgggaagcaa

SEQ ID NO: 4165824 - DNA, 23 bp, Homo sapiens
aattggtgggaagcaagcagggg

SEQ ID NO: 4165825 - DNA, 21 bp, Homo sapiens
aattgtaaaattgtatagaga

SEQ ID NO: 4165826 - DNA, 16 bp, Homo sapiens
aattgtactaaagcca

SEQ ID NO: 4165827 - DNA, 22 bp, Homo sapiens
aattgttttatctgaattttta

SEQ ID NO: 4165828 - DNA, 19 bp, Homo sapiens
aatttaataaaaacttcag

SEQ ID NO: 4165829 - DNA, 12 bp, Homo sapiens
aatttaattcca

SEQ ID NO: 4165830 - DNA, 14 bp, Homo sapiens
aatttaatttatgt

SEQ ID NO: 4165831 - DNA, 20 bp, Homo sapiens
aatttagaaatcattttgca

SEQ ID NO: 4165832 - DNA, 17 bp, Homo sapiens
aatttagacttcaagca

SEQ ID NO: 4165833 - DNA, 18 bp, Homo sapiens
aatttagcagtccaaaga

SEQ ID NO: 4165834 - DNA, 21 bp, Homo sapiens
aatttagtttcatataaagta

SEQ ID NO: 4165835 - DNA, 18 bp, Homo sapiens
aatttatatttgaaattt

SEQ ID NO: 4165836 - DNA, 16 bp, Homo sapiens
aatttatggtattgta

SEQ ID NO: 4165837 - DNA, 15 bp, Homo sapiens
aatttattaaaatga

SEQ ID NO: 4165838 - DNA, 17 bp, Homo sapiens
aatttattagttaatat

SEQ ID NO: 4165839 - DNA, 18 bp, Homo sapiens
aatttcaaatagaatatg

SEQ ID NO: 4165840 - DNA, 16 bp, Homo sapiens
aatttcactttagaag

SEQ ID NO: 4165841 - DNA, 11 bp, Homo sapiens
aatttcctggc

SEQ ID NO: 4165842 - DNA, 20 bp, Homo sapiens
aatttcttcactgttgaaaa

SEQ ID NO: 4165843 - DNA, 21 bp, Homo sapiens
aatttcttcactgttgaaaat

SEQ ID NO: 4165844 - DNA, 17 bp, Homo sapiens
aatttgatacaaaatgc

SEQ ID NO: 4165845 - DNA, 17 bp, Homo sapiens
aatttggaagaaaacta

SEQ ID NO: 4165846 - DNA, 17 bp, Homo sapiens
aatttgtaaaaaagatt

SEQ ID NO: 4165847 - DNA, 12 bp, Homo sapiens
aatttgtatctg

SEQ ID NO: 4165848 - DNA, 15 bp, Homo sapiens
aatttgtatctgaag

SEQ ID NO: 4165849 - DNA, 18 bp, Homo sapiens
aatttgtatctgaaggag

SEQ ID NO: 4165850 - DNA, 20 bp, Homo sapiens
aatttgtatctgaaggagat

SEQ ID NO: 4165851 - DNA, 20 bp, Homo sapiens
aattttaaaagttgggaaaa

SEQ ID NO: 4165852 - DNA, 17 bp, Homo sapiens
aattttaacttaaattt

SEQ ID NO: 4165853 - DNA, 22 bp, Homo sapiens
aattttaatccacagtatgtta

SEQ ID NO: 4165854 - DNA, 21 bp, Homo sapiens
aattttacttttgttctgtat

SEQ ID NO: 4165855 - DNA, 17 bp, Homo sapiens
aattttatttagttctt

SEQ ID NO: 4165856 - DNA, 12 bp, Homo sapiens
aattttctagac

SEQ ID NO: 4165857 - DNA, 17 bp, Homo sapiens
aattttctagactttct

SEQ ID NO: 4165858 - DNA, 21 bp, Homo sapiens
aattttctgtgttctgaagtc

SEQ ID NO: 4165859 - DNA, 20 bp, Homo sapiens
aattttcttacccatatatc

SEQ ID NO: 4165860 - DNA, 23 bp, Homo sapiens
aattttggccctacctgtaactt

SEQ ID NO: 4165861 - DNA, 13 bp, Homo sapiens
aattttgttaaca

SEQ ID NO: 4165862 - DNA, 19 bp, Homo sapiens
aatttttataaatatgtga

SEQ ID NO: 4165863 - DNA, 17 bp, Homo sapiens
aatttttatttttgaac

SEQ ID NO: 4165864 - DNA, 13 bp, Homo sapiens
aatttttgatact

SEQ ID NO: 4165865 - DNA, 14 bp, Homo sapiens
acaaaaagacatgg

SEQ ID NO: 4165866 - DNA, 16 bp, Homo sapiens
acaaaaatactcagat

SEQ ID NO: 4165867 - DNA, 22 bp, Homo sapiens
acaaaccaccctaaaatgacag

SEQ ID NO: 4165868 - DNA, 22 bp, Homo sapiens
acaaactattacttacaaactg

SEQ ID NO: 4165869 - DNA, 17 bp, Homo sapiens
acaaagacacaggaaga

SEQ ID NO: 4165870 - DNA, 13 bp, Homo sapiens
acaaagacatgga

SEQ ID NO: 4165871 - DNA, 15 bp, Homo sapiens
acaaagacatggaag

SEQ ID NO: 4165872 - DNA, 22 bp, Homo sapiens
acaaagagttcaagaaataagt

SEQ ID NO: 4165873 - DNA, 14 bp, Homo sapiens
acaaagattgagaa

SEQ ID NO: 4165874 - DNA, 18 bp, Homo sapiens
acaaagattgagaagcca

SEQ ID NO: 4165875 - DNA, 22 bp, Homo sapiens
acaaagctaggatggttctgtg

SEQ ID NO: 4165876 - DNA, 14 bp, Homo sapiens
acaaagtaattcct

SEQ ID NO: 4165877 - DNA, 21 bp, Homo sapiens
acaaatgctggggtcatataa

SEQ ID NO: 4165878 - DNA, 13 bp, Homo sapiens
acaacaacaacaa

SEQ ID NO: 4165879 - DNA, 13 bp, Homo sapiens
acaacaacaatac

SEQ ID NO: 4165880 - DNA, 9 bp, Homo sapiens
acaacaata

SEQ ID NO: 4165881 - DNA, 18 bp, Homo sapiens
acaacaatggtttacatg

SEQ ID NO: 4165882 - DNA, 23 bp, Homo sapiens
acaacaatggtttacatgaacac

SEQ ID NO: 4165883 - DNA, 22 bp, Homo sapiens
acaacagttgggctgtcaacat

SEQ ID NO: 4165884 - DNA, 22 bp, Homo sapiens
acaacatttctatagccaaaaa

SEQ ID NO: 4165885 - DNA, 16 bp, Homo sapiens
acaaccaatggaatgt

SEQ ID NO: 4165886 - DNA, 19 bp, Homo sapiens
acaactaggcttcagcata

SEQ ID NO: 4165887 - DNA, 16 bp, Homo sapiens
acaactattttcagat

SEQ ID NO: 4165888 - DNA, 14 bp, Homo sapiens
acaactcagtctgt

SEQ ID NO: 4165889 - DNA, 18 bp, Homo sapiens
acaactcttccatttatt

SEQ ID NO: 4165890 - DNA, 19 bp, Homo sapiens
acaactggcaggcaggctc

SEQ ID NO: 4165891 - DNA, 16 bp, Homo sapiens
acaacttgtatttcca

SEQ ID NO: 4165892 - DNA, 21 bp, Homo sapiens
gcttgcttctgcagcaactcc

SEQ ID NO: 4165893 - DNA, 13 bp, Homo sapiens
gcttggcagagag

SEQ ID NO: 4165894 - DNA, 17 bp, Homo sapiens
gcttgggcagcatcccc

SEQ ID NO: 4165895 - DNA, 20 bp, Homo sapiens
gcttggtggccaagcctggc

SEQ ID NO: 4165896 - DNA, 13 bp, Homo sapiens
gcttgttgtgctt

SEQ ID NO: 4165897 - DNA, 22 bp, Homo sapiens
gcttgttgtttttaagtcctgt

SEQ ID NO: 4165898 - DNA, 18 bp, Homo sapiens
gctttcagggaggccctg

SEQ ID NO: 4165899 - DNA, 12 bp, Homo sapiens
gctttcatcact

SEQ ID NO: 4165900 - DNA, 16 bp, Homo sapiens
gctttcatcactacct

SEQ ID NO: 4165901 - DNA, 22 bp, Homo sapiens
gctttccccgggggaggaaggg

SEQ ID NO: 4165902 - DNA, 22 bp, Homo sapiens
gctttcctttccttctggctcc

SEQ ID NO: 4165903 - DNA, 17 bp, Homo sapiens
gctttctgatcaaggcc

SEQ ID NO: 4165904 - DNA, 22 bp, Homo sapiens
gctttctggaaaagaggagttt

SEQ ID NO: 4165905 - DNA, 13 bp, Homo sapiens
gctttctggagag

SEQ ID NO: 4165906 - DNA, 21 bp, Homo sapiens
ggaaaaaaattctgatacatt

SEQ ID NO: 4165907 - DNA, 21 bp, Homo sapiens
ggaaaaagaaaaacatttcct

SEQ ID NO: 4165908 - DNA, 19 bp, Homo sapiens
ggaaaaagaaagaaacact

SEQ ID NO: 4165909 - DNA, 17 bp, Homo sapiens
ggaaaaatcagaagcac

SEQ ID NO: 4165910 - DNA, 21 bp, Homo sapiens
ggaaaagaggagtttcgaggt

SEQ ID NO: 4165911 - DNA, 12 bp, Homo sapiens
ggaaaagttctt

SEQ ID NO: 4165912 - DNA, 14 bp, Homo sapiens
ggaaaccaaaggaa

SEQ ID NO: 4165913 - DNA, 22 bp, Homo sapiens
ggaaacccaaggaacaagagaa

SEQ ID NO: 4165914 - DNA, 12 bp, Homo sapiens
ggaaagacacag

SEQ ID NO: 4165915 - DNA, 19 bp, Homo sapiens
ggaaagcatcacctcaggc

SEQ ID NO: 4165916 - DNA, 13 bp, Homo sapiens
ggaaagcctctgc

SEQ ID NO: 4165917 - DNA, 19 bp, Homo sapiens
ggaaaggctcagtctcagg

SEQ ID NO: 4165918 - DNA, 13 bp, Homo sapiens
ggaaagggaagcc

SEQ ID NO: 4165919 - DNA, 17 bp, Homo sapiens
ggaaagggaagcctgac

SEQ ID NO: 4165920 - DNA, 18 bp, Homo sapiens
ggaaagggaagcctgact

SEQ ID NO: 4165921 - DNA, 21 bp, Homo sapiens
ggaaaggtttcaagacttgat

SEQ ID NO: 4165922 - DNA, 23 bp, Homo sapiens
ggaaaggtttcaagacttgatac

SEQ ID NO: 4165923 - DNA, 16 bp, Homo sapiens
ggaaagttcagccaga

SEQ ID NO: 4165924 - DNA, 15 bp, Homo sapiens
ggaaataaaaccttt

SEQ ID NO: 4165925 - DNA, 19 bp, Homo sapiens
ggaaataaaacctttcaaa

SEQ ID NO: 4165926 - DNA, 20 bp, Homo sapiens
ggaaataaaacctttcaaat

SEQ ID NO: 4165927 - DNA, 18 bp, Homo sapiens
ggaaatcattaaactttt

SEQ ID NO: 4165928 - DNA, 20 bp, Homo sapiens
ggaacactagacaagccaga

SEQ ID NO: 4165929 - DNA, 21 bp, Homo sapiens
ggaacactagacaagccagaa

SEQ ID NO: 4165930 - DNA, 22 bp, Homo sapiens
ggaacagctcttcactcagcca

SEQ ID NO: 4165931 - DNA, 13 bp, Homo sapiens
ggaactcccagca

SEQ ID NO: 4165932 - DNA, 12 bp, Homo sapiens
ggaactggctcc

SEQ ID NO: 4165933 - DNA, 22 bp, Homo sapiens
ggaagaagagatcaggaagaga

SEQ ID NO: 4165934 - DNA, 13 bp, Homo sapiens
ggaagacaggtct

SEQ ID NO: 4165935 - DNA, 15 bp, Homo sapiens
ggaagactctggagc

SEQ ID NO: 4165936 - DNA, 13 bp, Homo sapiens
ggaagagaaggga

SEQ ID NO: 4165937 - DNA, 21 bp, Homo sapiens
ggaagagaggcacctgctgga

SEQ ID NO: 4165938 - DNA, 13 bp, Homo sapiens
ggaagataatttt

SEQ ID NO: 4165939 - DNA, 19 bp, Homo sapiens
ggaagataattttatgtgt

SEQ ID NO: 4165940 - DNA, 17 bp, Homo sapiens
ggaagattagaggtttg

SEQ ID NO: 4165941 - DNA, 22 bp, Homo sapiens
ggaagattagaggtttgtcaac

SEQ ID NO: 4165942 - DNA, 23 bp, Homo sapiens
ggaagcaactccgtgtgcctggg

SEQ ID NO: 4165943 - DNA, 23 bp, Homo sapiens
ggaagcacactgcagggctgctg

SEQ ID NO: 4165944 - DNA, 11 bp, Homo sapiens
ggaagcaggga

SEQ ID NO: 4165945 - DNA, 20 bp, Homo sapiens
ggaagccatattcacacctc

SEQ ID NO: 4165946 - DNA, 15 bp, Homo sapiens
ggaagcctcttcagg

SEQ ID NO: 4165947 - DNA, 14 bp, Homo sapiens
ggaagcctgactgc

SEQ ID NO: 4165948 - DNA, 18 bp, Homo sapiens
ggaagcctgactgctcgg

SEQ ID NO: 4165949 - DNA, 21 bp, Homo sapiens
ggaagcctgactgctcggtca

SEQ ID NO: 4165950 - DNA, 23 bp, Homo sapiens
ggaagcgatgaatttggagactc

SEQ ID NO: 4165951 - DNA, 20 bp, Homo sapiens
ggaagcgggtggtggctctg

SEQ ID NO: 4165952 - DNA, 16 bp, Homo sapiens
ggaagctgggggaagg

SEQ ID NO: 4165953 - DNA, 18 bp, Homo sapiens
ggaaggaactctggcttc

SEQ ID NO: 4165954 - DNA, 23 bp, Homo sapiens
ggaaggaactctggcttccaggt

SEQ ID NO: 4165955 - DNA, 13 bp, Homo sapiens
ggaaggcagggac

SEQ ID NO: 4165956 - DNA, 17 bp, Homo sapiens
ggaaggcagggaggagg

SEQ ID NO: 4165957 - DNA, 21 bp, Homo sapiens
ggaaggcagggaggaggcaga

SEQ ID NO: 4165958 - DNA, 17 bp, Homo sapiens
ggaaggccgcaagaggc

SEQ ID NO: 4165959 - DNA, 17 bp, Homo sapiens
ggaaggctggctgggca

SEQ ID NO: 4165960 - DNA, 17 bp, Homo sapiens
ggaaggttagaggtttg

SEQ ID NO: 4165961 - DNA, 20 bp, Homo sapiens
ggaaggttaggtttgtcaac

SEQ ID NO: 4165962 - DNA, 18 bp, Homo sapiens
ggaagtttcatatattgt

SEQ ID NO: 4165963 - DNA, 13 bp, Homo sapiens
ggaatatgactca

SEQ ID NO: 4165964 - DNA, 14 bp, Homo sapiens
ggaatatgactcag

SEQ ID NO: 4165965 - DNA, 22 bp, Homo sapiens
ggaatcaagatgtcagactggc

SEQ ID NO: 4165966 - DNA, 13 bp, Homo sapiens
ggaatcctgctgc

SEQ ID NO: 4165967 - DNA, 14 bp, Homo sapiens
ggaatcctgctgcc

SEQ ID NO: 4165968 - DNA, 22 bp, Homo sapiens
ggaatgtatgctaattgaacat

SEQ ID NO: 4165969 - DNA, 19 bp, Homo sapiens
ggaatgtttgggcagaagg

SEQ ID NO: 4165970 - DNA, 12 bp, Homo sapiens
ggaatttgtaag

SEQ ID NO: 4165971 - DNA, 21 bp, Homo sapiens
ggaattttcagtcatctcatg

SEQ ID NO: 4165972 - DNA, 11 bp, Homo sapiens
ggacaaaatgg

SEQ ID NO: 4165973 - DNA, 13 bp, Homo sapiens
ggacaaagaacct

SEQ ID NO: 4165974 - DNA, 20 bp, Homo sapiens
ggacaacctgcccctcccca

SEQ ID NO: 4165975 - DNA, 16 bp, Homo sapiens
ggacaacttgtatctt

SEQ ID NO: 4165976 - DNA, 16 bp, Homo sapiens
ggacaagaagctgcta

SEQ ID NO: 4165977 - DNA, 10 bp, Homo sapiens
ggacacctgc

SEQ ID NO: 4165978 - DNA, 17 bp, Homo sapiens
ggacacctgccctgccc

SEQ ID NO: 4165979 - DNA, 21 bp, Homo sapiens
ggacagaacattgccttcctc

SEQ ID NO: 4165980 - DNA, 22 bp, Homo sapiens
ggacagaacattgccttcctcg

SEQ ID NO: 4165981 - DNA, 12 bp, Homo sapiens
ggacagagatgg

SEQ ID NO: 4165982 - DNA, 23 bp, Homo sapiens
ggacaggaggggcccacaatgga

SEQ ID NO: 4165983 - DNA, 18 bp, Homo sapiens
ggacaggtaagtggcagg

SEQ ID NO: 4165984 - DNA, 15 bp, Homo sapiens
ggacagtcctgggag

SEQ ID NO: 4165985 - DNA, 15 bp, Homo sapiens
ggacataaagcctct

SEQ ID NO: 4165986 - DNA, 20 bp, Homo sapiens
ggacatgatttagggaagca

SEQ ID NO: 4165987 - DNA, 20 bp, Homo sapiens
ggaccacaactattttcaga

SEQ ID NO: 4165988 - DNA, 21 bp, Homo sapiens
ggaccaggactatagcccagg

SEQ ID NO: 4165989 - DNA, 12 bp, Homo sapiens
ggacccagctcc

SEQ ID NO: 4165990 - DNA, 16 bp, Homo sapiens
ggacccagctcctctg

SEQ ID NO: 4165991 - DNA, 22 bp, Homo sapiens
ggacccagctcctctgagccat

SEQ ID NO: 4165992 - DNA, 17 bp, Homo sapiens
ggaccgcgtagagagcc

SEQ ID NO: 4165993 - DNA, 21 bp, Homo sapiens
ggaccgcgtagagagccgggc

SEQ ID NO: 4165994 - DNA, 17 bp, Homo sapiens
ggacctgagtctgctat

SEQ ID NO: 4165995 - DNA, 18 bp, Homo sapiens
ggacggcattcctgctta

SEQ ID NO: 4165996 - DNA, 17 bp, Homo sapiens
ggactccccaggccagg

SEQ ID NO: 4165997 - DNA, 19 bp, Homo sapiens
ggactccccaggccaggcc

SEQ ID NO: 4165998 - DNA, 12 bp, Homo sapiens
ggactcctccca

SEQ ID NO: 4165999 - DNA, 22 bp, Homo sapiens
ggactctatactaccctgggct

SEQ ID NO: 4166000 - DNA, 22 bp, Homo sapiens
ggactggaaccagggagaccga

SEQ ID NO: 4166001 - DNA, 15 bp, Homo sapiens
ggagaaggatagcct

SEQ ID NO: 4166002 - DNA, 18 bp, Homo sapiens
ggagacagcaattgtaga

SEQ ID NO: 4166003 - DNA, 18 bp, Homo sapiens
ggagaccccggtggcagt

SEQ ID NO: 4166004 - DNA, 19 bp, Homo sapiens
ggagaccccggtggcagtg

SEQ ID NO: 4166005 - DNA, 12 bp, Homo sapiens
ggagagcagctg

SEQ ID NO: 4166006 - DNA, 17 bp, Homo sapiens
ggagagcagctggctct

SEQ ID NO: 4166007 - DNA, 14 bp, Homo sapiens
ggagagccagctct

SEQ ID NO: 4166008 - DNA, 11 bp, Homo sapiens
ggagagcccag

SEQ ID NO: 4166009 - DNA, 12 bp, Homo sapiens
ggagagcccagc

SEQ ID NO: 4166010 - DNA, 12 bp, Homo sapiens
ggagagcctggc

SEQ ID NO: 4166011 - DNA, 16 bp, Homo sapiens
ggagattttccttcct

SEQ ID NO: 4166012 - DNA, 17 bp, Homo sapiens
ggagattttccttccta

SEQ ID NO: 4166013 - DNA, 13 bp, Homo sapiens
ggagccaaggcag

SEQ ID NO: 4166014 - DNA, 20 bp, Homo sapiens
ggagcccgcttcaagctctc

SEQ ID NO: 4166015 - DNA, 13 bp, Homo sapiens
ggagcccttgggt

SEQ ID NO: 4166016 - DNA, 11 bp, Homo sapiens
ggagcctgcct

SEQ ID NO: 4166017 - DNA, 20 bp, Homo sapiens
ggagcctgcctccttcagtg

SEQ ID NO: 4166018 - DNA, 23 bp, Homo sapiens
ggagcctgcctccttcagtgaca

SEQ ID NO: 4166019 - DNA, 15 bp, Homo sapiens
ggagcggagcttgcc

SEQ ID NO: 4166020 - DNA, 16 bp, Homo sapiens
ggagcggagcttgcct

SEQ ID NO: 4166021 - DNA, 18 bp, Homo sapiens
ggagctgctggctgacct

SEQ ID NO: 4166022 - DNA, 12 bp, Homo sapiens
ggagctggaaat

SEQ ID NO: 4166023 - DNA, 21 bp, Homo sapiens
ggagcttctctgatgtgatat

SEQ ID NO: 4166024 - DNA, 17 bp, Homo sapiens
ggagcttgcctgcctgc

SEQ ID NO: 4166025 - DNA, 13 bp, Homo sapiens
ggaggaaaagaca

SEQ ID NO: 4166026 - DNA, 19 bp, Homo sapiens
ggaggaagactctggagcc

SEQ ID NO: 4166027 - DNA, 22 bp, Homo sapiens
ggaggaagactctggagccaag

SEQ ID NO: 4166028 - DNA, 10 bp, Homo sapiens
ggaggaaggg

SEQ ID NO: 4166029 - DNA, 20 bp, Homo sapiens
ggaggaggtggcagccctgt

SEQ ID NO: 4166030 - DNA, 22 bp, Homo sapiens
ggaggatcactggagcccagga

SEQ ID NO: 4166031 - DNA, 14 bp, Homo sapiens
gctccctggcccag

SEQ ID NO: 4166032 - DNA, 24 bp, Homo sapiens
gctcctaaacccccgctccagatc

SEQ ID NO: 4166033 - DNA, 12 bp, Homo sapiens
gctcctccagcc

SEQ ID NO: 4166034 - DNA, 14 bp, Homo sapiens
gctcctccagccct

SEQ ID NO: 4166035 - DNA, 16 bp, Homo sapiens
gctcctccagcccttc

SEQ ID NO: 4166036 - DNA, 13 bp, Homo sapiens
gctcctctgagcc

SEQ ID NO: 4166037 - DNA, 15 bp, Homo sapiens
gctcctttgcctctg

SEQ ID NO: 4166038 - DNA, 17 bp, Homo sapiens
gctcgccccacccaggg

SEQ ID NO: 4166039 - DNA, 16 bp, Homo sapiens
gctcgctgcccaggga

SEQ ID NO: 4166040 - DNA, 22 bp, Homo sapiens
gctcggtcaggagggtgcagta

SEQ ID NO: 4166041 - DNA, 23 bp, Homo sapiens
gctctagtcttgctttgctgtct

SEQ ID NO: 4166042 - DNA, 14 bp, Homo sapiens
gctctagtgggaag

SEQ ID NO: 4166043 - DNA, 16 bp, Homo sapiens
gctctattgagccaag

SEQ ID NO: 4166044 - DNA, 20 bp, Homo sapiens
gctctattgagccaagacca

SEQ ID NO: 4166045 - DNA, 12 bp, Homo sapiens
gctctcagaagg

SEQ ID NO: 4166046 - DNA, 12 bp, Homo sapiens
gctctcagggct

SEQ ID NO: 4166047 - DNA, 12 bp, Homo sapiens
gctctcatcact

SEQ ID NO: 4166048 - DNA, 16 bp, Homo sapiens
gctctcatcactacct

SEQ ID NO: 4166049 - DNA, 16 bp, Homo sapiens
gctctcccctgccctg

SEQ ID NO: 4166050 - DNA, 12 bp, Homo sapiens
gctctctgctga

SEQ ID NO: 4166051 - DNA, 13 bp, Homo sapiens
gctctctgctgag

SEQ ID NO: 4166052 - DNA, 15 bp, Homo sapiens
gctctgacccagtga

SEQ ID NO: 4166053 - DNA, 15 bp, Homo sapiens
gctctgcaggcacct

SEQ ID NO: 4166054 - DNA, 18 bp, Homo sapiens
gctctgcaggcaccttag

SEQ ID NO: 4166055 - DNA, 15 bp, Homo sapiens
gctctgccccagagg

SEQ ID NO: 4166056 - DNA, 16 bp, Homo sapiens
gctctgccccagaggc

SEQ ID NO: 4166057 - DNA, 13 bp, Homo sapiens
gctctgccccagc

SEQ ID NO: 4166058 - DNA, 21 bp, Homo sapiens
gctctggaaaatgtgacccag

SEQ ID NO: 4166059 - DNA, 13 bp, Homo sapiens
gctctgtctactt

SEQ ID NO: 4166060 - DNA, 16 bp, Homo sapiens
gctcttaccaaaacag

SEQ ID NO: 4166061 - DNA, 21 bp, Homo sapiens
gctctttggggtcagccaggg

SEQ ID NO: 4166062 - DNA, 22 bp, Homo sapiens
gctctttggggtcagccagggc

SEQ ID NO: 4166063 - DNA, 13 bp, Homo sapiens
gctcttttccact

SEQ ID NO: 4166064 - DNA, 22 bp, Homo sapiens
gctgaaggacagaacattgcct

SEQ ID NO: 4166065 - DNA, 19 bp, Homo sapiens
gctgaccccaaagagcctg

SEQ ID NO: 4166066 - DNA, 13 bp, Homo sapiens
gctgacctgggcc

SEQ ID NO: 4166067 - DNA, 23 bp, Homo sapiens
gctgacctgggcccacagagcct

SEQ ID NO: 4166068 - DNA, 14 bp, Homo sapiens
gctgacctgttttt

SEQ ID NO: 4166069 - DNA, 13 bp, Homo sapiens
gctgactagatct

SEQ ID NO: 4166070 - DNA, 14 bp, Homo sapiens
gctgagagactttt

SEQ ID NO: 4166071 - DNA, 18 bp, Homo sapiens
gctgagcaacctcttcag

SEQ ID NO: 4166072 - DNA, 12 bp, Homo sapiens
gctgagccctgg

SEQ ID NO: 4166073 - DNA, 15 bp, Homo sapiens
gctgagccctggcag

SEQ ID NO: 4166074 - DNA, 15 bp, Homo sapiens
gctgaggatgacaga

SEQ ID NO: 4166075 - DNA, 16 bp, Homo sapiens
gctgaggatgacagag

SEQ ID NO: 4166076 - DNA, 14 bp, Homo sapiens
gctgaggcaggaga

SEQ ID NO: 4166077 - DNA, 23 bp, Homo sapiens
gctgaggggggccgtgcccaggg

SEQ ID NO: 4166078 - DNA, 14 bp, Homo sapiens
gctgagtgcactcc

SEQ ID NO: 4166079 - DNA, 12 bp, Homo sapiens
gctgataatttt

SEQ ID NO: 4166080 - DNA, 23 bp, Homo sapiens
gctgatggataacctatatgatt

SEQ ID NO: 4166081 - DNA, 13 bp, Homo sapiens
gctgattcaagaa

SEQ ID NO: 4166082 - DNA, 17 bp, Homo sapiens
gctgcacctgccagcct

SEQ ID NO: 4166083 - DNA, 22 bp, Homo sapiens
gctgcacctgccagcctggctt

SEQ ID NO: 4166084 - DNA, 14 bp, Homo sapiens
gctgcactgccctc

SEQ ID NO: 4166085 - DNA, 20 bp, Homo sapiens
gctgcagccagcagttgtaa

SEQ ID NO: 4166086 - DNA, 17 bp, Homo sapiens
gctgcaggaatctttaa

SEQ ID NO: 4166087 - DNA, 15 bp, Homo sapiens
gctgccagccgggca

SEQ ID NO: 4166088 - DNA, 13 bp, Homo sapiens
gctgccagcctga

SEQ ID NO: 4166089 - DNA, 14 bp, Homo sapiens
gctgccagcctgag

SEQ ID NO: 4166090 - DNA, 15 bp, Homo sapiens
gctgccaggctccca

SEQ ID NO: 4166091 - DNA, 23 bp, Homo sapiens
gctgccatggcgtgtccctctcg

SEQ ID NO: 4166092 - DNA, 20 bp, Homo sapiens
gctgcccctggtgcactggc

SEQ ID NO: 4166093 - DNA, 19 bp, Homo sapiens
gctgcccctgtaggttgct

SEQ ID NO: 4166094 - DNA, 15 bp, Homo sapiens
gctgccctgccactt

SEQ ID NO: 4166095 - DNA, 16 bp, Homo sapiens
gctgccgcctcccagc

SEQ ID NO: 4166096 - DNA, 20 bp, Homo sapiens
gctgccgcctcccagcctgg

SEQ ID NO: 4166097 - DNA, 20 bp, Homo sapiens
gctgcctgtggtgaggtcct

SEQ ID NO: 4166098 - DNA, 18 bp, Homo sapiens
gctgcggccagcctgact

SEQ ID NO: 4166099 - DNA, 17 bp, Homo sapiens
gctgctagagaaggggg

SEQ ID NO: 4166100 - DNA, 21 bp, Homo sapiens
gctgctctgctatatgcctta

SEQ ID NO: 4166101 - DNA, 16 bp, Homo sapiens
gctgctgaagaggcaa

SEQ ID NO: 4166102 - DNA, 17 bp, Homo sapiens
gctgctgaagaggcaag

SEQ ID NO: 4166103 - DNA, 19 bp, Homo sapiens
gctgctggctgacctgggc

SEQ ID NO: 4166104 - DNA, 12 bp, Homo sapiens
gctgctgggaga

SEQ ID NO: 4166105 - DNA, 14 bp, Homo sapiens
gctgcttctcctcc

SEQ ID NO: 4166106 - DNA, 23 bp, Homo sapiens
gctgcttctcctcccagcgtgtg

SEQ ID NO: 4166107 - DNA, 17 bp, Homo sapiens
gctggaaaataatactg

SEQ ID NO: 4166108 - DNA, 12 bp, Homo sapiens
gctggagaagct

SEQ ID NO: 4166109 - DNA, 15 bp, Homo sapiens
gctggcaaaggtggc

SEQ ID NO: 4166110 - DNA, 23 bp, Homo sapiens
gctggcagtgctgattcagcctg

SEQ ID NO: 4166111 - DNA, 21 bp, Homo sapiens
gctggcccagccaactgcccc

SEQ ID NO: 4166112 - DNA, 21 bp, Homo sapiens
gctggcctcccaataaagctg

SEQ ID NO: 4166113 - DNA, 13 bp, Homo sapiens
gctggctctccac

SEQ ID NO: 4166114 - DNA, 16 bp, Homo sapiens
gctggctgacctgggc

SEQ ID NO: 4166115 - DNA, 17 bp, Homo sapiens
gctggctgacctgggcc

SEQ ID NO: 4166116 - DNA, 22 bp, Homo sapiens
gctggctgacctgggcccacag

SEQ ID NO: 4166117 - DNA, 16 bp, Homo sapiens
gctggctgggcatgga

SEQ ID NO: 4166118 - DNA, 15 bp, Homo sapiens
gctggcttgggcagc

SEQ ID NO: 4166119 - DNA, 16 bp, Homo sapiens
gctgggactggccagg

SEQ ID NO: 4166120 - DNA, 15 bp, Homo sapiens
gctgggatatgtagt

SEQ ID NO: 4166121 - DNA, 17 bp, Homo sapiens
gctggggcaagtccctg

SEQ ID NO: 4166122 - DNA, 21 bp, Homo sapiens
gctgggtaaactgtggatgat

SEQ ID NO: 4166123 - DNA, 15 bp, Homo sapiens
gctggtaaactattt

SEQ ID NO: 4166124 - DNA, 18 bp, Homo sapiens
gctggtctggatggtaga

SEQ ID NO: 4166125 - DNA, 17 bp, Homo sapiens
gctggtgctgtggccag

SEQ ID NO: 4166126 - DNA, 15 bp, Homo sapiens
gctggtttaatgttt

SEQ ID NO: 4166127 - DNA, 13 bp, Homo sapiens
gctgtaagcattc

SEQ ID NO: 4166128 - DNA, 15 bp, Homo sapiens
gctgtagctcccgag

SEQ ID NO: 4166129 - DNA, 15 bp, Homo sapiens
gctgtcactggcaga

SEQ ID NO: 4166130 - DNA, 12 bp, Homo sapiens
gctgtcagccaa

SEQ ID NO: 4166131 - DNA, 16 bp, Homo sapiens
gctgtcctaggccaca

SEQ ID NO: 4166132 - DNA, 14 bp, Homo sapiens
gctgtcctttctag

SEQ ID NO: 4166133 - DNA, 16 bp, Homo sapiens
gctgtgctatggtgct

SEQ ID NO: 4166134 - DNA, 16 bp, Homo sapiens
gctgtgtctcacagag

SEQ ID NO: 4166135 - DNA, 12 bp, Homo sapiens
gctgtgtgcagg

SEQ ID NO: 4166136 - DNA, 23 bp, Homo sapiens
gctgtttccagttgttactgaag

SEQ ID NO: 4166137 - DNA, 13 bp, Homo sapiens
gcttaaaactttg

SEQ ID NO: 4166138 - DNA, 21 bp, Homo sapiens
gcttagaattctgagatccag

SEQ ID NO: 4166139 - DNA, 16 bp, Homo sapiens
gcttagagaatgttct

SEQ ID NO: 4166140 - DNA, 14 bp, Homo sapiens
gcttagagaggaaa

SEQ ID NO: 4166141 - DNA, 23 bp, Homo sapiens
gcttagcagggtgctaacgtatc

SEQ ID NO: 4166142 - DNA, 22 bp, Homo sapiens
gcttagcctcctgacctgaggc

SEQ ID NO: 4166143 - DNA, 13 bp, Homo sapiens
gcttatcaaaatc

SEQ ID NO: 4166144 - DNA, 18 bp, Homo sapiens
gcttatggggtattttaa

SEQ ID NO: 4166145 - DNA, 19 bp, Homo sapiens
gcttatggggtattttaag

SEQ ID NO: 4166146 - DNA, 22 bp, Homo sapiens
gcttattcccaactgctctgcc

SEQ ID NO: 4166147 - DNA, 17 bp, Homo sapiens
gcttcaagctctctgtt

SEQ ID NO: 4166148 - DNA, 14 bp, Homo sapiens
gcttcaccttggag

SEQ ID NO: 4166149 - DNA, 21 bp, Homo sapiens
gcttcagcctgaggctgagac

SEQ ID NO: 4166150 - DNA, 23 bp, Homo sapiens
gcttcagcctgaggctgagactg

SEQ ID NO: 4166151 - DNA, 14 bp, Homo sapiens
gcttcagtggagaa

SEQ ID NO: 4166152 - DNA, 18 bp, Homo sapiens
gcttcatgctcagccctg

SEQ ID NO: 4166153 - DNA, 19 bp, Homo sapiens
gcttccagaaaaccccagc

SEQ ID NO: 4166154 - DNA, 19 bp, Homo sapiens
gcttccaggtatctccagg

SEQ ID NO: 4166155 - DNA, 20 bp, Homo sapiens
gcttccaggtatctccagga

SEQ ID NO: 4166156 - DNA, 22 bp, Homo sapiens
gcttccatgcctgtagctttcc

SEQ ID NO: 4166157 - DNA, 17 bp, Homo sapiens
gcttcccagaggccagg

SEQ ID NO: 4166158 - DNA, 18 bp, Homo sapiens
gcttccctaggctgagct

SEQ ID NO: 4166159 - DNA, 19 bp, Homo sapiens
gcttccctaggctgagctg

SEQ ID NO: 4166160 - DNA, 16 bp, Homo sapiens
gcttctgcttcaaacc

SEQ ID NO: 4166161 - DNA, 12 bp, Homo sapiens
gcttctggagcc

SEQ ID NO: 4166162 - DNA, 15 bp, Homo sapiens
gcttctggccaggaa

SEQ ID NO: 4166163 - DNA, 16 bp, Homo sapiens
gcttctggccaggaag

SEQ ID NO: 4166164 - DNA, 18 bp, Homo sapiens
gcttgagggacaatgcca

SEQ ID NO: 4166165 - DNA, 19 bp, Homo sapiens
gcttgcactttgtaacatg

SEQ ID NO: 4166166 - DNA, 11 bp, Homo sapiens
gcttgccctgg

SEQ ID NO: 4166167 - DNA, 18 bp, Homo sapiens
gcttgcctgcctgcctgt

SEQ ID NO: 4166168 - DNA, 13 bp, Homo sapiens
gcttgctgagggg

SEQ ID NO: 4166169 - DNA, 14 bp, Homo sapiens
gcttgctgaggggc

SEQ ID NO: 4166170 - DNA, 23 bp, Homo sapiens
gcttgctgaggggcagggagagc

SEQ ID NO: 4166171 - DNA, 16 bp, Homo sapiens
gcttgcttctgcagca

SEQ ID NO: 4166172 - DNA, 17 bp, Homo sapiens
gcctctctgctccagag

SEQ ID NO: 4166173 - DNA, 13 bp, Homo sapiens
gcctctgcccgca

SEQ ID NO: 4166174 - DNA, 22 bp, Homo sapiens
gcctctgcccgcagagcccacg

SEQ ID NO: 4166175 - DNA, 18 bp, Homo sapiens
gcctcttaaagctgcctg

SEQ ID NO: 4166176 - DNA, 19 bp, Homo sapiens
gcctcttaaagctgcctgt

SEQ ID NO: 4166177 - DNA, 12 bp, Homo sapiens
gcctcttcagca

SEQ ID NO: 4166178 - DNA, 18 bp, Homo sapiens
gcctcttcctctgggcag

SEQ ID NO: 4166179 - DNA, 21 bp, Homo sapiens
gcctgaaaaaactggtatgtt

SEQ ID NO: 4166180 - DNA, 22 bp, Homo sapiens
gcctgactgcacacagctaggc

SEQ ID NO: 4166181 - DNA, 14 bp, Homo sapiens
gcctgactgctcgg

SEQ ID NO: 4166182 - DNA, 18 bp, Homo sapiens
gcctgaggctgagactgc

SEQ ID NO: 4166183 - DNA, 19 bp, Homo sapiens
gcctgcagaggacagagct

SEQ ID NO: 4166184 - DNA, 21 bp, Homo sapiens
gcctgcagaggacagagctgg

SEQ ID NO: 4166185 - DNA, 13 bp, Homo sapiens
gcctgcctccttc

SEQ ID NO: 4166186 - DNA, 16 bp, Homo sapiens
gcctgcctgcctgtgg

SEQ ID NO: 4166187 - DNA, 16 bp, Homo sapiens
gcctgccttgaagcca

SEQ ID NO: 4166188 - DNA, 23 bp, Homo sapiens
gcctgccttgaagccactgaagc

SEQ ID NO: 4166189 - DNA, 19 bp, Homo sapiens
gcctgctgcgtcagaccag

SEQ ID NO: 4166190 - DNA, 22 bp, Homo sapiens
gcctggaccgcttcccagaggc

SEQ ID NO: 4166191 - DNA, 12 bp, Homo sapiens
gcctggagaagc

SEQ ID NO: 4166192 - DNA, 13 bp, Homo sapiens
gcctggagaagct

SEQ ID NO: 4166193 - DNA, 20 bp, Homo sapiens
gcctggcaaggcattcctca

SEQ ID NO: 4166194 - DNA, 22 bp, Homo sapiens
gcctggcaaggcattcctcatc

SEQ ID NO: 4166195 - DNA, 17 bp, Homo sapiens
gcctggcccccctccag

SEQ ID NO: 4166196 - DNA, 17 bp, Homo sapiens
gcctggcgtctggacgc

SEQ ID NO: 4166197 - DNA, 22 bp, Homo sapiens
gcctggcttctggagcccttgg

SEQ ID NO: 4166198 - DNA, 15 bp, Homo sapiens
gcctggcttgctgtg

SEQ ID NO: 4166199 - DNA, 16 bp, Homo sapiens
gcctgggaatcctgct

SEQ ID NO: 4166200 - DNA, 18 bp, Homo sapiens
gcctgggaatcctgctgc

SEQ ID NO: 4166201 - DNA, 20 bp, Homo sapiens
gcctgggcgacagagcgaga

SEQ ID NO: 4166202 - DNA, 19 bp, Homo sapiens
gcctggggtgatagaacaa

SEQ ID NO: 4166203 - DNA, 20 bp, Homo sapiens
gcctgtaatcccagcacttt

SEQ ID NO: 4166204 - DNA, 19 bp, Homo sapiens
gcctgtagtcccagccact

SEQ ID NO: 4166205 - DNA, 16 bp, Homo sapiens
gcctgtcctggtacag

SEQ ID NO: 4166206 - DNA, 20 bp, Homo sapiens
gcctgtcctggtacagcagg

SEQ ID NO: 4166207 - DNA, 15 bp, Homo sapiens
gcctgtgctaaagaa

SEQ ID NO: 4166208 - DNA, 16 bp, Homo sapiens
gccttactcacctctc

SEQ ID NO: 4166209 - DNA, 12 bp, Homo sapiens
gccttcaagtgc

SEQ ID NO: 4166210 - DNA, 15 bp, Homo sapiens
gccttcaagtgccaa

SEQ ID NO: 4166211 - DNA, 18 bp, Homo sapiens
gccttccccctcccaggg

SEQ ID NO: 4166212 - DNA, 16 bp, Homo sapiens
gccttccctccccaca

SEQ ID NO: 4166213 - DNA, 18 bp, Homo sapiens
gccttcctcgtgcagagc

SEQ ID NO: 4166214 - DNA, 16 bp, Homo sapiens
gccttctccctgggaa

SEQ ID NO: 4166215 - DNA, 15 bp, Homo sapiens
gccttgaagccactg

SEQ ID NO: 4166216 - DNA, 16 bp, Homo sapiens
gccttgatgttgtgtt

SEQ ID NO: 4166217 - DNA, 22 bp, Homo sapiens
gccttgcccggattctgggagg

SEQ ID NO: 4166218 - DNA, 18 bp, Homo sapiens
gcctttcaggtccaggcc

SEQ ID NO: 4166219 - DNA, 19 bp, Homo sapiens
gcctttctctggctccaga

SEQ ID NO: 4166220 - DNA, 20 bp, Homo sapiens
gcctttggatgaccagaaca

SEQ ID NO: 4166221 - DNA, 15 bp, Homo sapiens
gccttttaaaagaaa

SEQ ID NO: 4166222 - DNA, 19 bp, Homo sapiens
gccttttttcacagcccgg

SEQ ID NO: 4166223 - DNA, 14 bp, Homo sapiens
gcgaaggggccctg

SEQ ID NO: 4166224 - DNA, 12 bp, Homo sapiens
gcgaataaatgt

SEQ ID NO: 4166225 - DNA, 17 bp, Homo sapiens
gcgaataaatgttcaaa

SEQ ID NO: 4166226 - DNA, 14 bp, Homo sapiens
gcgagctgctctgc

SEQ ID NO: 4166227 - DNA, 14 bp, Homo sapiens
gcgagggctactca

SEQ ID NO: 4166228 - DNA, 16 bp, Homo sapiens
gcgagggctactcagc

SEQ ID NO: 4166229 - DNA, 18 bp, Homo sapiens
gcgagggctactcagcag

SEQ ID NO: 4166230 - DNA, 21 bp, Homo sapiens
gcgagtgccaggactccccag

SEQ ID NO: 4166231 - DNA, 17 bp, Homo sapiens
gcgagttgtggaaagcc

SEQ ID NO: 4166232 - DNA, 19 bp, Homo sapiens
gcgatgaatttggagactc

SEQ ID NO: 4166233 - DNA, 11 bp, Homo sapiens
gcgcacacaca

SEQ ID NO: 4166234 - DNA, 22 bp, Homo sapiens
gcgcagccgccgggcaggcctg

SEQ ID NO: 4166235 - DNA, 22 bp, Homo sapiens
gcgccactacactccagcctga

SEQ ID NO: 4166236 - DNA, 22 bp, Homo sapiens
gcgcctccttccttgctgtcct

SEQ ID NO: 4166237 - DNA, 18 bp, Homo sapiens
gcgcctcttcctctgggc

SEQ ID NO: 4166238 - DNA, 15 bp, Homo sapiens
gcgctcatctggctt

SEQ ID NO: 4166239 - DNA, 22 bp, Homo sapiens
gcgctttctggaaaagaggagt

SEQ ID NO: 4166240 - DNA, 13 bp, Homo sapiens
gcggaaggggacg

SEQ ID NO: 4166241 - DNA, 19 bp, Homo sapiens
gcggagcttgcctgcctgc

SEQ ID NO: 4166242 - DNA, 12 bp, Homo sapiens
gcggaggcggct

SEQ ID NO: 4166243 - DNA, 18 bp, Homo sapiens
gcggaggcggctccaggt

SEQ ID NO: 4166244 - DNA, 12 bp, Homo sapiens
gcggcgcagagg

SEQ ID NO: 4166245 - DNA, 15 bp, Homo sapiens
gcgggagctctgtat

SEQ ID NO: 4166246 - DNA, 16 bp, Homo sapiens
gcgggatggtcctggg

SEQ ID NO: 4166247 - DNA, 17 bp, Homo sapiens
gcgggatggtcctgggg

SEQ ID NO: 4166248 - DNA, 16 bp, Homo sapiens
gcgggcaccagaatgc

SEQ ID NO: 4166249 - DNA, 16 bp, Homo sapiens
gcgggccaccaagttc

SEQ ID NO: 4166250 - DNA, 18 bp, Homo sapiens
gcgggcggaggcggctcc

SEQ ID NO: 4166251 - DNA, 13 bp, Homo sapiens
gcggggcagagcc

SEQ ID NO: 4166252 - DNA, 14 bp, Homo sapiens
gcgggggagctgga

SEQ ID NO: 4166253 - DNA, 15 bp, Homo sapiens
gcgggggcgtggctg

SEQ ID NO: 4166254 - DNA, 13 bp, Homo sapiens
gcgggtgggtggg

SEQ ID NO: 4166255 - DNA, 13 bp, Homo sapiens
gcggttgcttctg

SEQ ID NO: 4166256 - DNA, 15 bp, Homo sapiens
gcgtctgccccaccc

SEQ ID NO: 4166257 - DNA, 20 bp, Homo sapiens
gcgtctggacgccgagggca

SEQ ID NO: 4166258 - DNA, 19 bp, Homo sapiens
gcgtgactattttttaata

SEQ ID NO: 4166259 - DNA, 12 bp, Homo sapiens
gcgtgtgtatcc

SEQ ID NO: 4166260 - DNA, 17 bp, Homo sapiens
gcgtgtgtatccgactc

SEQ ID NO: 4166261 - DNA, 14 bp, Homo sapiens
gctaagagaagtag

SEQ ID NO: 4166262 - DNA, 16 bp, Homo sapiens
gctacacaaaagccaa

SEQ ID NO: 4166263 - DNA, 13 bp, Homo sapiens
gctacataattta

SEQ ID NO: 4166264 - DNA, 14 bp, Homo sapiens
gctacccaggaggc

SEQ ID NO: 4166265 - DNA, 21 bp, Homo sapiens
gctacccaggaggctgaggca

SEQ ID NO: 4166266 - DNA, 17 bp, Homo sapiens
gctactcagaagcctga

SEQ ID NO: 4166267 - DNA, 18 bp, Homo sapiens
gctactcagaagcctgag

SEQ ID NO: 4166268 - DNA, 13 bp, Homo sapiens
gctactcagcagt

SEQ ID NO: 4166269 - DNA, 16 bp, Homo sapiens
gctactgatttttgtg

SEQ ID NO: 4166270 - DNA, 19 bp, Homo sapiens
gctactgcagctttacatg

SEQ ID NO: 4166271 - DNA, 18 bp, Homo sapiens
gctactgccgtcagtgct

SEQ ID NO: 4166272 - DNA, 16 bp, Homo sapiens
gctactttgccttttg

SEQ ID NO: 4166273 - DNA, 21 bp, Homo sapiens
gctagaattgagtgtttaaag

SEQ ID NO: 4166274 - DNA, 12 bp, Homo sapiens
gctaggcatgcc

SEQ ID NO: 4166275 - DNA, 17 bp, Homo sapiens
gctaggcatgcctggga

SEQ ID NO: 4166276 - DNA, 18 bp, Homo sapiens
gctaggcgagtgccagga

SEQ ID NO: 4166277 - DNA, 21 bp, Homo sapiens
gctaggcgagtgccaggactc

SEQ ID NO: 4166278 - DNA, 16 bp, Homo sapiens
gctaggggctggtcct

SEQ ID NO: 4166279 - DNA, 16 bp, Homo sapiens
gctataggctggagaa

SEQ ID NO: 4166280 - DNA, 14 bp, Homo sapiens
gctatatttatata

SEQ ID NO: 4166281 - DNA, 22 bp, Homo sapiens
gctatattttcatgacttttcc

SEQ ID NO: 4166282 - DNA, 13 bp, Homo sapiens
gctatcacacagt

SEQ ID NO: 4166283 - DNA, 14 bp, Homo sapiens
gctatgacatgcaa

SEQ ID NO: 4166284 - DNA, 17 bp, Homo sapiens
gctatgggaatcagctg

SEQ ID NO: 4166285 - DNA, 18 bp, Homo sapiens
gctatgggaatcagctgg

SEQ ID NO: 4166286 - DNA, 22 bp, Homo sapiens
gctattacatgtgttagtgtat

SEQ ID NO: 4166287 - DNA, 19 bp, Homo sapiens
gctatttaaaaagctcttt

SEQ ID NO: 4166288 - DNA, 16 bp, Homo sapiens
gctatttaaaagtata

SEQ ID NO: 4166289 - DNA, 21 bp, Homo sapiens
gctatttctagtagaaagaaa

SEQ ID NO: 4166290 - DNA, 22 bp, Homo sapiens
gctatttctagtagaaagaaaa

SEQ ID NO: 4166291 - DNA, 18 bp, Homo sapiens
gctattttatattacact

SEQ ID NO: 4166292 - DNA, 23 bp, Homo sapiens
gctattttatattacactacaca

SEQ ID NO: 4166293 - DNA, 23 bp, Homo sapiens
gctcacgactcttcctgcaaagg

SEQ ID NO: 4166294 - DNA, 21 bp, Homo sapiens
gctcacgcctatgatcccagc

SEQ ID NO: 4166295 - DNA, 13 bp, Homo sapiens
gctcagactctgg

SEQ ID NO: 4166296 - DNA, 24 bp, Homo sapiens
gctcagactctgggtccctcggag

SEQ ID NO: 4166297 - DNA, 21 bp, Homo sapiens
gctcagccaaggagtcagatg

SEQ ID NO: 4166298 - DNA, 20 bp, Homo sapiens
gctcagccctgactggtgct

SEQ ID NO: 4166299 - DNA, 21 bp, Homo sapiens
gctcagctcgctgcccaggga

SEQ ID NO: 4166300 - DNA, 15 bp, Homo sapiens
gctcaggaggcttgg

SEQ ID NO: 4166301 - DNA, 14 bp, Homo sapiens
gctcagtctcagga

SEQ ID NO: 4166302 - DNA, 23 bp, Homo sapiens
gctcatgttttctatatgaactt

SEQ ID NO: 4166303 - DNA, 21 bp, Homo sapiens
gctccagagagaggatgcaga

SEQ ID NO: 4166304 - DNA, 19 bp, Homo sapiens
gctccaggtccggaggggt

SEQ ID NO: 4166305 - DNA, 12 bp, Homo sapiens
gctcccactgcc

SEQ ID NO: 4166306 - DNA, 14 bp, Homo sapiens
gctcccagggtcct

SEQ ID NO: 4166307 - DNA, 20 bp, Homo sapiens
gctcccgagctactctcttg

SEQ ID NO: 4166308 - DNA, 21 bp, Homo sapiens
gctcccgcatttctcatgctt

SEQ ID NO: 4166309 - DNA, 13 bp, Homo sapiens
gctccctcctgga

SEQ ID NO: 4166310 - DNA, 13 bp, Homo sapiens
gctccctggccca

SEQ ID NO: 4166311 - DNA, 21 bp, Homo sapiens
gccactacactccagcctgag

SEQ ID NO: 4166312 - DNA, 23 bp, Homo sapiens
gccactacactccagcctgagca

SEQ ID NO: 4166313 - DNA, 16 bp, Homo sapiens
gccactacctttgtcc

SEQ ID NO: 4166314 - DNA, 15 bp, Homo sapiens
gccactctcccctcc

SEQ ID NO: 4166315 - DNA, 23 bp, Homo sapiens
gccactctcccctccctcttcct

SEQ ID NO: 4166316 - DNA, 13 bp, Homo sapiens
gccactcttccaa

SEQ ID NO: 4166317 - DNA, 17 bp, Homo sapiens
gccactgaagctgggat

SEQ ID NO: 4166318 - DNA, 19 bp, Homo sapiens
gccactgcactccagcctg

SEQ ID NO: 4166319 - DNA, 21 bp, Homo sapiens
gccactttggtacatggccag

SEQ ID NO: 4166320 - DNA, 22 bp, Homo sapiens
gccactttggtacatggccagt

SEQ ID NO: 4166321 - DNA, 23 bp, Homo sapiens
gccactttggtacatggccagtg

SEQ ID NO: 4166322 - DNA, 22 bp, Homo sapiens
gccagagccaaggggcttcagg

SEQ ID NO: 4166323 - DNA, 21 bp, Homo sapiens
gccagccaggaactggctcct

SEQ ID NO: 4166324 - DNA, 15 bp, Homo sapiens
gccagccggtgcctg

SEQ ID NO: 4166325 - DNA, 13 bp, Homo sapiens
gccagcctgagcg

SEQ ID NO: 4166326 - DNA, 16 bp, Homo sapiens
gccagcctggcttctg

SEQ ID NO: 4166327 - DNA, 19 bp, Homo sapiens
gccagcctggcttctggag

SEQ ID NO: 4166328 - DNA, 17 bp, Homo sapiens
gccagctctctctaccc

SEQ ID NO: 4166329 - DNA, 16 bp, Homo sapiens
gccaggaactggctcc

SEQ ID NO: 4166330 - DNA, 22 bp, Homo sapiens
gccaggaagctttggtgagaac

SEQ ID NO: 4166331 - DNA, 17 bp, Homo sapiens
gccaggactccccaggc

SEQ ID NO: 4166332 - DNA, 21 bp, Homo sapiens
gccaggactccccaggccagg

SEQ ID NO: 4166333 - DNA, 13 bp, Homo sapiens
gccaggactgtga

SEQ ID NO: 4166334 - DNA, 23 bp, Homo sapiens
gccaggactgtgataatcagaag

SEQ ID NO: 4166335 - DNA, 19 bp, Homo sapiens
gccaggcaccccctggaga

SEQ ID NO: 4166336 - DNA, 20 bp, Homo sapiens
gccaggcaccccctggagag

SEQ ID NO: 4166337 - DNA, 21 bp, Homo sapiens
gccaggcaccccctggagaga

SEQ ID NO: 4166338 - DNA, 20 bp, Homo sapiens
gccaggcaggggtgggagag

SEQ ID NO: 4166339 - DNA, 19 bp, Homo sapiens
gccaggccaccaggatggc

SEQ ID NO: 4166340 - DNA, 15 bp, Homo sapiens
gccaggctgtaagca

SEQ ID NO: 4166341 - DNA, 15 bp, Homo sapiens
gccagggccctgcag

SEQ ID NO: 4166342 - DNA, 13 bp, Homo sapiens
gccaggtgcagtg

SEQ ID NO: 4166343 - DNA, 23 bp, Homo sapiens
gccagtacagagaaattctgtgg

SEQ ID NO: 4166344 - DNA, 14 bp, Homo sapiens
gccagtgagggctg

SEQ ID NO: 4166345 - DNA, 15 bp, Homo sapiens
gccagtgagggctgg

SEQ ID NO: 4166346 - DNA, 20 bp, Homo sapiens
gccagtgagggctgggccca

SEQ ID NO: 4166347 - DNA, 21 bp, Homo sapiens
gccagtgagggctgggcccac

SEQ ID NO: 4166348 - DNA, 17 bp, Homo sapiens
gccagtgtgatcccaag

SEQ ID NO: 4166349 - DNA, 22 bp, Homo sapiens
gccatcagggtgggccactctc

SEQ ID NO: 4166350 - DNA, 23 bp, Homo sapiens
gccatcagggtgggccactctcc

SEQ ID NO: 4166351 - DNA, 13 bp, Homo sapiens
gccatgatgcctc

SEQ ID NO: 4166352 - DNA, 15 bp, Homo sapiens
gccatgatgcctctg

SEQ ID NO: 4166353 - DNA, 21 bp, Homo sapiens
gccatgatggtgctgacctct

SEQ ID NO: 4166354 - DNA, 14 bp, Homo sapiens
gccatgctgaaggg

SEQ ID NO: 4166355 - DNA, 17 bp, Homo sapiens
gccatggaataaaccat

SEQ ID NO: 4166356 - DNA, 15 bp, Homo sapiens
gccatgggcctgctg

SEQ ID NO: 4166357 - DNA, 18 bp, Homo sapiens
gccatgtgcttattatat

SEQ ID NO: 4166358 - DNA, 16 bp, Homo sapiens
gccattaccatggaga

SEQ ID NO: 4166359 - DNA, 12 bp, Homo sapiens
gccattcccact

SEQ ID NO: 4166360 - DNA, 15 bp, Homo sapiens
gccattgtactccag

SEQ ID NO: 4166361 - DNA, 18 bp, Homo sapiens
gccatttccatggctctg

SEQ ID NO: 4166362 - DNA, 17 bp, Homo sapiens
gcccaaggtgctgatgt

SEQ ID NO: 4166363 - DNA, 12 bp, Homo sapiens
gcccacagggaa

SEQ ID NO: 4166364 - DNA, 19 bp, Homo sapiens
gcccacagggaaccctgct

SEQ ID NO: 4166365 - DNA, 16 bp, Homo sapiens
gcccagaaccacagat

SEQ ID NO: 4166366 - DNA, 19 bp, Homo sapiens
gcccagaaccacagatgtg

SEQ ID NO: 4166367 - DNA, 16 bp, Homo sapiens
gcccagagaccccttc

SEQ ID NO: 4166368 - DNA, 17 bp, Homo sapiens
gcccagagaccccttcc

SEQ ID NO: 4166369 - DNA, 23 bp, Homo sapiens
gcccagagaccccttcctttcct

SEQ ID NO: 4166370 - DNA, 13 bp, Homo sapiens
gcccagagggccc

SEQ ID NO: 4166371 - DNA, 15 bp, Homo sapiens
gcccagagggcccag

SEQ ID NO: 4166372 - DNA, 16 bp, Homo sapiens
gcccagcaggcaggca

SEQ ID NO: 4166373 - DNA, 17 bp, Homo sapiens
gcccagcaggcaggcac

SEQ ID NO: 4166374 - DNA, 16 bp, Homo sapiens
gcccagccagccagga

SEQ ID NO: 4166375 - DNA, 20 bp, Homo sapiens
gcccagccattaccatggag

SEQ ID NO: 4166376 - DNA, 22 bp, Homo sapiens
gcccagccattaccatggagac

SEQ ID NO: 4166377 - DNA, 16 bp, Homo sapiens
gcccagccctaaacat

SEQ ID NO: 4166378 - DNA, 15 bp, Homo sapiens
gcccagcctgtcctg

SEQ ID NO: 4166379 - DNA, 15 bp, Homo sapiens
gcccagctgcacctg

SEQ ID NO: 4166380 - DNA, 16 bp, Homo sapiens
gcccaggcactgcaaa

SEQ ID NO: 4166381 - DNA, 20 bp, Homo sapiens
gcccaggggcccacagggaa

SEQ ID NO: 4166382 - DNA, 12 bp, Homo sapiens
gcccaggtcctc

SEQ ID NO: 4166383 - DNA, 15 bp, Homo sapiens
gccccacccagggct

SEQ ID NO: 4166384 - DNA, 22 bp, Homo sapiens
gccccaccctcgtggacacctg

SEQ ID NO: 4166385 - DNA, 21 bp, Homo sapiens
gccccagaacaattctgcaga

SEQ ID NO: 4166386 - DNA, 19 bp, Homo sapiens
gccccagaggcctctctct

SEQ ID NO: 4166387 - DNA, 18 bp, Homo sapiens
gccccagggctaccctcc

SEQ ID NO: 4166388 - DNA, 13 bp, Homo sapiens
gcccccacccagt

SEQ ID NO: 4166389 - DNA, 14 bp, Homo sapiens
gccccccacctttg

SEQ ID NO: 4166390 - DNA, 21 bp, Homo sapiens
gccccccatgccctccctgct

SEQ ID NO: 4166391 - DNA, 12 bp, Homo sapiens
gcccccctccag

SEQ ID NO: 4166392 - DNA, 20 bp, Homo sapiens
gcccccgacagcccagccta

SEQ ID NO: 4166393 - DNA, 23 bp, Homo sapiens
gccccctggtggacagtcctggg

SEQ ID NO: 4166394 - DNA, 15 bp, Homo sapiens
gccccgacccctgtc

SEQ ID NO: 4166395 - DNA, 17 bp, Homo sapiens
gccccgcgcctccttcc

SEQ ID NO: 4166396 - DNA, 21 bp, Homo sapiens
gcccctagaaaccacctgggt

SEQ ID NO: 4166397 - DNA, 23 bp, Homo sapiens
gcccctagaaaccacctgggttc

SEQ ID NO: 4166398 - DNA, 22 bp, Homo sapiens
gcccctccagagacaggaaaga

SEQ ID NO: 4166399 - DNA, 20 bp, Homo sapiens
gccccttgctctcccctgcc

SEQ ID NO: 4166400 - DNA, 14 bp, Homo sapiens
gcccgaccccatct

SEQ ID NO: 4166401 - DNA, 18 bp, Homo sapiens
gccctaggattcctcccc

SEQ ID NO: 4166402 - DNA, 17 bp, Homo sapiens
gccctatttttgcaatg

SEQ ID NO: 4166403 - DNA, 24 bp, Homo sapiens
gccctcataaaccaatgtggcaag

SEQ ID NO: 4166404 - DNA, 17 bp, Homo sapiens
gccctccctggcatgtc

SEQ ID NO: 4166405 - DNA, 18 bp, Homo sapiens
gccctccctggcatgtca

SEQ ID NO: 4166406 - DNA, 14 bp, Homo sapiens
gccctccgcccttc

SEQ ID NO: 4166407 - DNA, 22 bp, Homo sapiens
gccctgcaagacacaggctcag

SEQ ID NO: 4166408 - DNA, 21 bp, Homo sapiens
gccctgcagaggggaaaccag

SEQ ID NO: 4166409 - DNA, 18 bp, Homo sapiens
gccctgccacctgtctgt

SEQ ID NO: 4166410 - DNA, 20 bp, Homo sapiens
gccctgccacctgtctgtct

SEQ ID NO: 4166411 - DNA, 12 bp, Homo sapiens
gccctgccttca

SEQ ID NO: 4166412 - DNA, 12 bp, Homo sapiens
gccctggcagga

SEQ ID NO: 4166413 - DNA, 15 bp, Homo sapiens
gccctggtccttcca

SEQ ID NO: 4166414 - DNA, 18 bp, Homo sapiens
gccctggtccttccaggc

SEQ ID NO: 4166415 - DNA, 22 bp, Homo sapiens
gcccttaaacaactgcagaaag

SEQ ID NO: 4166416 - DNA, 20 bp, Homo sapiens
gcccttcaacttcagaaggc

SEQ ID NO: 4166417 - DNA, 16 bp, Homo sapiens
gcccttcccactggag

SEQ ID NO: 4166418 - DNA, 15 bp, Homo sapiens
gcccttctgtccacc

SEQ ID NO: 4166419 - DNA, 14 bp, Homo sapiens
gcccttggcttctg

SEQ ID NO: 4166420 - DNA, 12 bp, Homo sapiens
gccctttctgtg

SEQ ID NO: 4166421 - DNA, 21 bp, Homo sapiens
gccctttggggttgcccagcc

SEQ ID NO: 4166422 - DNA, 20 bp, Homo sapiens
gccgagatcacgccactgca

SEQ ID NO: 4166423 - DNA, 17 bp, Homo sapiens
gccgcagcctccctctg

SEQ ID NO: 4166424 - DNA, 17 bp, Homo sapiens
gccgccgggcaggcctg

SEQ ID NO: 4166425 - DNA, 18 bp, Homo sapiens
gccgggagaggactctgc

SEQ ID NO: 4166426 - DNA, 14 bp, Homo sapiens
gccgggcaggcctg

SEQ ID NO: 4166427 - DNA, 13 bp, Homo sapiens
gccgggtgcggtg

SEQ ID NO: 4166428 - DNA, 16 bp, Homo sapiens
gccgggtgcggtggct

SEQ ID NO: 4166429 - DNA, 23 bp, Homo sapiens
gccgtgcctttctctggctccag

SEQ ID NO: 4166430 - DNA, 22 bp, Homo sapiens
gccgtggggctccggaggggac

SEQ ID NO: 4166431 - DNA, 18 bp, Homo sapiens
gcctaagtgtggagaagg

SEQ ID NO: 4166432 - DNA, 17 bp, Homo sapiens
gcctaattcctggcatg

SEQ ID NO: 4166433 - DNA, 20 bp, Homo sapiens
gcctagaacatccctgggca

SEQ ID NO: 4166434 - DNA, 15 bp, Homo sapiens
gcctagactgttact

SEQ ID NO: 4166435 - DNA, 14 bp, Homo sapiens
gcctagcccacttg

SEQ ID NO: 4166436 - DNA, 19 bp, Homo sapiens
gcctatccatcctgcgagc

SEQ ID NO: 4166437 - DNA, 14 bp, Homo sapiens
gcctatcctctgta

SEQ ID NO: 4166438 - DNA, 12 bp, Homo sapiens
gcctcaagaaca

SEQ ID NO: 4166439 - DNA, 17 bp, Homo sapiens
gcctcaatgtgaccagg

SEQ ID NO: 4166440 - DNA, 23 bp, Homo sapiens
gcctcactcaagcctgagagaag

SEQ ID NO: 4166441 - DNA, 18 bp, Homo sapiens
gcctcagtgtagttaaag

SEQ ID NO: 4166442 - DNA, 22 bp, Homo sapiens
gcctccacttagttttgggagg

SEQ ID NO: 4166443 - DNA, 12 bp, Homo sapiens
gcctccctctga

SEQ ID NO: 4166444 - DNA, 20 bp, Homo sapiens
gcctccctctgacctgcagg

SEQ ID NO: 4166445 - DNA, 21 bp, Homo sapiens
gcctccgtcatgaatgccttc

SEQ ID NO: 4166446 - DNA, 14 bp, Homo sapiens
gcctcgtaccagcc

SEQ ID NO: 4166447 - DNA, 15 bp, Homo sapiens
gcctcgtaccagcca

SEQ ID NO: 4166448 - DNA, 16 bp, Homo sapiens
gcctcgtaccagccag

SEQ ID NO: 4166449 - DNA, 21 bp, Homo sapiens
gcactgctaggcgagtgccag

SEQ ID NO: 4166450 - DNA, 23 bp, Homo sapiens
gcactgctaggcgagtgccagga

SEQ ID NO: 4166451 - DNA, 23 bp, Homo sapiens
gcactttaaccctctcttcccta

SEQ ID NO: 4166452 - DNA, 20 bp, Homo sapiens
gcactttgggaggctgaggc

SEQ ID NO: 4166453 - DNA, 17 bp, Homo sapiens
gcagaaagctttatatg

SEQ ID NO: 4166454 - DNA, 15 bp, Homo sapiens
gcagaaggaaggcag

SEQ ID NO: 4166455 - DNA, 13 bp, Homo sapiens
gcagaatgttttt

SEQ ID NO: 4166456 - DNA, 20 bp, Homo sapiens
gcagactctttatgcttgca

SEQ ID NO: 4166457 - DNA, 18 bp, Homo sapiens
gcagagaaagaagagaca

SEQ ID NO: 4166458 - DNA, 22 bp, Homo sapiens
gcagagaaagaagagacaggag

SEQ ID NO: 4166459 - DNA, 23 bp, Homo sapiens
gcagagaaagaagagacaggagg

SEQ ID NO: 4166460 - DNA, 18 bp, Homo sapiens
gcagagccaccagggcac

SEQ ID NO: 4166461 - DNA, 18 bp, Homo sapiens
gcagagctgatggagaag

SEQ ID NO: 4166462 - DNA, 22 bp, Homo sapiens
gcagagctgatggagaaggaag

SEQ ID NO: 4166463 - DNA, 23 bp, Homo sapiens
gcagagctgatggagaaggaagg

SEQ ID NO: 4166464 - DNA, 21 bp, Homo sapiens
gcagaggacagtctggagaag

SEQ ID NO: 4166465 - DNA, 23 bp, Homo sapiens
gcagaggggagcttgagggacaa

SEQ ID NO: 4166466 - DNA, 16 bp, Homo sapiens
gcagaggggctttctg

SEQ ID NO: 4166467 - DNA, 18 bp, Homo sapiens
gcagaggggctttctgga

SEQ ID NO: 4166468 - DNA, 19 bp, Homo sapiens
gcagaggggctttctggag

SEQ ID NO: 4166469 - DNA, 19 bp, Homo sapiens
gcagaggggtgctgctcct

SEQ ID NO: 4166470 - DNA, 18 bp, Homo sapiens
gcagataatcagcctctt

SEQ ID NO: 4166471 - DNA, 23 bp, Homo sapiens
gcagatgctgtcactggcagagc

SEQ ID NO: 4166472 - DNA, 24 bp, Homo sapiens
gcagatgctgtcactggcagagca

SEQ ID NO: 4166473 - DNA, 11 bp, Homo sapiens
gcagcaactcc

SEQ ID NO: 4166474 - DNA, 23 bp, Homo sapiens
gcagcagaggacagtctggagaa

SEQ ID NO: 4166475 - DNA, 15 bp, Homo sapiens
gcagcagttccatga

SEQ ID NO: 4166476 - DNA, 21 bp, Homo sapiens
gcagcagttccatgaagacac

SEQ ID NO: 4166477 - DNA, 15 bp, Homo sapiens
gcagcatgaattcca

SEQ ID NO: 4166478 - DNA, 19 bp, Homo sapiens
gcagccagccggtgcctgg

SEQ ID NO: 4166479 - DNA, 15 bp, Homo sapiens
gcagcccccactttc

SEQ ID NO: 4166480 - DNA, 20 bp, Homo sapiens
gcagccccgacccctgtcca

SEQ ID NO: 4166481 - DNA, 22 bp, Homo sapiens
gcagcgcagccgccgggcaggc

SEQ ID NO: 4166482 - DNA, 16 bp, Homo sapiens
gcagcgcgtgcacagc

SEQ ID NO: 4166483 - DNA, 13 bp, Homo sapiens
gcagctggctctc

SEQ ID NO: 4166484 - DNA, 18 bp, Homo sapiens
gcagctgttttcaaagcc

SEQ ID NO: 4166485 - DNA, 22 bp, Homo sapiens
gcagctgttttcaaagcccccg

SEQ ID NO: 4166486 - DNA, 14 bp, Homo sapiens
gcaggaactcccag

SEQ ID NO: 4166487 - DNA, 15 bp, Homo sapiens
gcaggaactcccagc

SEQ ID NO: 4166488 - DNA, 11 bp, Homo sapiens
gcaggaaggct

SEQ ID NO: 4166489 - DNA, 15 bp, Homo sapiens
gcaggacaggagaca

SEQ ID NO: 4166490 - DNA, 12 bp, Homo sapiens
gcaggaccagga

SEQ ID NO: 4166491 - DNA, 18 bp, Homo sapiens
gcaggaccctgtcaggat

SEQ ID NO: 4166492 - DNA, 15 bp, Homo sapiens
gcaggcaccttagtg

SEQ ID NO: 4166493 - DNA, 15 bp, Homo sapiens
gcaggcaggctccca

SEQ ID NO: 4166494 - DNA, 20 bp, Homo sapiens
gcaggccaagagcagaggca

SEQ ID NO: 4166495 - DNA, 15 bp, Homo sapiens
gcaggcccagcagac

SEQ ID NO: 4166496 - DNA, 22 bp, Homo sapiens
gcaggccttagtacggctgctg

SEQ ID NO: 4166497 - DNA, 14 bp, Homo sapiens
gcaggctcccaggg

SEQ ID NO: 4166498 - DNA, 22 bp, Homo sapiens
gcaggctcccagggacacctgg

SEQ ID NO: 4166499 - DNA, 15 bp, Homo sapiens
gcaggctggctggcc

SEQ ID NO: 4166500 - DNA, 14 bp, Homo sapiens
gcagggacaccccc

SEQ ID NO: 4166501 - DNA, 15 bp, Homo sapiens
gcagggacagagatg

SEQ ID NO: 4166502 - DNA, 13 bp, Homo sapiens
gcagggagagcgc

SEQ ID NO: 4166503 - DNA, 20 bp, Homo sapiens
gcagggagagcgcctcttcc

SEQ ID NO: 4166504 - DNA, 18 bp, Homo sapiens
gcagggagcaactctcca

SEQ ID NO: 4166505 - DNA, 22 bp, Homo sapiens
gcagggagccgagatcacgcca

SEQ ID NO: 4166506 - DNA, 19 bp, Homo sapiens
gcagggctctgccccagag

SEQ ID NO: 4166507 - DNA, 21 bp, Homo sapiens
gcagggctgctgtggcccagt

SEQ ID NO: 4166508 - DNA, 17 bp, Homo sapiens
gcaggggagtagtggag

SEQ ID NO: 4166509 - DNA, 19 bp, Homo sapiens
gcaggggtcagtgcagcag

SEQ ID NO: 4166510 - DNA, 20 bp, Homo sapiens
gcaggggtgggagagccagc

SEQ ID NO: 4166511 - DNA, 13 bp, Homo sapiens
gcaggggttccca

SEQ ID NO: 4166512 - DNA, 13 bp, Homo sapiens
gcaggtgcctggc

SEQ ID NO: 4166513 - DNA, 14 bp, Homo sapiens
gcaggtgcctggct

SEQ ID NO: 4166514 - DNA, 19 bp, Homo sapiens
gcaggtgcctggcttgctg

SEQ ID NO: 4166515 - DNA, 19 bp, Homo sapiens
gcaggttgaggggctcctg

SEQ ID NO: 4166516 - DNA, 16 bp, Homo sapiens
gcagtaacactggcct

SEQ ID NO: 4166517 - DNA, 15 bp, Homo sapiens
gcagtaagtcttttt

SEQ ID NO: 4166518 - DNA, 19 bp, Homo sapiens
gcagtaggaacccagctct

SEQ ID NO: 4166519 - DNA, 22 bp, Homo sapiens
gcagtaggaacccagctctcag

SEQ ID NO: 4166520 - DNA, 15 bp, Homo sapiens
gcagtatctcttgct

SEQ ID NO: 4166521 - DNA, 16 bp, Homo sapiens
gcagtcagggcccaga

SEQ ID NO: 4166522 - DNA, 18 bp, Homo sapiens
gcagtgctgatccggctg

SEQ ID NO: 4166523 - DNA, 21 bp, Homo sapiens
gcagtggaaaaatcagaagca

SEQ ID NO: 4166524 - DNA, 15 bp, Homo sapiens
gcagttccatgaaga

SEQ ID NO: 4166525 - DNA, 17 bp, Homo sapiens
gcagttccatgaagaca

SEQ ID NO: 4166526 - DNA, 19 bp, Homo sapiens
gcagttccatgaagacacg

SEQ ID NO: 4166527 - DNA, 17 bp, Homo sapiens
gcagttgacagcaggtg

SEQ ID NO: 4166528 - DNA, 19 bp, Homo sapiens
gcataatcagcgccctgga

SEQ ID NO: 4166529 - DNA, 20 bp, Homo sapiens
gcatagagggagaggaagca

SEQ ID NO: 4166530 - DNA, 16 bp, Homo sapiens
gcatcacagggcagag

SEQ ID NO: 4166531 - DNA, 22 bp, Homo sapiens
gcatcacagggcagagccggga

SEQ ID NO: 4166532 - DNA, 14 bp, Homo sapiens
gcatcacctcaggc

SEQ ID NO: 4166533 - DNA, 15 bp, Homo sapiens
gcatcacctcaggcc

SEQ ID NO: 4166534 - DNA, 19 bp, Homo sapiens
gcatgccctccccacttcc

SEQ ID NO: 4166535 - DNA, 16 bp, Homo sapiens
gcatgcctgggaatcc

SEQ ID NO: 4166536 - DNA, 21 bp, Homo sapiens
gcatgcctgggaatcctgctg

SEQ ID NO: 4166537 - DNA, 13 bp, Homo sapiens
gcatgctggggca

SEQ ID NO: 4166538 - DNA, 16 bp, Homo sapiens
gcatgctggggcaagt

SEQ ID NO: 4166539 - DNA, 23 bp, Homo sapiens
gcatggacaccccttatccagga

SEQ ID NO: 4166540 - DNA, 23 bp, Homo sapiens
gcatggggataaaggagaaggca

SEQ ID NO: 4166541 - DNA, 12 bp, Homo sapiens
gcatgtatgtgt

SEQ ID NO: 4166542 - DNA, 15 bp, Homo sapiens
gcattacgtgagcca

SEQ ID NO: 4166543 - DNA, 18 bp, Homo sapiens
gcattacgtgagccaggt

SEQ ID NO: 4166544 - DNA, 21 bp, Homo sapiens
gcattagaaatagacagtata

SEQ ID NO: 4166545 - DNA, 18 bp, Homo sapiens
gcattcagaagaaaaaga

SEQ ID NO: 4166546 - DNA, 13 bp, Homo sapiens
gcattcttagact

SEQ ID NO: 4166547 - DNA, 13 bp, Homo sapiens
gcattggtctgct

SEQ ID NO: 4166548 - DNA, 15 bp, Homo sapiens
gcattggtctgctga

SEQ ID NO: 4166549 - DNA, 12 bp, Homo sapiens
gcattttattct

SEQ ID NO: 4166550 - DNA, 22 bp, Homo sapiens
gcattttgtaagttgaagcaaa

SEQ ID NO: 4166551 - DNA, 13 bp, Homo sapiens
gccaaaaatagct

SEQ ID NO: 4166552 - DNA, 17 bp, Homo sapiens
gccaaaacacttaggaa

SEQ ID NO: 4166553 - DNA, 18 bp, Homo sapiens
gccaaactctgccagcca

SEQ ID NO: 4166554 - DNA, 13 bp, Homo sapiens
gccaaatacctag

SEQ ID NO: 4166555 - DNA, 11 bp, Homo sapiens
gccaaattatt

SEQ ID NO: 4166556 - DNA, 15 bp, Homo sapiens
gccaaattatttgtg

SEQ ID NO: 4166557 - DNA, 16 bp, Homo sapiens
gccaacaggtggcagg

SEQ ID NO: 4166558 - DNA, 13 bp, Homo sapiens
gccaactgccccg

SEQ ID NO: 4166559 - DNA, 12 bp, Homo sapiens
gccaagacttgg

SEQ ID NO: 4166560 - DNA, 18 bp, Homo sapiens
gccaagacttggcaacag

SEQ ID NO: 4166561 - DNA, 22 bp, Homo sapiens
gccaagacttggcaacagaagc

SEQ ID NO: 4166562 - DNA, 23 bp, Homo sapiens
gccaagacttggcaacagaagca

SEQ ID NO: 4166563 - DNA, 18 bp, Homo sapiens
gccaagatcgcgccactg

SEQ ID NO: 4166564 - DNA, 19 bp, Homo sapiens
gccaagcgggggcgtggct

SEQ ID NO: 4166565 - DNA, 17 bp, Homo sapiens
gccaaggagtcagatgg

SEQ ID NO: 4166566 - DNA, 15 bp, Homo sapiens
gccaagggctaggct

SEQ ID NO: 4166567 - DNA, 18 bp, Homo sapiens
gccaaggggcttcaggtc

SEQ ID NO: 4166568 - DNA, 16 bp, Homo sapiens
gccaaggtgggctgag

SEQ ID NO: 4166569 - DNA, 14 bp, Homo sapiens
gccaagtagctttg

SEQ ID NO: 4166570 - DNA, 16 bp, Homo sapiens
gccaagtggccctcag

SEQ ID NO: 4166571 - DNA, 19 bp, Homo sapiens
gccaatgcacctaaagaaa

SEQ ID NO: 4166572 - DNA, 15 bp, Homo sapiens
gccaatgtctgattt

SEQ ID NO: 4166573 - DNA, 13 bp, Homo sapiens
gccaattgctacc

SEQ ID NO: 4166574 - DNA, 20 bp, Homo sapiens
gccaattgctaccgagaagg

SEQ ID NO: 4166575 - DNA, 22 bp, Homo sapiens
gccacaaaactctgtcaggcat

SEQ ID NO: 4166576 - DNA, 20 bp, Homo sapiens
gccacaaagctaggatggtt

SEQ ID NO: 4166577 - DNA, 21 bp, Homo sapiens
gccacaccaatcagagagcct

SEQ ID NO: 4166578 - DNA, 23 bp, Homo sapiens
gccacagattgttagagagtata

SEQ ID NO: 4166579 - DNA, 18 bp, Homo sapiens
gccacattgacagtggtg

SEQ ID NO: 4166580 - DNA, 16 bp, Homo sapiens
gccaccagggcactgt

SEQ ID NO: 4166581 - DNA, 21 bp, Homo sapiens
gccaccagggcactgtctgcg

SEQ ID NO: 4166582 - DNA, 23 bp, Homo sapiens
gccaccatattcagtgctgtggc

SEQ ID NO: 4166583 - DNA, 23 bp, Homo sapiens
gccaccctgcccagtctggaaga

SEQ ID NO: 4166584 - DNA, 23 bp, Homo sapiens
gccaccgctgccttttgctgctg

SEQ ID NO: 4166585 - DNA, 15 bp, Homo sapiens
gccacctgtctgtct

SEQ ID NO: 4166586 - DNA, 16 bp, Homo sapiens
gccacggggaggggga

SEQ ID NO: 4166587 - DNA, 15 bp, Homo sapiens
gatctccctccaggg

SEQ ID NO: 4166588 - DNA, 15 bp, Homo sapiens
gatctgcactgggtg

SEQ ID NO: 4166589 - DNA, 12 bp, Homo sapiens
gatctggcatgt

SEQ ID NO: 4166590 - DNA, 12 bp, Homo sapiens
gatctttcagga

SEQ ID NO: 4166591 - DNA, 13 bp, Homo sapiens
gatctttgactga

SEQ ID NO: 4166592 - DNA, 19 bp, Homo sapiens
gatcttttggtggagtcag

SEQ ID NO: 4166593 - DNA, 17 bp, Homo sapiens
gatgaaattgaacctgg

SEQ ID NO: 4166594 - DNA, 13 bp, Homo sapiens
gatgaactttctc

SEQ ID NO: 4166595 - DNA, 20 bp, Homo sapiens
gatgaagctttggccctcag

SEQ ID NO: 4166596 - DNA, 13 bp, Homo sapiens
gatgaccagaaca

SEQ ID NO: 4166597 - DNA, 23 bp, Homo sapiens
gatgaccctgcgaaggggccctg

SEQ ID NO: 4166598 - DNA, 14 bp, Homo sapiens
gatgactgagtcct

SEQ ID NO: 4166599 - DNA, 13 bp, Homo sapiens
gatgagagtggct

SEQ ID NO: 4166600 - DNA, 15 bp, Homo sapiens
gatgagagtggctta

SEQ ID NO: 4166601 - DNA, 14 bp, Homo sapiens
gatgatgatgatga

SEQ ID NO: 4166602 - DNA, 17 bp, Homo sapiens
gatgatgatgatgatga

SEQ ID NO: 4166603 - DNA, 18 bp, Homo sapiens
gatgcaccacccatggag

SEQ ID NO: 4166604 - DNA, 16 bp, Homo sapiens
gatgcactacactttt

SEQ ID NO: 4166605 - DNA, 14 bp, Homo sapiens
gatgcagctcaaga

SEQ ID NO: 4166606 - DNA, 15 bp, Homo sapiens
gatgcagtggctcat

SEQ ID NO: 4166607 - DNA, 19 bp, Homo sapiens
gatgccaaaaaaaaataca

SEQ ID NO: 4166608 - DNA, 16 bp, Homo sapiens
gatgccaagtggccct

SEQ ID NO: 4166609 - DNA, 23 bp, Homo sapiens
gatgcccagagggcccaggcagg

SEQ ID NO: 4166610 - DNA, 15 bp, Homo sapiens
gatgctgggatagcc

SEQ ID NO: 4166611 - DNA, 21 bp, Homo sapiens
gatgctgtcactggcagagca

SEQ ID NO: 4166612 - DNA, 23 bp, Homo sapiens
gatgctttgtttctttcatatga

SEQ ID NO: 4166613 - DNA, 13 bp, Homo sapiens
gatggagaaggaa

SEQ ID NO: 4166614 - DNA, 14 bp, Homo sapiens
gatggagaataaat

SEQ ID NO: 4166615 - DNA, 22 bp, Homo sapiens
gatggagactggtcctgtgtgc

SEQ ID NO: 4166616 - DNA, 16 bp, Homo sapiens
gatggagcgcacctgc

SEQ ID NO: 4166617 - DNA, 18 bp, Homo sapiens
gatggcccagcaggcagg

SEQ ID NO: 4166618 - DNA, 18 bp, Homo sapiens
gatggggacactaatgaa

SEQ ID NO: 4166619 - DNA, 24 bp, Homo sapiens
gatggtcctggggctctgtgcagg

SEQ ID NO: 4166620 - DNA, 20 bp, Homo sapiens
gatgtcatccccttgtgtca

SEQ ID NO: 4166621 - DNA, 22 bp, Homo sapiens
gatgtgaattgcctgcagagag

SEQ ID NO: 4166622 - DNA, 21 bp, Homo sapiens
gatgtgtctgggagagcctgg

SEQ ID NO: 4166623 - DNA, 14 bp, Homo sapiens
gatgttaactatta

SEQ ID NO: 4166624 - DNA, 19 bp, Homo sapiens
gatgttgtcattatgtaca

SEQ ID NO: 4166625 - DNA, 12 bp, Homo sapiens
gattaaaggaag

SEQ ID NO: 4166626 - DNA, 13 bp, Homo sapiens
gattaaaggaagg

SEQ ID NO: 4166627 - DNA, 18 bp, Homo sapiens
gattacagacatgagcca

SEQ ID NO: 4166628 - DNA, 15 bp, Homo sapiens
gattattatttaaaa

SEQ ID NO: 4166629 - DNA, 16 bp, Homo sapiens
gattcccaccaaggtc

SEQ ID NO: 4166630 - DNA, 20 bp, Homo sapiens
gattccccatctcaggccag

SEQ ID NO: 4166631 - DNA, 17 bp, Homo sapiens
gattgacctataaaaca

SEQ ID NO: 4166632 - DNA, 17 bp, Homo sapiens
gattggcctgtgtctgg

SEQ ID NO: 4166633 - DNA, 21 bp, Homo sapiens
gattggcctgtgtctggcccc

SEQ ID NO: 4166634 - DNA, 22 bp, Homo sapiens
gattggcctgtgtctggcccct

SEQ ID NO: 4166635 - DNA, 14 bp, Homo sapiens
gattgtaaaaacaa

SEQ ID NO: 4166636 - DNA, 12 bp, Homo sapiens
gattgtaaaata

SEQ ID NO: 4166637 - DNA, 23 bp, Homo sapiens
gattgtaaaatagcttgtatagt

SEQ ID NO: 4166638 - DNA, 14 bp, Homo sapiens
gatttaacaaatac

SEQ ID NO: 4166639 - DNA, 13 bp, Homo sapiens
gatttaatccaga

SEQ ID NO: 4166640 - DNA, 15 bp, Homo sapiens
gatttagaactgtat

SEQ ID NO: 4166641 - DNA, 21 bp, Homo sapiens
gatttatagtttgtacatgca

SEQ ID NO: 4166642 - DNA, 19 bp, Homo sapiens
gatttgatgagttaactgt

SEQ ID NO: 4166643 - DNA, 23 bp, Homo sapiens
gatttgatgagttaactgtgaaa

SEQ ID NO: 4166644 - DNA, 21 bp, Homo sapiens
gatttggaagagaggcacctg

SEQ ID NO: 4166645 - DNA, 24 bp, Homo sapiens
gatttgtagagtcaatcatgtgtt

SEQ ID NO: 4166646 - DNA, 16 bp, Homo sapiens
gatttgtgaactggaa

SEQ ID NO: 4166647 - DNA, 18 bp, Homo sapiens
gattttggtttattccct

SEQ ID NO: 4166648 - DNA, 17 bp, Homo sapiens
gattttgtcttatatga

SEQ ID NO: 4166649 - DNA, 15 bp, Homo sapiens
gatttttacaataat

SEQ ID NO: 4166650 - DNA, 17 bp, Homo sapiens
gattttttaataattta

SEQ ID NO: 4166651 - DNA, 18 bp, Homo sapiens
gattttttccttcaaagt

SEQ ID NO: 4166652 - DNA, 21 bp, Homo sapiens
gattttttccttcaaagttta

SEQ ID NO: 4166653 - DNA, 13 bp, Homo sapiens
gcaaaaaagaaaa

SEQ ID NO: 4166654 - DNA, 18 bp, Homo sapiens
gcaaaaaagaaaaccttt

SEQ ID NO: 4166655 - DNA, 20 bp, Homo sapiens
gcaaaaagatttaacaaata

SEQ ID NO: 4166656 - DNA, 11 bp, Homo sapiens
gcaaaagaaga

SEQ ID NO: 4166657 - DNA, 21 bp, Homo sapiens
gcaaaataaagaatagcaatt

SEQ ID NO: 4166658 - DNA, 13 bp, Homo sapiens
gcaaaatggaaat

SEQ ID NO: 4166659 - DNA, 16 bp, Homo sapiens
gcaaaatggaaatgta

SEQ ID NO: 4166660 - DNA, 21 bp, Homo sapiens
gcaaaatggaaatgtaataat

SEQ ID NO: 4166661 - DNA, 17 bp, Homo sapiens
gcaaagaactgccccat

SEQ ID NO: 4166662 - DNA, 22 bp, Homo sapiens
gcaaagcaccagcttctccagg

SEQ ID NO: 4166663 - DNA, 23 bp, Homo sapiens
gcaaagcaccagcttctccaggc

SEQ ID NO: 4166664 - DNA, 19 bp, Homo sapiens
gcaaagggctgaaagccat

SEQ ID NO: 4166665 - DNA, 19 bp, Homo sapiens
gcaaaggtcaagactgtgg

SEQ ID NO: 4166666 - DNA, 14 bp, Homo sapiens
gcaaagtctaaagt

SEQ ID NO: 4166667 - DNA, 15 bp, Homo sapiens
gcaaagtctaaagtt

SEQ ID NO: 4166668 - DNA, 19 bp, Homo sapiens
gcaacacaagctggaagca

SEQ ID NO: 4166669 - DNA, 17 bp, Homo sapiens
gcaactcccacgactgt

SEQ ID NO: 4166670 - DNA, 19 bp, Homo sapiens
gcaactccgtgtgcctggg

SEQ ID NO: 4166671 - DNA, 17 bp, Homo sapiens
gcaactctccactccat

SEQ ID NO: 4166672 - DNA, 23 bp, Homo sapiens
gcaagaaggcaaaaatagtttgg

SEQ ID NO: 4166673 - DNA, 13 bp, Homo sapiens
gcaagagacagaa

SEQ ID NO: 4166674 - DNA, 16 bp, Homo sapiens
gcaagagacagaatga

SEQ ID NO: 4166675 - DNA, 18 bp, Homo sapiens
gcaagcacgggacaggag

SEQ ID NO: 4166676 - DNA, 22 bp, Homo sapiens
gcaagcaggggtcgtaccttgc

SEQ ID NO: 4166677 - DNA, 23 bp, Homo sapiens
gcaagcttaatggctgataattt

SEQ ID NO: 4166678 - DNA, 15 bp, Homo sapiens
gcaagggggcggggc

SEQ ID NO: 4166679 - DNA, 22 bp, Homo sapiens
gcaagtccctgactctctgtga

SEQ ID NO: 4166680 - DNA, 19 bp, Homo sapiens
gcaagtggatggcccagca

SEQ ID NO: 4166681 - DNA, 22 bp, Homo sapiens
gcaagtggatggcccagcaggc

SEQ ID NO: 4166682 - DNA, 21 bp, Homo sapiens
gcaatccatgttagtttttac

SEQ ID NO: 4166683 - DNA, 23 bp, Homo sapiens
gcaatggtgttgccctgagtgga

SEQ ID NO: 4166684 - DNA, 18 bp, Homo sapiens
gcaatgtaaatattttaa

SEQ ID NO: 4166685 - DNA, 17 bp, Homo sapiens
gcaattagcagaagtga

SEQ ID NO: 4166686 - DNA, 15 bp, Homo sapiens
gcaattgcttaggat

SEQ ID NO: 4166687 - DNA, 16 bp, Homo sapiens
gcaattggggaagaaa

SEQ ID NO: 4166688 - DNA, 20 bp, Homo sapiens
gcacaaaattctagaagcag

SEQ ID NO: 4166689 - DNA, 19 bp, Homo sapiens
gcacaaagagggagttggc

SEQ ID NO: 4166690 - DNA, 18 bp, Homo sapiens
gcacaacccccaggaaac

SEQ ID NO: 4166691 - DNA, 15 bp, Homo sapiens
gcacacatggacaca

SEQ ID NO: 4166692 - DNA, 23 bp, Homo sapiens
gcacactgcagggctgctgtggc

SEQ ID NO: 4166693 - DNA, 24 bp, Homo sapiens
gcacactgttggaatgtatgctaa

SEQ ID NO: 4166694 - DNA, 18 bp, Homo sapiens
gcacacttgtatattgaa

SEQ ID NO: 4166695 - DNA, 16 bp, Homo sapiens
gcacagcgcgggcgga

SEQ ID NO: 4166696 - DNA, 22 bp, Homo sapiens
gcacagcgcgggcggaggcggc

SEQ ID NO: 4166697 - DNA, 23 bp, Homo sapiens
gcacatgtctgtcctcagagcag

SEQ ID NO: 4166698 - DNA, 22 bp, Homo sapiens
gcacattttacttagctggaga

SEQ ID NO: 4166699 - DNA, 16 bp, Homo sapiens
gcaccaaaagaagtaa

SEQ ID NO: 4166700 - DNA, 18 bp, Homo sapiens
gcaccaaaagaagtaaaa

SEQ ID NO: 4166701 - DNA, 16 bp, Homo sapiens
gcaccagcttctccag

SEQ ID NO: 4166702 - DNA, 17 bp, Homo sapiens
gcaccagcttctccagg

SEQ ID NO: 4166703 - DNA, 22 bp, Homo sapiens
gcaccatccaccctgcaggctt

SEQ ID NO: 4166704 - DNA, 18 bp, Homo sapiens
gcaccccctcattcccct

SEQ ID NO: 4166705 - DNA, 20 bp, Homo sapiens
gcaccccctcattcccctcg

SEQ ID NO: 4166706 - DNA, 14 bp, Homo sapiens
gcaccccctggaga

SEQ ID NO: 4166707 - DNA, 13 bp, Homo sapiens
gcacccctgtctc

SEQ ID NO: 4166708 - DNA, 14 bp, Homo sapiens
gcacctaaagaaaa

SEQ ID NO: 4166709 - DNA, 17 bp, Homo sapiens
gcacctaaagaaaaaca

SEQ ID NO: 4166710 - DNA, 16 bp, Homo sapiens
gcacctagtccagtga

SEQ ID NO: 4166711 - DNA, 18 bp, Homo sapiens
gcacctatagtcccagct

SEQ ID NO: 4166712 - DNA, 12 bp, Homo sapiens
gcacctcagggc

SEQ ID NO: 4166713 - DNA, 16 bp, Homo sapiens
gcacctgccagcctgg

SEQ ID NO: 4166714 - DNA, 17 bp, Homo sapiens
gcacctgccccctggtg

SEQ ID NO: 4166715 - DNA, 12 bp, Homo sapiens
gcacctgctgga

SEQ ID NO: 4166716 - DNA, 15 bp, Homo sapiens
gcacctgctggaaac

SEQ ID NO: 4166717 - DNA, 22 bp, Homo sapiens
gcacgggttaagatctgaaagt

SEQ ID NO: 4166718 - DNA, 20 bp, Homo sapiens
gcactaaagtatgtaaagta

SEQ ID NO: 4166719 - DNA, 22 bp, Homo sapiens
gcactaaagtatgtaaagtatg

SEQ ID NO: 4166720 - DNA, 20 bp, Homo sapiens
gcactagcattttcttgaac

SEQ ID NO: 4166721 - DNA, 22 bp, Homo sapiens
gcactagcattttcttgaacca

SEQ ID NO: 4166722 - DNA, 17 bp, Homo sapiens
gcactcacccatgtgcc

SEQ ID NO: 4166723 - DNA, 14 bp, Homo sapiens
gcactccagcctgg

SEQ ID NO: 4166724 - DNA, 11 bp, Homo sapiens
gcactgccctc

SEQ ID NO: 4166725 - DNA, 13 bp, Homo sapiens
gagctggaaataa

SEQ ID NO: 4166726 - DNA, 20 bp, Homo sapiens
gagctggaaataaacctgga

SEQ ID NO: 4166727 - DNA, 22 bp, Homo sapiens
gagctggaaataaacctggaga

SEQ ID NO: 4166728 - DNA, 21 bp, Homo sapiens
gagctggcgactgcagctgca

SEQ ID NO: 4166729 - DNA, 18 bp, Homo sapiens
gagctggggctgccagcc

SEQ ID NO: 4166730 - DNA, 17 bp, Homo sapiens
gagctgttggggcaggg

SEQ ID NO: 4166731 - DNA, 20 bp, Homo sapiens
gagcttgagggacaatgcca

SEQ ID NO: 4166732 - DNA, 23 bp, Homo sapiens
gagcttgagggacaatgccacta

SEQ ID NO: 4166733 - DNA, 17 bp, Homo sapiens
gagcttggtggctgagc

SEQ ID NO: 4166734 - DNA, 14 bp, Homo sapiens
gaggaaaagacaga

SEQ ID NO: 4166735 - DNA, 17 bp, Homo sapiens
gaggaaaagacagagcc

SEQ ID NO: 4166736 - DNA, 18 bp, Homo sapiens
gaggaaaagctgcctctg

SEQ ID NO: 4166737 - DNA, 15 bp, Homo sapiens
gaggacagtctggag

SEQ ID NO: 4166738 - DNA, 16 bp, Homo sapiens
gaggacagtctggaga

SEQ ID NO: 4166739 - DNA, 18 bp, Homo sapiens
gaggacatgatggagcgc

SEQ ID NO: 4166740 - DNA, 15 bp, Homo sapiens
gaggagctcagggtt

SEQ ID NO: 4166741 - DNA, 12 bp, Homo sapiens
gaggaggaagac

SEQ ID NO: 4166742 - DNA, 16 bp, Homo sapiens
gaggagggacctactg

SEQ ID NO: 4166743 - DNA, 20 bp, Homo sapiens
gaggaggtttggggtctgcc

SEQ ID NO: 4166744 - DNA, 16 bp, Homo sapiens
gaggagtttcgaggta

SEQ ID NO: 4166745 - DNA, 16 bp, Homo sapiens
gaggatcactggagcc

SEQ ID NO: 4166746 - DNA, 19 bp, Homo sapiens
gaggatcactggagcccag

SEQ ID NO: 4166747 - DNA, 20 bp, Homo sapiens
gaggatcactggagcccagg

SEQ ID NO: 4166748 - DNA, 14 bp, Homo sapiens
gaggattttccagt

SEQ ID NO: 4166749 - DNA, 13 bp, Homo sapiens
gaggcaagagaca

SEQ ID NO: 4166750 - DNA, 14 bp, Homo sapiens
gaggcacctgctgg

SEQ ID NO: 4166751 - DNA, 19 bp, Homo sapiens
gaggcagagaaagaagaga

SEQ ID NO: 4166752 - DNA, 21 bp, Homo sapiens
gaggcagagaaagaagagaca

SEQ ID NO: 4166753 - DNA, 20 bp, Homo sapiens
gaggcagtgctgatccggct

SEQ ID NO: 4166754 - DNA, 21 bp, Homo sapiens
gaggcatagagggagaggaag

SEQ ID NO: 4166755 - DNA, 15 bp, Homo sapiens
gaggcccagcctgtc

SEQ ID NO: 4166756 - DNA, 16 bp, Homo sapiens
gaggcccagcctgtcc

SEQ ID NO: 4166757 - DNA, 18 bp, Homo sapiens
gaggcccagcctgtcctg

SEQ ID NO: 4166758 - DNA, 14 bp, Homo sapiens
gaggccccaggccc

SEQ ID NO: 4166759 - DNA, 16 bp, Homo sapiens
gaggccccaggcccta

SEQ ID NO: 4166760 - DNA, 20 bp, Homo sapiens
gaggcctgccctcagggatc

SEQ ID NO: 4166761 - DNA, 13 bp, Homo sapiens
gaggcctggccag

SEQ ID NO: 4166762 - DNA, 14 bp, Homo sapiens
gaggcctggccagg

SEQ ID NO: 4166763 - DNA, 13 bp, Homo sapiens
gaggcgaataaat

SEQ ID NO: 4166764 - DNA, 16 bp, Homo sapiens
gaggcgaataaatgtt

SEQ ID NO: 4166765 - DNA, 20 bp, Homo sapiens
gaggcggctccaggtccgga

SEQ ID NO: 4166766 - DNA, 12 bp, Homo sapiens
gaggcgggtgga

SEQ ID NO: 4166767 - DNA, 17 bp, Homo sapiens
gaggctctattgagcca

SEQ ID NO: 4166768 - DNA, 19 bp, Homo sapiens
gaggctctattgagccaag

SEQ ID NO: 4166769 - DNA, 14 bp, Homo sapiens
gaggctgagacagg

SEQ ID NO: 4166770 - DNA, 14 bp, Homo sapiens
gaggctgaggcagg

SEQ ID NO: 4166771 - DNA, 20 bp, Homo sapiens
gaggctggtgctgtggccag

SEQ ID NO: 4166772 - DNA, 22 bp, Homo sapiens
gaggctggtgctgtggccaggg

SEQ ID NO: 4166773 - DNA, 13 bp, Homo sapiens
gagggaaggagct

SEQ ID NO: 4166774 - DNA, 21 bp, Homo sapiens
gagggacctactgaacccaga

SEQ ID NO: 4166775 - DNA, 16 bp, Homo sapiens
gagggataaggcagtt

SEQ ID NO: 4166776 - DNA, 15 bp, Homo sapiens
gagggatgctgcctg

SEQ ID NO: 4166777 - DNA, 23 bp, Homo sapiens
gagggatgttctagccctccctg

SEQ ID NO: 4166778 - DNA, 20 bp, Homo sapiens
gagggattttagcctcttcc

SEQ ID NO: 4166779 - DNA, 20 bp, Homo sapiens
gagggcaaggggtttccaca

SEQ ID NO: 4166780 - DNA, 20 bp, Homo sapiens
gagggcagcccccactttcc

SEQ ID NO: 4166781 - DNA, 17 bp, Homo sapiens
gagggcagtggggagca

SEQ ID NO: 4166782 - DNA, 13 bp, Homo sapiens
gagggcccaggca

SEQ ID NO: 4166783 - DNA, 19 bp, Homo sapiens
gagggctactcagcagtaa

SEQ ID NO: 4166784 - DNA, 14 bp, Homo sapiens
gagggctgggccca

SEQ ID NO: 4166785 - DNA, 21 bp, Homo sapiens
gaggggaggatcactggagcc

SEQ ID NO: 4166786 - DNA, 16 bp, Homo sapiens
gaggggcagggagagc

SEQ ID NO: 4166787 - DNA, 14 bp, Homo sapiens
gaggggctcctgga

SEQ ID NO: 4166788 - DNA, 17 bp, Homo sapiens
gaggggctttctggaga

SEQ ID NO: 4166789 - DNA, 22 bp, Homo sapiens
gagggtggtggggacaggtaag

SEQ ID NO: 4166790 - DNA, 16 bp, Homo sapiens
gaggtcacattcagga

SEQ ID NO: 4166791 - DNA, 16 bp, Homo sapiens
gaggtccaggcaggag

SEQ ID NO: 4166792 - DNA, 22 bp, Homo sapiens
gaggtcctgtcctggctcccag

SEQ ID NO: 4166793 - DNA, 15 bp, Homo sapiens
gaggtgagaccacct

SEQ ID NO: 4166794 - DNA, 22 bp, Homo sapiens
gaggttaggagttcgagaccag

SEQ ID NO: 4166795 - DNA, 18 bp, Homo sapiens
gaggtttgtcaacaaaaa

SEQ ID NO: 4166796 - DNA, 22 bp, Homo sapiens
gaggtttgtcaacaaaaagaca

SEQ ID NO: 4166797 - DNA, 15 bp, Homo sapiens
gaggtttgtcaacac

SEQ ID NO: 4166798 - DNA, 14 bp, Homo sapiens
gagtcagaggacac

SEQ ID NO: 4166799 - DNA, 16 bp, Homo sapiens
gagtcagatggcaatg

SEQ ID NO: 4166800 - DNA, 12 bp, Homo sapiens
gagtcaggaaga

SEQ ID NO: 4166801 - DNA, 19 bp, Homo sapiens
gagtcgtcatcacttttca

SEQ ID NO: 4166802 - DNA, 23 bp, Homo sapiens
gagtctcttggtgatggagtgtg

SEQ ID NO: 4166803 - DNA, 12 bp, Homo sapiens
gagtctgcagtg

SEQ ID NO: 4166804 - DNA, 15 bp, Homo sapiens
gagtgacggtcccac

SEQ ID NO: 4166805 - DNA, 18 bp, Homo sapiens
gagtgacggtcccacact

SEQ ID NO: 4166806 - DNA, 15 bp, Homo sapiens
gagtgactcgagggt

SEQ ID NO: 4166807 - DNA, 17 bp, Homo sapiens
gagtgatctcaaatcca

SEQ ID NO: 4166808 - DNA, 23 bp, Homo sapiens
gagtgatctcaaatccactgaca

SEQ ID NO: 4166809 - DNA, 20 bp, Homo sapiens
gagtgccaggactccccagg

SEQ ID NO: 4166810 - DNA, 16 bp, Homo sapiens
gagtggatctccaagg

SEQ ID NO: 4166811 - DNA, 19 bp, Homo sapiens
gagtggatctccaaggacc

SEQ ID NO: 4166812 - DNA, 18 bp, Homo sapiens
gagtgtagcaactacagt

SEQ ID NO: 4166813 - DNA, 20 bp, Homo sapiens
gagttaactgtgaaatacca

SEQ ID NO: 4166814 - DNA, 13 bp, Homo sapiens
gagttataaaaat

SEQ ID NO: 4166815 - DNA, 23 bp, Homo sapiens
gagttcactgttgtacacagtct

SEQ ID NO: 4166816 - DNA, 19 bp, Homo sapiens
gagttcgagaccagcctgg

SEQ ID NO: 4166817 - DNA, 12 bp, Homo sapiens
gagttcttgccc

SEQ ID NO: 4166818 - DNA, 16 bp, Homo sapiens
gagttttttgtaccaa

SEQ ID NO: 4166819 - DNA, 23 bp, Homo sapiens
gataaagagggatgtaactattg

SEQ ID NO: 4166820 - DNA, 19 bp, Homo sapiens
gataaagattttttaataa

SEQ ID NO: 4166821 - DNA, 16 bp, Homo sapiens
gataaattccactgga

SEQ ID NO: 4166822 - DNA, 18 bp, Homo sapiens
gataactatttacatata

SEQ ID NO: 4166823 - DNA, 19 bp, Homo sapiens
gataacttgcatactattg

SEQ ID NO: 4166824 - DNA, 20 bp, Homo sapiens
gataaggtaaaatgccatga

SEQ ID NO: 4166825 - DNA, 14 bp, Homo sapiens
gataatcagcctct

SEQ ID NO: 4166826 - DNA, 14 bp, Homo sapiens
gataatgaacagaa

SEQ ID NO: 4166827 - DNA, 18 bp, Homo sapiens
gataatggataatcttcg

SEQ ID NO: 4166828 - DNA, 15 bp, Homo sapiens
gataatgttatacat

SEQ ID NO: 4166829 - DNA, 18 bp, Homo sapiens
gataattttaaattctct

SEQ ID NO: 4166830 - DNA, 14 bp, Homo sapiens
gatacaaggatcag

SEQ ID NO: 4166831 - DNA, 21 bp, Homo sapiens
gatactgactagtcatagaaa

SEQ ID NO: 4166832 - DNA, 14 bp, Homo sapiens
gatagaaatgccaa

SEQ ID NO: 4166833 - DNA, 15 bp, Homo sapiens
gatagaacaggctgg

SEQ ID NO: 4166834 - DNA, 19 bp, Homo sapiens
gatagagcagaactgaact

SEQ ID NO: 4166835 - DNA, 15 bp, Homo sapiens
gatagagtgattttg

SEQ ID NO: 4166836 - DNA, 20 bp, Homo sapiens
gatagcaggtgtaataagac

SEQ ID NO: 4166837 - DNA, 22 bp, Homo sapiens
gatagcatttttgatttatgca

SEQ ID NO: 4166838 - DNA, 19 bp, Homo sapiens
gatagccatttccatggct

SEQ ID NO: 4166839 - DNA, 23 bp, Homo sapiens
gatagggaagagagaaacattta

SEQ ID NO: 4166840 - DNA, 21 bp, Homo sapiens
gatatatatttactaaaagaa

SEQ ID NO: 4166841 - DNA, 18 bp, Homo sapiens
gatatcaccatgatttaa

SEQ ID NO: 4166842 - DNA, 17 bp, Homo sapiens
gatatgtaaaacattta

SEQ ID NO: 4166843 - DNA, 16 bp, Homo sapiens
gatattaaaggagtta

SEQ ID NO: 4166844 - DNA, 22 bp, Homo sapiens
gatattgggacacacatcaaaa

SEQ ID NO: 4166845 - DNA, 13 bp, Homo sapiens
gatcaaggcctta

SEQ ID NO: 4166846 - DNA, 18 bp, Homo sapiens
gatcacagcgtttcagga

SEQ ID NO: 4166847 - DNA, 12 bp, Homo sapiens
gatcactggagc

SEQ ID NO: 4166848 - DNA, 21 bp, Homo sapiens
gatcacttgggcccaggaggt

SEQ ID NO: 4166849 - DNA, 12 bp, Homo sapiens
gatcaggaagag

SEQ ID NO: 4166850 - DNA, 17 bp, Homo sapiens
gatcataggtatttcaa

SEQ ID NO: 4166851 - DNA, 23 bp, Homo sapiens
gatcattgaaagtaaaaaataac

SEQ ID NO: 4166852 - DNA, 13 bp, Homo sapiens
gatcattttctta

SEQ ID NO: 4166853 - DNA, 21 bp, Homo sapiens
gatcccaagtagaatctcagt

SEQ ID NO: 4166854 - DNA, 18 bp, Homo sapiens
gatccctccatccggctc

SEQ ID NO: 4166855 - DNA, 19 bp, Homo sapiens
gatccggctgctcctccag

SEQ ID NO: 4166856 - DNA, 22 bp, Homo sapiens
gatcctacagccagtaagtgat

SEQ ID NO: 4166857 - DNA, 19 bp, Homo sapiens
gatcctcacaaccacctaa

SEQ ID NO: 4166858 - DNA, 18 bp, Homo sapiens
gatcctggaaccactgat

SEQ ID NO: 4166859 - DNA, 21 bp, Homo sapiens
gatctagaatgtgttttctga

SEQ ID NO: 4166860 - DNA, 13 bp, Homo sapiens
gatctcaaatcca

SEQ ID NO: 4166861 - DNA, 15 bp, Homo sapiens
gatctcaaatccact

SEQ ID NO: 4166862 - DNA, 17 bp, Homo sapiens
gatctcaaatccactga

SEQ ID NO: 4166863 - DNA, 19 bp, Homo sapiens
gatctccaaggaccaggtt

SEQ ID NO: 4166864 - DNA, 17 bp, Homo sapiens
gacggggtttcaccgtg

SEQ ID NO: 4166865 - DNA, 16 bp, Homo sapiens
gacggtcccacactgg

SEQ ID NO: 4166866 - DNA, 21 bp, Homo sapiens
gacggtttcaaaccaggattt

SEQ ID NO: 4166867 - DNA, 14 bp, Homo sapiens
gactaatggcatga

SEQ ID NO: 4166868 - DNA, 18 bp, Homo sapiens
gactaatttaaaaaataa

SEQ ID NO: 4166869 - DNA, 17 bp, Homo sapiens
gactatagcccaggtcc

SEQ ID NO: 4166870 - DNA, 19 bp, Homo sapiens
gactatcttactatttcac

SEQ ID NO: 4166871 - DNA, 17 bp, Homo sapiens
gactattttttaataaa

SEQ ID NO: 4166872 - DNA, 19 bp, Homo sapiens
gactattttttaataaaag

SEQ ID NO: 4166873 - DNA, 23 bp, Homo sapiens
gactcactccattcctaggtcac

SEQ ID NO: 4166874 - DNA, 15 bp, Homo sapiens
gactcagctccagaa

SEQ ID NO: 4166875 - DNA, 12 bp, Homo sapiens
gactcaggagcc

SEQ ID NO: 4166876 - DNA, 20 bp, Homo sapiens
gactcattccctagatcttt

SEQ ID NO: 4166877 - DNA, 17 bp, Homo sapiens
gactccgagaacaacag

SEQ ID NO: 4166878 - DNA, 19 bp, Homo sapiens
gactcgtaaagctgctagg

SEQ ID NO: 4166879 - DNA, 15 bp, Homo sapiens
gactctaagctgtgt

SEQ ID NO: 4166880 - DNA, 17 bp, Homo sapiens
gactctaagctgtgtgc

SEQ ID NO: 4166881 - DNA, 14 bp, Homo sapiens
gactctctgtgacc

SEQ ID NO: 4166882 - DNA, 22 bp, Homo sapiens
gactctgccttttttcacagcc

SEQ ID NO: 4166883 - DNA, 13 bp, Homo sapiens
gactctggcctcc

SEQ ID NO: 4166884 - DNA, 21 bp, Homo sapiens
gactctgggtccctcggagct

SEQ ID NO: 4166885 - DNA, 17 bp, Homo sapiens
gactctgtggggccttg

SEQ ID NO: 4166886 - DNA, 18 bp, Homo sapiens
gactctgtggggccttgg

SEQ ID NO: 4166887 - DNA, 21 bp, Homo sapiens
gactgagggattttagcctct

SEQ ID NO: 4166888 - DNA, 17 bp, Homo sapiens
gactgctacctctgaga

SEQ ID NO: 4166889 - DNA, 19 bp, Homo sapiens
gactggtgctataggctgg

SEQ ID NO: 4166890 - DNA, 20 bp, Homo sapiens
gactggtgctataggctgga

SEQ ID NO: 4166891 - DNA, 23 bp, Homo sapiens
gactggtgctataggctggagaa

SEQ ID NO: 4166892 - DNA, 20 bp, Homo sapiens
gactgtgataatcagaagct

SEQ ID NO: 4166893 - DNA, 22 bp, Homo sapiens
gactgttactttggcaatttcc

SEQ ID NO: 4166894 - DNA, 14 bp, Homo sapiens
gacttccatctagt

SEQ ID NO: 4166895 - DNA, 18 bp, Homo sapiens
gacttctcttgaattatt

SEQ ID NO: 4166896 - DNA, 19 bp, Homo sapiens
gacttctgctgaaggacag

SEQ ID NO: 4166897 - DNA, 14 bp, Homo sapiens
gacttgaaaaatat

SEQ ID NO: 4166898 - DNA, 15 bp, Homo sapiens
gacttgaaaaatatt

SEQ ID NO: 4166899 - DNA, 23 bp, Homo sapiens
gacttgaggattttgagtatctc

SEQ ID NO: 4166900 - DNA, 19 bp, Homo sapiens
gacttggcaacagaagcag

SEQ ID NO: 4166901 - DNA, 12 bp, Homo sapiens
gactttgttcac

SEQ ID NO: 4166902 - DNA, 22 bp, Homo sapiens
gagaaaacttatttgagtgatt

SEQ ID NO: 4166903 - DNA, 18 bp, Homo sapiens
gagaaagaagagacagga

SEQ ID NO: 4166904 - DNA, 23 bp, Homo sapiens
gagaacaagaggtgctagctctt

SEQ ID NO: 4166905 - DNA, 13 bp, Homo sapiens
gagaaccaggagg

SEQ ID NO: 4166906 - DNA, 14 bp, Homo sapiens
gagaaccaggaggg

SEQ ID NO: 4166907 - DNA, 21 bp, Homo sapiens
gagaactgaattttgggactt

SEQ ID NO: 4166908 - DNA, 22 bp, Homo sapiens
gagaactttcggagcctgcctc

SEQ ID NO: 4166909 - DNA, 13 bp, Homo sapiens
gagaagaggctgg

SEQ ID NO: 4166910 - DNA, 15 bp, Homo sapiens
gagaagccatgtact

SEQ ID NO: 4166911 - DNA, 13 bp, Homo sapiens
gagaaggagcaga

SEQ ID NO: 4166912 - DNA, 17 bp, Homo sapiens
gagaaggatctagaatg

SEQ ID NO: 4166913 - DNA, 23 bp, Homo sapiens
gagaaggttggaggtggggaagg

SEQ ID NO: 4166914 - DNA, 17 bp, Homo sapiens
gagaagttttgtacaga

SEQ ID NO: 4166915 - DNA, 16 bp, Homo sapiens
gagaatatttcaaatg

SEQ ID NO: 4166916 - DNA, 22 bp, Homo sapiens
gagaatatttcaaatgaacacg

SEQ ID NO: 4166917 - DNA, 17 bp, Homo sapiens
gagaatcgcttgaaccg

SEQ ID NO: 4166918 - DNA, 19 bp, Homo sapiens
gagacagcaattgtagaca

SEQ ID NO: 4166919 - DNA, 15 bp, Homo sapiens
gagacaggaaagaat

SEQ ID NO: 4166920 - DNA, 12 bp, Homo sapiens
gagaccccttcc

SEQ ID NO: 4166921 - DNA, 17 bp, Homo sapiens
gagaccctacaggagag

SEQ ID NO: 4166922 - DNA, 12 bp, Homo sapiens
gagactctgtgg

SEQ ID NO: 4166923 - DNA, 17 bp, Homo sapiens
gagacttggggaccaga

SEQ ID NO: 4166924 - DNA, 21 bp, Homo sapiens
gagacttgtgctcaaggaatc

SEQ ID NO: 4166925 - DNA, 13 bp, Homo sapiens
gagagaaaactta

SEQ ID NO: 4166926 - DNA, 19 bp, Homo sapiens
gagagaatatttcaaatga

SEQ ID NO: 4166927 - DNA, 20 bp, Homo sapiens
gagagacttgtgctcaagga

SEQ ID NO: 4166928 - DNA, 15 bp, Homo sapiens
gagagcaagaaggaa

SEQ ID NO: 4166929 - DNA, 14 bp, Homo sapiens
gagagcagctggct

SEQ ID NO: 4166930 - DNA, 12 bp, Homo sapiens
gagagccagctc

SEQ ID NO: 4166931 - DNA, 11 bp, Homo sapiens
gagagcccagc

SEQ ID NO: 4166932 - DNA, 20 bp, Homo sapiens
gagaggaagcacactgcagg

SEQ ID NO: 4166933 - DNA, 17 bp, Homo sapiens
gagaggcacctgctgga

SEQ ID NO: 4166934 - DNA, 16 bp, Homo sapiens
gagaggtagcgagctg

SEQ ID NO: 4166935 - DNA, 18 bp, Homo sapiens
gagaggtagcgagctgct

SEQ ID NO: 4166936 - DNA, 13 bp, Homo sapiens
gagaggtttgtca

SEQ ID NO: 4166937 - DNA, 16 bp, Homo sapiens
gagagtaccatgctgg

SEQ ID NO: 4166938 - DNA, 17 bp, Homo sapiens
gagagtaccatgctggc

SEQ ID NO: 4166939 - DNA, 15 bp, Homo sapiens
gagagtatattatgt

SEQ ID NO: 4166940 - DNA, 14 bp, Homo sapiens
gagagtctgtctca

SEQ ID NO: 4166941 - DNA, 12 bp, Homo sapiens
gagagtggctta

SEQ ID NO: 4166942 - DNA, 13 bp, Homo sapiens
gagatacatacag

SEQ ID NO: 4166943 - DNA, 16 bp, Homo sapiens
gagatcacgccactgc

SEQ ID NO: 4166944 - DNA, 12 bp, Homo sapiens
gagatcagcagt

SEQ ID NO: 4166945 - DNA, 15 bp, Homo sapiens
gagatcagcagtggc

SEQ ID NO: 4166946 - DNA, 13 bp, Homo sapiens
gagatcaggaaga

SEQ ID NO: 4166947 - DNA, 20 bp, Homo sapiens
gagatcaggaagagaaggag

SEQ ID NO: 4166948 - DNA, 17 bp, Homo sapiens
gagatcccgcctcttct

SEQ ID NO: 4166949 - DNA, 18 bp, Homo sapiens
gagatctgggaggtctcc

SEQ ID NO: 4166950 - DNA, 16 bp, Homo sapiens
gagatgatgatgatga

SEQ ID NO: 4166951 - DNA, 12 bp, Homo sapiens
gagatgctggct

SEQ ID NO: 4166952 - DNA, 14 bp, Homo sapiens
gagatttcaacata

SEQ ID NO: 4166953 - DNA, 16 bp, Homo sapiens
gagattttcttggcag

SEQ ID NO: 4166954 - DNA, 18 bp, Homo sapiens
gagattttcttggcagta

SEQ ID NO: 4166955 - DNA, 14 bp, Homo sapiens
gagcaaacaccagt

SEQ ID NO: 4166956 - DNA, 17 bp, Homo sapiens
gagcaaacaccagtgag

SEQ ID NO: 4166957 - DNA, 20 bp, Homo sapiens
gagcaacctcttcagctggg

SEQ ID NO: 4166958 - DNA, 21 bp, Homo sapiens
gagcaacctcttcagctggga

SEQ ID NO: 4166959 - DNA, 18 bp, Homo sapiens
gagcaactctccactcca

SEQ ID NO: 4166960 - DNA, 19 bp, Homo sapiens
gagcaactctccactccat

SEQ ID NO: 4166961 - DNA, 20 bp, Homo sapiens
gagcaagactccatttcaaa

SEQ ID NO: 4166962 - DNA, 14 bp, Homo sapiens
gagcaagagctggc

SEQ ID NO: 4166963 - DNA, 12 bp, Homo sapiens
gagcaccccctc

SEQ ID NO: 4166964 - DNA, 17 bp, Homo sapiens
gagcaccccctcattcc

SEQ ID NO: 4166965 - DNA, 18 bp, Homo sapiens
gagcaccccctcattccc

SEQ ID NO: 4166966 - DNA, 23 bp, Homo sapiens
gagcagagctgatggagaaggaa

SEQ ID NO: 4166967 - DNA, 23 bp, Homo sapiens
gagcaggccacgctcaggcccgg

SEQ ID NO: 4166968 - DNA, 16 bp, Homo sapiens
gagcaggctcagactc

SEQ ID NO: 4166969 - DNA, 13 bp, Homo sapiens
gagcaggggcagg

SEQ ID NO: 4166970 - DNA, 12 bp, Homo sapiens
gagcatcacaga

SEQ ID NO: 4166971 - DNA, 14 bp, Homo sapiens
gagcatcacagaat

SEQ ID NO: 4166972 - DNA, 18 bp, Homo sapiens
gagcattacgtgagccag

SEQ ID NO: 4166973 - DNA, 18 bp, Homo sapiens
gagccaaggggcttcagg

SEQ ID NO: 4166974 - DNA, 17 bp, Homo sapiens
gagccactacctttgtc

SEQ ID NO: 4166975 - DNA, 19 bp, Homo sapiens
gagccaggctctgcctgga

SEQ ID NO: 4166976 - DNA, 18 bp, Homo sapiens
gagccaggtaatgaggga

SEQ ID NO: 4166977 - DNA, 21 bp, Homo sapiens
gagcccacgcccgactagcag

SEQ ID NO: 4166978 - DNA, 22 bp, Homo sapiens
gagcccagccattaccatggag

SEQ ID NO: 4166979 - DNA, 19 bp, Homo sapiens
gagcccgcttcaagctctc

SEQ ID NO: 4166980 - DNA, 19 bp, Homo sapiens
gagccgagatcacgccact

SEQ ID NO: 4166981 - DNA, 16 bp, Homo sapiens
gagcctaactccctcc

SEQ ID NO: 4166982 - DNA, 20 bp, Homo sapiens
gagcctagaacatccctggg

SEQ ID NO: 4166983 - DNA, 17 bp, Homo sapiens
gagcctggcaaggcatt

SEQ ID NO: 4166984 - DNA, 22 bp, Homo sapiens
gagcctggcaaggcattcctca

SEQ ID NO: 4166985 - DNA, 23 bp, Homo sapiens
gagcctggcaaggcattcctcat

SEQ ID NO: 4166986 - DNA, 13 bp, Homo sapiens
gagcctggctttg

SEQ ID NO: 4166987 - DNA, 21 bp, Homo sapiens
gagcctggctttggtccccag

SEQ ID NO: 4166988 - DNA, 18 bp, Homo sapiens
gagccttcaagtgccaaa

SEQ ID NO: 4166989 - DNA, 19 bp, Homo sapiens
gagccttcaagtgccaaac

SEQ ID NO: 4166990 - DNA, 15 bp, Homo sapiens
gagcgcctcttcctc

SEQ ID NO: 4166991 - DNA, 16 bp, Homo sapiens
gagcggagcttgcctg

SEQ ID NO: 4166992 - DNA, 15 bp, Homo sapiens
gagctacataattta

SEQ ID NO: 4166993 - DNA, 17 bp, Homo sapiens
gagctactctcttgcca

SEQ ID NO: 4166994 - DNA, 21 bp, Homo sapiens
gagctactctcttgccagcat

SEQ ID NO: 4166995 - DNA, 12 bp, Homo sapiens
gagctcagctca

SEQ ID NO: 4166996 - DNA, 18 bp, Homo sapiens
gagctcagggtttcggaa

SEQ ID NO: 4166997 - DNA, 18 bp, Homo sapiens
gagctctgtatggtcagg

SEQ ID NO: 4166998 - DNA, 19 bp, Homo sapiens
gagctgaacccattttgag

SEQ ID NO: 4166999 - DNA, 22 bp, Homo sapiens
gagctgagatcacaccactgca

SEQ ID NO: 4167000 - DNA, 15 bp, Homo sapiens
gagctgatggagaag

SEQ ID NO: 4167001 - DNA, 16 bp, Homo sapiens
gagctgatggagaagg

SEQ ID NO: 4167002 - DNA, 20 bp, Homo sapiens
gagctgctggctgacctggg

SEQ ID NO: 4167003 - DNA, 11 bp, Homo sapiens
gagctggaaat

SEQ ID NO: 4167004 - DNA, 20 bp, Homo sapiens
gaatcgtttcaaatggactc

SEQ ID NO: 4167005 - DNA, 12 bp, Homo sapiens
gaatctgcaggg

SEQ ID NO: 4167006 - DNA, 21 bp, Homo sapiens
gaatcttaaggtgtagccaca

SEQ ID NO: 4167007 - DNA, 20 bp, Homo sapiens
gaatcttggtttgccttcca

SEQ ID NO: 4167008 - DNA, 15 bp, Homo sapiens
gaatgaaaattagat

SEQ ID NO: 4167009 - DNA, 16 bp, Homo sapiens
gaatgacaacagaagc

SEQ ID NO: 4167010 - DNA, 18 bp, Homo sapiens
gaatgatcattgaaagta

SEQ ID NO: 4167011 - DNA, 21 bp, Homo sapiens
gaatgatttttgctatttcta

SEQ ID NO: 4167012 - DNA, 19 bp, Homo sapiens
gaatgcaatataaaaatgt

SEQ ID NO: 4167013 - DNA, 21 bp, Homo sapiens
gaatgcaatataaaaatgtga

SEQ ID NO: 4167014 - DNA, 22 bp, Homo sapiens
gaatgcaatataaaaatgtgaa

SEQ ID NO: 4167015 - DNA, 20 bp, Homo sapiens
gaatgcacactagcctctcc

SEQ ID NO: 4167016 - DNA, 22 bp, Homo sapiens
gaatgcacactagcctctccag

SEQ ID NO: 4167017 - DNA, 20 bp, Homo sapiens
gaatgccggttaaattccat

SEQ ID NO: 4167018 - DNA, 13 bp, Homo sapiens
gaatgcctcctcc

SEQ ID NO: 4167019 - DNA, 18 bp, Homo sapiens
gaatgcttaaagcaaggc

SEQ ID NO: 4167020 - DNA, 21 bp, Homo sapiens
gaatggcaaagcggttgcttc

SEQ ID NO: 4167021 - DNA, 22 bp, Homo sapiens
gaatggcaaagcggttgcttct

SEQ ID NO: 4167022 - DNA, 14 bp, Homo sapiens
gaatgggacagggt

SEQ ID NO: 4167023 - DNA, 18 bp, Homo sapiens
gaatgggctgcagaagat

SEQ ID NO: 4167024 - DNA, 14 bp, Homo sapiens
gaatggtccagggt

SEQ ID NO: 4167025 - DNA, 20 bp, Homo sapiens
gaatgttgattacagtgcag

SEQ ID NO: 4167026 - DNA, 15 bp, Homo sapiens
gaattaatagctttt

SEQ ID NO: 4167027 - DNA, 20 bp, Homo sapiens
gaattagccaaaacacttag

SEQ ID NO: 4167028 - DNA, 12 bp, Homo sapiens
gaattccaagga

SEQ ID NO: 4167029 - DNA, 13 bp, Homo sapiens
gaattccaaggag

SEQ ID NO: 4167030 - DNA, 19 bp, Homo sapiens
gaattctttacaataaaca

SEQ ID NO: 4167031 - DNA, 16 bp, Homo sapiens
gaattgcctgcagaga

SEQ ID NO: 4167032 - DNA, 20 bp, Homo sapiens
gaattgcctgcagagagaag

SEQ ID NO: 4167033 - DNA, 13 bp, Homo sapiens
gaattgggaagct

SEQ ID NO: 4167034 - DNA, 12 bp, Homo sapiens
gaattgtatttt

SEQ ID NO: 4167035 - DNA, 18 bp, Homo sapiens
gaatttaaaaataagaaa

SEQ ID NO: 4167036 - DNA, 19 bp, Homo sapiens
gaatttcttcactgttgaa

SEQ ID NO: 4167037 - DNA, 11 bp, Homo sapiens
gacaaaatgga

SEQ ID NO: 4167038 - DNA, 16 bp, Homo sapiens
gacaaaccagagcaga

SEQ ID NO: 4167039 - DNA, 13 bp, Homo sapiens
gacaaagaacctt

SEQ ID NO: 4167040 - DNA, 22 bp, Homo sapiens
gacaacatttctatagccaaaa

SEQ ID NO: 4167041 - DNA, 17 bp, Homo sapiens
gacaagaaggccactgg

SEQ ID NO: 4167042 - DNA, 16 bp, Homo sapiens
gacaagcactgctagg

SEQ ID NO: 4167043 - DNA, 16 bp, Homo sapiens
gacaagccagaacttg

SEQ ID NO: 4167044 - DNA, 15 bp, Homo sapiens
gacaatcctgaagaa

SEQ ID NO: 4167045 - DNA, 22 bp, Homo sapiens
gacaatttatatttaataaaat

SEQ ID NO: 4167046 - DNA, 18 bp, Homo sapiens
gacacacagtgacaaaag

SEQ ID NO: 4167047 - DNA, 16 bp, Homo sapiens
gacacagacccacaca

SEQ ID NO: 4167048 - DNA, 13 bp, Homo sapiens
gacacaggaagaa

SEQ ID NO: 4167049 - DNA, 23 bp, Homo sapiens
gacacaggaagaatgggctgcag

SEQ ID NO: 4167050 - DNA, 13 bp, Homo sapiens
gacacaggctcag

SEQ ID NO: 4167051 - DNA, 11 bp, Homo sapiens
gacacagtgtt

SEQ ID NO: 4167052 - DNA, 19 bp, Homo sapiens
gacacatactcatttttca

SEQ ID NO: 4167053 - DNA, 22 bp, Homo sapiens
gacaccatccaagaatgttgtt

SEQ ID NO: 4167054 - DNA, 17 bp, Homo sapiens
gacaccccttatccagg

SEQ ID NO: 4167055 - DNA, 20 bp, Homo sapiens
gacaccccttatccaggact

SEQ ID NO: 4167056 - DNA, 9 bp, Homo sapiens
gacacctgc

SEQ ID NO: 4167057 - DNA, 13 bp, Homo sapiens
gacacctgccctg

SEQ ID NO: 4167058 - DNA, 22 bp, Homo sapiens
gacacctgccctgccctgccac

SEQ ID NO: 4167059 - DNA, 12 bp, Homo sapiens
gacacctgggag

SEQ ID NO: 4167060 - DNA, 22 bp, Homo sapiens
gacactctagtgacttcctggt

SEQ ID NO: 4167061 - DNA, 13 bp, Homo sapiens
gacactgggagaa

SEQ ID NO: 4167062 - DNA, 20 bp, Homo sapiens
gacactgggagaagagaacc

SEQ ID NO: 4167063 - DNA, 22 bp, Homo sapiens
gacagaacattgccttcctcgt

SEQ ID NO: 4167064 - DNA, 20 bp, Homo sapiens
gacagaagtttgcactatct

SEQ ID NO: 4167065 - DNA, 23 bp, Homo sapiens
gacagaatgatatccagtaagca

SEQ ID NO: 4167066 - DNA, 14 bp, Homo sapiens
gacagagcctccac

SEQ ID NO: 4167067 - DNA, 23 bp, Homo sapiens
gacagatagacagtgctgccctg

SEQ ID NO: 4167068 - DNA, 20 bp, Homo sapiens
gacagatgaggctttccatg

SEQ ID NO: 4167069 - DNA, 17 bp, Homo sapiens
gacagcaattgtagaca

SEQ ID NO: 4167070 - DNA, 17 bp, Homo sapiens
gacagcacttggctcct

SEQ ID NO: 4167071 - DNA, 16 bp, Homo sapiens
gacagcaggtgggaaa

SEQ ID NO: 4167072 - DNA, 13 bp, Homo sapiens
gacagcccagcct

SEQ ID NO: 4167073 - DNA, 13 bp, Homo sapiens
gacagccctgcct

SEQ ID NO: 4167074 - DNA, 16 bp, Homo sapiens
gacagccttccagtgg

SEQ ID NO: 4167075 - DNA, 19 bp, Homo sapiens
gacaggaggggcccacaat

SEQ ID NO: 4167076 - DNA, 14 bp, Homo sapiens
gacaggctgaaagc

SEQ ID NO: 4167077 - DNA, 22 bp, Homo sapiens
gacagggtgaataaagcaggga

SEQ ID NO: 4167078 - DNA, 16 bp, Homo sapiens
gacagtattctcagtg

SEQ ID NO: 4167079 - DNA, 14 bp, Homo sapiens
gacagtcctgggag

SEQ ID NO: 4167080 - DNA, 15 bp, Homo sapiens
gacagtcctgggaga

SEQ ID NO: 4167081 - DNA, 13 bp, Homo sapiens
gacagtctggaga

SEQ ID NO: 4167082 - DNA, 14 bp, Homo sapiens
gacagtgctgccct

SEQ ID NO: 4167083 - DNA, 17 bp, Homo sapiens
gacataaagttgataaa

SEQ ID NO: 4167084 - DNA, 19 bp, Homo sapiens
gacataaagttgataaaga

SEQ ID NO: 4167085 - DNA, 22 bp, Homo sapiens
gacatccatgtttgtaaaacta

SEQ ID NO: 4167086 - DNA, 23 bp, Homo sapiens
gacatccatgtttgtaaaactac

SEQ ID NO: 4167087 - DNA, 22 bp, Homo sapiens
gacatgaaggtaggtaaatagg

SEQ ID NO: 4167088 - DNA, 16 bp, Homo sapiens
gacatgaatgcacact

SEQ ID NO: 4167089 - DNA, 15 bp, Homo sapiens
gacatggaaggttag

SEQ ID NO: 4167090 - DNA, 18 bp, Homo sapiens
gacatggaaggttagagg

SEQ ID NO: 4167091 - DNA, 14 bp, Homo sapiens
gacatgtgcctgta

SEQ ID NO: 4167092 - DNA, 15 bp, Homo sapiens
gacatgttatatatt

SEQ ID NO: 4167093 - DNA, 14 bp, Homo sapiens
gacatgtttttgtt

SEQ ID NO: 4167094 - DNA, 18 bp, Homo sapiens
gacatttgacagtgtggg

SEQ ID NO: 4167095 - DNA, 21 bp, Homo sapiens
gaccaaaggatccagagactt

SEQ ID NO: 4167096 - DNA, 18 bp, Homo sapiens
gaccaagtcctcaaagca

SEQ ID NO: 4167097 - DNA, 13 bp, Homo sapiens
gaccactggccct

SEQ ID NO: 4167098 - DNA, 22 bp, Homo sapiens
gaccagccgtgagcatgtttgg

SEQ ID NO: 4167099 - DNA, 13 bp, Homo sapiens
gaccagcctggcc

SEQ ID NO: 4167100 - DNA, 22 bp, Homo sapiens
gaccaggactatagcccaggtc

SEQ ID NO: 4167101 - DNA, 14 bp, Homo sapiens
gaccatcgtccagc

SEQ ID NO: 4167102 - DNA, 16 bp, Homo sapiens
gaccatcgtccagccc

SEQ ID NO: 4167103 - DNA, 17 bp, Homo sapiens
gacccaatgctcctgga

SEQ ID NO: 4167104 - DNA, 15 bp, Homo sapiens
gacccacctggagcc

SEQ ID NO: 4167105 - DNA, 16 bp, Homo sapiens
gacccacctggagccc

SEQ ID NO: 4167106 - DNA, 16 bp, Homo sapiens
gacccagatcctcaca

SEQ ID NO: 4167107 - DNA, 11 bp, Homo sapiens
gacccagctcc

SEQ ID NO: 4167108 - DNA, 12 bp, Homo sapiens
gacccagctcct

SEQ ID NO: 4167109 - DNA, 13 bp, Homo sapiens
gacccagctcctc

SEQ ID NO: 4167110 - DNA, 17 bp, Homo sapiens
gacccagctcctctgag

SEQ ID NO: 4167111 - DNA, 23 bp, Homo sapiens
gacccagtgagattacagaggaa

SEQ ID NO: 4167112 - DNA, 13 bp, Homo sapiens
gacccctgtccag

SEQ ID NO: 4167113 - DNA, 13 bp, Homo sapiens
gacccctttcccc

SEQ ID NO: 4167114 - DNA, 14 bp, Homo sapiens
gacccctttccccc

SEQ ID NO: 4167115 - DNA, 17 bp, Homo sapiens
gacccctttcccccacc

SEQ ID NO: 4167116 - DNA, 18 bp, Homo sapiens
gacccctttcccccaccc

SEQ ID NO: 4167117 - DNA, 20 bp, Homo sapiens
gacccctttcccccacccca

SEQ ID NO: 4167118 - DNA, 21 bp, Homo sapiens
gaccctccaccgcagaaggaa

SEQ ID NO: 4167119 - DNA, 19 bp, Homo sapiens
gaccctcctcctcccccag

SEQ ID NO: 4167120 - DNA, 22 bp, Homo sapiens
gaccctcctcctcccccagagg

SEQ ID NO: 4167121 - DNA, 15 bp, Homo sapiens
gaccctctgaatggt

SEQ ID NO: 4167122 - DNA, 21 bp, Homo sapiens
gaccctgcgaaggggccctgg

SEQ ID NO: 4167123 - DNA, 19 bp, Homo sapiens
gaccctgtcaggattgcag

SEQ ID NO: 4167124 - DNA, 16 bp, Homo sapiens
gaccgcgtagagagcc

SEQ ID NO: 4167125 - DNA, 14 bp, Homo sapiens
gaccgcttcccaga

SEQ ID NO: 4167126 - DNA, 21 bp, Homo sapiens
gacctactgaacccagagtca

SEQ ID NO: 4167127 - DNA, 15 bp, Homo sapiens
gacctataaaacaaa

SEQ ID NO: 4167128 - DNA, 14 bp, Homo sapiens
gacctgaggctcct

SEQ ID NO: 4167129 - DNA, 20 bp, Homo sapiens
gacctgaggctcctgtgcta

SEQ ID NO: 4167130 - DNA, 20 bp, Homo sapiens
gacctgcacgccaccgctgc

SEQ ID NO: 4167131 - DNA, 20 bp, Homo sapiens
gacctgcaggccaagagcag

SEQ ID NO: 4167132 - DNA, 19 bp, Homo sapiens
gacctgcagtcagggccca

SEQ ID NO: 4167133 - DNA, 20 bp, Homo sapiens
gacctgcagtcagggcccag

SEQ ID NO: 4167134 - DNA, 20 bp, Homo sapiens
gacctgcggctgctgtgtgc

SEQ ID NO: 4167135 - DNA, 20 bp, Homo sapiens
gacctgggcccacagagcct

SEQ ID NO: 4167136 - DNA, 18 bp, Homo sapiens
gaccttcatgcccttctg

SEQ ID NO: 4167137 - DNA, 21 bp, Homo sapiens
gaccttcatgcccttctgatt

SEQ ID NO: 4167138 - DNA, 14 bp, Homo sapiens
gacgcatcctgcag

SEQ ID NO: 4167139 - DNA, 18 bp, Homo sapiens
gacgcgggctgtgcctta

SEQ ID NO: 4167140 - DNA, 12 bp, Homo sapiens
gacggctggacc

SEQ ID NO: 4167141 - DNA, 14 bp, Homo sapiens
gacggctggacctg

SEQ ID NO: 4167142 - DNA, 16 bp, Homo sapiens
gacggctggacctgca

SEQ ID NO: 4167143 - DNA, 17 bp, Homo sapiens
gacggggtttcaccatg

SEQ ID NO: 4167144 - DNA, 21 bp, Homo sapiens
gaaagtggccatgccaccctg

SEQ ID NO: 4167145 - DNA, 14 bp, Homo sapiens
gaaataaaaccttt

SEQ ID NO: 4167146 - DNA, 15 bp, Homo sapiens
gaaataaaacctttc

SEQ ID NO: 4167147 - DNA, 16 bp, Homo sapiens
gaaataaaacctttca

SEQ ID NO: 4167148 - DNA, 12 bp, Homo sapiens
gaaataaaatcc

SEQ ID NO: 4167149 - DNA, 24 bp, Homo sapiens
gaaataagaaacacaaatgtaaaa

SEQ ID NO: 4167150 - DNA, 13 bp, Homo sapiens
gaaatacaaaaat

SEQ ID NO: 4167151 - DNA, 14 bp, Homo sapiens
gaaatacaaaaata

SEQ ID NO: 4167152 - DNA, 18 bp, Homo sapiens
gaaatacaaaaatactca

SEQ ID NO: 4167153 - DNA, 22 bp, Homo sapiens
gaaataccacaagcctgagaac

SEQ ID NO: 4167154 - DNA, 12 bp, Homo sapiens
gaaatacttttc

SEQ ID NO: 4167155 - DNA, 19 bp, Homo sapiens
gaaatagacagtatattta

SEQ ID NO: 4167156 - DNA, 15 bp, Homo sapiens
gaaataggaagatta

SEQ ID NO: 4167157 - DNA, 20 bp, Homo sapiens
gaaatctggcttctggccag

SEQ ID NO: 4167158 - DNA, 22 bp, Homo sapiens
gaaatctggcttctggccagga

SEQ ID NO: 4167159 - DNA, 22 bp, Homo sapiens
gaaatgacagaatgctgtttta

SEQ ID NO: 4167160 - DNA, 16 bp, Homo sapiens
gaaatggtatgagctg

SEQ ID NO: 4167161 - DNA, 20 bp, Homo sapiens
gaaattaccagagttgttct

SEQ ID NO: 4167162 - DNA, 13 bp, Homo sapiens
gaaattatttaat

SEQ ID NO: 4167163 - DNA, 15 bp, Homo sapiens
gaaattatttaataa

SEQ ID NO: 4167164 - DNA, 17 bp, Homo sapiens
gaaattatttaataaaa

SEQ ID NO: 4167165 - DNA, 15 bp, Homo sapiens
gaaattgaacctggt

SEQ ID NO: 4167166 - DNA, 17 bp, Homo sapiens
gaaattggtgggaagca

SEQ ID NO: 4167167 - DNA, 18 bp, Homo sapiens
gaaattggtgggaagcaa

SEQ ID NO: 4167168 - DNA, 20 bp, Homo sapiens
gaaattgtctagcagagcag

SEQ ID NO: 4167169 - DNA, 14 bp, Homo sapiens
gaaatttaaactat

SEQ ID NO: 4167170 - DNA, 20 bp, Homo sapiens
gaaatttaaactataagcaa

SEQ ID NO: 4167171 - DNA, 19 bp, Homo sapiens
gaaatttattagttaatat

SEQ ID NO: 4167172 - DNA, 15 bp, Homo sapiens
gaaatttgatttcta

SEQ ID NO: 4167173 - DNA, 21 bp, Homo sapiens
gaaatttgatttctattcaag

SEQ ID NO: 4167174 - DNA, 18 bp, Homo sapiens
gaaattttctagactttc

SEQ ID NO: 4167175 - DNA, 13 bp, Homo sapiens
gaacaacaacaac

SEQ ID NO: 4167176 - DNA, 19 bp, Homo sapiens
gaacaactaggcttcagca

SEQ ID NO: 4167177 - DNA, 21 bp, Homo sapiens
gaacaactaggcttcagcata

SEQ ID NO: 4167178 - DNA, 20 bp, Homo sapiens
gaacaagaccctgtctcaaa

SEQ ID NO: 4167179 - DNA, 22 bp, Homo sapiens
gaacacctttgttttgcactga

SEQ ID NO: 4167180 - DNA, 22 bp, Homo sapiens
gaacacgtccagaatttttcat

SEQ ID NO: 4167181 - DNA, 17 bp, Homo sapiens
gaacactagacaagcca

SEQ ID NO: 4167182 - DNA, 19 bp, Homo sapiens
gaacactagacaagccaga

SEQ ID NO: 4167183 - DNA, 21 bp, Homo sapiens
gaacagctcttcactcagcca

SEQ ID NO: 4167184 - DNA, 22 bp, Homo sapiens
gaacagctcttcactcagccac

SEQ ID NO: 4167185 - DNA, 12 bp, Homo sapiens
gaacaggctggt

SEQ ID NO: 4167186 - DNA, 15 bp, Homo sapiens
gaacatccctgggca

SEQ ID NO: 4167187 - DNA, 22 bp, Homo sapiens
gaacatctcactttgccccagt

SEQ ID NO: 4167188 - DNA, 17 bp, Homo sapiens
gaacattgccttcctcg

SEQ ID NO: 4167189 - DNA, 13 bp, Homo sapiens
gaacatttgcttt

SEQ ID NO: 4167190 - DNA, 21 bp, Homo sapiens
gaacattttctgtgtgtacat

SEQ ID NO: 4167191 - DNA, 20 bp, Homo sapiens
gaaccacaagagatcagcag

SEQ ID NO: 4167192 - DNA, 15 bp, Homo sapiens
gaaccaggagggtaa

SEQ ID NO: 4167193 - DNA, 22 bp, Homo sapiens
gaaccaggagggtaacagaaga

SEQ ID NO: 4167194 - DNA, 15 bp, Homo sapiens
gaacccagagtcagg

SEQ ID NO: 4167195 - DNA, 15 bp, Homo sapiens
gaacccagctctcag

SEQ ID NO: 4167196 - DNA, 16 bp, Homo sapiens
gaacccagctctcagg

SEQ ID NO: 4167197 - DNA, 20 bp, Homo sapiens
gaacctcaaactaggaggaa

SEQ ID NO: 4167198 - DNA, 17 bp, Homo sapiens
gaacctgatgagcaaga

SEQ ID NO: 4167199 - DNA, 21 bp, Homo sapiens
gaacctgggttgcagacagga

SEQ ID NO: 4167200 - DNA, 15 bp, Homo sapiens
gaacggaagggttgg

SEQ ID NO: 4167201 - DNA, 16 bp, Homo sapiens
gaacggggtccttcaa

SEQ ID NO: 4167202 - DNA, 22 bp, Homo sapiens
gaactattggagggtgggagag

SEQ ID NO: 4167203 - DNA, 15 bp, Homo sapiens
gaactgaattaagtt

SEQ ID NO: 4167204 - DNA, 12 bp, Homo sapiens
gaactgccccat

SEQ ID NO: 4167205 - DNA, 20 bp, Homo sapiens
gaactggctcctttgcctct

SEQ ID NO: 4167206 - DNA, 11 bp, Homo sapiens
gaactgttaca

SEQ ID NO: 4167207 - DNA, 15 bp, Homo sapiens
gaacttctaatatat

SEQ ID NO: 4167208 - DNA, 16 bp, Homo sapiens
gaacttgaggacacat

SEQ ID NO: 4167209 - DNA, 18 bp, Homo sapiens
gaactttcggagcctgcc

SEQ ID NO: 4167210 - DNA, 20 bp, Homo sapiens
gaactttcggagcctgcctc

SEQ ID NO: 4167211 - DNA, 14 bp, Homo sapiens
gaagaaaaagaagc

SEQ ID NO: 4167212 - DNA, 14 bp, Homo sapiens
gaagaaaaatgttt

SEQ ID NO: 4167213 - DNA, 23 bp, Homo sapiens
gaagaatacttctcattttttaa

SEQ ID NO: 4167214 - DNA, 18 bp, Homo sapiens
gaagaatcaagagggcag

SEQ ID NO: 4167215 - DNA, 24 bp, Homo sapiens
gaagaatgcttaatcagatagata

SEQ ID NO: 4167216 - DNA, 20 bp, Homo sapiens
gaagaatgggctgcagaaga

SEQ ID NO: 4167217 - DNA, 15 bp, Homo sapiens
gaagacaggacagtg

SEQ ID NO: 4167218 - DNA, 22 bp, Homo sapiens
gaagaccacatccacacacgca

SEQ ID NO: 4167219 - DNA, 20 bp, Homo sapiens
gaagaccgactaacagctga

SEQ ID NO: 4167220 - DNA, 18 bp, Homo sapiens
gaagactctggagccaag

SEQ ID NO: 4167221 - DNA, 12 bp, Homo sapiens
gaagagaaggag

SEQ ID NO: 4167222 - DNA, 13 bp, Homo sapiens
gaagagaaggagc

SEQ ID NO: 4167223 - DNA, 15 bp, Homo sapiens
gaagagaaggagcag

SEQ ID NO: 4167224 - DNA, 13 bp, Homo sapiens
gaagagagaaaca

SEQ ID NO: 4167225 - DNA, 12 bp, Homo sapiens
gaagagaggcac

SEQ ID NO: 4167226 - DNA, 16 bp, Homo sapiens
gaagagatcaggaaga

SEQ ID NO: 4167227 - DNA, 20 bp, Homo sapiens
gaagaggaggagggattctg

SEQ ID NO: 4167228 - DNA, 16 bp, Homo sapiens
gaagaggctggtgctg

SEQ ID NO: 4167229 - DNA, 22 bp, Homo sapiens
gaagaggttgggcttccatgcc

SEQ ID NO: 4167230 - DNA, 15 bp, Homo sapiens
gaagataattttatg

SEQ ID NO: 4167231 - DNA, 21 bp, Homo sapiens
gaagatgttgtcattatgtac

SEQ ID NO: 4167232 - DNA, 17 bp, Homo sapiens
gaagatttagatgtttt

SEQ ID NO: 4167233 - DNA, 17 bp, Homo sapiens
gaagcaaatcgaatgaa

SEQ ID NO: 4167234 - DNA, 22 bp, Homo sapiens
gaagcaacctcagtaatttaga

SEQ ID NO: 4167235 - DNA, 14 bp, Homo sapiens
gaagcacatgttta

SEQ ID NO: 4167236 - DNA, 12 bp, Homo sapiens
gaagcaggcagg

SEQ ID NO: 4167237 - DNA, 15 bp, Homo sapiens
gaagcaggcagggca

SEQ ID NO: 4167238 - DNA, 18 bp, Homo sapiens
gaagcaggttgaggggct

SEQ ID NO: 4167239 - DNA, 18 bp, Homo sapiens
gaagccaacttggctttc

SEQ ID NO: 4167240 - DNA, 20 bp, Homo sapiens
gaagccatattcacacctca

SEQ ID NO: 4167241 - DNA, 13 bp, Homo sapiens
gaagcctgaggct

SEQ ID NO: 4167242 - DNA, 15 bp, Homo sapiens
gaagcgctcatctgg

SEQ ID NO: 4167243 - DNA, 13 bp, Homo sapiens
gaagctgggggaa

SEQ ID NO: 4167244 - DNA, 22 bp, Homo sapiens
gaagctgtacccaatttaattc

SEQ ID NO: 4167245 - DNA, 19 bp, Homo sapiens
gaaggaaggcagggaggag

SEQ ID NO: 4167246 - DNA, 20 bp, Homo sapiens
gaaggagagcaagaaggaaa

SEQ ID NO: 4167247 - DNA, 17 bp, Homo sapiens
gaaggaggtgagggatg

SEQ ID NO: 4167248 - DNA, 14 bp, Homo sapiens
gaaggatagcctca

SEQ ID NO: 4167249 - DNA, 18 bp, Homo sapiens
gaaggatagcctcagcca

SEQ ID NO: 4167250 - DNA, 21 bp, Homo sapiens
gaaggcagggacagagatgga

SEQ ID NO: 4167251 - DNA, 23 bp, Homo sapiens
gaaggcagggacagagatggagg

SEQ ID NO: 4167252 - DNA, 18 bp, Homo sapiens
gaaggcagggaggaggca

SEQ ID NO: 4167253 - DNA, 13 bp, Homo sapiens
gaaggccacatca

SEQ ID NO: 4167254 - DNA, 23 bp, Homo sapiens
gaaggcctcactcaagcctgaga

SEQ ID NO: 4167255 - DNA, 17 bp, Homo sapiens
gaaggcttgttgtgctt

SEQ ID NO: 4167256 - DNA, 12 bp, Homo sapiens
gaagggaagcct

SEQ ID NO: 4167257 - DNA, 17 bp, Homo sapiens
gaagggaataaggtaca

SEQ ID NO: 4167258 - DNA, 20 bp, Homo sapiens
gaagggaccttgaagggtaa

SEQ ID NO: 4167259 - DNA, 12 bp, Homo sapiens
gaagggagaagg

SEQ ID NO: 4167260 - DNA, 23 bp, Homo sapiens
gaaggggccctggtccttccagg

SEQ ID NO: 4167261 - DNA, 13 bp, Homo sapiens
gaagggtaaagaa

SEQ ID NO: 4167262 - DNA, 23 bp, Homo sapiens
gaaggtcactcttcctgcaagga

SEQ ID NO: 4167263 - DNA, 23 bp, Homo sapiens
gaaggttagaggtttgtcaacaa

SEQ ID NO: 4167264 - DNA, 19 bp, Homo sapiens
gaagtaaaagcaaaaaaga

SEQ ID NO: 4167265 - DNA, 15 bp, Homo sapiens
gaagtaatgacagat

SEQ ID NO: 4167266 - DNA, 14 bp, Homo sapiens
gaagtatgtgtggg

SEQ ID NO: 4167267 - DNA, 21 bp, Homo sapiens
gaagtcattgtcgctcagcaa

SEQ ID NO: 4167268 - DNA, 21 bp, Homo sapiens
gaagtccctaggagggaagga

SEQ ID NO: 4167269 - DNA, 16 bp, Homo sapiens
gaagtgccacatgaca

SEQ ID NO: 4167270 - DNA, 15 bp, Homo sapiens
gaagtggctctcagg

SEQ ID NO: 4167271 - DNA, 11 bp, Homo sapiens
gaagtttcatc

SEQ ID NO: 4167272 - DNA, 23 bp, Homo sapiens
gaagttttcaggacttggtctga

SEQ ID NO: 4167273 - DNA, 13 bp, Homo sapiens
gaataaaattgta

SEQ ID NO: 4167274 - DNA, 17 bp, Homo sapiens
gaataaggtacaagaag

SEQ ID NO: 4167275 - DNA, 20 bp, Homo sapiens
gaataaggtacaagaagcat

SEQ ID NO: 4167276 - DNA, 20 bp, Homo sapiens
gaatataattgttttatctg

SEQ ID NO: 4167277 - DNA, 16 bp, Homo sapiens
gaatatgactcaggag

SEQ ID NO: 4167278 - DNA, 17 bp, Homo sapiens
gaatatttcaaaataaa

SEQ ID NO: 4167279 - DNA, 22 bp, Homo sapiens
gaatcaaagcagttaactttaa

SEQ ID NO: 4167280 - DNA, 22 bp, Homo sapiens
gaatcattgtgcttaataatac

SEQ ID NO: 4167281 - DNA, 22 bp, Homo sapiens
gaatccgcctgcagaggacaga

SEQ ID NO: 4167282 - DNA, 19 bp, Homo sapiens
gaatcctgctgccagagaa

SEQ ID NO: 4167283 - DNA, 20 bp, Homo sapiens
cttggcatcacagggcagag

SEQ ID NO: 4167284 - DNA, 12 bp, Homo sapiens
cttggcctctgc

SEQ ID NO: 4167285 - DNA, 14 bp, Homo sapiens
cttggcctctgctt

SEQ ID NO: 4167286 - DNA, 20 bp, Homo sapiens
cttggcttttgcttggcaga

SEQ ID NO: 4167287 - DNA, 24 bp, Homo sapiens
cttgggcccaggaggtcaagcctg

SEQ ID NO: 4167288 - DNA, 22 bp, Homo sapiens
cttggggctcgccccacccagg

SEQ ID NO: 4167289 - DNA, 16 bp, Homo sapiens
cttggtaaattgtaaa

SEQ ID NO: 4167290 - DNA, 22 bp, Homo sapiens
cttggtaattatatctgttttg

SEQ ID NO: 4167291 - DNA, 17 bp, Homo sapiens
cttggtggccaagcctg

SEQ ID NO: 4167292 - DNA, 13 bp, Homo sapiens
cttggtggctgag

SEQ ID NO: 4167293 - DNA, 17 bp, Homo sapiens
cttggttcccttgtgtg

SEQ ID NO: 4167294 - DNA, 20 bp, Homo sapiens
cttggtttggacacagtgtt

SEQ ID NO: 4167295 - DNA, 14 bp, Homo sapiens
cttgtacacttaag

SEQ ID NO: 4167296 - DNA, 13 bp, Homo sapiens
cttgtatttccaa

SEQ ID NO: 4167297 - DNA, 18 bp, Homo sapiens
cttgtcaagaatgagaaa

SEQ ID NO: 4167298 - DNA, 14 bp, Homo sapiens
cttgtgtcagagac

SEQ ID NO: 4167299 - DNA, 21 bp, Homo sapiens
cttgttgctgattcaagaaac

SEQ ID NO: 4167300 - DNA, 18 bp, Homo sapiens
cttgttttgacttgaata

SEQ ID NO: 4167301 - DNA, 22 bp, Homo sapiens
cttgttttgacttgaataaagt

SEQ ID NO: 4167302 - DNA, 18 bp, Homo sapiens
ctttaaaagatgctttta

SEQ ID NO: 4167303 - DNA, 16 bp, Homo sapiens
ctttaaaatgtaaagc

SEQ ID NO: 4167304 - DNA, 18 bp, Homo sapiens
ctttacctaccaccttcc

SEQ ID NO: 4167305 - DNA, 19 bp, Homo sapiens
ctttactggtgatttctga

SEQ ID NO: 4167306 - DNA, 15 bp, Homo sapiens
ctttaggcagcctgc

SEQ ID NO: 4167307 - DNA, 22 bp, Homo sapiens
ctttaggtgagtcacactcaga

SEQ ID NO: 4167308 - DNA, 19 bp, Homo sapiens
ctttataaaaagtgaaata

SEQ ID NO: 4167309 - DNA, 12 bp, Homo sapiens
ctttataaactt

SEQ ID NO: 4167310 - DNA, 14 bp, Homo sapiens
ctttatagctctca

SEQ ID NO: 4167311 - DNA, 17 bp, Homo sapiens
ctttataggcagtagac

SEQ ID NO: 4167312 - DNA, 15 bp, Homo sapiens
ctttatatattgatt

SEQ ID NO: 4167313 - DNA, 13 bp, Homo sapiens
ctttatatgtaat

SEQ ID NO: 4167314 - DNA, 12 bp, Homo sapiens
ctttatatttag

SEQ ID NO: 4167315 - DNA, 21 bp, Homo sapiens
ctttatgtctgtggatttttt

SEQ ID NO: 4167316 - DNA, 14 bp, Homo sapiens
ctttcagctgtgaa

SEQ ID NO: 4167317 - DNA, 20 bp, Homo sapiens
ctttcagggaatttcaggaa

SEQ ID NO: 4167318 - DNA, 14 bp, Homo sapiens
ctttccccacctct

SEQ ID NO: 4167319 - DNA, 17 bp, Homo sapiens
ctttccccacctcttcc

SEQ ID NO: 4167320 - DNA, 20 bp, Homo sapiens
ctttccccacctcttccttc

SEQ ID NO: 4167321 - DNA, 21 bp, Homo sapiens
ctttccccacctcttccttcc

SEQ ID NO: 4167322 - DNA, 11 bp, Homo sapiens
ctttcccccac

SEQ ID NO: 4167323 - DNA, 13 bp, Homo sapiens
ctttcccccaccc

SEQ ID NO: 4167324 - DNA, 18 bp, Homo sapiens
ctttcccttgtgtcaaga

SEQ ID NO: 4167325 - DNA, 15 bp, Homo sapiens
ctttcctaaatgttt

SEQ ID NO: 4167326 - DNA, 15 bp, Homo sapiens
ctttcctccccacct

SEQ ID NO: 4167327 - DNA, 17 bp, Homo sapiens
ctttcctccccaccttc

SEQ ID NO: 4167328 - DNA, 15 bp, Homo sapiens
ctttccttctggctc

SEQ ID NO: 4167329 - DNA, 17 bp, Homo sapiens
ctttccttttcttcctt

SEQ ID NO: 4167330 - DNA, 15 bp, Homo sapiens
ctttcggagcctgcc

SEQ ID NO: 4167331 - DNA, 17 bp, Homo sapiens
ctttctcactaaatctt

SEQ ID NO: 4167332 - DNA, 14 bp, Homo sapiens
ctttctcactgctg

SEQ ID NO: 4167333 - DNA, 16 bp, Homo sapiens
ctttctcttccctcct

SEQ ID NO: 4167334 - DNA, 19 bp, Homo sapiens
ctttctcttccctccttcc

SEQ ID NO: 4167335 - DNA, 22 bp, Homo sapiens
ctttctgacaagataaaggaag

SEQ ID NO: 4167336 - DNA, 20 bp, Homo sapiens
ctttctgatcaaggccttat

SEQ ID NO: 4167337 - DNA, 21 bp, Homo sapiens
ctttctggccctttctggacc

SEQ ID NO: 4167338 - DNA, 13 bp, Homo sapiens
ctttctgtaaact

SEQ ID NO: 4167339 - DNA, 12 bp, Homo sapiens
ctttctgtgtgc

SEQ ID NO: 4167340 - DNA, 15 bp, Homo sapiens
ctttctgttggtgta

SEQ ID NO: 4167341 - DNA, 21 bp, Homo sapiens
ctttgagtaccaaatccacaa

SEQ ID NO: 4167342 - DNA, 15 bp, Homo sapiens
ctttgatctctgctt

SEQ ID NO: 4167343 - DNA, 20 bp, Homo sapiens
ctttgcttcaaatccatcca

SEQ ID NO: 4167344 - DNA, 21 bp, Homo sapiens
ctttgcttccaggtggcagga

SEQ ID NO: 4167345 - DNA, 17 bp, Homo sapiens
ctttggaaggagtgaga

SEQ ID NO: 4167346 - DNA, 16 bp, Homo sapiens
ctttggccctcagtgg

SEQ ID NO: 4167347 - DNA, 17 bp, Homo sapiens
ctttgggaggctgaggc

SEQ ID NO: 4167348 - DNA, 18 bp, Homo sapiens
ctttgggaggctgaggcg

SEQ ID NO: 4167349 - DNA, 16 bp, Homo sapiens
ctttgggatcagcctc

SEQ ID NO: 4167350 - DNA, 17 bp, Homo sapiens
ctttgggatcagcctcc

SEQ ID NO: 4167351 - DNA, 19 bp, Homo sapiens
ctttgggattctaggaaac

SEQ ID NO: 4167352 - DNA, 17 bp, Homo sapiens
ctttggtccccagcatt

SEQ ID NO: 4167353 - DNA, 15 bp, Homo sapiens
ctttgtttactaaag

SEQ ID NO: 4167354 - DNA, 16 bp, Homo sapiens
ctttgttttgcactga

SEQ ID NO: 4167355 - DNA, 14 bp, Homo sapiens
cttttaaaagaaaa

SEQ ID NO: 4167356 - DNA, 17 bp, Homo sapiens
cttttaaaatgaaatgt

SEQ ID NO: 4167357 - DNA, 23 bp, Homo sapiens
cttttagagccccccgtgtggct

SEQ ID NO: 4167358 - DNA, 16 bp, Homo sapiens
cttttatcaaaatccc

SEQ ID NO: 4167359 - DNA, 16 bp, Homo sapiens
cttttccacaaatatg

SEQ ID NO: 4167360 - DNA, 22 bp, Homo sapiens
cttttcccaaaatgttgaaata

SEQ ID NO: 4167361 - DNA, 21 bp, Homo sapiens
cttttcgcttgcttctgcagc

SEQ ID NO: 4167362 - DNA, 20 bp, Homo sapiens
cttttgaagtagtttgtata

SEQ ID NO: 4167363 - DNA, 22 bp, Homo sapiens
cttttgaagtagtttgtataac

SEQ ID NO: 4167364 - DNA, 14 bp, Homo sapiens
cttttgcaaacttt

SEQ ID NO: 4167365 - DNA, 22 bp, Homo sapiens
cttttgcataagattaaaggaa

SEQ ID NO: 4167366 - DNA, 16 bp, Homo sapiens
cttttgcttggcagag

SEQ ID NO: 4167367 - DNA, 21 bp, Homo sapiens
cttttgggaggtccaggcagg

SEQ ID NO: 4167368 - DNA, 18 bp, Homo sapiens
cttttgggggtcaacagt

SEQ ID NO: 4167369 - DNA, 12 bp, Homo sapiens
cttttgtggatt

SEQ ID NO: 4167370 - DNA, 14 bp, Homo sapiens
cttttgtgtacagt

SEQ ID NO: 4167371 - DNA, 16 bp, Homo sapiens
ctttttcaacttggaa

SEQ ID NO: 4167372 - DNA, 14 bp, Homo sapiens
ctttttctaccttt

SEQ ID NO: 4167373 - DNA, 11 bp, Homo sapiens
ctttttgaatg

SEQ ID NO: 4167374 - DNA, 15 bp, Homo sapiens
cttttttcttgagta

SEQ ID NO: 4167375 - DNA, 14 bp, Homo sapiens
cttttttttaataa

SEQ ID NO: 4167376 - DNA, 20 bp, Homo sapiens
gaaaaaaaaaaagaagaaga

SEQ ID NO: 4167377 - DNA, 14 bp, Homo sapiens
gaaaaagaagaatc

SEQ ID NO: 4167378 - DNA, 13 bp, Homo sapiens
gaaaaagcgaaaa

SEQ ID NO: 4167379 - DNA, 16 bp, Homo sapiens
gaaaaataacaactat

SEQ ID NO: 4167380 - DNA, 20 bp, Homo sapiens
gaaaacgttgacccctttcc

SEQ ID NO: 4167381 - DNA, 20 bp, Homo sapiens
gaaaactcctttagcaggtg

SEQ ID NO: 4167382 - DNA, 17 bp, Homo sapiens
gaaaactcttggcctct

SEQ ID NO: 4167383 - DNA, 19 bp, Homo sapiens
gaaaactcttggcctctgc

SEQ ID NO: 4167384 - DNA, 16 bp, Homo sapiens
gaaaactgaaaatcta

SEQ ID NO: 4167385 - DNA, 19 bp, Homo sapiens
gaaaacttagaaataagaa

SEQ ID NO: 4167386 - DNA, 14 bp, Homo sapiens
gaaaacttatttga

SEQ ID NO: 4167387 - DNA, 16 bp, Homo sapiens
gaaaactttaaagcgt

SEQ ID NO: 4167388 - DNA, 21 bp, Homo sapiens
gaaaagaatccctgcagcctg

SEQ ID NO: 4167389 - DNA, 17 bp, Homo sapiens
gaaaagacagagcctcc

SEQ ID NO: 4167390 - DNA, 19 bp, Homo sapiens
gaaaagggaagttgtgcct

SEQ ID NO: 4167391 - DNA, 22 bp, Homo sapiens
gaaaaggtttatgaaaaagaag

SEQ ID NO: 4167392 - DNA, 13 bp, Homo sapiens
gaaaagtgttatt

SEQ ID NO: 4167393 - DNA, 14 bp, Homo sapiens
gaaaagtgttatta

SEQ ID NO: 4167394 - DNA, 19 bp, Homo sapiens
gaaaatagctctttcaggg

SEQ ID NO: 4167395 - DNA, 14 bp, Homo sapiens
gaaaatctaatatt

SEQ ID NO: 4167396 - DNA, 23 bp, Homo sapiens
gaaaatctaatattaaaaatatg

SEQ ID NO: 4167397 - DNA, 17 bp, Homo sapiens
gaaaatggggcttgccc

SEQ ID NO: 4167398 - DNA, 23 bp, Homo sapiens
gaaaatggggcttgccctgggtc

SEQ ID NO: 4167399 - DNA, 19 bp, Homo sapiens
gaaaatgtacatactatgt

SEQ ID NO: 4167400 - DNA, 23 bp, Homo sapiens
gaaacaaagagttcaagaaataa

SEQ ID NO: 4167401 - DNA, 21 bp, Homo sapiens
gaaacactcaacaataaagac

SEQ ID NO: 4167402 - DNA, 13 bp, Homo sapiens
gaaacattttcat

SEQ ID NO: 4167403 - DNA, 22 bp, Homo sapiens
gaaaccaaagatatatacacag

SEQ ID NO: 4167404 - DNA, 17 bp, Homo sapiens
gaaaccacacttcttga

SEQ ID NO: 4167405 - DNA, 15 bp, Homo sapiens
gaaacccaaggaaca

SEQ ID NO: 4167406 - DNA, 13 bp, Homo sapiens
gaaaccttaatat

SEQ ID NO: 4167407 - DNA, 20 bp, Homo sapiens
gaaactttctataacctaaa

SEQ ID NO: 4167408 - DNA, 16 bp, Homo sapiens
gaaagaacggaagaag

SEQ ID NO: 4167409 - DNA, 20 bp, Homo sapiens
gaaagacatcacatccctct

SEQ ID NO: 4167410 - DNA, 21 bp, Homo sapiens
gaaagacggattgcattagaa

SEQ ID NO: 4167411 - DNA, 16 bp, Homo sapiens
gaaagcatcacctcag

SEQ ID NO: 4167412 - DNA, 17 bp, Homo sapiens
gaaagcatcacctcagg

SEQ ID NO: 4167413 - DNA, 12 bp, Homo sapiens
gaaagcccttca

SEQ ID NO: 4167414 - DNA, 21 bp, Homo sapiens
gaaagctggtaaactatttgt

SEQ ID NO: 4167415 - DNA, 22 bp, Homo sapiens
gaaagcttaggctgcttattgg

SEQ ID NO: 4167416 - DNA, 14 bp, Homo sapiens
gaaaggctcagtct

SEQ ID NO: 4167417 - DNA, 15 bp, Homo sapiens
gaaagggaagcctga

SEQ ID NO: 4167418 - DNA, 20 bp, Homo sapiens
gaaagggaagcctgactgct

SEQ ID NO: 4167419 - DNA, 22 bp, Homo sapiens
gaaaggtggtgtttctgtaaga

SEQ ID NO: 4167420 - DNA, 13 bp, Homo sapiens
gaaagtaaaagtt

SEQ ID NO: 4167421 - DNA, 17 bp, Homo sapiens
gaaagtcagatgcccag

SEQ ID NO: 4167422 - DNA, 23 bp, Homo sapiens
cttaatcaagaatattcaaatgt

SEQ ID NO: 4167423 - DNA, 21 bp, Homo sapiens
cttaatcagatagatattcct

SEQ ID NO: 4167424 - DNA, 20 bp, Homo sapiens
cttaatggctgataatttta

SEQ ID NO: 4167425 - DNA, 22 bp, Homo sapiens
cttacaaactgcggtatacatt

SEQ ID NO: 4167426 - DNA, 21 bp, Homo sapiens
cttacaatggagtctgcagtg

SEQ ID NO: 4167427 - DNA, 13 bp, Homo sapiens
cttaccaaaacag

SEQ ID NO: 4167428 - DNA, 18 bp, Homo sapiens
cttaccccagctgcggca

SEQ ID NO: 4167429 - DNA, 22 bp, Homo sapiens
cttactgcagtaacactggcct

SEQ ID NO: 4167430 - DNA, 17 bp, Homo sapiens
cttagactagttgaaca

SEQ ID NO: 4167431 - DNA, 16 bp, Homo sapiens
cttagagaggaaaagc

SEQ ID NO: 4167432 - DNA, 14 bp, Homo sapiens
cttagcctcctgac

SEQ ID NO: 4167433 - DNA, 13 bp, Homo sapiens
cttagctggagaa

SEQ ID NO: 4167434 - DNA, 23 bp, Homo sapiens
cttagcttctattatagccacat

SEQ ID NO: 4167435 - DNA, 21 bp, Homo sapiens
cttaggaagaaatcacttaaa

SEQ ID NO: 4167436 - DNA, 15 bp, Homo sapiens
cttaggtgccaggct

SEQ ID NO: 4167437 - DNA, 17 bp, Homo sapiens
cttaggtgccaggctgt

SEQ ID NO: 4167438 - DNA, 15 bp, Homo sapiens
cttagttttgggagg

SEQ ID NO: 4167439 - DNA, 22 bp, Homo sapiens
cttagtttttaccttgttttct

SEQ ID NO: 4167440 - DNA, 22 bp, Homo sapiens
cttataaacaaatgaattgtat

SEQ ID NO: 4167441 - DNA, 20 bp, Homo sapiens
cttatcactggcgcagactt

SEQ ID NO: 4167442 - DNA, 15 bp, Homo sapiens
cttatccaggactct

SEQ ID NO: 4167443 - DNA, 15 bp, Homo sapiens
cttatgcttaaaatg

SEQ ID NO: 4167444 - DNA, 19 bp, Homo sapiens
cttattcccaactgctctg

SEQ ID NO: 4167445 - DNA, 18 bp, Homo sapiens
cttattgtttgtaaacaa

SEQ ID NO: 4167446 - DNA, 13 bp, Homo sapiens
cttatttgagtga

SEQ ID NO: 4167447 - DNA, 15 bp, Homo sapiens
cttcaaagtttaata

SEQ ID NO: 4167448 - DNA, 14 bp, Homo sapiens
cttcaaatccatcc

SEQ ID NO: 4167449 - DNA, 13 bp, Homo sapiens
cttcaaatgcctg

SEQ ID NO: 4167450 - DNA, 22 bp, Homo sapiens
cttcaagcatggctattttata

SEQ ID NO: 4167451 - DNA, 15 bp, Homo sapiens
cttcaagctctctgt

SEQ ID NO: 4167452 - DNA, 16 bp, Homo sapiens
cttcaagctctctgtt

SEQ ID NO: 4167453 - DNA, 18 bp, Homo sapiens
cttcaccttggagcctga

SEQ ID NO: 4167454 - DNA, 13 bp, Homo sapiens
cttcactcagcca

SEQ ID NO: 4167455 - DNA, 14 bp, Homo sapiens
cttcactccggtgt

SEQ ID NO: 4167456 - DNA, 23 bp, Homo sapiens
cttcactccggtgtgcctgcagc

SEQ ID NO: 4167457 - DNA, 18 bp, Homo sapiens
cttcactgttgaaaatta

SEQ ID NO: 4167458 - DNA, 15 bp, Homo sapiens
cttcagcctgaggct

SEQ ID NO: 4167459 - DNA, 19 bp, Homo sapiens
cttcagggtgagtgaatgg

SEQ ID NO: 4167460 - DNA, 17 bp, Homo sapiens
cttcaggtccaggctgt

SEQ ID NO: 4167461 - DNA, 18 bp, Homo sapiens
cttcaggtccaggctgtg

SEQ ID NO: 4167462 - DNA, 15 bp, Homo sapiens
cttcatcttgacatg

SEQ ID NO: 4167463 - DNA, 23 bp, Homo sapiens
cttcatgaggaggtcagcccatt

SEQ ID NO: 4167464 - DNA, 18 bp, Homo sapiens
cttcatgcccttctgatt

SEQ ID NO: 4167465 - DNA, 15 bp, Homo sapiens
cttcatgctcagccc

SEQ ID NO: 4167466 - DNA, 17 bp, Homo sapiens
cttcatgctcagccctg

SEQ ID NO: 4167467 - DNA, 16 bp, Homo sapiens
cttccaggcccccacc

SEQ ID NO: 4167468 - DNA, 18 bp, Homo sapiens
cttccaggtatctccagg

SEQ ID NO: 4167469 - DNA, 19 bp, Homo sapiens
cttccaggtatctccagga

SEQ ID NO: 4167470 - DNA, 17 bp, Homo sapiens
cttccatgcctgtagct

SEQ ID NO: 4167471 - DNA, 14 bp, Homo sapiens
cttcccactggagg

SEQ ID NO: 4167472 - DNA, 15 bp, Homo sapiens
cttcccactggaggt

SEQ ID NO: 4167473 - DNA, 12 bp, Homo sapiens
cttccccagact

SEQ ID NO: 4167474 - DNA, 23 bp, Homo sapiens
cttccccagactcagctccagaa

SEQ ID NO: 4167475 - DNA, 23 bp, Homo sapiens
cttccccaggagctctctgctga

SEQ ID NO: 4167476 - DNA, 16 bp, Homo sapiens
cttccctaggctgagc

SEQ ID NO: 4167477 - DNA, 20 bp, Homo sapiens
cttccctccccacagtcctc

SEQ ID NO: 4167478 - DNA, 13 bp, Homo sapiens
cttccctccttcc

SEQ ID NO: 4167479 - DNA, 14 bp, Homo sapiens
cttccctccttccc

SEQ ID NO: 4167480 - DNA, 16 bp, Homo sapiens
cttccctccttccctt

SEQ ID NO: 4167481 - DNA, 14 bp, Homo sapiens
cttccctctttccc

SEQ ID NO: 4167482 - DNA, 18 bp, Homo sapiens
cttccctgttttaaatta

SEQ ID NO: 4167483 - DNA, 16 bp, Homo sapiens
cttcccttctctcctt

SEQ ID NO: 4167484 - DNA, 18 bp, Homo sapiens
cttcccttctctccttcc

SEQ ID NO: 4167485 - DNA, 20 bp, Homo sapiens
cttcccttctctccttccct

SEQ ID NO: 4167486 - DNA, 16 bp, Homo sapiens
cttccgctcctttacc

SEQ ID NO: 4167487 - DNA, 22 bp, Homo sapiens
cttccgctcctttacctaccac

SEQ ID NO: 4167488 - DNA, 13 bp, Homo sapiens
cttcctccctgga

SEQ ID NO: 4167489 - DNA, 17 bp, Homo sapiens
cttcctcgtgcagagct

SEQ ID NO: 4167490 - DNA, 12 bp, Homo sapiens
cttcctctgggc

SEQ ID NO: 4167491 - DNA, 14 bp, Homo sapiens
cttcctctgggcag

SEQ ID NO: 4167492 - DNA, 13 bp, Homo sapiens
cttcctgcaagga

SEQ ID NO: 4167493 - DNA, 15 bp, Homo sapiens
cttcctgcaaggact

SEQ ID NO: 4167494 - DNA, 22 bp, Homo sapiens
cttcctggtgaggcccagcctg

SEQ ID NO: 4167495 - DNA, 24 bp, Homo sapiens
cttcctggtgaggcccagcctgtc

SEQ ID NO: 4167496 - DNA, 12 bp, Homo sapiens
cttccttccccc

SEQ ID NO: 4167497 - DNA, 19 bp, Homo sapiens
cttccttgctgtcctaggc

SEQ ID NO: 4167498 - DNA, 20 bp, Homo sapiens
cttccttgctgtcctaggcc

SEQ ID NO: 4167499 - DNA, 14 bp, Homo sapiens
cttcctttcctctg

SEQ ID NO: 4167500 - DNA, 14 bp, Homo sapiens
cttcctttctaaat

SEQ ID NO: 4167501 - DNA, 11 bp, Homo sapiens
cttctaatata

SEQ ID NO: 4167502 - DNA, 14 bp, Homo sapiens
cttctaatatattt

SEQ ID NO: 4167503 - DNA, 20 bp, Homo sapiens
cttctaatatatttttatat

SEQ ID NO: 4167504 - DNA, 15 bp, Homo sapiens
cttctagatctggaa

SEQ ID NO: 4167505 - DNA, 17 bp, Homo sapiens
cttctaggactgggggt

SEQ ID NO: 4167506 - DNA, 13 bp, Homo sapiens
cttctattaaatg

SEQ ID NO: 4167507 - DNA, 19 bp, Homo sapiens
cttctattatagccacatc

SEQ ID NO: 4167508 - DNA, 12 bp, Homo sapiens
cttctcagccta

SEQ ID NO: 4167509 - DNA, 12 bp, Homo sapiens
cttctccaggct

SEQ ID NO: 4167510 - DNA, 14 bp, Homo sapiens
cttctccatcctca

SEQ ID NO: 4167511 - DNA, 23 bp, Homo sapiens
cttctcctcccagcgtgtgtatc

SEQ ID NO: 4167512 - DNA, 13 bp, Homo sapiens
cttctctacagac

SEQ ID NO: 4167513 - DNA, 14 bp, Homo sapiens
cttctctccttccc

SEQ ID NO: 4167514 - DNA, 16 bp, Homo sapiens
cttctctccttccctc

SEQ ID NO: 4167515 - DNA, 19 bp, Homo sapiens
cttctgcagcaactcccac

SEQ ID NO: 4167516 - DNA, 12 bp, Homo sapiens
cttctggccagg

SEQ ID NO: 4167517 - DNA, 17 bp, Homo sapiens
cttctggccaggaagct

SEQ ID NO: 4167518 - DNA, 13 bp, Homo sapiens
cttctggctccaa

SEQ ID NO: 4167519 - DNA, 21 bp, Homo sapiens
cttctggtgctactccatgca

SEQ ID NO: 4167520 - DNA, 20 bp, Homo sapiens
cttcttcagaagacactgca

SEQ ID NO: 4167521 - DNA, 16 bp, Homo sapiens
cttcttcatcttgaca

SEQ ID NO: 4167522 - DNA, 13 bp, Homo sapiens
cttcttcttcaga

SEQ ID NO: 4167523 - DNA, 15 bp, Homo sapiens
cttcttgtgtcctga

SEQ ID NO: 4167524 - DNA, 15 bp, Homo sapiens
cttctttctcttccc

SEQ ID NO: 4167525 - DNA, 18 bp, Homo sapiens
cttctttctcttccctcc

SEQ ID NO: 4167526 - DNA, 18 bp, Homo sapiens
cttctttgaagttattta

SEQ ID NO: 4167527 - DNA, 13 bp, Homo sapiens
cttcttttcacct

SEQ ID NO: 4167528 - DNA, 15 bp, Homo sapiens
cttgaaacagcctgg

SEQ ID NO: 4167529 - DNA, 19 bp, Homo sapiens
cttgaaatatcctgcttga

SEQ ID NO: 4167530 - DNA, 19 bp, Homo sapiens
cttgaagccaaactgttgg

SEQ ID NO: 4167531 - DNA, 16 bp, Homo sapiens
cttgaagccactgaag

SEQ ID NO: 4167532 - DNA, 20 bp, Homo sapiens
cttgacaactggcaggcagg

SEQ ID NO: 4167533 - DNA, 13 bp, Homo sapiens
cttgacccatctc

SEQ ID NO: 4167534 - DNA, 15 bp, Homo sapiens
cttgaccctgagctg

SEQ ID NO: 4167535 - DNA, 21 bp, Homo sapiens
cttgagcttggcagctgaact

SEQ ID NO: 4167536 - DNA, 14 bp, Homo sapiens
cttgaggacacatg

SEQ ID NO: 4167537 - DNA, 17 bp, Homo sapiens
cttgagtagatctgctt

SEQ ID NO: 4167538 - DNA, 17 bp, Homo sapiens
cttgatagaaatgccaa

SEQ ID NO: 4167539 - DNA, 22 bp, Homo sapiens
cttgatagaaatgccaagcact

SEQ ID NO: 4167540 - DNA, 17 bp, Homo sapiens
cttgatgggattctgga

SEQ ID NO: 4167541 - DNA, 14 bp, Homo sapiens
cttgcattcccagt

SEQ ID NO: 4167542 - DNA, 22 bp, Homo sapiens
cttgccaaattccatgtccctg

SEQ ID NO: 4167543 - DNA, 17 bp, Homo sapiens
cttgcccggattctggg

SEQ ID NO: 4167544 - DNA, 20 bp, Homo sapiens
cttgcccggattctgggagg

SEQ ID NO: 4167545 - DNA, 15 bp, Homo sapiens
cttgccgagagaggc

SEQ ID NO: 4167546 - DNA, 14 bp, Homo sapiens
cttgctctgcaggc

SEQ ID NO: 4167547 - DNA, 19 bp, Homo sapiens
cttgctgaggggcagggag

SEQ ID NO: 4167548 - DNA, 14 bp, Homo sapiens
cttgctgtcctagg

SEQ ID NO: 4167549 - DNA, 20 bp, Homo sapiens
cttgctgtcctaggccacac

SEQ ID NO: 4167550 - DNA, 23 bp, Homo sapiens
cttgctgtggctatgggaatcag

SEQ ID NO: 4167551 - DNA, 11 bp, Homo sapiens
cttgcttctgc

SEQ ID NO: 4167552 - DNA, 14 bp, Homo sapiens
cttgcttctgcagc

SEQ ID NO: 4167553 - DNA, 15 bp, Homo sapiens
cttgctttgctgtct

SEQ ID NO: 4167554 - DNA, 20 bp, Homo sapiens
cttggaaagcatcacctcag

SEQ ID NO: 4167555 - DNA, 23 bp, Homo sapiens
cttggaaagcatcacctcaggcc

SEQ ID NO: 4167556 - DNA, 18 bp, Homo sapiens
cttggaaagttcagccag

SEQ ID NO: 4167557 - DNA, 19 bp, Homo sapiens
cttggaaagttcagccaga

SEQ ID NO: 4167558 - DNA, 14 bp, Homo sapiens
cttggactcctccc

SEQ ID NO: 4167559 - DNA, 20 bp, Homo sapiens
cttggagagcagctggctct

SEQ ID NO: 4167560 - DNA, 22 bp, Homo sapiens
cttggagagcagctggctctcc

SEQ ID NO: 4167561 - DNA, 15 bp, Homo sapiens
cttggcaacagaagc

SEQ ID NO: 4167562 - DNA, 20 bp, Homo sapiens
ctgggagagcctggcaaggc

SEQ ID NO: 4167563 - DNA, 13 bp, Homo sapiens
ctgggaggaagca

SEQ ID NO: 4167564 - DNA, 22 bp, Homo sapiens
ctgggaggtctccactgaggat

SEQ ID NO: 4167565 - DNA, 18 bp, Homo sapiens
ctgggagtcctgtcagct

SEQ ID NO: 4167566 - DNA, 21 bp, Homo sapiens
ctgggagtcctgtcagcttcc

SEQ ID NO: 4167567 - DNA, 20 bp, Homo sapiens
ctgggattcccaccaaggtc

SEQ ID NO: 4167568 - DNA, 14 bp, Homo sapiens
ctgggattcctccc

SEQ ID NO: 4167569 - DNA, 13 bp, Homo sapiens
ctgggcatgtttg

SEQ ID NO: 4167570 - DNA, 15 bp, Homo sapiens
ctgggccaagttcct

SEQ ID NO: 4167571 - DNA, 20 bp, Homo sapiens
ctgggcccacagagatgcat

SEQ ID NO: 4167572 - DNA, 13 bp, Homo sapiens
ctgggcctgagcc

SEQ ID NO: 4167573 - DNA, 13 bp, Homo sapiens
ctgggcgacagag

SEQ ID NO: 4167574 - DNA, 18 bp, Homo sapiens
ctgggcgacagagcaaga

SEQ ID NO: 4167575 - DNA, 16 bp, Homo sapiens
ctggggcaagtccctg

SEQ ID NO: 4167576 - DNA, 17 bp, Homo sapiens
ctggggctctgtgcagg

SEQ ID NO: 4167577 - DNA, 18 bp, Homo sapiens
ctggggctgggcctgagc

SEQ ID NO: 4167578 - DNA, 13 bp, Homo sapiens
ctgggggaagggt

SEQ ID NO: 4167579 - DNA, 12 bp, Homo sapiens
ctggggtacagg

SEQ ID NO: 4167580 - DNA, 18 bp, Homo sapiens
ctgggtccctcggagctg

SEQ ID NO: 4167581 - DNA, 19 bp, Homo sapiens
ctgggtggggggagaagac

SEQ ID NO: 4167582 - DNA, 19 bp, Homo sapiens
ctgggttcagcctctccca

SEQ ID NO: 4167583 - DNA, 14 bp, Homo sapiens
ctgggttctagaac

SEQ ID NO: 4167584 - DNA, 23 bp, Homo sapiens
ctgggtttattacatggcagtgt

SEQ ID NO: 4167585 - DNA, 16 bp, Homo sapiens
ctggtaaactatttgt

SEQ ID NO: 4167586 - DNA, 21 bp, Homo sapiens
ctggtaatttgtatctgaagg

SEQ ID NO: 4167587 - DNA, 17 bp, Homo sapiens
ctggtacagcagggtct

SEQ ID NO: 4167588 - DNA, 22 bp, Homo sapiens
ctggtacagcagggtcttgctg

SEQ ID NO: 4167589 - DNA, 20 bp, Homo sapiens
ctggtagaattgggaagctg

SEQ ID NO: 4167590 - DNA, 20 bp, Homo sapiens
ctggtatgaacttgaggaca

SEQ ID NO: 4167591 - DNA, 21 bp, Homo sapiens
ctggtccatttctcagtggct

SEQ ID NO: 4167592 - DNA, 17 bp, Homo sapiens
ctggtccttccaggccc

SEQ ID NO: 4167593 - DNA, 15 bp, Homo sapiens
ctggtcttcactgcc

SEQ ID NO: 4167594 - DNA, 21 bp, Homo sapiens
ctggtgactgcgatcttcaga

SEQ ID NO: 4167595 - DNA, 16 bp, Homo sapiens
ctggtgaggcccagcc

SEQ ID NO: 4167596 - DNA, 18 bp, Homo sapiens
ctggtgaggcccagcctg

SEQ ID NO: 4167597 - DNA, 20 bp, Homo sapiens
ctggtgaggcccagcctgtc

SEQ ID NO: 4167598 - DNA, 19 bp, Homo sapiens
ctggtgctataggctggag

SEQ ID NO: 4167599 - DNA, 12 bp, Homo sapiens
ctggtgctgtgg

SEQ ID NO: 4167600 - DNA, 17 bp, Homo sapiens
ctggtgctgtggccagg

SEQ ID NO: 4167601 - DNA, 23 bp, Homo sapiens
ctggtgctgtggccagggtgaga

SEQ ID NO: 4167602 - DNA, 18 bp, Homo sapiens
ctggtggacagtcctggg

SEQ ID NO: 4167603 - DNA, 20 bp, Homo sapiens
ctggttcaagagacactgct

SEQ ID NO: 4167604 - DNA, 17 bp, Homo sapiens
ctggttctgagttctgg

SEQ ID NO: 4167605 - DNA, 23 bp, Homo sapiens
ctggtttcatttctactgtgact

SEQ ID NO: 4167606 - DNA, 13 bp, Homo sapiens
ctggttttaacaa

SEQ ID NO: 4167607 - DNA, 18 bp, Homo sapiens
ctggttttctcttactgc

SEQ ID NO: 4167608 - DNA, 22 bp, Homo sapiens
ctgtaaactcaaaacttaacat

SEQ ID NO: 4167609 - DNA, 17 bp, Homo sapiens
ctgtaacctgaagtcaa

SEQ ID NO: 4167610 - DNA, 15 bp, Homo sapiens
ctgtaactcagacat

SEQ ID NO: 4167611 - DNA, 21 bp, Homo sapiens
ctgtaagactcattccctaga

SEQ ID NO: 4167612 - DNA, 15 bp, Homo sapiens
ctgtaagctcaagct

SEQ ID NO: 4167613 - DNA, 20 bp, Homo sapiens
ctgtaatcccaacacttttg

SEQ ID NO: 4167614 - DNA, 14 bp, Homo sapiens
ctgtaatcccagca

SEQ ID NO: 4167615 - DNA, 15 bp, Homo sapiens
ctgtaatcccagcac

SEQ ID NO: 4167616 - DNA, 18 bp, Homo sapiens
ctgtaattaagtaaacca

SEQ ID NO: 4167617 - DNA, 13 bp, Homo sapiens
ctgtacaaaaaca

SEQ ID NO: 4167618 - DNA, 16 bp, Homo sapiens
ctgtacaaaaacaaaa

SEQ ID NO: 4167619 - DNA, 14 bp, Homo sapiens
ctgtacaaatgaaa

SEQ ID NO: 4167620 - DNA, 15 bp, Homo sapiens
ctgtacaaatgaaat

SEQ ID NO: 4167621 - DNA, 20 bp, Homo sapiens
ctgtactcaggaggctgagg

SEQ ID NO: 4167622 - DNA, 13 bp, Homo sapiens
ctgtacttaataa

SEQ ID NO: 4167623 - DNA, 14 bp, Homo sapiens
ctgtagctttcctg

SEQ ID NO: 4167624 - DNA, 16 bp, Homo sapiens
ctgtagctttcctggt

SEQ ID NO: 4167625 - DNA, 18 bp, Homo sapiens
ctgtagtagccctttctg

SEQ ID NO: 4167626 - DNA, 21 bp, Homo sapiens
ctgtagtagccctttctgtgt

SEQ ID NO: 4167627 - DNA, 21 bp, Homo sapiens
ctgtagtgccccctctaaccc

SEQ ID NO: 4167628 - DNA, 21 bp, Homo sapiens
ctgtagttaggaaataaaacc

SEQ ID NO: 4167629 - DNA, 17 bp, Homo sapiens
ctgtagtttaatacttt

SEQ ID NO: 4167630 - DNA, 15 bp, Homo sapiens
ctgtataatttaaca

SEQ ID NO: 4167631 - DNA, 10 bp, Homo sapiens
ctgtattttc

SEQ ID NO: 4167632 - DNA, 18 bp, Homo sapiens
ctgtcaatttccctgact

SEQ ID NO: 4167633 - DNA, 20 bp, Homo sapiens
ctgtcacccaggctggagta

SEQ ID NO: 4167634 - DNA, 16 bp, Homo sapiens
ctgtcactggcagagc

SEQ ID NO: 4167635 - DNA, 20 bp, Homo sapiens
ctgtcagcttccccaggagc

SEQ ID NO: 4167636 - DNA, 19 bp, Homo sapiens
ctgtcatggtcctttctgg

SEQ ID NO: 4167637 - DNA, 20 bp, Homo sapiens
ctgtcatggtcctttctgga

SEQ ID NO: 4167638 - DNA, 23 bp, Homo sapiens
ctgtcattcaggaccccaacccc

SEQ ID NO: 4167639 - DNA, 11 bp, Homo sapiens
ctgtccaagga

SEQ ID NO: 4167640 - DNA, 18 bp, Homo sapiens
ctgtccaccagacccacc

SEQ ID NO: 4167641 - DNA, 13 bp, Homo sapiens
ctgtccagcgcgg

SEQ ID NO: 4167642 - DNA, 16 bp, Homo sapiens
ctgtcccggttcacct

SEQ ID NO: 4167643 - DNA, 18 bp, Homo sapiens
ctgtcccggttcaccttg

SEQ ID NO: 4167644 - DNA, 15 bp, Homo sapiens
ctgtcctaggccaca

SEQ ID NO: 4167645 - DNA, 17 bp, Homo sapiens
ctgtcctcagagcaggg

SEQ ID NO: 4167646 - DNA, 22 bp, Homo sapiens
ctgtcctgcctctctgctccag

SEQ ID NO: 4167647 - DNA, 16 bp, Homo sapiens
ctgtcctggctcccag

SEQ ID NO: 4167648 - DNA, 20 bp, Homo sapiens
ctgtcctttctagagcactg

SEQ ID NO: 4167649 - DNA, 22 bp, Homo sapiens
ctgtcctttctagagcactgcc

SEQ ID NO: 4167650 - DNA, 17 bp, Homo sapiens
ctgtctctagccacttt

SEQ ID NO: 4167651 - DNA, 20 bp, Homo sapiens
ctgtctctagccactttggt

SEQ ID NO: 4167652 - DNA, 19 bp, Homo sapiens
ctgtctggtgtagctcctc

SEQ ID NO: 4167653 - DNA, 21 bp, Homo sapiens
ctgtctggtgtagctcctctg

SEQ ID NO: 4167654 - DNA, 14 bp, Homo sapiens
ctgtctgtacctaa

SEQ ID NO: 4167655 - DNA, 13 bp, Homo sapiens
ctgtcttctggac

SEQ ID NO: 4167656 - DNA, 18 bp, Homo sapiens
ctgtgaacatggactctt

SEQ ID NO: 4167657 - DNA, 14 bp, Homo sapiens
ctgtgaacctggag

SEQ ID NO: 4167658 - DNA, 16 bp, Homo sapiens
ctgtgacctgccccgc

SEQ ID NO: 4167659 - DNA, 17 bp, Homo sapiens
ctgtgataatcagaagc

SEQ ID NO: 4167660 - DNA, 13 bp, Homo sapiens
ctgtgcagggagg

SEQ ID NO: 4167661 - DNA, 22 bp, Homo sapiens
ctgtgcagggaggaggtggcag

SEQ ID NO: 4167662 - DNA, 20 bp, Homo sapiens
ctgtgccccttgacaactgg

SEQ ID NO: 4167663 - DNA, 11 bp, Homo sapiens
ctgtgcctttg

SEQ ID NO: 4167664 - DNA, 18 bp, Homo sapiens
ctgtgctactttgccttt

SEQ ID NO: 4167665 - DNA, 14 bp, Homo sapiens
ctgtggagacagcc

SEQ ID NO: 4167666 - DNA, 19 bp, Homo sapiens
ctgtggagacagccctgcc

SEQ ID NO: 4167667 - DNA, 11 bp, Homo sapiens
ctgtggcctgg

SEQ ID NO: 4167668 - DNA, 16 bp, Homo sapiens
ctgtggcctgggcaag

SEQ ID NO: 4167669 - DNA, 19 bp, Homo sapiens
ctgtggccttctcagccta

SEQ ID NO: 4167670 - DNA, 14 bp, Homo sapiens
ctgtgggagctcag

SEQ ID NO: 4167671 - DNA, 19 bp, Homo sapiens
ctgtggggccttggttccc

SEQ ID NO: 4167672 - DNA, 14 bp, Homo sapiens
ctgtggggtctggc

SEQ ID NO: 4167673 - DNA, 17 bp, Homo sapiens
ctgtggtgaggtcctgt

SEQ ID NO: 4167674 - DNA, 20 bp, Homo sapiens
ctgtggtgaggtcctgtcct

SEQ ID NO: 4167675 - DNA, 13 bp, Homo sapiens
ctgtgtgaaaatg

SEQ ID NO: 4167676 - DNA, 21 bp, Homo sapiens
ctgtgtgcaccttaccaactt

SEQ ID NO: 4167677 - DNA, 13 bp, Homo sapiens
ctgtgtgctgtaa

SEQ ID NO: 4167678 - DNA, 16 bp, Homo sapiens
ctgtgtttggctttca

SEQ ID NO: 4167679 - DNA, 22 bp, Homo sapiens
ctgtgtttggctttcagggagg

SEQ ID NO: 4167680 - DNA, 17 bp, Homo sapiens
ctgttatgcaagcacaa

SEQ ID NO: 4167681 - DNA, 18 bp, Homo sapiens
ctgttgcgctcccgcatt

SEQ ID NO: 4167682 - DNA, 15 bp, Homo sapiens
ctgttgctgaagtca

SEQ ID NO: 4167683 - DNA, 16 bp, Homo sapiens
ctgttgctgaagtcat

SEQ ID NO: 4167684 - DNA, 16 bp, Homo sapiens
ctgttggaatgtatgc

SEQ ID NO: 4167685 - DNA, 17 bp, Homo sapiens
ctgtttagtagcagtga

SEQ ID NO: 4167686 - DNA, 18 bp, Homo sapiens
ctgtttcaaaaataaaag

SEQ ID NO: 4167687 - DNA, 21 bp, Homo sapiens
ctgtttcagctaaatgcaggg

SEQ ID NO: 4167688 - DNA, 18 bp, Homo sapiens
ctgtttccagttgttact

SEQ ID NO: 4167689 - DNA, 19 bp, Homo sapiens
cttaaaaagtaattgtaga

SEQ ID NO: 4167690 - DNA, 14 bp, Homo sapiens
cttaaacctgggag

SEQ ID NO: 4167691 - DNA, 12 bp, Homo sapiens
cttaaagaaagt

SEQ ID NO: 4167692 - DNA, 23 bp, Homo sapiens
cttaaagctgcctgtagttagga

SEQ ID NO: 4167693 - DNA, 20 bp, Homo sapiens
cttaaaggcaccatctaata

SEQ ID NO: 4167694 - DNA, 16 bp, Homo sapiens
cttaaataagaaactt

SEQ ID NO: 4167695 - DNA, 17 bp, Homo sapiens
cttaaataagaaacttt

SEQ ID NO: 4167696 - DNA, 19 bp, Homo sapiens
cttaaatgttaatgagaaa

SEQ ID NO: 4167697 - DNA, 13 bp, Homo sapiens
cttaacatattta

SEQ ID NO: 4167698 - DNA, 23 bp, Homo sapiens
cttaagataatggataatcttcg

SEQ ID NO: 4167699 - DNA, 12 bp, Homo sapiens
cttaataaattc

SEQ ID NO: 4167700 - DNA, 18 bp, Homo sapiens
cttaatatacaatctatc

SEQ ID NO: 4167701 - DNA, 22 bp, Homo sapiens
ctgccaggctcccactgcccct

SEQ ID NO: 4167702 - DNA, 23 bp, Homo sapiens
ctgccaggctcccactgcccctg

SEQ ID NO: 4167703 - DNA, 13 bp, Homo sapiens
ctgccatgcctca

SEQ ID NO: 4167704 - DNA, 19 bp, Homo sapiens
ctgccatgcctcaagaaca

SEQ ID NO: 4167705 - DNA, 17 bp, Homo sapiens
ctgccattcttctggtg

SEQ ID NO: 4167706 - DNA, 13 bp, Homo sapiens
ctgcccactgtga

SEQ ID NO: 4167707 - DNA, 22 bp, Homo sapiens
ctgccccagaacaattctgcag

SEQ ID NO: 4167708 - DNA, 13 bp, Homo sapiens
ctgccccagctct

SEQ ID NO: 4167709 - DNA, 14 bp, Homo sapiens
ctgccccagctctg

SEQ ID NO: 4167710 - DNA, 18 bp, Homo sapiens
ctgccccagctctggctt

SEQ ID NO: 4167711 - DNA, 21 bp, Homo sapiens
ctgccccgggtgcctcagagc

SEQ ID NO: 4167712 - DNA, 17 bp, Homo sapiens
ctgcccctgtaggttgc

SEQ ID NO: 4167713 - DNA, 13 bp, Homo sapiens
ctgcccgcagagc

SEQ ID NO: 4167714 - DNA, 15 bp, Homo sapiens
ctgccctgccacctg

SEQ ID NO: 4167715 - DNA, 16 bp, Homo sapiens
ctgccctgccacctgt

SEQ ID NO: 4167716 - DNA, 18 bp, Homo sapiens
ctgccctgccacctgtct

SEQ ID NO: 4167717 - DNA, 21 bp, Homo sapiens
ctgccctgccacctgtctgtc

SEQ ID NO: 4167718 - DNA, 15 bp, Homo sapiens
ctgccctgccctgcc

SEQ ID NO: 4167719 - DNA, 11 bp, Homo sapiens
ctgccctgctg

SEQ ID NO: 4167720 - DNA, 22 bp, Homo sapiens
ctgccctgctgccgcctcccag

SEQ ID NO: 4167721 - DNA, 16 bp, Homo sapiens
ctgccctggagggagg

SEQ ID NO: 4167722 - DNA, 20 bp, Homo sapiens
ctgccgtcagtgctgtgctg

SEQ ID NO: 4167723 - DNA, 18 bp, Homo sapiens
ctgcctatccatcctgcg

SEQ ID NO: 4167724 - DNA, 18 bp, Homo sapiens
ctgcctccttcagtgaca

SEQ ID NO: 4167725 - DNA, 22 bp, Homo sapiens
ctgcctctctgctccagagaga

SEQ ID NO: 4167726 - DNA, 21 bp, Homo sapiens
ctgcctggaggatccctccat

SEQ ID NO: 4167727 - DNA, 13 bp, Homo sapiens
ctgcctgtgcatg

SEQ ID NO: 4167728 - DNA, 19 bp, Homo sapiens
ctgcctgtgcatgacctga

SEQ ID NO: 4167729 - DNA, 22 bp, Homo sapiens
ctgcctgtggtgaggtcctgtc

SEQ ID NO: 4167730 - DNA, 21 bp, Homo sapiens
ctgccttaggctgctgggaga

SEQ ID NO: 4167731 - DNA, 22 bp, Homo sapiens
ctgccttctggattcaagtgat

SEQ ID NO: 4167732 - DNA, 16 bp, Homo sapiens
ctgccttgaagccact

SEQ ID NO: 4167733 - DNA, 22 bp, Homo sapiens
ctgccttgaagccactgaagct

SEQ ID NO: 4167734 - DNA, 19 bp, Homo sapiens
ctgcgaaaacgttgacccc

SEQ ID NO: 4167735 - DNA, 20 bp, Homo sapiens
ctgcgagctccttgggtcct

SEQ ID NO: 4167736 - DNA, 14 bp, Homo sapiens
ctgcgatcttcaga

SEQ ID NO: 4167737 - DNA, 17 bp, Homo sapiens
ctgcgatcttcagagca

SEQ ID NO: 4167738 - DNA, 19 bp, Homo sapiens
ctgcgggatggtcctgggg

SEQ ID NO: 4167739 - DNA, 19 bp, Homo sapiens
ctgcggtggtgccagaggt

SEQ ID NO: 4167740 - DNA, 17 bp, Homo sapiens
ctgctacctctgagaag

SEQ ID NO: 4167741 - DNA, 18 bp, Homo sapiens
ctgctacctctgagaaga

SEQ ID NO: 4167742 - DNA, 17 bp, Homo sapiens
ctgctactgaggcaggg

SEQ ID NO: 4167743 - DNA, 22 bp, Homo sapiens
ctgctagggcccctagaaacca

SEQ ID NO: 4167744 - DNA, 12 bp, Homo sapiens
ctgctccagaga

SEQ ID NO: 4167745 - DNA, 12 bp, Homo sapiens
ctgctcctccag

SEQ ID NO: 4167746 - DNA, 14 bp, Homo sapiens
ctgctcctccagcc

SEQ ID NO: 4167747 - DNA, 17 bp, Homo sapiens
ctgctcctccagccctt

SEQ ID NO: 4167748 - DNA, 11 bp, Homo sapiens
ctgctctgccc

SEQ ID NO: 4167749 - DNA, 13 bp, Homo sapiens
ctgctgacctgtt

SEQ ID NO: 4167750 - DNA, 13 bp, Homo sapiens
ctgctgagcagcc

SEQ ID NO: 4167751 - DNA, 15 bp, Homo sapiens
ctgctgagcagccca

SEQ ID NO: 4167752 - DNA, 19 bp, Homo sapiens
ctgctgagcagcccagcac

SEQ ID NO: 4167753 - DNA, 21 bp, Homo sapiens
ctgctgagcagcccagcacaa

SEQ ID NO: 4167754 - DNA, 22 bp, Homo sapiens
ctgctgccaggctcccactgcc

SEQ ID NO: 4167755 - DNA, 17 bp, Homo sapiens
ctgctggctgacctggg

SEQ ID NO: 4167756 - DNA, 22 bp, Homo sapiens
ctgctggtaatttgtatctgaa

SEQ ID NO: 4167757 - DNA, 21 bp, Homo sapiens
ctgctgtcagccaagtcatgg

SEQ ID NO: 4167758 - DNA, 16 bp, Homo sapiens
ctgctgtggcccagtc

SEQ ID NO: 4167759 - DNA, 21 bp, Homo sapiens
ctgctgtttcaaaaataaaag

SEQ ID NO: 4167760 - DNA, 23 bp, Homo sapiens
ctgcttatcaataaacctgtttg

SEQ ID NO: 4167761 - DNA, 14 bp, Homo sapiens
ctgcttcttcatct

SEQ ID NO: 4167762 - DNA, 23 bp, Homo sapiens
ctgcttgatgggattctggacag

SEQ ID NO: 4167763 - DNA, 14 bp, Homo sapiens
ctgctttttgacat

SEQ ID NO: 4167764 - DNA, 15 bp, Homo sapiens
ctggaaaactcagga

SEQ ID NO: 4167765 - DNA, 20 bp, Homo sapiens
ctggaaaattcctattgatt

SEQ ID NO: 4167766 - DNA, 21 bp, Homo sapiens
ctggaaagactgattgtttta

SEQ ID NO: 4167767 - DNA, 13 bp, Homo sapiens
ctggaaaggctca

SEQ ID NO: 4167768 - DNA, 15 bp, Homo sapiens
ctggaaaggctcagt

SEQ ID NO: 4167769 - DNA, 20 bp, Homo sapiens
ctggaaaggctcagtctcag

SEQ ID NO: 4167770 - DNA, 19 bp, Homo sapiens
ctggaaataaacctggaga

SEQ ID NO: 4167771 - DNA, 22 bp, Homo sapiens
ctggaaataaacctggagatga

SEQ ID NO: 4167772 - DNA, 20 bp, Homo sapiens
ctggaacactagacaagcca

SEQ ID NO: 4167773 - DNA, 13 bp, Homo sapiens
ctggaagaaagca

SEQ ID NO: 4167774 - DNA, 20 bp, Homo sapiens
ctggaagaaagcaacaaaga

SEQ ID NO: 4167775 - DNA, 17 bp, Homo sapiens
ctggaagacatgataca

SEQ ID NO: 4167776 - DNA, 16 bp, Homo sapiens
ctggaatcaaggaatc

SEQ ID NO: 4167777 - DNA, 15 bp, Homo sapiens
ctggacaagaagctg

SEQ ID NO: 4167778 - DNA, 16 bp, Homo sapiens
ctggacaagaagctgc

SEQ ID NO: 4167779 - DNA, 19 bp, Homo sapiens
ctggacaagaagctgctat

SEQ ID NO: 4167780 - DNA, 14 bp, Homo sapiens
ctggacagcagcag

SEQ ID NO: 4167781 - DNA, 18 bp, Homo sapiens
ctggaccgcttcccagag

SEQ ID NO: 4167782 - DNA, 15 bp, Homo sapiens
ctggacggcattcct

SEQ ID NO: 4167783 - DNA, 19 bp, Homo sapiens
ctggacggcattcctgctt

SEQ ID NO: 4167784 - DNA, 23 bp, Homo sapiens
ctggactgggttttgtctctgca

SEQ ID NO: 4167785 - DNA, 15 bp, Homo sapiens
ctggacttgagcttg

SEQ ID NO: 4167786 - DNA, 20 bp, Homo sapiens
ctggacttgagcttggcagc

SEQ ID NO: 4167787 - DNA, 17 bp, Homo sapiens
ctggagaagctgatgct

SEQ ID NO: 4167788 - DNA, 19 bp, Homo sapiens
ctggagaagctgatgcttt

SEQ ID NO: 4167789 - DNA, 23 bp, Homo sapiens
ctggagaggagggatgctgcctg

SEQ ID NO: 4167790 - DNA, 17 bp, Homo sapiens
ctggagcggagcttgcc

SEQ ID NO: 4167791 - DNA, 18 bp, Homo sapiens
ctggagcggagcttgcct

SEQ ID NO: 4167792 - DNA, 17 bp, Homo sapiens
ctggaggatccctccat

SEQ ID NO: 4167793 - DNA, 18 bp, Homo sapiens
ctggaggatccctccatc

SEQ ID NO: 4167794 - DNA, 17 bp, Homo sapiens
ctggatactatatgata

SEQ ID NO: 4167795 - DNA, 23 bp, Homo sapiens
ctggatactatatgataaagagg

SEQ ID NO: 4167796 - DNA, 22 bp, Homo sapiens
ctggatcagggttgttctggga

SEQ ID NO: 4167797 - DNA, 22 bp, Homo sapiens
ctggatcttttggtggagtcag

SEQ ID NO: 4167798 - DNA, 13 bp, Homo sapiens
ctggattccagag

SEQ ID NO: 4167799 - DNA, 19 bp, Homo sapiens
ctggattgttgacatgagt

SEQ ID NO: 4167800 - DNA, 18 bp, Homo sapiens
ctggcaaggcattcctca

SEQ ID NO: 4167801 - DNA, 19 bp, Homo sapiens
ctggcaaggcattcctcat

SEQ ID NO: 4167802 - DNA, 14 bp, Homo sapiens
ctggcagctgtcat

SEQ ID NO: 4167803 - DNA, 20 bp, Homo sapiens
ctggcaggatgaccctgcga

SEQ ID NO: 4167804 - DNA, 17 bp, Homo sapiens
ctggcatgacactctag

SEQ ID NO: 4167805 - DNA, 14 bp, Homo sapiens
ctggcatgtcagag

SEQ ID NO: 4167806 - DNA, 16 bp, Homo sapiens
ctggcatgtcagagcc

SEQ ID NO: 4167807 - DNA, 18 bp, Homo sapiens
ctggcattggtctgctga

SEQ ID NO: 4167808 - DNA, 19 bp, Homo sapiens
ctggcccagccagccagga

SEQ ID NO: 4167809 - DNA, 18 bp, Homo sapiens
ctggcccccctccaggca

SEQ ID NO: 4167810 - DNA, 17 bp, Homo sapiens
ctggcccctccgcgagg

SEQ ID NO: 4167811 - DNA, 18 bp, Homo sapiens
ctggcccgtcatgttcct

SEQ ID NO: 4167812 - DNA, 15 bp, Homo sapiens
ctggccctttctgga

SEQ ID NO: 4167813 - DNA, 21 bp, Homo sapiens
ctggcctcctgggggcccatt

SEQ ID NO: 4167814 - DNA, 17 bp, Homo sapiens
ctggctatttaaaaagc

SEQ ID NO: 4167815 - DNA, 22 bp, Homo sapiens
ctggctatttaaaaagctcttt

SEQ ID NO: 4167816 - DNA, 12 bp, Homo sapiens
ctggctccagaa

SEQ ID NO: 4167817 - DNA, 14 bp, Homo sapiens
ctggctcctccttc

SEQ ID NO: 4167818 - DNA, 15 bp, Homo sapiens
ctggctcctccttcc

SEQ ID NO: 4167819 - DNA, 19 bp, Homo sapiens
ctggctcctttgcctctgc

SEQ ID NO: 4167820 - DNA, 21 bp, Homo sapiens
ctggctcctttgcctctgcta

SEQ ID NO: 4167821 - DNA, 14 bp, Homo sapiens
ctggctctccacct

SEQ ID NO: 4167822 - DNA, 15 bp, Homo sapiens
ctggctggctgcagt

SEQ ID NO: 4167823 - DNA, 20 bp, Homo sapiens
ctggctgtcttcccccaccc

SEQ ID NO: 4167824 - DNA, 12 bp, Homo sapiens
ctggctgtgtgg

SEQ ID NO: 4167825 - DNA, 16 bp, Homo sapiens
ctggcttccaggtatc

SEQ ID NO: 4167826 - DNA, 15 bp, Homo sapiens
ctggcttctggagcc

SEQ ID NO: 4167827 - DNA, 20 bp, Homo sapiens
ctggcttctggagcccttgg

SEQ ID NO: 4167828 - DNA, 13 bp, Homo sapiens
ctggcttgctgtg

SEQ ID NO: 4167829 - DNA, 15 bp, Homo sapiens
ctggctttctccgac

SEQ ID NO: 4167830 - DNA, 14 bp, Homo sapiens
ctggctttgtctct

SEQ ID NO: 4167831 - DNA, 16 bp, Homo sapiens
ctggctttgtctctag

SEQ ID NO: 4167832 - DNA, 23 bp, Homo sapiens
ctggcttttcgcttgcttctgca

SEQ ID NO: 4167833 - DNA, 14 bp, Homo sapiens
ctgggaatcctgct

SEQ ID NO: 4167834 - DNA, 18 bp, Homo sapiens
ctgggaatcctgctgcca

SEQ ID NO: 4167835 - DNA, 13 bp, Homo sapiens
ctgggagaaatct

SEQ ID NO: 4167836 - DNA, 18 bp, Homo sapiens
ctgggagaacctcaggct

SEQ ID NO: 4167837 - DNA, 12 bp, Homo sapiens
ctgggagaagag

SEQ ID NO: 4167838 - DNA, 13 bp, Homo sapiens
ctgggagagcctg

SEQ ID NO: 4167839 - DNA, 15 bp, Homo sapiens
ctgggagagcctggc

SEQ ID NO: 4167840 - DNA, 12 bp, Homo sapiens
ctcttgcctgta

SEQ ID NO: 4167841 - DNA, 23 bp, Homo sapiens
ctcttgctgggaacacagccagt

SEQ ID NO: 4167842 - DNA, 12 bp, Homo sapiens
ctcttggcctct

SEQ ID NO: 4167843 - DNA, 14 bp, Homo sapiens
ctcttggcctctgc

SEQ ID NO: 4167844 - DNA, 16 bp, Homo sapiens
ctctttcactcaggct

SEQ ID NO: 4167845 - DNA, 14 bp, Homo sapiens
ctctttcatctttt

SEQ ID NO: 4167846 - DNA, 20 bp, Homo sapiens
ctctttccccacctcttcct

SEQ ID NO: 4167847 - DNA, 12 bp, Homo sapiens
ctctttttccaa

SEQ ID NO: 4167848 - DNA, 21 bp, Homo sapiens
ctctttttccaacttggctgc

SEQ ID NO: 4167849 - DNA, 17 bp, Homo sapiens
ctgaaaatagcaggaca

SEQ ID NO: 4167850 - DNA, 20 bp, Homo sapiens
ctgaaaatctaatattaaaa

SEQ ID NO: 4167851 - DNA, 23 bp, Homo sapiens
ctgaaagccatttgttggggcag

SEQ ID NO: 4167852 - DNA, 20 bp, Homo sapiens
ctgaaattggtgggaagcaa

SEQ ID NO: 4167853 - DNA, 17 bp, Homo sapiens
ctgaacatgacatttct

SEQ ID NO: 4167854 - DNA, 18 bp, Homo sapiens
ctgaaccactgtggcctt

SEQ ID NO: 4167855 - DNA, 20 bp, Homo sapiens
ctgaaccactgtggccttct

SEQ ID NO: 4167856 - DNA, 21 bp, Homo sapiens
ctgaacccagagtcaggaaga

SEQ ID NO: 4167857 - DNA, 15 bp, Homo sapiens
ctgaagaatcaagag

SEQ ID NO: 4167858 - DNA, 14 bp, Homo sapiens
ctgaagccattgtc

SEQ ID NO: 4167859 - DNA, 21 bp, Homo sapiens
ctgaaggagattttccttcct

SEQ ID NO: 4167860 - DNA, 22 bp, Homo sapiens
ctgaaggatcctggaaccactg

SEQ ID NO: 4167861 - DNA, 23 bp, Homo sapiens
ctgaaggatcctggaaccactga

SEQ ID NO: 4167862 - DNA, 16 bp, Homo sapiens
ctgaagtcaaacctta

SEQ ID NO: 4167863 - DNA, 20 bp, Homo sapiens
ctgaataggaaaatgtacat

SEQ ID NO: 4167864 - DNA, 17 bp, Homo sapiens
ctgaatgacctgcagtc

SEQ ID NO: 4167865 - DNA, 22 bp, Homo sapiens
ctgaatgcctcaatgtgaccag

SEQ ID NO: 4167866 - DNA, 14 bp, Homo sapiens
ctgaatggtccagg

SEQ ID NO: 4167867 - DNA, 18 bp, Homo sapiens
ctgaattaagttattgat

SEQ ID NO: 4167868 - DNA, 18 bp, Homo sapiens
ctgaattagccaaaacac

SEQ ID NO: 4167869 - DNA, 15 bp, Homo sapiens
ctgaattttgggact

SEQ ID NO: 4167870 - DNA, 11 bp, Homo sapiens
ctgaattttta

SEQ ID NO: 4167871 - DNA, 18 bp, Homo sapiens
ctgaatttttaaacaagt

SEQ ID NO: 4167872 - DNA, 22 bp, Homo sapiens
ctgacaacatttctatagccaa

SEQ ID NO: 4167873 - DNA, 15 bp, Homo sapiens
ctgacacccatgtaa

SEQ ID NO: 4167874 - DNA, 14 bp, Homo sapiens
ctgacatggctttg

SEQ ID NO: 4167875 - DNA, 23 bp, Homo sapiens
ctgaccctccaccgcagaaggaa

SEQ ID NO: 4167876 - DNA, 20 bp, Homo sapiens
ctgaccctcctccactccac

SEQ ID NO: 4167877 - DNA, 12 bp, Homo sapiens
ctgacctctggt

SEQ ID NO: 4167878 - DNA, 21 bp, Homo sapiens
ctgacctgaggctcctgtgct

SEQ ID NO: 4167879 - DNA, 20 bp, Homo sapiens
ctgacctgatcacctctggc

SEQ ID NO: 4167880 - DNA, 19 bp, Homo sapiens
ctgacctgggcccacagag

SEQ ID NO: 4167881 - DNA, 23 bp, Homo sapiens
ctgacctgggcccacagagcctg

SEQ ID NO: 4167882 - DNA, 12 bp, Homo sapiens
ctgacctgtttt

SEQ ID NO: 4167883 - DNA, 16 bp, Homo sapiens
ctgacggaagccaact

SEQ ID NO: 4167884 - DNA, 23 bp, Homo sapiens
ctgacggaagccaacttggcttt

SEQ ID NO: 4167885 - DNA, 18 bp, Homo sapiens
ctgactagggagccatgt

SEQ ID NO: 4167886 - DNA, 16 bp, Homo sapiens
ctgactctctgtgacc

SEQ ID NO: 4167887 - DNA, 18 bp, Homo sapiens
ctgactctctgtgacctg

SEQ ID NO: 4167888 - DNA, 15 bp, Homo sapiens
ctgactgcacacagc

SEQ ID NO: 4167889 - DNA, 15 bp, Homo sapiens
ctgactgttcttggt

SEQ ID NO: 4167890 - DNA, 15 bp, Homo sapiens
ctgagaactgaattt

SEQ ID NO: 4167891 - DNA, 16 bp, Homo sapiens
ctgagaattccaagga

SEQ ID NO: 4167892 - DNA, 18 bp, Homo sapiens
ctgagacccgttcgcccc

SEQ ID NO: 4167893 - DNA, 14 bp, Homo sapiens
ctgagagcagatgg

SEQ ID NO: 4167894 - DNA, 16 bp, Homo sapiens
ctgagagcagatggtc

SEQ ID NO: 4167895 - DNA, 17 bp, Homo sapiens
ctgagatacatacagaa

SEQ ID NO: 4167896 - DNA, 19 bp, Homo sapiens
ctgagatacatacagaatt

SEQ ID NO: 4167897 - DNA, 18 bp, Homo sapiens
ctgagatctccctccagg

SEQ ID NO: 4167898 - DNA, 16 bp, Homo sapiens
ctgagcaacagagtga

SEQ ID NO: 4167899 - DNA, 12 bp, Homo sapiens
ctgagcaagagc

SEQ ID NO: 4167900 - DNA, 15 bp, Homo sapiens
ctgagcaagagctgg

SEQ ID NO: 4167901 - DNA, 20 bp, Homo sapiens
ctgagcaagagctggcaaag

SEQ ID NO: 4167902 - DNA, 21 bp, Homo sapiens
ctgagcaccccctcattcccc

SEQ ID NO: 4167903 - DNA, 13 bp, Homo sapiens
ctgagcacctgct

SEQ ID NO: 4167904 - DNA, 11 bp, Homo sapiens
ctgagccctgg

SEQ ID NO: 4167905 - DNA, 12 bp, Homo sapiens
ctgagccctggc

SEQ ID NO: 4167906 - DNA, 13 bp, Homo sapiens
ctgagccctggca

SEQ ID NO: 4167907 - DNA, 14 bp, Homo sapiens
ctgagccctggcag

SEQ ID NO: 4167908 - DNA, 15 bp, Homo sapiens
ctgagctgaccagcc

SEQ ID NO: 4167909 - DNA, 22 bp, Homo sapiens
ctgagcttcagtataaaagaca

SEQ ID NO: 4167910 - DNA, 23 bp, Homo sapiens
ctgaggcaggggagtagtggaga

SEQ ID NO: 4167911 - DNA, 23 bp, Homo sapiens
ctgaggctctgacccagtgagat

SEQ ID NO: 4167912 - DNA, 16 bp, Homo sapiens
ctgaggctctttctgg

SEQ ID NO: 4167913 - DNA, 18 bp, Homo sapiens
ctgaggctctttctgggc

SEQ ID NO: 4167914 - DNA, 17 bp, Homo sapiens
ctgagggacgtggtgcc

SEQ ID NO: 4167915 - DNA, 23 bp, Homo sapiens
ctgagggattttagcctcttccc

SEQ ID NO: 4167916 - DNA, 21 bp, Homo sapiens
ctgaggggaggatcactggag

SEQ ID NO: 4167917 - DNA, 12 bp, Homo sapiens
ctgaggggcagg

SEQ ID NO: 4167918 - DNA, 14 bp, Homo sapiens
ctgaggggcaggga

SEQ ID NO: 4167919 - DNA, 24 bp, Homo sapiens
ctgaggggcagggagagcgcctct

SEQ ID NO: 4167920 - DNA, 22 bp, Homo sapiens
ctgaggggggccgtgcccaggg

SEQ ID NO: 4167921 - DNA, 17 bp, Homo sapiens
ctgagggtttttctaag

SEQ ID NO: 4167922 - DNA, 14 bp, Homo sapiens
ctgaggtcactggg

SEQ ID NO: 4167923 - DNA, 21 bp, Homo sapiens
ctgagtctgctatattttcat

SEQ ID NO: 4167924 - DNA, 15 bp, Homo sapiens
ctgagtgcactcctg

SEQ ID NO: 4167925 - DNA, 18 bp, Homo sapiens
ctgagtggatctccaagg

SEQ ID NO: 4167926 - DNA, 13 bp, Homo sapiens
ctgagttctggtg

SEQ ID NO: 4167927 - DNA, 16 bp, Homo sapiens
ctgagttttccatggc

SEQ ID NO: 4167928 - DNA, 20 bp, Homo sapiens
ctgagttttccatggcagga

SEQ ID NO: 4167929 - DNA, 22 bp, Homo sapiens
ctgagttttccatggcaggaag

SEQ ID NO: 4167930 - DNA, 17 bp, Homo sapiens
ctgataattttaaattc

SEQ ID NO: 4167931 - DNA, 17 bp, Homo sapiens
ctgatagagtgattttg

SEQ ID NO: 4167932 - DNA, 17 bp, Homo sapiens
ctgatcacctctggctt

SEQ ID NO: 4167933 - DNA, 20 bp, Homo sapiens
ctgatcattacatggctgtg

SEQ ID NO: 4167934 - DNA, 20 bp, Homo sapiens
ctgatccggctgctcctcca

SEQ ID NO: 4167935 - DNA, 22 bp, Homo sapiens
ctgatccggctgctcctccagc

SEQ ID NO: 4167936 - DNA, 22 bp, Homo sapiens
ctgatgctttgcttcaaatcca

SEQ ID NO: 4167937 - DNA, 16 bp, Homo sapiens
ctgatggtgctcacga

SEQ ID NO: 4167938 - DNA, 20 bp, Homo sapiens
ctgatgttacatcacagtgt

SEQ ID NO: 4167939 - DNA, 18 bp, Homo sapiens
ctgattaacaaataaatt

SEQ ID NO: 4167940 - DNA, 18 bp, Homo sapiens
ctgatttcactcagggtg

SEQ ID NO: 4167941 - DNA, 13 bp, Homo sapiens
ctgatttttcctt

SEQ ID NO: 4167942 - DNA, 14 bp, Homo sapiens
ctgatttttccttt

SEQ ID NO: 4167943 - DNA, 15 bp, Homo sapiens
ctgcaagacacaggc

SEQ ID NO: 4167944 - DNA, 19 bp, Homo sapiens
ctgcaagacacaggctcag

SEQ ID NO: 4167945 - DNA, 21 bp, Homo sapiens
ctgcaagacacaggctcagca

SEQ ID NO: 4167946 - DNA, 19 bp, Homo sapiens
ctgcaagcagggctctgcc

SEQ ID NO: 4167947 - DNA, 16 bp, Homo sapiens
ctgcaatctccagggc

SEQ ID NO: 4167948 - DNA, 21 bp, Homo sapiens
ctgcaatctccagggctgccc

SEQ ID NO: 4167949 - DNA, 22 bp, Homo sapiens
ctgcaatctccagggctgcccc

SEQ ID NO: 4167950 - DNA, 21 bp, Homo sapiens
ctgcacacagctaggcatgcc

SEQ ID NO: 4167951 - DNA, 21 bp, Homo sapiens
ctgcactaaaacccatcttcc

SEQ ID NO: 4167952 - DNA, 12 bp, Homo sapiens
ctgcactccaga

SEQ ID NO: 4167953 - DNA, 18 bp, Homo sapiens
ctgcactccagcctgggc

SEQ ID NO: 4167954 - DNA, 15 bp, Homo sapiens
ctgcactgccctccg

SEQ ID NO: 4167955 - DNA, 17 bp, Homo sapiens
ctgcactgggtgtggcc

SEQ ID NO: 4167956 - DNA, 11 bp, Homo sapiens
ctgcagagggg

SEQ ID NO: 4167957 - DNA, 21 bp, Homo sapiens
ctgcagaggggaaaccagtgt

SEQ ID NO: 4167958 - DNA, 23 bp, Homo sapiens
ctgcagaggggaaaccagtgtag

SEQ ID NO: 4167959 - DNA, 21 bp, Homo sapiens
ctgcagaggggaaagacttcc

SEQ ID NO: 4167960 - DNA, 22 bp, Homo sapiens
ctgcagaggggctttctggaga

SEQ ID NO: 4167961 - DNA, 15 bp, Homo sapiens
ctgcagcaactccca

SEQ ID NO: 4167962 - DNA, 16 bp, Homo sapiens
ctgcagcgagctgaga

SEQ ID NO: 4167963 - DNA, 21 bp, Homo sapiens
ctgcagcgagctgagatcaca

SEQ ID NO: 4167964 - DNA, 14 bp, Homo sapiens
ctgcagctttacat

SEQ ID NO: 4167965 - DNA, 14 bp, Homo sapiens
ctgcaggaatcttt

SEQ ID NO: 4167966 - DNA, 12 bp, Homo sapiens
ctgcaggcacct

SEQ ID NO: 4167967 - DNA, 18 bp, Homo sapiens
ctgcagtaacactggcct

SEQ ID NO: 4167968 - DNA, 20 bp, Homo sapiens
ctgcagtaacactggccttc

SEQ ID NO: 4167969 - DNA, 17 bp, Homo sapiens
ctgcagtcagggcccag

SEQ ID NO: 4167970 - DNA, 21 bp, Homo sapiens
ctgcatctgggattcccacca

SEQ ID NO: 4167971 - DNA, 19 bp, Homo sapiens
ctgcattttattctggatg

SEQ ID NO: 4167972 - DNA, 20 bp, Homo sapiens
ctgcattttattctggatgg

SEQ ID NO: 4167973 - DNA, 19 bp, Homo sapiens
ctgccaattgctaccgaga

SEQ ID NO: 4167974 - DNA, 12 bp, Homo sapiens
ctgccacagaga

SEQ ID NO: 4167975 - DNA, 15 bp, Homo sapiens
ctgccagcctgagcg

SEQ ID NO: 4167976 - DNA, 19 bp, Homo sapiens
ctgccagcctgagcggagg

SEQ ID NO: 4167977 - DNA, 19 bp, Homo sapiens
ctgccagcctggcttctgg

SEQ ID NO: 4167978 - DNA, 12 bp, Homo sapiens
cctttcctcccc

SEQ ID NO: 4167979 - DNA, 13 bp, Homo sapiens
cctttccttctgg

SEQ ID NO: 4167980 - DNA, 14 bp, Homo sapiens
cctttctagagcac

SEQ ID NO: 4167981 - DNA, 20 bp, Homo sapiens
cctttctggaagtttctggt

SEQ ID NO: 4167982 - DNA, 13 bp, Homo sapiens
cctttctgtgtgc

SEQ ID NO: 4167983 - DNA, 15 bp, Homo sapiens
cctttgcaggcccag

SEQ ID NO: 4167984 - DNA, 20 bp, Homo sapiens
cctttgcaggcccagcagac

SEQ ID NO: 4167985 - DNA, 20 bp, Homo sapiens
cctttggaacaattatttta

SEQ ID NO: 4167986 - DNA, 16 bp, Homo sapiens
cctttggatgaccaga

SEQ ID NO: 4167987 - DNA, 16 bp, Homo sapiens
cctgcggctgctgtgt

SEQ ID NO: 4167988 - DNA, 18 bp, Homo sapiens
cctgctgccagagaacca

SEQ ID NO: 4167989 - DNA, 12 bp, Homo sapiens
cctgctgccagg

SEQ ID NO: 4167990 - DNA, 15 bp, Homo sapiens
cctgctgccgcctcc

SEQ ID NO: 4167991 - DNA, 17 bp, Homo sapiens
cctgctgcgtcagacca

SEQ ID NO: 4167992 - DNA, 18 bp, Homo sapiens
cctgctgcgtcagaccag

SEQ ID NO: 4167993 - DNA, 22 bp, Homo sapiens
cctgctgcgtcagaccagtact

SEQ ID NO: 4167994 - DNA, 18 bp, Homo sapiens
cctgctgctgacctgatc

SEQ ID NO: 4167995 - DNA, 22 bp, Homo sapiens
cctgctggaaaccacacttctt

SEQ ID NO: 4167996 - DNA, 15 bp, Homo sapiens
cctgctgggtaaact

SEQ ID NO: 4167997 - DNA, 16 bp, Homo sapiens
cctgcttcatgctcag

SEQ ID NO: 4167998 - DNA, 22 bp, Homo sapiens
cctgcttgatgggattctggac

SEQ ID NO: 4167999 - DNA, 15 bp, Homo sapiens
cctggaaaggctcag

SEQ ID NO: 4168000 - DNA, 18 bp, Homo sapiens
cctggaatcaaggaatcc

SEQ ID NO: 4168001 - DNA, 17 bp, Homo sapiens
cctggagaagctgatgc

SEQ ID NO: 4168002 - DNA, 14 bp, Homo sapiens
cctggagatgatga

SEQ ID NO: 4168003 - DNA, 23 bp, Homo sapiens
cctggagcggagcttgcctgcct

SEQ ID NO: 4168004 - DNA, 14 bp, Homo sapiens
cctggagggaggct

SEQ ID NO: 4168005 - DNA, 15 bp, Homo sapiens
cctggagtataatat

SEQ ID NO: 4168006 - DNA, 16 bp, Homo sapiens
cctggagtcccctggg

SEQ ID NO: 4168007 - DNA, 14 bp, Homo sapiens
cctggagtgcagtt

SEQ ID NO: 4168008 - DNA, 21 bp, Homo sapiens
cctggcaaggcattcctcatc

SEQ ID NO: 4168009 - DNA, 17 bp, Homo sapiens
cctggcaggatgaccct

SEQ ID NO: 4168010 - DNA, 22 bp, Homo sapiens
cctggcaggatgaccctgcgaa

SEQ ID NO: 4168011 - DNA, 17 bp, Homo sapiens
cctggcatgacactcta

SEQ ID NO: 4168012 - DNA, 12 bp, Homo sapiens
cctggccaggca

SEQ ID NO: 4168013 - DNA, 13 bp, Homo sapiens
cctggccaggcac

SEQ ID NO: 4168014 - DNA, 17 bp, Homo sapiens
cctggcccccctccagg

SEQ ID NO: 4168015 - DNA, 18 bp, Homo sapiens
cctggcccccctccaggc

SEQ ID NO: 4168016 - DNA, 16 bp, Homo sapiens
cctggctctcagaagg

SEQ ID NO: 4168017 - DNA, 22 bp, Homo sapiens
cctggctgaccccaaagagcct

SEQ ID NO: 4168018 - DNA, 23 bp, Homo sapiens
cctggctgaccccaaagagcctg

SEQ ID NO: 4168019 - DNA, 13 bp, Homo sapiens
cctggcttctaga

SEQ ID NO: 4168020 - DNA, 13 bp, Homo sapiens
cctggcttctgga

SEQ ID NO: 4168021 - DNA, 15 bp, Homo sapiens
cctggcttctggagc

SEQ ID NO: 4168022 - DNA, 21 bp, Homo sapiens
cctggcttctggagcccttgg

SEQ ID NO: 4168023 - DNA, 23 bp, Homo sapiens
cctggcttctggagcccttgggt

SEQ ID NO: 4168024 - DNA, 18 bp, Homo sapiens
cctgggaatcctgctgcc

SEQ ID NO: 4168025 - DNA, 22 bp, Homo sapiens
cctgggcaagtggatggcccag

SEQ ID NO: 4168026 - DNA, 23 bp, Homo sapiens
cctgggcaagtggatggcccagc

SEQ ID NO: 4168027 - DNA, 13 bp, Homo sapiens
cctgggcagaaag

SEQ ID NO: 4168028 - DNA, 19 bp, Homo sapiens
cctgggcccacagagcctg

SEQ ID NO: 4168029 - DNA, 21 bp, Homo sapiens
cctgggcccacagagcctggc

SEQ ID NO: 4168030 - DNA, 24 bp, Homo sapiens
cctgggctctgccccagctctggc

SEQ ID NO: 4168031 - DNA, 16 bp, Homo sapiens
cctgggctctggtctg

SEQ ID NO: 4168032 - DNA, 23 bp, Homo sapiens
cctgggggcccattctgcatgcc

SEQ ID NO: 4168033 - DNA, 16 bp, Homo sapiens
cctgggggctgctgca

SEQ ID NO: 4168034 - DNA, 18 bp, Homo sapiens
cctgggggctgctgcact

SEQ ID NO: 4168035 - DNA, 17 bp, Homo sapiens
cctgggtcacctagctg

SEQ ID NO: 4168036 - DNA, 16 bp, Homo sapiens
cctggtacagcagggt

SEQ ID NO: 4168037 - DNA, 20 bp, Homo sapiens
cctggtagcacatgtctgtc

SEQ ID NO: 4168038 - DNA, 23 bp, Homo sapiens
cctggtccctcacccccatggcc

SEQ ID NO: 4168039 - DNA, 14 bp, Homo sapiens
cctggtcctgcact

SEQ ID NO: 4168040 - DNA, 20 bp, Homo sapiens
cctggtcctgcactgtcccg

SEQ ID NO: 4168041 - DNA, 19 bp, Homo sapiens
cctggtgcactggccccac

SEQ ID NO: 4168042 - DNA, 20 bp, Homo sapiens
cctggtgcactggccccacc

SEQ ID NO: 4168043 - DNA, 17 bp, Homo sapiens
cctggtggacagtcctg

SEQ ID NO: 4168044 - DNA, 21 bp, Homo sapiens
cctggtggaggcttcttgccc

SEQ ID NO: 4168045 - DNA, 14 bp, Homo sapiens
cctggttcatattt

SEQ ID NO: 4168046 - DNA, 22 bp, Homo sapiens
cctggttcatatttatactttg

SEQ ID NO: 4168047 - DNA, 15 bp, Homo sapiens
cctgtaatcccagct

SEQ ID NO: 4168048 - DNA, 18 bp, Homo sapiens
cctgtagctttcctggtc

SEQ ID NO: 4168049 - DNA, 13 bp, Homo sapiens
cctgtaggttgct

SEQ ID NO: 4168050 - DNA, 17 bp, Homo sapiens
cctgtagttaggaaata

SEQ ID NO: 4168051 - DNA, 19 bp, Homo sapiens
cctgtagttaggaaataaa

SEQ ID NO: 4168052 - DNA, 21 bp, Homo sapiens
cctgtcagcttccccaggagc

SEQ ID NO: 4168053 - DNA, 18 bp, Homo sapiens
cctgtcatcccctacact

SEQ ID NO: 4168054 - DNA, 16 bp, Homo sapiens
cctgtcccttcttggg

SEQ ID NO: 4168055 - DNA, 16 bp, Homo sapiens
cctgtcctagcaggat

SEQ ID NO: 4168056 - DNA, 14 bp, Homo sapiens
cctgtcctgcctct

SEQ ID NO: 4168057 - DNA, 23 bp, Homo sapiens
cctgtcctgcctctctgctccag

SEQ ID NO: 4168058 - DNA, 16 bp, Homo sapiens
cctgtcctggctccca

SEQ ID NO: 4168059 - DNA, 21 bp, Homo sapiens
cctgtcctggtacagcagggt

SEQ ID NO: 4168060 - DNA, 13 bp, Homo sapiens
cctgtctcctttc

SEQ ID NO: 4168061 - DNA, 21 bp, Homo sapiens
cctgtctctagccactttggt

SEQ ID NO: 4168062 - DNA, 21 bp, Homo sapiens
cctgtctgtctgtctgtccca

SEQ ID NO: 4168063 - DNA, 22 bp, Homo sapiens
cctgtctgtctgtctgtcccaa

SEQ ID NO: 4168064 - DNA, 18 bp, Homo sapiens
cctgtgactatggctctg

SEQ ID NO: 4168065 - DNA, 17 bp, Homo sapiens
cctgtgctactttgcct

SEQ ID NO: 4168066 - DNA, 23 bp, Homo sapiens
cctgtgctactttgccttttgca

SEQ ID NO: 4168067 - DNA, 19 bp, Homo sapiens
cctgtggagacagccctgc

SEQ ID NO: 4168068 - DNA, 21 bp, Homo sapiens
cctgtgggaagagaagggaag

SEQ ID NO: 4168069 - DNA, 20 bp, Homo sapiens
cctgtggtgaggtcctgtcc

SEQ ID NO: 4168070 - DNA, 22 bp, Homo sapiens
cctgttgaaagttgtctggctt

SEQ ID NO: 4168071 - DNA, 19 bp, Homo sapiens
cctgttttatactgtactt

SEQ ID NO: 4168072 - DNA, 23 bp, Homo sapiens
ccttaaagaaagtcgaattaata

SEQ ID NO: 4168073 - DNA, 19 bp, Homo sapiens
ccttaccaactttctgtaa

SEQ ID NO: 4168074 - DNA, 16 bp, Homo sapiens
ccttactcacctctct

SEQ ID NO: 4168075 - DNA, 21 bp, Homo sapiens
ccttacttaagtcgggggtgg

SEQ ID NO: 4168076 - DNA, 17 bp, Homo sapiens
ccttaggctgctgggag

SEQ ID NO: 4168077 - DNA, 20 bp, Homo sapiens
ccttagtggcttttttcctc

SEQ ID NO: 4168078 - DNA, 14 bp, Homo sapiens
ccttatccaggact

SEQ ID NO: 4168079 - DNA, 15 bp, Homo sapiens
ccttatccaggactc

SEQ ID NO: 4168080 - DNA, 17 bp, Homo sapiens
ccttattatcccagctt

SEQ ID NO: 4168081 - DNA, 16 bp, Homo sapiens
ccttcaagtgccaaac

SEQ ID NO: 4168082 - DNA, 16 bp, Homo sapiens
ccttcaattcctgggc

SEQ ID NO: 4168083 - DNA, 20 bp, Homo sapiens
ccttcaattcctgggcccca

SEQ ID NO: 4168084 - DNA, 20 bp, Homo sapiens
ccttcactccggtgtgcctg

SEQ ID NO: 4168085 - DNA, 19 bp, Homo sapiens
ccttcagtgacaagtaggg

SEQ ID NO: 4168086 - DNA, 15 bp, Homo sapiens
ccttcccaacctccc

SEQ ID NO: 4168087 - DNA, 12 bp, Homo sapiens
ccttccccagac

SEQ ID NO: 4168088 - DNA, 13 bp, Homo sapiens
ccttccccagact

SEQ ID NO: 4168089 - DNA, 19 bp, Homo sapiens
ccttccccagactcagctc

SEQ ID NO: 4168090 - DNA, 17 bp, Homo sapiens
ccttccccctcccaggg

SEQ ID NO: 4168091 - DNA, 20 bp, Homo sapiens
ccttccccctcccagggcca

SEQ ID NO: 4168092 - DNA, 14 bp, Homo sapiens
ccttcccctgtggt

SEQ ID NO: 4168093 - DNA, 11 bp, Homo sapiens
ccttcccttct

SEQ ID NO: 4168094 - DNA, 15 bp, Homo sapiens
ccttccgctccttta

SEQ ID NO: 4168095 - DNA, 21 bp, Homo sapiens
ccttccgctcctttacctacc

SEQ ID NO: 4168096 - DNA, 12 bp, Homo sapiens
ccttcctttcct

SEQ ID NO: 4168097 - DNA, 19 bp, Homo sapiens
ccttcctttcctctgcagc

SEQ ID NO: 4168098 - DNA, 12 bp, Homo sapiens
ccttctggctcc

SEQ ID NO: 4168099 - DNA, 14 bp, Homo sapiens
ccttctgtccacca

SEQ ID NO: 4168100 - DNA, 17 bp, Homo sapiens
ccttctgtccaccagac

SEQ ID NO: 4168101 - DNA, 19 bp, Homo sapiens
ccttctttctcttccctcc

SEQ ID NO: 4168102 - DNA, 20 bp, Homo sapiens
ccttctttctcttccctcct

SEQ ID NO: 4168103 - DNA, 15 bp, Homo sapiens
ccttgaatctgcagg

SEQ ID NO: 4168104 - DNA, 15 bp, Homo sapiens
ccttgacaactggca

SEQ ID NO: 4168105 - DNA, 16 bp, Homo sapiens
ccttgaccactggccc

SEQ ID NO: 4168106 - DNA, 20 bp, Homo sapiens
ccttgacgtcaagtctcctt

SEQ ID NO: 4168107 - DNA, 11 bp, Homo sapiens
ccttgcatcaa

SEQ ID NO: 4168108 - DNA, 19 bp, Homo sapiens
ccttgcccggattctggga

SEQ ID NO: 4168109 - DNA, 20 bp, Homo sapiens
ccttgctctcccctgccctg

SEQ ID NO: 4168110 - DNA, 15 bp, Homo sapiens
ccttggacttgagga

SEQ ID NO: 4168111 - DNA, 21 bp, Homo sapiens
ccttggagagcagctggctct

SEQ ID NO: 4168112 - DNA, 22 bp, Homo sapiens
ccttggagagcagctggctctc

SEQ ID NO: 4168113 - DNA, 15 bp, Homo sapiens
ccttggatggcacca

SEQ ID NO: 4168114 - DNA, 19 bp, Homo sapiens
ccttggcatcacagggcag

SEQ ID NO: 4168115 - DNA, 20 bp, Homo sapiens
ccttggcttttgcttggcag

SEQ ID NO: 4168116 - DNA, 19 bp, Homo sapiens
ccttggtgtgaccctctga

SEQ ID NO: 4168117 - DNA, 17 bp, Homo sapiens
ccttggttcccttgtgt

SEQ ID NO: 4168118 - DNA, 21 bp, Homo sapiens
ccttggtttggacacagtgtt

SEQ ID NO: 4168119 - DNA, 17 bp, Homo sapiens
ccttgtcactgaagatt

SEQ ID NO: 4168120 - DNA, 16 bp, Homo sapiens
cctttacctaccacct

SEQ ID NO: 4168121 - DNA, 22 bp, Homo sapiens
cctttacctaccaccttccctc

SEQ ID NO: 4168122 - DNA, 16 bp, Homo sapiens
cctttatagctcatca

SEQ ID NO: 4168123 - DNA, 20 bp, Homo sapiens
cctttcagggaatttcagga

SEQ ID NO: 4168124 - DNA, 21 bp, Homo sapiens
cctttcccatgatccagaact

SEQ ID NO: 4168125 - DNA, 20 bp, Homo sapiens
ccgtgttagccaggatggtc

SEQ ID NO: 4168126 - DNA, 23 bp, Homo sapiens
cctaagaaagacatcacatccct

SEQ ID NO: 4168127 - DNA, 14 bp, Homo sapiens
cctaattcctggca

SEQ ID NO: 4168128 - DNA, 17 bp, Homo sapiens
cctacacccttggactt

SEQ ID NO: 4168129 - DNA, 20 bp, Homo sapiens
cctacacccttggacttgag

SEQ ID NO: 4168130 - DNA, 15 bp, Homo sapiens
cctaccaccttccct

SEQ ID NO: 4168131 - DNA, 20 bp, Homo sapiens
cctacccccagcctgacaaa

SEQ ID NO: 4168132 - DNA, 13 bp, Homo sapiens
cctacctcagcct

SEQ ID NO: 4168133 - DNA, 14 bp, Homo sapiens
cctacctcagccta

SEQ ID NO: 4168134 - DNA, 17 bp, Homo sapiens
cctacgcagatgctgtc

SEQ ID NO: 4168135 - DNA, 18 bp, Homo sapiens
cctacgcagatgctgtca

SEQ ID NO: 4168136 - DNA, 16 bp, Homo sapiens
cctactgaacccagag

SEQ ID NO: 4168137 - DNA, 17 bp, Homo sapiens
cctactgaacccagagt

SEQ ID NO: 4168138 - DNA, 18 bp, Homo sapiens
cctagaaaccacctgggt

SEQ ID NO: 4168139 - DNA, 19 bp, Homo sapiens
cctagaacatccctgggca

SEQ ID NO: 4168140 - DNA, 17 bp, Homo sapiens
cctagactgtgtatgtc

SEQ ID NO: 4168141 - DNA, 15 bp, Homo sapiens
cctagactgttactt

SEQ ID NO: 4168142 - DNA, 16 bp, Homo sapiens
cctaggagggaaggag

SEQ ID NO: 4168143 - DNA, 16 bp, Homo sapiens
cctaggattcctcccc

SEQ ID NO: 4168144 - DNA, 16 bp, Homo sapiens
cctagtccagtgacct

SEQ ID NO: 4168145 - DNA, 11 bp, Homo sapiens
cctataaaatc

SEQ ID NO: 4168146 - DNA, 20 bp, Homo sapiens
cctataaaatcaaagaaaac

SEQ ID NO: 4168147 - DNA, 12 bp, Homo sapiens
cctatccatcct

SEQ ID NO: 4168148 - DNA, 12 bp, Homo sapiens
cctatcctctgt

SEQ ID NO: 4168149 - DNA, 23 bp, Homo sapiens
cctatccttggagagcagctggc

SEQ ID NO: 4168150 - DNA, 15 bp, Homo sapiens
cctattctcaccagg

SEQ ID NO: 4168151 - DNA, 18 bp, Homo sapiens
cctattctttgccacctt

SEQ ID NO: 4168152 - DNA, 21 bp, Homo sapiens
cctcaaagcaagcattcagaa

SEQ ID NO: 4168153 - DNA, 16 bp, Homo sapiens
cctcaatgtgaccagg

SEQ ID NO: 4168154 - DNA, 12 bp, Homo sapiens
cctcactccaaa

SEQ ID NO: 4168155 - DNA, 18 bp, Homo sapiens
cctcagagcaggggccag

SEQ ID NO: 4168156 - DNA, 19 bp, Homo sapiens
cctcagagggataaggcag

SEQ ID NO: 4168157 - DNA, 16 bp, Homo sapiens
cctcagcctagaccct

SEQ ID NO: 4168158 - DNA, 16 bp, Homo sapiens
cctcagggacaacatt

SEQ ID NO: 4168159 - DNA, 20 bp, Homo sapiens
cctcagtgggctccctggcc

SEQ ID NO: 4168160 - DNA, 17 bp, Homo sapiens
cctcatgcctggccccc

SEQ ID NO: 4168161 - DNA, 19 bp, Homo sapiens
cctcatgcctggcccccct

SEQ ID NO: 4168162 - DNA, 15 bp, Homo sapiens
cctccacagccgcag

SEQ ID NO: 4168163 - DNA, 20 bp, Homo sapiens
cctccaggcatgctggcctc

SEQ ID NO: 4168164 - DNA, 21 bp, Homo sapiens
cctccagggaatccgcctgca

SEQ ID NO: 4168165 - DNA, 22 bp, Homo sapiens
cctccagggtctaaagagaaca

SEQ ID NO: 4168166 - DNA, 16 bp, Homo sapiens
cctccatccggctcct

SEQ ID NO: 4168167 - DNA, 17 bp, Homo sapiens
cctcccaataaagctgg

SEQ ID NO: 4168168 - DNA, 12 bp, Homo sapiens
cctcccagcgtg

SEQ ID NO: 4168169 - DNA, 20 bp, Homo sapiens
cctcccagcgtgtgtatccg

SEQ ID NO: 4168170 - DNA, 16 bp, Homo sapiens
cctcccataattgctt

SEQ ID NO: 4168171 - DNA, 23 bp, Homo sapiens
cctccccacagtcctcacagcct

SEQ ID NO: 4168172 - DNA, 18 bp, Homo sapiens
cctccccaccttccccag

SEQ ID NO: 4168173 - DNA, 23 bp, Homo sapiens
cctccccaccttccccagactca

SEQ ID NO: 4168174 - DNA, 21 bp, Homo sapiens
cctccccattagagtcagcct

SEQ ID NO: 4168175 - DNA, 21 bp, Homo sapiens
cctccccctagcaaggtccag

SEQ ID NO: 4168176 - DNA, 14 bp, Homo sapiens
cctcccctggtcct

SEQ ID NO: 4168177 - DNA, 19 bp, Homo sapiens
cctccctctgacctgcagg

SEQ ID NO: 4168178 - DNA, 14 bp, Homo sapiens
cctccctgctgcca

SEQ ID NO: 4168179 - DNA, 21 bp, Homo sapiens
cctcctacgcagatgctgtca

SEQ ID NO: 4168180 - DNA, 23 bp, Homo sapiens
cctcctagggcttatcatcagcc

SEQ ID NO: 4168181 - DNA, 19 bp, Homo sapiens
cctcctatccttggagagc

SEQ ID NO: 4168182 - DNA, 20 bp, Homo sapiens
cctcctggagcatcccaggc

SEQ ID NO: 4168183 - DNA, 17 bp, Homo sapiens
cctcctgggcatgtttg

SEQ ID NO: 4168184 - DNA, 20 bp, Homo sapiens
cctcctgggcatgtttgtct

SEQ ID NO: 4168185 - DNA, 22 bp, Homo sapiens
cctcctgggcatgtttgtctgt

SEQ ID NO: 4168186 - DNA, 15 bp, Homo sapiens
cctcctgggggccca

SEQ ID NO: 4168187 - DNA, 22 bp, Homo sapiens
cctcctgggggcccattctgca

SEQ ID NO: 4168188 - DNA, 13 bp, Homo sapiens
cctccttcccttc

SEQ ID NO: 4168189 - DNA, 18 bp, Homo sapiens
cctccttgctctgcaggc

SEQ ID NO: 4168190 - DNA, 22 bp, Homo sapiens
cctccttgctctgcaggcacct

SEQ ID NO: 4168191 - DNA, 13 bp, Homo sapiens
cctcgtgcagagc

SEQ ID NO: 4168192 - DNA, 18 bp, Homo sapiens
cctcgtggacacctgccc

SEQ ID NO: 4168193 - DNA, 23 bp, Homo sapiens
cctctaacccccagtgccacaga

SEQ ID NO: 4168194 - DNA, 14 bp, Homo sapiens
cctctaagccactc

SEQ ID NO: 4168195 - DNA, 14 bp, Homo sapiens
cctctccctgccaa

SEQ ID NO: 4168196 - DNA, 21 bp, Homo sapiens
cctctcggaaggctggctggg

SEQ ID NO: 4168197 - DNA, 14 bp, Homo sapiens
cctctctgctccag

SEQ ID NO: 4168198 - DNA, 15 bp, Homo sapiens
cctctctgctccaga

SEQ ID NO: 4168199 - DNA, 11 bp, Homo sapiens
cctctcttccc

SEQ ID NO: 4168200 - DNA, 18 bp, Homo sapiens
cctctgatacccagagca

SEQ ID NO: 4168201 - DNA, 22 bp, Homo sapiens
cctctgctgctcccatctgcac

SEQ ID NO: 4168202 - DNA, 9 bp, Homo sapiens
cctctgtgc

SEQ ID NO: 4168203 - DNA, 17 bp, Homo sapiens
cctcttaaagctgcctg

SEQ ID NO: 4168204 - DNA, 15 bp, Homo sapiens
cctcttaaattatat

SEQ ID NO: 4168205 - DNA, 13 bp, Homo sapiens
cctcttccttccc

SEQ ID NO: 4168206 - DNA, 16 bp, Homo sapiens
cctcttcttcttcaga

SEQ ID NO: 4168207 - DNA, 18 bp, Homo sapiens
cctcttcttttcacctct

SEQ ID NO: 4168208 - DNA, 22 bp, Homo sapiens
cctctttctacattctcatcta

SEQ ID NO: 4168209 - DNA, 15 bp, Homo sapiens
cctctttctctcctt

SEQ ID NO: 4168210 - DNA, 22 bp, Homo sapiens
cctgaaaaggtttatgaaaaag

SEQ ID NO: 4168211 - DNA, 21 bp, Homo sapiens
cctgaaccactgtggccttct

SEQ ID NO: 4168212 - DNA, 19 bp, Homo sapiens
cctgaatgacctgcagtca

SEQ ID NO: 4168213 - DNA, 19 bp, Homo sapiens
cctgacaagcactgctagg

SEQ ID NO: 4168214 - DNA, 19 bp, Homo sapiens
cctgacactgtctgctgcc

SEQ ID NO: 4168215 - DNA, 14 bp, Homo sapiens
cctgacctgaggct

SEQ ID NO: 4168216 - DNA, 13 bp, Homo sapiens
cctgactcctcta

SEQ ID NO: 4168217 - DNA, 20 bp, Homo sapiens
cctgactcctctaagccact

SEQ ID NO: 4168218 - DNA, 15 bp, Homo sapiens
cctgactctctgtga

SEQ ID NO: 4168219 - DNA, 12 bp, Homo sapiens
cctgactgcaca

SEQ ID NO: 4168220 - DNA, 16 bp, Homo sapiens
cctgactgctcggtca

SEQ ID NO: 4168221 - DNA, 23 bp, Homo sapiens
cctgagaactgaattttgggact

SEQ ID NO: 4168222 - DNA, 23 bp, Homo sapiens
cctgagcaacagagtgagaccct

SEQ ID NO: 4168223 - DNA, 17 bp, Homo sapiens
cctgagctgaccagccg

SEQ ID NO: 4168224 - DNA, 18 bp, Homo sapiens
cctgaggctcctgtgcta

SEQ ID NO: 4168225 - DNA, 14 bp, Homo sapiens
cctgagtggatctc

SEQ ID NO: 4168226 - DNA, 23 bp, Homo sapiens
cctgagtggatctccaaggacca

SEQ ID NO: 4168227 - DNA, 14 bp, Homo sapiens
cctgatcacctctg

SEQ ID NO: 4168228 - DNA, 20 bp, Homo sapiens
cctgatcattacatggctgt

SEQ ID NO: 4168229 - DNA, 21 bp, Homo sapiens
cctgatggtacaggaaagctc

SEQ ID NO: 4168230 - DNA, 15 bp, Homo sapiens
cctgcaatctccagg

SEQ ID NO: 4168231 - DNA, 20 bp, Homo sapiens
cctgcaatctccagggctgc

SEQ ID NO: 4168232 - DNA, 21 bp, Homo sapiens
cctgcaatctccagggctgcc

SEQ ID NO: 4168233 - DNA, 22 bp, Homo sapiens
cctgcacgccaccgctgccttt

SEQ ID NO: 4168234 - DNA, 12 bp, Homo sapiens
cctgcactccag

SEQ ID NO: 4168235 - DNA, 13 bp, Homo sapiens
cctgcactccaga

SEQ ID NO: 4168236 - DNA, 14 bp, Homo sapiens
cctgcactccagaa

SEQ ID NO: 4168237 - DNA, 22 bp, Homo sapiens
cctgcaggccaagagcagaggc

SEQ ID NO: 4168238 - DNA, 17 bp, Homo sapiens
cctgcagtcagggccca

SEQ ID NO: 4168239 - DNA, 19 bp, Homo sapiens
cctgcagtcagggcccaga

SEQ ID NO: 4168240 - DNA, 13 bp, Homo sapiens
cctgccaattgct

SEQ ID NO: 4168241 - DNA, 15 bp, Homo sapiens
cctgccacctgtctg

SEQ ID NO: 4168242 - DNA, 16 bp, Homo sapiens
cctgccacctgtctgt

SEQ ID NO: 4168243 - DNA, 13 bp, Homo sapiens
cctgccagcctgg

SEQ ID NO: 4168244 - DNA, 14 bp, Homo sapiens
cctgccagcctggc

SEQ ID NO: 4168245 - DNA, 16 bp, Homo sapiens
cctgccagcctggctt

SEQ ID NO: 4168246 - DNA, 17 bp, Homo sapiens
cctgccagcctggcttc

SEQ ID NO: 4168247 - DNA, 16 bp, Homo sapiens
cctgccattcttctgg

SEQ ID NO: 4168248 - DNA, 17 bp, Homo sapiens
cctgccatttgcaccct

SEQ ID NO: 4168249 - DNA, 15 bp, Homo sapiens
cctgcccccgacagc

SEQ ID NO: 4168250 - DNA, 20 bp, Homo sapiens
cctgcccccgacagcccagc

SEQ ID NO: 4168251 - DNA, 14 bp, Homo sapiens
cctgccccctggtg

SEQ ID NO: 4168252 - DNA, 15 bp, Homo sapiens
cctgccccctggtgg

SEQ ID NO: 4168253 - DNA, 12 bp, Homo sapiens
cctgccctgcca

SEQ ID NO: 4168254 - DNA, 15 bp, Homo sapiens
cctgccctgccctgc

SEQ ID NO: 4168255 - DNA, 13 bp, Homo sapiens
cctgccctgctgc

SEQ ID NO: 4168256 - DNA, 17 bp, Homo sapiens
cctgcctatccatcctg

SEQ ID NO: 4168257 - DNA, 17 bp, Homo sapiens
cctgcctatcctctgta

SEQ ID NO: 4168258 - DNA, 19 bp, Homo sapiens
cctgcctctctgctccaga

SEQ ID NO: 4168259 - DNA, 20 bp, Homo sapiens
cctgcctctctgctccagag

SEQ ID NO: 4168260 - DNA, 14 bp, Homo sapiens
cctgcctgtgcatg

SEQ ID NO: 4168261 - DNA, 19 bp, Homo sapiens
cctgccttgaagccactga

SEQ ID NO: 4168262 - DNA, 21 bp, Homo sapiens
cctgccttgaagccactgaag

SEQ ID NO: 4168263 - DNA, 20 bp, Homo sapiens
cctgcgaaggggccctggtc

SEQ ID NO: 4168264 - DNA, 19 bp, Homo sapiens
cccctcgtgtgactctctt

SEQ ID NO: 4168265 - DNA, 14 bp, Homo sapiens
cccctctcctccgc

SEQ ID NO: 4168266 - DNA, 19 bp, Homo sapiens
cccctgcacctgcttctca

SEQ ID NO: 4168267 - DNA, 13 bp, Homo sapiens
cccctgccctgct

SEQ ID NO: 4168268 - DNA, 15 bp, Homo sapiens
cccctgccctgctgc

SEQ ID NO: 4168269 - DNA, 11 bp, Homo sapiens
cccctgggctc

SEQ ID NO: 4168270 - DNA, 23 bp, Homo sapiens
cccctggtgcactggccccaccc

SEQ ID NO: 4168271 - DNA, 22 bp, Homo sapiens
cccctggtggacagtcctggga

SEQ ID NO: 4168272 - DNA, 14 bp, Homo sapiens
ccccttatccagga

SEQ ID NO: 4168273 - DNA, 13 bp, Homo sapiens
ccccttcctttcc

SEQ ID NO: 4168274 - DNA, 23 bp, Homo sapiens
ccccttcctttcctctgcagcac

SEQ ID NO: 4168275 - DNA, 22 bp, Homo sapiens
ccccttggcttttgcttggcag

SEQ ID NO: 4168276 - DNA, 11 bp, Homo sapiens
cccctttcccc

SEQ ID NO: 4168277 - DNA, 21 bp, Homo sapiens
cccctttcccccaccccagag

SEQ ID NO: 4168278 - DNA, 14 bp, Homo sapiens
cccgacagcccagc

SEQ ID NO: 4168279 - DNA, 16 bp, Homo sapiens
cccgacagcccagcct

SEQ ID NO: 4168280 - DNA, 11 bp, Homo sapiens
cccgcagtgcc

SEQ ID NO: 4168281 - DNA, 13 bp, Homo sapiens
cccgcccagctgc

SEQ ID NO: 4168282 - DNA, 17 bp, Homo sapiens
cccgctctgcattgcct

SEQ ID NO: 4168283 - DNA, 16 bp, Homo sapiens
cccgcttcaagctctc

SEQ ID NO: 4168284 - DNA, 16 bp, Homo sapiens
cccggattctgggagg

SEQ ID NO: 4168285 - DNA, 22 bp, Homo sapiens
cccggcccagagaccccttcct

SEQ ID NO: 4168286 - DNA, 17 bp, Homo sapiens
cccgggtgcctcagagc

SEQ ID NO: 4168287 - DNA, 19 bp, Homo sapiens
cccgggtgcctcagagcag

SEQ ID NO: 4168288 - DNA, 23 bp, Homo sapiens
cccgggtgcctcagagcaggctc

SEQ ID NO: 4168289 - DNA, 12 bp, Homo sapiens
cccggtggcagt

SEQ ID NO: 4168290 - DNA, 14 bp, Homo sapiens
cccgtaatgcttag

SEQ ID NO: 4168291 - DNA, 16 bp, Homo sapiens
cccgtgtggcttacaa

SEQ ID NO: 4168292 - DNA, 12 bp, Homo sapiens
ccctaaactgta

SEQ ID NO: 4168293 - DNA, 21 bp, Homo sapiens
ccctagaaaccacctgggttc

SEQ ID NO: 4168294 - DNA, 21 bp, Homo sapiens
ccctaggctgagctggcattg

SEQ ID NO: 4168295 - DNA, 16 bp, Homo sapiens
ccctcaaaccctgtgg

SEQ ID NO: 4168296 - DNA, 23 bp, Homo sapiens
ccctcaagaggggaagcaactcc

SEQ ID NO: 4168297 - DNA, 18 bp, Homo sapiens
ccctcacacccgcttccc

SEQ ID NO: 4168298 - DNA, 22 bp, Homo sapiens
ccctcagggatcttgcattccc

SEQ ID NO: 4168299 - DNA, 13 bp, Homo sapiens
ccctcattcccct

SEQ ID NO: 4168300 - DNA, 14 bp, Homo sapiens
ccctcattcccctc

SEQ ID NO: 4168301 - DNA, 19 bp, Homo sapiens
ccctccaccgcagaaggaa

SEQ ID NO: 4168302 - DNA, 11 bp, Homo sapiens
ccctccaggca

SEQ ID NO: 4168303 - DNA, 14 bp, Homo sapiens
ccctccccagccct

SEQ ID NO: 4168304 - DNA, 15 bp, Homo sapiens
ccctccccagccctt

SEQ ID NO: 4168305 - DNA, 14 bp, Homo sapiens
ccctccctggcatg

SEQ ID NO: 4168306 - DNA, 13 bp, Homo sapiens
ccctccgccttca

SEQ ID NO: 4168307 - DNA, 13 bp, Homo sapiens
ccctcctggagca

SEQ ID NO: 4168308 - DNA, 14 bp, Homo sapiens
ccctccttcccttc

SEQ ID NO: 4168309 - DNA, 15 bp, Homo sapiens
ccctccttcccttct

SEQ ID NO: 4168310 - DNA, 17 bp, Homo sapiens
ccctcgtggacacctgc

SEQ ID NO: 4168311 - DNA, 22 bp, Homo sapiens
ccctctcctctcctcctctgtg

SEQ ID NO: 4168312 - DNA, 13 bp, Homo sapiens
ccctctcttccct

SEQ ID NO: 4168313 - DNA, 22 bp, Homo sapiens
ccctctgaatggtccagggttg

SEQ ID NO: 4168314 - DNA, 21 bp, Homo sapiens
ccctctgagaattccaaggag

SEQ ID NO: 4168315 - DNA, 20 bp, Homo sapiens
ccctctgctccccagtgcta

SEQ ID NO: 4168316 - DNA, 19 bp, Homo sapiens
ccctcttgacccatctccc

SEQ ID NO: 4168317 - DNA, 16 bp, Homo sapiens
ccctctttccccacct

SEQ ID NO: 4168318 - DNA, 15 bp, Homo sapiens
ccctctttctacatt

SEQ ID NO: 4168319 - DNA, 11 bp, Homo sapiens
ccctgagctga

SEQ ID NO: 4168320 - DNA, 16 bp, Homo sapiens
ccctgagggcccttcc

SEQ ID NO: 4168321 - DNA, 20 bp, Homo sapiens
ccctgagggcccttcccaac

SEQ ID NO: 4168322 - DNA, 20 bp, Homo sapiens
ccctgagtggatctccaagg

SEQ ID NO: 4168323 - DNA, 21 bp, Homo sapiens
ccctgagtggatctccaagga

SEQ ID NO: 4168324 - DNA, 18 bp, Homo sapiens
ccctgccacctgtctgtc

SEQ ID NO: 4168325 - DNA, 17 bp, Homo sapiens
ccctgccctgccacctg

SEQ ID NO: 4168326 - DNA, 16 bp, Homo sapiens
ccctgcctatcctctg

SEQ ID NO: 4168327 - DNA, 18 bp, Homo sapiens
ccctgcctatcctctgta

SEQ ID NO: 4168328 - DNA, 21 bp, Homo sapiens
ccctgcgaaggggccctggtc

SEQ ID NO: 4168329 - DNA, 23 bp, Homo sapiens
ccctgctgccaggctcccactgc

SEQ ID NO: 4168330 - DNA, 20 bp, Homo sapiens
ccctgctgccgcctcccagc

SEQ ID NO: 4168331 - DNA, 19 bp, Homo sapiens
ccctggagtcccctgggcc

SEQ ID NO: 4168332 - DNA, 20 bp, Homo sapiens
ccctggagtcccctgggcct

SEQ ID NO: 4168333 - DNA, 16 bp, Homo sapiens
ccctggatcagggttg

SEQ ID NO: 4168334 - DNA, 12 bp, Homo sapiens
ccctggcccagc

SEQ ID NO: 4168335 - DNA, 18 bp, Homo sapiens
ccctggcccagccagcca

SEQ ID NO: 4168336 - DNA, 24 bp, Homo sapiens
ccctgggcctggaccgcttcccag

SEQ ID NO: 4168337 - DNA, 22 bp, Homo sapiens
ccctgggctctggtctgtaggt

SEQ ID NO: 4168338 - DNA, 23 bp, Homo sapiens
ccctgggctctggtctgtaggtt

SEQ ID NO: 4168339 - DNA, 13 bp, Homo sapiens
ccctggtccttcc

SEQ ID NO: 4168340 - DNA, 16 bp, Homo sapiens
ccctggtccttccagg

SEQ ID NO: 4168341 - DNA, 10 bp, Homo sapiens
ccctggtgga

SEQ ID NO: 4168342 - DNA, 18 bp, Homo sapiens
ccctggtggacagtcctg

SEQ ID NO: 4168343 - DNA, 19 bp, Homo sapiens
ccctggtggacagtcctgg

SEQ ID NO: 4168344 - DNA, 15 bp, Homo sapiens
ccctggtttgcagct

SEQ ID NO: 4168345 - DNA, 20 bp, Homo sapiens
ccctgttgaaagttgtctgg

SEQ ID NO: 4168346 - DNA, 22 bp, Homo sapiens
ccctgttgaaagttgtctggct

SEQ ID NO: 4168347 - DNA, 13 bp, Homo sapiens
cccttatccagga

SEQ ID NO: 4168348 - DNA, 14 bp, Homo sapiens
cccttatccaggac

SEQ ID NO: 4168349 - DNA, 18 bp, Homo sapiens
cccttcaacttcagaagg

SEQ ID NO: 4168350 - DNA, 11 bp, Homo sapiens
cccttcccaac

SEQ ID NO: 4168351 - DNA, 16 bp, Homo sapiens
cccttcccactggagg

SEQ ID NO: 4168352 - DNA, 22 bp, Homo sapiens
cccttgccgggccttttttcca

SEQ ID NO: 4168353 - DNA, 20 bp, Homo sapiens
cccttgctgacatggctttg

SEQ ID NO: 4168354 - DNA, 22 bp, Homo sapiens
cccttggaaagttcagccagaa

SEQ ID NO: 4168355 - DNA, 12 bp, Homo sapiens
cccttgtgtgtg

SEQ ID NO: 4168356 - DNA, 12 bp, Homo sapiens
ccctttccccca

SEQ ID NO: 4168357 - DNA, 13 bp, Homo sapiens
ccctttcctcccc

SEQ ID NO: 4168358 - DNA, 12 bp, Homo sapiens
ccctttctgtgt

SEQ ID NO: 4168359 - DNA, 20 bp, Homo sapiens
ccctttgcaggcccagcaga

SEQ ID NO: 4168360 - DNA, 13 bp, Homo sapiens
ccctttgcttccc

SEQ ID NO: 4168361 - DNA, 22 bp, Homo sapiens
ccctttggggttgcccagcctg

SEQ ID NO: 4168362 - DNA, 18 bp, Homo sapiens
cccttttatcttctagcc

SEQ ID NO: 4168363 - DNA, 22 bp, Homo sapiens
cccttttatcttctagccacag

SEQ ID NO: 4168364 - DNA, 12 bp, Homo sapiens
ccgacccctgtc

SEQ ID NO: 4168365 - DNA, 16 bp, Homo sapiens
ccgacccctgtccagc

SEQ ID NO: 4168366 - DNA, 15 bp, Homo sapiens
ccgactagcaggcat

SEQ ID NO: 4168367 - DNA, 13 bp, Homo sapiens
ccgagagaggcgc

SEQ ID NO: 4168368 - DNA, 22 bp, Homo sapiens
ccgagagaggcgcgtctgcccc

SEQ ID NO: 4168369 - DNA, 21 bp, Homo sapiens
ccgagatcacgccactgcact

SEQ ID NO: 4168370 - DNA, 19 bp, Homo sapiens
ccgagcgctttctggaaaa

SEQ ID NO: 4168371 - DNA, 16 bp, Homo sapiens
ccgagctactctcttg

SEQ ID NO: 4168372 - DNA, 15 bp, Homo sapiens
ccgagggagctgctg

SEQ ID NO: 4168373 - DNA, 14 bp, Homo sapiens
ccgcactcacccat

SEQ ID NO: 4168374 - DNA, 20 bp, Homo sapiens
ccgcagccagccggtgcctg

SEQ ID NO: 4168375 - DNA, 13 bp, Homo sapiens
ccgcatttctcat

SEQ ID NO: 4168376 - DNA, 18 bp, Homo sapiens
ccgcatttctcatgcttc

SEQ ID NO: 4168377 - DNA, 21 bp, Homo sapiens
ccgccggaccgcgtagagagc

SEQ ID NO: 4168378 - DNA, 16 bp, Homo sapiens
ccgcctctgcccgcag

SEQ ID NO: 4168379 - DNA, 18 bp, Homo sapiens
ccgcctgtcctgcctctc

SEQ ID NO: 4168380 - DNA, 11 bp, Homo sapiens
ccgctccagat

SEQ ID NO: 4168381 - DNA, 19 bp, Homo sapiens
ccgctcctttacctaccac

SEQ ID NO: 4168382 - DNA, 22 bp, Homo sapiens
ccgctcctttacctaccacctt

SEQ ID NO: 4168383 - DNA, 19 bp, Homo sapiens
ccgcttcaagctctctgtt

SEQ ID NO: 4168384 - DNA, 23 bp, Homo sapiens
ccggacggacgttggttctgcac

SEQ ID NO: 4168385 - DNA, 16 bp, Homo sapiens
ccggaggggacccagc

SEQ ID NO: 4168386 - DNA, 20 bp, Homo sapiens
ccggaggggacccagctcct

SEQ ID NO: 4168387 - DNA, 21 bp, Homo sapiens
ccggaggggacccagctcctc

SEQ ID NO: 4168388 - DNA, 19 bp, Homo sapiens
ccggaggggttgcggggga

SEQ ID NO: 4168389 - DNA, 16 bp, Homo sapiens
ccggcccagagacccc

SEQ ID NO: 4168390 - DNA, 21 bp, Homo sapiens
ccggctgctcctccagccctt

SEQ ID NO: 4168391 - DNA, 14 bp, Homo sapiens
ccgggaggcagtgc

SEQ ID NO: 4168392 - DNA, 14 bp, Homo sapiens
ccgggtgccattcc

SEQ ID NO: 4168393 - DNA, 22 bp, Homo sapiens
ccgggtgccccccatgccctcc

SEQ ID NO: 4168394 - DNA, 22 bp, Homo sapiens
ccgggtgcctcagagcaggctc

SEQ ID NO: 4168395 - DNA, 18 bp, Homo sapiens
ccgggtgtgcctgccctg

SEQ ID NO: 4168396 - DNA, 16 bp, Homo sapiens
ccggtgtgcctgcagc

SEQ ID NO: 4168397 - DNA, 22 bp, Homo sapiens
ccgtatctgcagaatgggccac

SEQ ID NO: 4168398 - DNA, 19 bp, Homo sapiens
ccgtgcagcttctgtcctg

SEQ ID NO: 4168399 - DNA, 23 bp, Homo sapiens
ccgtgcctttctctggctccaga

SEQ ID NO: 4168400 - DNA, 15 bp, Homo sapiens
ccgtggtcagagtgc

SEQ ID NO: 4168401 - DNA, 21 bp, Homo sapiens
ccgtggtcagagtgccactgc

SEQ ID NO: 4168402 - DNA, 21 bp, Homo sapiens
ccgtggtgaggttgtgctgcc

SEQ ID NO: 4168403 - DNA, 16 bp, Homo sapiens
ccatgctgaagggacc

SEQ ID NO: 4168404 - DNA, 20 bp, Homo sapiens
ccatgctttccttttcttcc

SEQ ID NO: 4168405 - DNA, 12 bp, Homo sapiens
ccatgggcctgc

SEQ ID NO: 4168406 - DNA, 21 bp, Homo sapiens
ccatgggcctgctgcgtcaga

SEQ ID NO: 4168407 - DNA, 15 bp, Homo sapiens
ccatgggtgcatgga

SEQ ID NO: 4168408 - DNA, 16 bp, Homo sapiens
ccatgtttattaagaa

SEQ ID NO: 4168409 - DNA, 22 bp, Homo sapiens
ccattaaccagatctagtcaat

SEQ ID NO: 4168410 - DNA, 16 bp, Homo sapiens
ccattaggcatgccta

SEQ ID NO: 4168411 - DNA, 22 bp, Homo sapiens
ccattatttaataagagtaaaa

SEQ ID NO: 4168412 - DNA, 17 bp, Homo sapiens
ccattcccaaaataact

SEQ ID NO: 4168413 - DNA, 14 bp, Homo sapiens
ccattcttctggtg

SEQ ID NO: 4168414 - DNA, 15 bp, Homo sapiens
ccattcttctggtgc

SEQ ID NO: 4168415 - DNA, 20 bp, Homo sapiens
ccattgggaccctccagtgc

SEQ ID NO: 4168416 - DNA, 13 bp, Homo sapiens
ccatttcaaatgg

SEQ ID NO: 4168417 - DNA, 18 bp, Homo sapiens
ccatttggacaaaatgga

SEQ ID NO: 4168418 - DNA, 19 bp, Homo sapiens
cccaaagagcctggagaag

SEQ ID NO: 4168419 - DNA, 16 bp, Homo sapiens
cccaaagtctgtgtga

SEQ ID NO: 4168420 - DNA, 23 bp, Homo sapiens
cccaactacccccagctgtgctt

SEQ ID NO: 4168421 - DNA, 12 bp, Homo sapiens
cccaagcagccg

SEQ ID NO: 4168422 - DNA, 19 bp, Homo sapiens
cccaagcagccgcagcgca

SEQ ID NO: 4168423 - DNA, 17 bp, Homo sapiens
cccaaggaacaagagaa

SEQ ID NO: 4168424 - DNA, 11 bp, Homo sapiens
cccaataaagc

SEQ ID NO: 4168425 - DNA, 12 bp, Homo sapiens
cccaatgctcct

SEQ ID NO: 4168426 - DNA, 23 bp, Homo sapiens
cccacaataagagttcttgccct

SEQ ID NO: 4168427 - DNA, 22 bp, Homo sapiens
cccacaatctggcttagtgcca

SEQ ID NO: 4168428 - DNA, 11 bp, Homo sapiens
cccacacatgt

SEQ ID NO: 4168429 - DNA, 12 bp, Homo sapiens
cccacagagcct

SEQ ID NO: 4168430 - DNA, 13 bp, Homo sapiens
cccacagagcctg

SEQ ID NO: 4168431 - DNA, 14 bp, Homo sapiens
cccacagagcctgg

SEQ ID NO: 4168432 - DNA, 22 bp, Homo sapiens
cccacagtcctcacagcctctc

SEQ ID NO: 4168433 - DNA, 18 bp, Homo sapiens
cccacatgaggacatgat

SEQ ID NO: 4168434 - DNA, 21 bp, Homo sapiens
cccaccacactccccgcctgt

SEQ ID NO: 4168435 - DNA, 13 bp, Homo sapiens
cccaccccagagt

SEQ ID NO: 4168436 - DNA, 21 bp, Homo sapiens
cccacccctaacctggcttat

SEQ ID NO: 4168437 - DNA, 18 bp, Homo sapiens
cccacctcatgcctggcc

SEQ ID NO: 4168438 - DNA, 13 bp, Homo sapiens
cccacctcttcct

SEQ ID NO: 4168439 - DNA, 20 bp, Homo sapiens
cccaccttcaattcctgggc

SEQ ID NO: 4168440 - DNA, 13 bp, Homo sapiens
cccaccttcccca

SEQ ID NO: 4168441 - DNA, 14 bp, Homo sapiens
cccaccttccccag

SEQ ID NO: 4168442 - DNA, 17 bp, Homo sapiens
cccaccttccccagact

SEQ ID NO: 4168443 - DNA, 20 bp, Homo sapiens
cccacgactgttgtacaagc

SEQ ID NO: 4168444 - DNA, 19 bp, Homo sapiens
cccactaagctttctcctt

SEQ ID NO: 4168445 - DNA, 16 bp, Homo sapiens
cccactgcccctgcac

SEQ ID NO: 4168446 - DNA, 19 bp, Homo sapiens
cccactgtatctaggcaac

SEQ ID NO: 4168447 - DNA, 14 bp, Homo sapiens
cccagactcagctc

SEQ ID NO: 4168448 - DNA, 18 bp, Homo sapiens
cccagagccactaccttt

SEQ ID NO: 4168449 - DNA, 21 bp, Homo sapiens
cccagagctgtggactttgtt

SEQ ID NO: 4168450 - DNA, 14 bp, Homo sapiens
cccagaggcctctc

SEQ ID NO: 4168451 - DNA, 16 bp, Homo sapiens
cccagagggcccaggc

SEQ ID NO: 4168452 - DNA, 18 bp, Homo sapiens
cccagagggcccaggcag

SEQ ID NO: 4168453 - DNA, 21 bp, Homo sapiens
cccagcaagtttcaccttggg

SEQ ID NO: 4168454 - DNA, 23 bp, Homo sapiens
cccagcaggcaggcactgtggcc

SEQ ID NO: 4168455 - DNA, 19 bp, Homo sapiens
cccagcagggcctcaaagt

SEQ ID NO: 4168456 - DNA, 12 bp, Homo sapiens
cccagccagcca

SEQ ID NO: 4168457 - DNA, 18 bp, Homo sapiens
cccagccattaccatgga

SEQ ID NO: 4168458 - DNA, 22 bp, Homo sapiens
cccagccattaccatggagaca

SEQ ID NO: 4168459 - DNA, 15 bp, Homo sapiens
cccagcctagcccac

SEQ ID NO: 4168460 - DNA, 15 bp, Homo sapiens
cccagcctgtcctgg

SEQ ID NO: 4168461 - DNA, 22 bp, Homo sapiens
cccagcctgtcctggtacagca

SEQ ID NO: 4168462 - DNA, 15 bp, Homo sapiens
cccagcgtgtgtatc

SEQ ID NO: 4168463 - DNA, 16 bp, Homo sapiens
cccagcgtgtgtatcc

SEQ ID NO: 4168464 - DNA, 14 bp, Homo sapiens
cccagctaattttt

SEQ ID NO: 4168465 - DNA, 15 bp, Homo sapiens
cccagctacccagga

SEQ ID NO: 4168466 - DNA, 16 bp, Homo sapiens
cccagctacccaggag

SEQ ID NO: 4168467 - DNA, 17 bp, Homo sapiens
cccagctactcagaagc

SEQ ID NO: 4168468 - DNA, 22 bp, Homo sapiens
cccagctactcagaagcctgag

SEQ ID NO: 4168469 - DNA, 23 bp, Homo sapiens
cccagctactcagaagcctgagg

SEQ ID NO: 4168470 - DNA, 13 bp, Homo sapiens
cccagctcctctg

SEQ ID NO: 4168471 - DNA, 14 bp, Homo sapiens
cccagctcctctga

SEQ ID NO: 4168472 - DNA, 22 bp, Homo sapiens
cccagctctttgttcagttgac

SEQ ID NO: 4168473 - DNA, 12 bp, Homo sapiens
cccagctgcacc

SEQ ID NO: 4168474 - DNA, 13 bp, Homo sapiens
cccagctgcacct

SEQ ID NO: 4168475 - DNA, 23 bp, Homo sapiens
cccagctgcacctgccagcctgg

SEQ ID NO: 4168476 - DNA, 15 bp, Homo sapiens
cccaggagctctctg

SEQ ID NO: 4168477 - DNA, 19 bp, Homo sapiens
cccaggagctctctgctga

SEQ ID NO: 4168478 - DNA, 20 bp, Homo sapiens
cccaggagctctctgctgag

SEQ ID NO: 4168479 - DNA, 18 bp, Homo sapiens
cccaggaggctgaggcag

SEQ ID NO: 4168480 - DNA, 23 bp, Homo sapiens
cccaggagtttgaggctgcagcg

SEQ ID NO: 4168481 - DNA, 14 bp, Homo sapiens
cccaggcaggccac

SEQ ID NO: 4168482 - DNA, 13 bp, Homo sapiens
cccaggccaggcc

SEQ ID NO: 4168483 - DNA, 20 bp, Homo sapiens
cccaggccaggccaccagga

SEQ ID NO: 4168484 - DNA, 18 bp, Homo sapiens
cccagggacacctgggag

SEQ ID NO: 4168485 - DNA, 15 bp, Homo sapiens
cccagggccagggcc

SEQ ID NO: 4168486 - DNA, 18 bp, Homo sapiens
cccagggccagggccctg

SEQ ID NO: 4168487 - DNA, 20 bp, Homo sapiens
cccagggccagggccctgca

SEQ ID NO: 4168488 - DNA, 15 bp, Homo sapiens
cccagggctaccctc

SEQ ID NO: 4168489 - DNA, 19 bp, Homo sapiens
cccagggctccctcctgga

SEQ ID NO: 4168490 - DNA, 21 bp, Homo sapiens
cccagggctccctcctggagc

SEQ ID NO: 4168491 - DNA, 12 bp, Homo sapiens
cccagggtcctg

SEQ ID NO: 4168492 - DNA, 13 bp, Homo sapiens
cccagggtcctgg

SEQ ID NO: 4168493 - DNA, 14 bp, Homo sapiens
cccagtgccacaga

SEQ ID NO: 4168494 - DNA, 15 bp, Homo sapiens
cccagtgccacagag

SEQ ID NO: 4168495 - DNA, 16 bp, Homo sapiens
cccagtggtttccctt

SEQ ID NO: 4168496 - DNA, 17 bp, Homo sapiens
cccatcccctttcctcc

SEQ ID NO: 4168497 - DNA, 19 bp, Homo sapiens
cccatcccctttcctcccc

SEQ ID NO: 4168498 - DNA, 23 bp, Homo sapiens
cccatcccctttcctccccacct

SEQ ID NO: 4168499 - DNA, 11 bp, Homo sapiens
cccatctcagg

SEQ ID NO: 4168500 - DNA, 16 bp, Homo sapiens
cccatctcaggccaga

SEQ ID NO: 4168501 - DNA, 18 bp, Homo sapiens
cccatgaagacaggacag

SEQ ID NO: 4168502 - DNA, 14 bp, Homo sapiens
cccatgatccagaa

SEQ ID NO: 4168503 - DNA, 17 bp, Homo sapiens
cccatgcacctcagggc

SEQ ID NO: 4168504 - DNA, 20 bp, Homo sapiens
cccatgccctccctgctgcc

SEQ ID NO: 4168505 - DNA, 16 bp, Homo sapiens
cccattgctgacgatt

SEQ ID NO: 4168506 - DNA, 22 bp, Homo sapiens
cccattttggaagttttcagga

SEQ ID NO: 4168507 - DNA, 15 bp, Homo sapiens
ccccaaagagcctgg

SEQ ID NO: 4168508 - DNA, 14 bp, Homo sapiens
ccccaaaggcatcc

SEQ ID NO: 4168509 - DNA, 22 bp, Homo sapiens
ccccaacatctccctcccacat

SEQ ID NO: 4168510 - DNA, 13 bp, Homo sapiens
ccccaccccagag

SEQ ID NO: 4168511 - DNA, 22 bp, Homo sapiens
ccccaccctcaaaccctgtggg

SEQ ID NO: 4168512 - DNA, 14 bp, Homo sapiens
ccccacctcttcct

SEQ ID NO: 4168513 - DNA, 21 bp, Homo sapiens
ccccaccttcaattcctgggc

SEQ ID NO: 4168514 - DNA, 23 bp, Homo sapiens
ccccactccctggctctcagaag

SEQ ID NO: 4168515 - DNA, 18 bp, Homo sapiens
ccccagaggcctctctct

SEQ ID NO: 4168516 - DNA, 11 bp, Homo sapiens
ccccagagttg

SEQ ID NO: 4168517 - DNA, 23 bp, Homo sapiens
ccccagcagttgaatgacaacag

SEQ ID NO: 4168518 - DNA, 21 bp, Homo sapiens
ccccaggagctctctgctgag

SEQ ID NO: 4168519 - DNA, 12 bp, Homo sapiens
ccccaggccagg

SEQ ID NO: 4168520 - DNA, 13 bp, Homo sapiens
ccccaggccaggc

SEQ ID NO: 4168521 - DNA, 15 bp, Homo sapiens
ccccaggccaggcca

SEQ ID NO: 4168522 - DNA, 14 bp, Homo sapiens
ccccagtgccacag

SEQ ID NO: 4168523 - DNA, 20 bp, Homo sapiens
ccccagtgccacagagaaga

SEQ ID NO: 4168524 - DNA, 18 bp, Homo sapiens
ccccagttacaaaaatag

SEQ ID NO: 4168525 - DNA, 14 bp, Homo sapiens
ccccatctcaggcc

SEQ ID NO: 4168526 - DNA, 14 bp, Homo sapiens
ccccatgccctccc

SEQ ID NO: 4168527 - DNA, 15 bp, Homo sapiens
ccccatgccctccct

SEQ ID NO: 4168528 - DNA, 23 bp, Homo sapiens
cccccacccctaacctggcttat

SEQ ID NO: 4168529 - DNA, 11 bp, Homo sapiens
cccccatcccc

SEQ ID NO: 4168530 - DNA, 16 bp, Homo sapiens
cccccgacagcccagc

SEQ ID NO: 4168531 - DNA, 15 bp, Homo sapiens
ccccctccagctcca

SEQ ID NO: 4168532 - DNA, 10 bp, Homo sapiens
ccccctgggc

SEQ ID NO: 4168533 - DNA, 13 bp, Homo sapiens
ccccctgggctct

SEQ ID NO: 4168534 - DNA, 21 bp, Homo sapiens
ccccctggtggacagtcctgg

SEQ ID NO: 4168535 - DNA, 14 bp, Homo sapiens
ccccgctccagatc

SEQ ID NO: 4168536 - DNA, 17 bp, Homo sapiens
ccccgggtgcctcagag

SEQ ID NO: 4168537 - DNA, 12 bp, Homo sapiens
ccccgtgtggct

SEQ ID NO: 4168538 - DNA, 14 bp, Homo sapiens
ccccgtgtggctta

SEQ ID NO: 4168539 - DNA, 16 bp, Homo sapiens
cccctaacctggctta

SEQ ID NO: 4168540 - DNA, 11 bp, Homo sapiens
cccctccagct

SEQ ID NO: 4168541 - DNA, 15 bp, Homo sapiens
cccctccagctccag

SEQ ID NO: 4168542 - DNA, 14 bp, Homo sapiens
cccctccccagccc

SEQ ID NO: 4168543 - DNA, 20 bp, Homo sapiens
cccctccgcgagggctactc

SEQ ID NO: 4168544 - DNA, 17 bp, Homo sapiens
ccagacccacctggagc

SEQ ID NO: 4168545 - DNA, 19 bp, Homo sapiens
ccagacccacctggagccc

SEQ ID NO: 4168546 - DNA, 14 bp, Homo sapiens
ccagactcagctcc

SEQ ID NO: 4168547 - DNA, 16 bp, Homo sapiens
ccagagacaggaaaga

SEQ ID NO: 4168548 - DNA, 20 bp, Homo sapiens
ccagagaccccttcctttcc

SEQ ID NO: 4168549 - DNA, 20 bp, Homo sapiens
ccagagagaggatgcagagg

SEQ ID NO: 4168550 - DNA, 14 bp, Homo sapiens
ccagagcagagagc

SEQ ID NO: 4168551 - DNA, 20 bp, Homo sapiens
ccagagcattacgtgagcca

SEQ ID NO: 4168552 - DNA, 20 bp, Homo sapiens
ccagagccggggcactttca

SEQ ID NO: 4168553 - DNA, 18 bp, Homo sapiens
ccagagccttcaagtgcc

SEQ ID NO: 4168554 - DNA, 19 bp, Homo sapiens
ccagagccttcaagtgcca

SEQ ID NO: 4168555 - DNA, 18 bp, Homo sapiens
ccagagggcccaggcagg

SEQ ID NO: 4168556 - DNA, 14 bp, Homo sapiens
ccagagtcaggaag

SEQ ID NO: 4168557 - DNA, 16 bp, Homo sapiens
ccagagtcaggaagag

SEQ ID NO: 4168558 - DNA, 12 bp, Homo sapiens
ccagagtgtgaa

SEQ ID NO: 4168559 - DNA, 21 bp, Homo sapiens
ccagatacttcccattttgga

SEQ ID NO: 4168560 - DNA, 15 bp, Homo sapiens
ccagatgattttcct

SEQ ID NO: 4168561 - DNA, 13 bp, Homo sapiens
ccagatgccttcc

SEQ ID NO: 4168562 - DNA, 16 bp, Homo sapiens
ccagatgccttcctgt

SEQ ID NO: 4168563 - DNA, 16 bp, Homo sapiens
ccagcagacttgagtc

SEQ ID NO: 4168564 - DNA, 22 bp, Homo sapiens
ccagccactcgggaggctgaga

SEQ ID NO: 4168565 - DNA, 23 bp, Homo sapiens
ccagccaggatcccaagcgtccc

SEQ ID NO: 4168566 - DNA, 15 bp, Homo sapiens
ccagccggtgcctgg

SEQ ID NO: 4168567 - DNA, 11 bp, Homo sapiens
ccagcctgagc

SEQ ID NO: 4168568 - DNA, 12 bp, Homo sapiens
ccagcctgagca

SEQ ID NO: 4168569 - DNA, 18 bp, Homo sapiens
ccagcctggcttctggag

SEQ ID NO: 4168570 - DNA, 19 bp, Homo sapiens
ccagcctgggcgacagagc

SEQ ID NO: 4168571 - DNA, 20 bp, Homo sapiens
ccagcctgggcgacagagca

SEQ ID NO: 4168572 - DNA, 17 bp, Homo sapiens
ccagctactcagaagcc

SEQ ID NO: 4168573 - DNA, 14 bp, Homo sapiens
ccagctcctctgag

SEQ ID NO: 4168574 - DNA, 16 bp, Homo sapiens
ccagctcctctgagcc

SEQ ID NO: 4168575 - DNA, 14 bp, Homo sapiens
ccagctctcagggc

SEQ ID NO: 4168576 - DNA, 18 bp, Homo sapiens
ccagctctcagggctgtc

SEQ ID NO: 4168577 - DNA, 16 bp, Homo sapiens
ccagctctctctaccc

SEQ ID NO: 4168578 - DNA, 17 bp, Homo sapiens
ccagctgcacctgccag

SEQ ID NO: 4168579 - DNA, 23 bp, Homo sapiens
ccagctgcacctgccagcctggc

SEQ ID NO: 4168580 - DNA, 16 bp, Homo sapiens
ccagctgcctgggagg

SEQ ID NO: 4168581 - DNA, 14 bp, Homo sapiens
ccagctgtgcttat

SEQ ID NO: 4168582 - DNA, 14 bp, Homo sapiens
ccagcttctccagg

SEQ ID NO: 4168583 - DNA, 16 bp, Homo sapiens
ccagcttgctgagggg

SEQ ID NO: 4168584 - DNA, 15 bp, Homo sapiens
ccaggaagctttggt

SEQ ID NO: 4168585 - DNA, 22 bp, Homo sapiens
ccaggaagggggtccacccagc

SEQ ID NO: 4168586 - DNA, 19 bp, Homo sapiens
ccaggaatgcctcctccct

SEQ ID NO: 4168587 - DNA, 20 bp, Homo sapiens
ccaggactatagcccaggtc

SEQ ID NO: 4168588 - DNA, 17 bp, Homo sapiens
ccaggactccccaggcc

SEQ ID NO: 4168589 - DNA, 14 bp, Homo sapiens
ccaggagctctctg

SEQ ID NO: 4168590 - DNA, 16 bp, Homo sapiens
ccaggagctctctgct

SEQ ID NO: 4168591 - DNA, 17 bp, Homo sapiens
ccaggagctctctgctg

SEQ ID NO: 4168592 - DNA, 19 bp, Homo sapiens
ccaggaggctgaggcagga

SEQ ID NO: 4168593 - DNA, 18 bp, Homo sapiens
ccaggagggtaacagaag

SEQ ID NO: 4168594 - DNA, 19 bp, Homo sapiens
ccaggagggtaacagaaga

SEQ ID NO: 4168595 - DNA, 21 bp, Homo sapiens
ccaggagtttgaggctgcagc

SEQ ID NO: 4168596 - DNA, 16 bp, Homo sapiens
ccaggatagagactgg

SEQ ID NO: 4168597 - DNA, 18 bp, Homo sapiens
ccaggatagagactggaa

SEQ ID NO: 4168598 - DNA, 19 bp, Homo sapiens
ccaggatctttgactgaaa

SEQ ID NO: 4168599 - DNA, 16 bp, Homo sapiens
ccaggattgaagagca

SEQ ID NO: 4168600 - DNA, 18 bp, Homo sapiens
ccaggattgaagagcatt

SEQ ID NO: 4168601 - DNA, 19 bp, Homo sapiens
ccaggattggcctgtgtct

SEQ ID NO: 4168602 - DNA, 15 bp, Homo sapiens
ccaggattttgtgtt

SEQ ID NO: 4168603 - DNA, 23 bp, Homo sapiens
ccaggcaaagctggagatgaggc

SEQ ID NO: 4168604 - DNA, 16 bp, Homo sapiens
ccaggcaccccctgga

SEQ ID NO: 4168605 - DNA, 18 bp, Homo sapiens
ccaggcaccccctggaga

SEQ ID NO: 4168606 - DNA, 21 bp, Homo sapiens
ccaggcaccccctggagagaa

SEQ ID NO: 4168607 - DNA, 12 bp, Homo sapiens
ccaggcactgca

SEQ ID NO: 4168608 - DNA, 21 bp, Homo sapiens
ccaggcaggaggatcacttgg

SEQ ID NO: 4168609 - DNA, 19 bp, Homo sapiens
ccaggcaggggtgggagag

SEQ ID NO: 4168610 - DNA, 12 bp, Homo sapiens
ccaggcatgctg

SEQ ID NO: 4168611 - DNA, 14 bp, Homo sapiens
ccaggccaccagga

SEQ ID NO: 4168612 - DNA, 12 bp, Homo sapiens
ccaggccaggcc

SEQ ID NO: 4168613 - DNA, 16 bp, Homo sapiens
ccaggccagtgggcct

SEQ ID NO: 4168614 - DNA, 22 bp, Homo sapiens
ccaggccctaggattcctcccc

SEQ ID NO: 4168615 - DNA, 22 bp, Homo sapiens
ccaggccggtgtgggctgtgtc

SEQ ID NO: 4168616 - DNA, 18 bp, Homo sapiens
ccaggctcccactgcccc

SEQ ID NO: 4168617 - DNA, 13 bp, Homo sapiens
ccaggctctgcct

SEQ ID NO: 4168618 - DNA, 17 bp, Homo sapiens
ccaggctctgcctggag

SEQ ID NO: 4168619 - DNA, 23 bp, Homo sapiens
ccaggctctttggggtcagccag

SEQ ID NO: 4168620 - DNA, 18 bp, Homo sapiens
ccaggctttacagatgac

SEQ ID NO: 4168621 - DNA, 21 bp, Homo sapiens
ccagggaatccgcctgcagag

SEQ ID NO: 4168622 - DNA, 22 bp, Homo sapiens
ccagggaatccgcctgcagagg

SEQ ID NO: 4168623 - DNA, 13 bp, Homo sapiens
ccagggagaccga

SEQ ID NO: 4168624 - DNA, 12 bp, Homo sapiens
ccagggccaggg

SEQ ID NO: 4168625 - DNA, 17 bp, Homo sapiens
ccagggccagggccctg

SEQ ID NO: 4168626 - DNA, 14 bp, Homo sapiens
ccagggccctgcag

SEQ ID NO: 4168627 - DNA, 18 bp, Homo sapiens
ccaggggcccacagggaa

SEQ ID NO: 4168628 - DNA, 16 bp, Homo sapiens
ccaggggtctccctgg

SEQ ID NO: 4168629 - DNA, 20 bp, Homo sapiens
ccaggggtgatttcagagag

SEQ ID NO: 4168630 - DNA, 20 bp, Homo sapiens
ccaggggtgctatgacatgc

SEQ ID NO: 4168631 - DNA, 20 bp, Homo sapiens
ccagggtcctgggggctgct

SEQ ID NO: 4168632 - DNA, 18 bp, Homo sapiens
ccagggtctaaagagaac

SEQ ID NO: 4168633 - DNA, 16 bp, Homo sapiens
ccagggttgatcacac

SEQ ID NO: 4168634 - DNA, 15 bp, Homo sapiens
ccaggtatctccagg

SEQ ID NO: 4168635 - DNA, 18 bp, Homo sapiens
ccaggtatctccaggatt

SEQ ID NO: 4168636 - DNA, 23 bp, Homo sapiens
ccaggtcctcccgggagcacaga

SEQ ID NO: 4168637 - DNA, 22 bp, Homo sapiens
ccaggtcctctgatacccagag

SEQ ID NO: 4168638 - DNA, 15 bp, Homo sapiens
ccaggtttgctgtgt

SEQ ID NO: 4168639 - DNA, 16 bp, Homo sapiens
ccaggtttgctgtgtc

SEQ ID NO: 4168640 - DNA, 19 bp, Homo sapiens
ccagtaggaaatcaggcag

SEQ ID NO: 4168641 - DNA, 21 bp, Homo sapiens
ccagtcgtccgctcagccaag

SEQ ID NO: 4168642 - DNA, 20 bp, Homo sapiens
ccagtctggaagaagaggag

SEQ ID NO: 4168643 - DNA, 12 bp, Homo sapiens
ccagtcttgtgt

SEQ ID NO: 4168644 - DNA, 16 bp, Homo sapiens
ccagtgagggctgggc

SEQ ID NO: 4168645 - DNA, 12 bp, Homo sapiens
ccagtgccacag

SEQ ID NO: 4168646 - DNA, 15 bp, Homo sapiens
ccagtgccacagaga

SEQ ID NO: 4168647 - DNA, 19 bp, Homo sapiens
ccagtgcccaaagtctgtg

SEQ ID NO: 4168648 - DNA, 14 bp, Homo sapiens
ccagtgctggattt

SEQ ID NO: 4168649 - DNA, 21 bp, Homo sapiens
ccagtgggcctggtagcacat

SEQ ID NO: 4168650 - DNA, 15 bp, Homo sapiens
ccagtgtagccttgc

SEQ ID NO: 4168651 - DNA, 18 bp, Homo sapiens
ccagttacaaaaatagta

SEQ ID NO: 4168652 - DNA, 23 bp, Homo sapiens
ccagttggagttttttgtaccaa

SEQ ID NO: 4168653 - DNA, 19 bp, Homo sapiens
ccagttgttactgaagtta

SEQ ID NO: 4168654 - DNA, 23 bp, Homo sapiens
ccagttgttactgaagttatctg

SEQ ID NO: 4168655 - DNA, 20 bp, Homo sapiens
ccagtttagcccttccctgc

SEQ ID NO: 4168656 - DNA, 15 bp, Homo sapiens
ccagtttcagaagca

SEQ ID NO: 4168657 - DNA, 12 bp, Homo sapiens
ccagtttcccac

SEQ ID NO: 4168658 - DNA, 13 bp, Homo sapiens
ccagtttcccacc

SEQ ID NO: 4168659 - DNA, 19 bp, Homo sapiens
ccataaactgtacaaatga

SEQ ID NO: 4168660 - DNA, 13 bp, Homo sapiens
ccataacagccaa

SEQ ID NO: 4168661 - DNA, 20 bp, Homo sapiens
ccataaccaagaaatactaa

SEQ ID NO: 4168662 - DNA, 19 bp, Homo sapiens
ccataattgctttgccaaa

SEQ ID NO: 4168663 - DNA, 13 bp, Homo sapiens
ccatagagtttaa

SEQ ID NO: 4168664 - DNA, 21 bp, Homo sapiens
ccatagatgggtctggctgag

SEQ ID NO: 4168665 - DNA, 15 bp, Homo sapiens
ccatatgctccagga

SEQ ID NO: 4168666 - DNA, 22 bp, Homo sapiens
ccatattcagtgctgtggcctg

SEQ ID NO: 4168667 - DNA, 13 bp, Homo sapiens
ccatccaccctgc

SEQ ID NO: 4168668 - DNA, 13 bp, Homo sapiens
ccatcccctttcc

SEQ ID NO: 4168669 - DNA, 14 bp, Homo sapiens
ccatcccctttcct

SEQ ID NO: 4168670 - DNA, 15 bp, Homo sapiens
ccatcccctttcctc

SEQ ID NO: 4168671 - DNA, 20 bp, Homo sapiens
ccatcccctttcctccccac

SEQ ID NO: 4168672 - DNA, 13 bp, Homo sapiens
ccatccggctcct

SEQ ID NO: 4168673 - DNA, 14 bp, Homo sapiens
ccatcgtccagccc

SEQ ID NO: 4168674 - DNA, 18 bp, Homo sapiens
ccatcgtccagccctcct

SEQ ID NO: 4168675 - DNA, 20 bp, Homo sapiens
ccatctagtcacaaagactc

SEQ ID NO: 4168676 - DNA, 18 bp, Homo sapiens
ccatctcaggccagagcc

SEQ ID NO: 4168677 - DNA, 18 bp, Homo sapiens
ccatctcctttcagggaa

SEQ ID NO: 4168678 - DNA, 17 bp, Homo sapiens
ccatctctccagagagc

SEQ ID NO: 4168679 - DNA, 18 bp, Homo sapiens
ccatctctccagagagca

SEQ ID NO: 4168680 - DNA, 20 bp, Homo sapiens
ccatgaagacacgcttaaaa

SEQ ID NO: 4168681 - DNA, 17 bp, Homo sapiens
ccatgaagacaggacag

SEQ ID NO: 4168682 - DNA, 19 bp, Homo sapiens
ccatgatggtgctgacctc

SEQ ID NO: 4168683 - DNA, 23 bp, Homo sapiens
catttggtatattacctcaaatt

SEQ ID NO: 4168684 - DNA, 18 bp, Homo sapiens
cattttaatttatatttg

SEQ ID NO: 4168685 - DNA, 21 bp, Homo sapiens
cattttaatttatatttgaaa

SEQ ID NO: 4168686 - DNA, 16 bp, Homo sapiens
cattttactgattaac

SEQ ID NO: 4168687 - DNA, 19 bp, Homo sapiens
cattttactgattaacaaa

SEQ ID NO: 4168688 - DNA, 16 bp, Homo sapiens
cattttagacactggg

SEQ ID NO: 4168689 - DNA, 18 bp, Homo sapiens
cattttagttcctttatt

SEQ ID NO: 4168690 - DNA, 21 bp, Homo sapiens
cattttcgctttcctctggtt

SEQ ID NO: 4168691 - DNA, 20 bp, Homo sapiens
cattttctgtgtgtacatgt

SEQ ID NO: 4168692 - DNA, 17 bp, Homo sapiens
cattttgagtgactcga

SEQ ID NO: 4168693 - DNA, 13 bp, Homo sapiens
cattttgcctttc

SEQ ID NO: 4168694 - DNA, 16 bp, Homo sapiens
cattttggtactttgg

SEQ ID NO: 4168695 - DNA, 17 bp, Homo sapiens
catttttgatttatgca

SEQ ID NO: 4168696 - DNA, 23 bp, Homo sapiens
catttttggtaggcttatcaaaa

SEQ ID NO: 4168697 - DNA, 13 bp, Homo sapiens
ccaaaaatagcta

SEQ ID NO: 4168698 - DNA, 14 bp, Homo sapiens
ccaaaacaatgttt

SEQ ID NO: 4168699 - DNA, 21 bp, Homo sapiens
ccaaaataactgagaaagaga

SEQ ID NO: 4168700 - DNA, 13 bp, Homo sapiens
ccaaacactccac

SEQ ID NO: 4168701 - DNA, 13 bp, Homo sapiens
ccaaactctgcca

SEQ ID NO: 4168702 - DNA, 15 bp, Homo sapiens
ccaaactgtgccctg

SEQ ID NO: 4168703 - DNA, 14 bp, Homo sapiens
ccaaagagcctgga

SEQ ID NO: 4168704 - DNA, 22 bp, Homo sapiens
ccaaagagcctggagaagctga

SEQ ID NO: 4168705 - DNA, 16 bp, Homo sapiens
ccaaataaagataacc

SEQ ID NO: 4168706 - DNA, 20 bp, Homo sapiens
ccaaatccttagatctggca

SEQ ID NO: 4168707 - DNA, 17 bp, Homo sapiens
ccaaatgtccaatataa

SEQ ID NO: 4168708 - DNA, 17 bp, Homo sapiens
ccaaattatttgtgtaa

SEQ ID NO: 4168709 - DNA, 23 bp, Homo sapiens
ccaacaggtggcaggaccaggac

SEQ ID NO: 4168710 - DNA, 20 bp, Homo sapiens
ccaacagtgagtctgtcagc

SEQ ID NO: 4168711 - DNA, 15 bp, Homo sapiens
ccaacataaaaatga

SEQ ID NO: 4168712 - DNA, 14 bp, Homo sapiens
ccaacccacagcct

SEQ ID NO: 4168713 - DNA, 21 bp, Homo sapiens
ccaacctcccctggtcctgca

SEQ ID NO: 4168714 - DNA, 15 bp, Homo sapiens
ccaactaaataaaaa

SEQ ID NO: 4168715 - DNA, 19 bp, Homo sapiens
ccaactaaataaaaaattc

SEQ ID NO: 4168716 - DNA, 20 bp, Homo sapiens
ccaactcttctccaagtcta

SEQ ID NO: 4168717 - DNA, 13 bp, Homo sapiens
ccaacttggcttt

SEQ ID NO: 4168718 - DNA, 23 bp, Homo sapiens
ccaagaaactagtatctctggcc

SEQ ID NO: 4168719 - DNA, 22 bp, Homo sapiens
ccaagaccaagtcctcaaagca

SEQ ID NO: 4168720 - DNA, 20 bp, Homo sapiens
ccaagacttggcaacagaag

SEQ ID NO: 4168721 - DNA, 22 bp, Homo sapiens
ccaagacttggcaacagaagca

SEQ ID NO: 4168722 - DNA, 22 bp, Homo sapiens
ccaagagctacgtatttaatag

SEQ ID NO: 4168723 - DNA, 16 bp, Homo sapiens
ccaagatcgcgccact

SEQ ID NO: 4168724 - DNA, 17 bp, Homo sapiens
ccaagcgggggcgtggc

SEQ ID NO: 4168725 - DNA, 18 bp, Homo sapiens
ccaagctctagtgggaag

SEQ ID NO: 4168726 - DNA, 12 bp, Homo sapiens
ccaagctggcag

SEQ ID NO: 4168727 - DNA, 14 bp, Homo sapiens
ccaaggaacaagag

SEQ ID NO: 4168728 - DNA, 14 bp, Homo sapiens
ccaaggaccaggtt

SEQ ID NO: 4168729 - DNA, 18 bp, Homo sapiens
ccaaggataattaaatat

SEQ ID NO: 4168730 - DNA, 16 bp, Homo sapiens
ccaagggctaggctct

SEQ ID NO: 4168731 - DNA, 16 bp, Homo sapiens
ccaaggggcttcaggt

SEQ ID NO: 4168732 - DNA, 20 bp, Homo sapiens
ccaagggtatgggaagccat

SEQ ID NO: 4168733 - DNA, 17 bp, Homo sapiens
ccaaggtcttcagccat

SEQ ID NO: 4168734 - DNA, 19 bp, Homo sapiens
ccaaggtcttcagccatca

SEQ ID NO: 4168735 - DNA, 18 bp, Homo sapiens
ccaaggtgggctgagccc

SEQ ID NO: 4168736 - DNA, 21 bp, Homo sapiens
ccaagtcaacactcttcttga

SEQ ID NO: 4168737 - DNA, 20 bp, Homo sapiens
ccaagtccaacctgcctgtg

SEQ ID NO: 4168738 - DNA, 22 bp, Homo sapiens
ccaagtccaacctgcctgtgca

SEQ ID NO: 4168739 - DNA, 16 bp, Homo sapiens
ccaagtctacttcact

SEQ ID NO: 4168740 - DNA, 16 bp, Homo sapiens
ccaagtgccagtcttg

SEQ ID NO: 4168741 - DNA, 19 bp, Homo sapiens
ccaatcagagagcctagaa

SEQ ID NO: 4168742 - DNA, 18 bp, Homo sapiens
ccaatgcacctaaagaaa

SEQ ID NO: 4168743 - DNA, 19 bp, Homo sapiens
ccaatgtctgatttaacac

SEQ ID NO: 4168744 - DNA, 13 bp, Homo sapiens
ccacaaaaattga

SEQ ID NO: 4168745 - DNA, 18 bp, Homo sapiens
ccacaaaactctgtcagg

SEQ ID NO: 4168746 - DNA, 16 bp, Homo sapiens
ccacaaagccgtgcct

SEQ ID NO: 4168747 - DNA, 18 bp, Homo sapiens
ccacaaccctgttttata

SEQ ID NO: 4168748 - DNA, 15 bp, Homo sapiens
ccacaagaaatttga

SEQ ID NO: 4168749 - DNA, 18 bp, Homo sapiens
ccacaagccttactcacc

SEQ ID NO: 4168750 - DNA, 13 bp, Homo sapiens
ccacaatctggct

SEQ ID NO: 4168751 - DNA, 22 bp, Homo sapiens
ccacacacgcaggaactcccag

SEQ ID NO: 4168752 - DNA, 16 bp, Homo sapiens
ccacaccaatcagaga

SEQ ID NO: 4168753 - DNA, 17 bp, Homo sapiens
ccacaccaatcagagag

SEQ ID NO: 4168754 - DNA, 23 bp, Homo sapiens
ccacaccaatcagagagcctaga

SEQ ID NO: 4168755 - DNA, 15 bp, Homo sapiens
ccacaccgcagaagc

SEQ ID NO: 4168756 - DNA, 13 bp, Homo sapiens
ccacactggtgac

SEQ ID NO: 4168757 - DNA, 12 bp, Homo sapiens
ccacagagcctg

SEQ ID NO: 4168758 - DNA, 13 bp, Homo sapiens
ccacagagcctgg

SEQ ID NO: 4168759 - DNA, 14 bp, Homo sapiens
ccacagagcctggc

SEQ ID NO: 4168760 - DNA, 16 bp, Homo sapiens
ccacagataactgaaa

SEQ ID NO: 4168761 - DNA, 14 bp, Homo sapiens
ccacagcagctgaa

SEQ ID NO: 4168762 - DNA, 18 bp, Homo sapiens
ccacagccgcagcctccc

SEQ ID NO: 4168763 - DNA, 17 bp, Homo sapiens
ccacagcgtgggaactc

SEQ ID NO: 4168764 - DNA, 15 bp, Homo sapiens
ccacagtcctcacag

SEQ ID NO: 4168765 - DNA, 18 bp, Homo sapiens
ccacattgacagtggtgg

SEQ ID NO: 4168766 - DNA, 18 bp, Homo sapiens
ccacattggacttccttg

SEQ ID NO: 4168767 - DNA, 17 bp, Homo sapiens
ccaccaaggtcttcagc

SEQ ID NO: 4168768 - DNA, 13 bp, Homo sapiens
ccaccacactccc

SEQ ID NO: 4168769 - DNA, 11 bp, Homo sapiens
ccaccacgtgc

SEQ ID NO: 4168770 - DNA, 17 bp, Homo sapiens
ccaccagacccacctgg

SEQ ID NO: 4168771 - DNA, 18 bp, Homo sapiens
ccaccagacccacctgga

SEQ ID NO: 4168772 - DNA, 11 bp, Homo sapiens
ccaccagggca

SEQ ID NO: 4168773 - DNA, 13 bp, Homo sapiens
ccaccagggcact

SEQ ID NO: 4168774 - DNA, 17 bp, Homo sapiens
ccaccagggcactgtct

SEQ ID NO: 4168775 - DNA, 22 bp, Homo sapiens
ccaccagggcactgtctgcgtg

SEQ ID NO: 4168776 - DNA, 22 bp, Homo sapiens
ccaccatattcagtgctgtggc

SEQ ID NO: 4168777 - DNA, 23 bp, Homo sapiens
ccaccatattcagtgctgtggcc

SEQ ID NO: 4168778 - DNA, 16 bp, Homo sapiens
ccaccatgccaggcta

SEQ ID NO: 4168779 - DNA, 15 bp, Homo sapiens
ccacccagggctccc

SEQ ID NO: 4168780 - DNA, 12 bp, Homo sapiens
ccaccccagagt

SEQ ID NO: 4168781 - DNA, 14 bp, Homo sapiens
ccacccccatgcag

SEQ ID NO: 4168782 - DNA, 21 bp, Homo sapiens
ccacccccgccgtggggctcc

SEQ ID NO: 4168783 - DNA, 14 bp, Homo sapiens
ccaccccctccagc

SEQ ID NO: 4168784 - DNA, 15 bp, Homo sapiens
ccaccccctccagct

SEQ ID NO: 4168785 - DNA, 18 bp, Homo sapiens
ccaccctaaaatgacagc

SEQ ID NO: 4168786 - DNA, 17 bp, Homo sapiens
ccaccctcgtggacacc

SEQ ID NO: 4168787 - DNA, 18 bp, Homo sapiens
ccaccctcgtggacacct

SEQ ID NO: 4168788 - DNA, 21 bp, Homo sapiens
ccaccctcgtggacacctgcc

SEQ ID NO: 4168789 - DNA, 16 bp, Homo sapiens
ccaccgcagaaggaag

SEQ ID NO: 4168790 - DNA, 22 bp, Homo sapiens
ccaccgctgccttttgctgctg

SEQ ID NO: 4168791 - DNA, 17 bp, Homo sapiens
ccacctcatgcctggcc

SEQ ID NO: 4168792 - DNA, 12 bp, Homo sapiens
ccacctcttcct

SEQ ID NO: 4168793 - DNA, 15 bp, Homo sapiens
ccacctgcctatcca

SEQ ID NO: 4168794 - DNA, 19 bp, Homo sapiens
ccacctgcctatccatcct

SEQ ID NO: 4168795 - DNA, 20 bp, Homo sapiens
ccacctgcctatccatcctg

SEQ ID NO: 4168796 - DNA, 15 bp, Homo sapiens
ccacctggagcccgc

SEQ ID NO: 4168797 - DNA, 11 bp, Homo sapiens
ccacctgtctg

SEQ ID NO: 4168798 - DNA, 18 bp, Homo sapiens
ccaccttcaattcctggg

SEQ ID NO: 4168799 - DNA, 20 bp, Homo sapiens
ccaccttcaattcctgggcc

SEQ ID NO: 4168800 - DNA, 12 bp, Homo sapiens
ccaccttcccca

SEQ ID NO: 4168801 - DNA, 18 bp, Homo sapiens
ccaccttccccagactca

SEQ ID NO: 4168802 - DNA, 12 bp, Homo sapiens
ccaccttccctc

SEQ ID NO: 4168803 - DNA, 22 bp, Homo sapiens
ccaccttggactcctcccacaa

SEQ ID NO: 4168804 - DNA, 19 bp, Homo sapiens
ccacgcccgactagcaggc

SEQ ID NO: 4168805 - DNA, 13 bp, Homo sapiens
ccacggggagggg

SEQ ID NO: 4168806 - DNA, 21 bp, Homo sapiens
ccactaagctttctcctttga

SEQ ID NO: 4168807 - DNA, 13 bp, Homo sapiens
ccactcaggccaa

SEQ ID NO: 4168808 - DNA, 20 bp, Homo sapiens
ccactccaagatgccctcat

SEQ ID NO: 4168809 - DNA, 24 bp, Homo sapiens
ccactccaggctttacagatgact

SEQ ID NO: 4168810 - DNA, 16 bp, Homo sapiens
ccactccccaccttca

SEQ ID NO: 4168811 - DNA, 15 bp, Homo sapiens
ccactctcccctccc

SEQ ID NO: 4168812 - DNA, 18 bp, Homo sapiens
ccactctcccctccctct

SEQ ID NO: 4168813 - DNA, 17 bp, Homo sapiens
ccactgcactccagcct

SEQ ID NO: 4168814 - DNA, 13 bp, Homo sapiens
ccactggccctgg

SEQ ID NO: 4168815 - DNA, 15 bp, Homo sapiens
ccactgtccgcctct

SEQ ID NO: 4168816 - DNA, 15 bp, Homo sapiens
ccacttgtcatccat

SEQ ID NO: 4168817 - DNA, 18 bp, Homo sapiens
ccactttggtcccgtgca

SEQ ID NO: 4168818 - DNA, 21 bp, Homo sapiens
ccactttggtcccgtgcagct

SEQ ID NO: 4168819 - DNA, 19 bp, Homo sapiens
ccagaaagaaggacacttg

SEQ ID NO: 4168820 - DNA, 22 bp, Homo sapiens
ccagaacaaggttccctctgag

SEQ ID NO: 4168821 - DNA, 14 bp, Homo sapiens
ccagaaccacagat

SEQ ID NO: 4168822 - DNA, 20 bp, Homo sapiens
ccagaatcttcgtcctgccc

SEQ ID NO: 4168823 - DNA, 16 bp, Homo sapiens
catccataaagcaagc

SEQ ID NO: 4168824 - DNA, 15 bp, Homo sapiens
catccatagtgcact

SEQ ID NO: 4168825 - DNA, 22 bp, Homo sapiens
catcccaggcgggcggcacgcc

SEQ ID NO: 4168826 - DNA, 23 bp, Homo sapiens
catccccaaactgtgccctgcct

SEQ ID NO: 4168827 - DNA, 16 bp, Homo sapiens
catccccacaatctgg

SEQ ID NO: 4168828 - DNA, 19 bp, Homo sapiens
catccccacaatctggctt

SEQ ID NO: 4168829 - DNA, 16 bp, Homo sapiens
catcccccagcactga

SEQ ID NO: 4168830 - DNA, 19 bp, Homo sapiens
catccccttgaactcttca

SEQ ID NO: 4168831 - DNA, 12 bp, Homo sapiens
catcccctttcc

SEQ ID NO: 4168832 - DNA, 13 bp, Homo sapiens
catccctgggcaa

SEQ ID NO: 4168833 - DNA, 16 bp, Homo sapiens
catcccttccctgtcc

SEQ ID NO: 4168834 - DNA, 11 bp, Homo sapiens
catccttaaag

SEQ ID NO: 4168835 - DNA, 12 bp, Homo sapiens
catccttctgcc

SEQ ID NO: 4168836 - DNA, 14 bp, Homo sapiens
catcgtccagccct

SEQ ID NO: 4168837 - DNA, 21 bp, Homo sapiens
catctagagattttcttggca

SEQ ID NO: 4168838 - DNA, 14 bp, Homo sapiens
catctcaggccaga

SEQ ID NO: 4168839 - DNA, 17 bp, Homo sapiens
catctcaggccagagcc

SEQ ID NO: 4168840 - DNA, 21 bp, Homo sapiens
catctcagtgaagaatacttc

SEQ ID NO: 4168841 - DNA, 23 bp, Homo sapiens
catctcctcccatggccttccct

SEQ ID NO: 4168842 - DNA, 15 bp, Homo sapiens
catctctccagagag

SEQ ID NO: 4168843 - DNA, 20 bp, Homo sapiens
catctctccagagagcaaac

SEQ ID NO: 4168844 - DNA, 19 bp, Homo sapiens
catctgaaccactttgcct

SEQ ID NO: 4168845 - DNA, 16 bp, Homo sapiens
catctggattccagag

SEQ ID NO: 4168846 - DNA, 12 bp, Homo sapiens
catctgttgttt

SEQ ID NO: 4168847 - DNA, 17 bp, Homo sapiens
catcttgacatgtaatg

SEQ ID NO: 4168848 - DNA, 13 bp, Homo sapiens
catctttcctgtc

SEQ ID NO: 4168849 - DNA, 19 bp, Homo sapiens
catcttttaattcacctct

SEQ ID NO: 4168850 - DNA, 21 bp, Homo sapiens
catgaaaaacacggcagctgt

SEQ ID NO: 4168851 - DNA, 17 bp, Homo sapiens
catgaagaccacatcca

SEQ ID NO: 4168852 - DNA, 18 bp, Homo sapiens
catgaattccaactcact

SEQ ID NO: 4168853 - DNA, 17 bp, Homo sapiens
catgacatgttatatat

SEQ ID NO: 4168854 - DNA, 15 bp, Homo sapiens
catgacttttccatg

SEQ ID NO: 4168855 - DNA, 17 bp, Homo sapiens
catgagaaaatcagtaa

SEQ ID NO: 4168856 - DNA, 13 bp, Homo sapiens
catgagaaataca

SEQ ID NO: 4168857 - DNA, 12 bp, Homo sapiens
catgaggaaaga

SEQ ID NO: 4168858 - DNA, 20 bp, Homo sapiens
catgatactttaatttttat

SEQ ID NO: 4168859 - DNA, 15 bp, Homo sapiens
catgatctcggctta

SEQ ID NO: 4168860 - DNA, 18 bp, Homo sapiens
catgatttagggaagcag

SEQ ID NO: 4168861 - DNA, 19 bp, Homo sapiens
catgatttagggaagcagg

SEQ ID NO: 4168862 - DNA, 20 bp, Homo sapiens
catgatttagggaagcaggg

SEQ ID NO: 4168863 - DNA, 22 bp, Homo sapiens
catgcaattggggaagaaaaaa

SEQ ID NO: 4168864 - DNA, 15 bp, Homo sapiens
catgcacactgttgg

SEQ ID NO: 4168865 - DNA, 15 bp, Homo sapiens
catgcagaagtgcat

SEQ ID NO: 4168866 - DNA, 15 bp, Homo sapiens
catgcatcatcagcc

SEQ ID NO: 4168867 - DNA, 15 bp, Homo sapiens
catgcatctgtttat

SEQ ID NO: 4168868 - DNA, 14 bp, Homo sapiens
catgcattcataca

SEQ ID NO: 4168869 - DNA, 19 bp, Homo sapiens
catgccaaagcaaaagaag

SEQ ID NO: 4168870 - DNA, 17 bp, Homo sapiens
catgccctccccacttc

SEQ ID NO: 4168871 - DNA, 13 bp, Homo sapiens
catgcccttctga

SEQ ID NO: 4168872 - DNA, 14 bp, Homo sapiens
catgcccttctgat

SEQ ID NO: 4168873 - DNA, 18 bp, Homo sapiens
catgcctggcccccctcc

SEQ ID NO: 4168874 - DNA, 21 bp, Homo sapiens
catgcctggcccccctccagg

SEQ ID NO: 4168875 - DNA, 24 bp, Homo sapiens
catgcctgggaatcctgctgccag

SEQ ID NO: 4168876 - DNA, 13 bp, Homo sapiens
catgctaagagaa

SEQ ID NO: 4168877 - DNA, 16 bp, Homo sapiens
catgctaagagaagta

SEQ ID NO: 4168878 - DNA, 15 bp, Homo sapiens
catgctcagccctga

SEQ ID NO: 4168879 - DNA, 22 bp, Homo sapiens
catgctggaaaataatactgct

SEQ ID NO: 4168880 - DNA, 23 bp, Homo sapiens
catgctggcggcgcagagggaag

SEQ ID NO: 4168881 - DNA, 14 bp, Homo sapiens
catgcttcttctca

SEQ ID NO: 4168882 - DNA, 13 bp, Homo sapiens
catgctttctcct

SEQ ID NO: 4168883 - DNA, 17 bp, Homo sapiens
catgctttctccttttt

SEQ ID NO: 4168884 - DNA, 14 bp, Homo sapiens
catggaaggttaga

SEQ ID NO: 4168885 - DNA, 18 bp, Homo sapiens
catggaatttaatttatg

SEQ ID NO: 4168886 - DNA, 19 bp, Homo sapiens
catggaatttgtaagttta

SEQ ID NO: 4168887 - DNA, 13 bp, Homo sapiens
catggacacagac

SEQ ID NO: 4168888 - DNA, 14 bp, Homo sapiens
catggagaggtttg

SEQ ID NO: 4168889 - DNA, 20 bp, Homo sapiens
catggagaggtttgtcaaca

SEQ ID NO: 4168890 - DNA, 16 bp, Homo sapiens
catggccacaaaggga

SEQ ID NO: 4168891 - DNA, 15 bp, Homo sapiens
catggccccaggccc

SEQ ID NO: 4168892 - DNA, 12 bp, Homo sapiens
catggccttccc

SEQ ID NO: 4168893 - DNA, 23 bp, Homo sapiens
catggctgtggttcctaagcctg

SEQ ID NO: 4168894 - DNA, 15 bp, Homo sapiens
catggcttagaaatc

SEQ ID NO: 4168895 - DNA, 14 bp, Homo sapiens
catggtcctttctg

SEQ ID NO: 4168896 - DNA, 19 bp, Homo sapiens
catggtcctttctggaagt

SEQ ID NO: 4168897 - DNA, 20 bp, Homo sapiens
catggtgctttcaggtctgg

SEQ ID NO: 4168898 - DNA, 14 bp, Homo sapiens
catgtaatcagttt

SEQ ID NO: 4168899 - DNA, 17 bp, Homo sapiens
catgtactcaagtacca

SEQ ID NO: 4168900 - DNA, 15 bp, Homo sapiens
catgtatgtgtgtgt

SEQ ID NO: 4168901 - DNA, 18 bp, Homo sapiens
catgtcagagccaggctc

SEQ ID NO: 4168902 - DNA, 21 bp, Homo sapiens
catgtcagagccaggctctgc

SEQ ID NO: 4168903 - DNA, 19 bp, Homo sapiens
catgtccttgtgtgttttg

SEQ ID NO: 4168904 - DNA, 15 bp, Homo sapiens
catgtctcacagacg

SEQ ID NO: 4168905 - DNA, 22 bp, Homo sapiens
catgtgaggactgggggcacct

SEQ ID NO: 4168906 - DNA, 13 bp, Homo sapiens
catgttatatatt

SEQ ID NO: 4168907 - DNA, 21 bp, Homo sapiens
catgtttgtctgtgtgctgta

SEQ ID NO: 4168908 - DNA, 15 bp, Homo sapiens
cattaagtggctttt

SEQ ID NO: 4168909 - DNA, 17 bp, Homo sapiens
cattactataagaactt

SEQ ID NO: 4168910 - DNA, 19 bp, Homo sapiens
cattagcacatatttcaca

SEQ ID NO: 4168911 - DNA, 19 bp, Homo sapiens
cattatactctctgaaata

SEQ ID NO: 4168912 - DNA, 12 bp, Homo sapiens
cattatttaata

SEQ ID NO: 4168913 - DNA, 15 bp, Homo sapiens
cattatttaataaga

SEQ ID NO: 4168914 - DNA, 12 bp, Homo sapiens
cattcacagccc

SEQ ID NO: 4168915 - DNA, 17 bp, Homo sapiens
cattcagaagaaaaaga

SEQ ID NO: 4168916 - DNA, 17 bp, Homo sapiens
cattcaggaagatgaaa

SEQ ID NO: 4168917 - DNA, 16 bp, Homo sapiens
cattcagggttataca

SEQ ID NO: 4168918 - DNA, 18 bp, Homo sapiens
cattcatgccaaagcaaa

SEQ ID NO: 4168919 - DNA, 18 bp, Homo sapiens
cattccaagtcaacactc

SEQ ID NO: 4168920 - DNA, 14 bp, Homo sapiens
cattccagggttgg

SEQ ID NO: 4168921 - DNA, 16 bp, Homo sapiens
cattcccaagccatgg

SEQ ID NO: 4168922 - DNA, 20 bp, Homo sapiens
cattcccactaagctttctc

SEQ ID NO: 4168923 - DNA, 23 bp, Homo sapiens
cattcccactaagctttctcctt

SEQ ID NO: 4168924 - DNA, 20 bp, Homo sapiens
cattcccattggttctccta

SEQ ID NO: 4168925 - DNA, 14 bp, Homo sapiens
cattcctgttctct

SEQ ID NO: 4168926 - DNA, 18 bp, Homo sapiens
cattcctgttctctttgc

SEQ ID NO: 4168927 - DNA, 23 bp, Homo sapiens
cattcgaggtgtcaccctgcaga

SEQ ID NO: 4168928 - DNA, 16 bp, Homo sapiens
cattctcatctactca

SEQ ID NO: 4168929 - DNA, 21 bp, Homo sapiens
cattctgaaaatagcaggaca

SEQ ID NO: 4168930 - DNA, 21 bp, Homo sapiens
cattcttagactagttgaaca

SEQ ID NO: 4168931 - DNA, 19 bp, Homo sapiens
cattgaaaaaaatatatga

SEQ ID NO: 4168932 - DNA, 22 bp, Homo sapiens
cattgacagtggtgggcgggga

SEQ ID NO: 4168933 - DNA, 10 bp, Homo sapiens
cattggagct

SEQ ID NO: 4168934 - DNA, 12 bp, Homo sapiens
cattggagctga

SEQ ID NO: 4168935 - DNA, 16 bp, Homo sapiens
cattggagctgactgt

SEQ ID NO: 4168936 - DNA, 16 bp, Homo sapiens
cattgggaccctccag

SEQ ID NO: 4168937 - DNA, 20 bp, Homo sapiens
cattgggaccctccagtgct

SEQ ID NO: 4168938 - DNA, 23 bp, Homo sapiens
cattgggaccctccagtgctgga

SEQ ID NO: 4168939 - DNA, 23 bp, Homo sapiens
cattgggttgtagccaaaggttc

SEQ ID NO: 4168940 - DNA, 16 bp, Homo sapiens
cattgtactccagcct

SEQ ID NO: 4168941 - DNA, 19 bp, Homo sapiens
cattgtagagcttggtggc

SEQ ID NO: 4168942 - DNA, 23 bp, Homo sapiens
cattgtagagcttggtggctgag

SEQ ID NO: 4168943 - DNA, 16 bp, Homo sapiens
cattgtctcagtgctg

SEQ ID NO: 4168944 - DNA, 15 bp, Homo sapiens
cattgtgatgattat

SEQ ID NO: 4168945 - DNA, 17 bp, Homo sapiens
cattgtgcttaataata

SEQ ID NO: 4168946 - DNA, 18 bp, Homo sapiens
cattgtgcttaataatac

SEQ ID NO: 4168947 - DNA, 20 bp, Homo sapiens
catttaagcaggaatgcaat

SEQ ID NO: 4168948 - DNA, 16 bp, Homo sapiens
catttcaactccagaa

SEQ ID NO: 4168949 - DNA, 16 bp, Homo sapiens
catttcaattctcaaa

SEQ ID NO: 4168950 - DNA, 15 bp, Homo sapiens
catttccatggctct

SEQ ID NO: 4168951 - DNA, 18 bp, Homo sapiens
catttctactgtgactga

SEQ ID NO: 4168952 - DNA, 22 bp, Homo sapiens
catttctcagtcggtgtgtaat

SEQ ID NO: 4168953 - DNA, 15 bp, Homo sapiens
catttgataaactaa

SEQ ID NO: 4168954 - DNA, 19 bp, Homo sapiens
catttgataaactaaaagc

SEQ ID NO: 4168955 - DNA, 17 bp, Homo sapiens
catttgcaaacctcaga

SEQ ID NO: 4168956 - DNA, 19 bp, Homo sapiens
catttgcaaacctcagagg

SEQ ID NO: 4168957 - DNA, 17 bp, Homo sapiens
catttgccattcctgga

SEQ ID NO: 4168958 - DNA, 12 bp, Homo sapiens
catttgccctgt

SEQ ID NO: 4168959 - DNA, 23 bp, Homo sapiens
catttgccctgtggattccagca

SEQ ID NO: 4168960 - DNA, 13 bp, Homo sapiens
catttgctttttg

SEQ ID NO: 4168961 - DNA, 14 bp, Homo sapiens
catttggaaatcag

SEQ ID NO: 4168962 - DNA, 17 bp, Homo sapiens
catttggacaaaatgga

SEQ ID NO: 4168963 - DNA, 22 bp, Homo sapiens
caggtatctccaggattgaaga

SEQ ID NO: 4168964 - DNA, 20 bp, Homo sapiens
caggtcaccagcctgactgc

SEQ ID NO: 4168965 - DNA, 15 bp, Homo sapiens
caggtccaggccagt

SEQ ID NO: 4168966 - DNA, 18 bp, Homo sapiens
caggtccaggccagtggg

SEQ ID NO: 4168967 - DNA, 17 bp, Homo sapiens
caggtccggaggggttg

SEQ ID NO: 4168968 - DNA, 22 bp, Homo sapiens
caggtcctcccgggagcacaga

SEQ ID NO: 4168969 - DNA, 21 bp, Homo sapiens
caggtcctctgatacccagag

SEQ ID NO: 4168970 - DNA, 21 bp, Homo sapiens
caggtctggggcttttagagc

SEQ ID NO: 4168971 - DNA, 15 bp, Homo sapiens
caggtgcctggcttg

SEQ ID NO: 4168972 - DNA, 20 bp, Homo sapiens
caggtgcctggcttgctgtg

SEQ ID NO: 4168973 - DNA, 17 bp, Homo sapiens
caggtggcaggaccagg

SEQ ID NO: 4168974 - DNA, 20 bp, Homo sapiens
caggtggcaggaccaggact

SEQ ID NO: 4168975 - DNA, 20 bp, Homo sapiens
caggtggtcctgagacctga

SEQ ID NO: 4168976 - DNA, 15 bp, Homo sapiens
caggtgtaataagac

SEQ ID NO: 4168977 - DNA, 15 bp, Homo sapiens
caggtgttggaagcc

SEQ ID NO: 4168978 - DNA, 19 bp, Homo sapiens
caggtgttggaagccagga

SEQ ID NO: 4168979 - DNA, 20 bp, Homo sapiens
caggttgaggggctcctgga

SEQ ID NO: 4168980 - DNA, 21 bp, Homo sapiens
caggttgaggggctcctggaa

SEQ ID NO: 4168981 - DNA, 16 bp, Homo sapiens
caggtttgctgtgtct

SEQ ID NO: 4168982 - DNA, 14 bp, Homo sapiens
cagtaaataaattg

SEQ ID NO: 4168983 - DNA, 16 bp, Homo sapiens
cagtaaataaattgtt

SEQ ID NO: 4168984 - DNA, 21 bp, Homo sapiens
cagtacagagaaattctgtgg

SEQ ID NO: 4168985 - DNA, 22 bp, Homo sapiens
cagtagactcatcttttgaaac

SEQ ID NO: 4168986 - DNA, 22 bp, Homo sapiens
cagtaggtaatgattatgtgtc

SEQ ID NO: 4168987 - DNA, 20 bp, Homo sapiens
cagtaggttatttagcttgg

SEQ ID NO: 4168988 - DNA, 14 bp, Homo sapiens
cagtataaaagaca

SEQ ID NO: 4168989 - DNA, 15 bp, Homo sapiens
cagtataaaagacaa

SEQ ID NO: 4168990 - DNA, 16 bp, Homo sapiens
cagtataaaagacaaa

SEQ ID NO: 4168991 - DNA, 15 bp, Homo sapiens
cagtatatttatagt

SEQ ID NO: 4168992 - DNA, 14 bp, Homo sapiens
cagtatatttctga

SEQ ID NO: 4168993 - DNA, 15 bp, Homo sapiens
cagtatctcttgctg

SEQ ID NO: 4168994 - DNA, 17 bp, Homo sapiens
cagtatgttacatgcat

SEQ ID NO: 4168995 - DNA, 16 bp, Homo sapiens
cagtattcttgtcaaa

SEQ ID NO: 4168996 - DNA, 19 bp, Homo sapiens
cagtattcttgtcaaaaaa

SEQ ID NO: 4168997 - DNA, 17 bp, Homo sapiens
cagtattttggagaaat

SEQ ID NO: 4168998 - DNA, 18 bp, Homo sapiens
cagtattttggagaaatt

SEQ ID NO: 4168999 - DNA, 13 bp, Homo sapiens
cagtcagggccca

SEQ ID NO: 4169000 - DNA, 16 bp, Homo sapiens
cagtcagggcccagag

SEQ ID NO: 4169001 - DNA, 18 bp, Homo sapiens
cagtccagatgccttcct

SEQ ID NO: 4169002 - DNA, 20 bp, Homo sapiens
cagtccagatgccttcctgt

SEQ ID NO: 4169003 - DNA, 19 bp, Homo sapiens
cagtccgccaaacactcca

SEQ ID NO: 4169004 - DNA, 21 bp, Homo sapiens
cagtcctgggagaacctcagg

SEQ ID NO: 4169005 - DNA, 19 bp, Homo sapiens
cagtccttattatcccagc

SEQ ID NO: 4169006 - DNA, 21 bp, Homo sapiens
cagtccttattatcccagctt

SEQ ID NO: 4169007 - DNA, 17 bp, Homo sapiens
cagtcgtccgctcagcc

SEQ ID NO: 4169008 - DNA, 19 bp, Homo sapiens
cagtcgtccgctcagccaa

SEQ ID NO: 4169009 - DNA, 22 bp, Homo sapiens
cagtctagattagaagtgtttt

SEQ ID NO: 4169010 - DNA, 14 bp, Homo sapiens
cagtctcaggagca

SEQ ID NO: 4169011 - DNA, 14 bp, Homo sapiens
cagtctcagtccag

SEQ ID NO: 4169012 - DNA, 15 bp, Homo sapiens
cagtctggaagaaga

SEQ ID NO: 4169013 - DNA, 15 bp, Homo sapiens
cagtctggagaaggt

SEQ ID NO: 4169014 - DNA, 19 bp, Homo sapiens
cagtctgtgggagctcagc

SEQ ID NO: 4169015 - DNA, 16 bp, Homo sapiens
cagtcttaccaatgac

SEQ ID NO: 4169016 - DNA, 14 bp, Homo sapiens
cagtcttgcctagg

SEQ ID NO: 4169017 - DNA, 14 bp, Homo sapiens
cagtgaagacagaa

SEQ ID NO: 4169018 - DNA, 15 bp, Homo sapiens
cagtgacaaaaggct

SEQ ID NO: 4169019 - DNA, 18 bp, Homo sapiens
cagtgacgtgcacctgta

SEQ ID NO: 4169020 - DNA, 13 bp, Homo sapiens
cagtgagggctgg

SEQ ID NO: 4169021 - DNA, 21 bp, Homo sapiens
cagtgatcctcaaacacacaa

SEQ ID NO: 4169022 - DNA, 20 bp, Homo sapiens
cagtgattgtcttaatattg

SEQ ID NO: 4169023 - DNA, 14 bp, Homo sapiens
cagtgcaacaaaat

SEQ ID NO: 4169024 - DNA, 18 bp, Homo sapiens
cagtgcaagagactctgg

SEQ ID NO: 4169025 - DNA, 19 bp, Homo sapiens
cagtgcaagagactctggc

SEQ ID NO: 4169026 - DNA, 21 bp, Homo sapiens
cagtgcaagagactctggcct

SEQ ID NO: 4169027 - DNA, 22 bp, Homo sapiens
cagtgcaagagactctggcctc

SEQ ID NO: 4169028 - DNA, 24 bp, Homo sapiens
cagtgcaagagactctggcctcca

SEQ ID NO: 4169029 - DNA, 15 bp, Homo sapiens
cagtgcagcagagga

SEQ ID NO: 4169030 - DNA, 13 bp, Homo sapiens
cagtgccacagag

SEQ ID NO: 4169031 - DNA, 15 bp, Homo sapiens
cagtgccacagagaa

SEQ ID NO: 4169032 - DNA, 16 bp, Homo sapiens
cagtgccacagagaag

SEQ ID NO: 4169033 - DNA, 23 bp, Homo sapiens
cagtgctgatccggctgctcctc

SEQ ID NO: 4169034 - DNA, 16 bp, Homo sapiens
cagtgctgattcagcc

SEQ ID NO: 4169035 - DNA, 13 bp, Homo sapiens
cagtgctggattt

SEQ ID NO: 4169036 - DNA, 18 bp, Homo sapiens
cagtgctgtggcctgggc

SEQ ID NO: 4169037 - DNA, 20 bp, Homo sapiens
cagtgctgtggcctgggcaa

SEQ ID NO: 4169038 - DNA, 17 bp, Homo sapiens
cagtgcttctctacaga

SEQ ID NO: 4169039 - DNA, 21 bp, Homo sapiens
cagtggaaaaatcagaagcac

SEQ ID NO: 4169040 - DNA, 15 bp, Homo sapiens
cagtggcaggaccct

SEQ ID NO: 4169041 - DNA, 20 bp, Homo sapiens
cagtggctcacgcctatgat

SEQ ID NO: 4169042 - DNA, 11 bp, Homo sapiens
cagtggcttct

SEQ ID NO: 4169043 - DNA, 11 bp, Homo sapiens
cagtgggacaa

SEQ ID NO: 4169044 - DNA, 22 bp, Homo sapiens
cagtgggacaaaccagagcaga

SEQ ID NO: 4169045 - DNA, 13 bp, Homo sapiens
cagtgggcctggt

SEQ ID NO: 4169046 - DNA, 19 bp, Homo sapiens
cagtgggcctggtagcaca

SEQ ID NO: 4169047 - DNA, 13 bp, Homo sapiens
cagtgggctccct

SEQ ID NO: 4169048 - DNA, 16 bp, Homo sapiens
cagtgggctccctggc

SEQ ID NO: 4169049 - DNA, 17 bp, Homo sapiens
cagtgggctccctggcc

SEQ ID NO: 4169050 - DNA, 15 bp, Homo sapiens
cagtggtaagctctg

SEQ ID NO: 4169051 - DNA, 21 bp, Homo sapiens
cagtgtcaatccaatctgtaa

SEQ ID NO: 4169052 - DNA, 19 bp, Homo sapiens
cagtgtgatcccaagtgcc

SEQ ID NO: 4169053 - DNA, 21 bp, Homo sapiens
cagtgttaagtgtttgaaaac

SEQ ID NO: 4169054 - DNA, 22 bp, Homo sapiens
cagttacaaaaatagtagaaca

SEQ ID NO: 4169055 - DNA, 22 bp, Homo sapiens
cagttactatttttatattcta

SEQ ID NO: 4169056 - DNA, 13 bp, Homo sapiens
cagttagcaacaa

SEQ ID NO: 4169057 - DNA, 16 bp, Homo sapiens
cagttattcttaagta

SEQ ID NO: 4169058 - DNA, 22 bp, Homo sapiens
cagttggagttttttgtaccaa

SEQ ID NO: 4169059 - DNA, 14 bp, Homo sapiens
cagttgttatttag

SEQ ID NO: 4169060 - DNA, 14 bp, Homo sapiens
cagttgttttcccg

SEQ ID NO: 4169061 - DNA, 14 bp, Homo sapiens
cagtttatatttaa

SEQ ID NO: 4169062 - DNA, 17 bp, Homo sapiens
cataaactgtacaaatg

SEQ ID NO: 4169063 - DNA, 13 bp, Homo sapiens
cataaagcctctg

SEQ ID NO: 4169064 - DNA, 21 bp, Homo sapiens
cataaagttgataaagatttt

SEQ ID NO: 4169065 - DNA, 15 bp, Homo sapiens
cataaccaagaaata

SEQ ID NO: 4169066 - DNA, 14 bp, Homo sapiens
cataattcactctg

SEQ ID NO: 4169067 - DNA, 23 bp, Homo sapiens
catacagaattactgtaactgat

SEQ ID NO: 4169068 - DNA, 19 bp, Homo sapiens
catagagggagaggaagca

SEQ ID NO: 4169069 - DNA, 17 bp, Homo sapiens
catagcctatgatgata

SEQ ID NO: 4169070 - DNA, 22 bp, Homo sapiens
catagctgttttagctgaggga

SEQ ID NO: 4169071 - DNA, 23 bp, Homo sapiens
cataggaatatgactcaggagcc

SEQ ID NO: 4169072 - DNA, 19 bp, Homo sapiens
cataggctgcccaatctga

SEQ ID NO: 4169073 - DNA, 22 bp, Homo sapiens
catagttatttacttgaaagat

SEQ ID NO: 4169074 - DNA, 23 bp, Homo sapiens
catagttatttacttgaaagatg

SEQ ID NO: 4169075 - DNA, 23 bp, Homo sapiens
catataaaaggtgagctcagctc

SEQ ID NO: 4169076 - DNA, 15 bp, Homo sapiens
catatatattaaaat

SEQ ID NO: 4169077 - DNA, 13 bp, Homo sapiens
catatatcttatg

SEQ ID NO: 4169078 - DNA, 13 bp, Homo sapiens
catatgagtcttt

SEQ ID NO: 4169079 - DNA, 21 bp, Homo sapiens
catatgcgtcccaagcagccg

SEQ ID NO: 4169080 - DNA, 21 bp, Homo sapiens
catatgctccaggatctttga

SEQ ID NO: 4169081 - DNA, 14 bp, Homo sapiens
catattcacacctc

SEQ ID NO: 4169082 - DNA, 14 bp, Homo sapiens
catattggtattca

SEQ ID NO: 4169083 - DNA, 16 bp, Homo sapiens
catattggtattcact

SEQ ID NO: 4169084 - DNA, 14 bp, Homo sapiens
catatttatacttt

SEQ ID NO: 4169085 - DNA, 23 bp, Homo sapiens
catattttcacatgacgtaaaat

SEQ ID NO: 4169086 - DNA, 19 bp, Homo sapiens
catcaagaaggtagcttga

SEQ ID NO: 4169087 - DNA, 21 bp, Homo sapiens
catcaattcttaaatttctta

SEQ ID NO: 4169088 - DNA, 13 bp, Homo sapiens
catcacagggcag

SEQ ID NO: 4169089 - DNA, 15 bp, Homo sapiens
catcacagggcagag

SEQ ID NO: 4169090 - DNA, 12 bp, Homo sapiens
catcacctcagg

SEQ ID NO: 4169091 - DNA, 18 bp, Homo sapiens
catcacctcaggccaggt

SEQ ID NO: 4169092 - DNA, 23 bp, Homo sapiens
catcactacctttatagctctca

SEQ ID NO: 4169093 - DNA, 17 bp, Homo sapiens
catcactgagttttcca

SEQ ID NO: 4169094 - DNA, 17 bp, Homo sapiens
catcacttttcagtgat

SEQ ID NO: 4169095 - DNA, 23 bp, Homo sapiens
catcagggtgggccactctcccc

SEQ ID NO: 4169096 - DNA, 12 bp, Homo sapiens
catcataaccat

SEQ ID NO: 4169097 - DNA, 14 bp, Homo sapiens
catcattctacata

SEQ ID NO: 4169098 - DNA, 14 bp, Homo sapiens
catcattttttact

SEQ ID NO: 4169099 - DNA, 15 bp, Homo sapiens
catccaaccccccac

SEQ ID NO: 4169100 - DNA, 21 bp, Homo sapiens
catccaaccccccacctgcca

SEQ ID NO: 4169101 - DNA, 18 bp, Homo sapiens
catccacacacgcaggaa

SEQ ID NO: 4169102 - DNA, 19 bp, Homo sapiens
cagcgtgtgtatccgactc

SEQ ID NO: 4169103 - DNA, 22 bp, Homo sapiens
cagctaaagcccaacctcctga

SEQ ID NO: 4169104 - DNA, 21 bp, Homo sapiens
cagctaaatgcagggaaactc

SEQ ID NO: 4169105 - DNA, 15 bp, Homo sapiens
cagctacccaggagg

SEQ ID NO: 4169106 - DNA, 16 bp, Homo sapiens
cagctacccaggaggc

SEQ ID NO: 4169107 - DNA, 17 bp, Homo sapiens
cagctacccaggaggct

SEQ ID NO: 4169108 - DNA, 19 bp, Homo sapiens
cagctacccaggaggctga

SEQ ID NO: 4169109 - DNA, 21 bp, Homo sapiens
cagctacccaggaggctgagg

SEQ ID NO: 4169110 - DNA, 22 bp, Homo sapiens
cagctacccaggaggctgaggc

SEQ ID NO: 4169111 - DNA, 22 bp, Homo sapiens
cagctactcagaagcctgaggc

SEQ ID NO: 4169112 - DNA, 15 bp, Homo sapiens
cagctcaagagatcc

SEQ ID NO: 4169113 - DNA, 19 bp, Homo sapiens
cagctccagaataccttct

SEQ ID NO: 4169114 - DNA, 10 bp, Homo sapiens
cagctccagt

SEQ ID NO: 4169115 - DNA, 11 bp, Homo sapiens
cagctcctctg

SEQ ID NO: 4169116 - DNA, 16 bp, Homo sapiens
cagctcctctgagcca

SEQ ID NO: 4169117 - DNA, 18 bp, Homo sapiens
cagctcctctgagccata

SEQ ID NO: 4169118 - DNA, 16 bp, Homo sapiens
cagctcgctgcccagg

SEQ ID NO: 4169119 - DNA, 18 bp, Homo sapiens
cagctcgctgcccaggga

SEQ ID NO: 4169120 - DNA, 20 bp, Homo sapiens
cagctcttcactcagccaca

SEQ ID NO: 4169121 - DNA, 21 bp, Homo sapiens
cagctgagagacttttaatca

SEQ ID NO: 4169122 - DNA, 20 bp, Homo sapiens
cagctgcacctgccagcctg

SEQ ID NO: 4169123 - DNA, 22 bp, Homo sapiens
cagctgcacctgccagcctggc

SEQ ID NO: 4169124 - DNA, 19 bp, Homo sapiens
cagctgcagatgccacacc

SEQ ID NO: 4169125 - DNA, 16 bp, Homo sapiens
cagctggctctccacc

SEQ ID NO: 4169126 - DNA, 16 bp, Homo sapiens
cagctgtcattcagga

SEQ ID NO: 4169127 - DNA, 12 bp, Homo sapiens
cagctgttttca

SEQ ID NO: 4169128 - DNA, 13 bp, Homo sapiens
cagcttctccagg

SEQ ID NO: 4169129 - DNA, 19 bp, Homo sapiens
cagctttacatgcaattta

SEQ ID NO: 4169130 - DNA, 21 bp, Homo sapiens
cagctttacatgcaatttatt

SEQ ID NO: 4169131 - DNA, 15 bp, Homo sapiens
cagcttttgcttcat

SEQ ID NO: 4169132 - DNA, 13 bp, Homo sapiens
caggaaaattgaa

SEQ ID NO: 4169133 - DNA, 19 bp, Homo sapiens
caggaaagctcagctactg

SEQ ID NO: 4169134 - DNA, 20 bp, Homo sapiens
caggaacgttgccacaccaa

SEQ ID NO: 4169135 - DNA, 15 bp, Homo sapiens
caggaactggctcct

SEQ ID NO: 4169136 - DNA, 22 bp, Homo sapiens
caggaagaatgggctgcagaag

SEQ ID NO: 4169137 - DNA, 14 bp, Homo sapiens
caggaagagaagga

SEQ ID NO: 4169138 - DNA, 19 bp, Homo sapiens
caggaagaggtaatttttc

SEQ ID NO: 4169139 - DNA, 21 bp, Homo sapiens
caggaagatgaaagaggaggt

SEQ ID NO: 4169140 - DNA, 22 bp, Homo sapiens
caggaagctttggtgagaacct

SEQ ID NO: 4169141 - DNA, 13 bp, Homo sapiens
caggaaggcttgt

SEQ ID NO: 4169142 - DNA, 18 bp, Homo sapiens
caggaagggggtccaccc

SEQ ID NO: 4169143 - DNA, 15 bp, Homo sapiens
caggaatctgccatt

SEQ ID NO: 4169144 - DNA, 16 bp, Homo sapiens
caggaccccaacccct

SEQ ID NO: 4169145 - DNA, 23 bp, Homo sapiens
caggaccctgtcaggattgcagg

SEQ ID NO: 4169146 - DNA, 20 bp, Homo sapiens
caggacttggtctgatttca

SEQ ID NO: 4169147 - DNA, 23 bp, Homo sapiens
caggacttggtctgatttcagga

SEQ ID NO: 4169148 - DNA, 18 bp, Homo sapiens
caggagaatcaataaaaa

SEQ ID NO: 4169149 - DNA, 15 bp, Homo sapiens
caggagacaggaagg

SEQ ID NO: 4169150 - DNA, 12 bp, Homo sapiens
caggagagggaa

SEQ ID NO: 4169151 - DNA, 15 bp, Homo sapiens
caggagcagaaagat

SEQ ID NO: 4169152 - DNA, 20 bp, Homo sapiens
caggagctctctgctgagca

SEQ ID NO: 4169153 - DNA, 20 bp, Homo sapiens
caggaggcgaataaatgttc

SEQ ID NO: 4169154 - DNA, 16 bp, Homo sapiens
caggaggctgaggcag

SEQ ID NO: 4169155 - DNA, 15 bp, Homo sapiens
caggaggctgagggg

SEQ ID NO: 4169156 - DNA, 21 bp, Homo sapiens
caggaggcttggaaagcatca

SEQ ID NO: 4169157 - DNA, 17 bp, Homo sapiens
caggagggcaagggcca

SEQ ID NO: 4169158 - DNA, 18 bp, Homo sapiens
caggagggtaacagaaga

SEQ ID NO: 4169159 - DNA, 20 bp, Homo sapiens
caggagggtaacagaagagg

SEQ ID NO: 4169160 - DNA, 21 bp, Homo sapiens
caggagggtaacagaagagga

SEQ ID NO: 4169161 - DNA, 20 bp, Homo sapiens
caggagtttgaggctgcagc

SEQ ID NO: 4169162 - DNA, 18 bp, Homo sapiens
caggatactctgtcagat

SEQ ID NO: 4169163 - DNA, 20 bp, Homo sapiens
caggatactctgtcagatgg

SEQ ID NO: 4169164 - DNA, 19 bp, Homo sapiens
caggatcctattctcacca

SEQ ID NO: 4169165 - DNA, 21 bp, Homo sapiens
caggatcctattctcaccagg

SEQ ID NO: 4169166 - DNA, 22 bp, Homo sapiens
caggatcctattctcaccagga

SEQ ID NO: 4169167 - DNA, 15 bp, Homo sapiens
caggatctgcccaca

SEQ ID NO: 4169168 - DNA, 16 bp, Homo sapiens
caggatctttgactga

SEQ ID NO: 4169169 - DNA, 13 bp, Homo sapiens
caggatggtctgg

SEQ ID NO: 4169170 - DNA, 20 bp, Homo sapiens
caggatgtgtttgctttctg

SEQ ID NO: 4169171 - DNA, 21 bp, Homo sapiens
caggattgcaggtgcctggct

SEQ ID NO: 4169172 - DNA, 18 bp, Homo sapiens
caggattggcctgtgtct

SEQ ID NO: 4169173 - DNA, 19 bp, Homo sapiens
caggattggcctgtgtctg

SEQ ID NO: 4169174 - DNA, 22 bp, Homo sapiens
caggattggcctgtgtctggcc

SEQ ID NO: 4169175 - DNA, 15 bp, Homo sapiens
caggcaccaaaagaa

SEQ ID NO: 4169176 - DNA, 16 bp, Homo sapiens
caggcaccaaaagaag

SEQ ID NO: 4169177 - DNA, 17 bp, Homo sapiens
caggcaccccctggaga

SEQ ID NO: 4169178 - DNA, 18 bp, Homo sapiens
caggcaccccctggagag

SEQ ID NO: 4169179 - DNA, 19 bp, Homo sapiens
caggcaccttagtggcttt

SEQ ID NO: 4169180 - DNA, 14 bp, Homo sapiens
caggcactgtggcc

SEQ ID NO: 4169181 - DNA, 17 bp, Homo sapiens
caggcaggaggatcact

SEQ ID NO: 4169182 - DNA, 18 bp, Homo sapiens
caggcaggcactgtggcc

SEQ ID NO: 4169183 - DNA, 18 bp, Homo sapiens
caggcaggctcccaggga

SEQ ID NO: 4169184 - DNA, 18 bp, Homo sapiens
caggccaagagcagaggc

SEQ ID NO: 4169185 - DNA, 21 bp, Homo sapiens
caggccaagagcagaggcagc

SEQ ID NO: 4169186 - DNA, 13 bp, Homo sapiens
caggccaccagga

SEQ ID NO: 4169187 - DNA, 16 bp, Homo sapiens
caggccaccaggatgg

SEQ ID NO: 4169188 - DNA, 20 bp, Homo sapiens
caggcccggcatgcgggcca

SEQ ID NO: 4169189 - DNA, 22 bp, Homo sapiens
caggccttagtacggctgctgc

SEQ ID NO: 4169190 - DNA, 23 bp, Homo sapiens
caggccttagtacggctgctgca

SEQ ID NO: 4169191 - DNA, 16 bp, Homo sapiens
caggctagagtgcagt

SEQ ID NO: 4169192 - DNA, 11 bp, Homo sapiens
caggctcagca

SEQ ID NO: 4169193 - DNA, 12 bp, Homo sapiens
caggctcagcat

SEQ ID NO: 4169194 - DNA, 15 bp, Homo sapiens
caggctcccactgcc

SEQ ID NO: 4169195 - DNA, 18 bp, Homo sapiens
caggctcccactgcccct

SEQ ID NO: 4169196 - DNA, 14 bp, Homo sapiens
caggctctgcctgg

SEQ ID NO: 4169197 - DNA, 21 bp, Homo sapiens
caggctctgcctggaggatcc

SEQ ID NO: 4169198 - DNA, 21 bp, Homo sapiens
caggctgagctttctagccta

SEQ ID NO: 4169199 - DNA, 11 bp, Homo sapiens
caggctgaggt

SEQ ID NO: 4169200 - DNA, 13 bp, Homo sapiens
caggctggttctg

SEQ ID NO: 4169201 - DNA, 15 bp, Homo sapiens
caggctgtaagcatt

SEQ ID NO: 4169202 - DNA, 22 bp, Homo sapiens
caggctgtaagcattctgagct

SEQ ID NO: 4169203 - DNA, 18 bp, Homo sapiens
cagggaacattggagctg

SEQ ID NO: 4169204 - DNA, 22 bp, Homo sapiens
cagggaatccgcctgcagagga

SEQ ID NO: 4169205 - DNA, 23 bp, Homo sapiens
cagggaatttcaggaactagaga

SEQ ID NO: 4169206 - DNA, 13 bp, Homo sapiens
cagggacagagat

SEQ ID NO: 4169207 - DNA, 20 bp, Homo sapiens
cagggacggggactggccct

SEQ ID NO: 4169208 - DNA, 19 bp, Homo sapiens
cagggagagcgcctcttcc

SEQ ID NO: 4169209 - DNA, 20 bp, Homo sapiens
cagggagcaactctccactc

SEQ ID NO: 4169210 - DNA, 18 bp, Homo sapiens
cagggaggaggtggcagc

SEQ ID NO: 4169211 - DNA, 22 bp, Homo sapiens
cagggaggaggtggcagccctg

SEQ ID NO: 4169212 - DNA, 13 bp, Homo sapiens
cagggatttgagg

SEQ ID NO: 4169213 - DNA, 15 bp, Homo sapiens
cagggcactgtctgc

SEQ ID NO: 4169214 - DNA, 15 bp, Homo sapiens
cagggcagagccggg

SEQ ID NO: 4169215 - DNA, 13 bp, Homo sapiens
cagggccagggcc

SEQ ID NO: 4169216 - DNA, 15 bp, Homo sapiens
cagggccagggccct

SEQ ID NO: 4169217 - DNA, 14 bp, Homo sapiens
cagggctccctcct

SEQ ID NO: 4169218 - DNA, 18 bp, Homo sapiens
cagggctccctcctggag

SEQ ID NO: 4169219 - DNA, 15 bp, Homo sapiens
cagggctctgcccca

SEQ ID NO: 4169220 - DNA, 20 bp, Homo sapiens
cagggctctgccccagaggc

SEQ ID NO: 4169221 - DNA, 21 bp, Homo sapiens
cagggctctgccccagaggcc

SEQ ID NO: 4169222 - DNA, 15 bp, Homo sapiens
cagggctgcccctgt

SEQ ID NO: 4169223 - DNA, 23 bp, Homo sapiens
cagggctgcccctgtaggttgct

SEQ ID NO: 4169224 - DNA, 14 bp, Homo sapiens
cagggctgctgtgg

SEQ ID NO: 4169225 - DNA, 15 bp, Homo sapiens
cagggctgctgtggc

SEQ ID NO: 4169226 - DNA, 21 bp, Homo sapiens
caggggccagatgattttcct

SEQ ID NO: 4169227 - DNA, 13 bp, Homo sapiens
caggggtcagtgc

SEQ ID NO: 4169228 - DNA, 15 bp, Homo sapiens
caggggtcagtgcag

SEQ ID NO: 4169229 - DNA, 16 bp, Homo sapiens
caggggtgggagagcc

SEQ ID NO: 4169230 - DNA, 22 bp, Homo sapiens
caggggtgggagagccagctct

SEQ ID NO: 4169231 - DNA, 19 bp, Homo sapiens
cagggtgaataaagcaggg

SEQ ID NO: 4169232 - DNA, 15 bp, Homo sapiens
cagggtgagagctgc

SEQ ID NO: 4169233 - DNA, 15 bp, Homo sapiens
cagggtgggccactc

SEQ ID NO: 4169234 - DNA, 23 bp, Homo sapiens
cagggtgggccactctcccctcc

SEQ ID NO: 4169235 - DNA, 21 bp, Homo sapiens
cagggttgatcacactctggg

SEQ ID NO: 4169236 - DNA, 16 bp, Homo sapiens
cagggtttcggaaatc

SEQ ID NO: 4169237 - DNA, 15 bp, Homo sapiens
caggtaggggcacag

SEQ ID NO: 4169238 - DNA, 16 bp, Homo sapiens
caggtagtactgggaa

SEQ ID NO: 4169239 - DNA, 20 bp, Homo sapiens
caggtagttggtgaacagag

SEQ ID NO: 4169240 - DNA, 23 bp, Homo sapiens
cagagaaccattcccaagccatg

SEQ ID NO: 4169241 - DNA, 16 bp, Homo sapiens
cagagacaggaaagaa

SEQ ID NO: 4169242 - DNA, 17 bp, Homo sapiens
cagagacaggaaagaat

SEQ ID NO: 4169243 - DNA, 15 bp, Homo sapiens
cagagaccccttcct

SEQ ID NO: 4169244 - DNA, 20 bp, Homo sapiens
cagagaccccttcctttcct

SEQ ID NO: 4169245 - DNA, 14 bp, Homo sapiens
cagagacttgggga

SEQ ID NO: 4169246 - DNA, 16 bp, Homo sapiens
cagagagaaccaggag

SEQ ID NO: 4169247 - DNA, 12 bp, Homo sapiens
cagagagaagcc

SEQ ID NO: 4169248 - DNA, 19 bp, Homo sapiens
cagagagcaaacataggaa

SEQ ID NO: 4169249 - DNA, 20 bp, Homo sapiens
cagagagcctagaacatccc

SEQ ID NO: 4169250 - DNA, 16 bp, Homo sapiens
cagagatctgggaggt

SEQ ID NO: 4169251 - DNA, 21 bp, Homo sapiens
cagagatgcatgcgcaggctc

SEQ ID NO: 4169252 - DNA, 14 bp, Homo sapiens
cagagcaagactcc

SEQ ID NO: 4169253 - DNA, 13 bp, Homo sapiens
cagagcacagccc

SEQ ID NO: 4169254 - DNA, 14 bp, Homo sapiens
cagagcacagccca

SEQ ID NO: 4169255 - DNA, 15 bp, Homo sapiens
cagagcactgctcca

SEQ ID NO: 4169256 - DNA, 13 bp, Homo sapiens
cagagcagagagc

SEQ ID NO: 4169257 - DNA, 22 bp, Homo sapiens
cagagcaggccacgctcaggcc

SEQ ID NO: 4169258 - DNA, 13 bp, Homo sapiens
cagagcaggctca

SEQ ID NO: 4169259 - DNA, 21 bp, Homo sapiens
cagagcaggctcagactctgg

SEQ ID NO: 4169260 - DNA, 15 bp, Homo sapiens
cagagcaggggcagg

SEQ ID NO: 4169261 - DNA, 13 bp, Homo sapiens
cagagcaggggcc

SEQ ID NO: 4169262 - DNA, 22 bp, Homo sapiens
cagagcattacgtgagccaggt

SEQ ID NO: 4169263 - DNA, 23 bp, Homo sapiens
cagagcattacgtgagccaggta

SEQ ID NO: 4169264 - DNA, 12 bp, Homo sapiens
cagagccactct

SEQ ID NO: 4169265 - DNA, 12 bp, Homo sapiens
cagagccaggct

SEQ ID NO: 4169266 - DNA, 18 bp, Homo sapiens
cagagccaggctctgcct

SEQ ID NO: 4169267 - DNA, 21 bp, Homo sapiens
cagagccggggcactttcaga

SEQ ID NO: 4169268 - DNA, 10 bp, Homo sapiens
cagagcctcc

SEQ ID NO: 4169269 - DNA, 11 bp, Homo sapiens
cagagcctggc

SEQ ID NO: 4169270 - DNA, 13 bp, Homo sapiens
cagagcctggctt

SEQ ID NO: 4169271 - DNA, 16 bp, Homo sapiens
cagagccttcaagtgc

SEQ ID NO: 4169272 - DNA, 21 bp, Homo sapiens
cagagccttcaagtgccaaac

SEQ ID NO: 4169273 - DNA, 19 bp, Homo sapiens
cagagcctttggatgacca

SEQ ID NO: 4169274 - DNA, 20 bp, Homo sapiens
cagagcgagagtctgtctca

SEQ ID NO: 4169275 - DNA, 16 bp, Homo sapiens
cagagctatggtgagg

SEQ ID NO: 4169276 - DNA, 23 bp, Homo sapiens
cagagctggcgactgcagctgca

SEQ ID NO: 4169277 - DNA, 14 bp, Homo sapiens
cagagctggctgtc

SEQ ID NO: 4169278 - DNA, 17 bp, Homo sapiens
cagagctggctgtcttc

SEQ ID NO: 4169279 - DNA, 14 bp, Homo sapiens
cagagctggggctg

SEQ ID NO: 4169280 - DNA, 19 bp, Homo sapiens
cagagctggggctgccagc

SEQ ID NO: 4169281 - DNA, 12 bp, Homo sapiens
cagaggaagcac

SEQ ID NO: 4169282 - DNA, 14 bp, Homo sapiens
cagaggaagcacat

SEQ ID NO: 4169283 - DNA, 22 bp, Homo sapiens
cagaggacagagctggctgtct

SEQ ID NO: 4169284 - DNA, 14 bp, Homo sapiens
cagaggccaggaat

SEQ ID NO: 4169285 - DNA, 13 bp, Homo sapiens
cagagggcccagg

SEQ ID NO: 4169286 - DNA, 15 bp, Homo sapiens
cagagggcccaggca

SEQ ID NO: 4169287 - DNA, 21 bp, Homo sapiens
cagaggggagcttgagggaca

SEQ ID NO: 4169288 - DNA, 18 bp, Homo sapiens
cagaggggctttctggag

SEQ ID NO: 4169289 - DNA, 15 bp, Homo sapiens
cagaggggtaggcag

SEQ ID NO: 4169290 - DNA, 23 bp, Homo sapiens
cagaggggtgggttcctcttccc

SEQ ID NO: 4169291 - DNA, 20 bp, Homo sapiens
cagagtatgtccgatggtat

SEQ ID NO: 4169292 - DNA, 13 bp, Homo sapiens
cagagtcaggaag

SEQ ID NO: 4169293 - DNA, 18 bp, Homo sapiens
cagagtgaaataaaatgc

SEQ ID NO: 4169294 - DNA, 15 bp, Homo sapiens
cagagtgagaccctg

SEQ ID NO: 4169295 - DNA, 20 bp, Homo sapiens
cagagtgagaccctgtctct

SEQ ID NO: 4169296 - DNA, 11 bp, Homo sapiens
cagagtgccac

SEQ ID NO: 4169297 - DNA, 23 bp, Homo sapiens
cagagtgtccccagagacatgca

SEQ ID NO: 4169298 - DNA, 16 bp, Homo sapiens
cagagttgggatgcgg

SEQ ID NO: 4169299 - DNA, 17 bp, Homo sapiens
cagataaccagctgtaa

SEQ ID NO: 4169300 - DNA, 22 bp, Homo sapiens
cagataactgaaaattatttaa

SEQ ID NO: 4169301 - DNA, 15 bp, Homo sapiens
cagataatcagcctc

SEQ ID NO: 4169302 - DNA, 16 bp, Homo sapiens
cagataatcagcctct

SEQ ID NO: 4169303 - DNA, 17 bp, Homo sapiens
cagatagacagtgctgc

SEQ ID NO: 4169304 - DNA, 19 bp, Homo sapiens
cagatagacagtgctgccc

SEQ ID NO: 4169305 - DNA, 20 bp, Homo sapiens
cagatataaaataggcttag

SEQ ID NO: 4169306 - DNA, 14 bp, Homo sapiens
cagatatatttttc

SEQ ID NO: 4169307 - DNA, 15 bp, Homo sapiens
cagatatatttttca

SEQ ID NO: 4169308 - DNA, 16 bp, Homo sapiens
cagatcctcacaacca

SEQ ID NO: 4169309 - DNA, 21 bp, Homo sapiens
cagatctagtcaatcaagtct

SEQ ID NO: 4169310 - DNA, 21 bp, Homo sapiens
cagatgctgtcactggcagag

SEQ ID NO: 4169311 - DNA, 14 bp, Homo sapiens
cagatggaaagaaa

SEQ ID NO: 4169312 - DNA, 22 bp, Homo sapiens
cagatgggacaagttagtcttt

SEQ ID NO: 4169313 - DNA, 13 bp, Homo sapiens
cagatgtgtctgg

SEQ ID NO: 4169314 - DNA, 20 bp, Homo sapiens
cagattgacctataaaacaa

SEQ ID NO: 4169315 - DNA, 19 bp, Homo sapiens
cagcaaagagtgggctgca

SEQ ID NO: 4169316 - DNA, 16 bp, Homo sapiens
cagcaacacaagctgg

SEQ ID NO: 4169317 - DNA, 21 bp, Homo sapiens
cagcaacacaagctggaagca

SEQ ID NO: 4169318 - DNA, 13 bp, Homo sapiens
cagcaacacagag

SEQ ID NO: 4169319 - DNA, 12 bp, Homo sapiens
cagcaactccca

SEQ ID NO: 4169320 - DNA, 21 bp, Homo sapiens
cagcaatagggtgcagttttc

SEQ ID NO: 4169321 - DNA, 15 bp, Homo sapiens
cagcaatatgtaaat

SEQ ID NO: 4169322 - DNA, 17 bp, Homo sapiens
cagcacaactcagtctg

SEQ ID NO: 4169323 - DNA, 18 bp, Homo sapiens
cagcacaactcagtctgt

SEQ ID NO: 4169324 - DNA, 21 bp, Homo sapiens
cagcacaactcagtctgtggg

SEQ ID NO: 4169325 - DNA, 15 bp, Homo sapiens
cagcacttggctcct

SEQ ID NO: 4169326 - DNA, 19 bp, Homo sapiens
cagcactttaaccctctct

SEQ ID NO: 4169327 - DNA, 17 bp, Homo sapiens
cagcagatggaaagaaa

SEQ ID NO: 4169328 - DNA, 16 bp, Homo sapiens
cagcaggcaggcactg

SEQ ID NO: 4169329 - DNA, 14 bp, Homo sapiens
cagcagggcctcaa

SEQ ID NO: 4169330 - DNA, 17 bp, Homo sapiens
cagcagggtcttgctgt

SEQ ID NO: 4169331 - DNA, 18 bp, Homo sapiens
cagcaggtaggggcacag

SEQ ID NO: 4169332 - DNA, 20 bp, Homo sapiens
cagcaggtaggggcacagtg

SEQ ID NO: 4169333 - DNA, 15 bp, Homo sapiens
cagcagtaagcaggc

SEQ ID NO: 4169334 - DNA, 18 bp, Homo sapiens
cagcatacagagcaggcc

SEQ ID NO: 4169335 - DNA, 18 bp, Homo sapiens
cagcatatttatagcaat

SEQ ID NO: 4169336 - DNA, 18 bp, Homo sapiens
cagcatctactctaggca

SEQ ID NO: 4169337 - DNA, 18 bp, Homo sapiens
cagcatgaattccaactc

SEQ ID NO: 4169338 - DNA, 19 bp, Homo sapiens
cagcatgaattccaactca

SEQ ID NO: 4169339 - DNA, 15 bp, Homo sapiens
cagcattttcacatt

SEQ ID NO: 4169340 - DNA, 19 bp, Homo sapiens
cagcattttcacattttgc

SEQ ID NO: 4169341 - DNA, 20 bp, Homo sapiens
cagccaaataaaacctcagg

SEQ ID NO: 4169342 - DNA, 18 bp, Homo sapiens
cagccaacaggtggcagg

SEQ ID NO: 4169343 - DNA, 20 bp, Homo sapiens
cagccacaaaactctgtcag

SEQ ID NO: 4169344 - DNA, 18 bp, Homo sapiens
cagccagccggtgcctgg

SEQ ID NO: 4169345 - DNA, 20 bp, Homo sapiens
cagccagccggtgcctggcg

SEQ ID NO: 4169346 - DNA, 19 bp, Homo sapiens
cagccaggaactggctcct

SEQ ID NO: 4169347 - DNA, 13 bp, Homo sapiens
cagccattcctgt

SEQ ID NO: 4169348 - DNA, 17 bp, Homo sapiens
cagccattcctgttctc

SEQ ID NO: 4169349 - DNA, 19 bp, Homo sapiens
cagccattcctgttctctt

SEQ ID NO: 4169350 - DNA, 20 bp, Homo sapiens
cagccattcctgttctcttt

SEQ ID NO: 4169351 - DNA, 12 bp, Homo sapiens
cagcccagccta

SEQ ID NO: 4169352 - DNA, 15 bp, Homo sapiens
cagcccagcctagcc

SEQ ID NO: 4169353 - DNA, 16 bp, Homo sapiens
cagcccagcctagccc

SEQ ID NO: 4169354 - DNA, 20 bp, Homo sapiens
cagcccattggctcccatct

SEQ ID NO: 4169355 - DNA, 22 bp, Homo sapiens
cagcccccactttcctacaaaa

SEQ ID NO: 4169356 - DNA, 18 bp, Homo sapiens
cagccccgcgcctccttc

SEQ ID NO: 4169357 - DNA, 15 bp, Homo sapiens
cagccggtgcctggc

SEQ ID NO: 4169358 - DNA, 14 bp, Homo sapiens
cagccgtgagcatg

SEQ ID NO: 4169359 - DNA, 18 bp, Homo sapiens
cagcctacagcagtgtgg

SEQ ID NO: 4169360 - DNA, 19 bp, Homo sapiens
cagcctacagcagtgtggt

SEQ ID NO: 4169361 - DNA, 19 bp, Homo sapiens
cagcctcccaagtagctgg

SEQ ID NO: 4169362 - DNA, 19 bp, Homo sapiens
cagcctcccgagtagctgg

SEQ ID NO: 4169363 - DNA, 11 bp, Homo sapiens
cagcctcttaa

SEQ ID NO: 4169364 - DNA, 15 bp, Homo sapiens
cagcctcttaaagct

SEQ ID NO: 4169365 - DNA, 20 bp, Homo sapiens
cagcctcttaaagctgcctg

SEQ ID NO: 4169366 - DNA, 15 bp, Homo sapiens
cagcctgaggctgag

SEQ ID NO: 4169367 - DNA, 16 bp, Homo sapiens
cagcctggcttctgga

SEQ ID NO: 4169368 - DNA, 11 bp, Homo sapiens
cagcctgggcg

SEQ ID NO: 4169369 - DNA, 22 bp, Homo sapiens
cagcctgggcgacagagcaaga

SEQ ID NO: 4169370 - DNA, 20 bp, Homo sapiens
cagcctggggtgatagaaca

SEQ ID NO: 4169371 - DNA, 18 bp, Homo sapiens
cagcctggtagaattggg

SEQ ID NO: 4169372 - DNA, 14 bp, Homo sapiens
cagcctgtcctggt

SEQ ID NO: 4169373 - DNA, 17 bp, Homo sapiens
cagcctgtttagccaag

SEQ ID NO: 4169374 - DNA, 23 bp, Homo sapiens
cagcgcaacagctgtgtgtgccc

SEQ ID NO: 4169375 - DNA, 21 bp, Homo sapiens
cagcgccctggagtcccctgg

SEQ ID NO: 4169376 - DNA, 16 bp, Homo sapiens
cagcgcgggcggaggc

SEQ ID NO: 4169377 - DNA, 19 bp, Homo sapiens
cagcgcgggcggaggcggc

SEQ ID NO: 4169378 - DNA, 14 bp, Homo sapiens
cagcgtgtgtatcc

SEQ ID NO: 4169379 - DNA, 15 bp, Homo sapiens
cagcgtgtgtatccg

SEQ ID NO: 4169380 - DNA, 15 bp, Homo sapiens
cactaaagtatgtaa

SEQ ID NO: 4169381 - DNA, 22 bp, Homo sapiens
cactaaagtatgtaaagtatgt

SEQ ID NO: 4169382 - DNA, 20 bp, Homo sapiens
cactaagctttctcctttga

SEQ ID NO: 4169383 - DNA, 19 bp, Homo sapiens
cactacactccagcctgag

SEQ ID NO: 4169384 - DNA, 20 bp, Homo sapiens
cactacactccagcctgagc

SEQ ID NO: 4169385 - DNA, 21 bp, Homo sapiens
cactacactccagcctgagca

SEQ ID NO: 4169386 - DNA, 20 bp, Homo sapiens
cactacctttatagctctca

SEQ ID NO: 4169387 - DNA, 14 bp, Homo sapiens
cactagacaagcca

SEQ ID NO: 4169388 - DNA, 17 bp, Homo sapiens
cactagacaagccagaa

SEQ ID NO: 4169389 - DNA, 17 bp, Homo sapiens
cactagcattttcttga

SEQ ID NO: 4169390 - DNA, 14 bp, Homo sapiens
cactagcctctcca

SEQ ID NO: 4169391 - DNA, 16 bp, Homo sapiens
cactaggactctgagg

SEQ ID NO: 4169392 - DNA, 20 bp, Homo sapiens
cactagttcagaggaagcac

SEQ ID NO: 4169393 - DNA, 22 bp, Homo sapiens
cactatagtttaatactcagag

SEQ ID NO: 4169394 - DNA, 23 bp, Homo sapiens
cactatagtttaatactcagagg

SEQ ID NO: 4169395 - DNA, 14 bp, Homo sapiens
cactatcttcacaa

SEQ ID NO: 4169396 - DNA, 14 bp, Homo sapiens
cactatctttcagc

SEQ ID NO: 4169397 - DNA, 17 bp, Homo sapiens
cactcaaacaatcatga

SEQ ID NO: 4169398 - DNA, 13 bp, Homo sapiens
cactcaagcctga

SEQ ID NO: 4169399 - DNA, 17 bp, Homo sapiens
cactcaaggcggtgctt

SEQ ID NO: 4169400 - DNA, 16 bp, Homo sapiens
cactcacccatgtgcc

SEQ ID NO: 4169401 - DNA, 13 bp, Homo sapiens
cactcagcagccc

SEQ ID NO: 4169402 - DNA, 15 bp, Homo sapiens
cactcagcagccccc

SEQ ID NO: 4169403 - DNA, 20 bp, Homo sapiens
cactcagcagccccctgccc

SEQ ID NO: 4169404 - DNA, 14 bp, Homo sapiens
cactcagccacacc

SEQ ID NO: 4169405 - DNA, 21 bp, Homo sapiens
cactcagccgcagacaagtaa

SEQ ID NO: 4169406 - DNA, 19 bp, Homo sapiens
cactcaggccaacaagcca

SEQ ID NO: 4169407 - DNA, 23 bp, Homo sapiens
cactcatataaaaggtgagctca

SEQ ID NO: 4169408 - DNA, 15 bp, Homo sapiens
cactcattcctgtag

SEQ ID NO: 4169409 - DNA, 19 bp, Homo sapiens
cactccaccccctccagct

SEQ ID NO: 4169410 - DNA, 17 bp, Homo sapiens
cactccacctccaccca

SEQ ID NO: 4169411 - DNA, 14 bp, Homo sapiens
cactccagcctgag

SEQ ID NO: 4169412 - DNA, 21 bp, Homo sapiens
cactccagcctgagcaacaga

SEQ ID NO: 4169413 - DNA, 14 bp, Homo sapiens
cactccagcctggg

SEQ ID NO: 4169414 - DNA, 16 bp, Homo sapiens
cactccagcctgggcg

SEQ ID NO: 4169415 - DNA, 23 bp, Homo sapiens
cactccagcctgggcgacagagc

SEQ ID NO: 4169416 - DNA, 17 bp, Homo sapiens
cactccccgcctgtcct

SEQ ID NO: 4169417 - DNA, 19 bp, Homo sapiens
cactccggtgtgcctgcag

SEQ ID NO: 4169418 - DNA, 22 bp, Homo sapiens
cactccggtgtgcctgcagccc

SEQ ID NO: 4169419 - DNA, 18 bp, Homo sapiens
cactcgggaggctgagac

SEQ ID NO: 4169420 - DNA, 18 bp, Homo sapiens
cactctagtgacttcctg

SEQ ID NO: 4169421 - DNA, 23 bp, Homo sapiens
cactctagtgacttcctggtgag

SEQ ID NO: 4169422 - DNA, 18 bp, Homo sapiens
cactctcccctccctctt

SEQ ID NO: 4169423 - DNA, 22 bp, Homo sapiens
cactctcccctccctcttcctt

SEQ ID NO: 4169424 - DNA, 16 bp, Homo sapiens
cactctctgtacaaaa

SEQ ID NO: 4169425 - DNA, 21 bp, Homo sapiens
cactctctgtacaaaaacaaa

SEQ ID NO: 4169426 - DNA, 16 bp, Homo sapiens
cactctgagtgtttta

SEQ ID NO: 4169427 - DNA, 16 bp, Homo sapiens
cactcttcttgagcag

SEQ ID NO: 4169428 - DNA, 18 bp, Homo sapiens
cactcttcttgagcagac

SEQ ID NO: 4169429 - DNA, 23 bp, Homo sapiens
cactgagatattgggacacacat

SEQ ID NO: 4169430 - DNA, 14 bp, Homo sapiens
cactgaggatgtga

SEQ ID NO: 4169431 - DNA, 15 bp, Homo sapiens
cactgaggatgtgag

SEQ ID NO: 4169432 - DNA, 20 bp, Homo sapiens
cactgaggatgtgagcctga

SEQ ID NO: 4169433 - DNA, 20 bp, Homo sapiens
cactgcaatctccacctccc

SEQ ID NO: 4169434 - DNA, 17 bp, Homo sapiens
cactgcactccagcctg

SEQ ID NO: 4169435 - DNA, 20 bp, Homo sapiens
cactgcactccagcctgggc

SEQ ID NO: 4169436 - DNA, 12 bp, Homo sapiens
cactgcagggct

SEQ ID NO: 4169437 - DNA, 19 bp, Homo sapiens
cactgcagggctgctgtgg

SEQ ID NO: 4169438 - DNA, 20 bp, Homo sapiens
cactgcagggctgctgtggc

SEQ ID NO: 4169439 - DNA, 13 bp, Homo sapiens
cactgcaggggcc

SEQ ID NO: 4169440 - DNA, 20 bp, Homo sapiens
cactgccctccgcccttccc

SEQ ID NO: 4169441 - DNA, 18 bp, Homo sapiens
cactgcgggagctctgta

SEQ ID NO: 4169442 - DNA, 14 bp, Homo sapiens
cactggcagagcac

SEQ ID NO: 4169443 - DNA, 22 bp, Homo sapiens
cactggcagagcacagcccacg

SEQ ID NO: 4169444 - DNA, 18 bp, Homo sapiens
cactggccttcccttctc

SEQ ID NO: 4169445 - DNA, 16 bp, Homo sapiens
cactgggagaagagaa

SEQ ID NO: 4169446 - DNA, 20 bp, Homo sapiens
cactggtccatttctcagtg

SEQ ID NO: 4169447 - DNA, 18 bp, Homo sapiens
cactgtatgctggacggc

SEQ ID NO: 4169448 - DNA, 20 bp, Homo sapiens
cactgtcccccaagaaacta

SEQ ID NO: 4169449 - DNA, 21 bp, Homo sapiens
cactgtcccccaagaaactag

SEQ ID NO: 4169450 - DNA, 19 bp, Homo sapiens
cactgtcccggagctcagg

SEQ ID NO: 4169451 - DNA, 22 bp, Homo sapiens
cactgtctgcgtgactattttt

SEQ ID NO: 4169452 - DNA, 10 bp, Homo sapiens
cactgtgcct

SEQ ID NO: 4169453 - DNA, 14 bp, Homo sapiens
cactgtggccttct

SEQ ID NO: 4169454 - DNA, 22 bp, Homo sapiens
cactgttcccaatatgtagcct

SEQ ID NO: 4169455 - DNA, 23 bp, Homo sapiens
cactgttggaatgtatgctaatt

SEQ ID NO: 4169456 - DNA, 24 bp, Homo sapiens
cactgttggaatgtatgctaattg

SEQ ID NO: 4169457 - DNA, 18 bp, Homo sapiens
cacttaagcagagcagaa

SEQ ID NO: 4169458 - DNA, 15 bp, Homo sapiens
cacttagctatcaga

SEQ ID NO: 4169459 - DNA, 21 bp, Homo sapiens
cacttataagtgggagctaaa

SEQ ID NO: 4169460 - DNA, 16 bp, Homo sapiens
cacttccatgttgtct

SEQ ID NO: 4169461 - DNA, 17 bp, Homo sapiens
cacttcttgaaacagcc

SEQ ID NO: 4169462 - DNA, 18 bp, Homo sapiens
cacttcttgaaacagcct

SEQ ID NO: 4169463 - DNA, 21 bp, Homo sapiens
cacttcttgaaacagcctggg

SEQ ID NO: 4169464 - DNA, 15 bp, Homo sapiens
cacttgaagccaaac

SEQ ID NO: 4169465 - DNA, 14 bp, Homo sapiens
cacttggaaaggtt

SEQ ID NO: 4169466 - DNA, 16 bp, Homo sapiens
cacttgggcccaggag

SEQ ID NO: 4169467 - DNA, 19 bp, Homo sapiens
cacttggtaattgtactaa

SEQ ID NO: 4169468 - DNA, 15 bp, Homo sapiens
cactttaaccctctc

SEQ ID NO: 4169469 - DNA, 22 bp, Homo sapiens
cactttgccccagttacaaaaa

SEQ ID NO: 4169470 - DNA, 13 bp, Homo sapiens
cacttttgggagg

SEQ ID NO: 4169471 - DNA, 22 bp, Homo sapiens
cacttttgggaggtccaggcag

SEQ ID NO: 4169472 - DNA, 23 bp, Homo sapiens
cacttttgggaggtccaggcagg

SEQ ID NO: 4169473 - DNA, 18 bp, Homo sapiens
cacttttttacaactcca

SEQ ID NO: 4169474 - DNA, 22 bp, Homo sapiens
cagaaaaatatgtaccaagaat

SEQ ID NO: 4169475 - DNA, 15 bp, Homo sapiens
cagaaaacaaaactg

SEQ ID NO: 4169476 - DNA, 14 bp, Homo sapiens
cagaaaaccccagc

SEQ ID NO: 4169477 - DNA, 17 bp, Homo sapiens
cagaaaagaaaaccatt

SEQ ID NO: 4169478 - DNA, 22 bp, Homo sapiens
cagaaaagggagctaaattgaa

SEQ ID NO: 4169479 - DNA, 16 bp, Homo sapiens
cagaacatagacagaa

SEQ ID NO: 4169480 - DNA, 19 bp, Homo sapiens
cagaacatagacagaagaa

SEQ ID NO: 4169481 - DNA, 23 bp, Homo sapiens
cagaactgaggtcactgggttct

SEQ ID NO: 4169482 - DNA, 22 bp, Homo sapiens
cagaagaggttgggcttccatg

SEQ ID NO: 4169483 - DNA, 15 bp, Homo sapiens
cagaagcaggcaggg

SEQ ID NO: 4169484 - DNA, 23 bp, Homo sapiens
cagaagcagttgagtcgtcatca

SEQ ID NO: 4169485 - DNA, 19 bp, Homo sapiens
cagaagcctgaggctggga

SEQ ID NO: 4169486 - DNA, 15 bp, Homo sapiens
cagaagggagaagga

SEQ ID NO: 4169487 - DNA, 22 bp, Homo sapiens
cagaaggtatacctgggaagat

SEQ ID NO: 4169488 - DNA, 15 bp, Homo sapiens
cagaagtaggaagga

SEQ ID NO: 4169489 - DNA, 21 bp, Homo sapiens
cagaagtaggaaggaaaaaat

SEQ ID NO: 4169490 - DNA, 23 bp, Homo sapiens
cagaagtccctaggagggaagga

SEQ ID NO: 4169491 - DNA, 22 bp, Homo sapiens
cagaagtgaccaaattgggaga

SEQ ID NO: 4169492 - DNA, 13 bp, Homo sapiens
cagaagtgcatga

SEQ ID NO: 4169493 - DNA, 19 bp, Homo sapiens
cagaagtggggctctggga

SEQ ID NO: 4169494 - DNA, 22 bp, Homo sapiens
cagaagtggggctctgggaggg

SEQ ID NO: 4169495 - DNA, 16 bp, Homo sapiens
cagaatagataaattt

SEQ ID NO: 4169496 - DNA, 17 bp, Homo sapiens
cagaatcaacttgaagc

SEQ ID NO: 4169497 - DNA, 17 bp, Homo sapiens
cagaatgagcagtccct

SEQ ID NO: 4169498 - DNA, 21 bp, Homo sapiens
cagaatgctaaagtttcctaa

SEQ ID NO: 4169499 - DNA, 16 bp, Homo sapiens
cagaatgttgattaca

SEQ ID NO: 4169500 - DNA, 11 bp, Homo sapiens
cagacagatga

SEQ ID NO: 4169501 - DNA, 19 bp, Homo sapiens
cagacatccatgtttgtaa

SEQ ID NO: 4169502 - DNA, 15 bp, Homo sapiens
cagacccacctggag

SEQ ID NO: 4169503 - DNA, 23 bp, Homo sapiens
cagaccccttggcttttgcttgg

SEQ ID NO: 4169504 - DNA, 23 bp, Homo sapiens
cagacgagatcctgtttcagcta

SEQ ID NO: 4169505 - DNA, 19 bp, Homo sapiens
cagactatttaacttgagg

SEQ ID NO: 4169506 - DNA, 13 bp, Homo sapiens
cagactcagctcc

SEQ ID NO: 4169507 - DNA, 17 bp, Homo sapiens
cagactcagctccagaa

SEQ ID NO: 4169508 - DNA, 18 bp, Homo sapiens
cagactccttcaacaatt

SEQ ID NO: 4169509 - DNA, 18 bp, Homo sapiens
cagactctttatgcttgc

SEQ ID NO: 4169510 - DNA, 18 bp, Homo sapiens
cagactgcatgtagttgg

SEQ ID NO: 4169511 - DNA, 13 bp, Homo sapiens
cagactgctggga

SEQ ID NO: 4169512 - DNA, 16 bp, Homo sapiens
cagactgctgggactg

SEQ ID NO: 4169513 - DNA, 20 bp, Homo sapiens
cagactgctgggactggcca

SEQ ID NO: 4169514 - DNA, 20 bp, Homo sapiens
cagacttctccagacccacc

SEQ ID NO: 4169515 - DNA, 15 bp, Homo sapiens
cagagaaagaagaga

SEQ ID NO: 4169516 - DNA, 15 bp, Homo sapiens
cagagaaattctgtg

SEQ ID NO: 4169517 - DNA, 14 bp, Homo sapiens
cacaagctggaagc

SEQ ID NO: 4169518 - DNA, 15 bp, Homo sapiens
cacaagctggaagca

SEQ ID NO: 4169519 - DNA, 16 bp, Homo sapiens
cacaagctggaagcac

SEQ ID NO: 4169520 - DNA, 16 bp, Homo sapiens
cacaagtcctgtgaat

SEQ ID NO: 4169521 - DNA, 20 bp, Homo sapiens
cacaatctgggactttcact

SEQ ID NO: 4169522 - DNA, 23 bp, Homo sapiens
cacacaaaagggaacccagctct

SEQ ID NO: 4169523 - DNA, 19 bp, Homo sapiens
cacacacaaaagggaaccc

SEQ ID NO: 4169524 - DNA, 22 bp, Homo sapiens
cacacagctaggcatgcctggg

SEQ ID NO: 4169525 - DNA, 21 bp, Homo sapiens
cacacagtattaagtgacagt

SEQ ID NO: 4169526 - DNA, 19 bp, Homo sapiens
cacacagtctcagtccaga

SEQ ID NO: 4169527 - DNA, 13 bp, Homo sapiens
cacacagtgacaa

SEQ ID NO: 4169528 - DNA, 20 bp, Homo sapiens
cacacagtgacaaaaggctc

SEQ ID NO: 4169529 - DNA, 18 bp, Homo sapiens
cacaccaatcagagagcc

SEQ ID NO: 4169530 - DNA, 19 bp, Homo sapiens
cacaccactgcactccagc

SEQ ID NO: 4169531 - DNA, 17 bp, Homo sapiens
cacacctcacgctctgg

SEQ ID NO: 4169532 - DNA, 19 bp, Homo sapiens
cacacctcacgctctggac

SEQ ID NO: 4169533 - DNA, 21 bp, Homo sapiens
cacacgcaggaactcccagca

SEQ ID NO: 4169534 - DNA, 15 bp, Homo sapiens
cacactgcagggctg

SEQ ID NO: 4169535 - DNA, 15 bp, Homo sapiens
cacactggtgactgc

SEQ ID NO: 4169536 - DNA, 14 bp, Homo sapiens
cacagacccacaca

SEQ ID NO: 4169537 - DNA, 16 bp, Homo sapiens
cacagacccacacatg

SEQ ID NO: 4169538 - DNA, 14 bp, Homo sapiens
cacagagagagtca

SEQ ID NO: 4169539 - DNA, 20 bp, Homo sapiens
cacagagctggcgactgcag

SEQ ID NO: 4169540 - DNA, 22 bp, Homo sapiens
cacagataactgaaaattattt

SEQ ID NO: 4169541 - DNA, 15 bp, Homo sapiens
cacagatgtgtctgg

SEQ ID NO: 4169542 - DNA, 22 bp, Homo sapiens
cacagatttcggtcataaagaa

SEQ ID NO: 4169543 - DNA, 16 bp, Homo sapiens
cacagcagctgaacag

SEQ ID NO: 4169544 - DNA, 19 bp, Homo sapiens
cacagcagctgaacagcca

SEQ ID NO: 4169545 - DNA, 15 bp, Homo sapiens
cacagcccagaacca

SEQ ID NO: 4169546 - DNA, 13 bp, Homo sapiens
cacagcccgggtg

SEQ ID NO: 4169547 - DNA, 17 bp, Homo sapiens
cacagcccgggtgtgcc

SEQ ID NO: 4169548 - DNA, 14 bp, Homo sapiens
cacagccgcagcct

SEQ ID NO: 4169549 - DNA, 22 bp, Homo sapiens
cacagccgcagcctccctctga

SEQ ID NO: 4169550 - DNA, 12 bp, Homo sapiens
cacagcctctcc

SEQ ID NO: 4169551 - DNA, 14 bp, Homo sapiens
cacagcctctccct

SEQ ID NO: 4169552 - DNA, 17 bp, Homo sapiens
cacagctaggcatgcct

SEQ ID NO: 4169553 - DNA, 20 bp, Homo sapiens
cacagctgctgaagaggcaa

SEQ ID NO: 4169554 - DNA, 23 bp, Homo sapiens
cacaggttagggtgtgtgccaca

SEQ ID NO: 4169555 - DNA, 20 bp, Homo sapiens
cacaggttccatagaactaa

SEQ ID NO: 4169556 - DNA, 17 bp, Homo sapiens
cacagtcctcacagcct

SEQ ID NO: 4169557 - DNA, 18 bp, Homo sapiens
cacagtctcagtccagat

SEQ ID NO: 4169558 - DNA, 20 bp, Homo sapiens
cacagtctcagtccagatgc

SEQ ID NO: 4169559 - DNA, 21 bp, Homo sapiens
cacagtctcagtccagatgcc

SEQ ID NO: 4169560 - DNA, 19 bp, Homo sapiens
cacagtgaatgtgtgtatg

SEQ ID NO: 4169561 - DNA, 18 bp, Homo sapiens
cacagtgcccagctaatt

SEQ ID NO: 4169562 - DNA, 17 bp, Homo sapiens
cacagttggctggatga

SEQ ID NO: 4169563 - DNA, 22 bp, Homo sapiens
cacataaactttataaattcat

SEQ ID NO: 4169564 - DNA, 12 bp, Homo sapiens
cacatccctctc

SEQ ID NO: 4169565 - DNA, 15 bp, Homo sapiens
cacatctttcctgtc

SEQ ID NO: 4169566 - DNA, 21 bp, Homo sapiens
cacatgtctgtcctcagagca

SEQ ID NO: 4169567 - DNA, 22 bp, Homo sapiens
cacatgtctgtcctcagagcag

SEQ ID NO: 4169568 - DNA, 23 bp, Homo sapiens
cacatgtgttctctattttgcct

SEQ ID NO: 4169569 - DNA, 16 bp, Homo sapiens
cacatgtttacagaac

SEQ ID NO: 4169570 - DNA, 22 bp, Homo sapiens
cacattcttaacacatgtcctt

SEQ ID NO: 4169571 - DNA, 14 bp, Homo sapiens
caccaagggatctg

SEQ ID NO: 4169572 - DNA, 20 bp, Homo sapiens
caccaaggtcttcagccatc

SEQ ID NO: 4169573 - DNA, 15 bp, Homo sapiens
caccaagttctggaa

SEQ ID NO: 4169574 - DNA, 14 bp, Homo sapiens
caccaatcagagag

SEQ ID NO: 4169575 - DNA, 15 bp, Homo sapiens
caccaatcagagagc

SEQ ID NO: 4169576 - DNA, 17 bp, Homo sapiens
caccaatcagagagcct

SEQ ID NO: 4169577 - DNA, 19 bp, Homo sapiens
caccaccttggactcctcc

SEQ ID NO: 4169578 - DNA, 20 bp, Homo sapiens
caccactaggactctgaggc

SEQ ID NO: 4169579 - DNA, 13 bp, Homo sapiens
caccactagggtc

SEQ ID NO: 4169580 - DNA, 22 bp, Homo sapiens
caccagacccacctggagcccg

SEQ ID NO: 4169581 - DNA, 11 bp, Homo sapiens
caccaggaagg

SEQ ID NO: 4169582 - DNA, 17 bp, Homo sapiens
caccagggcactgtctg

SEQ ID NO: 4169583 - DNA, 21 bp, Homo sapiens
caccatattcagtgctgtggc

SEQ ID NO: 4169584 - DNA, 15 bp, Homo sapiens
caccatcacacatgc

SEQ ID NO: 4169585 - DNA, 16 bp, Homo sapiens
caccatccaccctgca

SEQ ID NO: 4169586 - DNA, 11 bp, Homo sapiens
caccatgaaac

SEQ ID NO: 4169587 - DNA, 13 bp, Homo sapiens
caccatgatttaa

SEQ ID NO: 4169588 - DNA, 21 bp, Homo sapiens
caccatgccaggctaattttt

SEQ ID NO: 4169589 - DNA, 16 bp, Homo sapiens
cacccaagcaaggcca

SEQ ID NO: 4169590 - DNA, 23 bp, Homo sapiens
cacccaataaacattaagattga

SEQ ID NO: 4169591 - DNA, 17 bp, Homo sapiens
cacccagcaacacagag

SEQ ID NO: 4169592 - DNA, 20 bp, Homo sapiens
cacccaggctggagtacagt

SEQ ID NO: 4169593 - DNA, 15 bp, Homo sapiens
cacccagggctccct

SEQ ID NO: 4169594 - DNA, 16 bp, Homo sapiens
cacccagggctccctc

SEQ ID NO: 4169595 - DNA, 13 bp, Homo sapiens
cacccatgtgcca

SEQ ID NO: 4169596 - DNA, 12 bp, Homo sapiens
cacccccatggc

SEQ ID NO: 4169597 - DNA, 11 bp, Homo sapiens
caccccctcat

SEQ ID NO: 4169598 - DNA, 16 bp, Homo sapiens
caccccctcattcccc

SEQ ID NO: 4169599 - DNA, 19 bp, Homo sapiens
caccccctccagctccagt

SEQ ID NO: 4169600 - DNA, 20 bp, Homo sapiens
cacccgtcttggggctcgcc

SEQ ID NO: 4169601 - DNA, 18 bp, Homo sapiens
caccctcaaaccctgtgg

SEQ ID NO: 4169602 - DNA, 19 bp, Homo sapiens
caccctcaataaatgttgc

SEQ ID NO: 4169603 - DNA, 11 bp, Homo sapiens
caccctgcaga

SEQ ID NO: 4169604 - DNA, 21 bp, Homo sapiens
caccctgcccagtctggaaga

SEQ ID NO: 4169605 - DNA, 16 bp, Homo sapiens
cacccttggacttgag

SEQ ID NO: 4169606 - DNA, 16 bp, Homo sapiens
caccgctgccttttgc

SEQ ID NO: 4169607 - DNA, 21 bp, Homo sapiens
caccgctgccttttgctgctg

SEQ ID NO: 4169608 - DNA, 23 bp, Homo sapiens
caccgctgccttttgctgctgct

SEQ ID NO: 4169609 - DNA, 19 bp, Homo sapiens
cacctaatcaggctgaggt

SEQ ID NO: 4169610 - DNA, 12 bp, Homo sapiens
cacctattacat

SEQ ID NO: 4169611 - DNA, 19 bp, Homo sapiens
cacctcacgctctggacat

SEQ ID NO: 4169612 - DNA, 15 bp, Homo sapiens
cacctcaggccaggt

SEQ ID NO: 4169613 - DNA, 14 bp, Homo sapiens
cacctcatgcctgg

SEQ ID NO: 4169614 - DNA, 23 bp, Homo sapiens
cacctcatgcctggcccccctcc

SEQ ID NO: 4169615 - DNA, 21 bp, Homo sapiens
cacctccctatactgcttgga

SEQ ID NO: 4169616 - DNA, 21 bp, Homo sapiens
cacctctcaatattcaataaa

SEQ ID NO: 4169617 - DNA, 17 bp, Homo sapiens
cacctctggctttgtct

SEQ ID NO: 4169618 - DNA, 16 bp, Homo sapiens
cacctcttccttccgc

SEQ ID NO: 4169619 - DNA, 15 bp, Homo sapiens
cacctgaaccactgt

SEQ ID NO: 4169620 - DNA, 20 bp, Homo sapiens
cacctgccagcctggcttct

SEQ ID NO: 4169621 - DNA, 18 bp, Homo sapiens
cacctgccctgccctgcc

SEQ ID NO: 4169622 - DNA, 19 bp, Homo sapiens
cacctgccctgccctgcca

SEQ ID NO: 4169623 - DNA, 17 bp, Homo sapiens
cacctgcctatccatcc

SEQ ID NO: 4169624 - DNA, 11 bp, Homo sapiens
cacctgctgga

SEQ ID NO: 4169625 - DNA, 14 bp, Homo sapiens
cacctgcttctcag

SEQ ID NO: 4169626 - DNA, 15 bp, Homo sapiens
cacctggagcccgct

SEQ ID NO: 4169627 - DNA, 23 bp, Homo sapiens
cacctggagcccgcttcaagctc

SEQ ID NO: 4169628 - DNA, 17 bp, Homo sapiens
cacctgggagaaatctg

SEQ ID NO: 4169629 - DNA, 16 bp, Homo sapiens
cacctgtactcaggag

SEQ ID NO: 4169630 - DNA, 23 bp, Homo sapiens
cacctgtactcaggaggctgagg

SEQ ID NO: 4169631 - DNA, 14 bp, Homo sapiens
cacctgtctgtctg

SEQ ID NO: 4169632 - DNA, 18 bp, Homo sapiens
caccttaccaactttctg

SEQ ID NO: 4169633 - DNA, 15 bp, Homo sapiens
caccttagtggcttt

SEQ ID NO: 4169634 - DNA, 17 bp, Homo sapiens
caccttcaattcctggg

SEQ ID NO: 4169635 - DNA, 20 bp, Homo sapiens
caccttccccagactcagct

SEQ ID NO: 4169636 - DNA, 16 bp, Homo sapiens
caccttccctctttct

SEQ ID NO: 4169637 - DNA, 16 bp, Homo sapiens
caccttggactcctcc

SEQ ID NO: 4169638 - DNA, 13 bp, Homo sapiens
caccttggagcct

SEQ ID NO: 4169639 - DNA, 15 bp, Homo sapiens
caccttggagcctga

SEQ ID NO: 4169640 - DNA, 19 bp, Homo sapiens
cacctttgggatcagcctc

SEQ ID NO: 4169641 - DNA, 17 bp, Homo sapiens
cacgactcttcctgcaa

SEQ ID NO: 4169642 - DNA, 16 bp, Homo sapiens
cacgcaggaactccca

SEQ ID NO: 4169643 - DNA, 17 bp, Homo sapiens
cacgcaggaactcccag

SEQ ID NO: 4169644 - DNA, 20 bp, Homo sapiens
cacgcaggaactcccagcaa

SEQ ID NO: 4169645 - DNA, 22 bp, Homo sapiens
cacgccactgcactccagcctg

SEQ ID NO: 4169646 - DNA, 20 bp, Homo sapiens
cacgccattgtactccagcc

SEQ ID NO: 4169647 - DNA, 22 bp, Homo sapiens
cacgcctatgatcccagcactt

SEQ ID NO: 4169648 - DNA, 17 bp, Homo sapiens
cacgcctgtaatcccag

SEQ ID NO: 4169649 - DNA, 21 bp, Homo sapiens
cacggcgtccctgagggccct

SEQ ID NO: 4169650 - DNA, 16 bp, Homo sapiens
cacggggatcacagcg

SEQ ID NO: 4169651 - DNA, 18 bp, Homo sapiens
cacgtatttatatttgga

SEQ ID NO: 4169652 - DNA, 16 bp, Homo sapiens
cacgtccagaattttt

SEQ ID NO: 4169653 - DNA, 14 bp, Homo sapiens
cacgtgacacaaac

SEQ ID NO: 4169654 - DNA, 17 bp, Homo sapiens
cacgtggtgtccctgcg

SEQ ID NO: 4169655 - DNA, 22 bp, Homo sapiens
cactaaactttacccaaaaact

SEQ ID NO: 4169656 - DNA, 20 bp, Homo sapiens
caactacccccagctgtgct

SEQ ID NO: 4169657 - DNA, 17 bp, Homo sapiens
caactattttcagatgt

SEQ ID NO: 4169658 - DNA, 15 bp, Homo sapiens
caactccaacttcta

SEQ ID NO: 4169659 - DNA, 13 bp, Homo sapiens
caactcccacgac

SEQ ID NO: 4169660 - DNA, 17 bp, Homo sapiens
caactccgtgtgcctgg

SEQ ID NO: 4169661 - DNA, 18 bp, Homo sapiens
caactccgtgtgcctggg

SEQ ID NO: 4169662 - DNA, 15 bp, Homo sapiens
caactctccactcca

SEQ ID NO: 4169663 - DNA, 12 bp, Homo sapiens
caactgctctgc

SEQ ID NO: 4169664 - DNA, 12 bp, Homo sapiens
caactggcaggc

SEQ ID NO: 4169665 - DNA, 12 bp, Homo sapiens
caacttggaaaa

SEQ ID NO: 4169666 - DNA, 20 bp, Homo sapiens
caacttggaaaaagaaagaa

SEQ ID NO: 4169667 - DNA, 16 bp, Homo sapiens
caacttggctgcagga

SEQ ID NO: 4169668 - DNA, 14 bp, Homo sapiens
caacttgtgttcta

SEQ ID NO: 4169669 - DNA, 21 bp, Homo sapiens
caagaaacatcattctacata

SEQ ID NO: 4169670 - DNA, 22 bp, Homo sapiens
caagaaactagtatctctggcc

SEQ ID NO: 4169671 - DNA, 16 bp, Homo sapiens
caagaaagctggtaaa

SEQ ID NO: 4169672 - DNA, 16 bp, Homo sapiens
caagaaggcaaaaata

SEQ ID NO: 4169673 - DNA, 17 bp, Homo sapiens
caagaattctagaaaat

SEQ ID NO: 4169674 - DNA, 15 bp, Homo sapiens
caagacacaggctca

SEQ ID NO: 4169675 - DNA, 24 bp, Homo sapiens
caagacactagttcagaggaagca

SEQ ID NO: 4169676 - DNA, 12 bp, Homo sapiens
caagacatttct

SEQ ID NO: 4169677 - DNA, 15 bp, Homo sapiens
caagaccctgtctca

SEQ ID NO: 4169678 - DNA, 20 bp, Homo sapiens
caagagatcagcagtggcag

SEQ ID NO: 4169679 - DNA, 13 bp, Homo sapiens
caagagcccagca

SEQ ID NO: 4169680 - DNA, 19 bp, Homo sapiens
caagaggtgctagctctta

SEQ ID NO: 4169681 - DNA, 15 bp, Homo sapiens
caagataactgagaa

SEQ ID NO: 4169682 - DNA, 16 bp, Homo sapiens
caagataactgagaat

SEQ ID NO: 4169683 - DNA, 18 bp, Homo sapiens
caagatacatagtaaatg

SEQ ID NO: 4169684 - DNA, 16 bp, Homo sapiens
caagatcgcgccactg

SEQ ID NO: 4169685 - DNA, 15 bp, Homo sapiens
caagatctttcagga

SEQ ID NO: 4169686 - DNA, 21 bp, Homo sapiens
caagatggaaaataaattata

SEQ ID NO: 4169687 - DNA, 15 bp, Homo sapiens
caagatgtcagactg

SEQ ID NO: 4169688 - DNA, 16 bp, Homo sapiens
caagatgtcagactgg

SEQ ID NO: 4169689 - DNA, 17 bp, Homo sapiens
caagcaacataaaacaa

SEQ ID NO: 4169690 - DNA, 14 bp, Homo sapiens
caagcacttctttt

SEQ ID NO: 4169691 - DNA, 16 bp, Homo sapiens
caagcattcagaagaa

SEQ ID NO: 4169692 - DNA, 17 bp, Homo sapiens
caagcattcagaagaaa

SEQ ID NO: 4169693 - DNA, 21 bp, Homo sapiens
caagcctgcagcgagctgaga

SEQ ID NO: 4169694 - DNA, 16 bp, Homo sapiens
caagccttactcacct

SEQ ID NO: 4169695 - DNA, 20 bp, Homo sapiens
caagccttactcacctctct

SEQ ID NO: 4169696 - DNA, 23 bp, Homo sapiens
caagccttactcacctctctcta

SEQ ID NO: 4169697 - DNA, 18 bp, Homo sapiens
caagcgtgcagcttgttc

SEQ ID NO: 4169698 - DNA, 14 bp, Homo sapiens
caagctcaaccttg

SEQ ID NO: 4169699 - DNA, 12 bp, Homo sapiens
caagctggaagc

SEQ ID NO: 4169700 - DNA, 14 bp, Homo sapiens
caagctggaagcac

SEQ ID NO: 4169701 - DNA, 20 bp, Homo sapiens
caaggacaacctgcccctcc

SEQ ID NO: 4169702 - DNA, 22 bp, Homo sapiens
caagggatctgccattgggacc

SEQ ID NO: 4169703 - DNA, 21 bp, Homo sapiens
caagggccatgctgaagggac

SEQ ID NO: 4169704 - DNA, 18 bp, Homo sapiens
caagggtatgggaagcca

SEQ ID NO: 4169705 - DNA, 14 bp, Homo sapiens
caaggtctgctttt

SEQ ID NO: 4169706 - DNA, 13 bp, Homo sapiens
caaggtctttaaa

SEQ ID NO: 4169707 - DNA, 19 bp, Homo sapiens
caaggtgaatagcacaggt

SEQ ID NO: 4169708 - DNA, 15 bp, Homo sapiens
caaggtgatttcaga

SEQ ID NO: 4169709 - DNA, 17 bp, Homo sapiens
caaggtgctctgtgtcc

SEQ ID NO: 4169710 - DNA, 21 bp, Homo sapiens
caaggtgctgatgtcaaagtg

SEQ ID NO: 4169711 - DNA, 24 bp, Homo sapiens
caaggtgggctgagccctggcagg

SEQ ID NO: 4169712 - DNA, 19 bp, Homo sapiens
caaggttccctctgagaat

SEQ ID NO: 4169713 - DNA, 20 bp, Homo sapiens
caagtaccaccaagggatct

SEQ ID NO: 4169714 - DNA, 23 bp, Homo sapiens
caagtagaatctcagttgatttt

SEQ ID NO: 4169715 - DNA, 21 bp, Homo sapiens
caagtagatcatggcagcatg

SEQ ID NO: 4169716 - DNA, 14 bp, Homo sapiens
caagtatctaactc

SEQ ID NO: 4169717 - DNA, 23 bp, Homo sapiens
caagtattaggggtaatatattg

SEQ ID NO: 4169718 - DNA, 20 bp, Homo sapiens
caagtcaacactcttcttga

SEQ ID NO: 4169719 - DNA, 14 bp, Homo sapiens
caagtccaacctgc

SEQ ID NO: 4169720 - DNA, 18 bp, Homo sapiens
caagtccaacctgcctgt

SEQ ID NO: 4169721 - DNA, 20 bp, Homo sapiens
caagtccaacctgcctgtgc

SEQ ID NO: 4169722 - DNA, 18 bp, Homo sapiens
caagtccctgactctctg

SEQ ID NO: 4169723 - DNA, 23 bp, Homo sapiens
caagtccctgactctctgtgacc

SEQ ID NO: 4169724 - DNA, 15 bp, Homo sapiens
caagtcctgtgaatt

SEQ ID NO: 4169725 - DNA, 18 bp, Homo sapiens
caagtcctgtgaatttct

SEQ ID NO: 4169726 - DNA, 14 bp, Homo sapiens
caagtctccttccc

SEQ ID NO: 4169727 - DNA, 14 bp, Homo sapiens
caagtctgtttact

SEQ ID NO: 4169728 - DNA, 20 bp, Homo sapiens
caagtctgtttactgcaagg

SEQ ID NO: 4169729 - DNA, 20 bp, Homo sapiens
caagtgccagtcttgtgtct

SEQ ID NO: 4169730 - DNA, 20 bp, Homo sapiens
caagtgcctagactgttact

SEQ ID NO: 4169731 - DNA, 21 bp, Homo sapiens
caagtgcctagactgttactt

SEQ ID NO: 4169732 - DNA, 23 bp, Homo sapiens
caagtggatggcccagcaggcag

SEQ ID NO: 4169733 - DNA, 14 bp, Homo sapiens
caagtgtatatcag

SEQ ID NO: 4169734 - DNA, 16 bp, Homo sapiens
caagtgtatatcagaa

SEQ ID NO: 4169735 - DNA, 16 bp, Homo sapiens
caagtgtgcatatata

SEQ ID NO: 4169736 - DNA, 19 bp, Homo sapiens
caagttagctcaggaggct

SEQ ID NO: 4169737 - DNA, 12 bp, Homo sapiens
caagttattgta

SEQ ID NO: 4169738 - DNA, 17 bp, Homo sapiens
caagttcaatctgtttt

SEQ ID NO: 4169739 - DNA, 18 bp, Homo sapiens
caagttcctgcactccag

SEQ ID NO: 4169740 - DNA, 16 bp, Homo sapiens
caagttctagagaaga

SEQ ID NO: 4169741 - DNA, 23 bp, Homo sapiens
caagttggtcttatagaaagcac

SEQ ID NO: 4169742 - DNA, 18 bp, Homo sapiens
caataaaaatctttgatt

SEQ ID NO: 4169743 - DNA, 18 bp, Homo sapiens
caataaaagttgatcata

SEQ ID NO: 4169744 - DNA, 17 bp, Homo sapiens
caataaagctggacaag

SEQ ID NO: 4169745 - DNA, 10 bp, Homo sapiens
caataacaac

SEQ ID NO: 4169746 - DNA, 23 bp, Homo sapiens
caataacgtttaagccaaaacaa

SEQ ID NO: 4169747 - DNA, 17 bp, Homo sapiens
caataattaatgtgtgt

SEQ ID NO: 4169748 - DNA, 15 bp, Homo sapiens
caatacaacaagaac

SEQ ID NO: 4169749 - DNA, 16 bp, Homo sapiens
caatacaacaagaaca

SEQ ID NO: 4169750 - DNA, 15 bp, Homo sapiens
caatagggtgcagtt

SEQ ID NO: 4169751 - DNA, 16 bp, Homo sapiens
caatataaaaatgtga

SEQ ID NO: 4169752 - DNA, 21 bp, Homo sapiens
caatatgtaaatagtgcagaa

SEQ ID NO: 4169753 - DNA, 19 bp, Homo sapiens
caatattaattataataaa

SEQ ID NO: 4169754 - DNA, 16 bp, Homo sapiens
caatatttactcatca

SEQ ID NO: 4169755 - DNA, 15 bp, Homo sapiens
caatcactgctcccc

SEQ ID NO: 4169756 - DNA, 14 bp, Homo sapiens
caatcagagaataa

SEQ ID NO: 4169757 - DNA, 16 bp, Homo sapiens
caatcagagagcctag

SEQ ID NO: 4169758 - DNA, 17 bp, Homo sapiens
caatcatctgtgtgaaa

SEQ ID NO: 4169759 - DNA, 20 bp, Homo sapiens
caatcatctgtgtgaaaatg

SEQ ID NO: 4169760 - DNA, 15 bp, Homo sapiens
caatccaaataaaga

SEQ ID NO: 4169761 - DNA, 19 bp, Homo sapiens
caatctaacaataatattt

SEQ ID NO: 4169762 - DNA, 21 bp, Homo sapiens
caatctaacaataatatttca

SEQ ID NO: 4169763 - DNA, 16 bp, Homo sapiens
caatctatcttttcca

SEQ ID NO: 4169764 - DNA, 12 bp, Homo sapiens
caatctccaggg

SEQ ID NO: 4169765 - DNA, 18 bp, Homo sapiens
caatctccagggctgccc

SEQ ID NO: 4169766 - DNA, 14 bp, Homo sapiens
caatctgagcaaac

SEQ ID NO: 4169767 - DNA, 15 bp, Homo sapiens
caatctgggactttc

SEQ ID NO: 4169768 - DNA, 12 bp, Homo sapiens
caatgaaaccaa

SEQ ID NO: 4169769 - DNA, 15 bp, Homo sapiens
caatgaaaccaaagc

SEQ ID NO: 4169770 - DNA, 17 bp, Homo sapiens
caatgaaagtttgcact

SEQ ID NO: 4169771 - DNA, 15 bp, Homo sapiens
caatgaaatgcttgt

SEQ ID NO: 4169772 - DNA, 17 bp, Homo sapiens
caatgcacctaaagaaa

SEQ ID NO: 4169773 - DNA, 17 bp, Homo sapiens
caatgggtaaccattaa

SEQ ID NO: 4169774 - DNA, 17 bp, Homo sapiens
caatgtaaatattttaa

SEQ ID NO: 4169775 - DNA, 15 bp, Homo sapiens
caattagcagaagtg

SEQ ID NO: 4169776 - DNA, 23 bp, Homo sapiens
caattaggcagactctttatgct

SEQ ID NO: 4169777 - DNA, 21 bp, Homo sapiens
caattataagaggatatgaac

SEQ ID NO: 4169778 - DNA, 12 bp, Homo sapiens
caattcctgggc

SEQ ID NO: 4169779 - DNA, 14 bp, Homo sapiens
caattgacaacagt

SEQ ID NO: 4169780 - DNA, 14 bp, Homo sapiens
caattggggaagaa

SEQ ID NO: 4169781 - DNA, 18 bp, Homo sapiens
caattggggaagaaaaaa

SEQ ID NO: 4169782 - DNA, 13 bp, Homo sapiens
caattgtcttttt

SEQ ID NO: 4169783 - DNA, 23 bp, Homo sapiens
caatttattaaaatgattgtaaa

SEQ ID NO: 4169784 - DNA, 15 bp, Homo sapiens
cacaaagacacagga

SEQ ID NO: 4169785 - DNA, 12 bp, Homo sapiens
cacaaagacatg

SEQ ID NO: 4169786 - DNA, 14 bp, Homo sapiens
cacaaagacatgga

SEQ ID NO: 4169787 - DNA, 17 bp, Homo sapiens
cacaaagacatggaaga

SEQ ID NO: 4169788 - DNA, 17 bp, Homo sapiens
cacaaagactccttcgt

SEQ ID NO: 4169789 - DNA, 13 bp, Homo sapiens
cacaacatttatt

SEQ ID NO: 4169790 - DNA, 14 bp, Homo sapiens
cacaagaaatttga

SEQ ID NO: 4169791 - DNA, 22 bp, Homo sapiens
cacaagagatcagcagtggcag

SEQ ID NO: 4169792 - DNA, 15 bp, Homo sapiens
cacaagcctgagaac

SEQ ID NO: 4169793 - DNA, 17 bp, Homo sapiens
cacaagccttactcacc

SEQ ID NO: 4169794 - DNA, 19 bp, Homo sapiens
cacaagccttactcacctc

SEQ ID NO: 4169795 - DNA, 12 bp, Homo sapiens
cacaagctggaa

SEQ ID NO: 4169796 - DNA, 12 bp, Homo sapiens
atttttcctttc

SEQ ID NO: 4169797 - DNA, 19 bp, Homo sapiens
atttttgatactaagcatt

SEQ ID NO: 4169798 - DNA, 21 bp, Homo sapiens
atttttgatactaagcattga

SEQ ID NO: 4169799 - DNA, 23 bp, Homo sapiens
atttttgtaataaaaggtatgaa

SEQ ID NO: 4169800 - DNA, 17 bp, Homo sapiens
attttttaaaaaagctt

SEQ ID NO: 4169801 - DNA, 20 bp, Homo sapiens
attttttaaaaaagcttaaa

SEQ ID NO: 4169802 - DNA, 13 bp, Homo sapiens
attttttaataaa

SEQ ID NO: 4169803 - DNA, 13 bp, Homo sapiens
atttttttaagct

SEQ ID NO: 4169804 - DNA, 14 bp, Homo sapiens
atttttttaagtta

SEQ ID NO: 4169805 - DNA, 22 bp, Homo sapiens
attttttttttttggtaattat

SEQ ID NO: 4169806 - DNA, 18 bp, Homo sapiens
caaaaagacagtgtgtgt

SEQ ID NO: 4169807 - DNA, 22 bp, Homo sapiens
caaaaagatgccttttaccatg

SEQ ID NO: 4169808 - DNA, 16 bp, Homo sapiens
caaaaagatttaacaa

SEQ ID NO: 4169809 - DNA, 16 bp, Homo sapiens
caaaaagtttcctttt

SEQ ID NO: 4169810 - DNA, 18 bp, Homo sapiens
caaaaataaaaggaaaac

SEQ ID NO: 4169811 - DNA, 16 bp, Homo sapiens
caaaacaaaacaacaa

SEQ ID NO: 4169812 - DNA, 17 bp, Homo sapiens
caaaacaacaacaatac

SEQ ID NO: 4169813 - DNA, 14 bp, Homo sapiens
caaaacaatgttta

SEQ ID NO: 4169814 - DNA, 18 bp, Homo sapiens
caaaacaatgtttaaacc

SEQ ID NO: 4169815 - DNA, 15 bp, Homo sapiens
caaaacacttaggaa

SEQ ID NO: 4169816 - DNA, 20 bp, Homo sapiens
caaaacacttaggaagaaat

SEQ ID NO: 4169817 - DNA, 21 bp, Homo sapiens
caaaacagatggtagagagag

SEQ ID NO: 4169818 - DNA, 22 bp, Homo sapiens
caaaacgatgaagttatgctgt

SEQ ID NO: 4169819 - DNA, 15 bp, Homo sapiens
caaaactgcatttca

SEQ ID NO: 4169820 - DNA, 13 bp, Homo sapiens
caaaacttaacat

SEQ ID NO: 4169821 - DNA, 17 bp, Homo sapiens
caaaagaagtaaaagca

SEQ ID NO: 4169822 - DNA, 18 bp, Homo sapiens
caaaagaagtaaaagcaa

SEQ ID NO: 4169823 - DNA, 21 bp, Homo sapiens
caaaagaagtaaaagctaatt

SEQ ID NO: 4169824 - DNA, 20 bp, Homo sapiens
caaaagcaagggaccttcat

SEQ ID NO: 4169825 - DNA, 14 bp, Homo sapiens
caaaagcacccttg

SEQ ID NO: 4169826 - DNA, 21 bp, Homo sapiens
caaaagctgaccacaaagagt

SEQ ID NO: 4169827 - DNA, 17 bp, Homo sapiens
caaaagttcgaaagaaa

SEQ ID NO: 4169828 - DNA, 15 bp, Homo sapiens
caaaagttttcctga

SEQ ID NO: 4169829 - DNA, 19 bp, Homo sapiens
caaaataaagaatagcaat

SEQ ID NO: 4169830 - DNA, 14 bp, Homo sapiens
caaaataaatgttg

SEQ ID NO: 4169831 - DNA, 14 bp, Homo sapiens
caaaataccagagc

SEQ ID NO: 4169832 - DNA, 16 bp, Homo sapiens
caaaataccagagcct

SEQ ID NO: 4169833 - DNA, 23 bp, Homo sapiens
caaaatcatgaatatttcaaaat

SEQ ID NO: 4169834 - DNA, 17 bp, Homo sapiens
caaaatggaaatgtaat

SEQ ID NO: 4169835 - DNA, 23 bp, Homo sapiens
caaaatggaaatgtaataataat

SEQ ID NO: 4169836 - DNA, 15 bp, Homo sapiens
caaaattaagtgttg

SEQ ID NO: 4169837 - DNA, 18 bp, Homo sapiens
caaaatttctttttttaa

SEQ ID NO: 4169838 - DNA, 14 bp, Homo sapiens
caaacaccagtgag

SEQ ID NO: 4169839 - DNA, 12 bp, Homo sapiens
caaacactccac

SEQ ID NO: 4169840 - DNA, 16 bp, Homo sapiens
caaaccatttcaaatg

SEQ ID NO: 4169841 - DNA, 12 bp, Homo sapiens
caaacctcagag

SEQ ID NO: 4169842 - DNA, 21 bp, Homo sapiens
caaaccttaagataatggata

SEQ ID NO: 4169843 - DNA, 13 bp, Homo sapiens
caaactaggagga

SEQ ID NO: 4169844 - DNA, 17 bp, Homo sapiens
caaactaggaggaaaag

SEQ ID NO: 4169845 - DNA, 16 bp, Homo sapiens
caaactgtgccctgcc

SEQ ID NO: 4169846 - DNA, 18 bp, Homo sapiens
caaacttaacatggaaga

SEQ ID NO: 4169847 - DNA, 22 bp, Homo sapiens
caaacttaacatggaagatatt

SEQ ID NO: 4169848 - DNA, 15 bp, Homo sapiens
caaacttgtgctgag

SEQ ID NO: 4169849 - DNA, 13 bp, Homo sapiens
caaagaaataaaa

SEQ ID NO: 4169850 - DNA, 15 bp, Homo sapiens
caaagaactgcccca

SEQ ID NO: 4169851 - DNA, 15 bp, Homo sapiens
caaagacatggaaga

SEQ ID NO: 4169852 - DNA, 17 bp, Homo sapiens
caaagacatggaagatt

SEQ ID NO: 4169853 - DNA, 16 bp, Homo sapiens
caaagacatggaaggt

SEQ ID NO: 4169854 - DNA, 15 bp, Homo sapiens
caaagagaaaactta

SEQ ID NO: 4169855 - DNA, 15 bp, Homo sapiens
caaagagcctggaga

SEQ ID NO: 4169856 - DNA, 17 bp, Homo sapiens
caaagagcctggagaag

SEQ ID NO: 4169857 - DNA, 23 bp, Homo sapiens
caaagatatatacacaggatcct

SEQ ID NO: 4169858 - DNA, 13 bp, Homo sapiens
caaagattgagaa

SEQ ID NO: 4169859 - DNA, 15 bp, Homo sapiens
caaagattgagaagc

SEQ ID NO: 4169860 - DNA, 16 bp, Homo sapiens
caaagattgagaagcc

SEQ ID NO: 4169861 - DNA, 17 bp, Homo sapiens
caaagattgagaagcca

SEQ ID NO: 4169862 - DNA, 14 bp, Homo sapiens
caaagcaaaagaag

SEQ ID NO: 4169863 - DNA, 17 bp, Homo sapiens
caaagcaaaagaagtaa

SEQ ID NO: 4169864 - DNA, 22 bp, Homo sapiens
caaagcaagcattcagaagaaa

SEQ ID NO: 4169865 - DNA, 12 bp, Homo sapiens
caaagcaccagc

SEQ ID NO: 4169866 - DNA, 20 bp, Homo sapiens
caaagcacctgaaccactgt

SEQ ID NO: 4169867 - DNA, 22 bp, Homo sapiens
caaagccaaactctgccagcca

SEQ ID NO: 4169868 - DNA, 23 bp, Homo sapiens
caaagcccagctctttgttcagt

SEQ ID NO: 4169869 - DNA, 21 bp, Homo sapiens
caaagccgtgcctttctctgg

SEQ ID NO: 4169870 - DNA, 23 bp, Homo sapiens
caaagccgtgcctttctctggct

SEQ ID NO: 4169871 - DNA, 13 bp, Homo sapiens
caaagctaggatg

SEQ ID NO: 4169872 - DNA, 16 bp, Homo sapiens
caaaggaaaccaaagg

SEQ ID NO: 4169873 - DNA, 22 bp, Homo sapiens
caaaggaatcgtttcaaatgga

SEQ ID NO: 4169874 - DNA, 18 bp, Homo sapiens
caaagggctgaaagccat

SEQ ID NO: 4169875 - DNA, 21 bp, Homo sapiens
caaagggctgaaagccatttg

SEQ ID NO: 4169876 - DNA, 13 bp, Homo sapiens
caaaggtggctct

SEQ ID NO: 4169877 - DNA, 15 bp, Homo sapiens
caaagtctaaagttt

SEQ ID NO: 4169878 - DNA, 23 bp, Homo sapiens
caaagtctgggaaattctatatg

SEQ ID NO: 4169879 - DNA, 13 bp, Homo sapiens
caaagtctgtgtg

SEQ ID NO: 4169880 - DNA, 14 bp, Homo sapiens
caaagtctgtgtga

SEQ ID NO: 4169881 - DNA, 16 bp, Homo sapiens
caaagtgccactcatt

SEQ ID NO: 4169882 - DNA, 22 bp, Homo sapiens
caaagtggggggtggacacaga

SEQ ID NO: 4169883 - DNA, 17 bp, Homo sapiens
caaagttggggcaggct

SEQ ID NO: 4169884 - DNA, 18 bp, Homo sapiens
caaataaactctaaacat

SEQ ID NO: 4169885 - DNA, 14 bp, Homo sapiens
caaataaattggaa

SEQ ID NO: 4169886 - DNA, 21 bp, Homo sapiens
caaataaattggaatttaaaa

SEQ ID NO: 4169887 - DNA, 15 bp, Homo sapiens
caaatattaccaaaa

SEQ ID NO: 4169888 - DNA, 21 bp, Homo sapiens
caaatattgttaccatgaaga

SEQ ID NO: 4169889 - DNA, 19 bp, Homo sapiens
caaatcaccacaaactgta

SEQ ID NO: 4169890 - DNA, 20 bp, Homo sapiens
caaatcaccacaaactgtaa

SEQ ID NO: 4169891 - DNA, 15 bp, Homo sapiens
caaatccacaagcca

SEQ ID NO: 4169892 - DNA, 16 bp, Homo sapiens
caaatccactgacaga

SEQ ID NO: 4169893 - DNA, 17 bp, Homo sapiens
caaatccactgacagat

SEQ ID NO: 4169894 - DNA, 17 bp, Homo sapiens
caaatccttagatctgg

SEQ ID NO: 4169895 - DNA, 22 bp, Homo sapiens
caaatcttggttgatgccaaaa

SEQ ID NO: 4169896 - DNA, 18 bp, Homo sapiens
caaatgtaaaataagtat

SEQ ID NO: 4169897 - DNA, 22 bp, Homo sapiens
caaattctacagcatacagagc

SEQ ID NO: 4169898 - DNA, 15 bp, Homo sapiens
caaattctcaccaaa

SEQ ID NO: 4169899 - DNA, 11 bp, Homo sapiens
caaatttcaca

SEQ ID NO: 4169900 - DNA, 20 bp, Homo sapiens
caaatttgcaaaactgtgct

SEQ ID NO: 4169901 - DNA, 21 bp, Homo sapiens
caaattttgatgccaagaaag

SEQ ID NO: 4169902 - DNA, 13 bp, Homo sapiens
caacaaaaagaca

SEQ ID NO: 4169903 - DNA, 21 bp, Homo sapiens
caacaaaaagacatggaaggt

SEQ ID NO: 4169904 - DNA, 11 bp, Homo sapiens
caacaacaata

SEQ ID NO: 4169905 - DNA, 16 bp, Homo sapiens
caacaagaacaacaac

SEQ ID NO: 4169906 - DNA, 15 bp, Homo sapiens
caacaagagtttatt

SEQ ID NO: 4169907 - DNA, 16 bp, Homo sapiens
caacaataacaacaat

SEQ ID NO: 4169908 - DNA, 14 bp, Homo sapiens
caacaatacaacaa

SEQ ID NO: 4169909 - DNA, 13 bp, Homo sapiens
caacaattctaaa

SEQ ID NO: 4169910 - DNA, 13 bp, Homo sapiens
caacaattttaaa

SEQ ID NO: 4169911 - DNA, 13 bp, Homo sapiens
caacacaaagaca

SEQ ID NO: 4169912 - DNA, 15 bp, Homo sapiens
caacacaaagacaca

SEQ ID NO: 4169913 - DNA, 16 bp, Homo sapiens
caacacaaagacacag

SEQ ID NO: 4169914 - DNA, 20 bp, Homo sapiens
caacacaaagacatggaaga

SEQ ID NO: 4169915 - DNA, 20 bp, Homo sapiens
caacactcttcttgagcaga

SEQ ID NO: 4169916 - DNA, 21 bp, Homo sapiens
caacaggtggcaggaccagga

SEQ ID NO: 4169917 - DNA, 23 bp, Homo sapiens
caacaggtggcaggaccaggact

SEQ ID NO: 4169918 - DNA, 16 bp, Homo sapiens
caacagtgaagacaga

SEQ ID NO: 4169919 - DNA, 12 bp, Homo sapiens
caacagttttcc

SEQ ID NO: 4169920 - DNA, 23 bp, Homo sapiens
caacatctaagcctgttgagact

SEQ ID NO: 4169921 - DNA, 22 bp, Homo sapiens
caacatgttatttgtaatagat

SEQ ID NO: 4169922 - DNA, 17 bp, Homo sapiens
caacattcaaagcagca

SEQ ID NO: 4169923 - DNA, 16 bp, Homo sapiens
caaccaaccaaccaac

SEQ ID NO: 4169924 - DNA, 14 bp, Homo sapiens
caaccaaccacaaa

SEQ ID NO: 4169925 - DNA, 14 bp, Homo sapiens
caaccaatggaatg

SEQ ID NO: 4169926 - DNA, 15 bp, Homo sapiens
caacccacagccttt

SEQ ID NO: 4169927 - DNA, 17 bp, Homo sapiens
caaccccccacctgcca

SEQ ID NO: 4169928 - DNA, 15 bp, Homo sapiens
caacctcagtaattt

SEQ ID NO: 4169929 - DNA, 18 bp, Homo sapiens
caacctcagtaatttaga

SEQ ID NO: 4169930 - DNA, 12 bp, Homo sapiens
caacctgcccct

SEQ ID NO: 4169931 - DNA, 12 bp, Homo sapiens
caacctgcctgt

SEQ ID NO: 4169932 - DNA, 18 bp, Homo sapiens
caacgttggtatgataat

SEQ ID NO: 4169933 - DNA, 19 bp, Homo sapiens
caacgttggtatgataatg

SEQ ID NO: 4169934 - DNA, 22 bp, Homo sapiens
caactaaataaaaaattcaaac

SEQ ID NO: 4169935 - DNA, 17 bp, Homo sapiens
caactacccccagctgt

SEQ ID NO: 4169936 - DNA, 19 bp, Homo sapiens
attggacttccttggtttg

SEQ ID NO: 4169937 - DNA, 17 bp, Homo sapiens
attggagctgactgttc

SEQ ID NO: 4169938 - DNA, 13 bp, Homo sapiens
attggctcctcca

SEQ ID NO: 4169939 - DNA, 19 bp, Homo sapiens
attggcttattttttaaaa

SEQ ID NO: 4169940 - DNA, 18 bp, Homo sapiens
attgggaagctgggggaa

SEQ ID NO: 4169941 - DNA, 22 bp, Homo sapiens
attgggacacacatcaaaaacc

SEQ ID NO: 4169942 - DNA, 19 bp, Homo sapiens
attggggtcttttggctct

SEQ ID NO: 4169943 - DNA, 14 bp, Homo sapiens
attgtaaaaacaaa

SEQ ID NO: 4169944 - DNA, 15 bp, Homo sapiens
attgtaaaattgtat

SEQ ID NO: 4169945 - DNA, 18 bp, Homo sapiens
attgtaaaccattaatga

SEQ ID NO: 4169946 - DNA, 22 bp, Homo sapiens
attgtacactaacatatttaga

SEQ ID NO: 4169947 - DNA, 14 bp, Homo sapiens
attgtacagctgtt

SEQ ID NO: 4169948 - DNA, 17 bp, Homo sapiens
attgtacagctgtttaa

SEQ ID NO: 4169949 - DNA, 15 bp, Homo sapiens
attgtatagagatat

SEQ ID NO: 4169950 - DNA, 21 bp, Homo sapiens
attgtatagagatatgcagaa

SEQ ID NO: 4169951 - DNA, 22 bp, Homo sapiens
attgtatagagatatgcagaag

SEQ ID NO: 4169952 - DNA, 17 bp, Homo sapiens
attgtcaaagcttgccg

SEQ ID NO: 4169953 - DNA, 19 bp, Homo sapiens
attgtctgtctacatttct

SEQ ID NO: 4169954 - DNA, 16 bp, Homo sapiens
attgtcttaatattgt

SEQ ID NO: 4169955 - DNA, 15 bp, Homo sapiens
attgtgtttcacaaa

SEQ ID NO: 4169956 - DNA, 18 bp, Homo sapiens
attgttccaaatgaatgt

SEQ ID NO: 4169957 - DNA, 19 bp, Homo sapiens
attgttttatctgaatttt

SEQ ID NO: 4169958 - DNA, 15 bp, Homo sapiens
atttaaaaaataact

SEQ ID NO: 4169959 - DNA, 16 bp, Homo sapiens
atttaaaaataagaaa

SEQ ID NO: 4169960 - DNA, 13 bp, Homo sapiens
atttaaaatagca

SEQ ID NO: 4169961 - DNA, 18 bp, Homo sapiens
atttaaaccgctaaaaga

SEQ ID NO: 4169962 - DNA, 24 bp, Homo sapiens
atttaaaccgctaaaagaaacttt

SEQ ID NO: 4169963 - DNA, 21 bp, Homo sapiens
atttaacactaaaattccact

SEQ ID NO: 4169964 - DNA, 18 bp, Homo sapiens
atttaacttgagggtaat

SEQ ID NO: 4169965 - DNA, 21 bp, Homo sapiens
atttaacttgagggtaataaa

SEQ ID NO: 4169966 - DNA, 22 bp, Homo sapiens
atttaacttgagggtaataaac

SEQ ID NO: 4169967 - DNA, 23 bp, Homo sapiens
atttaacttgagggtaataaact

SEQ ID NO: 4169968 - DNA, 21 bp, Homo sapiens
atttaaggtgtgcaattttct

SEQ ID NO: 4169969 - DNA, 20 bp, Homo sapiens
atttaataagagtaaaaata

SEQ ID NO: 4169970 - DNA, 16 bp, Homo sapiens
atttaatgcttaaaaa

SEQ ID NO: 4169971 - DNA, 20 bp, Homo sapiens
atttaatgcttaaaaatgta

SEQ ID NO: 4169972 - DNA, 18 bp, Homo sapiens
atttaatttctattgtgt

SEQ ID NO: 4169973 - DNA, 22 bp, Homo sapiens
atttaatttctattgtgtttca

SEQ ID NO: 4169974 - DNA, 13 bp, Homo sapiens
atttacatataat

SEQ ID NO: 4169975 - DNA, 13 bp, Homo sapiens
atttactaaaaga

SEQ ID NO: 4169976 - DNA, 22 bp, Homo sapiens
atttactcattcatttattcat

SEQ ID NO: 4169977 - DNA, 13 bp, Homo sapiens
atttagaaaactt

SEQ ID NO: 4169978 - DNA, 17 bp, Homo sapiens
atttagaaaactttaaa

SEQ ID NO: 4169979 - DNA, 18 bp, Homo sapiens
atttagaaaactttaaag

SEQ ID NO: 4169980 - DNA, 14 bp, Homo sapiens
atttagaactgtat

SEQ ID NO: 4169981 - DNA, 23 bp, Homo sapiens
atttagggaagcagggacacccc

SEQ ID NO: 4169982 - DNA, 14 bp, Homo sapiens
atttagttatagtt

SEQ ID NO: 4169983 - DNA, 14 bp, Homo sapiens
atttagtttttaac

SEQ ID NO: 4169984 - DNA, 17 bp, Homo sapiens
atttagtttttaacaat

SEQ ID NO: 4169985 - DNA, 12 bp, Homo sapiens
atttatatattt

SEQ ID NO: 4169986 - DNA, 22 bp, Homo sapiens
atttatatcttatatataataa

SEQ ID NO: 4169987 - DNA, 14 bp, Homo sapiens
atttatatttggaa

SEQ ID NO: 4169988 - DNA, 17 bp, Homo sapiens
atttatcgcagaccttt

SEQ ID NO: 4169989 - DNA, 20 bp, Homo sapiens
atttatctgtattttttaca

SEQ ID NO: 4169990 - DNA, 20 bp, Homo sapiens
atttatgtaaaatcaataaa

SEQ ID NO: 4169991 - DNA, 13 bp, Homo sapiens
atttattgtctgt

SEQ ID NO: 4169992 - DNA, 16 bp, Homo sapiens
atttattgtctgtcta

SEQ ID NO: 4169993 - DNA, 19 bp, Homo sapiens
atttattgtctgtctacat

SEQ ID NO: 4169994 - DNA, 16 bp, Homo sapiens
atttattttattctat

SEQ ID NO: 4169995 - DNA, 22 bp, Homo sapiens
atttattttattctatgtatgt

SEQ ID NO: 4169996 - DNA, 13 bp, Homo sapiens
atttattttgaca

SEQ ID NO: 4169997 - DNA, 17 bp, Homo sapiens
atttcaaatagaatatg

SEQ ID NO: 4169998 - DNA, 11 bp, Homo sapiens
atttcaaatga

SEQ ID NO: 4169999 - DNA, 23 bp, Homo sapiens
atttcaacaagtagctaaagtct

SEQ ID NO: 4170000 - DNA, 12 bp, Homo sapiens
atttcaagtgcc

SEQ ID NO: 4170001 - DNA, 20 bp, Homo sapiens
atttcagactgcagagggga

SEQ ID NO: 4170002 - DNA, 21 bp, Homo sapiens
atttccaaacctggttcatat

SEQ ID NO: 4170003 - DNA, 19 bp, Homo sapiens
atttcctcttataacttct

SEQ ID NO: 4170004 - DNA, 16 bp, Homo sapiens
atttcctggccctcca

SEQ ID NO: 4170005 - DNA, 17 bp, Homo sapiens
atttcggtcataaagaa

SEQ ID NO: 4170006 - DNA, 15 bp, Homo sapiens
atttctactgtgact

SEQ ID NO: 4170007 - DNA, 18 bp, Homo sapiens
atttctactgtgactgat

SEQ ID NO: 4170008 - DNA, 16 bp, Homo sapiens
atttctagtagaaaga

SEQ ID NO: 4170009 - DNA, 23 bp, Homo sapiens
atttctatagccaaaaatagcta

SEQ ID NO: 4170010 - DNA, 19 bp, Homo sapiens
atttctcagtggcttctcc

SEQ ID NO: 4170011 - DNA, 13 bp, Homo sapiens
atttctgaaatga

SEQ ID NO: 4170012 - DNA, 16 bp, Homo sapiens
atttctgaactgttac

SEQ ID NO: 4170013 - DNA, 17 bp, Homo sapiens
atttctgaactgttaca

SEQ ID NO: 4170014 - DNA, 13 bp, Homo sapiens
atttcttcactgt

SEQ ID NO: 4170015 - DNA, 19 bp, Homo sapiens
atttcttttttttaataag

SEQ ID NO: 4170016 - DNA, 22 bp, Homo sapiens
atttcttttttttaataaggaa

SEQ ID NO: 4170017 - DNA, 22 bp, Homo sapiens
atttgaaaacataatctgcaaa

SEQ ID NO: 4170018 - DNA, 18 bp, Homo sapiens
atttgaaagaaagtgtta

SEQ ID NO: 4170019 - DNA, 18 bp, Homo sapiens
atttgaaattttatttag

SEQ ID NO: 4170020 - DNA, 21 bp, Homo sapiens
atttgaaattttatttagttc

SEQ ID NO: 4170021 - DNA, 16 bp, Homo sapiens
atttgaagcaaagcac

SEQ ID NO: 4170022 - DNA, 14 bp, Homo sapiens
atttgacagtgtgg

SEQ ID NO: 4170023 - DNA, 23 bp, Homo sapiens
atttgaggagcagcttcagttgt

SEQ ID NO: 4170024 - DNA, 13 bp, Homo sapiens
atttgatacaaaa

SEQ ID NO: 4170025 - DNA, 15 bp, Homo sapiens
atttgatacaaaatg

SEQ ID NO: 4170026 - DNA, 22 bp, Homo sapiens
atttgatgagttaactgtgaaa

SEQ ID NO: 4170027 - DNA, 18 bp, Homo sapiens
atttgatgcccagataat

SEQ ID NO: 4170028 - DNA, 24 bp, Homo sapiens
atttgatgcccagataatatatta

SEQ ID NO: 4170029 - DNA, 20 bp, Homo sapiens
atttgattgtaaaaacaaaa

SEQ ID NO: 4170030 - DNA, 18 bp, Homo sapiens
atttgcaaaatggaaatg

SEQ ID NO: 4170031 - DNA, 13 bp, Homo sapiens
atttggaaagaga

SEQ ID NO: 4170032 - DNA, 11 bp, Homo sapiens
atttggagact

SEQ ID NO: 4170033 - DNA, 17 bp, Homo sapiens
atttggagactctgtgg

SEQ ID NO: 4170034 - DNA, 14 bp, Homo sapiens
atttggagtgtgta

SEQ ID NO: 4170035 - DNA, 13 bp, Homo sapiens
atttgtaaaaaag

SEQ ID NO: 4170036 - DNA, 14 bp, Homo sapiens
atttgtaagtttat

SEQ ID NO: 4170037 - DNA, 13 bp, Homo sapiens
atttgtacagttc

SEQ ID NO: 4170038 - DNA, 15 bp, Homo sapiens
atttgtacagttcag

SEQ ID NO: 4170039 - DNA, 22 bp, Homo sapiens
atttgtattttgcttaaaattt

SEQ ID NO: 4170040 - DNA, 15 bp, Homo sapiens
atttgtctttcagga

SEQ ID NO: 4170041 - DNA, 17 bp, Homo sapiens
atttgtgaactggaaga

SEQ ID NO: 4170042 - DNA, 20 bp, Homo sapiens
atttgtgaactggaagaaag

SEQ ID NO: 4170043 - DNA, 13 bp, Homo sapiens
atttgtgtgttaa

SEQ ID NO: 4170044 - DNA, 11 bp, Homo sapiens
atttgttacag

SEQ ID NO: 4170045 - DNA, 16 bp, Homo sapiens
atttgtttacatgcag

SEQ ID NO: 4170046 - DNA, 12 bp, Homo sapiens
attttaaaagtt

SEQ ID NO: 4170047 - DNA, 17 bp, Homo sapiens
attttaaacaaaataga

SEQ ID NO: 4170048 - DNA, 17 bp, Homo sapiens
attttaaagaattgtgt

SEQ ID NO: 4170049 - DNA, 13 bp, Homo sapiens
attttaaataaga

SEQ ID NO: 4170050 - DNA, 15 bp, Homo sapiens
attttaactgtgtga

SEQ ID NO: 4170051 - DNA, 18 bp, Homo sapiens
attttaagcattcttaga

SEQ ID NO: 4170052 - DNA, 20 bp, Homo sapiens
attttaagcattcttagact

SEQ ID NO: 4170053 - DNA, 17 bp, Homo sapiens
attttactgattaacaa

SEQ ID NO: 4170054 - DNA, 18 bp, Homo sapiens
attttacttagctggaga

SEQ ID NO: 4170055 - DNA, 16 bp, Homo sapiens
attttagcctcttccc

SEQ ID NO: 4170056 - DNA, 12 bp, Homo sapiens
attttatgtgtt

SEQ ID NO: 4170057 - DNA, 20 bp, Homo sapiens
attttcacatgacgtaaaat

SEQ ID NO: 4170058 - DNA, 22 bp, Homo sapiens
attttcacattcccatctgtca

SEQ ID NO: 4170059 - DNA, 17 bp, Homo sapiens
attttcagtcatctcat

SEQ ID NO: 4170060 - DNA, 20 bp, Homo sapiens
attttcatgacttttccatg

SEQ ID NO: 4170061 - DNA, 19 bp, Homo sapiens
attttcattttaatttata

SEQ ID NO: 4170062 - DNA, 16 bp, Homo sapiens
attttcctaaccacaa

SEQ ID NO: 4170063 - DNA, 12 bp, Homo sapiens
attttctgaatt

SEQ ID NO: 4170064 - DNA, 20 bp, Homo sapiens
attttctgtgtgtacatgta

SEQ ID NO: 4170065 - DNA, 14 bp, Homo sapiens
attttcttaatata

SEQ ID NO: 4170066 - DNA, 20 bp, Homo sapiens
attttgaatgtttatgttct

SEQ ID NO: 4170067 - DNA, 14 bp, Homo sapiens
attttgcttaaaat

SEQ ID NO: 4170068 - DNA, 20 bp, Homo sapiens
attttggaagttttcaggac

SEQ ID NO: 4170069 - DNA, 14 bp, Homo sapiens
attttggagaaatt

SEQ ID NO: 4170070 - DNA, 16 bp, Homo sapiens
attttggtgctattta

SEQ ID NO: 4170071 - DNA, 22 bp, Homo sapiens
attttgtaatttttttgaaaaa

SEQ ID NO: 4170072 - DNA, 15 bp, Homo sapiens
atttttaaacaagta

SEQ ID NO: 4170073 - DNA, 23 bp, Homo sapiens
atttttataaatatgtgaaaatg

SEQ ID NO: 4170074 - DNA, 14 bp, Homo sapiens
atttttatttttga

SEQ ID NO: 4170075 - DNA, 13 bp, Homo sapiens
atgtctaaagagc

SEQ ID NO: 4170076 - DNA, 15 bp, Homo sapiens
atgtctatagagaaa

SEQ ID NO: 4170077 - DNA, 16 bp, Homo sapiens
atgtctgtcctcagag

SEQ ID NO: 4170078 - DNA, 21 bp, Homo sapiens
atgtctgttttccaaagataa

SEQ ID NO: 4170079 - DNA, 12 bp, Homo sapiens
atgtgaaccatt

SEQ ID NO: 4170080 - DNA, 12 bp, Homo sapiens
atgtgagcctga

SEQ ID NO: 4170081 - DNA, 20 bp, Homo sapiens
atgtgataaggaaatcaact

SEQ ID NO: 4170082 - DNA, 14 bp, Homo sapiens
atgtgatgttaact

SEQ ID NO: 4170083 - DNA, 22 bp, Homo sapiens
atgtgcttccctaggctgagct

SEQ ID NO: 4170084 - DNA, 18 bp, Homo sapiens
atgtgtctgggagagcct

SEQ ID NO: 4170085 - DNA, 13 bp, Homo sapiens
atgtgtgtgtgta

SEQ ID NO: 4170086 - DNA, 23 bp, Homo sapiens
atgtgttcaaggaccacatgtgt

SEQ ID NO: 4170087 - DNA, 12 bp, Homo sapiens
atgtgtttgctt

SEQ ID NO: 4170088 - DNA, 15 bp, Homo sapiens
atgtgtttgctttct

SEQ ID NO: 4170089 - DNA, 14 bp, Homo sapiens
atgtgttttctgaa

SEQ ID NO: 4170090 - DNA, 21 bp, Homo sapiens
atgttaaaaaaataagaagaa

SEQ ID NO: 4170091 - DNA, 17 bp, Homo sapiens
atgttaatttatttagt

SEQ ID NO: 4170092 - DNA, 14 bp, Homo sapiens
atgttaatttgtta

SEQ ID NO: 4170093 - DNA, 19 bp, Homo sapiens
atgttacattgtcaaagct

SEQ ID NO: 4170094 - DNA, 17 bp, Homo sapiens
atgttactgtgtgaaga

SEQ ID NO: 4170095 - DNA, 19 bp, Homo sapiens
atgttatttgtaatagatg

SEQ ID NO: 4170096 - DNA, 16 bp, Homo sapiens
atgttctcagaatcag

SEQ ID NO: 4170097 - DNA, 18 bp, Homo sapiens
atgttcttttttgttaca

SEQ ID NO: 4170098 - DNA, 18 bp, Homo sapiens
atgttgattacagtgcag

SEQ ID NO: 4170099 - DNA, 17 bp, Homo sapiens
atgttgtgttgttatca

SEQ ID NO: 4170100 - DNA, 16 bp, Homo sapiens
atgtttaagccaaaat

SEQ ID NO: 4170101 - DNA, 15 bp, Homo sapiens
atgtttacagaactg

SEQ ID NO: 4170102 - DNA, 21 bp, Homo sapiens
atgtttcacataaaacctcat

SEQ ID NO: 4170103 - DNA, 21 bp, Homo sapiens
atgtttgatagattttctgct

SEQ ID NO: 4170104 - DNA, 19 bp, Homo sapiens
atgtttgtctgtgtgctgt

SEQ ID NO: 4170105 - DNA, 15 bp, Homo sapiens
atgtttttcatgaaa

SEQ ID NO: 4170106 - DNA, 18 bp, Homo sapiens
attaaaaccacagaacag

SEQ ID NO: 4170107 - DNA, 18 bp, Homo sapiens
attaaaatgattgtaaaa

SEQ ID NO: 4170108 - DNA, 13 bp, Homo sapiens
attaaacagccaa

SEQ ID NO: 4170109 - DNA, 13 bp, Homo sapiens
attaaaggaagga

SEQ ID NO: 4170110 - DNA, 16 bp, Homo sapiens
attaaaggaaggaaaa

SEQ ID NO: 4170111 - DNA, 20 bp, Homo sapiens
attaaatgaaagaatatcta

SEQ ID NO: 4170112 - DNA, 21 bp, Homo sapiens
attaaatgtatatgtcattta

SEQ ID NO: 4170113 - DNA, 13 bp, Homo sapiens
attaacaaataaa

SEQ ID NO: 4170114 - DNA, 16 bp, Homo sapiens
attaactctctgctat

SEQ ID NO: 4170115 - DNA, 22 bp, Homo sapiens
attaactgggtaatgaaacaaa

SEQ ID NO: 4170116 - DNA, 17 bp, Homo sapiens
attaagataaatagagt

SEQ ID NO: 4170117 - DNA, 17 bp, Homo sapiens
attaagttattgatttt

SEQ ID NO: 4170118 - DNA, 13 bp, Homo sapiens
attaataaatttt

SEQ ID NO: 4170119 - DNA, 18 bp, Homo sapiens
attaatacaatattaatt

SEQ ID NO: 4170120 - DNA, 13 bp, Homo sapiens
attaatagctttt

SEQ ID NO: 4170121 - DNA, 21 bp, Homo sapiens
attaatcgtgtcttcaattaa

SEQ ID NO: 4170122 - DNA, 14 bp, Homo sapiens
attaattataataa

SEQ ID NO: 4170123 - DNA, 15 bp, Homo sapiens
attaattataataaa

SEQ ID NO: 4170124 - DNA, 14 bp, Homo sapiens
attacacttggtaa

SEQ ID NO: 4170125 - DNA, 15 bp, Homo sapiens
attacagaggaagtt

SEQ ID NO: 4170126 - DNA, 17 bp, Homo sapiens
attacagaggaagttat

SEQ ID NO: 4170127 - DNA, 16 bp, Homo sapiens
attacattttactgat

SEQ ID NO: 4170128 - DNA, 17 bp, Homo sapiens
attaccaaaaaagtatt

SEQ ID NO: 4170129 - DNA, 18 bp, Homo sapiens
attaccaaaaaagtattt

SEQ ID NO: 4170130 - DNA, 17 bp, Homo sapiens
attaccagcatttacta

SEQ ID NO: 4170131 - DNA, 13 bp, Homo sapiens
attaccatggaga

SEQ ID NO: 4170132 - DNA, 15 bp, Homo sapiens
attactttgtcccgc

SEQ ID NO: 4170133 - DNA, 16 bp, Homo sapiens
attagaaatagacagt

SEQ ID NO: 4170134 - DNA, 22 bp, Homo sapiens
attagcaaagcaaaaggctgag

SEQ ID NO: 4170135 - DNA, 16 bp, Homo sapiens
attagcagctatgtaa

SEQ ID NO: 4170136 - DNA, 21 bp, Homo sapiens
attagcagctatgtaaatgac

SEQ ID NO: 4170137 - DNA, 17 bp, Homo sapiens
attagccaaaacactta

SEQ ID NO: 4170138 - DNA, 21 bp, Homo sapiens
attaggcagactctttatgct

SEQ ID NO: 4170139 - DNA, 18 bp, Homo sapiens
attaggtactatctgtga

SEQ ID NO: 4170140 - DNA, 19 bp, Homo sapiens
attaggtactatctgtgaa

SEQ ID NO: 4170141 - DNA, 20 bp, Homo sapiens
attaggtactatctgtgaag

SEQ ID NO: 4170142 - DNA, 14 bp, Homo sapiens
attataaaaccatg

SEQ ID NO: 4170143 - DNA, 17 bp, Homo sapiens
attataacagcaaggaa

SEQ ID NO: 4170144 - DNA, 14 bp, Homo sapiens
attataagatgtca

SEQ ID NO: 4170145 - DNA, 18 bp, Homo sapiens
attataataaaggtcaca

SEQ ID NO: 4170146 - DNA, 22 bp, Homo sapiens
attataataaaggtcacataaa

SEQ ID NO: 4170147 - DNA, 13 bp, Homo sapiens
attatataggttg

SEQ ID NO: 4170148 - DNA, 20 bp, Homo sapiens
attatataggttgtgcaaat

SEQ ID NO: 4170149 - DNA, 13 bp, Homo sapiens
attatcccagctt

SEQ ID NO: 4170150 - DNA, 16 bp, Homo sapiens
attatgtctcaaaata

SEQ ID NO: 4170151 - DNA, 13 bp, Homo sapiens
attattaacttgt

SEQ ID NO: 4170152 - DNA, 22 bp, Homo sapiens
attattgcccagttattcttaa

SEQ ID NO: 4170153 - DNA, 13 bp, Homo sapiens
attatttaataag

SEQ ID NO: 4170154 - DNA, 15 bp, Homo sapiens
attatttaataagag

SEQ ID NO: 4170155 - DNA, 13 bp, Homo sapiens
attattttaaaca

SEQ ID NO: 4170156 - DNA, 17 bp, Homo sapiens
attcaagaaacagaagt

SEQ ID NO: 4170157 - DNA, 19 bp, Homo sapiens
attcacacctcacgctctg

SEQ ID NO: 4170158 - DNA, 13 bp, Homo sapiens
attcacagcccag

SEQ ID NO: 4170159 - DNA, 21 bp, Homo sapiens
attcactctgagtgttttatg

SEQ ID NO: 4170160 - DNA, 17 bp, Homo sapiens
attcagaagaaaaagaa

SEQ ID NO: 4170161 - DNA, 18 bp, Homo sapiens
attcagatatatttttca

SEQ ID NO: 4170162 - DNA, 14 bp, Homo sapiens
attcataaggaaat

SEQ ID NO: 4170163 - DNA, 19 bp, Homo sapiens
attcatgctttctcctttt

SEQ ID NO: 4170164 - DNA, 14 bp, Homo sapiens
attccaacagtgag

SEQ ID NO: 4170165 - DNA, 19 bp, Homo sapiens
attccaagtcaacactctt

SEQ ID NO: 4170166 - DNA, 17 bp, Homo sapiens
attccagagcactgctc

SEQ ID NO: 4170167 - DNA, 15 bp, Homo sapiens
attccatgtccctgt

SEQ ID NO: 4170168 - DNA, 19 bp, Homo sapiens
attcccaactgctctgccc

SEQ ID NO: 4170169 - DNA, 17 bp, Homo sapiens
attcccaagccatggca

SEQ ID NO: 4170170 - DNA, 20 bp, Homo sapiens
attcccactaagctttctcc

SEQ ID NO: 4170171 - DNA, 16 bp, Homo sapiens
attccccatctcaggc

SEQ ID NO: 4170172 - DNA, 17 bp, Homo sapiens
attcctatctgtggatg

SEQ ID NO: 4170173 - DNA, 19 bp, Homo sapiens
attcctggcatgacactct

SEQ ID NO: 4170174 - DNA, 13 bp, Homo sapiens
attcctgttctct

SEQ ID NO: 4170175 - DNA, 12 bp, Homo sapiens
attccttctgga

SEQ ID NO: 4170176 - DNA, 19 bp, Homo sapiens
attcgaggtgtcaccctgc

SEQ ID NO: 4170177 - DNA, 21 bp, Homo sapiens
attcgcctgtgggaagagaag

SEQ ID NO: 4170178 - DNA, 22 bp, Homo sapiens
attcgcctgtgggaagagaagg

SEQ ID NO: 4170179 - DNA, 16 bp, Homo sapiens
attctaaaatgattgt

SEQ ID NO: 4170180 - DNA, 15 bp, Homo sapiens
attctaaaatgcctt

SEQ ID NO: 4170181 - DNA, 16 bp, Homo sapiens
attctaaagctttctg

SEQ ID NO: 4170182 - DNA, 19 bp, Homo sapiens
attctacataatggaaaac

SEQ ID NO: 4170183 - DNA, 17 bp, Homo sapiens
attctagccaaactatt

SEQ ID NO: 4170184 - DNA, 22 bp, Homo sapiens
attctataactcgaggagctca

SEQ ID NO: 4170185 - DNA, 16 bp, Homo sapiens
attctatgtatgttaa

SEQ ID NO: 4170186 - DNA, 14 bp, Homo sapiens
attctattcaaaag

SEQ ID NO: 4170187 - DNA, 13 bp, Homo sapiens
attctcaccagga

SEQ ID NO: 4170188 - DNA, 16 bp, Homo sapiens
attctcaccaggaagg

SEQ ID NO: 4170189 - DNA, 16 bp, Homo sapiens
attctgaacaattctc

SEQ ID NO: 4170190 - DNA, 19 bp, Homo sapiens
attctgagatccagcacaa

SEQ ID NO: 4170191 - DNA, 22 bp, Homo sapiens
attctggacaggatgtgtttgc

SEQ ID NO: 4170192 - DNA, 17 bp, Homo sapiens
attctgtggtgggaaca

SEQ ID NO: 4170193 - DNA, 22 bp, Homo sapiens
attcttaagggaacttccacat

SEQ ID NO: 4170194 - DNA, 19 bp, Homo sapiens
attcttccagtgcaacaaa

SEQ ID NO: 4170195 - DNA, 22 bp, Homo sapiens
attcttctggtgctactccatg

SEQ ID NO: 4170196 - DNA, 16 bp, Homo sapiens
attgaaaaaaatatat

SEQ ID NO: 4170197 - DNA, 15 bp, Homo sapiens
attgaacatgcaatt

SEQ ID NO: 4170198 - DNA, 17 bp, Homo sapiens
attgaataagtattctt

SEQ ID NO: 4170199 - DNA, 22 bp, Homo sapiens
attgaatggctatgtttttaat

SEQ ID NO: 4170200 - DNA, 17 bp, Homo sapiens
attgacaacagttacat

SEQ ID NO: 4170201 - DNA, 14 bp, Homo sapiens
attgacttctcttg

SEQ ID NO: 4170202 - DNA, 18 bp, Homo sapiens
attgacttctcttgaatt

SEQ ID NO: 4170203 - DNA, 16 bp, Homo sapiens
attgagttttgagtac

SEQ ID NO: 4170204 - DNA, 22 bp, Homo sapiens
attgatagcaggtgtaataaga

SEQ ID NO: 4170205 - DNA, 23 bp, Homo sapiens
attgatcactttgttaaaaatat

SEQ ID NO: 4170206 - DNA, 23 bp, Homo sapiens
attgcaggtgcctggcttgctgt

SEQ ID NO: 4170207 - DNA, 16 bp, Homo sapiens
attgcctgcagagaga

SEQ ID NO: 4170208 - DNA, 23 bp, Homo sapiens
attgccttcctcgtgcagagctg

SEQ ID NO: 4170209 - DNA, 23 bp, Homo sapiens
attgcgaaacaacttgtgttcta

SEQ ID NO: 4170210 - DNA, 17 bp, Homo sapiens
attgctaccgagaaggt

SEQ ID NO: 4170211 - DNA, 15 bp, Homo sapiens
attgctgctggtaat

SEQ ID NO: 4170212 - DNA, 15 bp, Homo sapiens
attgctttgccaaaa

SEQ ID NO: 4170213 - DNA, 23 bp, Homo sapiens
attgctttgccaaaataccagag

SEQ ID NO: 4170214 - DNA, 17 bp, Homo sapiens
attggacaaagaacctt

SEQ ID NO: 4170215 - DNA, 12 bp, Homo sapiens
atgataatgaac

SEQ ID NO: 4170216 - DNA, 15 bp, Homo sapiens
atgataatgaacaga

SEQ ID NO: 4170217 - DNA, 13 bp, Homo sapiens
atgataatgataa

SEQ ID NO: 4170218 - DNA, 18 bp, Homo sapiens
atgataatgataacttgt

SEQ ID NO: 4170219 - DNA, 14 bp, Homo sapiens
atgatagtgtgatt

SEQ ID NO: 4170220 - DNA, 15 bp, Homo sapiens
atgatagtgtgattt

SEQ ID NO: 4170221 - DNA, 11 bp, Homo sapiens
atgatcctgaa

SEQ ID NO: 4170222 - DNA, 14 bp, Homo sapiens
atgatgaaacattc

SEQ ID NO: 4170223 - DNA, 14 bp, Homo sapiens
atgatgatgatgat

SEQ ID NO: 4170224 - DNA, 16 bp, Homo sapiens
atgatgatgatgatga

SEQ ID NO: 4170225 - DNA, 23 bp, Homo sapiens
atgatgattccttgagcatttta

SEQ ID NO: 4170226 - DNA, 16 bp, Homo sapiens
atgatggtgctgacct

SEQ ID NO: 4170227 - DNA, 14 bp, Homo sapiens
atgatgttaaaaaa

SEQ ID NO: 4170228 - DNA, 15 bp, Homo sapiens
atgattaatacaata

SEQ ID NO: 4170229 - DNA, 21 bp, Homo sapiens
atgattccttgagcattttat

SEQ ID NO: 4170230 - DNA, 15 bp, Homo sapiens
atgattgtaaaatag

SEQ ID NO: 4170231 - DNA, 14 bp, Homo sapiens
atgatttatagttt

SEQ ID NO: 4170232 - DNA, 15 bp, Homo sapiens
atgcaatataaaaat

SEQ ID NO: 4170233 - DNA, 19 bp, Homo sapiens
atgcacactgttggaatgt

SEQ ID NO: 4170234 - DNA, 22 bp, Homo sapiens
atgcacatgtaacccaaatgtc

SEQ ID NO: 4170235 - DNA, 23 bp, Homo sapiens
atgcaccacccatggagaggttt

SEQ ID NO: 4170236 - DNA, 16 bp, Homo sapiens
atgcacctaaagaaaa

SEQ ID NO: 4170237 - DNA, 18 bp, Homo sapiens
atgcacctaaagaaaaac

SEQ ID NO: 4170238 - DNA, 14 bp, Homo sapiens
atgcagaagtgcat

SEQ ID NO: 4170239 - DNA, 20 bp, Homo sapiens
atgcagaatgtttttaaaat

SEQ ID NO: 4170240 - DNA, 23 bp, Homo sapiens
atgcagaggtaaaagtgtgagca

SEQ ID NO: 4170241 - DNA, 18 bp, Homo sapiens
atgcaggggtcagtgcag

SEQ ID NO: 4170242 - DNA, 17 bp, Homo sapiens
atgcatgcgcaggctca

SEQ ID NO: 4170243 - DNA, 14 bp, Homo sapiens
atgcatgtaaggtc

SEQ ID NO: 4170244 - DNA, 23 bp, Homo sapiens
atgcattctaccactacattttg

SEQ ID NO: 4170245 - DNA, 20 bp, Homo sapiens
atgccaaattgtagttcttg

SEQ ID NO: 4170246 - DNA, 14 bp, Homo sapiens
atgccaacttgtcc

SEQ ID NO: 4170247 - DNA, 15 bp, Homo sapiens
atgccacccagcaac

SEQ ID NO: 4170248 - DNA, 20 bp, Homo sapiens
atgccacccagcaacacaga

SEQ ID NO: 4170249 - DNA, 22 bp, Homo sapiens
atgccattctccagtttcagaa

SEQ ID NO: 4170250 - DNA, 21 bp, Homo sapiens
atgcccagagggcccaggcag

SEQ ID NO: 4170251 - DNA, 22 bp, Homo sapiens
atgcccagagggcccaggcagg

SEQ ID NO: 4170252 - DNA, 19 bp, Homo sapiens
atgccctccctgctgccag

SEQ ID NO: 4170253 - DNA, 18 bp, Homo sapiens
atgccgcggtaggtaagg

SEQ ID NO: 4170254 - DNA, 18 bp, Homo sapiens
atgccgggcgtggtggca

SEQ ID NO: 4170255 - DNA, 21 bp, Homo sapiens
atgcctaatatttaggcaaga

SEQ ID NO: 4170256 - DNA, 16 bp, Homo sapiens
atgcctagactgtgta

SEQ ID NO: 4170257 - DNA, 20 bp, Homo sapiens
atgcctagactgtgtatgtc

SEQ ID NO: 4170258 - DNA, 13 bp, Homo sapiens
atgcctcttaaat

SEQ ID NO: 4170259 - DNA, 19 bp, Homo sapiens
atgcctggcccccctccag

SEQ ID NO: 4170260 - DNA, 20 bp, Homo sapiens
atgcctggcccccctccagg

SEQ ID NO: 4170261 - DNA, 21 bp, Homo sapiens
atgcctgggaatcctgctgcc

SEQ ID NO: 4170262 - DNA, 21 bp, Homo sapiens
atgccttccgggccgggcgga

SEQ ID NO: 4170263 - DNA, 14 bp, Homo sapiens
atgccttcctgtct

SEQ ID NO: 4170264 - DNA, 21 bp, Homo sapiens
atgccttttcccaaaatgttg

SEQ ID NO: 4170265 - DNA, 17 bp, Homo sapiens
atgcgtcccaagcagcc

SEQ ID NO: 4170266 - DNA, 16 bp, Homo sapiens
atgctaagagaagtag

SEQ ID NO: 4170267 - DNA, 14 bp, Homo sapiens
atgctccaggatct

SEQ ID NO: 4170268 - DNA, 12 bp, Homo sapiens
atgctgcctgag

SEQ ID NO: 4170269 - DNA, 17 bp, Homo sapiens
atgctgcttctcctccc

SEQ ID NO: 4170270 - DNA, 21 bp, Homo sapiens
atgctggacggcattcctgct

SEQ ID NO: 4170271 - DNA, 21 bp, Homo sapiens
atgctggcggcgcagagggaa

SEQ ID NO: 4170272 - DNA, 19 bp, Homo sapiens
atgctggggtcatataaaa

SEQ ID NO: 4170273 - DNA, 22 bp, Homo sapiens
atgctgtcactggcagagcaca

SEQ ID NO: 4170274 - DNA, 20 bp, Homo sapiens
atgcttagaattctgagatc

SEQ ID NO: 4170275 - DNA, 15 bp, Homo sapiens
atgcttcttccttac

SEQ ID NO: 4170276 - DNA, 13 bp, Homo sapiens
atgcttcttctca

SEQ ID NO: 4170277 - DNA, 16 bp, Homo sapiens
atgcttgcaaaaacta

SEQ ID NO: 4170278 - DNA, 15 bp, Homo sapiens
atgctttccaaaacc

SEQ ID NO: 4170279 - DNA, 13 bp, Homo sapiens
atgctttctcctt

SEQ ID NO: 4170280 - DNA, 15 bp, Homo sapiens
atgctttctcctttt

SEQ ID NO: 4170281 - DNA, 16 bp, Homo sapiens
atgctttgaaacagaa

SEQ ID NO: 4170282 - DNA, 17 bp, Homo sapiens
atgctttgaaacagaaa

SEQ ID NO: 4170283 - DNA, 22 bp, Homo sapiens
atgctttttgaatgttatttgt

SEQ ID NO: 4170284 - DNA, 23 bp, Homo sapiens
atggaaacctgaaaaaaagttta

SEQ ID NO: 4170285 - DNA, 20 bp, Homo sapiens
atggaaatgtaataataatg

SEQ ID NO: 4170286 - DNA, 15 bp, Homo sapiens
atggaagattagagg

SEQ ID NO: 4170287 - DNA, 22 bp, Homo sapiens
atggaagattagaggtttgtca

SEQ ID NO: 4170288 - DNA, 15 bp, Homo sapiens
atggaaggttagagg

SEQ ID NO: 4170289 - DNA, 22 bp, Homo sapiens
atggaaggttagaggtttgtca

SEQ ID NO: 4170290 - DNA, 20 bp, Homo sapiens
atggaaggttaggtttgtca

SEQ ID NO: 4170291 - DNA, 16 bp, Homo sapiens
atggaatttaatttat

SEQ ID NO: 4170292 - DNA, 15 bp, Homo sapiens
atggacaaatggact

SEQ ID NO: 4170293 - DNA, 21 bp, Homo sapiens
atggacaccccttatccagga

SEQ ID NO: 4170294 - DNA, 13 bp, Homo sapiens
atggagaaggaag

SEQ ID NO: 4170295 - DNA, 15 bp, Homo sapiens
atggagaaggaaggc

SEQ ID NO: 4170296 - DNA, 13 bp, Homo sapiens
atggagaggtttg

SEQ ID NO: 4170297 - DNA, 23 bp, Homo sapiens
atggagcgcacctgccccctggt

SEQ ID NO: 4170298 - DNA, 20 bp, Homo sapiens
atggagtgggagatcagcca

SEQ ID NO: 4170299 - DNA, 21 bp, Homo sapiens
atggagtgggagatcagccac

SEQ ID NO: 4170300 - DNA, 19 bp, Homo sapiens
atggataacctatatgatt

SEQ ID NO: 4170301 - DNA, 14 bp, Homo sapiens
atggataatcttcg

SEQ ID NO: 4170302 - DNA, 12 bp, Homo sapiens
atggattctaaa

SEQ ID NO: 4170303 - DNA, 14 bp, Homo sapiens
atggattctaaaat

SEQ ID NO: 4170304 - DNA, 22 bp, Homo sapiens
atggcagacagtcaaggagatg

SEQ ID NO: 4170305 - DNA, 18 bp, Homo sapiens
atggcagcatgaattcca

SEQ ID NO: 4170306 - DNA, 15 bp, Homo sapiens
atggcatgagaaata

SEQ ID NO: 4170307 - DNA, 17 bp, Homo sapiens
atggcatgagaaataca

SEQ ID NO: 4170308 - DNA, 12 bp, Homo sapiens
atggccatggaa

SEQ ID NO: 4170309 - DNA, 16 bp, Homo sapiens
atggcccagcaggcag

SEQ ID NO: 4170310 - DNA, 19 bp, Homo sapiens
atggctatatggcaagaaa

SEQ ID NO: 4170311 - DNA, 16 bp, Homo sapiens
atggctttgctttgtg

SEQ ID NO: 4170312 - DNA, 11 bp, Homo sapiens
atggggtgggg

SEQ ID NO: 4170313 - DNA, 22 bp, Homo sapiens
atgggtcacacctgacaaatgg

SEQ ID NO: 4170314 - DNA, 16 bp, Homo sapiens
atgggttggtgcttct

SEQ ID NO: 4170315 - DNA, 14 bp, Homo sapiens
atggtagagagagt

SEQ ID NO: 4170316 - DNA, 15 bp, Homo sapiens
atggtagagagagtt

SEQ ID NO: 4170317 - DNA, 21 bp, Homo sapiens
atggtatctgggtaagaagaa

SEQ ID NO: 4170318 - DNA, 18 bp, Homo sapiens
atggtcctgcagaaagct

SEQ ID NO: 4170319 - DNA, 18 bp, Homo sapiens
atggtctcagaaaccaaa

SEQ ID NO: 4170320 - DNA, 20 bp, Homo sapiens
atggtctggatctcctgacc

SEQ ID NO: 4170321 - DNA, 15 bp, Homo sapiens
atggtctttgggcag

SEQ ID NO: 4170322 - DNA, 18 bp, Homo sapiens
atggtgcagttgacagca

SEQ ID NO: 4170323 - DNA, 23 bp, Homo sapiens
atggtgttgatacgtgtgtgaag

SEQ ID NO: 4170324 - DNA, 20 bp, Homo sapiens
atggtgttgccctgagtgga

SEQ ID NO: 4170325 - DNA, 21 bp, Homo sapiens
atggttctgtgacccatctgt

SEQ ID NO: 4170326 - DNA, 15 bp, Homo sapiens
atggttgccttaaag

SEQ ID NO: 4170327 - DNA, 18 bp, Homo sapiens
atggttgccttaaagaaa

SEQ ID NO: 4170328 - DNA, 23 bp, Homo sapiens
atggttggtaacacaaattttca

SEQ ID NO: 4170329 - DNA, 20 bp, Homo sapiens
atggttttctccaagagcta

SEQ ID NO: 4170330 - DNA, 14 bp, Homo sapiens
atgtaaaatcaata

SEQ ID NO: 4170331 - DNA, 13 bp, Homo sapiens
atgtaaagattgt

SEQ ID NO: 4170332 - DNA, 13 bp, Homo sapiens
atgtaaagtatgt

SEQ ID NO: 4170333 - DNA, 23 bp, Homo sapiens
atgtaaatattttaaagaattgt

SEQ ID NO: 4170334 - DNA, 20 bp, Homo sapiens
atgtaaattttgtatgaaaa

SEQ ID NO: 4170335 - DNA, 15 bp, Homo sapiens
atgtaactattgaat

SEQ ID NO: 4170336 - DNA, 11 bp, Homo sapiens
atgtaattgtt

SEQ ID NO: 4170337 - DNA, 15 bp, Homo sapiens
atgtacgtatatata

SEQ ID NO: 4170338 - DNA, 11 bp, Homo sapiens
atgtagaatga

SEQ ID NO: 4170339 - DNA, 18 bp, Homo sapiens
atgtagaatgatttttgc

SEQ ID NO: 4170340 - DNA, 16 bp, Homo sapiens
atgtagccttttatcc

SEQ ID NO: 4170341 - DNA, 20 bp, Homo sapiens
atgtagccttttatccctca

SEQ ID NO: 4170342 - DNA, 23 bp, Homo sapiens
atgtaggggttaacttggtcaga

SEQ ID NO: 4170343 - DNA, 21 bp, Homo sapiens
atgtaggtgtctgcacccagg

SEQ ID NO: 4170344 - DNA, 16 bp, Homo sapiens
atgtatatagatgtgc

SEQ ID NO: 4170345 - DNA, 13 bp, Homo sapiens
atgtatgtgtgtg

SEQ ID NO: 4170346 - DNA, 14 bp, Homo sapiens
atgtatgtgtgtgg

SEQ ID NO: 4170347 - DNA, 20 bp, Homo sapiens
atgtatttatatgttaattt

SEQ ID NO: 4170348 - DNA, 20 bp, Homo sapiens
atgtcaaagagaaaacttat

SEQ ID NO: 4170349 - DNA, 15 bp, Homo sapiens
atgtcaaagtgtaac

SEQ ID NO: 4170350 - DNA, 23 bp, Homo sapiens
atgtcagacatccatgtttgtaa

SEQ ID NO: 4170351 - DNA, 11 bp, Homo sapiens
atgtcagcctt

SEQ ID NO: 4170352 - DNA, 18 bp, Homo sapiens
atgtcagttcataatata

SEQ ID NO: 4170353 - DNA, 22 bp, Homo sapiens
atgtcatcaaatattaccaaaa

SEQ ID NO: 4170354 - DNA, 12 bp, Homo sapiens
tctcaagactga

SEQ ID NO: 4170355 - DNA, 14 bp, Homo sapiens
tctcaatatgctta

SEQ ID NO: 4170356 - DNA, 17 bp, Homo sapiens
tctcaatattcaataaa

SEQ ID NO: 4170357 - DNA, 18 bp, Homo sapiens
tctcaatattcaataaag

SEQ ID NO: 4170358 - DNA, 13 bp, Homo sapiens
tctcacagaggca

SEQ ID NO: 4170359 - DNA, 12 bp, Homo sapiens
tctcaccaggaa

SEQ ID NO: 4170360 - DNA, 15 bp, Homo sapiens
tctcactaaacttta

SEQ ID NO: 4170361 - DNA, 15 bp, Homo sapiens
tctcactgctgtcag

SEQ ID NO: 4170362 - DNA, 19 bp, Homo sapiens
tctcagcctacagcagtgt

SEQ ID NO: 4170363 - DNA, 21 bp, Homo sapiens
tctcatctactcattgtctca

SEQ ID NO: 4170364 - DNA, 20 bp, Homo sapiens
tctcatctcagtgaagaata

SEQ ID NO: 4170365 - DNA, 19 bp, Homo sapiens
tctcattccaacagtgagt

SEQ ID NO: 4170366 - DNA, 12 bp, Homo sapiens
tctccactccat

SEQ ID NO: 4170367 - DNA, 17 bp, Homo sapiens
tctccagagagcaaaca

SEQ ID NO: 4170368 - DNA, 16 bp, Homo sapiens
tctccagggctgcccc

SEQ ID NO: 4170369 - DNA, 23 bp, Homo sapiens
tctccagtttcagaagcaggcag

SEQ ID NO: 4170370 - DNA, 22 bp, Homo sapiens
tctccattctgaaaatagcagg

SEQ ID NO: 4170371 - DNA, 14 bp, Homo sapiens
tctccccctgggct

SEQ ID NO: 4170372 - DNA, 20 bp, Homo sapiens
tctccccctgggctctgccc

SEQ ID NO: 4170373 - DNA, 17 bp, Homo sapiens
tctcccctccctcttcc

SEQ ID NO: 4170374 - DNA, 22 bp, Homo sapiens
tctcccctccctcttccttccc

SEQ ID NO: 4170375 - DNA, 17 bp, Homo sapiens
tctcccctgccctgctg

SEQ ID NO: 4170376 - DNA, 21 bp, Homo sapiens
tctccctccagggaatccgcc

SEQ ID NO: 4170377 - DNA, 17 bp, Homo sapiens
tctccgactgctaggga

SEQ ID NO: 4170378 - DNA, 17 bp, Homo sapiens
tctcctaccccacctca

SEQ ID NO: 4170379 - DNA, 22 bp, Homo sapiens
tctcctaccccacctcatgcct

SEQ ID NO: 4170380 - DNA, 24 bp, Homo sapiens
tctcctaccccacctcatgcctgg

SEQ ID NO: 4170381 - DNA, 12 bp, Homo sapiens
tctcctcccagc

SEQ ID NO: 4170382 - DNA, 14 bp, Homo sapiens
tctcctcccagcgt

SEQ ID NO: 4170383 - DNA, 20 bp, Homo sapiens
tctcctcccagcgtgtgtat

SEQ ID NO: 4170384 - DNA, 16 bp, Homo sapiens
tctcctcccatggcct

SEQ ID NO: 4170385 - DNA, 13 bp, Homo sapiens
tctcctccctgtt

SEQ ID NO: 4170386 - DNA, 23 bp, Homo sapiens
tctcctccctgttatctgctaga

SEQ ID NO: 4170387 - DNA, 12 bp, Homo sapiens
tctcctccgcca

SEQ ID NO: 4170388 - DNA, 21 bp, Homo sapiens
tctcctcctctgtgctcctgt

SEQ ID NO: 4170389 - DNA, 16 bp, Homo sapiens
tctcctgtagcacaaa

SEQ ID NO: 4170390 - DNA, 22 bp, Homo sapiens
tctccttacctgtggagaagcc

SEQ ID NO: 4170391 - DNA, 14 bp, Homo sapiens
tctccttccctctt

SEQ ID NO: 4170392 - DNA, 15 bp, Homo sapiens
tctccttccctcttt

SEQ ID NO: 4170393 - DNA, 21 bp, Homo sapiens
tctcggacctttcagctgtga

SEQ ID NO: 4170394 - DNA, 15 bp, Homo sapiens
tctcgggaaattatt

SEQ ID NO: 4170395 - DNA, 11 bp, Homo sapiens
tctctaatatg

SEQ ID NO: 4170396 - DNA, 16 bp, Homo sapiens
tctctcaatatgctta

SEQ ID NO: 4170397 - DNA, 14 bp, Homo sapiens
tctctcagggttct

SEQ ID NO: 4170398 - DNA, 22 bp, Homo sapiens
tctctccagagagcaaacatag

SEQ ID NO: 4170399 - DNA, 20 bp, Homo sapiens
tctctcgtaactggtttcat

SEQ ID NO: 4170400 - DNA, 19 bp, Homo sapiens
tctctctactcctacctca

SEQ ID NO: 4170401 - DNA, 11 bp, Homo sapiens
tctctctttcc

SEQ ID NO: 4170402 - DNA, 16 bp, Homo sapiens
tctctgaacagaaggt

SEQ ID NO: 4170403 - DNA, 13 bp, Homo sapiens
tctctgctccaga

SEQ ID NO: 4170404 - DNA, 22 bp, Homo sapiens
tctctgcttactaatgtgcccc

SEQ ID NO: 4170405 - DNA, 12 bp, Homo sapiens
tctctggcctcc

SEQ ID NO: 4170406 - DNA, 15 bp, Homo sapiens
tctctggcctcctgg

SEQ ID NO: 4170407 - DNA, 13 bp, Homo sapiens
tctctggctccag

SEQ ID NO: 4170408 - DNA, 22 bp, Homo sapiens
tctctgtaaccgcttctggggc

SEQ ID NO: 4170409 - DNA, 13 bp, Homo sapiens
tctctgtacaaaa

SEQ ID NO: 4170410 - DNA, 18 bp, Homo sapiens
tctctgtgacctgccccg

SEQ ID NO: 4170411 - DNA, 16 bp, Homo sapiens
tctcttacatggccac

SEQ ID NO: 4170412 - DNA, 17 bp, Homo sapiens
tctcttacatggccaca

SEQ ID NO: 4170413 - DNA, 12 bp, Homo sapiens
tctcttccctat

SEQ ID NO: 4170414 - DNA, 15 bp, Homo sapiens
tctcttccctccttc

SEQ ID NO: 4170415 - DNA, 19 bp, Homo sapiens
tctctttatgtctgtggat

SEQ ID NO: 4170416 - DNA, 18 bp, Homo sapiens
tctgaaaatagcaggaca

SEQ ID NO: 4170417 - DNA, 14 bp, Homo sapiens
tctgaaacttaatt

SEQ ID NO: 4170418 - DNA, 19 bp, Homo sapiens
tctgaaacttcataaatgt

SEQ ID NO: 4170419 - DNA, 21 bp, Homo sapiens
tctgaaattggtgggaagcaa

SEQ ID NO: 4170420 - DNA, 15 bp, Homo sapiens
tctgaaccactttgc

SEQ ID NO: 4170421 - DNA, 12 bp, Homo sapiens
tctgaaggagat

SEQ ID NO: 4170422 - DNA, 22 bp, Homo sapiens
tctgaaggatcctggaaccact

SEQ ID NO: 4170423 - DNA, 23 bp, Homo sapiens
tctgaaggatcctggaaccactg

SEQ ID NO: 4170424 - DNA, 13 bp, Homo sapiens
tctgaatggtcca

SEQ ID NO: 4170425 - DNA, 16 bp, Homo sapiens
tctgaatttttaaaca

SEQ ID NO: 4170426 - DNA, 12 bp, Homo sapiens
tctgacctgcag

SEQ ID NO: 4170427 - DNA, 14 bp, Homo sapiens
tctgacctgcaggc

SEQ ID NO: 4170428 - DNA, 18 bp, Homo sapiens
tctgagaagacacaaggt

SEQ ID NO: 4170429 - DNA, 20 bp, Homo sapiens
tctgagaattccaaggagtt

SEQ ID NO: 4170430 - DNA, 16 bp, Homo sapiens
tctgagatccagcaca

SEQ ID NO: 4170431 - DNA, 17 bp, Homo sapiens
tctgagatccagcacaa

SEQ ID NO: 4170432 - DNA, 15 bp, Homo sapiens
tctgagcaagagctg

SEQ ID NO: 4170433 - DNA, 12 bp, Homo sapiens
tctgagctgggc

SEQ ID NO: 4170434 - DNA, 23 bp, Homo sapiens
tctgagtgttttatgagaaagcc

SEQ ID NO: 4170435 - DNA, 14 bp, Homo sapiens
tctgatacccagag

SEQ ID NO: 4170436 - DNA, 13 bp, Homo sapiens
tctgatgtttgtt

SEQ ID NO: 4170437 - DNA, 13 bp, Homo sapiens
tctgattggctca

SEQ ID NO: 4170438 - DNA, 22 bp, Homo sapiens
tctgcagatcttccgtggtcag

SEQ ID NO: 4170439 - DNA, 15 bp, Homo sapiens
tctgcagcaactccc

SEQ ID NO: 4170440 - DNA, 19 bp, Homo sapiens
tctgcagcaactcccacga

SEQ ID NO: 4170441 - DNA, 21 bp, Homo sapiens
tctgcagcaactcccacgact

SEQ ID NO: 4170442 - DNA, 20 bp, Homo sapiens
tctgcagcactttaaccctc

SEQ ID NO: 4170443 - DNA, 23 bp, Homo sapiens
tctgcagcactttaaccctctct

SEQ ID NO: 4170444 - DNA, 17 bp, Homo sapiens
tctgcaggcaccttagt

SEQ ID NO: 4170445 - DNA, 23 bp, Homo sapiens
tctgcagtgaggggagatgctgg

SEQ ID NO: 4170446 - DNA, 13 bp, Homo sapiens
tctgccacagaga

SEQ ID NO: 4170447 - DNA, 16 bp, Homo sapiens
tctgccacagagagtc

SEQ ID NO: 4170448 - DNA, 18 bp, Homo sapiens
tctgcccacacctcggcc

SEQ ID NO: 4170449 - DNA, 14 bp, Homo sapiens
tctgcccgcagagc

SEQ ID NO: 4170450 - DNA, 15 bp, Homo sapiens
tctgcccgcagagcc

SEQ ID NO: 4170451 - DNA, 21 bp, Homo sapiens
tctgcccgcagagcccacgcc

SEQ ID NO: 4170452 - DNA, 13 bp, Homo sapiens
tctgcctttttta

SEQ ID NO: 4170453 - DNA, 19 bp, Homo sapiens
tctgccttttttcacagcc

SEQ ID NO: 4170454 - DNA, 16 bp, Homo sapiens
tctgcgtgactatttt

SEQ ID NO: 4170455 - DNA, 15 bp, Homo sapiens
tctgcgttacaacag

SEQ ID NO: 4170456 - DNA, 15 bp, Homo sapiens
tctgctactgaggca

SEQ ID NO: 4170457 - DNA, 13 bp, Homo sapiens
tctgctccagaga

SEQ ID NO: 4170458 - DNA, 11 bp, Homo sapiens
tctgctgacct

SEQ ID NO: 4170459 - DNA, 18 bp, Homo sapiens
tctggaaaatgtgaccca

SEQ ID NO: 4170460 - DNA, 17 bp, Homo sapiens
tctggaaaccaaatagg

SEQ ID NO: 4170461 - DNA, 19 bp, Homo sapiens
tctggacgccgagggcagc

SEQ ID NO: 4170462 - DNA, 13 bp, Homo sapiens
tctggagcccttg

SEQ ID NO: 4170463 - DNA, 16 bp, Homo sapiens
tctggagcccttgggt

SEQ ID NO: 4170464 - DNA, 24 bp, Homo sapiens
tctggattcaaatgtcagttcata

SEQ ID NO: 4170465 - DNA, 16 bp, Homo sapiens
tctggccaggaagctt

SEQ ID NO: 4170466 - DNA, 17 bp, Homo sapiens
tctggccaggaagcttt

SEQ ID NO: 4170467 - DNA, 13 bp, Homo sapiens
tctggctccagaa

SEQ ID NO: 4170468 - DNA, 14 bp, Homo sapiens
tctggctgagctga

SEQ ID NO: 4170469 - DNA, 21 bp, Homo sapiens
tctggctgagctgaacccatt

SEQ ID NO: 4170470 - DNA, 14 bp, Homo sapiens
tctggcttagaaat

SEQ ID NO: 4170471 - DNA, 15 bp, Homo sapiens
tctggcttccaggta

SEQ ID NO: 4170472 - DNA, 19 bp, Homo sapiens
tctggctttgtctctagcc

SEQ ID NO: 4170473 - DNA, 14 bp, Homo sapiens
tctgggaagggaag

SEQ ID NO: 4170474 - DNA, 15 bp, Homo sapiens
tctgggagagcctgg

SEQ ID NO: 4170475 - DNA, 13 bp, Homo sapiens
tctgggaggtctc

SEQ ID NO: 4170476 - DNA, 18 bp, Homo sapiens
tctgggaggtctccactg

SEQ ID NO: 4170477 - DNA, 13 bp, Homo sapiens
tctgggagtcctg

SEQ ID NO: 4170478 - DNA, 12 bp, Homo sapiens
tctgggccaagt

SEQ ID NO: 4170479 - DNA, 19 bp, Homo sapiens
tctgggccaagttcctcta

SEQ ID NO: 4170480 - DNA, 23 bp, Homo sapiens
tctgggccaagttcctctagtgc

SEQ ID NO: 4170481 - DNA, 15 bp, Homo sapiens
tctggggcagggtta

SEQ ID NO: 4170482 - DNA, 17 bp, Homo sapiens
tctgggtaagaagaaag

SEQ ID NO: 4170483 - DNA, 17 bp, Homo sapiens
tctgggtccctcggagc

SEQ ID NO: 4170484 - DNA, 16 bp, Homo sapiens
tctggtgctactccat

SEQ ID NO: 4170485 - DNA, 19 bp, Homo sapiens
tctggtgctactccatgca

SEQ ID NO: 4170486 - DNA, 21 bp, Homo sapiens
tctggtgtagctcctctgctg

SEQ ID NO: 4170487 - DNA, 15 bp, Homo sapiens
tctggttttaacaat

SEQ ID NO: 4170488 - DNA, 13 bp, Homo sapiens
tctgtatggtcag

SEQ ID NO: 4170489 - DNA, 14 bp, Homo sapiens
tctgtcaatgaaaa

SEQ ID NO: 4170490 - DNA, 21 bp, Homo sapiens
tctgtcagcgcaggtttagtt

SEQ ID NO: 4170491 - DNA, 12 bp, Homo sapiens
tctgtccaagga

SEQ ID NO: 4170492 - DNA, 20 bp, Homo sapiens
tctgtcccggttcaccttgc

SEQ ID NO: 4170493 - DNA, 14 bp, Homo sapiens
tctgtctacatttc

SEQ ID NO: 4170494 - DNA, 15 bp, Homo sapiens
tctgtctacatttct

SEQ ID NO: 4170495 - DNA, 19 bp, Homo sapiens
tcctctcctcctctgtgct

SEQ ID NO: 4170496 - DNA, 23 bp, Homo sapiens
tcctctgagccataccgaccatc

SEQ ID NO: 4170497 - DNA, 15 bp, Homo sapiens
tcctctgcagcactt

SEQ ID NO: 4170498 - DNA, 14 bp, Homo sapiens
tcctctgctgctcc

SEQ ID NO: 4170499 - DNA, 12 bp, Homo sapiens
tcctctgggcag

SEQ ID NO: 4170500 - DNA, 14 bp, Homo sapiens
tcctcttataactt

SEQ ID NO: 4170501 - DNA, 15 bp, Homo sapiens
tcctcttataacttc

SEQ ID NO: 4170502 - DNA, 21 bp, Homo sapiens
tcctcttctcccctcactttt

SEQ ID NO: 4170503 - DNA, 21 bp, Homo sapiens
tcctgaaaaggtttatgaaaa

SEQ ID NO: 4170504 - DNA, 23 bp, Homo sapiens
tcctgaaaaggtttatgaaaaag

SEQ ID NO: 4170505 - DNA, 14 bp, Homo sapiens
tcctgacctgaggc

SEQ ID NO: 4170506 - DNA, 16 bp, Homo sapiens
tcctgacctgaggctc

SEQ ID NO: 4170507 - DNA, 13 bp, Homo sapiens
tcctgagtagctg

SEQ ID NO: 4170508 - DNA, 19 bp, Homo sapiens
tcctgagtttctctctcct

SEQ ID NO: 4170509 - DNA, 18 bp, Homo sapiens
tcctgatggtacaggaaa

SEQ ID NO: 4170510 - DNA, 15 bp, Homo sapiens
tcctgcaatctccag

SEQ ID NO: 4170511 - DNA, 14 bp, Homo sapiens
tcctgcactccaga

SEQ ID NO: 4170512 - DNA, 22 bp, Homo sapiens
tcctgcccccgacagcccagcc

SEQ ID NO: 4170513 - DNA, 23 bp, Homo sapiens
tcctgcccccgacagcccagcct

SEQ ID NO: 4170514 - DNA, 19 bp, Homo sapiens
tcctgctgctgacctgatc

SEQ ID NO: 4170515 - DNA, 22 bp, Homo sapiens
tcctgcttgatgggattctgga

SEQ ID NO: 4170516 - DNA, 16 bp, Homo sapiens
tcctggaaaggctcag

SEQ ID NO: 4170517 - DNA, 21 bp, Homo sapiens
tcctggaatcaaggaatcctg

SEQ ID NO: 4170518 - DNA, 14 bp, Homo sapiens
tcctggagcatccc

SEQ ID NO: 4170519 - DNA, 17 bp, Homo sapiens
tcctggagggggcaagc

SEQ ID NO: 4170520 - DNA, 16 bp, Homo sapiens
tcctggcatgacactc

SEQ ID NO: 4170521 - DNA, 12 bp, Homo sapiens
tcctggccctct

SEQ ID NO: 4170522 - DNA, 11 bp, Homo sapiens
tcctggcttct

SEQ ID NO: 4170523 - DNA, 20 bp, Homo sapiens
tcctggcttctagatctgga

SEQ ID NO: 4170524 - DNA, 23 bp, Homo sapiens
tcctggcttctagatctggaacc

SEQ ID NO: 4170525 - DNA, 20 bp, Homo sapiens
tcctgggagaacctcaggct

SEQ ID NO: 4170526 - DNA, 20 bp, Homo sapiens
tcctgggcatgtttgtctgt

SEQ ID NO: 4170527 - DNA, 15 bp, Homo sapiens
tcctggggctctgtg

SEQ ID NO: 4170528 - DNA, 19 bp, Homo sapiens
tcctggggctctgtgcagg

SEQ ID NO: 4170529 - DNA, 14 bp, Homo sapiens
tcctgggggcccat

SEQ ID NO: 4170530 - DNA, 20 bp, Homo sapiens
tcctgggggctgctgcactg

SEQ ID NO: 4170531 - DNA, 22 bp, Homo sapiens
tcctgggggctgctgcactgcc

SEQ ID NO: 4170532 - DNA, 16 bp, Homo sapiens
tcctggtgaggcccag

SEQ ID NO: 4170533 - DNA, 22 bp, Homo sapiens
tcctggtgaggcccagcctgtc

SEQ ID NO: 4170534 - DNA, 16 bp, Homo sapiens
tcctgtattcagacag

SEQ ID NO: 4170535 - DNA, 16 bp, Homo sapiens
tcctgttctctttgcc

SEQ ID NO: 4170536 - DNA, 22 bp, Homo sapiens
tccttaaaggcaccatctaata

SEQ ID NO: 4170537 - DNA, 17 bp, Homo sapiens
tccttaattcactccca

SEQ ID NO: 4170538 - DNA, 19 bp, Homo sapiens
tccttaattcactcccaca

SEQ ID NO: 4170539 - DNA, 15 bp, Homo sapiens
tccttaccccagctg

SEQ ID NO: 4170540 - DNA, 20 bp, Homo sapiens
tccttaccccagctgcggca

SEQ ID NO: 4170541 - DNA, 15 bp, Homo sapiens
tccttattatcccag

SEQ ID NO: 4170542 - DNA, 23 bp, Homo sapiens
tccttcaagttagctcaggaggc

SEQ ID NO: 4170543 - DNA, 21 bp, Homo sapiens
tccttccaggcccccaccact

SEQ ID NO: 4170544 - DNA, 22 bp, Homo sapiens
tccttccctctttccccacctc

SEQ ID NO: 4170545 - DNA, 17 bp, Homo sapiens
tccttcccttctctcct

SEQ ID NO: 4170546 - DNA, 23 bp, Homo sapiens
tccttcctacacccttggacttg

SEQ ID NO: 4170547 - DNA, 20 bp, Homo sapiens
tccttcgtccccagttgccg

SEQ ID NO: 4170548 - DNA, 15 bp, Homo sapiens
tccttctgccttttt

SEQ ID NO: 4170549 - DNA, 13 bp, Homo sapiens
tccttctggctcc

SEQ ID NO: 4170550 - DNA, 13 bp, Homo sapiens
tccttcttccctg

SEQ ID NO: 4170551 - DNA, 15 bp, Homo sapiens
tccttctttctcttc

SEQ ID NO: 4170552 - DNA, 15 bp, Homo sapiens
tccttctttgtctta

SEQ ID NO: 4170553 - DNA, 19 bp, Homo sapiens
tccttgaagaatctctcct

SEQ ID NO: 4170554 - DNA, 22 bp, Homo sapiens
tccttgaccactggccctgggg

SEQ ID NO: 4170555 - DNA, 14 bp, Homo sapiens
tccttgctctgcag

SEQ ID NO: 4170556 - DNA, 18 bp, Homo sapiens
tccttgctttcatcacta

SEQ ID NO: 4170557 - DNA, 16 bp, Homo sapiens
tccttggaagtttcat

SEQ ID NO: 4170558 - DNA, 14 bp, Homo sapiens
tccttggagagcag

SEQ ID NO: 4170559 - DNA, 19 bp, Homo sapiens
tccttggagagcagctggc

SEQ ID NO: 4170560 - DNA, 19 bp, Homo sapiens
tccttgtcactgaagattg

SEQ ID NO: 4170561 - DNA, 13 bp, Homo sapiens
tcctttacctacc

SEQ ID NO: 4170562 - DNA, 14 bp, Homo sapiens
tcctttaggcagcc

SEQ ID NO: 4170563 - DNA, 16 bp, Homo sapiens
tcctttaggcagcctg

SEQ ID NO: 4170564 - DNA, 17 bp, Homo sapiens
tcctttaggcagcctgc

SEQ ID NO: 4170565 - DNA, 22 bp, Homo sapiens
tcctttcagggaatttcaggaa

SEQ ID NO: 4170566 - DNA, 13 bp, Homo sapiens
tcctttgcctctg

SEQ ID NO: 4170567 - DNA, 18 bp, Homo sapiens
tccttttcttccttcttt

SEQ ID NO: 4170568 - DNA, 19 bp, Homo sapiens
tcctttttctttataaact

SEQ ID NO: 4170569 - DNA, 17 bp, Homo sapiens
tcgaatgaaattaactg

SEQ ID NO: 4170570 - DNA, 16 bp, Homo sapiens
tcgaattaatagcttt

SEQ ID NO: 4170571 - DNA, 18 bp, Homo sapiens
tcgactttatacagaact

SEQ ID NO: 4170572 - DNA, 15 bp, Homo sapiens
tcgagaccagcctgg

SEQ ID NO: 4170573 - DNA, 16 bp, Homo sapiens
tcgagaccagcctggc

SEQ ID NO: 4170574 - DNA, 14 bp, Homo sapiens
tcgaggtgtcaccc

SEQ ID NO: 4170575 - DNA, 17 bp, Homo sapiens
tcgaggtgtcaccctgc

SEQ ID NO: 4170576 - DNA, 18 bp, Homo sapiens
tcgagtttacttcatgag

SEQ ID NO: 4170577 - DNA, 20 bp, Homo sapiens
tcgcccacaagccttactca

SEQ ID NO: 4170578 - DNA, 12 bp, Homo sapiens
tcgccccaccca

SEQ ID NO: 4170579 - DNA, 18 bp, Homo sapiens
tcgcctgtgggaagagaa

SEQ ID NO: 4170580 - DNA, 13 bp, Homo sapiens
tcgcttgcttctg

SEQ ID NO: 4170581 - DNA, 15 bp, Homo sapiens
tcgcttgcttctgca

SEQ ID NO: 4170582 - DNA, 19 bp, Homo sapiens
tcgcttgcttctgcagcaa

SEQ ID NO: 4170583 - DNA, 14 bp, Homo sapiens
tcggccgtgggccg

SEQ ID NO: 4170584 - DNA, 20 bp, Homo sapiens
tcggctggggactgctacct

SEQ ID NO: 4170585 - DNA, 16 bp, Homo sapiens
tcgggaggctgagaca

SEQ ID NO: 4170586 - DNA, 18 bp, Homo sapiens
tcggggcatgctggggca

SEQ ID NO: 4170587 - DNA, 16 bp, Homo sapiens
tcgggggtggcaaggg

SEQ ID NO: 4170588 - DNA, 13 bp, Homo sapiens
tcggtactcccat

SEQ ID NO: 4170589 - DNA, 14 bp, Homo sapiens
tcggtcataaagaa

SEQ ID NO: 4170590 - DNA, 14 bp, Homo sapiens
tcgtccgctcagcc

SEQ ID NO: 4170591 - DNA, 23 bp, Homo sapiens
tcgtcctgcccccgacagcccag

SEQ ID NO: 4170592 - DNA, 14 bp, Homo sapiens
tcgtgcatttgtta

SEQ ID NO: 4170593 - DNA, 13 bp, Homo sapiens
tcgtggacacctg

SEQ ID NO: 4170594 - DNA, 18 bp, Homo sapiens
tcgtggacacctgccctg

SEQ ID NO: 4170595 - DNA, 20 bp, Homo sapiens
tcgtggcagataatcagcct

SEQ ID NO: 4170596 - DNA, 23 bp, Homo sapiens
tcgtggcagataatcagcctctt

SEQ ID NO: 4170597 - DNA, 23 bp, Homo sapiens
tcgtgggagagagacgtgtacat

SEQ ID NO: 4170598 - DNA, 22 bp, Homo sapiens
tcgtgggtgtgtgtagccaagg

SEQ ID NO: 4170599 - DNA, 16 bp, Homo sapiens
tcgtggtagaagccag

SEQ ID NO: 4170600 - DNA, 14 bp, Homo sapiens
tcgttttttacaaa

SEQ ID NO: 4170601 - DNA, 12 bp, Homo sapiens
tctaaagtttac

SEQ ID NO: 4170602 - DNA, 16 bp, Homo sapiens
tctaaagtttacagta

SEQ ID NO: 4170603 - DNA, 17 bp, Homo sapiens
tctaactacaaggacaa

SEQ ID NO: 4170604 - DNA, 17 bp, Homo sapiens
tctaactcttctggaaa

SEQ ID NO: 4170605 - DNA, 17 bp, Homo sapiens
tctaagacccaaagtgg

SEQ ID NO: 4170606 - DNA, 23 bp, Homo sapiens
tctaataaatattgacttctctt

SEQ ID NO: 4170607 - DNA, 15 bp, Homo sapiens
tctaatatattttta

SEQ ID NO: 4170608 - DNA, 13 bp, Homo sapiens
tctaatcagtcct

SEQ ID NO: 4170609 - DNA, 20 bp, Homo sapiens
tctacaagcatttgccctgt

SEQ ID NO: 4170610 - DNA, 21 bp, Homo sapiens
tctacaggatggggacactaa

SEQ ID NO: 4170611 - DNA, 16 bp, Homo sapiens
tctacccggcccagag

SEQ ID NO: 4170612 - DNA, 22 bp, Homo sapiens
tctactttccccagaggaccac

SEQ ID NO: 4170613 - DNA, 13 bp, Homo sapiens
tctagactttctg

SEQ ID NO: 4170614 - DNA, 14 bp, Homo sapiens
tctagactttctgt

SEQ ID NO: 4170615 - DNA, 17 bp, Homo sapiens
tctaggcatattgatca

SEQ ID NO: 4170616 - DNA, 15 bp, Homo sapiens
tctagtagaaagaaa

SEQ ID NO: 4170617 - DNA, 23 bp, Homo sapiens
tctagtagaaagaaaatgtctgt

SEQ ID NO: 4170618 - DNA, 14 bp, Homo sapiens
tctagtgaagatgt

SEQ ID NO: 4170619 - DNA, 15 bp, Homo sapiens
tctagtgaagatgtt

SEQ ID NO: 4170620 - DNA, 15 bp, Homo sapiens
tctagtgacttcctg

SEQ ID NO: 4170621 - DNA, 16 bp, Homo sapiens
tctagtgacttcctgg

SEQ ID NO: 4170622 - DNA, 20 bp, Homo sapiens
tctagtgccctccacagccg

SEQ ID NO: 4170623 - DNA, 20 bp, Homo sapiens
tctagttctcaatcactgct

SEQ ID NO: 4170624 - DNA, 19 bp, Homo sapiens
tctagtttggcacatgcag

SEQ ID NO: 4170625 - DNA, 20 bp, Homo sapiens
tctatacctgtctcctttct

SEQ ID NO: 4170626 - DNA, 20 bp, Homo sapiens
tctatactaccctgggctct

SEQ ID NO: 4170627 - DNA, 13 bp, Homo sapiens
tctatagagaaaa

SEQ ID NO: 4170628 - DNA, 15 bp, Homo sapiens
tctatagagcctggc

SEQ ID NO: 4170629 - DNA, 19 bp, Homo sapiens
tctatagccaaaaatagct

SEQ ID NO: 4170630 - DNA, 13 bp, Homo sapiens
tctatatgatcct

SEQ ID NO: 4170631 - DNA, 20 bp, Homo sapiens
tctatctgcctttacctaca

SEQ ID NO: 4170632 - DNA, 14 bp, Homo sapiens
tctattgagccaag

SEQ ID NO: 4170633 - DNA, 21 bp, Homo sapiens
tctcaaaaaaaaaaaaaacaa

SEQ ID NO: 4170634 - DNA, 18 bp, Homo sapiens
tccatgttagtttttact

SEQ ID NO: 4170635 - DNA, 16 bp, Homo sapiens
tccatgtttgtaaaac

SEQ ID NO: 4170636 - DNA, 21 bp, Homo sapiens
tccattcctaggtcacttgaa

SEQ ID NO: 4170637 - DNA, 20 bp, Homo sapiens
tccattctgaaaatagcagg

SEQ ID NO: 4170638 - DNA, 21 bp, Homo sapiens
tccattctgaaaatagcagga

SEQ ID NO: 4170639 - DNA, 17 bp, Homo sapiens
tccatttggacaaaatg

SEQ ID NO: 4170640 - DNA, 15 bp, Homo sapiens
tccattttacttcca

SEQ ID NO: 4170641 - DNA, 21 bp, Homo sapiens
tcccaaagaagttctggtatg

SEQ ID NO: 4170642 - DNA, 13 bp, Homo sapiens
tcccaaagtgctg

SEQ ID NO: 4170643 - DNA, 20 bp, Homo sapiens
tcccaacctcccctggtcct

SEQ ID NO: 4170644 - DNA, 16 bp, Homo sapiens
tcccaactgctctgcc

SEQ ID NO: 4170645 - DNA, 13 bp, Homo sapiens
tcccaagccatgg

SEQ ID NO: 4170646 - DNA, 19 bp, Homo sapiens
tcccaagtagaatctcagt

SEQ ID NO: 4170647 - DNA, 13 bp, Homo sapiens
tcccaataaagct

SEQ ID NO: 4170648 - DNA, 15 bp, Homo sapiens
tcccaataaagctgg

SEQ ID NO: 4170649 - DNA, 17 bp, Homo sapiens
tcccaataaagctggac

SEQ ID NO: 4170650 - DNA, 18 bp, Homo sapiens
tcccacaggttcaggcga

SEQ ID NO: 4170651 - DNA, 20 bp, Homo sapiens
tcccaccaccttggactcct

SEQ ID NO: 4170652 - DNA, 22 bp, Homo sapiens
tcccactaagctttctcctttg

SEQ ID NO: 4170653 - DNA, 16 bp, Homo sapiens
tcccactatggtggga

SEQ ID NO: 4170654 - DNA, 15 bp, Homo sapiens
tcccactgcccctgc

SEQ ID NO: 4170655 - DNA, 14 bp, Homo sapiens
tcccagaggccagg

SEQ ID NO: 4170656 - DNA, 20 bp, Homo sapiens
tcccagccactcgggaggct

SEQ ID NO: 4170657 - DNA, 15 bp, Homo sapiens
tcccagcgtgtgtat

SEQ ID NO: 4170658 - DNA, 18 bp, Homo sapiens
tcccagctacccaggagg

SEQ ID NO: 4170659 - DNA, 19 bp, Homo sapiens
tcccagctactcagaagcc

SEQ ID NO: 4170660 - DNA, 16 bp, Homo sapiens
tcccagggacacctgg

SEQ ID NO: 4170661 - DNA, 20 bp, Homo sapiens
tcccagggccagggccctgc

SEQ ID NO: 4170662 - DNA, 22 bp, Homo sapiens
tcccataattgctttgccaaaa

SEQ ID NO: 4170663 - DNA, 15 bp, Homo sapiens
tcccatgatccagaa

SEQ ID NO: 4170664 - DNA, 16 bp, Homo sapiens
tcccatttatcgcaga

SEQ ID NO: 4170665 - DNA, 18 bp, Homo sapiens
tccccaaactgtgccctg

SEQ ID NO: 4170666 - DNA, 23 bp, Homo sapiens
tccccaaactgtgccctgccttc

SEQ ID NO: 4170667 - DNA, 12 bp, Homo sapiens
tccccacagcct

SEQ ID NO: 4170668 - DNA, 18 bp, Homo sapiens
tccccacagtcctcacag

SEQ ID NO: 4170669 - DNA, 20 bp, Homo sapiens
tccccaccttcaattcctgg

SEQ ID NO: 4170670 - DNA, 22 bp, Homo sapiens
tccccaccttcaattcctgggc

SEQ ID NO: 4170671 - DNA, 16 bp, Homo sapiens
tccccaccttccccag

SEQ ID NO: 4170672 - DNA, 20 bp, Homo sapiens
tccccaccttccccagactc

SEQ ID NO: 4170673 - DNA, 12 bp, Homo sapiens
tccccagactca

SEQ ID NO: 4170674 - DNA, 16 bp, Homo sapiens
tccccagactcagctc

SEQ ID NO: 4170675 - DNA, 17 bp, Homo sapiens
tccccaggagctctctg

SEQ ID NO: 4170676 - DNA, 21 bp, Homo sapiens
tccccaggagctctctgctga

SEQ ID NO: 4170677 - DNA, 23 bp, Homo sapiens
tccccaggccaggccaccaggat

SEQ ID NO: 4170678 - DNA, 14 bp, Homo sapiens
tccccatctcaggc

SEQ ID NO: 4170679 - DNA, 18 bp, Homo sapiens
tcccccaccccagagttg

SEQ ID NO: 4170680 - DNA, 22 bp, Homo sapiens
tcccccactcctcttatttgct

SEQ ID NO: 4170681 - DNA, 20 bp, Homo sapiens
tccccctgggctctgcccca

SEQ ID NO: 4170682 - DNA, 11 bp, Homo sapiens
tccccgcctgt

SEQ ID NO: 4170683 - DNA, 13 bp, Homo sapiens
tccccgcctgtcc

SEQ ID NO: 4170684 - DNA, 18 bp, Homo sapiens
tccccgcctgtcctgcct

SEQ ID NO: 4170685 - DNA, 12 bp, Homo sapiens
tcccctccctct

SEQ ID NO: 4170686 - DNA, 14 bp, Homo sapiens
tcccctccctcttc

SEQ ID NO: 4170687 - DNA, 15 bp, Homo sapiens
tcccctccctcttcc

SEQ ID NO: 4170688 - DNA, 16 bp, Homo sapiens
tcccctccctcttcct

SEQ ID NO: 4170689 - DNA, 17 bp, Homo sapiens
tcccctctcctccgcca

SEQ ID NO: 4170690 - DNA, 17 bp, Homo sapiens
tcccctggtcctgcact

SEQ ID NO: 4170691 - DNA, 17 bp, Homo sapiens
tcccctgtggtcttgga

SEQ ID NO: 4170692 - DNA, 19 bp, Homo sapiens
tccccttgtgtcagagaca

SEQ ID NO: 4170693 - DNA, 20 bp, Homo sapiens
tcccgagcaaagtctaaagt

SEQ ID NO: 4170694 - DNA, 15 bp, Homo sapiens
tcccgagggagctgc

SEQ ID NO: 4170695 - DNA, 21 bp, Homo sapiens
tcccggactgcaagcagggct

SEQ ID NO: 4170696 - DNA, 13 bp, Homo sapiens
tcccgtgcagctt

SEQ ID NO: 4170697 - DNA, 13 bp, Homo sapiens
tccctaaactgta

SEQ ID NO: 4170698 - DNA, 23 bp, Homo sapiens
tccctaatggtattgggcagttg

SEQ ID NO: 4170699 - DNA, 16 bp, Homo sapiens
tccctagaaacaaagg

SEQ ID NO: 4170700 - DNA, 13 bp, Homo sapiens
tccctcctggagc

SEQ ID NO: 4170701 - DNA, 18 bp, Homo sapiens
tccctctgacctgcaggc

SEQ ID NO: 4170702 - DNA, 11 bp, Homo sapiens
tccctctttcc

SEQ ID NO: 4170703 - DNA, 14 bp, Homo sapiens
tccctgagggccct

SEQ ID NO: 4170704 - DNA, 16 bp, Homo sapiens
tccctgagggcccttc

SEQ ID NO: 4170705 - DNA, 13 bp, Homo sapiens
tccctgatttgga

SEQ ID NO: 4170706 - DNA, 15 bp, Homo sapiens
tccctgctgccaggc

SEQ ID NO: 4170707 - DNA, 17 bp, Homo sapiens
tccctgctgccaggctc

SEQ ID NO: 4170708 - DNA, 19 bp, Homo sapiens
tccctggctctcagaaggt

SEQ ID NO: 4170709 - DNA, 19 bp, Homo sapiens
tccctggtttgcagctgtt

SEQ ID NO: 4170710 - DNA, 18 bp, Homo sapiens
tccctgtgttaactcagg

SEQ ID NO: 4170711 - DNA, 17 bp, Homo sapiens
tcccttaatatcctaaa

SEQ ID NO: 4170712 - DNA, 17 bp, Homo sapiens
tcccttgaaattttaaa

SEQ ID NO: 4170713 - DNA, 19 bp, Homo sapiens
tcccttggaaagttcagcc

SEQ ID NO: 4170714 - DNA, 21 bp, Homo sapiens
tcccttggaaagttcagccag

SEQ ID NO: 4170715 - DNA, 20 bp, Homo sapiens
tcccttggtaattatatctg

SEQ ID NO: 4170716 - DNA, 15 bp, Homo sapiens
tcccttgtgtcaaga

SEQ ID NO: 4170717 - DNA, 21 bp, Homo sapiens
tcccttgtgtcaagacatttc

SEQ ID NO: 4170718 - DNA, 22 bp, Homo sapiens
tcccttgtgtcaagacatttct

SEQ ID NO: 4170719 - DNA, 16 bp, Homo sapiens
tccctttaaagccttt

SEQ ID NO: 4170720 - DNA, 21 bp, Homo sapiens
tccctttcccatgatccagaa

SEQ ID NO: 4170721 - DNA, 16 bp, Homo sapiens
tcccttttatcttcta

SEQ ID NO: 4170722 - DNA, 18 bp, Homo sapiens
tccgaaaccagttaagaa

SEQ ID NO: 4170723 - DNA, 14 bp, Homo sapiens
tccgactctaagct

SEQ ID NO: 4170724 - DNA, 16 bp, Homo sapiens
tccgactctaagctgt

SEQ ID NO: 4170725 - DNA, 17 bp, Homo sapiens
tccgactctaagctgtg

SEQ ID NO: 4170726 - DNA, 17 bp, Homo sapiens
tccgccaaacactccac

SEQ ID NO: 4170727 - DNA, 21 bp, Homo sapiens
tccgcgagggctactcagcag

SEQ ID NO: 4170728 - DNA, 20 bp, Homo sapiens
tccggaggggacccagctcc

SEQ ID NO: 4170729 - DNA, 22 bp, Homo sapiens
tccggaggggacccagctcctc

SEQ ID NO: 4170730 - DNA, 17 bp, Homo sapiens
tccggctgctcctccag

SEQ ID NO: 4170731 - DNA, 16 bp, Homo sapiens
tccgggtgccattccc

SEQ ID NO: 4170732 - DNA, 15 bp, Homo sapiens
tccggtgtgcctgca

SEQ ID NO: 4170733 - DNA, 16 bp, Homo sapiens
tccgtctgtgtatgtg

SEQ ID NO: 4170734 - DNA, 18 bp, Homo sapiens
tccgtggtcagagtgcca

SEQ ID NO: 4170735 - DNA, 19 bp, Homo sapiens
tccgtggtcagagtgccac

SEQ ID NO: 4170736 - DNA, 20 bp, Homo sapiens
tcctaaacccccgctccaga

SEQ ID NO: 4170737 - DNA, 23 bp, Homo sapiens
tcctaaacccccgctccagatct

SEQ ID NO: 4170738 - DNA, 19 bp, Homo sapiens
tcctaaagtgctgagatta

SEQ ID NO: 4170739 - DNA, 14 bp, Homo sapiens
tcctaaatattatg

SEQ ID NO: 4170740 - DNA, 14 bp, Homo sapiens
tcctacaaaatgga

SEQ ID NO: 4170741 - DNA, 18 bp, Homo sapiens
tcctacacccttggactt

SEQ ID NO: 4170742 - DNA, 23 bp, Homo sapiens
tcctaccccacctcatgcctggc

SEQ ID NO: 4170743 - DNA, 14 bp, Homo sapiens
tcctacctcagcct

SEQ ID NO: 4170744 - DNA, 14 bp, Homo sapiens
tcctagaggacctg

SEQ ID NO: 4170745 - DNA, 15 bp, Homo sapiens
tcctagaggacctga

SEQ ID NO: 4170746 - DNA, 21 bp, Homo sapiens
tcctagcaggatctgcccaca

SEQ ID NO: 4170747 - DNA, 13 bp, Homo sapiens
tcctaggtcactt

SEQ ID NO: 4170748 - DNA, 21 bp, Homo sapiens
tcctagtggtaggtcagaaga

SEQ ID NO: 4170749 - DNA, 17 bp, Homo sapiens
tcctattctcaccagga

SEQ ID NO: 4170750 - DNA, 18 bp, Homo sapiens
tcctattttgtaattttt

SEQ ID NO: 4170751 - DNA, 20 bp, Homo sapiens
tcctcaaagcacctgaacca

SEQ ID NO: 4170752 - DNA, 19 bp, Homo sapiens
tcctcaacaacaaaccaaa

SEQ ID NO: 4170753 - DNA, 12 bp, Homo sapiens
tcctcacagcct

SEQ ID NO: 4170754 - DNA, 16 bp, Homo sapiens
tcctcacagcctctcc

SEQ ID NO: 4170755 - DNA, 20 bp, Homo sapiens
tcctcactccaaaataggtg

SEQ ID NO: 4170756 - DNA, 15 bp, Homo sapiens
tcctcaggaacagaa

SEQ ID NO: 4170757 - DNA, 23 bp, Homo sapiens
tcctcatcaccatcgtgtttgca

SEQ ID NO: 4170758 - DNA, 21 bp, Homo sapiens
tcctcatttgcaaacctcaga

SEQ ID NO: 4170759 - DNA, 23 bp, Homo sapiens
tcctcatttgcaaacctcagagg

SEQ ID NO: 4170760 - DNA, 13 bp, Homo sapiens
tcctcccacaatc

SEQ ID NO: 4170761 - DNA, 17 bp, Homo sapiens
tcctcccagcgtgtgta

SEQ ID NO: 4170762 - DNA, 13 bp, Homo sapiens
tcctcccatggcc

SEQ ID NO: 4170763 - DNA, 15 bp, Homo sapiens
tcctcccatggcctt

SEQ ID NO: 4170764 - DNA, 22 bp, Homo sapiens
tcctccccaccttccccagact

SEQ ID NO: 4170765 - DNA, 23 bp, Homo sapiens
tcctccccaccttccccagactc

SEQ ID NO: 4170766 - DNA, 22 bp, Homo sapiens
tcctccccattagagtcagcct

SEQ ID NO: 4170767 - DNA, 14 bp, Homo sapiens
tcctcccccagagc

SEQ ID NO: 4170768 - DNA, 14 bp, Homo sapiens
tcctcctctgtgct

SEQ ID NO: 4170769 - DNA, 20 bp, Homo sapiens
tcctctaagccactcttcca

SEQ ID NO: 4170770 - DNA, 21 bp, Homo sapiens
tcctctaagccactcttccaa

SEQ ID NO: 4170771 - DNA, 18 bp, Homo sapiens
tcctctcactaaacttta

SEQ ID NO: 4170772 - DNA, 18 bp, Homo sapiens
tcctctccctgccaagtc

SEQ ID NO: 4170773 - DNA, 14 bp, Homo sapiens
tcaggaccttttga

SEQ ID NO: 4170774 - DNA, 15 bp, Homo sapiens
tcaggacttggtctg

SEQ ID NO: 4170775 - DNA, 15 bp, Homo sapiens
tcaggagattgttaa

SEQ ID NO: 4170776 - DNA, 12 bp, Homo sapiens
tcaggagcctcc

SEQ ID NO: 4170777 - DNA, 20 bp, Homo sapiens
tcaggagcctcctagggctt

SEQ ID NO: 4170778 - DNA, 17 bp, Homo sapiens
tcaggaggcgaataaat

SEQ ID NO: 4170779 - DNA, 20 bp, Homo sapiens
tcaggaggcgaataaatgtt

SEQ ID NO: 4170780 - DNA, 21 bp, Homo sapiens
tcaggaggcgaataaatgttc

SEQ ID NO: 4170781 - DNA, 20 bp, Homo sapiens
tcaggatactctgtcagatg

SEQ ID NO: 4170782 - DNA, 20 bp, Homo sapiens
tcaggatgccaagtggccct

SEQ ID NO: 4170783 - DNA, 22 bp, Homo sapiens
tcaggatgccaagtggccctca

SEQ ID NO: 4170784 - DNA, 19 bp, Homo sapiens
tcaggattgcaggtgcctg

SEQ ID NO: 4170785 - DNA, 18 bp, Homo sapiens
tcaggcagttccctgttg

SEQ ID NO: 4170786 - DNA, 18 bp, Homo sapiens
tcaggccaggtgcagtgg

SEQ ID NO: 4170787 - DNA, 21 bp, Homo sapiens
tcagggttatacacagaaaag

SEQ ID NO: 4170788 - DNA, 23 bp, Homo sapiens
tcaggttgacagtcccttgctga

SEQ ID NO: 4170789 - DNA, 15 bp, Homo sapiens
tcagtcatattctta

SEQ ID NO: 4170790 - DNA, 20 bp, Homo sapiens
tcagtcatgaggaaagacac

SEQ ID NO: 4170791 - DNA, 23 bp, Homo sapiens
tcagtcatgaggaaagacacaga

SEQ ID NO: 4170792 - DNA, 16 bp, Homo sapiens
tcagtcggtgtgtaat

SEQ ID NO: 4170793 - DNA, 18 bp, Homo sapiens
tcagtctcagaatgtcat

SEQ ID NO: 4170794 - DNA, 14 bp, Homo sapiens
tcagtctcaggagc

SEQ ID NO: 4170795 - DNA, 12 bp, Homo sapiens
tcagtgctgtgg

SEQ ID NO: 4170796 - DNA, 19 bp, Homo sapiens
tcagtggcttctccatcct

SEQ ID NO: 4170797 - DNA, 23 bp, Homo sapiens
tcagtgggacaaaccagagcaga

SEQ ID NO: 4170798 - DNA, 12 bp, Homo sapiens
tcagtgggctcc

SEQ ID NO: 4170799 - DNA, 19 bp, Homo sapiens
tcagtgtctccccgtgtcc

SEQ ID NO: 4170800 - DNA, 17 bp, Homo sapiens
tcagttcctctttgcat

SEQ ID NO: 4170801 - DNA, 23 bp, Homo sapiens
tcatacttctaaatcagaaatag

SEQ ID NO: 4170802 - DNA, 16 bp, Homo sapiens
tcataggttgccaata

SEQ ID NO: 4170803 - DNA, 13 bp, Homo sapiens
tcatagtttcttg

SEQ ID NO: 4170804 - DNA, 15 bp, Homo sapiens
tcatagtttcttggc

SEQ ID NO: 4170805 - DNA, 20 bp, Homo sapiens
tcatataaaaggtgagctca

SEQ ID NO: 4170806 - DNA, 12 bp, Homo sapiens
tcatatgaaaaa

SEQ ID NO: 4170807 - DNA, 21 bp, Homo sapiens
tcatatgaaaaaaatgcattt

SEQ ID NO: 4170808 - DNA, 14 bp, Homo sapiens
tcatatttatactt

SEQ ID NO: 4170809 - DNA, 17 bp, Homo sapiens
tcatcacttttcagtga

SEQ ID NO: 4170810 - DNA, 14 bp, Homo sapiens
tcatcccctacact

SEQ ID NO: 4170811 - DNA, 13 bp, Homo sapiens
tcatccccttgtg

SEQ ID NO: 4170812 - DNA, 22 bp, Homo sapiens
tcatctcagtgaagaatacttc

SEQ ID NO: 4170813 - DNA, 20 bp, Homo sapiens
tcatctggtttttaaaagat

SEQ ID NO: 4170814 - DNA, 14 bp, Homo sapiens
tcatctgtgtgaaa

SEQ ID NO: 4170815 - DNA, 20 bp, Homo sapiens
tcatcttttaattcacctct

SEQ ID NO: 4170816 - DNA, 21 bp, Homo sapiens
tcatcttttaattcacctctt

SEQ ID NO: 4170817 - DNA, 20 bp, Homo sapiens
tcatgaattcttatgcttat

SEQ ID NO: 4170818 - DNA, 17 bp, Homo sapiens
tcatgacatgttatata

SEQ ID NO: 4170819 - DNA, 15 bp, Homo sapiens
tcatgaggaaagaca

SEQ ID NO: 4170820 - DNA, 17 bp, Homo sapiens
tcatgataatgaacaga

SEQ ID NO: 4170821 - DNA, 16 bp, Homo sapiens
tcatgatagtgtgatt

SEQ ID NO: 4170822 - DNA, 21 bp, Homo sapiens
tcatgatttctgtgaagcaaa

SEQ ID NO: 4170823 - DNA, 22 bp, Homo sapiens
tcatgatttctgtgaagcaaaa

SEQ ID NO: 4170824 - DNA, 15 bp, Homo sapiens
tcatgcccttctgat

SEQ ID NO: 4170825 - DNA, 20 bp, Homo sapiens
tcatgccgggcgtggtggca

SEQ ID NO: 4170826 - DNA, 15 bp, Homo sapiens
tcatgcctggccccc

SEQ ID NO: 4170827 - DNA, 22 bp, Homo sapiens
tcatgcctggcccccctccagg

SEQ ID NO: 4170828 - DNA, 23 bp, Homo sapiens
tcatgcctggcccccctccaggc

SEQ ID NO: 4170829 - DNA, 17 bp, Homo sapiens
tcatgcttcttccttac

SEQ ID NO: 4170830 - DNA, 23 bp, Homo sapiens
tcatggagtgacggtcccacact

SEQ ID NO: 4170831 - DNA, 11 bp, Homo sapiens
tcatgtagatt

SEQ ID NO: 4170832 - DNA, 20 bp, Homo sapiens
tcatgtagattttagttcac

SEQ ID NO: 4170833 - DNA, 16 bp, Homo sapiens
tcatgtgtgctgtgct

SEQ ID NO: 4170834 - DNA, 12 bp, Homo sapiens
tcattactaacc

SEQ ID NO: 4170835 - DNA, 19 bp, Homo sapiens
tcattcaggtgttctcttc

SEQ ID NO: 4170836 - DNA, 16 bp, Homo sapiens
tcattcatttattcat

SEQ ID NO: 4170837 - DNA, 17 bp, Homo sapiens
tcattccaacagtgagt

SEQ ID NO: 4170838 - DNA, 13 bp, Homo sapiens
tcattcccctcgt

SEQ ID NO: 4170839 - DNA, 22 bp, Homo sapiens
tcattgaaaaaaatatatgatt

SEQ ID NO: 4170840 - DNA, 16 bp, Homo sapiens
tcattgtgcttaataa

SEQ ID NO: 4170841 - DNA, 16 bp, Homo sapiens
tcatttgaacaactag

SEQ ID NO: 4170842 - DNA, 18 bp, Homo sapiens
tcattttagacactggga

SEQ ID NO: 4170843 - DNA, 20 bp, Homo sapiens
tcattttagacactgggaga

SEQ ID NO: 4170844 - DNA, 21 bp, Homo sapiens
tcattttcttatcttctgcaa

SEQ ID NO: 4170845 - DNA, 13 bp, Homo sapiens
tcattttttctta

SEQ ID NO: 4170846 - DNA, 12 bp, Homo sapiens
tccaaacaccgg

SEQ ID NO: 4170847 - DNA, 19 bp, Homo sapiens
tccaaacaccggcagaaaa

SEQ ID NO: 4170848 - DNA, 13 bp, Homo sapiens
tccaacagtgagt

SEQ ID NO: 4170849 - DNA, 16 bp, Homo sapiens
tccaaccaagtggaaa

SEQ ID NO: 4170850 - DNA, 17 bp, Homo sapiens
tccaaccccccacctgc

SEQ ID NO: 4170851 - DNA, 19 bp, Homo sapiens
tccaactgtgttcattaga

SEQ ID NO: 4170852 - DNA, 15 bp, Homo sapiens
tccaagaatgttgtt

SEQ ID NO: 4170853 - DNA, 22 bp, Homo sapiens
tccaagggtatgggaagccata

SEQ ID NO: 4170854 - DNA, 20 bp, Homo sapiens
tccaagtccaacctgcctgt

SEQ ID NO: 4170855 - DNA, 22 bp, Homo sapiens
tccaagtccaacctgcctgtgc

SEQ ID NO: 4170856 - DNA, 14 bp, Homo sapiens
tccaagttcctgca

SEQ ID NO: 4170857 - DNA, 20 bp, Homo sapiens
tccaagttcctgcactccag

SEQ ID NO: 4170858 - DNA, 21 bp, Homo sapiens
tccaagttcctgcactccaga

SEQ ID NO: 4170859 - DNA, 22 bp, Homo sapiens
tccaatcccatagatgggtctg

SEQ ID NO: 4170860 - DNA, 19 bp, Homo sapiens
tccacaaagccgtgccttt

SEQ ID NO: 4170861 - DNA, 15 bp, Homo sapiens
tccacaaatatgagt

SEQ ID NO: 4170862 - DNA, 23 bp, Homo sapiens
tccacaagcaatggacctttggg

SEQ ID NO: 4170863 - DNA, 14 bp, Homo sapiens
tccacagccgcagc

SEQ ID NO: 4170864 - DNA, 17 bp, Homo sapiens
tccacagccgcagcctc

SEQ ID NO: 4170865 - DNA, 19 bp, Homo sapiens
tccaccaaaccccacttcc

SEQ ID NO: 4170866 - DNA, 18 bp, Homo sapiens
tccaccccctccagctcc

SEQ ID NO: 4170867 - DNA, 21 bp, Homo sapiens
tccaccccctccagctccagt

SEQ ID NO: 4170868 - DNA, 12 bp, Homo sapiens
tccaccctgcag

SEQ ID NO: 4170869 - DNA, 14 bp, Homo sapiens
tccaccctgcaggc

SEQ ID NO: 4170870 - DNA, 15 bp, Homo sapiens
tccaccgcagaagga

SEQ ID NO: 4170871 - DNA, 16 bp, Homo sapiens
tccaccgcagaaggaa

SEQ ID NO: 4170872 - DNA, 23 bp, Homo sapiens
tccacctgcctatccatcctgcg

SEQ ID NO: 4170873 - DNA, 15 bp, Homo sapiens
tccactcttgttcaa

SEQ ID NO: 4170874 - DNA, 12 bp, Homo sapiens
tccactggactt

SEQ ID NO: 4170875 - DNA, 13 bp, Homo sapiens
tccagaaaacaaa

SEQ ID NO: 4170876 - DNA, 23 bp, Homo sapiens
tccagaactgaggtcactgggtt

SEQ ID NO: 4170877 - DNA, 13 bp, Homo sapiens
tccagagacagga

SEQ ID NO: 4170878 - DNA, 15 bp, Homo sapiens
tccagagagcaaaca

SEQ ID NO: 4170879 - DNA, 18 bp, Homo sapiens
tccagagtttcctagaac

SEQ ID NO: 4170880 - DNA, 12 bp, Homo sapiens
tccagatctgca

SEQ ID NO: 4170881 - DNA, 15 bp, Homo sapiens
tccagatctgcactg

SEQ ID NO: 4170882 - DNA, 18 bp, Homo sapiens
tccagcacaactcagtct

SEQ ID NO: 4170883 - DNA, 21 bp, Homo sapiens
tccagcatttgccattcctgg

SEQ ID NO: 4170884 - DNA, 22 bp, Homo sapiens
tccagcatttgccattcctgga

SEQ ID NO: 4170885 - DNA, 13 bp, Homo sapiens
tccagcctgagca

SEQ ID NO: 4170886 - DNA, 13 bp, Homo sapiens
tccagctccagtt

SEQ ID NO: 4170887 - DNA, 22 bp, Homo sapiens
tccaggaatgcctcctccctgg

SEQ ID NO: 4170888 - DNA, 20 bp, Homo sapiens
tccaggatctttgactgaaa

SEQ ID NO: 4170889 - DNA, 19 bp, Homo sapiens
tccaggattgaagagcatt

SEQ ID NO: 4170890 - DNA, 21 bp, Homo sapiens
tccaggcaaagctggagatga

SEQ ID NO: 4170891 - DNA, 12 bp, Homo sapiens
tccaggcaggag

SEQ ID NO: 4170892 - DNA, 18 bp, Homo sapiens
tccaggcaggaggatcac

SEQ ID NO: 4170893 - DNA, 14 bp, Homo sapiens
tccaggccagtggg

SEQ ID NO: 4170894 - DNA, 20 bp, Homo sapiens
tccaggccagtgggcctggt

SEQ ID NO: 4170895 - DNA, 22 bp, Homo sapiens
tccaggctctttggggtcagcc

SEQ ID NO: 4170896 - DNA, 23 bp, Homo sapiens
tccaggctctttggggtcagcca

SEQ ID NO: 4170897 - DNA, 23 bp, Homo sapiens
tccagggaatccgcctgcagagg

SEQ ID NO: 4170898 - DNA, 16 bp, Homo sapiens
tccagggtctaaagag

SEQ ID NO: 4170899 - DNA, 20 bp, Homo sapiens
tccagggtctaaagagaaca

SEQ ID NO: 4170900 - DNA, 17 bp, Homo sapiens
tccaggtatctccagga

SEQ ID NO: 4170901 - DNA, 22 bp, Homo sapiens
tccaggtcaccagcctgactgc

SEQ ID NO: 4170902 - DNA, 14 bp, Homo sapiens
tccaggtggcagga

SEQ ID NO: 4170903 - DNA, 14 bp, Homo sapiens
tccagtaagcacat

SEQ ID NO: 4170904 - DNA, 19 bp, Homo sapiens
tccagtattcttgtcaaaa

SEQ ID NO: 4170905 - DNA, 23 bp, Homo sapiens
tccagtgggaggtgagaccacct

SEQ ID NO: 4170906 - DNA, 14 bp, Homo sapiens
tccagttagttctc

SEQ ID NO: 4170907 - DNA, 23 bp, Homo sapiens
tccagtttagcccttccctgcct

SEQ ID NO: 4170908 - DNA, 15 bp, Homo sapiens
tccataaagcaagct

SEQ ID NO: 4170909 - DNA, 20 bp, Homo sapiens
tccatgaagaccacatccac

SEQ ID NO: 4170910 - DNA, 21 bp, Homo sapiens
tccatgaagaccacatccaca

SEQ ID NO: 4170911 - DNA, 17 bp, Homo sapiens
tcaaagaaaacatagca

SEQ ID NO: 4170912 - DNA, 16 bp, Homo sapiens
tcaaagaaggatggca

SEQ ID NO: 4170913 - DNA, 22 bp, Homo sapiens
tcaaagcaagcattcagaagaa

SEQ ID NO: 4170914 - DNA, 15 bp, Homo sapiens
tcaaagcacatatgt

SEQ ID NO: 4170915 - DNA, 23 bp, Homo sapiens
tcaaagcacctgaaccactgtgg

SEQ ID NO: 4170916 - DNA, 16 bp, Homo sapiens
tcaaagtttaacacaa

SEQ ID NO: 4170917 - DNA, 16 bp, Homo sapiens
tcaaatccactgacag

SEQ ID NO: 4170918 - DNA, 22 bp, Homo sapiens
tcaaatcccacttactttaatg

SEQ ID NO: 4170919 - DNA, 16 bp, Homo sapiens
tcaaatctccagtatt

SEQ ID NO: 4170920 - DNA, 12 bp, Homo sapiens
tcaaatgaacac

SEQ ID NO: 4170921 - DNA, 16 bp, Homo sapiens
tcaaatgtcagttcat

SEQ ID NO: 4170922 - DNA, 12 bp, Homo sapiens
tcaaatttcaca

SEQ ID NO: 4170923 - DNA, 21 bp, Homo sapiens
tcaacaaaaagacatggaagg

SEQ ID NO: 4170924 - DNA, 17 bp, Homo sapiens
tcaacaacaaaccaaaa

SEQ ID NO: 4170925 - DNA, 14 bp, Homo sapiens
tcaacaattctaaa

SEQ ID NO: 4170926 - DNA, 18 bp, Homo sapiens
tcaacacaaagacacagg

SEQ ID NO: 4170927 - DNA, 16 bp, Homo sapiens
tcaacactcttcttga

SEQ ID NO: 4170928 - DNA, 14 bp, Homo sapiens
tcaacagttttcct

SEQ ID NO: 4170929 - DNA, 23 bp, Homo sapiens
tcaacagttttcctatgctttga

SEQ ID NO: 4170930 - DNA, 18 bp, Homo sapiens
tcaacattcaaagcagca

SEQ ID NO: 4170931 - DNA, 18 bp, Homo sapiens
tcaacgttggtatgataa

SEQ ID NO: 4170932 - DNA, 11 bp, Homo sapiens
tcaactccaga

SEQ ID NO: 4170933 - DNA, 19 bp, Homo sapiens
tcaacttattaacaattag

SEQ ID NO: 4170934 - DNA, 18 bp, Homo sapiens
tcaacttgaagcaagctt

SEQ ID NO: 4170935 - DNA, 19 bp, Homo sapiens
tcaacttggaaaaagaaag

SEQ ID NO: 4170936 - DNA, 20 bp, Homo sapiens
tcaacttggaaaaagaaaga

SEQ ID NO: 4170937 - DNA, 18 bp, Homo sapiens
tcaaggaaaaatgctgct

SEQ ID NO: 4170938 - DNA, 20 bp, Homo sapiens
tcaaggaaaaatgctgcttc

SEQ ID NO: 4170939 - DNA, 18 bp, Homo sapiens
tcaaggagatgagcgtcc

SEQ ID NO: 4170940 - DNA, 11 bp, Homo sapiens
tcaagtgccta

SEQ ID NO: 4170941 - DNA, 17 bp, Homo sapiens
tcaagttattgtacagc

SEQ ID NO: 4170942 - DNA, 17 bp, Homo sapiens
tcaatattcaataaagc

SEQ ID NO: 4170943 - DNA, 15 bp, Homo sapiens
tcaatcatctgtgtg

SEQ ID NO: 4170944 - DNA, 20 bp, Homo sapiens
tcaatgttcagttttcctta

SEQ ID NO: 4170945 - DNA, 17 bp, Homo sapiens
tcaattcaaagctgtgt

SEQ ID NO: 4170946 - DNA, 17 bp, Homo sapiens
tcaattcctgggcccca

SEQ ID NO: 4170947 - DNA, 13 bp, Homo sapiens
tcaattttttgct

SEQ ID NO: 4170948 - DNA, 22 bp, Homo sapiens
tcacaacagcctgacaacattt

SEQ ID NO: 4170949 - DNA, 17 bp, Homo sapiens
tcacaagagcccagcag

SEQ ID NO: 4170950 - DNA, 15 bp, Homo sapiens
tcacacatgcatcat

SEQ ID NO: 4170951 - DNA, 19 bp, Homo sapiens
tcacacctcacgctctgga

SEQ ID NO: 4170952 - DNA, 12 bp, Homo sapiens
tcacagcccaga

SEQ ID NO: 4170953 - DNA, 22 bp, Homo sapiens
tcacagcccgggtgtgcctgcc

SEQ ID NO: 4170954 - DNA, 14 bp, Homo sapiens
tcacagcctctccc

SEQ ID NO: 4170955 - DNA, 16 bp, Homo sapiens
tcacagcctctccctt

SEQ ID NO: 4170956 - DNA, 18 bp, Homo sapiens
tcacagggcagagccggg

SEQ ID NO: 4170957 - DNA, 18 bp, Homo sapiens
tcacagttgagtgaaatt

SEQ ID NO: 4170958 - DNA, 22 bp, Homo sapiens
tcacagttggctggatgaaatt

SEQ ID NO: 4170959 - DNA, 19 bp, Homo sapiens
tcacataaactttataaat

SEQ ID NO: 4170960 - DNA, 20 bp, Homo sapiens
tcacataaactttataaatt

SEQ ID NO: 4170961 - DNA, 12 bp, Homo sapiens
tcacattagaag

SEQ ID NO: 4170962 - DNA, 17 bp, Homo sapiens
tcacattttgcctttct

SEQ ID NO: 4170963 - DNA, 11 bp, Homo sapiens
tcaccagcctg

SEQ ID NO: 4170964 - DNA, 22 bp, Homo sapiens
tcacccccatggccccaggccc

SEQ ID NO: 4170965 - DNA, 17 bp, Homo sapiens
tcaccccttatcctgag

SEQ ID NO: 4170966 - DNA, 12 bp, Homo sapiens
tcaccctgcaga

SEQ ID NO: 4170967 - DNA, 21 bp, Homo sapiens
tcaccgagacggctggacctg

SEQ ID NO: 4170968 - DNA, 23 bp, Homo sapiens
tcaccgagacggctggacctgca

SEQ ID NO: 4170969 - DNA, 17 bp, Homo sapiens
tcaccgtcacaataaaa

SEQ ID NO: 4170970 - DNA, 18 bp, Homo sapiens
tcacctcaggccaggtgc

SEQ ID NO: 4170971 - DNA, 17 bp, Homo sapiens
tcacctggtatccatta

SEQ ID NO: 4170972 - DNA, 21 bp, Homo sapiens
tcaccttgccgagagaggcgc

SEQ ID NO: 4170973 - DNA, 16 bp, Homo sapiens
tcaccttgcttttcag

SEQ ID NO: 4170974 - DNA, 14 bp, Homo sapiens
tcaccttggagcct

SEQ ID NO: 4170975 - DNA, 14 bp, Homo sapiens
tcacgactcttcct

SEQ ID NO: 4170976 - DNA, 22 bp, Homo sapiens
tcacgccactgcactccagcct

SEQ ID NO: 4170977 - DNA, 16 bp, Homo sapiens
tcacgctctggacatg

SEQ ID NO: 4170978 - DNA, 16 bp, Homo sapiens
tcacgctttttgaaaa

SEQ ID NO: 4170979 - DNA, 17 bp, Homo sapiens
tcactaaatcttttata

SEQ ID NO: 4170980 - DNA, 14 bp, Homo sapiens
tcactccaaaatag

SEQ ID NO: 4170981 - DNA, 19 bp, Homo sapiens
tcactccggtgtgcctgca

SEQ ID NO: 4170982 - DNA, 22 bp, Homo sapiens
tcactccggtgtgcctgcagcc

SEQ ID NO: 4170983 - DNA, 18 bp, Homo sapiens
tcactcttcctgcaagga

SEQ ID NO: 4170984 - DNA, 21 bp, Homo sapiens
tcactgagttttccatggcag

SEQ ID NO: 4170985 - DNA, 17 bp, Homo sapiens
tcactgctcccccgtgt

SEQ ID NO: 4170986 - DNA, 11 bp, Homo sapiens
tcactggagcc

SEQ ID NO: 4170987 - DNA, 14 bp, Homo sapiens
tcactggcagagca

SEQ ID NO: 4170988 - DNA, 20 bp, Homo sapiens
tcactggtccatttctcagt

SEQ ID NO: 4170989 - DNA, 15 bp, Homo sapiens
tcactgttgaaaatt

SEQ ID NO: 4170990 - DNA, 16 bp, Homo sapiens
tcacttcatacttcta

SEQ ID NO: 4170991 - DNA, 16 bp, Homo sapiens
tcacttgggcccagga

SEQ ID NO: 4170992 - DNA, 21 bp, Homo sapiens
tcacttgggcccaggaggtca

SEQ ID NO: 4170993 - DNA, 18 bp, Homo sapiens
tcagaaaagaaaaccatt

SEQ ID NO: 4170994 - DNA, 14 bp, Homo sapiens
tcagaaaagggaag

SEQ ID NO: 4170995 - DNA, 15 bp, Homo sapiens
tcagaaataggaaga

SEQ ID NO: 4170996 - DNA, 19 bp, Homo sapiens
tcagaaataggaagattaa

SEQ ID NO: 4170997 - DNA, 16 bp, Homo sapiens
tcagaagaaaaagaag

SEQ ID NO: 4170998 - DNA, 13 bp, Homo sapiens
tcagaagcacaaa

SEQ ID NO: 4170999 - DNA, 14 bp, Homo sapiens
tcagaagcaggcag

SEQ ID NO: 4171000 - DNA, 15 bp, Homo sapiens
tcagaagcctgaggc

SEQ ID NO: 4171001 - DNA, 22 bp, Homo sapiens
tcagaaggcctcactcaagcct

SEQ ID NO: 4171002 - DNA, 17 bp, Homo sapiens
tcagaagtttggcaata

SEQ ID NO: 4171003 - DNA, 22 bp, Homo sapiens
tcagaatcaggttgacagtccc

SEQ ID NO: 4171004 - DNA, 18 bp, Homo sapiens
tcagaccagtactgggaa

SEQ ID NO: 4171005 - DNA, 17 bp, Homo sapiens
tcagaccctaggaagct

SEQ ID NO: 4171006 - DNA, 11 bp, Homo sapiens
tcagactctgg

SEQ ID NO: 4171007 - DNA, 15 bp, Homo sapiens
tcagactctgggtcc

SEQ ID NO: 4171008 - DNA, 15 bp, Homo sapiens
tcagactgcagaggg

SEQ ID NO: 4171009 - DNA, 14 bp, Homo sapiens
tcagactgctggga

SEQ ID NO: 4171010 - DNA, 13 bp, Homo sapiens
tcagactggctgg

SEQ ID NO: 4171011 - DNA, 19 bp, Homo sapiens
tcagacttttatcaaaatc

SEQ ID NO: 4171012 - DNA, 21 bp, Homo sapiens
tcagagacagaccccttggct

SEQ ID NO: 4171013 - DNA, 18 bp, Homo sapiens
tcagagacttagaagcat

SEQ ID NO: 4171014 - DNA, 14 bp, Homo sapiens
tcagagagcctaga

SEQ ID NO: 4171015 - DNA, 14 bp, Homo sapiens
tcagagcaggctca

SEQ ID NO: 4171016 - DNA, 13 bp, Homo sapiens
tcagaggaagcac

SEQ ID NO: 4171017 - DNA, 21 bp, Homo sapiens
tcagagggataaggcagttga

SEQ ID NO: 4171018 - DNA, 13 bp, Homo sapiens
tcagagtgccact

SEQ ID NO: 4171019 - DNA, 15 bp, Homo sapiens
tcagatgggaagaca

SEQ ID NO: 4171020 - DNA, 17 bp, Homo sapiens
tcagcaatagggtgcag

SEQ ID NO: 4171021 - DNA, 16 bp, Homo sapiens
tcagcactcagaaaag

SEQ ID NO: 4171022 - DNA, 12 bp, Homo sapiens
tcagcagccccc

SEQ ID NO: 4171023 - DNA, 17 bp, Homo sapiens
tcagcagccccctgccc

SEQ ID NO: 4171024 - DNA, 16 bp, Homo sapiens
tcagcagtaagcaggc

SEQ ID NO: 4171025 - DNA, 14 bp, Homo sapiens
tcagcagtggcagg

SEQ ID NO: 4171026 - DNA, 20 bp, Homo sapiens
tcagcataagtaaacaacat

SEQ ID NO: 4171027 - DNA, 16 bp, Homo sapiens
tcagcatttaataaat

SEQ ID NO: 4171028 - DNA, 12 bp, Homo sapiens
tcagccagggcc

SEQ ID NO: 4171029 - DNA, 13 bp, Homo sapiens
tcagccagggcca

SEQ ID NO: 4171030 - DNA, 14 bp, Homo sapiens
tcagccattcctgt

SEQ ID NO: 4171031 - DNA, 18 bp, Homo sapiens
tcagccattcctgttctc

SEQ ID NO: 4171032 - DNA, 19 bp, Homo sapiens
tcagccattcctgttctct

SEQ ID NO: 4171033 - DNA, 10 bp, Homo sapiens
tcagcccttg

SEQ ID NO: 4171034 - DNA, 19 bp, Homo sapiens
tcagcccttggcttctgct

SEQ ID NO: 4171035 - DNA, 18 bp, Homo sapiens
tcagccgcagacaagtaa

SEQ ID NO: 4171036 - DNA, 21 bp, Homo sapiens
tcagcctcttaaagctgcctg

SEQ ID NO: 4171037 - DNA, 22 bp, Homo sapiens
tcagcctcttaaagctgcctgt

SEQ ID NO: 4171038 - DNA, 13 bp, Homo sapiens
tcagcctgaggct

SEQ ID NO: 4171039 - DNA, 20 bp, Homo sapiens
tcagcctgaggctgagactg

SEQ ID NO: 4171040 - DNA, 21 bp, Homo sapiens
tcagccttccccctcccaggg

SEQ ID NO: 4171041 - DNA, 13 bp, Homo sapiens
tcagcgccctgga

SEQ ID NO: 4171042 - DNA, 22 bp, Homo sapiens
tcagcgccctggagtcccctgg

SEQ ID NO: 4171043 - DNA, 18 bp, Homo sapiens
tcagctaaagcccaacct

SEQ ID NO: 4171044 - DNA, 17 bp, Homo sapiens
tcagctaaatgcaggga

SEQ ID NO: 4171045 - DNA, 19 bp, Homo sapiens
tcagctaaatgcagggaaa

SEQ ID NO: 4171046 - DNA, 15 bp, Homo sapiens
tcagctactgatttt

SEQ ID NO: 4171047 - DNA, 22 bp, Homo sapiens
tcagctccagaataccttcttc

SEQ ID NO: 4171048 - DNA, 12 bp, Homo sapiens
tcagctgtgaac

SEQ ID NO: 4171049 - DNA, 14 bp, Homo sapiens
tcaggaaagacagg

SEQ ID NO: 4171050 - DNA, 16 bp, Homo sapiens
tcaggaagagaaggag

SEQ ID NO: 4171051 - DNA, 16 bp, Homo sapiens
tatatgattgtataat

SEQ ID NO: 4171052 - DNA, 20 bp, Homo sapiens
tatatgattgtataatgtga

SEQ ID NO: 4171053 - DNA, 22 bp, Homo sapiens
tatatgattgtataatgtgatt

SEQ ID NO: 4171054 - DNA, 15 bp, Homo sapiens
tatatgatttatagt

SEQ ID NO: 4171055 - DNA, 18 bp, Homo sapiens
tatatgccttaagccaat

SEQ ID NO: 4171056 - DNA, 17 bp, Homo sapiens
tatatgctcaaccagaa

SEQ ID NO: 4171057 - DNA, 22 bp, Homo sapiens
tatattacactacacactgtgt

SEQ ID NO: 4171058 - DNA, 22 bp, Homo sapiens
tatattccgggtgccattccca

SEQ ID NO: 4171059 - DNA, 17 bp, Homo sapiens
tatatttactaaaagaa

SEQ ID NO: 4171060 - DNA, 14 bp, Homo sapiens
tatatttggaaaga

SEQ ID NO: 4171061 - DNA, 19 bp, Homo sapiens
tatatttttgtaaatagta

SEQ ID NO: 4171062 - DNA, 12 bp, Homo sapiens
tatcaaaagaca

SEQ ID NO: 4171063 - DNA, 23 bp, Homo sapiens
tatcaaacaccaacataaaaatg

SEQ ID NO: 4171064 - DNA, 20 bp, Homo sapiens
tatcaaacagaattttaaag

SEQ ID NO: 4171065 - DNA, 13 bp, Homo sapiens
tatcaattacagt

SEQ ID NO: 4171066 - DNA, 14 bp, Homo sapiens
tatcagaagaccac

SEQ ID NO: 4171067 - DNA, 21 bp, Homo sapiens
tatcagaagaccacaaaaatt

SEQ ID NO: 4171068 - DNA, 23 bp, Homo sapiens
tatcagaagaccacaaaaattga

SEQ ID NO: 4171069 - DNA, 15 bp, Homo sapiens
tatccattataaaca

SEQ ID NO: 4171070 - DNA, 19 bp, Homo sapiens
tatcccccccctgtatagt

SEQ ID NO: 4171071 - DNA, 23 bp, Homo sapiens
tatccgactctaagctgtgtgca

SEQ ID NO: 4171072 - DNA, 15 bp, Homo sapiens
tatcctacaacaaga

SEQ ID NO: 4171073 - DNA, 17 bp, Homo sapiens
tatccttggagagcagc

SEQ ID NO: 4171074 - DNA, 12 bp, Homo sapiens
tatcgactttat

SEQ ID NO: 4171075 - DNA, 18 bp, Homo sapiens
tatctaactcttctggaa

SEQ ID NO: 4171076 - DNA, 16 bp, Homo sapiens
tatctacccagaatta

SEQ ID NO: 4171077 - DNA, 22 bp, Homo sapiens
tatctctaggctgttttctcca

SEQ ID NO: 4171078 - DNA, 13 bp, Homo sapiens
tatctctggcctc

SEQ ID NO: 4171079 - DNA, 17 bp, Homo sapiens
tatctgggtaagaagaa

SEQ ID NO: 4171080 - DNA, 21 bp, Homo sapiens
tatcttctggattagaatgcc

SEQ ID NO: 4171081 - DNA, 22 bp, Homo sapiens
tatctttttgcttacagtttta

SEQ ID NO: 4171082 - DNA, 14 bp, Homo sapiens
tatgaaaagctaga

SEQ ID NO: 4171083 - DNA, 19 bp, Homo sapiens
tatgaaaagctagaattga

SEQ ID NO: 4171084 - DNA, 16 bp, Homo sapiens
tatgaacttgaggaca

SEQ ID NO: 4171085 - DNA, 21 bp, Homo sapiens
tatgaacttgaggacacatgt

SEQ ID NO: 4171086 - DNA, 18 bp, Homo sapiens
tatgacaatcctgaagaa

SEQ ID NO: 4171087 - DNA, 19 bp, Homo sapiens
tatgacccatttaatttct

SEQ ID NO: 4171088 - DNA, 17 bp, Homo sapiens
tatgagtgggaaataaa

SEQ ID NO: 4171089 - DNA, 18 bp, Homo sapiens
tatgataactatttacat

SEQ ID NO: 4171090 - DNA, 14 bp, Homo sapiens
tatgataatgataa

SEQ ID NO: 4171091 - DNA, 18 bp, Homo sapiens
tatgataatgataacttg

SEQ ID NO: 4171092 - DNA, 14 bp, Homo sapiens
tatgatgttaaaaa

SEQ ID NO: 4171093 - DNA, 19 bp, Homo sapiens
tatgattgtataatgtgat

SEQ ID NO: 4171094 - DNA, 18 bp, Homo sapiens
tatgatttatagtttgta

SEQ ID NO: 4171095 - DNA, 20 bp, Homo sapiens
tatgcatggaaacctgaaaa

SEQ ID NO: 4171096 - DNA, 15 bp, Homo sapiens
tatgctttgaaacag

SEQ ID NO: 4171097 - DNA, 15 bp, Homo sapiens
tatggaaaggccaga

SEQ ID NO: 4171098 - DNA, 15 bp, Homo sapiens
tatggaacttctaat

SEQ ID NO: 4171099 - DNA, 13 bp, Homo sapiens
tatggattctaaa

SEQ ID NO: 4171100 - DNA, 14 bp, Homo sapiens
tatggcaaaaatgg

SEQ ID NO: 4171101 - DNA, 20 bp, Homo sapiens
tatgggaaccagaatagata

SEQ ID NO: 4171102 - DNA, 23 bp, Homo sapiens
tatggtgctctgtctacttgctc

SEQ ID NO: 4171103 - DNA, 13 bp, Homo sapiens
tatgtaaaacatt

SEQ ID NO: 4171104 - DNA, 15 bp, Homo sapiens
tatgtaaacaggaga

SEQ ID NO: 4171105 - DNA, 14 bp, Homo sapiens
tatgtaaagtatgt

SEQ ID NO: 4171106 - DNA, 19 bp, Homo sapiens
tatgtaaagtatgtaaaca

SEQ ID NO: 4171107 - DNA, 15 bp, Homo sapiens
tatgtagttaaatag

SEQ ID NO: 4171108 - DNA, 13 bp, Homo sapiens
tatgtatgttaat

SEQ ID NO: 4171109 - DNA, 20 bp, Homo sapiens
tatgtctgccttaggctgct

SEQ ID NO: 4171110 - DNA, 13 bp, Homo sapiens
tatgtgaatctgg

SEQ ID NO: 4171111 - DNA, 15 bp, Homo sapiens
tatgtgaatttaatg

SEQ ID NO: 4171112 - DNA, 16 bp, Homo sapiens
tatgtgacagacattt

SEQ ID NO: 4171113 - DNA, 21 bp, Homo sapiens
tatgtgatgattaatacaata

SEQ ID NO: 4171114 - DNA, 14 bp, Homo sapiens
tatgtgtgggtaca

SEQ ID NO: 4171115 - DNA, 23 bp, Homo sapiens
tatgttctagtgatttcctgtat

SEQ ID NO: 4171116 - DNA, 15 bp, Homo sapiens
tatgttctcagaatc

SEQ ID NO: 4171117 - DNA, 13 bp, Homo sapiens
tattaaagatgtg

SEQ ID NO: 4171118 - DNA, 14 bp, Homo sapiens
tattaaagatgtgt

SEQ ID NO: 4171119 - DNA, 16 bp, Homo sapiens
tattaaagatgtgttg

SEQ ID NO: 4171120 - DNA, 22 bp, Homo sapiens
tattaaatgtatatgtcattta

SEQ ID NO: 4171121 - DNA, 14 bp, Homo sapiens
tattaataaatttt

SEQ ID NO: 4171122 - DNA, 22 bp, Homo sapiens
tattaataaattttaacatttt

SEQ ID NO: 4171123 - DNA, 12 bp, Homo sapiens
tattacttacaa

SEQ ID NO: 4171124 - DNA, 17 bp, Homo sapiens
tattaggggtaatatat

SEQ ID NO: 4171125 - DNA, 14 bp, Homo sapiens
tattatatttcttt

SEQ ID NO: 4171126 - DNA, 23 bp, Homo sapiens
tattatcccagcttgctgagggg

SEQ ID NO: 4171127 - DNA, 21 bp, Homo sapiens
tattatgactcaataaaagaa

SEQ ID NO: 4171128 - DNA, 12 bp, Homo sapiens
tattattgttct

SEQ ID NO: 4171129 - DNA, 15 bp, Homo sapiens
tattcagtgctgtgg

SEQ ID NO: 4171130 - DNA, 16 bp, Homo sapiens
tattcatgctttctcc

SEQ ID NO: 4171131 - DNA, 18 bp, Homo sapiens
tattcatgctttctcctt

SEQ ID NO: 4171132 - DNA, 19 bp, Homo sapiens
tattccatgggatgttaag

SEQ ID NO: 4171133 - DNA, 22 bp, Homo sapiens
tattccttgatactaaaagttc

SEQ ID NO: 4171134 - DNA, 19 bp, Homo sapiens
tattccttttgtgtacagt

SEQ ID NO: 4171135 - DNA, 15 bp, Homo sapiens
tattctcctccctgt

SEQ ID NO: 4171136 - DNA, 22 bp, Homo sapiens
tattcttaagggaacttccaca

SEQ ID NO: 4171137 - DNA, 13 bp, Homo sapiens
tattcttaagtaa

SEQ ID NO: 4171138 - DNA, 16 bp, Homo sapiens
tattcttaagtaagga

SEQ ID NO: 4171139 - DNA, 16 bp, Homo sapiens
tattcttcatcagcat

SEQ ID NO: 4171140 - DNA, 17 bp, Homo sapiens
tattgaagaaaagcact

SEQ ID NO: 4171141 - DNA, 13 bp, Homo sapiens
tattgaataagta

SEQ ID NO: 4171142 - DNA, 18 bp, Homo sapiens
tattgcactcagcttttt

SEQ ID NO: 4171143 - DNA, 17 bp, Homo sapiens
tattggacaaagaacct

SEQ ID NO: 4171144 - DNA, 16 bp, Homo sapiens
tattggaccagaagtc

SEQ ID NO: 4171145 - DNA, 20 bp, Homo sapiens
tattgtacactaacatattt

SEQ ID NO: 4171146 - DNA, 17 bp, Homo sapiens
tattgtgcaatgtaaat

SEQ ID NO: 4171147 - DNA, 18 bp, Homo sapiens
tattgttttatgttctag

SEQ ID NO: 4171148 - DNA, 16 bp, Homo sapiens
tatttaaaaaactaaa

SEQ ID NO: 4171149 - DNA, 14 bp, Homo sapiens
tatttaaaatagca

SEQ ID NO: 4171150 - DNA, 20 bp, Homo sapiens
tatttaatagcaaagaattg

SEQ ID NO: 4171151 - DNA, 16 bp, Homo sapiens
tatttactaaaagaat

SEQ ID NO: 4171152 - DNA, 20 bp, Homo sapiens
tatttagttatagtttcaga

SEQ ID NO: 4171153 - DNA, 17 bp, Homo sapiens
tatttatagtttaatac

SEQ ID NO: 4171154 - DNA, 16 bp, Homo sapiens
tatttatatttggaaa

SEQ ID NO: 4171155 - DNA, 20 bp, Homo sapiens
tatttatgtaaaatcaataa

SEQ ID NO: 4171156 - DNA, 12 bp, Homo sapiens
tatttcaaatga

SEQ ID NO: 4171157 - DNA, 22 bp, Homo sapiens
tatttcaagtgcctagactgtt

SEQ ID NO: 4171158 - DNA, 15 bp, Homo sapiens
tatttcacaacagcc

SEQ ID NO: 4171159 - DNA, 19 bp, Homo sapiens
tatttctagtagaaagaaa

SEQ ID NO: 4171160 - DNA, 13 bp, Homo sapiens
tatttcttaaaca

SEQ ID NO: 4171161 - DNA, 14 bp, Homo sapiens
tatttctttttaga

SEQ ID NO: 4171162 - DNA, 19 bp, Homo sapiens
tatttgaaactgaatgttt

SEQ ID NO: 4171163 - DNA, 22 bp, Homo sapiens
tatttgaaattttatttagttc

SEQ ID NO: 4171164 - DNA, 17 bp, Homo sapiens
tatttgagaatagatgg

SEQ ID NO: 4171165 - DNA, 12 bp, Homo sapiens
tatttggctctc

SEQ ID NO: 4171166 - DNA, 18 bp, Homo sapiens
tatttgtttacatgcaga

SEQ ID NO: 4171167 - DNA, 12 bp, Homo sapiens
tattttaaagaa

SEQ ID NO: 4171168 - DNA, 16 bp, Homo sapiens
tattttaaagaattgt

SEQ ID NO: 4171169 - DNA, 18 bp, Homo sapiens
tattttaggcagggattt

SEQ ID NO: 4171170 - DNA, 21 bp, Homo sapiens
tattttagtgaacttgaaata

SEQ ID NO: 4171171 - DNA, 13 bp, Homo sapiens
tattttattgtct

SEQ ID NO: 4171172 - DNA, 14 bp, Homo sapiens
tattttcagatgtg

SEQ ID NO: 4171173 - DNA, 17 bp, Homo sapiens
tattttcagtattttgg

SEQ ID NO: 4171174 - DNA, 18 bp, Homo sapiens
tattttgacataaagttg

SEQ ID NO: 4171175 - DNA, 20 bp, Homo sapiens
tattttgtaatttttttgaa

SEQ ID NO: 4171176 - DNA, 15 bp, Homo sapiens
tattttgtatatatc

SEQ ID NO: 4171177 - DNA, 17 bp, Homo sapiens
tattttgttacactaaa

SEQ ID NO: 4171178 - DNA, 21 bp, Homo sapiens
tatttttatatttagttatag

SEQ ID NO: 4171179 - DNA, 20 bp, Homo sapiens
tatttttgaacccctgtgtc

SEQ ID NO: 4171180 - DNA, 13 bp, Homo sapiens
tatttttgttgtt

SEQ ID NO: 4171181 - DNA, 17 bp, Homo sapiens
tattttttgttgaaagt

SEQ ID NO: 4171182 - DNA, 18 bp, Homo sapiens
tcaaaagaaaaggcaaaa

SEQ ID NO: 4171183 - DNA, 17 bp, Homo sapiens
tcaaaagattgttttat

SEQ ID NO: 4171184 - DNA, 15 bp, Homo sapiens
tcaaaagctggatta

SEQ ID NO: 4171185 - DNA, 18 bp, Homo sapiens
tcaaaatgttcgtattct

SEQ ID NO: 4171186 - DNA, 14 bp, Homo sapiens
tcaaactaggagga

SEQ ID NO: 4171187 - DNA, 18 bp, Homo sapiens
tcaaactaggaggaaaag

SEQ ID NO: 4171188 - DNA, 20 bp, Homo sapiens
tcaaactaggaggaaaagac

SEQ ID NO: 4171189 - DNA, 22 bp, Homo sapiens
tcaaacttgtcaagaatgagaa

SEQ ID NO: 4171190 - DNA, 14 bp, Homo sapiens
tcaaacttgtgctg

SEQ ID NO: 4171191 - DNA, 14 bp, Homo sapiens
tagagactggaaca

SEQ ID NO: 4171192 - DNA, 19 bp, Homo sapiens
tagagagagttgctggcta

SEQ ID NO: 4171193 - DNA, 19 bp, Homo sapiens
tagagatatgcagaaggaa

SEQ ID NO: 4171194 - DNA, 14 bp, Homo sapiens
tagagcactgccac

SEQ ID NO: 4171195 - DNA, 16 bp, Homo sapiens
tagaggtgagaaattt

SEQ ID NO: 4171196 - DNA, 14 bp, Homo sapiens
tagaggtttgtcaa

SEQ ID NO: 4171197 - DNA, 16 bp, Homo sapiens
tagaggttttgttgtt

SEQ ID NO: 4171198 - DNA, 12 bp, Homo sapiens
tagagtttaaca

SEQ ID NO: 4171199 - DNA, 13 bp, Homo sapiens
tagagtttaacac

SEQ ID NO: 4171200 - DNA, 14 bp, Homo sapiens
tagatattattcat

SEQ ID NO: 4171201 - DNA, 16 bp, Homo sapiens
tagatattggacaaag

SEQ ID NO: 4171202 - DNA, 23 bp, Homo sapiens
tagatccatttggacaaaatgga

SEQ ID NO: 4171203 - DNA, 22 bp, Homo sapiens
tagatgggtctggctgagctga

SEQ ID NO: 4171204 - DNA, 16 bp, Homo sapiens
tagattttagttcact

SEQ ID NO: 4171205 - DNA, 16 bp, Homo sapiens
tagcaaaagaagaagt

SEQ ID NO: 4171206 - DNA, 15 bp, Homo sapiens
tagcaaagcaaaagg

SEQ ID NO: 4171207 - DNA, 23 bp, Homo sapiens
tagcaaagcaaaaggctgagaag

SEQ ID NO: 4171208 - DNA, 18 bp, Homo sapiens
tagcaaagggcttggtgg

SEQ ID NO: 4171209 - DNA, 22 bp, Homo sapiens
tagcaacaaatccatggaccta

SEQ ID NO: 4171210 - DNA, 22 bp, Homo sapiens
tagcaactacagtctaaagctg

SEQ ID NO: 4171211 - DNA, 21 bp, Homo sapiens
tagcaatccatgttagttttt

SEQ ID NO: 4171212 - DNA, 15 bp, Homo sapiens
tagcaattagcagaa

SEQ ID NO: 4171213 - DNA, 23 bp, Homo sapiens
tagcacatgtctgtcctcagagc

SEQ ID NO: 4171214 - DNA, 22 bp, Homo sapiens
tagcaggtggtcctgagacctg

SEQ ID NO: 4171215 - DNA, 18 bp, Homo sapiens
tagcaggtgtaataagac

SEQ ID NO: 4171216 - DNA, 23 bp, Homo sapiens
tagcagtccaaagaacaagaaat

SEQ ID NO: 4171217 - DNA, 19 bp, Homo sapiens
tagccaaaacacttaggaa

SEQ ID NO: 4171218 - DNA, 16 bp, Homo sapiens
tagccaagtagctttg

SEQ ID NO: 4171219 - DNA, 19 bp, Homo sapiens
tagccaagtagctttgggc

SEQ ID NO: 4171220 - DNA, 17 bp, Homo sapiens
tagccacaccaggatag

SEQ ID NO: 4171221 - DNA, 19 bp, Homo sapiens
tagcccaggtcctctgata

SEQ ID NO: 4171222 - DNA, 17 bp, Homo sapiens
tagcccatctctccaga

SEQ ID NO: 4171223 - DNA, 13 bp, Homo sapiens
tagccctttctgt

SEQ ID NO: 4171224 - DNA, 15 bp, Homo sapiens
tagccctttctgtgt

SEQ ID NO: 4171225 - DNA, 17 bp, Homo sapiens
tagcctcttccctctga

SEQ ID NO: 4171226 - DNA, 14 bp, Homo sapiens
tagcgagctgctct

SEQ ID NO: 4171227 - DNA, 15 bp, Homo sapiens
tagctcatcactgtg

SEQ ID NO: 4171228 - DNA, 21 bp, Homo sapiens
tagctccctgatttggagcca

SEQ ID NO: 4171229 - DNA, 15 bp, Homo sapiens
tagctcctctgctgc

SEQ ID NO: 4171230 - DNA, 14 bp, Homo sapiens
tagctctgttcttt

SEQ ID NO: 4171231 - DNA, 18 bp, Homo sapiens
tagctcttaccaaaacag

SEQ ID NO: 4171232 - DNA, 20 bp, Homo sapiens
tagctgaatgagtctgcttt

SEQ ID NO: 4171233 - DNA, 21 bp, Homo sapiens
tagctgaatgagtctgctttc

SEQ ID NO: 4171234 - DNA, 17 bp, Homo sapiens
tagctgggatatgtagt

SEQ ID NO: 4171235 - DNA, 17 bp, Homo sapiens
tagcttgtatagtgtaa

SEQ ID NO: 4171236 - DNA, 22 bp, Homo sapiens
tagctttaacttaaatagtatt

SEQ ID NO: 4171237 - DNA, 19 bp, Homo sapiens
tagctttcccaaataaact

SEQ ID NO: 4171238 - DNA, 18 bp, Homo sapiens
tagcttttattgtataaa

SEQ ID NO: 4171239 - DNA, 16 bp, Homo sapiens
taggaaaatgtacata

SEQ ID NO: 4171240 - DNA, 16 bp, Homo sapiens
taggaaataaaacctt

SEQ ID NO: 4171241 - DNA, 21 bp, Homo sapiens
taggaatatgactcaggagcc

SEQ ID NO: 4171242 - DNA, 22 bp, Homo sapiens
taggaatatgactcaggagcct

SEQ ID NO: 4171243 - DNA, 21 bp, Homo sapiens
taggacatataccttctcaaa

SEQ ID NO: 4171244 - DNA, 14 bp, Homo sapiens
taggattaatttat

SEQ ID NO: 4171245 - DNA, 21 bp, Homo sapiens
taggattttttttaatgttta

SEQ ID NO: 4171246 - DNA, 12 bp, Homo sapiens
taggcagagcct

SEQ ID NO: 4171247 - DNA, 14 bp, Homo sapiens
taggcagcctgccg

SEQ ID NO: 4171248 - DNA, 15 bp, Homo sapiens
taggcagggatttga

SEQ ID NO: 4171249 - DNA, 21 bp, Homo sapiens
taggcatttttaccatcactg

SEQ ID NO: 4171250 - DNA, 18 bp, Homo sapiens
taggcgagtgccaggact

SEQ ID NO: 4171251 - DNA, 15 bp, Homo sapiens
taggctggagaagct

SEQ ID NO: 4171252 - DNA, 19 bp, Homo sapiens
taggctgtggggtctggct

SEQ ID NO: 4171253 - DNA, 20 bp, Homo sapiens
taggctgtggggtctggctg

SEQ ID NO: 4171254 - DNA, 22 bp, Homo sapiens
taggctgtggggtctggctgtg

SEQ ID NO: 4171255 - DNA, 18 bp, Homo sapiens
taggcttatcaaaatctt

SEQ ID NO: 4171256 - DNA, 15 bp, Homo sapiens
tagggaagcagggac

SEQ ID NO: 4171257 - DNA, 13 bp, Homo sapiens
taggtaagtgggg

SEQ ID NO: 4171258 - DNA, 19 bp, Homo sapiens
taggtattaaagatgtgtt

SEQ ID NO: 4171259 - DNA, 14 bp, Homo sapiens
taggtatttcaaaa

SEQ ID NO: 4171260 - DNA, 17 bp, Homo sapiens
taggtcagaagaagatg

SEQ ID NO: 4171261 - DNA, 17 bp, Homo sapiens
taggtcatgatttctgt

SEQ ID NO: 4171262 - DNA, 15 bp, Homo sapiens
taggtcattactaac

SEQ ID NO: 4171263 - DNA, 15 bp, Homo sapiens
taggtgccaggctgt

SEQ ID NO: 4171264 - DNA, 13 bp, Homo sapiens
taggtgggagaga

SEQ ID NO: 4171265 - DNA, 18 bp, Homo sapiens
taggtttgtcaacacaaa

SEQ ID NO: 4171266 - DNA, 18 bp, Homo sapiens
tagtaaatcacgcttttt

SEQ ID NO: 4171267 - DNA, 21 bp, Homo sapiens
tagtaatttattgtctgtcta

SEQ ID NO: 4171268 - DNA, 11 bp, Homo sapiens
tagtagcattt

SEQ ID NO: 4171269 - DNA, 17 bp, Homo sapiens
tagtagccctttctgtg

SEQ ID NO: 4171270 - DNA, 14 bp, Homo sapiens
tagtagtttgggtg

SEQ ID NO: 4171271 - DNA, 14 bp, Homo sapiens
tagtatcttttaaa

SEQ ID NO: 4171272 - DNA, 16 bp, Homo sapiens
tagtcattaatgttct

SEQ ID NO: 4171273 - DNA, 12 bp, Homo sapiens
tagtgaagatgt

SEQ ID NO: 4171274 - DNA, 17 bp, Homo sapiens
tagtgccctccacagcc

SEQ ID NO: 4171275 - DNA, 11 bp, Homo sapiens
tagtgtaaaat

SEQ ID NO: 4171276 - DNA, 21 bp, Homo sapiens
tagttaggaaataaaaccttt

SEQ ID NO: 4171277 - DNA, 23 bp, Homo sapiens
tagttaggaaataaaacctttca

SEQ ID NO: 4171278 - DNA, 15 bp, Homo sapiens
tagttaggatagcat

SEQ ID NO: 4171279 - DNA, 15 bp, Homo sapiens
tagttatagtttcag

SEQ ID NO: 4171280 - DNA, 14 bp, Homo sapiens
tagttatattttct

SEQ ID NO: 4171281 - DNA, 15 bp, Homo sapiens
tagttattgttttat

SEQ ID NO: 4171282 - DNA, 16 bp, Homo sapiens
tagttatttacttgaa

SEQ ID NO: 4171283 - DNA, 17 bp, Homo sapiens
tagttatttacttgaaa

SEQ ID NO: 4171284 - DNA, 15 bp, Homo sapiens
tagttcgtagctttc

SEQ ID NO: 4171285 - DNA, 21 bp, Homo sapiens
tagttgtgcagtcagtgtcaa

SEQ ID NO: 4171286 - DNA, 18 bp, Homo sapiens
tagtttcagatatatatc

SEQ ID NO: 4171287 - DNA, 11 bp, Homo sapiens
tagtttggata

SEQ ID NO: 4171288 - DNA, 22 bp, Homo sapiens
tagttttgggaggggatggcag

SEQ ID NO: 4171289 - DNA, 15 bp, Homo sapiens
tataaaaagtgaaat

SEQ ID NO: 4171290 - DNA, 11 bp, Homo sapiens
tataaaacaaa

SEQ ID NO: 4171291 - DNA, 13 bp, Homo sapiens
tataaactttaga

SEQ ID NO: 4171292 - DNA, 12 bp, Homo sapiens
tataaatatgtg

SEQ ID NO: 4171293 - DNA, 21 bp, Homo sapiens
tataaatggtaagcattagca

SEQ ID NO: 4171294 - DNA, 12 bp, Homo sapiens
tataacagcaag

SEQ ID NO: 4171295 - DNA, 16 bp, Homo sapiens
tataaccagacacata

SEQ ID NO: 4171296 - DNA, 11 bp, Homo sapiens
tataagatgtc

SEQ ID NO: 4171297 - DNA, 15 bp, Homo sapiens
tataatatcctttgt

SEQ ID NO: 4171298 - DNA, 22 bp, Homo sapiens
tataattgttttatctgaattt

SEQ ID NO: 4171299 - DNA, 13 bp, Homo sapiens
tatacaacaatgt

SEQ ID NO: 4171300 - DNA, 14 bp, Homo sapiens
tatacacaacattt

SEQ ID NO: 4171301 - DNA, 19 bp, Homo sapiens
tatacacaacatttatttc

SEQ ID NO: 4171302 - DNA, 12 bp, Homo sapiens
tatacagaactg

SEQ ID NO: 4171303 - DNA, 23 bp, Homo sapiens
tatacagaactgaattaagttat

SEQ ID NO: 4171304 - DNA, 21 bp, Homo sapiens
tatacaggtggtttttggtta

SEQ ID NO: 4171305 - DNA, 13 bp, Homo sapiens
tatacatttctgt

SEQ ID NO: 4171306 - DNA, 13 bp, Homo sapiens
tataccttctcaa

SEQ ID NO: 4171307 - DNA, 16 bp, Homo sapiens
tatactaaaaaatgtc

SEQ ID NO: 4171308 - DNA, 23 bp, Homo sapiens
tatagagaaaaactttcattttt

SEQ ID NO: 4171309 - DNA, 17 bp, Homo sapiens
tatagagatatgcagaa

SEQ ID NO: 4171310 - DNA, 11 bp, Homo sapiens
tatagatgtgc

SEQ ID NO: 4171311 - DNA, 17 bp, Homo sapiens
tatagatttgtatttta

SEQ ID NO: 4171312 - DNA, 21 bp, Homo sapiens
tatagccacatccctttgaaa

SEQ ID NO: 4171313 - DNA, 13 bp, Homo sapiens
tatagcccaggtc

SEQ ID NO: 4171314 - DNA, 11 bp, Homo sapiens
tatagctatta

SEQ ID NO: 4171315 - DNA, 15 bp, Homo sapiens
tatagctcatcactg

SEQ ID NO: 4171316 - DNA, 20 bp, Homo sapiens
tatagctcatcactgtgcct

SEQ ID NO: 4171317 - DNA, 12 bp, Homo sapiens
tatagctctcat

SEQ ID NO: 4171318 - DNA, 15 bp, Homo sapiens
tatagctctcatcac

SEQ ID NO: 4171319 - DNA, 21 bp, Homo sapiens
tataggatttatttaaaatag

SEQ ID NO: 4171320 - DNA, 22 bp, Homo sapiens
tatagtatgatttttacaataa

SEQ ID NO: 4171321 - DNA, 18 bp, Homo sapiens
tatagtgtaaaataagaa

SEQ ID NO: 4171322 - DNA, 22 bp, Homo sapiens
tatagtttcagatatatatcat

SEQ ID NO: 4171323 - DNA, 20 bp, Homo sapiens
tatagtttgctttgcttttt

SEQ ID NO: 4171324 - DNA, 17 bp, Homo sapiens
tatataggttgtgcaaa

SEQ ID NO: 4171325 - DNA, 22 bp, Homo sapiens
tatatatcatattggtattcac

SEQ ID NO: 4171326 - DNA, 21 bp, Homo sapiens
tatatatctgcttcagtggag

SEQ ID NO: 4171327 - DNA, 20 bp, Homo sapiens
tatatatttattttattcta

SEQ ID NO: 4171328 - DNA, 18 bp, Homo sapiens
tatatcaatgtaacaaaa

SEQ ID NO: 4171329 - DNA, 22 bp, Homo sapiens
tatatgatcctgaaaaaatgat

SEQ ID NO: 4171330 - DNA, 12 bp, Homo sapiens
tatatgattgta

SEQ ID NO: 4171331 - DNA, 13 bp, Homo sapiens
taattttaaattc

SEQ ID NO: 4171332 - DNA, 12 bp, Homo sapiens
taattttatgtg

SEQ ID NO: 4171333 - DNA, 14 bp, Homo sapiens
taatttttataaat

SEQ ID NO: 4171334 - DNA, 15 bp, Homo sapiens
taatttttataaata

SEQ ID NO: 4171335 - DNA, 20 bp, Homo sapiens
taatttttcttacacatttt

SEQ ID NO: 4171336 - DNA, 18 bp, Homo sapiens
taatttttttgaaaaaag

SEQ ID NO: 4171337 - DNA, 12 bp, Homo sapiens
tacaaaaacaaa

SEQ ID NO: 4171338 - DNA, 14 bp, Homo sapiens
tacaaatgaaattt

SEQ ID NO: 4171339 - DNA, 18 bp, Homo sapiens
tacaaatttttcctgcaa

SEQ ID NO: 4171340 - DNA, 18 bp, Homo sapiens
tacaacttgtatttccaa

SEQ ID NO: 4171341 - DNA, 15 bp, Homo sapiens
tacaagaagcatttt

SEQ ID NO: 4171342 - DNA, 17 bp, Homo sapiens
tacaagaattgtccatg

SEQ ID NO: 4171343 - DNA, 22 bp, Homo sapiens
tacaagaattgtccatgtgctt

SEQ ID NO: 4171344 - DNA, 21 bp, Homo sapiens
tacaagcatttgccctgtgga

SEQ ID NO: 4171345 - DNA, 20 bp, Homo sapiens
tacaataataaatcctcagg

SEQ ID NO: 4171346 - DNA, 20 bp, Homo sapiens
tacaataattaatgtgtgtc

SEQ ID NO: 4171347 - DNA, 17 bp, Homo sapiens
tacaatattaattataa

SEQ ID NO: 4171348 - DNA, 20 bp, Homo sapiens
tacaatattaattataataa

SEQ ID NO: 4171349 - DNA, 21 bp, Homo sapiens
tacaatattaattataataaa

SEQ ID NO: 4171350 - DNA, 17 bp, Homo sapiens
tacaatggtaaaatgag

SEQ ID NO: 4171351 - DNA, 21 bp, Homo sapiens
tacacaagtttaaaaatatta

SEQ ID NO: 4171352 - DNA, 23 bp, Homo sapiens
tacacagaaaagggagctaaatt

SEQ ID NO: 4171353 - DNA, 16 bp, Homo sapiens
tacactccagcctgag

SEQ ID NO: 4171354 - DNA, 17 bp, Homo sapiens
tacagaaattagccggg

SEQ ID NO: 4171355 - DNA, 15 bp, Homo sapiens
tacagaattactgta

SEQ ID NO: 4171356 - DNA, 14 bp, Homo sapiens
tacagagcaggcca

SEQ ID NO: 4171357 - DNA, 18 bp, Homo sapiens
tacagcagggtcttgctg

SEQ ID NO: 4171358 - DNA, 19 bp, Homo sapiens
tacagcgagaggcagagaa

SEQ ID NO: 4171359 - DNA, 16 bp, Homo sapiens
tacagctgtttaagat

SEQ ID NO: 4171360 - DNA, 21 bp, Homo sapiens
tacagggctgatagagtgatt

SEQ ID NO: 4171361 - DNA, 21 bp, Homo sapiens
tacagtaaataaattgtttga

SEQ ID NO: 4171362 - DNA, 16 bp, Homo sapiens
tacagtcaagatacat

SEQ ID NO: 4171363 - DNA, 15 bp, Homo sapiens
tacagtcaattttac

SEQ ID NO: 4171364 - DNA, 14 bp, Homo sapiens
tacagtctaaagct

SEQ ID NO: 4171365 - DNA, 15 bp, Homo sapiens
tacagtctaaagctg

SEQ ID NO: 4171366 - DNA, 12 bp, Homo sapiens
tacagttcagtt

SEQ ID NO: 4171367 - DNA, 13 bp, Homo sapiens
tacataataaagt

SEQ ID NO: 4171368 - DNA, 16 bp, Homo sapiens
tacataattcactctg

SEQ ID NO: 4171369 - DNA, 19 bp, Homo sapiens
tacataattttttattcaa

SEQ ID NO: 4171370 - DNA, 12 bp, Homo sapiens
tacatacagaat

SEQ ID NO: 4171371 - DNA, 20 bp, Homo sapiens
tacatacagaattactgtaa

SEQ ID NO: 4171372 - DNA, 14 bp, Homo sapiens
tacatacgtgttct

SEQ ID NO: 4171373 - DNA, 16 bp, Homo sapiens
tacatactatgttcat

SEQ ID NO: 4171374 - DNA, 23 bp, Homo sapiens
tacatactatgttcatgatagtg

SEQ ID NO: 4171375 - DNA, 17 bp, Homo sapiens
tacatataataaataga

SEQ ID NO: 4171376 - DNA, 15 bp, Homo sapiens
tacatcaaaaatggg

SEQ ID NO: 4171377 - DNA, 18 bp, Homo sapiens
tacatcttataaactgac

SEQ ID NO: 4171378 - DNA, 15 bp, Homo sapiens
tacatgaacacagct

SEQ ID NO: 4171379 - DNA, 14 bp, Homo sapiens
tacatgtggtttat

SEQ ID NO: 4171380 - DNA, 16 bp, Homo sapiens
taccaatgacttttta

SEQ ID NO: 4171381 - DNA, 12 bp, Homo sapiens
taccacaagcct

SEQ ID NO: 4171382 - DNA, 17 bp, Homo sapiens
taccacaagcctgagaa

SEQ ID NO: 4171383 - DNA, 12 bp, Homo sapiens
taccaccttccc

SEQ ID NO: 4171384 - DNA, 19 bp, Homo sapiens
taccaccttccctctttct

SEQ ID NO: 4171385 - DNA, 11 bp, Homo sapiens
taccagccagg

SEQ ID NO: 4171386 - DNA, 12 bp, Homo sapiens
taccagccagga

SEQ ID NO: 4171387 - DNA, 17 bp, Homo sapiens
taccaggcaccaaaaga

SEQ ID NO: 4171388 - DNA, 21 bp, Homo sapiens
taccaggcaccaaaagaagta

SEQ ID NO: 4171389 - DNA, 14 bp, Homo sapiens
tacccaaatatgtt

SEQ ID NO: 4171390 - DNA, 17 bp, Homo sapiens
tacccaggaggctgagg

SEQ ID NO: 4171391 - DNA, 22 bp, Homo sapiens
tacccaggaggctgaggcagga

SEQ ID NO: 4171392 - DNA, 16 bp, Homo sapiens
taccccaagtccacct

SEQ ID NO: 4171393 - DNA, 20 bp, Homo sapiens
taccctgcgattttgcctgt

SEQ ID NO: 4171394 - DNA, 15 bp, Homo sapiens
taccctgggctctgg

SEQ ID NO: 4171395 - DNA, 22 bp, Homo sapiens
tacctacataggcaaattggaa

SEQ ID NO: 4171396 - DNA, 16 bp, Homo sapiens
tacctaccaccttccc

SEQ ID NO: 4171397 - DNA, 17 bp, Homo sapiens
tacctaccaccttccct

SEQ ID NO: 4171398 - DNA, 15 bp, Homo sapiens
tacctcatgggacag

SEQ ID NO: 4171399 - DNA, 15 bp, Homo sapiens
tacctcgaggctctt

SEQ ID NO: 4171400 - DNA, 13 bp, Homo sapiens
tacctctgagaag

SEQ ID NO: 4171401 - DNA, 15 bp, Homo sapiens
taccttgttttctct

SEQ ID NO: 4171402 - DNA, 14 bp, Homo sapiens
tacgcagatgctgt

SEQ ID NO: 4171403 - DNA, 23 bp, Homo sapiens
tacgtgttctatagagcctggcg

SEQ ID NO: 4171404 - DNA, 11 bp, Homo sapiens
tactaaaagaa

SEQ ID NO: 4171405 - DNA, 20 bp, Homo sapiens
tactaaaagttcttctccaa

SEQ ID NO: 4171406 - DNA, 18 bp, Homo sapiens
tactaaaatgtaactttt

SEQ ID NO: 4171407 - DNA, 18 bp, Homo sapiens
tactaaagccaaacatat

SEQ ID NO: 4171408 - DNA, 16 bp, Homo sapiens
tactaccctgggctct

SEQ ID NO: 4171409 - DNA, 13 bp, Homo sapiens
tactatacaacaa

SEQ ID NO: 4171410 - DNA, 15 bp, Homo sapiens
tactatacaacaatg

SEQ ID NO: 4171411 - DNA, 12 bp, Homo sapiens
tactattaaaaa

SEQ ID NO: 4171412 - DNA, 13 bp, Homo sapiens
tactatttcacaa

SEQ ID NO: 4171413 - DNA, 17 bp, Homo sapiens
tactcagaagcctgagg

SEQ ID NO: 4171414 - DNA, 16 bp, Homo sapiens
tactcagcagtaagca

SEQ ID NO: 4171415 - DNA, 20 bp, Homo sapiens
tactcattcatttattcatt

SEQ ID NO: 4171416 - DNA, 14 bp, Homo sapiens
tactcatttttcat

SEQ ID NO: 4171417 - DNA, 12 bp, Homo sapiens
tactccagcctg

SEQ ID NO: 4171418 - DNA, 13 bp, Homo sapiens
tactccagcctgg

SEQ ID NO: 4171419 - DNA, 15 bp, Homo sapiens
tactccagcctgggc

SEQ ID NO: 4171420 - DNA, 16 bp, Homo sapiens
tactcctacctcagcc

SEQ ID NO: 4171421 - DNA, 17 bp, Homo sapiens
tactctaatcagtcctt

SEQ ID NO: 4171422 - DNA, 23 bp, Homo sapiens
tactctgcggtggtgccagaggt

SEQ ID NO: 4171423 - DNA, 13 bp, Homo sapiens
tactcttcctttc

SEQ ID NO: 4171424 - DNA, 16 bp, Homo sapiens
tactgaggcaggggag

SEQ ID NO: 4171425 - DNA, 19 bp, Homo sapiens
tactgattaacaaataaat

SEQ ID NO: 4171426 - DNA, 16 bp, Homo sapiens
tactgtctggttttaa

SEQ ID NO: 4171427 - DNA, 22 bp, Homo sapiens
tactgtctggttttaacaattt

SEQ ID NO: 4171428 - DNA, 13 bp, Homo sapiens
tactgtgactgat

SEQ ID NO: 4171429 - DNA, 17 bp, Homo sapiens
tacttctaaatcagaaa

SEQ ID NO: 4171430 - DNA, 20 bp, Homo sapiens
tacttctaaatcagaaatag

SEQ ID NO: 4171431 - DNA, 14 bp, Homo sapiens
tactttaatgcgaa

SEQ ID NO: 4171432 - DNA, 21 bp, Homo sapiens
tactttacactctctgtacaa

SEQ ID NO: 4171433 - DNA, 22 bp, Homo sapiens
tactttgccttttgcaaacttt

SEQ ID NO: 4171434 - DNA, 17 bp, Homo sapiens
tacttttgcatgaaaat

SEQ ID NO: 4171435 - DNA, 22 bp, Homo sapiens
tagaaaactgaaaatctaatat

SEQ ID NO: 4171436 - DNA, 11 bp, Homo sapiens
tagaaaacttt

SEQ ID NO: 4171437 - DNA, 15 bp, Homo sapiens
tagaaaactttaaag

SEQ ID NO: 4171438 - DNA, 16 bp, Homo sapiens
tagaaaactttaaagc

SEQ ID NO: 4171439 - DNA, 20 bp, Homo sapiens
tagaaacgtgataaatatat

SEQ ID NO: 4171440 - DNA, 16 bp, Homo sapiens
tagaaagcaataaaaa

SEQ ID NO: 4171441 - DNA, 13 bp, Homo sapiens
tagaaaggccagc

SEQ ID NO: 4171442 - DNA, 13 bp, Homo sapiens
tagaaatactttt

SEQ ID NO: 4171443 - DNA, 16 bp, Homo sapiens
tagaaatcattttgca

SEQ ID NO: 4171444 - DNA, 16 bp, Homo sapiens
tagaaattttttcatg

SEQ ID NO: 4171445 - DNA, 15 bp, Homo sapiens
tagaacaagaccctg

SEQ ID NO: 4171446 - DNA, 15 bp, Homo sapiens
tagaacaggctggtt

SEQ ID NO: 4171447 - DNA, 14 bp, Homo sapiens
tagaacgcaactta

SEQ ID NO: 4171448 - DNA, 22 bp, Homo sapiens
tagaagcaagctggatgcagtg

SEQ ID NO: 4171449 - DNA, 13 bp, Homo sapiens
tagaagtgtttta

SEQ ID NO: 4171450 - DNA, 17 bp, Homo sapiens
tagaataataataaaaa

SEQ ID NO: 4171451 - DNA, 20 bp, Homo sapiens
tagaatatggacttaaatgt

SEQ ID NO: 4171452 - DNA, 17 bp, Homo sapiens
tagaatgaaaactcatt

SEQ ID NO: 4171453 - DNA, 19 bp, Homo sapiens
tagaatgcatgtaaggtct

SEQ ID NO: 4171454 - DNA, 20 bp, Homo sapiens
tagaatgcatgtaaggtctt

SEQ ID NO: 4171455 - DNA, 13 bp, Homo sapiens
tagaatgtgtttt

SEQ ID NO: 4171456 - DNA, 18 bp, Homo sapiens
tagaatgtgttttctgaa

SEQ ID NO: 4171457 - DNA, 23 bp, Homo sapiens
tagaattagtggagcttttgtat

SEQ ID NO: 4171458 - DNA, 22 bp, Homo sapiens
tagaattgggaagctgggggaa

SEQ ID NO: 4171459 - DNA, 13 bp, Homo sapiens
tagacaagccaga

SEQ ID NO: 4171460 - DNA, 17 bp, Homo sapiens
tagacacccattttcac

SEQ ID NO: 4171461 - DNA, 18 bp, Homo sapiens
tagacacccattttcaca

SEQ ID NO: 4171462 - DNA, 14 bp, Homo sapiens
tagacagaagaaac

SEQ ID NO: 4171463 - DNA, 17 bp, Homo sapiens
tagacagtgctgccctg

SEQ ID NO: 4171464 - DNA, 20 bp, Homo sapiens
tagacagtgctgccctgcga

SEQ ID NO: 4171465 - DNA, 19 bp, Homo sapiens
tagactagttgaacatctc

SEQ ID NO: 4171466 - DNA, 12 bp, Homo sapiens
tagactgaggga

SEQ ID NO: 4171467 - DNA, 15 bp, Homo sapiens
tagactgtgtatgtc

SEQ ID NO: 4171468 - DNA, 22 bp, Homo sapiens
tagacttcaagcatggctattt

SEQ ID NO: 4171469 - DNA, 21 bp, Homo sapiens
tagactttctcagtgggacaa

SEQ ID NO: 4171470 - DNA, 11 bp, Homo sapiens
tagactttctg

SEQ ID NO: 4171471 - DNA, 19 bp, Homo sapiens
tagagacggggtttcacca

SEQ ID NO: 4171472 - DNA, 15 bp, Homo sapiens
taaagcgtttgcaca

SEQ ID NO: 4171473 - DNA, 16 bp, Homo sapiens
taaagctgcctgtagt

SEQ ID NO: 4171474 - DNA, 12 bp, Homo sapiens
taaagctgctag

SEQ ID NO: 4171475 - DNA, 16 bp, Homo sapiens
taaagctggacaagaa

SEQ ID NO: 4171476 - DNA, 18 bp, Homo sapiens
taaagctggacaagaagc

SEQ ID NO: 4171477 - DNA, 22 bp, Homo sapiens
taaagctggacaagaagctgct

SEQ ID NO: 4171478 - DNA, 14 bp, Homo sapiens
taaaggaaggaaaa

SEQ ID NO: 4171479 - DNA, 16 bp, Homo sapiens
taaaggaagtcaccaa

SEQ ID NO: 4171480 - DNA, 22 bp, Homo sapiens
taaaggagaaggcatgaaattg

SEQ ID NO: 4171481 - DNA, 20 bp, Homo sapiens
taaaggagttaagagtagca

SEQ ID NO: 4171482 - DNA, 15 bp, Homo sapiens
taaaggattgatcac

SEQ ID NO: 4171483 - DNA, 19 bp, Homo sapiens
taaaggcaccatctaatag

SEQ ID NO: 4171484 - DNA, 20 bp, Homo sapiens
taaagggcaggtggttctaa

SEQ ID NO: 4171485 - DNA, 17 bp, Homo sapiens
taaaggtagagatgtgt

SEQ ID NO: 4171486 - DNA, 22 bp, Homo sapiens
taaagtatgtaaacaggagaca

SEQ ID NO: 4171487 - DNA, 22 bp, Homo sapiens
taaagtatgtaaagtatgtaaa

SEQ ID NO: 4171488 - DNA, 16 bp, Homo sapiens
taaagtttacagtaaa

SEQ ID NO: 4171489 - DNA, 10 bp, Homo sapiens
taaataaaag

SEQ ID NO: 4171490 - DNA, 16 bp, Homo sapiens
taaatacatcaaaaat

SEQ ID NO: 4171491 - DNA, 16 bp, Homo sapiens
taaatagtatatgcat

SEQ ID NO: 4171492 - DNA, 12 bp, Homo sapiens
taaatagtattt

SEQ ID NO: 4171493 - DNA, 15 bp, Homo sapiens
taaatatgtgaaaat

SEQ ID NO: 4171494 - DNA, 19 bp, Homo sapiens
taaatatgtgaaaatgatt

SEQ ID NO: 4171495 - DNA, 13 bp, Homo sapiens
taaatattgactt

SEQ ID NO: 4171496 - DNA, 18 bp, Homo sapiens
taaatattgacttctctt

SEQ ID NO: 4171497 - DNA, 17 bp, Homo sapiens
taaatattttaaagaat

SEQ ID NO: 4171498 - DNA, 18 bp, Homo sapiens
taaatcacgctttttgaa

SEQ ID NO: 4171499 - DNA, 16 bp, Homo sapiens
taaatcagcacatttg

SEQ ID NO: 4171500 - DNA, 20 bp, Homo sapiens
taaatcaggcccaatatcag

SEQ ID NO: 4171501 - DNA, 22 bp, Homo sapiens
taaatctgagatctccctccag

SEQ ID NO: 4171502 - DNA, 19 bp, Homo sapiens
taaatgcctcttaaattat

SEQ ID NO: 4171503 - DNA, 23 bp, Homo sapiens
taaattcagatatatttttcaca

SEQ ID NO: 4171504 - DNA, 22 bp, Homo sapiens
taaattctctctcttgcaggaa

SEQ ID NO: 4171505 - DNA, 14 bp, Homo sapiens
taaattgaatacac

SEQ ID NO: 4171506 - DNA, 14 bp, Homo sapiens
taaattgatgcact

SEQ ID NO: 4171507 - DNA, 16 bp, Homo sapiens
taaattggaattttct

SEQ ID NO: 4171508 - DNA, 15 bp, Homo sapiens
taaatttattttctt

SEQ ID NO: 4171509 - DNA, 20 bp, Homo sapiens
taaattttgacttgaaaaat

SEQ ID NO: 4171510 - DNA, 17 bp, Homo sapiens
taacaagatctttcagg

SEQ ID NO: 4171511 - DNA, 18 bp, Homo sapiens
taacaagatctttcagga

SEQ ID NO: 4171512 - DNA, 20 bp, Homo sapiens
taacaataatatttcaagtg

SEQ ID NO: 4171513 - DNA, 16 bp, Homo sapiens
taacaattaggcagac

SEQ ID NO: 4171514 - DNA, 13 bp, Homo sapiens
taacaatttcctt

SEQ ID NO: 4171515 - DNA, 17 bp, Homo sapiens
taacagctgaagtaatg

SEQ ID NO: 4171516 - DNA, 21 bp, Homo sapiens
taacagtcctaactggtatag

SEQ ID NO: 4171517 - DNA, 13 bp, Homo sapiens
taacatatttact

SEQ ID NO: 4171518 - DNA, 23 bp, Homo sapiens
taacatatttactaagccacaag

SEQ ID NO: 4171519 - DNA, 21 bp, Homo sapiens
taacatctattataaaaccat

SEQ ID NO: 4171520 - DNA, 13 bp, Homo sapiens
taacatggaagat

SEQ ID NO: 4171521 - DNA, 15 bp, Homo sapiens
taacattcacagccc

SEQ ID NO: 4171522 - DNA, 17 bp, Homo sapiens
taaccaagaaatactaa

SEQ ID NO: 4171523 - DNA, 18 bp, Homo sapiens
taaccaagaaatactaat

SEQ ID NO: 4171524 - DNA, 22 bp, Homo sapiens
taaccagatctagtcaatcaag

SEQ ID NO: 4171525 - DNA, 15 bp, Homo sapiens
taaccattaagaaat

SEQ ID NO: 4171526 - DNA, 17 bp, Homo sapiens
taactagtttaattaac

SEQ ID NO: 4171527 - DNA, 14 bp, Homo sapiens
taactattgaattg

SEQ ID NO: 4171528 - DNA, 23 bp, Homo sapiens
taactcttctggaaaccaaatag

SEQ ID NO: 4171529 - DNA, 17 bp, Homo sapiens
taactgggtaatgaaac

SEQ ID NO: 4171530 - DNA, 17 bp, Homo sapiens
taacttaaatagtattt

SEQ ID NO: 4171531 - DNA, 17 bp, Homo sapiens
taacttctgaagtaatt

SEQ ID NO: 4171532 - DNA, 17 bp, Homo sapiens
taacttctttgaagtta

SEQ ID NO: 4171533 - DNA, 22 bp, Homo sapiens
taacttgagggtaataaactta

SEQ ID NO: 4171534 - DNA, 20 bp, Homo sapiens
taactttgtggtaacttctt

SEQ ID NO: 4171535 - DNA, 16 bp, Homo sapiens
taactttttaatcatc

SEQ ID NO: 4171536 - DNA, 19 bp, Homo sapiens
taagaaacatgatgtgaga

SEQ ID NO: 4171537 - DNA, 20 bp, Homo sapiens
taagaaacttttttatttaa

SEQ ID NO: 4171538 - DNA, 15 bp, Homo sapiens
taagaaagtgcagaa

SEQ ID NO: 4171539 - DNA, 14 bp, Homo sapiens
taagagaagtagaa

SEQ ID NO: 4171540 - DNA, 15 bp, Homo sapiens
taagagctttatata

SEQ ID NO: 4171541 - DNA, 23 bp, Homo sapiens
taagagtctctatttcacaatta

SEQ ID NO: 4171542 - DNA, 15 bp, Homo sapiens
taagagtgaatgtgt

SEQ ID NO: 4171543 - DNA, 19 bp, Homo sapiens
taagagtgaatgtgtaccc

SEQ ID NO: 4171544 - DNA, 19 bp, Homo sapiens
taagataaatagagttcca

SEQ ID NO: 4171545 - DNA, 21 bp, Homo sapiens
taagataatggataatcttcg

SEQ ID NO: 4171546 - DNA, 20 bp, Homo sapiens
taagatagaacaggctggtt

SEQ ID NO: 4171547 - DNA, 17 bp, Homo sapiens
taagatctatagcctct

SEQ ID NO: 4171548 - DNA, 20 bp, Homo sapiens
taagcaaaggaaaccaaagg

SEQ ID NO: 4171549 - DNA, 14 bp, Homo sapiens
taagcaagaaggca

SEQ ID NO: 4171550 - DNA, 15 bp, Homo sapiens
taagcattctgagct

SEQ ID NO: 4171551 - DNA, 16 bp, Homo sapiens
taagcattctgagctg

SEQ ID NO: 4171552 - DNA, 21 bp, Homo sapiens
taagcattctgagctgggctt

SEQ ID NO: 4171553 - DNA, 13 bp, Homo sapiens
taagccaaaatgc

SEQ ID NO: 4171554 - DNA, 16 bp, Homo sapiens
taagccacaagaaatt

SEQ ID NO: 4171555 - DNA, 13 bp, Homo sapiens
taagcctgttgct

SEQ ID NO: 4171556 - DNA, 13 bp, Homo sapiens
taagctctggctt

SEQ ID NO: 4171557 - DNA, 15 bp, Homo sapiens
taagctgtaaaaaga

SEQ ID NO: 4171558 - DNA, 14 bp, Homo sapiens
taagctttctcctt

SEQ ID NO: 4171559 - DNA, 15 bp, Homo sapiens
taagctttctccttt

SEQ ID NO: 4171560 - DNA, 14 bp, Homo sapiens
taaggaaaaaataa

SEQ ID NO: 4171561 - DNA, 18 bp, Homo sapiens
taaggcttaggtgccagg

SEQ ID NO: 4171562 - DNA, 19 bp, Homo sapiens
taaggtacaagaagcattt

SEQ ID NO: 4171563 - DNA, 15 bp, Homo sapiens
taagtaaacaacata

SEQ ID NO: 4171564 - DNA, 17 bp, Homo sapiens
taagtaccactcaggcc

SEQ ID NO: 4171565 - DNA, 17 bp, Homo sapiens
taagtatttgaaactga

SEQ ID NO: 4171566 - DNA, 20 bp, Homo sapiens
taagtgataaatctagaaaa

SEQ ID NO: 4171567 - DNA, 21 bp, Homo sapiens
taagtggggtagactgaggga

SEQ ID NO: 4171568 - DNA, 17 bp, Homo sapiens
taagtgttgttcattat

SEQ ID NO: 4171569 - DNA, 19 bp, Homo sapiens
taagttagagaatatattt

SEQ ID NO: 4171570 - DNA, 22 bp, Homo sapiens
taagttattgatttttgtaata

SEQ ID NO: 4171571 - DNA, 16 bp, Homo sapiens
taagttggagaaatgt

SEQ ID NO: 4171572 - DNA, 23 bp, Homo sapiens
taataaacttagaataaaattgt

SEQ ID NO: 4171573 - DNA, 19 bp, Homo sapiens
taataaatagaaattttgt

SEQ ID NO: 4171574 - DNA, 23 bp, Homo sapiens
taataagccaagggctaggctct

SEQ ID NO: 4171575 - DNA, 12 bp, Homo sapiens
taataaggaaaa

SEQ ID NO: 4171576 - DNA, 19 bp, Homo sapiens
taataaggaaaaaataata

SEQ ID NO: 4171577 - DNA, 22 bp, Homo sapiens
taataatttagacttcaagcat

SEQ ID NO: 4171578 - DNA, 18 bp, Homo sapiens
taatagaaaactgaaaat

SEQ ID NO: 4171579 - DNA, 15 bp, Homo sapiens
taatagcaaagaatt

SEQ ID NO: 4171580 - DNA, 18 bp, Homo sapiens
taatagcttttattgtat

SEQ ID NO: 4171581 - DNA, 14 bp, Homo sapiens
taatatgtctgcca

SEQ ID NO: 4171582 - DNA, 14 bp, Homo sapiens
taatattaaaaata

SEQ ID NO: 4171583 - DNA, 16 bp, Homo sapiens
taatatttaggcaaga

SEQ ID NO: 4171584 - DNA, 17 bp, Homo sapiens
taatatttcaagtgcct

SEQ ID NO: 4171585 - DNA, 16 bp, Homo sapiens
taatcaagaatattca

SEQ ID NO: 4171586 - DNA, 17 bp, Homo sapiens
taatcaatcatctgtgt

SEQ ID NO: 4171587 - DNA, 11 bp, Homo sapiens
taatcagcctc

SEQ ID NO: 4171588 - DNA, 17 bp, Homo sapiens
taatctgggaagggaag

SEQ ID NO: 4171589 - DNA, 20 bp, Homo sapiens
taatgagaacttcaatcact

SEQ ID NO: 4171590 - DNA, 15 bp, Homo sapiens
taatgagggactgga

SEQ ID NO: 4171591 - DNA, 20 bp, Homo sapiens
taatgcttagagaatgttct

SEQ ID NO: 4171592 - DNA, 15 bp, Homo sapiens
taatgtcaaaatcat

SEQ ID NO: 4171593 - DNA, 18 bp, Homo sapiens
taatgtcaaaatcatgaa

SEQ ID NO: 4171594 - DNA, 12 bp, Homo sapiens
taatgtgatttt

SEQ ID NO: 4171595 - DNA, 19 bp, Homo sapiens
taatgtgattttttttaga

SEQ ID NO: 4171596 - DNA, 22 bp, Homo sapiens
taattaaaaaccactgaacatt

SEQ ID NO: 4171597 - DNA, 15 bp, Homo sapiens
taattacatccagaa

SEQ ID NO: 4171598 - DNA, 23 bp, Homo sapiens
taattagaaacgtgataaatata

SEQ ID NO: 4171599 - DNA, 19 bp, Homo sapiens
taattcaattcaaagctgt

SEQ ID NO: 4171600 - DNA, 22 bp, Homo sapiens
taattgatagcaggtgtaataa

SEQ ID NO: 4171601 - DNA, 17 bp, Homo sapiens
taattgtagatggaaat

SEQ ID NO: 4171602 - DNA, 16 bp, Homo sapiens
taatttagaaaacttt

SEQ ID NO: 4171603 - DNA, 21 bp, Homo sapiens
taatttagaaaactttaaagc

SEQ ID NO: 4171604 - DNA, 17 bp, Homo sapiens
taatttagtttcatata

SEQ ID NO: 4171605 - DNA, 14 bp, Homo sapiens
taatttatatttga

SEQ ID NO: 4171606 - DNA, 16 bp, Homo sapiens
taatttatatttgaaa

SEQ ID NO: 4171607 - DNA, 14 bp, Homo sapiens
taatttatgcagaa

SEQ ID NO: 4171608 - DNA, 16 bp, Homo sapiens
taatttcactttagaa

SEQ ID NO: 4171609 - DNA, 17 bp, Homo sapiens
taatttctgtgtatttt

SEQ ID NO: 4171610 - DNA, 13 bp, Homo sapiens
taatttgtatctg

SEQ ID NO: 4171611 - DNA, 19 bp, Homo sapiens
gttccaaatgaatgttgtc

SEQ ID NO: 4171612 - DNA, 23 bp, Homo sapiens
gttccagtttagcccttccctgc

SEQ ID NO: 4171613 - DNA, 20 bp, Homo sapiens
gttccccactgtatctaggc

SEQ ID NO: 4171614 - DNA, 14 bp, Homo sapiens
gttccctctgagaa

SEQ ID NO: 4171615 - DNA, 16 bp, Homo sapiens
gttccctgtcttgtcc

SEQ ID NO: 4171616 - DNA, 14 bp, Homo sapiens
gttcctataaaatc

SEQ ID NO: 4171617 - DNA, 13 bp, Homo sapiens
gttcctctttgca

SEQ ID NO: 4171618 - DNA, 18 bp, Homo sapiens
gttctaatatttttagct

SEQ ID NO: 4171619 - DNA, 16 bp, Homo sapiens
gttctatagagcctgg

SEQ ID NO: 4171620 - DNA, 23 bp, Homo sapiens
gttctatgaatatggaaaggcca

SEQ ID NO: 4171621 - DNA, 16 bp, Homo sapiens
gttctgacacacgtat

SEQ ID NO: 4171622 - DNA, 20 bp, Homo sapiens
gttctgggagtcctgtcagc

SEQ ID NO: 4171623 - DNA, 16 bp, Homo sapiens
gttctgtgacccatct

SEQ ID NO: 4171624 - DNA, 21 bp, Homo sapiens
gttctgtgacccatctgtagt

SEQ ID NO: 4171625 - DNA, 23 bp, Homo sapiens
gttcttgagtagatctgcttctt

SEQ ID NO: 4171626 - DNA, 15 bp, Homo sapiens
gttctttctggagtc

SEQ ID NO: 4171627 - DNA, 22 bp, Homo sapiens
gttcttttttgttacagctatg

SEQ ID NO: 4171628 - DNA, 16 bp, Homo sapiens
gttgaaatatgatgtt

SEQ ID NO: 4171629 - DNA, 20 bp, Homo sapiens
gttgaacatctcactttgcc

SEQ ID NO: 4171630 - DNA, 18 bp, Homo sapiens
gttgaagcaaatcgaatg

SEQ ID NO: 4171631 - DNA, 23 bp, Homo sapiens
gttgaagcaaatcgaatgaaatt

SEQ ID NO: 4171632 - DNA, 22 bp, Homo sapiens
gttgagaggggagggcaggagg

SEQ ID NO: 4171633 - DNA, 18 bp, Homo sapiens
gttgataaattccactgg

SEQ ID NO: 4171634 - DNA, 20 bp, Homo sapiens
gttgcagacaggaatcttaa

SEQ ID NO: 4171635 - DNA, 20 bp, Homo sapiens
gttgccacaccaatcagaga

SEQ ID NO: 4171636 - DNA, 16 bp, Homo sapiens
gttgcgggggagctgg

SEQ ID NO: 4171637 - DNA, 17 bp, Homo sapiens
gttgcgggggagctgga

SEQ ID NO: 4171638 - DNA, 22 bp, Homo sapiens
gttgcttctggctcctccttcc

SEQ ID NO: 4171639 - DNA, 14 bp, Homo sapiens
gttggggcaaagcc

SEQ ID NO: 4171640 - DNA, 13 bp, Homo sapiens
gttgtgaggcctg

SEQ ID NO: 4171641 - DNA, 17 bp, Homo sapiens
gttgtgcaaattaacag

SEQ ID NO: 4171642 - DNA, 19 bp, Homo sapiens
gttgtttttaagtcctgta

SEQ ID NO: 4171643 - DNA, 17 bp, Homo sapiens
gtttaagccaaaacaat

SEQ ID NO: 4171644 - DNA, 16 bp, Homo sapiens
gtttacaagtgtatat

SEQ ID NO: 4171645 - DNA, 19 bp, Homo sapiens
gtttacagtaaataaattg

SEQ ID NO: 4171646 - DNA, 19 bp, Homo sapiens
gtttacttttcagggcatc

SEQ ID NO: 4171647 - DNA, 19 bp, Homo sapiens
gtttaggggaagtatgtgt

SEQ ID NO: 4171648 - DNA, 15 bp, Homo sapiens
gtttatgtctaaaga

SEQ ID NO: 4171649 - DNA, 21 bp, Homo sapiens
gtttattccctccagggtcta

SEQ ID NO: 4171650 - DNA, 12 bp, Homo sapiens
gtttatttccaa

SEQ ID NO: 4171651 - DNA, 18 bp, Homo sapiens
gtttcaccgtgttagcca

SEQ ID NO: 4171652 - DNA, 15 bp, Homo sapiens
gtttcagaagcaggc

SEQ ID NO: 4171653 - DNA, 21 bp, Homo sapiens
gtttcagatatatatcatatt

SEQ ID NO: 4171654 - DNA, 19 bp, Homo sapiens
gtttcatttctactgtgac

SEQ ID NO: 4171655 - DNA, 22 bp, Homo sapiens
gtttccaaaaaggaacactgga

SEQ ID NO: 4171656 - DNA, 16 bp, Homo sapiens
gtttccaacctggagt

SEQ ID NO: 4171657 - DNA, 14 bp, Homo sapiens
gtttctccccctgg

SEQ ID NO: 4171658 - DNA, 23 bp, Homo sapiens
gtttctccccctgggctctgccc

SEQ ID NO: 4171659 - DNA, 21 bp, Homo sapiens
gtttcttaaataagaaacttt

SEQ ID NO: 4171660 - DNA, 15 bp, Homo sapiens
gtttgccttccagaa

SEQ ID NO: 4171661 - DNA, 11 bp, Homo sapiens
gtttgctttct

SEQ ID NO: 4171662 - DNA, 15 bp, Homo sapiens
gtttggcaatagttt

SEQ ID NO: 4171663 - DNA, 17 bp, Homo sapiens
gtttggcaatagtttgc

SEQ ID NO: 4171664 - DNA, 20 bp, Homo sapiens
gtttggcacatgcaggtagt

SEQ ID NO: 4171665 - DNA, 21 bp, Homo sapiens
gtttgggcagaagggagaagg

SEQ ID NO: 4171666 - DNA, 13 bp, Homo sapiens
gtttgtaaacaac

SEQ ID NO: 4171667 - DNA, 13 bp, Homo sapiens
gtttgtaaatgcc

SEQ ID NO: 4171668 - DNA, 14 bp, Homo sapiens
gtttgtaaatgcct

SEQ ID NO: 4171669 - DNA, 15 bp, Homo sapiens
gtttgtaaatgcctc

SEQ ID NO: 4171670 - DNA, 20 bp, Homo sapiens
gtttgtattttaaatgtttt

SEQ ID NO: 4171671 - DNA, 11 bp, Homo sapiens
gtttgtcaaca

SEQ ID NO: 4171672 - DNA, 15 bp, Homo sapiens
gtttgtcaacaaaaa

SEQ ID NO: 4171673 - DNA, 21 bp, Homo sapiens
gtttgtcaacacaaagacatg

SEQ ID NO: 4171674 - DNA, 13 bp, Homo sapiens
gtttgttttacaa

SEQ ID NO: 4171675 - DNA, 11 bp, Homo sapiens
gttttaaatta

SEQ ID NO: 4171676 - DNA, 19 bp, Homo sapiens
gttttacaaatttttcctg

SEQ ID NO: 4171677 - DNA, 20 bp, Homo sapiens
gttttacaagaattgtccat

SEQ ID NO: 4171678 - DNA, 21 bp, Homo sapiens
gttttacagtgaatttctgat

SEQ ID NO: 4171679 - DNA, 22 bp, Homo sapiens
gttttatcatgacatgttatat

SEQ ID NO: 4171680 - DNA, 22 bp, Homo sapiens
gttttccttgaccactggccct

SEQ ID NO: 4171681 - DNA, 22 bp, Homo sapiens
gttttgggaggggatggcagac

SEQ ID NO: 4171682 - DNA, 16 bp, Homo sapiens
gtttttaagtcctgta

SEQ ID NO: 4171683 - DNA, 18 bp, Homo sapiens
gtttttaatgtatagtaa

SEQ ID NO: 4171684 - DNA, 15 bp, Homo sapiens
taaaaaaataagaag

SEQ ID NO: 4171685 - DNA, 22 bp, Homo sapiens
taaaaaaataagaagaatgctt

SEQ ID NO: 4171686 - DNA, 19 bp, Homo sapiens
taaaaaactaaaaactaga

SEQ ID NO: 4171687 - DNA, 17 bp, Homo sapiens
taaaaaagcttaaaact

SEQ ID NO: 4171688 - DNA, 19 bp, Homo sapiens
taaaaaagcttaaaacttt

SEQ ID NO: 4171689 - DNA, 13 bp, Homo sapiens
taaaaagtgaaat

SEQ ID NO: 4171690 - DNA, 21 bp, Homo sapiens
taaaaatactatgaaatgaaa

SEQ ID NO: 4171691 - DNA, 19 bp, Homo sapiens
taaaaatatggaacttcta

SEQ ID NO: 4171692 - DNA, 18 bp, Homo sapiens
taaaaatgaaattattta

SEQ ID NO: 4171693 - DNA, 21 bp, Homo sapiens
taaaacacacctaagagaaaa

SEQ ID NO: 4171694 - DNA, 17 bp, Homo sapiens
taaaacatcattactat

SEQ ID NO: 4171695 - DNA, 23 bp, Homo sapiens
taaaacatgaaaattatctccct

SEQ ID NO: 4171696 - DNA, 14 bp, Homo sapiens
taaaacatttattt

SEQ ID NO: 4171697 - DNA, 19 bp, Homo sapiens
taaaaccccatctctacta

SEQ ID NO: 4171698 - DNA, 23 bp, Homo sapiens
taaaacctagaacttcaaaatgt

SEQ ID NO: 4171699 - DNA, 14 bp, Homo sapiens
taaaacctttcaaa

SEQ ID NO: 4171700 - DNA, 16 bp, Homo sapiens
taaaacctttcaaatt

SEQ ID NO: 4171701 - DNA, 22 bp, Homo sapiens
taaaactgaaggcctcacttaa

SEQ ID NO: 4171702 - DNA, 13 bp, Homo sapiens
taaaagaaacttt

SEQ ID NO: 4171703 - DNA, 16 bp, Homo sapiens
taaaagcaaaaaagaa

SEQ ID NO: 4171704 - DNA, 22 bp, Homo sapiens
taaaagcaaaaaagaaaacctt

SEQ ID NO: 4171705 - DNA, 23 bp, Homo sapiens
taaaagcaaaaaagaaaaccttt

SEQ ID NO: 4171706 - DNA, 14 bp, Homo sapiens
taaaagcttaggct

SEQ ID NO: 4171707 - DNA, 15 bp, Homo sapiens
taaaaggaaaaccag

SEQ ID NO: 4171708 - DNA, 21 bp, Homo sapiens
taaaagtactgaagacccgtt

SEQ ID NO: 4171709 - DNA, 19 bp, Homo sapiens
taaaagttgggaaaagtgt

SEQ ID NO: 4171710 - DNA, 14 bp, Homo sapiens
taaaagttgtgatt

SEQ ID NO: 4171711 - DNA, 15 bp, Homo sapiens
taaaagttgtgattc

SEQ ID NO: 4171712 - DNA, 22 bp, Homo sapiens
taaaagtttttgtcactatctt

SEQ ID NO: 4171713 - DNA, 17 bp, Homo sapiens
taaaatgaggacatgtt

SEQ ID NO: 4171714 - DNA, 20 bp, Homo sapiens
taaaatgattgtaaaatagc

SEQ ID NO: 4171715 - DNA, 15 bp, Homo sapiens
taaaatgtaaagcca

SEQ ID NO: 4171716 - DNA, 18 bp, Homo sapiens
taaaatgtaaagccatgc

SEQ ID NO: 4171717 - DNA, 14 bp, Homo sapiens
taaaatgtaacttt

SEQ ID NO: 4171718 - DNA, 16 bp, Homo sapiens
taaaattgtaaaattg

SEQ ID NO: 4171719 - DNA, 19 bp, Homo sapiens
taaaattgtaaaattgtat

SEQ ID NO: 4171720 - DNA, 22 bp, Homo sapiens
taaaattgtaaaattgtataga

SEQ ID NO: 4171721 - DNA, 16 bp, Homo sapiens
taaaattgtatagaga

SEQ ID NO: 4171722 - DNA, 23 bp, Homo sapiens
taaaattttttgatgtcagcctt

SEQ ID NO: 4171723 - DNA, 19 bp, Homo sapiens
taaacaactgcagaaagcc

SEQ ID NO: 4171724 - DNA, 22 bp, Homo sapiens
taaacaagtatttgttaattta

SEQ ID NO: 4171725 - DNA, 22 bp, Homo sapiens
taaacacttatcttctggatta

SEQ ID NO: 4171726 - DNA, 23 bp, Homo sapiens
taaacagactatttaacttgagg

SEQ ID NO: 4171727 - DNA, 18 bp, Homo sapiens
taaacataggtataatta

SEQ ID NO: 4171728 - DNA, 17 bp, Homo sapiens
taaacatcattcatttt

SEQ ID NO: 4171729 - DNA, 22 bp, Homo sapiens
taaaccaccagtgcccaaagtc

SEQ ID NO: 4171730 - DNA, 17 bp, Homo sapiens
taaacccccgctccaga

SEQ ID NO: 4171731 - DNA, 17 bp, Homo sapiens
taaaccgctaaaagaaa

SEQ ID NO: 4171732 - DNA, 13 bp, Homo sapiens
taaaccttttttg

SEQ ID NO: 4171733 - DNA, 14 bp, Homo sapiens
taaactatattttc

SEQ ID NO: 4171734 - DNA, 17 bp, Homo sapiens
taaactatcagtttgtc

SEQ ID NO: 4171735 - DNA, 22 bp, Homo sapiens
taaactctaaacattaatcaat

SEQ ID NO: 4171736 - DNA, 23 bp, Homo sapiens
taaactggggagttataaaaata

SEQ ID NO: 4171737 - DNA, 18 bp, Homo sapiens
taaactgtacaaatgaaa

SEQ ID NO: 4171738 - DNA, 19 bp, Homo sapiens
taaactgtacaaatgaaat

SEQ ID NO: 4171739 - DNA, 19 bp, Homo sapiens
taaacttagaataaaattg

SEQ ID NO: 4171740 - DNA, 21 bp, Homo sapiens
taaacttagaataaaattgta

SEQ ID NO: 4171741 - DNA, 19 bp, Homo sapiens
taaacttcttaacgaaatt

SEQ ID NO: 4171742 - DNA, 20 bp, Homo sapiens
taaactttacccaaaaacta

SEQ ID NO: 4171743 - DNA, 18 bp, Homo sapiens
taaactttagagtagcat

SEQ ID NO: 4171744 - DNA, 15 bp, Homo sapiens
taaagaaaaacaaac

SEQ ID NO: 4171745 - DNA, 21 bp, Homo sapiens
taaagaaagtcgaattaatag

SEQ ID NO: 4171746 - DNA, 15 bp, Homo sapiens
taaagactgagaccc

SEQ ID NO: 4171747 - DNA, 11 bp, Homo sapiens
taaagagaaca

SEQ ID NO: 4171748 - DNA, 20 bp, Homo sapiens
gtgcctcagagcaggctcag

SEQ ID NO: 4171749 - DNA, 18 bp, Homo sapiens
gtgcctgccctggaggga

SEQ ID NO: 4171750 - DNA, 20 bp, Homo sapiens
gtgccttcgcggtggaaggc

SEQ ID NO: 4171751 - DNA, 19 bp, Homo sapiens
gtgcctttctctggctcca

SEQ ID NO: 4171752 - DNA, 13 bp, Homo sapiens
gtgctagctctta

SEQ ID NO: 4171753 - DNA, 19 bp, Homo sapiens
gtgctataggctggagaag

SEQ ID NO: 4171754 - DNA, 19 bp, Homo sapiens
gtgctgatccggctgctcc

SEQ ID NO: 4171755 - DNA, 20 bp, Homo sapiens
gtgctgatccggctgctcct

SEQ ID NO: 4171756 - DNA, 21 bp, Homo sapiens
gtgctgatccggctgctcctc

SEQ ID NO: 4171757 - DNA, 15 bp, Homo sapiens
gtgctgattcagcct

SEQ ID NO: 4171758 - DNA, 12 bp, Homo sapiens
gtgctgccctgc

SEQ ID NO: 4171759 - DNA, 15 bp, Homo sapiens
gtgctgtggccaggg

SEQ ID NO: 4171760 - DNA, 16 bp, Homo sapiens
gtgctgtggcctgggc

SEQ ID NO: 4171761 - DNA, 17 bp, Homo sapiens
gtgctgtggcctgggca

SEQ ID NO: 4171762 - DNA, 19 bp, Homo sapiens
gtgctgtggcctgggcaag

SEQ ID NO: 4171763 - DNA, 12 bp, Homo sapiens
gtgcttaataat

SEQ ID NO: 4171764 - DNA, 15 bp, Homo sapiens
gtgcttattatattt

SEQ ID NO: 4171765 - DNA, 18 bp, Homo sapiens
gtgcttcagcctgaggct

SEQ ID NO: 4171766 - DNA, 15 bp, Homo sapiens
gtggaaagcctctgc

SEQ ID NO: 4171767 - DNA, 14 bp, Homo sapiens
gtggacacctgccc

SEQ ID NO: 4171768 - DNA, 17 bp, Homo sapiens
gtggacacctgccctgc

SEQ ID NO: 4171769 - DNA, 19 bp, Homo sapiens
gtggacacctgccctgccc

SEQ ID NO: 4171770 - DNA, 14 bp, Homo sapiens
gtggacagtcctgg

SEQ ID NO: 4171771 - DNA, 15 bp, Homo sapiens
gtggagaaggatagc

SEQ ID NO: 4171772 - DNA, 12 bp, Homo sapiens
gtggagacagcc

SEQ ID NO: 4171773 - DNA, 16 bp, Homo sapiens
gtggagacagccctgc

SEQ ID NO: 4171774 - DNA, 19 bp, Homo sapiens
gtggaggttgcagtgagct

SEQ ID NO: 4171775 - DNA, 18 bp, Homo sapiens
gtggatctccaaggacca

SEQ ID NO: 4171776 - DNA, 19 bp, Homo sapiens
gtggatctccaaggaccag

SEQ ID NO: 4171777 - DNA, 15 bp, Homo sapiens
gtggatggcccagca

SEQ ID NO: 4171778 - DNA, 21 bp, Homo sapiens
gtggatggcccagcaggcagg

SEQ ID NO: 4171779 - DNA, 23 bp, Homo sapiens
gtggattttgtccattcatctca

SEQ ID NO: 4171780 - DNA, 13 bp, Homo sapiens
gtggcagccctgt

SEQ ID NO: 4171781 - DNA, 13 bp, Homo sapiens
gtggcaggaccag

SEQ ID NO: 4171782 - DNA, 15 bp, Homo sapiens
gtggcaggaccagga

SEQ ID NO: 4171783 - DNA, 19 bp, Homo sapiens
gtggccaaattatttgtgt

SEQ ID NO: 4171784 - DNA, 13 bp, Homo sapiens
gtggccagggtga

SEQ ID NO: 4171785 - DNA, 19 bp, Homo sapiens
gtggcccttctgtccacca

SEQ ID NO: 4171786 - DNA, 22 bp, Homo sapiens
gtggcccttctgtccaccagac

SEQ ID NO: 4171787 - DNA, 13 bp, Homo sapiens
gtggctctccagt

SEQ ID NO: 4171788 - DNA, 22 bp, Homo sapiens
gtggctggcctttcaggtccag

SEQ ID NO: 4171789 - DNA, 22 bp, Homo sapiens
gtggcttacaaattctacagca

SEQ ID NO: 4171790 - DNA, 17 bp, Homo sapiens
gtgggaagcaagcaggg

SEQ ID NO: 4171791 - DNA, 20 bp, Homo sapiens
gtgggacaaaccagagcaga

SEQ ID NO: 4171792 - DNA, 13 bp, Homo sapiens
gtgggagagccca

SEQ ID NO: 4171793 - DNA, 13 bp, Homo sapiens
gtgggagctcagc

SEQ ID NO: 4171794 - DNA, 14 bp, Homo sapiens
gtgggcagaggctg

SEQ ID NO: 4171795 - DNA, 19 bp, Homo sapiens
gtgggccactctcccctcc

SEQ ID NO: 4171796 - DNA, 13 bp, Homo sapiens
gtgggccgggagg

SEQ ID NO: 4171797 - DNA, 16 bp, Homo sapiens
gtgggccgggaggcag

SEQ ID NO: 4171798 - DNA, 18 bp, Homo sapiens
gtgggccgggaggcagtg

SEQ ID NO: 4171799 - DNA, 19 bp, Homo sapiens
gtgggccgggaggcagtgc

SEQ ID NO: 4171800 - DNA, 17 bp, Homo sapiens
gtgggctccctggccca

SEQ ID NO: 4171801 - DNA, 23 bp, Homo sapiens
gtggggacaggtaagtggcagga

SEQ ID NO: 4171802 - DNA, 14 bp, Homo sapiens
gtggggcctgatgg

SEQ ID NO: 4171803 - DNA, 20 bp, Homo sapiens
gtggggctccggaggggacc

SEQ ID NO: 4171804 - DNA, 17 bp, Homo sapiens
gtgggttatcagttaac

SEQ ID NO: 4171805 - DNA, 19 bp, Homo sapiens
gtggtagaaccacttggct

SEQ ID NO: 4171806 - DNA, 14 bp, Homo sapiens
gtggtagaagccag

SEQ ID NO: 4171807 - DNA, 20 bp, Homo sapiens
gtggtatagtagaaaggcca

SEQ ID NO: 4171808 - DNA, 22 bp, Homo sapiens
gtggtcaaaccgcactcaccca

SEQ ID NO: 4171809 - DNA, 15 bp, Homo sapiens
gtggtcagagtgcca

SEQ ID NO: 4171810 - DNA, 13 bp, Homo sapiens
gtggtgccagagg

SEQ ID NO: 4171811 - DNA, 16 bp, Homo sapiens
gtggtgggcggggaga

SEQ ID NO: 4171812 - DNA, 22 bp, Homo sapiens
gtggtgggttctttggaaggag

SEQ ID NO: 4171813 - DNA, 20 bp, Homo sapiens
gtggttctaatatttttagc

SEQ ID NO: 4171814 - DNA, 20 bp, Homo sapiens
gtgtagctcctctgctgctc

SEQ ID NO: 4171815 - DNA, 13 bp, Homo sapiens
gtgtatatcagaa

SEQ ID NO: 4171816 - DNA, 21 bp, Homo sapiens
gtgtatcccccccctgtatag

SEQ ID NO: 4171817 - DNA, 16 bp, Homo sapiens
gtgtatccgactctaa

SEQ ID NO: 4171818 - DNA, 19 bp, Homo sapiens
gtgtatccgactctaagct

SEQ ID NO: 4171819 - DNA, 21 bp, Homo sapiens
gtgtatccgactctaagctgt

SEQ ID NO: 4171820 - DNA, 22 bp, Homo sapiens
gtgtatccgactctaagctgtg

SEQ ID NO: 4171821 - DNA, 13 bp, Homo sapiens
gtgtatgtctatt

SEQ ID NO: 4171822 - DNA, 15 bp, Homo sapiens
gtgtcaccagcctgt

SEQ ID NO: 4171823 - DNA, 22 bp, Homo sapiens
gtgtcactcaaggcggtgcttg

SEQ ID NO: 4171824 - DNA, 13 bp, Homo sapiens
gtgtctgaagact

SEQ ID NO: 4171825 - DNA, 12 bp, Homo sapiens
gtgtctggcccc

SEQ ID NO: 4171826 - DNA, 13 bp, Homo sapiens
gtgtctgggagag

SEQ ID NO: 4171827 - DNA, 21 bp, Homo sapiens
gtgtgatgaatagcgaatcat

SEQ ID NO: 4171828 - DNA, 19 bp, Homo sapiens
gtgtgcatatatactacat

SEQ ID NO: 4171829 - DNA, 12 bp, Homo sapiens
gtgtgccacacc

SEQ ID NO: 4171830 - DNA, 21 bp, Homo sapiens
gtgtgccatagagtttaacac

SEQ ID NO: 4171831 - DNA, 13 bp, Homo sapiens
gtgtgcctgcagc

SEQ ID NO: 4171832 - DNA, 14 bp, Homo sapiens
gtgtgcctgcagcc

SEQ ID NO: 4171833 - DNA, 18 bp, Homo sapiens
gtgtgcctgcagccccgc

SEQ ID NO: 4171834 - DNA, 13 bp, Homo sapiens
gtgtgcctgccct

SEQ ID NO: 4171835 - DNA, 14 bp, Homo sapiens
gtgtgcctgccctg

SEQ ID NO: 4171836 - DNA, 15 bp, Homo sapiens
gtgtgcctgccctgg

SEQ ID NO: 4171837 - DNA, 23 bp, Homo sapiens
gtgtgcctgccctggagggaggc

SEQ ID NO: 4171838 - DNA, 21 bp, Homo sapiens
gtgtggtctcttacatggcca

SEQ ID NO: 4171839 - DNA, 15 bp, Homo sapiens
gtgtggtgtgtgtgc

SEQ ID NO: 4171840 - DNA, 19 bp, Homo sapiens
gtgtgtatccgactctaag

SEQ ID NO: 4171841 - DNA, 22 bp, Homo sapiens
gtgtgtatccgactctaagctg

SEQ ID NO: 4171842 - DNA, 18 bp, Homo sapiens
gtgtgtatgtatgtgtgt

SEQ ID NO: 4171843 - DNA, 13 bp, Homo sapiens
gtgtgtctgaaga

SEQ ID NO: 4171844 - DNA, 15 bp, Homo sapiens
gtgtgtctgaagact

SEQ ID NO: 4171845 - DNA, 13 bp, Homo sapiens
gtgtgtctgtgcg

SEQ ID NO: 4171846 - DNA, 18 bp, Homo sapiens
gtgtgtctgttgagtgca

SEQ ID NO: 4171847 - DNA, 24 bp, Homo sapiens
gtgtgtggaaggcagggacagaga

SEQ ID NO: 4171848 - DNA, 22 bp, Homo sapiens
gtgtgtttaacattcacagccc

SEQ ID NO: 4171849 - DNA, 20 bp, Homo sapiens
gtgttctatagagcctggcg

SEQ ID NO: 4171850 - DNA, 14 bp, Homo sapiens
gtgttctattaatc

SEQ ID NO: 4171851 - DNA, 20 bp, Homo sapiens
gtgttgatacgtgtgtgaag

SEQ ID NO: 4171852 - DNA, 21 bp, Homo sapiens
gtgttgttatcatttaagatt

SEQ ID NO: 4171853 - DNA, 14 bp, Homo sapiens
gttaaatagctata

SEQ ID NO: 4171854 - DNA, 17 bp, Homo sapiens
gttaacatggaatttaa

SEQ ID NO: 4171855 - DNA, 11 bp, Homo sapiens
gttaactatta

SEQ ID NO: 4171856 - DNA, 18 bp, Homo sapiens
gttaactgtgaaatacca

SEQ ID NO: 4171857 - DNA, 19 bp, Homo sapiens
gttaactgtgaaataccac

SEQ ID NO: 4171858 - DNA, 19 bp, Homo sapiens
gttaacttggtcagagcca

SEQ ID NO: 4171859 - DNA, 19 bp, Homo sapiens
gttaagaaaaactacagca

SEQ ID NO: 4171860 - DNA, 20 bp, Homo sapiens
gttaagcaaaggaaaccaaa

SEQ ID NO: 4171861 - DNA, 14 bp, Homo sapiens
gttaagggaaggaa

SEQ ID NO: 4171862 - DNA, 21 bp, Homo sapiens
gttaatatatcccagaaatta

SEQ ID NO: 4171863 - DNA, 17 bp, Homo sapiens
gttaatttgttatgtat

SEQ ID NO: 4171864 - DNA, 21 bp, Homo sapiens
gttactgaagttatctgtgtt

SEQ ID NO: 4171865 - DNA, 15 bp, Homo sapiens
gttactgattctcct

SEQ ID NO: 4171866 - DNA, 17 bp, Homo sapiens
gttactgattctcctgt

SEQ ID NO: 4171867 - DNA, 22 bp, Homo sapiens
gttagagaggtagcgagctgct

SEQ ID NO: 4171868 - DNA, 23 bp, Homo sapiens
gttagcagcagtgagcttctatt

SEQ ID NO: 4171869 - DNA, 19 bp, Homo sapiens
gttaggaaataaaaccttt

SEQ ID NO: 4171870 - DNA, 15 bp, Homo sapiens
gttaggagttcgaga

SEQ ID NO: 4171871 - DNA, 14 bp, Homo sapiens
gttataaaaataca

SEQ ID NO: 4171872 - DNA, 16 bp, Homo sapiens
gttataaaaatacaac

SEQ ID NO: 4171873 - DNA, 17 bp, Homo sapiens
gttatcagttaacatta

SEQ ID NO: 4171874 - DNA, 15 bp, Homo sapiens
gttatgcaagcacaa

SEQ ID NO: 4171875 - DNA, 13 bp, Homo sapiens
gttatgctgtcat

SEQ ID NO: 4171876 - DNA, 19 bp, Homo sapiens
gttatgtatatagatgtgc

SEQ ID NO: 4171877 - DNA, 16 bp, Homo sapiens
gttattgatttttgta

SEQ ID NO: 4171878 - DNA, 16 bp, Homo sapiens
gttatttgtaatagat

SEQ ID NO: 4171879 - DNA, 13 bp, Homo sapiens
gttatttgtacag

SEQ ID NO: 4171880 - DNA, 14 bp, Homo sapiens
gttatttgtacagt

SEQ ID NO: 4171881 - DNA, 18 bp, Homo sapiens
gttatttgttattttcag

SEQ ID NO: 4171882 - DNA, 17 bp, Homo sapiens
gttattttcagtatttt

SEQ ID NO: 4171883 - DNA, 17 bp, Homo sapiens
gttcaagtatctaactc

SEQ ID NO: 4171884 - DNA, 20 bp, Homo sapiens
gttcagttcctctttgcatg

SEQ ID NO: 4171885 - DNA, 15 bp, Homo sapiens
gttcagttttcctta

SEQ ID NO: 4171886 - DNA, 20 bp, Homo sapiens
gttcatgatagtgtgatttt

SEQ ID NO: 4171887 - DNA, 17 bp, Homo sapiens
gttcatgttctgtgata

SEQ ID NO: 4171888 - DNA, 22 bp, Homo sapiens
gtcagccttccccctcccaggg

SEQ ID NO: 4171889 - DNA, 17 bp, Homo sapiens
gtcaggaaagacaggct

SEQ ID NO: 4171890 - DNA, 16 bp, Homo sapiens
gtcagtgcagcagagg

SEQ ID NO: 4171891 - DNA, 16 bp, Homo sapiens
gtcatcacttttcagt

SEQ ID NO: 4171892 - DNA, 21 bp, Homo sapiens
gtcatcccctacactttggcc

SEQ ID NO: 4171893 - DNA, 19 bp, Homo sapiens
gtcatgaggaaagacacag

SEQ ID NO: 4171894 - DNA, 23 bp, Homo sapiens
gtcatgttggtcaaaagctggat

SEQ ID NO: 4171895 - DNA, 18 bp, Homo sapiens
gtcattttggtactttgg

SEQ ID NO: 4171896 - DNA, 16 bp, Homo sapiens
gtccaacctgcctgtg

SEQ ID NO: 4171897 - DNA, 14 bp, Homo sapiens
gtccaccagaccca

SEQ ID NO: 4171898 - DNA, 11 bp, Homo sapiens
gtccacccagc

SEQ ID NO: 4171899 - DNA, 16 bp, Homo sapiens
gtccagatgccttcct

SEQ ID NO: 4171900 - DNA, 15 bp, Homo sapiens
gtccaggcaggagga

SEQ ID NO: 4171901 - DNA, 17 bp, Homo sapiens
gtccaggccagtgggcc

SEQ ID NO: 4171902 - DNA, 19 bp, Homo sapiens
gtccaggtcaccagcctga

SEQ ID NO: 4171903 - DNA, 14 bp, Homo sapiens
gtccatgtgcttcc

SEQ ID NO: 4171904 - DNA, 13 bp, Homo sapiens
gtcccaagcagcc

SEQ ID NO: 4171905 - DNA, 22 bp, Homo sapiens
gtcccagctactcagaagcctg

SEQ ID NO: 4171906 - DNA, 11 bp, Homo sapiens
gtccccagcta

SEQ ID NO: 4171907 - DNA, 17 bp, Homo sapiens
gtccccagctagcgtct

SEQ ID NO: 4171908 - DNA, 19 bp, Homo sapiens
gtccccatggcaccctgct

SEQ ID NO: 4171909 - DNA, 14 bp, Homo sapiens
gtcccctccgtagg

SEQ ID NO: 4171910 - DNA, 21 bp, Homo sapiens
gtcccgtgcagcttctgtcct

SEQ ID NO: 4171911 - DNA, 21 bp, Homo sapiens
gtccctaggagggaaggagct

SEQ ID NO: 4171912 - DNA, 18 bp, Homo sapiens
gtccctgactctctgtga

SEQ ID NO: 4171913 - DNA, 13 bp, Homo sapiens
gtccctggatcag

SEQ ID NO: 4171914 - DNA, 15 bp, Homo sapiens
gtcccttgctgacat

SEQ ID NO: 4171915 - DNA, 15 bp, Homo sapiens
gtccgtctgtgtatg

SEQ ID NO: 4171916 - DNA, 15 bp, Homo sapiens
gtcctcacagcctct

SEQ ID NO: 4171917 - DNA, 13 bp, Homo sapiens
gtcctccatttca

SEQ ID NO: 4171918 - DNA, 21 bp, Homo sapiens
gtcctccatttcaactccaga

SEQ ID NO: 4171919 - DNA, 22 bp, Homo sapiens
gtcctccatttcaactccagaa

SEQ ID NO: 4171920 - DNA, 17 bp, Homo sapiens
gtcctcgtagccatctc

SEQ ID NO: 4171921 - DNA, 12 bp, Homo sapiens
gtcctgcctctc

SEQ ID NO: 4171922 - DNA, 20 bp, Homo sapiens
gtcctggctcccagggtcct

SEQ ID NO: 4171923 - DNA, 21 bp, Homo sapiens
gtcctgtcctggctcccaggg

SEQ ID NO: 4171924 - DNA, 14 bp, Homo sapiens
gtccttccaggccc

SEQ ID NO: 4171925 - DNA, 22 bp, Homo sapiens
gtccttccaggcccccaccact

SEQ ID NO: 4171926 - DNA, 17 bp, Homo sapiens
gtccttggaagtttcat

SEQ ID NO: 4171927 - DNA, 14 bp, Homo sapiens
gtccttggtgtgac

SEQ ID NO: 4171928 - DNA, 14 bp, Homo sapiens
gtcctttaggcagc

SEQ ID NO: 4171929 - DNA, 18 bp, Homo sapiens
gtcctttaggcagcctgc

SEQ ID NO: 4171930 - DNA, 22 bp, Homo sapiens
gtcctttctagagcactgccac

SEQ ID NO: 4171931 - DNA, 14 bp, Homo sapiens
gtcgggacagagag

SEQ ID NO: 4171932 - DNA, 15 bp, Homo sapiens
gtcgtggcagataat

SEQ ID NO: 4171933 - DNA, 22 bp, Homo sapiens
gtcgtggcagataatcagcctc

SEQ ID NO: 4171934 - DNA, 14 bp, Homo sapiens
gtctaaagagaaca

SEQ ID NO: 4171935 - DNA, 21 bp, Homo sapiens
gtctaaagctggtttaatgtt

SEQ ID NO: 4171936 - DNA, 11 bp, Homo sapiens
gtctaaagttt

SEQ ID NO: 4171937 - DNA, 15 bp, Homo sapiens
gtctaagataaaagc

SEQ ID NO: 4171938 - DNA, 23 bp, Homo sapiens
gtctctgtcccggttcaccttgc

SEQ ID NO: 4171939 - DNA, 16 bp, Homo sapiens
gtctgaagtggttgtt

SEQ ID NO: 4171940 - DNA, 12 bp, Homo sapiens
gtctgatgtttg

SEQ ID NO: 4171941 - DNA, 15 bp, Homo sapiens
gtctgccacagagag

SEQ ID NO: 4171942 - DNA, 18 bp, Homo sapiens
gtctgccaccatcctgct

SEQ ID NO: 4171943 - DNA, 23 bp, Homo sapiens
gtctgccttaggctgctgggaga

SEQ ID NO: 4171944 - DNA, 15 bp, Homo sapiens
gtctgcgtgactatt

SEQ ID NO: 4171945 - DNA, 12 bp, Homo sapiens
gtctgctgcccc

SEQ ID NO: 4171946 - DNA, 19 bp, Homo sapiens
gtctgctttcactgtgact

SEQ ID NO: 4171947 - DNA, 20 bp, Homo sapiens
gtctggacgccgagggcagc

SEQ ID NO: 4171948 - DNA, 16 bp, Homo sapiens
gtctggagaaggtatt

SEQ ID NO: 4171949 - DNA, 19 bp, Homo sapiens
gtctggcagtttatattta

SEQ ID NO: 4171950 - DNA, 12 bp, Homo sapiens
gtctggctgtgt

SEQ ID NO: 4171951 - DNA, 17 bp, Homo sapiens
gtctgggaaattctata

SEQ ID NO: 4171952 - DNA, 13 bp, Homo sapiens
gtctgggagagcc

SEQ ID NO: 4171953 - DNA, 15 bp, Homo sapiens
gtctgggagagcctg

SEQ ID NO: 4171954 - DNA, 23 bp, Homo sapiens
gtctggtgtagctcctctgctgc

SEQ ID NO: 4171955 - DNA, 18 bp, Homo sapiens
gtctggttttaacaattt

SEQ ID NO: 4171956 - DNA, 21 bp, Homo sapiens
gtctggttttaacaatttcct

SEQ ID NO: 4171957 - DNA, 22 bp, Homo sapiens
gtctgtagtgtcactcaaggcg

SEQ ID NO: 4171958 - DNA, 14 bp, Homo sapiens
gtctgtctgtctgt

SEQ ID NO: 4171959 - DNA, 16 bp, Homo sapiens
gtctgtctgtctgtcc

SEQ ID NO: 4171960 - DNA, 13 bp, Homo sapiens
gtctgtggatttt

SEQ ID NO: 4171961 - DNA, 13 bp, Homo sapiens
gtctgtgggagct

SEQ ID NO: 4171962 - DNA, 19 bp, Homo sapiens
gtctgtgggagctcagctc

SEQ ID NO: 4171963 - DNA, 13 bp, Homo sapiens
gtctgtgtatgtg

SEQ ID NO: 4171964 - DNA, 15 bp, Homo sapiens
gtctgtgtgctgtaa

SEQ ID NO: 4171965 - DNA, 15 bp, Homo sapiens
gtcttatagaaagca

SEQ ID NO: 4171966 - DNA, 16 bp, Homo sapiens
gtcttgctttgctgtc

SEQ ID NO: 4171967 - DNA, 22 bp, Homo sapiens
gtcttggtggatgggccctgca

SEQ ID NO: 4171968 - DNA, 13 bp, Homo sapiens
gtcttgtacactt

SEQ ID NO: 4171969 - DNA, 21 bp, Homo sapiens
gtgaaagagagtaccatgctg

SEQ ID NO: 4171970 - DNA, 21 bp, Homo sapiens
gtgaaagtcagatgcccagag

SEQ ID NO: 4171971 - DNA, 21 bp, Homo sapiens
gtgaaatttattagttaatat

SEQ ID NO: 4171972 - DNA, 22 bp, Homo sapiens
gtgaacagagagaaccaggagg

SEQ ID NO: 4171973 - DNA, 12 bp, Homo sapiens
gtgaacctggag

SEQ ID NO: 4171974 - DNA, 13 bp, Homo sapiens
gtgaactggaaga

SEQ ID NO: 4171975 - DNA, 17 bp, Homo sapiens
gtgaactggaagaaagc

SEQ ID NO: 4171976 - DNA, 18 bp, Homo sapiens
gtgaactggaagaaagca

SEQ ID NO: 4171977 - DNA, 15 bp, Homo sapiens
gtgaatgtgtgtatg

SEQ ID NO: 4171978 - DNA, 20 bp, Homo sapiens
gtgaattgcctgcagagaga

SEQ ID NO: 4171979 - DNA, 14 bp, Homo sapiens
gtgacaagtagggc

SEQ ID NO: 4171980 - DNA, 21 bp, Homo sapiens
gtgacacaaacacacacaaaa

SEQ ID NO: 4171981 - DNA, 16 bp, Homo sapiens
gtgacacaaattgaag

SEQ ID NO: 4171982 - DNA, 21 bp, Homo sapiens
gtgacagacattttcaataat

SEQ ID NO: 4171983 - DNA, 13 bp, Homo sapiens
gtgacccatctgt

SEQ ID NO: 4171984 - DNA, 16 bp, Homo sapiens
gtgacccatctgtagt

SEQ ID NO: 4171985 - DNA, 19 bp, Homo sapiens
gtgacggtcccacactggt

SEQ ID NO: 4171986 - DNA, 24 bp, Homo sapiens
gtgacggtcctttaggcagcctgc

SEQ ID NO: 4171987 - DNA, 20 bp, Homo sapiens
gtgactattttttaataaaa

SEQ ID NO: 4171988 - DNA, 21 bp, Homo sapiens
gtgactgatgttacatcacag

SEQ ID NO: 4171989 - DNA, 14 bp, Homo sapiens
gtgagaccacctct

SEQ ID NO: 4171990 - DNA, 13 bp, Homo sapiens
gtgagcatgtttg

SEQ ID NO: 4171991 - DNA, 19 bp, Homo sapiens
gtgagcatgtttggaaggg

SEQ ID NO: 4171992 - DNA, 23 bp, Homo sapiens
gtgaggcccagcctgtcctggta

SEQ ID NO: 4171993 - DNA, 13 bp, Homo sapiens
gtgaggcctggcc

SEQ ID NO: 4171994 - DNA, 16 bp, Homo sapiens
gtgaggcctggccagg

SEQ ID NO: 4171995 - DNA, 22 bp, Homo sapiens
gtgaggctctattgagccaaga

SEQ ID NO: 4171996 - DNA, 16 bp, Homo sapiens
gtgaggggagatgctg

SEQ ID NO: 4171997 - DNA, 17 bp, Homo sapiens
gtgaggttgtgctgcct

SEQ ID NO: 4171998 - DNA, 13 bp, Homo sapiens
gtgatagagcaga

SEQ ID NO: 4171999 - DNA, 17 bp, Homo sapiens
gtgatctcaaatccact

SEQ ID NO: 4172000 - DNA, 14 bp, Homo sapiens
gtgatgaactttct

SEQ ID NO: 4172001 - DNA, 14 bp, Homo sapiens
gtgatggagtgtgc

SEQ ID NO: 4172002 - DNA, 21 bp, Homo sapiens
gtgatttagaactgtatgtca

SEQ ID NO: 4172003 - DNA, 23 bp, Homo sapiens
gtgatttagaactgtatgtcaga

SEQ ID NO: 4172004 - DNA, 19 bp, Homo sapiens
gtgatttcagagagggcag

SEQ ID NO: 4172005 - DNA, 20 bp, Homo sapiens
gtgatttggaagagaggcac

SEQ ID NO: 4172006 - DNA, 21 bp, Homo sapiens
gtgcaaaaataaaaggaaaac

SEQ ID NO: 4172007 - DNA, 19 bp, Homo sapiens
gtgcaagagactctggcct

SEQ ID NO: 4172008 - DNA, 22 bp, Homo sapiens
gtgcaatgtaaatattttaaag

SEQ ID NO: 4172009 - DNA, 21 bp, Homo sapiens
gtgcacagcgcgggcggaggc

SEQ ID NO: 4172010 - DNA, 20 bp, Homo sapiens
gtgcaccttaccaactttct

SEQ ID NO: 4172011 - DNA, 17 bp, Homo sapiens
gtgcagcttctgtcctg

SEQ ID NO: 4172012 - DNA, 19 bp, Homo sapiens
gtgcagttgacagcaggtg

SEQ ID NO: 4172013 - DNA, 17 bp, Homo sapiens
gtgcatatatactacat

SEQ ID NO: 4172014 - DNA, 19 bp, Homo sapiens
gtgcatccacgcacacatg

SEQ ID NO: 4172015 - DNA, 19 bp, Homo sapiens
gtgcatgaacagggtccct

SEQ ID NO: 4172016 - DNA, 22 bp, Homo sapiens
gtgccacccacctttgccacaa

SEQ ID NO: 4172017 - DNA, 19 bp, Homo sapiens
gtgccactgcgggagctct

SEQ ID NO: 4172018 - DNA, 18 bp, Homo sapiens
gtgccaggactccccagg

SEQ ID NO: 4172019 - DNA, 21 bp, Homo sapiens
gtgccaggactccccaggcca

SEQ ID NO: 4172020 - DNA, 23 bp, Homo sapiens
gtgccaggactccccaggccagg

SEQ ID NO: 4172021 - DNA, 18 bp, Homo sapiens
gtgccagtcttgtgtctg

SEQ ID NO: 4172022 - DNA, 14 bp, Homo sapiens
gtgcccagctaatt

SEQ ID NO: 4172023 - DNA, 14 bp, Homo sapiens
gtgcccccacccag

SEQ ID NO: 4172024 - DNA, 21 bp, Homo sapiens
gtgccctctgctccccagtgc

SEQ ID NO: 4172025 - DNA, 12 bp, Homo sapiens
gtgccctgcctt

SEQ ID NO: 4172026 - DNA, 17 bp, Homo sapiens
gtgcctagactgttact

SEQ ID NO: 4172027 - DNA, 15 bp, Homo sapiens
ggttggggcaaagcc

SEQ ID NO: 4172028 - DNA, 15 bp, Homo sapiens
ggttggtgggctggc

SEQ ID NO: 4172029 - DNA, 13 bp, Homo sapiens
ggttgtgaggcct

SEQ ID NO: 4172030 - DNA, 16 bp, Homo sapiens
ggttgtgaggcctggc

SEQ ID NO: 4172031 - DNA, 22 bp, Homo sapiens
ggttgtgaggcctggccaggca

SEQ ID NO: 4172032 - DNA, 16 bp, Homo sapiens
ggtttacatgaacaca

SEQ ID NO: 4172033 - DNA, 19 bp, Homo sapiens
ggtttcaccatgttggcca

SEQ ID NO: 4172034 - DNA, 15 bp, Homo sapiens
ggtttgtattttaaa

SEQ ID NO: 4172035 - DNA, 11 bp, Homo sapiens
ggtttgtcaac

SEQ ID NO: 4172036 - DNA, 13 bp, Homo sapiens
ggtttgtcaacaa

SEQ ID NO: 4172037 - DNA, 20 bp, Homo sapiens
ggtttgtcaacaaaaagaca

SEQ ID NO: 4172038 - DNA, 14 bp, Homo sapiens
ggtttgtgtggatg

SEQ ID NO: 4172039 - DNA, 18 bp, Homo sapiens
gtaaaacatttattttga

SEQ ID NO: 4172040 - DNA, 19 bp, Homo sapiens
gtaaaagcaaaaaagaaaa

SEQ ID NO: 4172041 - DNA, 15 bp, Homo sapiens
gtaaaagttatatct

SEQ ID NO: 4172042 - DNA, 15 bp, Homo sapiens
gtaaaattgtataga

SEQ ID NO: 4172043 - DNA, 17 bp, Homo sapiens
gtaaacataggtataat

SEQ ID NO: 4172044 - DNA, 15 bp, Homo sapiens
gtaaactcaaaactt

SEQ ID NO: 4172045 - DNA, 16 bp, Homo sapiens
gtaaactgtggatgat

SEQ ID NO: 4172046 - DNA, 12 bp, Homo sapiens
gtaaagccatgc

SEQ ID NO: 4172047 - DNA, 18 bp, Homo sapiens
gtaaagctgctagggccc

SEQ ID NO: 4172048 - DNA, 22 bp, Homo sapiens
gtaaatgcctcttaaattatat

SEQ ID NO: 4172049 - DNA, 12 bp, Homo sapiens
gtaacatgttta

SEQ ID NO: 4172050 - DNA, 15 bp, Homo sapiens
gtaactattgaattg

SEQ ID NO: 4172051 - DNA, 22 bp, Homo sapiens
gtaactctatagttattgtttt

SEQ ID NO: 4172052 - DNA, 17 bp, Homo sapiens
gtaacttctttgaagtt

SEQ ID NO: 4172053 - DNA, 19 bp, Homo sapiens
gtaacttctttgaagttat

SEQ ID NO: 4172054 - DNA, 14 bp, Homo sapiens
gtaagaagaaagca

SEQ ID NO: 4172055 - DNA, 15 bp, Homo sapiens
gtaagcattctgagc

SEQ ID NO: 4172056 - DNA, 13 bp, Homo sapiens
gtaagctctggct

SEQ ID NO: 4172057 - DNA, 12 bp, Homo sapiens
gtaagtcttttt

SEQ ID NO: 4172058 - DNA, 20 bp, Homo sapiens
gtaagtggcaggaccctgtc

SEQ ID NO: 4172059 - DNA, 16 bp, Homo sapiens
gtaatatattgctgct

SEQ ID NO: 4172060 - DNA, 18 bp, Homo sapiens
gtaatatattgctgctgg

SEQ ID NO: 4172061 - DNA, 20 bp, Homo sapiens
gtaatatattgctgctggta

SEQ ID NO: 4172062 - DNA, 15 bp, Homo sapiens
gtaatatgctctcat

SEQ ID NO: 4172063 - DNA, 16 bp, Homo sapiens
gtaatcccagcacttt

SEQ ID NO: 4172064 - DNA, 16 bp, Homo sapiens
gtaatgcttcaatcag

SEQ ID NO: 4172065 - DNA, 16 bp, Homo sapiens
gtaatgtaaatacatc

SEQ ID NO: 4172066 - DNA, 18 bp, Homo sapiens
gtaatttagaaatcattt

SEQ ID NO: 4172067 - DNA, 21 bp, Homo sapiens
gtaatttattgtctgtctaca

SEQ ID NO: 4172068 - DNA, 20 bp, Homo sapiens
gtaatttctgtgtattttga

SEQ ID NO: 4172069 - DNA, 15 bp, Homo sapiens
gtaatttgtatctga

SEQ ID NO: 4172070 - DNA, 17 bp, Homo sapiens
gtaatttttttgtaaag

SEQ ID NO: 4172071 - DNA, 12 bp, Homo sapiens
gtacaaaaacaa

SEQ ID NO: 4172072 - DNA, 15 bp, Homo sapiens
gtacaagaagcattt

SEQ ID NO: 4172073 - DNA, 23 bp, Homo sapiens
gtacactgttcccaatatgtagc

SEQ ID NO: 4172074 - DNA, 19 bp, Homo sapiens
gtacagacgtctcaagact

SEQ ID NO: 4172075 - DNA, 15 bp, Homo sapiens
gtacagcagggtctt

SEQ ID NO: 4172076 - DNA, 20 bp, Homo sapiens
gtacagcagggtcttgctgt

SEQ ID NO: 4172077 - DNA, 12 bp, Homo sapiens
gtacatgtacat

SEQ ID NO: 4172078 - DNA, 16 bp, Homo sapiens
gtacatttccctgtgc

SEQ ID NO: 4172079 - DNA, 18 bp, Homo sapiens
gtacatttccctgtgctg

SEQ ID NO: 4172080 - DNA, 17 bp, Homo sapiens
gtaccagatgcagctca

SEQ ID NO: 4172081 - DNA, 16 bp, Homo sapiens
gtaccagcaatatgta

SEQ ID NO: 4172082 - DNA, 12 bp, Homo sapiens
gtaccagccagg

SEQ ID NO: 4172083 - DNA, 21 bp, Homo sapiens
gtaccatgctggcggcgcaga

SEQ ID NO: 4172084 - DNA, 16 bp, Homo sapiens
gtacctatgtgacaga

SEQ ID NO: 4172085 - DNA, 21 bp, Homo sapiens
gtaccttgctttagagtagat

SEQ ID NO: 4172086 - DNA, 14 bp, Homo sapiens
gtactatctgtgaa

SEQ ID NO: 4172087 - DNA, 22 bp, Homo sapiens
gtactccagcaggtaggggcac

SEQ ID NO: 4172088 - DNA, 18 bp, Homo sapiens
gtactctaatcagtcctt

SEQ ID NO: 4172089 - DNA, 15 bp, Homo sapiens
gtacttaataaattc

SEQ ID NO: 4172090 - DNA, 13 bp, Homo sapiens
gtagaaagaaaat

SEQ ID NO: 4172091 - DNA, 19 bp, Homo sapiens
gtagacacgctcttctatt

SEQ ID NO: 4172092 - DNA, 12 bp, Homo sapiens
gtagagatgtgt

SEQ ID NO: 4172093 - DNA, 14 bp, Homo sapiens
gtagaggttttgtt

SEQ ID NO: 4172094 - DNA, 16 bp, Homo sapiens
gtagagttcactgttg

SEQ ID NO: 4172095 - DNA, 15 bp, Homo sapiens
gtagatctgcttctt

SEQ ID NO: 4172096 - DNA, 18 bp, Homo sapiens
gtagcacatgtctgtcct

SEQ ID NO: 4172097 - DNA, 15 bp, Homo sapiens
gtagccacaccagga

SEQ ID NO: 4172098 - DNA, 16 bp, Homo sapiens
gtagccacaccaggat

SEQ ID NO: 4172099 - DNA, 15 bp, Homo sapiens
gtagccttgcccgga

SEQ ID NO: 4172100 - DNA, 23 bp, Homo sapiens
gtagccttgcccggattctggga

SEQ ID NO: 4172101 - DNA, 15 bp, Homo sapiens
gtagcgagctgctct

SEQ ID NO: 4172102 - DNA, 17 bp, Homo sapiens
gtagctaaacattgtga

SEQ ID NO: 4172103 - DNA, 22 bp, Homo sapiens
gtagctatttgtttacatgcag

SEQ ID NO: 4172104 - DNA, 14 bp, Homo sapiens
gtagctttcctggt

SEQ ID NO: 4172105 - DNA, 15 bp, Homo sapiens
gtaggaacccagctc

SEQ ID NO: 4172106 - DNA, 19 bp, Homo sapiens
gtaggactttcctaaatgt

SEQ ID NO: 4172107 - DNA, 20 bp, Homo sapiens
gtaggtattaaagatgtgtt

SEQ ID NO: 4172108 - DNA, 17 bp, Homo sapiens
gtagtgtgttgtagtcg

SEQ ID NO: 4172109 - DNA, 20 bp, Homo sapiens
gtagttaggaaataaaacct

SEQ ID NO: 4172110 - DNA, 12 bp, Homo sapiens
gtatacaggtgg

SEQ ID NO: 4172111 - DNA, 14 bp, Homo sapiens
gtatagacagcact

SEQ ID NO: 4172112 - DNA, 22 bp, Homo sapiens
gtatagacagcacttggctcct

SEQ ID NO: 4172113 - DNA, 20 bp, Homo sapiens
gtatagcatgcatctgttta

SEQ ID NO: 4172114 - DNA, 13 bp, Homo sapiens
gtatagtgtaaaa

SEQ ID NO: 4172115 - DNA, 15 bp, Homo sapiens
gtatagtgtaaaata

SEQ ID NO: 4172116 - DNA, 16 bp, Homo sapiens
gtatagtgtaaaataa

SEQ ID NO: 4172117 - DNA, 19 bp, Homo sapiens
gtatagttaggatagcatt

SEQ ID NO: 4172118 - DNA, 14 bp, Homo sapiens
gtatatagatgtgc

SEQ ID NO: 4172119 - DNA, 22 bp, Homo sapiens
gtatatatctgcttcagtggag

SEQ ID NO: 4172120 - DNA, 21 bp, Homo sapiens
gtatatgcatttttaatacat

SEQ ID NO: 4172121 - DNA, 16 bp, Homo sapiens
gtatatgtcatttatt

SEQ ID NO: 4172122 - DNA, 13 bp, Homo sapiens
gtatatttatagt

SEQ ID NO: 4172123 - DNA, 22 bp, Homo sapiens
gtatatttatagtcacaagagc

SEQ ID NO: 4172124 - DNA, 13 bp, Homo sapiens
gtatcatcagtgt

SEQ ID NO: 4172125 - DNA, 20 bp, Homo sapiens
gtatcccccccctgtatagt

SEQ ID NO: 4172126 - DNA, 19 bp, Homo sapiens
gtatccgactctaagctgt

SEQ ID NO: 4172127 - DNA, 21 bp, Homo sapiens
gtatccgactctaagctgtgt

SEQ ID NO: 4172128 - DNA, 22 bp, Homo sapiens
gtatccgactctaagctgtgtg

SEQ ID NO: 4172129 - DNA, 13 bp, Homo sapiens
gtatctccaggat

SEQ ID NO: 4172130 - DNA, 14 bp, Homo sapiens
gtatctccaggatt

SEQ ID NO: 4172131 - DNA, 18 bp, Homo sapiens
gtatctgggtaagaagaa

SEQ ID NO: 4172132 - DNA, 23 bp, Homo sapiens
gtatctgggtaagaagaaagcaa

SEQ ID NO: 4172133 - DNA, 16 bp, Homo sapiens
gtatcttactctgtcc

SEQ ID NO: 4172134 - DNA, 15 bp, Homo sapiens
gtatgaacttgagga

SEQ ID NO: 4172135 - DNA, 14 bp, Homo sapiens
gtatgagctgaggg

SEQ ID NO: 4172136 - DNA, 17 bp, Homo sapiens
gtatgtatgaaggccac

SEQ ID NO: 4172137 - DNA, 22 bp, Homo sapiens
gtatgtggcatggcagaatgaa

SEQ ID NO: 4172138 - DNA, 13 bp, Homo sapiens
gtatgtgtgggta

SEQ ID NO: 4172139 - DNA, 18 bp, Homo sapiens
gtattccatgggatgtta

SEQ ID NO: 4172140 - DNA, 21 bp, Homo sapiens
gtattggggtcttttggctct

SEQ ID NO: 4172141 - DNA, 15 bp, Homo sapiens
gtatttatatttgga

SEQ ID NO: 4172142 - DNA, 16 bp, Homo sapiens
gtatttatatttggaa

SEQ ID NO: 4172143 - DNA, 21 bp, Homo sapiens
gtatttatatttggaaagaga

SEQ ID NO: 4172144 - DNA, 12 bp, Homo sapiens
gtatttcctgct

SEQ ID NO: 4172145 - DNA, 20 bp, Homo sapiens
gtatttcttttttttaataa

SEQ ID NO: 4172146 - DNA, 17 bp, Homo sapiens
gtatttgttaatttaga

SEQ ID NO: 4172147 - DNA, 16 bp, Homo sapiens
gtattttcattttaat

SEQ ID NO: 4172148 - DNA, 22 bp, Homo sapiens
gtcaaaccgcactcacccatgt

SEQ ID NO: 4172149 - DNA, 12 bp, Homo sapiens
gtcaaagaaatg

SEQ ID NO: 4172150 - DNA, 17 bp, Homo sapiens
gtcaacaaaaagacatg

SEQ ID NO: 4172151 - DNA, 14 bp, Homo sapiens
gtcaacacaaagac

SEQ ID NO: 4172152 - DNA, 14 bp, Homo sapiens
gtcaacagttttcc

SEQ ID NO: 4172153 - DNA, 14 bp, Homo sapiens
gtcaagactgatca

SEQ ID NO: 4172154 - DNA, 18 bp, Homo sapiens
gtcaagcctgcagcgagc

SEQ ID NO: 4172155 - DNA, 19 bp, Homo sapiens
gtcaaggagatgagcgtcc

SEQ ID NO: 4172156 - DNA, 12 bp, Homo sapiens
gtcaccagcctg

SEQ ID NO: 4172157 - DNA, 15 bp, Homo sapiens
gtcaccctgcagagc

SEQ ID NO: 4172158 - DNA, 15 bp, Homo sapiens
gtcactggcagagca

SEQ ID NO: 4172159 - DNA, 20 bp, Homo sapiens
gtcactggcagagcacagcc

SEQ ID NO: 4172160 - DNA, 22 bp, Homo sapiens
gtcactggcagagcacagccca

SEQ ID NO: 4172161 - DNA, 19 bp, Homo sapiens
gtcactgtttattttttta

SEQ ID NO: 4172162 - DNA, 18 bp, Homo sapiens
gtcagacatccatgtttg

SEQ ID NO: 4172163 - DNA, 24 bp, Homo sapiens
gtcagactgctgggactggccagg

SEQ ID NO: 4172164 - DNA, 18 bp, Homo sapiens
gtcagatgggaagacatg

SEQ ID NO: 4172165 - DNA, 15 bp, Homo sapiens
gtcagccagggccag

SEQ ID NO: 4172166 - DNA, 16 bp, Homo sapiens
gtcagccagggccagg

SEQ ID NO: 4172167 - DNA, 18 bp, Homo sapiens
gtcagcccttggcttctg

SEQ ID NO: 4172168 - DNA, 15 bp, Homo sapiens
gggctgagccctggc

SEQ ID NO: 4172169 - DNA, 20 bp, Homo sapiens
gggctgccagcctgagcgga

SEQ ID NO: 4172170 - DNA, 22 bp, Homo sapiens
gggctgcccctgtaggttgctt

SEQ ID NO: 4172171 - DNA, 22 bp, Homo sapiens
gggctgcgaaaacgttgacccc

SEQ ID NO: 4172172 - DNA, 16 bp, Homo sapiens
gggctgctgcactgcc

SEQ ID NO: 4172173 - DNA, 13 bp, Homo sapiens
gggctgctgtggc

SEQ ID NO: 4172174 - DNA, 12 bp, Homo sapiens
gggctgggccca

SEQ ID NO: 4172175 - DNA, 17 bp, Homo sapiens
gggcttatcatcagccc

SEQ ID NO: 4172176 - DNA, 14 bp, Homo sapiens
gggcttggtggcca

SEQ ID NO: 4172177 - DNA, 22 bp, Homo sapiens
gggcttggtggccaagcctggc

SEQ ID NO: 4172178 - DNA, 23 bp, Homo sapiens
gggcttggtggccaagcctggcc

SEQ ID NO: 4172179 - DNA, 14 bp, Homo sapiens
ggggaagggtggtc

SEQ ID NO: 4172180 - DNA, 21 bp, Homo sapiens
ggggacccagctcctctgagc

SEQ ID NO: 4172181 - DNA, 18 bp, Homo sapiens
ggggacgcgcacacacac

SEQ ID NO: 4172182 - DNA, 11 bp, Homo sapiens
ggggaggaagg

SEQ ID NO: 4172183 - DNA, 16 bp, Homo sapiens
ggggagggggacgcgc

SEQ ID NO: 4172184 - DNA, 15 bp, Homo sapiens
ggggcaaagcctcct

SEQ ID NO: 4172185 - DNA, 23 bp, Homo sapiens
ggggccaggcaggggtgggagag

SEQ ID NO: 4172186 - DNA, 18 bp, Homo sapiens
ggggccatgggtgcatgg

SEQ ID NO: 4172187 - DNA, 13 bp, Homo sapiens
ggggcgtggctgg

SEQ ID NO: 4172188 - DNA, 16 bp, Homo sapiens
ggggcgtggctggcct

SEQ ID NO: 4172189 - DNA, 19 bp, Homo sapiens
ggggcgtggctggcctttc

SEQ ID NO: 4172190 - DNA, 11 bp, Homo sapiens
ggggctcctgg

SEQ ID NO: 4172191 - DNA, 21 bp, Homo sapiens
ggggctcctggaaaggctcag

SEQ ID NO: 4172192 - DNA, 14 bp, Homo sapiens
ggggctggtccttc

SEQ ID NO: 4172193 - DNA, 14 bp, Homo sapiens
ggggcttgccctgg

SEQ ID NO: 4172194 - DNA, 15 bp, Homo sapiens
gggggcgtggctggc

SEQ ID NO: 4172195 - DNA, 18 bp, Homo sapiens
gggggcgtggctggcctt

SEQ ID NO: 4172196 - DNA, 20 bp, Homo sapiens
gggggcgtggctggcctttc

SEQ ID NO: 4172197 - DNA, 18 bp, Homo sapiens
gggggtttttactccagt

SEQ ID NO: 4172198 - DNA, 22 bp, Homo sapiens
ggggtatttaccacagcagctg

SEQ ID NO: 4172199 - DNA, 22 bp, Homo sapiens
ggggtgcatcccccagcactga

SEQ ID NO: 4172200 - DNA, 19 bp, Homo sapiens
ggggttaacttggtcagag

SEQ ID NO: 4172201 - DNA, 17 bp, Homo sapiens
ggggttggggcaaagcc

SEQ ID NO: 4172202 - DNA, 19 bp, Homo sapiens
gggtacatttccctgtgct

SEQ ID NO: 4172203 - DNA, 16 bp, Homo sapiens
gggtctaaagagaaca

SEQ ID NO: 4172204 - DNA, 20 bp, Homo sapiens
gggtctgccaccatcctgct

SEQ ID NO: 4172205 - DNA, 15 bp, Homo sapiens
gggtctggctgagct

SEQ ID NO: 4172206 - DNA, 16 bp, Homo sapiens
gggtgatttcagagag

SEQ ID NO: 4172207 - DNA, 14 bp, Homo sapiens
gggtgggagagccc

SEQ ID NO: 4172208 - DNA, 16 bp, Homo sapiens
gggtgtgcctgccctg

SEQ ID NO: 4172209 - DNA, 21 bp, Homo sapiens
gggttaacttggtcagagcca

SEQ ID NO: 4172210 - DNA, 14 bp, Homo sapiens
gggttgcccagcct

SEQ ID NO: 4172211 - DNA, 15 bp, Homo sapiens
gggttgcccagcctg

SEQ ID NO: 4172212 - DNA, 17 bp, Homo sapiens
gggttgcccagcctgga

SEQ ID NO: 4172213 - DNA, 20 bp, Homo sapiens
gggttgcgggggagctggaa

SEQ ID NO: 4172214 - DNA, 21 bp, Homo sapiens
gggttgcgggggagctggaaa

SEQ ID NO: 4172215 - DNA, 17 bp, Homo sapiens
gggttggggcaaagcct

SEQ ID NO: 4172216 - DNA, 21 bp, Homo sapiens
gggttgggttcatctgagcaa

SEQ ID NO: 4172217 - DNA, 20 bp, Homo sapiens
gggttggtgggctggcccag

SEQ ID NO: 4172218 - DNA, 21 bp, Homo sapiens
gggttgtgaggcctggccagg

SEQ ID NO: 4172219 - DNA, 20 bp, Homo sapiens
gggtttcaccgtgttagcca

SEQ ID NO: 4172220 - DNA, 20 bp, Homo sapiens
gggtttcgtcatgttggcca

SEQ ID NO: 4172221 - DNA, 23 bp, Homo sapiens
ggtaaaagtgtgagcagtgagtt

SEQ ID NO: 4172222 - DNA, 19 bp, Homo sapiens
ggtaaattgtaaacagcta

SEQ ID NO: 4172223 - DNA, 13 bp, Homo sapiens
ggtacagcagggt

SEQ ID NO: 4172224 - DNA, 22 bp, Homo sapiens
ggtaccagatgcagctcaagag

SEQ ID NO: 4172225 - DNA, 11 bp, Homo sapiens
ggtagagatgt

SEQ ID NO: 4172226 - DNA, 23 bp, Homo sapiens
ggtagagtttgaaggaggtgagg

SEQ ID NO: 4172227 - DNA, 18 bp, Homo sapiens
ggtagcccatcaaaatgt

SEQ ID NO: 4172228 - DNA, 12 bp, Homo sapiens
ggtaggaaaatt

SEQ ID NO: 4172229 - DNA, 16 bp, Homo sapiens
ggtatctccaggattg

SEQ ID NO: 4172230 - DNA, 19 bp, Homo sapiens
ggtatgaacttgaggacac

SEQ ID NO: 4172231 - DNA, 23 bp, Homo sapiens
ggtatgaacttgaggacacatgt

SEQ ID NO: 4172232 - DNA, 15 bp, Homo sapiens
ggtatgagctgaggg

SEQ ID NO: 4172233 - DNA, 16 bp, Homo sapiens
ggtatgagctgagggg

SEQ ID NO: 4172234 - DNA, 17 bp, Homo sapiens
ggtattaaagatgtgtt

SEQ ID NO: 4172235 - DNA, 18 bp, Homo sapiens
ggtattgcgaaacaactt

SEQ ID NO: 4172236 - DNA, 22 bp, Homo sapiens
ggtattttaggcagggatttga

SEQ ID NO: 4172237 - DNA, 22 bp, Homo sapiens
ggtcaacagttttcctatgctt

SEQ ID NO: 4172238 - DNA, 14 bp, Homo sapiens
ggtcaagactgtgg

SEQ ID NO: 4172239 - DNA, 17 bp, Homo sapiens
ggtcaagcctgcagcga

SEQ ID NO: 4172240 - DNA, 17 bp, Homo sapiens
ggtcacattcaggaaga

SEQ ID NO: 4172241 - DNA, 14 bp, Homo sapiens
ggtcactgggttct

SEQ ID NO: 4172242 - DNA, 21 bp, Homo sapiens
ggtcagaagaagatgctgtga

SEQ ID NO: 4172243 - DNA, 16 bp, Homo sapiens
ggtcagagtgccactg

SEQ ID NO: 4172244 - DNA, 17 bp, Homo sapiens
ggtcagagtgccactgc

SEQ ID NO: 4172245 - DNA, 16 bp, Homo sapiens
ggtccacccagcaaag

SEQ ID NO: 4172246 - DNA, 22 bp, Homo sapiens
ggtccaggccagtgggcctggt

SEQ ID NO: 4172247 - DNA, 20 bp, Homo sapiens
ggtccaggtcaccagcctga

SEQ ID NO: 4172248 - DNA, 21 bp, Homo sapiens
ggtcccgtgcagcttctgtcc

SEQ ID NO: 4172249 - DNA, 23 bp, Homo sapiens
ggtcctccatttcaactccagaa

SEQ ID NO: 4172250 - DNA, 19 bp, Homo sapiens
ggtcctgcaatctccaggg

SEQ ID NO: 4172251 - DNA, 13 bp, Homo sapiens
ggtcctggcttct

SEQ ID NO: 4172252 - DNA, 15 bp, Homo sapiens
ggtccttccaggccc

SEQ ID NO: 4172253 - DNA, 20 bp, Homo sapiens
ggtccttggtgtgaccctct

SEQ ID NO: 4172254 - DNA, 16 bp, Homo sapiens
ggtcctttaggcagcc

SEQ ID NO: 4172255 - DNA, 23 bp, Homo sapiens
ggtcctttctggaagtttctggt

SEQ ID NO: 4172256 - DNA, 17 bp, Homo sapiens
ggtctgagcaccccctc

SEQ ID NO: 4172257 - DNA, 21 bp, Homo sapiens
ggtgaaaacagcccaggtcct

SEQ ID NO: 4172258 - DNA, 16 bp, Homo sapiens
ggtgaataaagcaggg

SEQ ID NO: 4172259 - DNA, 17 bp, Homo sapiens
ggtgacatgtgcctgta

SEQ ID NO: 4172260 - DNA, 22 bp, Homo sapiens
ggtgacggtcctttaggcagcc

SEQ ID NO: 4172261 - DNA, 23 bp, Homo sapiens
ggtgactgcgatcttcagagcag

SEQ ID NO: 4172262 - DNA, 15 bp, Homo sapiens
ggtgagaccacctct

SEQ ID NO: 4172263 - DNA, 13 bp, Homo sapiens
ggtgagggatgtg

SEQ ID NO: 4172264 - DNA, 20 bp, Homo sapiens
ggtgcagttgacagcaggtg

SEQ ID NO: 4172265 - DNA, 18 bp, Homo sapiens
ggtgcagttttccaggaa

SEQ ID NO: 4172266 - DNA, 12 bp, Homo sapiens
ggtgccagaggt

SEQ ID NO: 4172267 - DNA, 22 bp, Homo sapiens
ggtgccatttctgaactgttac

SEQ ID NO: 4172268 - DNA, 18 bp, Homo sapiens
ggtgcctcagagcaggct

SEQ ID NO: 4172269 - DNA, 19 bp, Homo sapiens
ggtgctataggctggagaa

SEQ ID NO: 4172270 - DNA, 22 bp, Homo sapiens
ggtgctcacgactcttcctgca

SEQ ID NO: 4172271 - DNA, 13 bp, Homo sapiens
ggtgctggaggat

SEQ ID NO: 4172272 - DNA, 16 bp, Homo sapiens
ggtggaaggcccgagg

SEQ ID NO: 4172273 - DNA, 14 bp, Homo sapiens
ggtggagtcaggaa

SEQ ID NO: 4172274 - DNA, 16 bp, Homo sapiens
ggtggatcacctgagg

SEQ ID NO: 4172275 - DNA, 18 bp, Homo sapiens
ggtggcagccctgtaggg

SEQ ID NO: 4172276 - DNA, 11 bp, Homo sapiens
ggtggcaggat

SEQ ID NO: 4172277 - DNA, 16 bp, Homo sapiens
ggtggccaagcctggc

SEQ ID NO: 4172278 - DNA, 17 bp, Homo sapiens
ggtggccaagcctggcc

SEQ ID NO: 4172279 - DNA, 16 bp, Homo sapiens
ggtggctctggacagc

SEQ ID NO: 4172280 - DNA, 23 bp, Homo sapiens
ggtggcttttgcggttcaggaaa

SEQ ID NO: 4172281 - DNA, 12 bp, Homo sapiens
ggtgggaagcaa

SEQ ID NO: 4172282 - DNA, 13 bp, Homo sapiens
ggtgggagagcca

SEQ ID NO: 4172283 - DNA, 16 bp, Homo sapiens
ggtgggcagaggctgg

SEQ ID NO: 4172284 - DNA, 15 bp, Homo sapiens
ggtgggctgagccct

SEQ ID NO: 4172285 - DNA, 13 bp, Homo sapiens
ggtggggaatgtt

SEQ ID NO: 4172286 - DNA, 13 bp, Homo sapiens
ggtggggacaggt

SEQ ID NO: 4172287 - DNA, 20 bp, Homo sapiens
ggtggggggatcacaaggtc

SEQ ID NO: 4172288 - DNA, 16 bp, Homo sapiens
ggtgtcaccagcctgt

SEQ ID NO: 4172289 - DNA, 17 bp, Homo sapiens
ggtgtcaccctgcagag

SEQ ID NO: 4172290 - DNA, 13 bp, Homo sapiens
ggtgtgcctgcag

SEQ ID NO: 4172291 - DNA, 19 bp, Homo sapiens
ggtgtgcctgccctggagg

SEQ ID NO: 4172292 - DNA, 22 bp, Homo sapiens
ggtgtggtgtttgtaggctgtg

SEQ ID NO: 4172293 - DNA, 18 bp, Homo sapiens
ggtgtgtggagatgcaga

SEQ ID NO: 4172294 - DNA, 14 bp, Homo sapiens
ggtgtgtgtagcca

SEQ ID NO: 4172295 - DNA, 19 bp, Homo sapiens
ggttaggtttgtcaacaca

SEQ ID NO: 4172296 - DNA, 14 bp, Homo sapiens
ggttcaccttgccg

SEQ ID NO: 4172297 - DNA, 22 bp, Homo sapiens
ggttcaccttgccgagagaggc

SEQ ID NO: 4172298 - DNA, 15 bp, Homo sapiens
ggttcatctgagcaa

SEQ ID NO: 4172299 - DNA, 15 bp, Homo sapiens
ggttctttggaagga

SEQ ID NO: 4172300 - DNA, 17 bp, Homo sapiens
ggttctttggaaggagt

SEQ ID NO: 4172301 - DNA, 18 bp, Homo sapiens
ggttgaggggctcctgga

SEQ ID NO: 4172302 - DNA, 19 bp, Homo sapiens
ggttgaggggctcctggaa

SEQ ID NO: 4172303 - DNA, 14 bp, Homo sapiens
ggttgatcacactc

SEQ ID NO: 4172304 - DNA, 17 bp, Homo sapiens
ggttgccaatgtctgat

SEQ ID NO: 4172305 - DNA, 15 bp, Homo sapiens
ggttgcccagcctgg

SEQ ID NO: 4172306 - DNA, 19 bp, Homo sapiens
ggttgcttctggctcctcc

SEQ ID NO: 4172307 - DNA, 22 bp, Homo sapiens
ggcctggaccgcttcccagagg

SEQ ID NO: 4172308 - DNA, 13 bp, Homo sapiens
ggcctggccaggc

SEQ ID NO: 4172309 - DNA, 22 bp, Homo sapiens
ggcctggtagcacatgtctgtc

SEQ ID NO: 4172310 - DNA, 19 bp, Homo sapiens
ggccttagtacggctgctg

SEQ ID NO: 4172311 - DNA, 20 bp, Homo sapiens
ggccttagtacggctgctgc

SEQ ID NO: 4172312 - DNA, 18 bp, Homo sapiens
ggccttctcagcctacag

SEQ ID NO: 4172313 - DNA, 20 bp, Homo sapiens
ggcctttcaggtccaggcca

SEQ ID NO: 4172314 - DNA, 11 bp, Homo sapiens
ggcgaataaat

SEQ ID NO: 4172315 - DNA, 12 bp, Homo sapiens
ggcgaataaatg

SEQ ID NO: 4172316 - DNA, 15 bp, Homo sapiens
ggcgaataaatgttc

SEQ ID NO: 4172317 - DNA, 15 bp, Homo sapiens
ggcgagtgccaggac

SEQ ID NO: 4172318 - DNA, 16 bp, Homo sapiens
ggcgagtgccaggact

SEQ ID NO: 4172319 - DNA, 17 bp, Homo sapiens
ggcgatcaagtccagag

SEQ ID NO: 4172320 - DNA, 18 bp, Homo sapiens
ggcgatcaagtccagagc

SEQ ID NO: 4172321 - DNA, 19 bp, Homo sapiens
ggcgatcaagtccagagcc

SEQ ID NO: 4172322 - DNA, 18 bp, Homo sapiens
ggcgcctgtagtcccagc

SEQ ID NO: 4172323 - DNA, 22 bp, Homo sapiens
ggcgggcacctatagtcccagc

SEQ ID NO: 4172324 - DNA, 17 bp, Homo sapiens
ggcgtggctggcctttc

SEQ ID NO: 4172325 - DNA, 19 bp, Homo sapiens
ggctactcagcagtaagca

SEQ ID NO: 4172326 - DNA, 22 bp, Homo sapiens
ggctatttaaaagtataaaact

SEQ ID NO: 4172327 - DNA, 19 bp, Homo sapiens
ggctcacccaagcaaggcc

SEQ ID NO: 4172328 - DNA, 22 bp, Homo sapiens
ggctcacgcctgtaatcccagc

SEQ ID NO: 4172329 - DNA, 14 bp, Homo sapiens
ggctcagtctcagg

SEQ ID NO: 4172330 - DNA, 17 bp, Homo sapiens
ggctcccgccaccctca

SEQ ID NO: 4172331 - DNA, 15 bp, Homo sapiens
ggctccctggcccag

SEQ ID NO: 4172332 - DNA, 16 bp, Homo sapiens
ggctccctggcccagc

SEQ ID NO: 4172333 - DNA, 20 bp, Homo sapiens
ggctccggaggggacccagc

SEQ ID NO: 4172334 - DNA, 23 bp, Homo sapiens
ggctcctgtgctactttgccttt

SEQ ID NO: 4172335 - DNA, 17 bp, Homo sapiens
ggctcctttgcctctgc

SEQ ID NO: 4172336 - DNA, 18 bp, Homo sapiens
ggctcctttgcctctgct

SEQ ID NO: 4172337 - DNA, 23 bp, Homo sapiens
ggctcctttgcctctgctactga

SEQ ID NO: 4172338 - DNA, 18 bp, Homo sapiens
ggctcgccccacccaggg

SEQ ID NO: 4172339 - DNA, 16 bp, Homo sapiens
ggctctattgagccaa

SEQ ID NO: 4172340 - DNA, 12 bp, Homo sapiens
ggctctgcccca

SEQ ID NO: 4172341 - DNA, 23 bp, Homo sapiens
ggctctgccccagctctggcttc

SEQ ID NO: 4172342 - DNA, 18 bp, Homo sapiens
ggctgaccccaaagagcc

SEQ ID NO: 4172343 - DNA, 21 bp, Homo sapiens
ggctgacctgggcccacagag

SEQ ID NO: 4172344 - DNA, 15 bp, Homo sapiens
ggctgagacaggaga

SEQ ID NO: 4172345 - DNA, 18 bp, Homo sapiens
ggctgagacaggagaatc

SEQ ID NO: 4172346 - DNA, 14 bp, Homo sapiens
ggctgagccctggc

SEQ ID NO: 4172347 - DNA, 16 bp, Homo sapiens
ggctgagcttggccct

SEQ ID NO: 4172348 - DNA, 23 bp, Homo sapiens
ggctgcagaagatttagatgttt

SEQ ID NO: 4172349 - DNA, 12 bp, Homo sapiens
ggctgccctgcc

SEQ ID NO: 4172350 - DNA, 13 bp, Homo sapiens
ggctgccctgcca

SEQ ID NO: 4172351 - DNA, 15 bp, Homo sapiens
ggctgcgaaaacgtt

SEQ ID NO: 4172352 - DNA, 16 bp, Homo sapiens
ggctgctcctccagcc

SEQ ID NO: 4172353 - DNA, 18 bp, Homo sapiens
ggctgctcctccagccct

SEQ ID NO: 4172354 - DNA, 18 bp, Homo sapiens
ggctgctgtggcccagtc

SEQ ID NO: 4172355 - DNA, 13 bp, Homo sapiens
ggctggacctgca

SEQ ID NO: 4172356 - DNA, 13 bp, Homo sapiens
ggctggcccagcc

SEQ ID NO: 4172357 - DNA, 13 bp, Homo sapiens
ggctggcctttca

SEQ ID NO: 4172358 - DNA, 15 bp, Homo sapiens
ggctggctgcagtga

SEQ ID NO: 4172359 - DNA, 22 bp, Homo sapiens
ggctgggcccacagagatgcat

SEQ ID NO: 4172360 - DNA, 23 bp, Homo sapiens
ggctgggcccacagagatgcatg

SEQ ID NO: 4172361 - DNA, 14 bp, Homo sapiens
ggctgggcctgagc

SEQ ID NO: 4172362 - DNA, 19 bp, Homo sapiens
ggctggggactgctacctc

SEQ ID NO: 4172363 - DNA, 12 bp, Homo sapiens
ggctgtgcctta

SEQ ID NO: 4172364 - DNA, 17 bp, Homo sapiens
ggctgtggggtctggct

SEQ ID NO: 4172365 - DNA, 19 bp, Homo sapiens
ggctgtggggtctggctgt

SEQ ID NO: 4172366 - DNA, 12 bp, Homo sapiens
ggctgtgtggcc

SEQ ID NO: 4172367 - DNA, 16 bp, Homo sapiens
ggcttaggtgccaggc

SEQ ID NO: 4172368 - DNA, 17 bp, Homo sapiens
ggcttcagcatatttat

SEQ ID NO: 4172369 - DNA, 13 bp, Homo sapiens
ggcttctggagcc

SEQ ID NO: 4172370 - DNA, 16 bp, Homo sapiens
ggcttctggagccctt

SEQ ID NO: 4172371 - DNA, 20 bp, Homo sapiens
ggcttctggagcccttgggt

SEQ ID NO: 4172372 - DNA, 12 bp, Homo sapiens
ggcttgccctgg

SEQ ID NO: 4172373 - DNA, 17 bp, Homo sapiens
ggcttgggggaaaagag

SEQ ID NO: 4172374 - DNA, 19 bp, Homo sapiens
ggcttggtggccaagcctg

SEQ ID NO: 4172375 - DNA, 14 bp, Homo sapiens
ggctttagaagaga

SEQ ID NO: 4172376 - DNA, 13 bp, Homo sapiens
ggctttctggaga

SEQ ID NO: 4172377 - DNA, 18 bp, Homo sapiens
ggctttgccatgggcctg

SEQ ID NO: 4172378 - DNA, 20 bp, Homo sapiens
ggctttgtctctagccgggc

SEQ ID NO: 4172379 - DNA, 19 bp, Homo sapiens
ggcttttcgcttgcttctg

SEQ ID NO: 4172380 - DNA, 23 bp, Homo sapiens
gggaaattctatatgatcctgaa

SEQ ID NO: 4172381 - DNA, 12 bp, Homo sapiens
gggaaccctgct

SEQ ID NO: 4172382 - DNA, 20 bp, Homo sapiens
gggaagacaggtctagactt

SEQ ID NO: 4172383 - DNA, 21 bp, Homo sapiens
gggaagctgggggaagggtgg

SEQ ID NO: 4172384 - DNA, 23 bp, Homo sapiens
gggacagagaggagttgccaggg

SEQ ID NO: 4172385 - DNA, 21 bp, Homo sapiens
gggacagtattctcagtgctc

SEQ ID NO: 4172386 - DNA, 16 bp, Homo sapiens
gggacccagctcctct

SEQ ID NO: 4172387 - DNA, 21 bp, Homo sapiens
gggacccagctcctctgagcc

SEQ ID NO: 4172388 - DNA, 22 bp, Homo sapiens
gggacccagctcctctgagcca

SEQ ID NO: 4172389 - DNA, 18 bp, Homo sapiens
gggacctgaatgacctgc

SEQ ID NO: 4172390 - DNA, 17 bp, Homo sapiens
gggacgcgcacacacac

SEQ ID NO: 4172391 - DNA, 13 bp, Homo sapiens
gggacgcgggctg

SEQ ID NO: 4172392 - DNA, 23 bp, Homo sapiens
gggactctatactaccctgggct

SEQ ID NO: 4172393 - DNA, 16 bp, Homo sapiens
gggagaacctcaggct

SEQ ID NO: 4172394 - DNA, 18 bp, Homo sapiens
gggagagagacgtgtaca

SEQ ID NO: 4172395 - DNA, 15 bp, Homo sapiens
gggagagccagctct

SEQ ID NO: 4172396 - DNA, 12 bp, Homo sapiens
gggagagcccag

SEQ ID NO: 4172397 - DNA, 13 bp, Homo sapiens
gggagaggaagca

SEQ ID NO: 4172398 - DNA, 14 bp, Homo sapiens
gggagaggaagcac

SEQ ID NO: 4172399 - DNA, 14 bp, Homo sapiens
gggagctgctggct

SEQ ID NO: 4172400 - DNA, 22 bp, Homo sapiens
gggagctgctggctgacctggg

SEQ ID NO: 4172401 - DNA, 12 bp, Homo sapiens
gggagctggaaa

SEQ ID NO: 4172402 - DNA, 17 bp, Homo sapiens
gggaggatcactggagc

SEQ ID NO: 4172403 - DNA, 22 bp, Homo sapiens
gggaggatcactggagcccagg

SEQ ID NO: 4172404 - DNA, 21 bp, Homo sapiens
gggaggcctcgtaccagccag

SEQ ID NO: 4172405 - DNA, 20 bp, Homo sapiens
gggaggcttttggtggtccc

SEQ ID NO: 4172406 - DNA, 19 bp, Homo sapiens
gggaggggatggcagacag

SEQ ID NO: 4172407 - DNA, 15 bp, Homo sapiens
gggaggggcagaaca

SEQ ID NO: 4172408 - DNA, 17 bp, Homo sapiens
gggaggtccaggcagga

SEQ ID NO: 4172409 - DNA, 12 bp, Homo sapiens
gggatcacagcg

SEQ ID NO: 4172410 - DNA, 23 bp, Homo sapiens
gggatcagcctccgccattccaa

SEQ ID NO: 4172411 - DNA, 20 bp, Homo sapiens
gggatgagctcaagcaggaa

SEQ ID NO: 4172412 - DNA, 16 bp, Homo sapiens
gggatggtcctggggc

SEQ ID NO: 4172413 - DNA, 19 bp, Homo sapiens
gggattacagacatgagcc

SEQ ID NO: 4172414 - DNA, 18 bp, Homo sapiens
gggattttagcctcttcc

SEQ ID NO: 4172415 - DNA, 13 bp, Homo sapiens
gggcaagggccat

SEQ ID NO: 4172416 - DNA, 24 bp, Homo sapiens
gggcaagtccctgactctctgtga

SEQ ID NO: 4172417 - DNA, 16 bp, Homo sapiens
gggcaatgaaaccaaa

SEQ ID NO: 4172418 - DNA, 14 bp, Homo sapiens
gggcagaagggaga

SEQ ID NO: 4172419 - DNA, 18 bp, Homo sapiens
gggcagaagggagaagga

SEQ ID NO: 4172420 - DNA, 14 bp, Homo sapiens
gggcagagccggga

SEQ ID NO: 4172421 - DNA, 22 bp, Homo sapiens
gggcagccccgacccctgtcca

SEQ ID NO: 4172422 - DNA, 23 bp, Homo sapiens
gggcagggagagcgcctcttcct

SEQ ID NO: 4172423 - DNA, 17 bp, Homo sapiens
gggcatgctggggcaag

SEQ ID NO: 4172424 - DNA, 20 bp, Homo sapiens
gggcatggacgttcggggca

SEQ ID NO: 4172425 - DNA, 19 bp, Homo sapiens
gggccactctcccctccct

SEQ ID NO: 4172426 - DNA, 22 bp, Homo sapiens
gggccagtgagggctgggccca

SEQ ID NO: 4172427 - DNA, 14 bp, Homo sapiens
gggccatgctgaag

SEQ ID NO: 4172428 - DNA, 15 bp, Homo sapiens
gggcccacagagcct

SEQ ID NO: 4172429 - DNA, 20 bp, Homo sapiens
gggcccacagagcctggctt

SEQ ID NO: 4172430 - DNA, 13 bp, Homo sapiens
gggcccaggaggt

SEQ ID NO: 4172431 - DNA, 22 bp, Homo sapiens
gggccccaaacgggctgccctg

SEQ ID NO: 4172432 - DNA, 19 bp, Homo sapiens
gggcccgaaagctgagacc

SEQ ID NO: 4172433 - DNA, 20 bp, Homo sapiens
gggcccttcccaacctcccc

SEQ ID NO: 4172434 - DNA, 21 bp, Homo sapiens
gggcccttcccaacctcccct

SEQ ID NO: 4172435 - DNA, 17 bp, Homo sapiens
gggccgggaggcagtgc

SEQ ID NO: 4172436 - DNA, 16 bp, Homo sapiens
gggccttttgtggatt

SEQ ID NO: 4172437 - DNA, 16 bp, Homo sapiens
gggcgctgcctgctct

SEQ ID NO: 4172438 - DNA, 15 bp, Homo sapiens
gggctactcagcagt

SEQ ID NO: 4172439 - DNA, 16 bp, Homo sapiens
gggctactcagcagta

SEQ ID NO: 4172440 - DNA, 18 bp, Homo sapiens
gggctactcagcagtaag

SEQ ID NO: 4172441 - DNA, 12 bp, Homo sapiens
gggctccctcct

SEQ ID NO: 4172442 - DNA, 15 bp, Homo sapiens
gggctccctggccca

SEQ ID NO: 4172443 - DNA, 17 bp, Homo sapiens
gggctccctggcccagc

SEQ ID NO: 4172444 - DNA, 23 bp, Homo sapiens
gggctccctggcccagccagcca

SEQ ID NO: 4172445 - DNA, 12 bp, Homo sapiens
gggctcctggaa

SEQ ID NO: 4172446 - DNA, 14 bp, Homo sapiens
ggaggatccctcca

SEQ ID NO: 4172447 - DNA, 15 bp, Homo sapiens
ggaggatccctccat

SEQ ID NO: 4172448 - DNA, 22 bp, Homo sapiens
ggaggcctcgtaccagccagga

SEQ ID NO: 4172449 - DNA, 20 bp, Homo sapiens
ggaggcggaggttgcagtga

SEQ ID NO: 4172450 - DNA, 16 bp, Homo sapiens
ggaggcggctccaggt

SEQ ID NO: 4172451 - DNA, 22 bp, Homo sapiens
ggaggcggctccaggtccggag

SEQ ID NO: 4172452 - DNA, 14 bp, Homo sapiens
ggaggctgagacag

SEQ ID NO: 4172453 - DNA, 15 bp, Homo sapiens
ggaggcttcttgccc

SEQ ID NO: 4172454 - DNA, 18 bp, Homo sapiens
ggagggaatgggacaggg

SEQ ID NO: 4172455 - DNA, 21 bp, Homo sapiens
ggagggatgctgcctgagtca

SEQ ID NO: 4172456 - DNA, 21 bp, Homo sapiens
ggagggcaagggccatgctga

SEQ ID NO: 4172457 - DNA, 15 bp, Homo sapiens
ggagggtaacagaag

SEQ ID NO: 4172458 - DNA, 19 bp, Homo sapiens
ggagggtgggagagcccag

SEQ ID NO: 4172459 - DNA, 23 bp, Homo sapiens
ggaggtcaagcctgcagcgagct

SEQ ID NO: 4172460 - DNA, 19 bp, Homo sapiens
ggaggtcacattcaggaag

SEQ ID NO: 4172461 - DNA, 23 bp, Homo sapiens
ggaggtcacattcaggaagatga

SEQ ID NO: 4172462 - DNA, 13 bp, Homo sapiens
ggaggtgagggat

SEQ ID NO: 4172463 - DNA, 14 bp, Homo sapiens
ggaggtggggaagg

SEQ ID NO: 4172464 - DNA, 12 bp, Homo sapiens
ggaggttgcagg

SEQ ID NO: 4172465 - DNA, 17 bp, Homo sapiens
ggaggttgcagtgagct

SEQ ID NO: 4172466 - DNA, 20 bp, Homo sapiens
ggaggttgcagtgagctgag

SEQ ID NO: 4172467 - DNA, 16 bp, Homo sapiens
ggagtctgcagtgagg

SEQ ID NO: 4172468 - DNA, 14 bp, Homo sapiens
ggagttataaaaat

SEQ ID NO: 4172469 - DNA, 20 bp, Homo sapiens
ggagtttgaggctgcagcga

SEQ ID NO: 4172470 - DNA, 13 bp, Homo sapiens
ggataaggcagtt

SEQ ID NO: 4172471 - DNA, 16 bp, Homo sapiens
ggatatgtaaaacatt

SEQ ID NO: 4172472 - DNA, 17 bp, Homo sapiens
ggatcactggagcccag

SEQ ID NO: 4172473 - DNA, 21 bp, Homo sapiens
ggatcacttgggcccaggagg

SEQ ID NO: 4172474 - DNA, 21 bp, Homo sapiens
ggatctccaaggaccaggtta

SEQ ID NO: 4172475 - DNA, 12 bp, Homo sapiens
ggatctgcccac

SEQ ID NO: 4172476 - DNA, 16 bp, Homo sapiens
ggatctgtccaaggaa

SEQ ID NO: 4172477 - DNA, 22 bp, Homo sapiens
ggatcttttggtggagtcagga

SEQ ID NO: 4172478 - DNA, 17 bp, Homo sapiens
ggatgaaattttctaga

SEQ ID NO: 4172479 - DNA, 12 bp, Homo sapiens
ggatgcagaggg

SEQ ID NO: 4172480 - DNA, 17 bp, Homo sapiens
ggatgccaagtggccct

SEQ ID NO: 4172481 - DNA, 14 bp, Homo sapiens
ggatgcccagtggt

SEQ ID NO: 4172482 - DNA, 14 bp, Homo sapiens
ggatgctgcctgag

SEQ ID NO: 4172483 - DNA, 22 bp, Homo sapiens
ggatggcagacagtcaaggaga

SEQ ID NO: 4172484 - DNA, 21 bp, Homo sapiens
ggatggcccagcaggcaggca

SEQ ID NO: 4172485 - DNA, 21 bp, Homo sapiens
ggatggctaggaaagggaagc

SEQ ID NO: 4172486 - DNA, 12 bp, Homo sapiens
ggatggggacac

SEQ ID NO: 4172487 - DNA, 21 bp, Homo sapiens
ggatggggtatggattctaaa

SEQ ID NO: 4172488 - DNA, 14 bp, Homo sapiens
ggatggtcctgggg

SEQ ID NO: 4172489 - DNA, 16 bp, Homo sapiens
ggatggtcctggggct

SEQ ID NO: 4172490 - DNA, 20 bp, Homo sapiens
ggatggtcctggggctctgt

SEQ ID NO: 4172491 - DNA, 18 bp, Homo sapiens
ggatggtctttgggcagg

SEQ ID NO: 4172492 - DNA, 15 bp, Homo sapiens
ggatggttctgtgac

SEQ ID NO: 4172493 - DNA, 13 bp, Homo sapiens
ggatgttgttatg

SEQ ID NO: 4172494 - DNA, 19 bp, Homo sapiens
ggattacagacatgagcca

SEQ ID NO: 4172495 - DNA, 13 bp, Homo sapiens
ggattcaagtgat

SEQ ID NO: 4172496 - DNA, 13 bp, Homo sapiens
ggattctgggagg

SEQ ID NO: 4172497 - DNA, 19 bp, Homo sapiens
ggattctgggaggaagcag

SEQ ID NO: 4172498 - DNA, 18 bp, Homo sapiens
ggattgcaggtgcctggc

SEQ ID NO: 4172499 - DNA, 19 bp, Homo sapiens
ggatttatttaaaatagca

SEQ ID NO: 4172500 - DNA, 13 bp, Homo sapiens
ggatttgaagcaa

SEQ ID NO: 4172501 - DNA, 19 bp, Homo sapiens
ggattttagcctcttccct

SEQ ID NO: 4172502 - DNA, 16 bp, Homo sapiens
ggcaagagaaaataaa

SEQ ID NO: 4172503 - DNA, 16 bp, Homo sapiens
ggcaagagacagaatg

SEQ ID NO: 4172504 - DNA, 19 bp, Homo sapiens
ggcaagggccatgctgaag

SEQ ID NO: 4172505 - DNA, 15 bp, Homo sapiens
ggcaatcagcaatca

SEQ ID NO: 4172506 - DNA, 14 bp, Homo sapiens
ggcaatttcctggc

SEQ ID NO: 4172507 - DNA, 20 bp, Homo sapiens
ggcacaaaattctagaagca

SEQ ID NO: 4172508 - DNA, 22 bp, Homo sapiens
ggcacaaaattctagaagcaga

SEQ ID NO: 4172509 - DNA, 20 bp, Homo sapiens
ggcacaatggctaattccca

SEQ ID NO: 4172510 - DNA, 24 bp, Homo sapiens
ggcaccactagggtcctggccctc

SEQ ID NO: 4172511 - DNA, 13 bp, Homo sapiens
ggcaccagaatgc

SEQ ID NO: 4172512 - DNA, 15 bp, Homo sapiens
ggcaccccctggaga

SEQ ID NO: 4172513 - DNA, 19 bp, Homo sapiens
ggcaccccctggagagaag

SEQ ID NO: 4172514 - DNA, 22 bp, Homo sapiens
ggcacctatagtcccagctact

SEQ ID NO: 4172515 - DNA, 13 bp, Homo sapiens
ggcacctgctgga

SEQ ID NO: 4172516 - DNA, 17 bp, Homo sapiens
ggcaccttagtggcttt

SEQ ID NO: 4172517 - DNA, 14 bp, Homo sapiens
ggcactgcaggggc

SEQ ID NO: 4172518 - DNA, 12 bp, Homo sapiens
ggcactgtggcc

SEQ ID NO: 4172519 - DNA, 18 bp, Homo sapiens
ggcactgtggcccttctg

SEQ ID NO: 4172520 - DNA, 18 bp, Homo sapiens
ggcagactctttatgctt

SEQ ID NO: 4172521 - DNA, 17 bp, Homo sapiens
ggcagagaaagaagaga

SEQ ID NO: 4172522 - DNA, 20 bp, Homo sapiens
ggcagagaagaaagaacgga

SEQ ID NO: 4172523 - DNA, 20 bp, Homo sapiens
ggcagagatcaggtgggcag

SEQ ID NO: 4172524 - DNA, 16 bp, Homo sapiens
ggcagaggggagcttg

SEQ ID NO: 4172525 - DNA, 14 bp, Homo sapiens
ggcagagtgaaata

SEQ ID NO: 4172526 - DNA, 23 bp, Homo sapiens
ggcagagtgagactcgtctcaaa

SEQ ID NO: 4172527 - DNA, 19 bp, Homo sapiens
ggcagcagttccatgaaga

SEQ ID NO: 4172528 - DNA, 21 bp, Homo sapiens
ggcagcagttccatgaagaca

SEQ ID NO: 4172529 - DNA, 22 bp, Homo sapiens
ggcagccccgacccctgtccag

SEQ ID NO: 4172530 - DNA, 21 bp, Homo sapiens
ggcagctgaactattggaggg

SEQ ID NO: 4172531 - DNA, 15 bp, Homo sapiens
ggcaggatgaccctg

SEQ ID NO: 4172532 - DNA, 16 bp, Homo sapiens
ggcaggcactgtggcc

SEQ ID NO: 4172533 - DNA, 21 bp, Homo sapiens
ggcaggcactgtggcccttct

SEQ ID NO: 4172534 - DNA, 21 bp, Homo sapiens
ggcagggagagcgcctcttcc

SEQ ID NO: 4172535 - DNA, 16 bp, Homo sapiens
ggcagggcaaaggtca

SEQ ID NO: 4172536 - DNA, 22 bp, Homo sapiens
ggcagggcaaaggtcaagactg

SEQ ID NO: 4172537 - DNA, 16 bp, Homo sapiens
ggcaggggtgggagag

SEQ ID NO: 4172538 - DNA, 17 bp, Homo sapiens
ggcaggggtgggagagc

SEQ ID NO: 4172539 - DNA, 20 bp, Homo sapiens
ggcagtaggaacccagctct

SEQ ID NO: 4172540 - DNA, 19 bp, Homo sapiens
ggcagtggaaaaatcagaa

SEQ ID NO: 4172541 - DNA, 20 bp, Homo sapiens
ggcagtggtaagctctggct

SEQ ID NO: 4172542 - DNA, 15 bp, Homo sapiens
ggcagttactatttt

SEQ ID NO: 4172543 - DNA, 16 bp, Homo sapiens
ggcatacctgtcctag

SEQ ID NO: 4172544 - DNA, 13 bp, Homo sapiens
ggcatcacagggc

SEQ ID NO: 4172545 - DNA, 23 bp, Homo sapiens
ggcatcacagggcagagccggga

SEQ ID NO: 4172546 - DNA, 17 bp, Homo sapiens
ggcatcctctttttcca

SEQ ID NO: 4172547 - DNA, 15 bp, Homo sapiens
ggcatgacactctag

SEQ ID NO: 4172548 - DNA, 13 bp, Homo sapiens
ggcatgctggggc

SEQ ID NO: 4172549 - DNA, 14 bp, Homo sapiens
ggcatgcttaaata

SEQ ID NO: 4172550 - DNA, 14 bp, Homo sapiens
ggcatgttcctctg

SEQ ID NO: 4172551 - DNA, 21 bp, Homo sapiens
ggcatttttaccatcactgag

SEQ ID NO: 4172552 - DNA, 15 bp, Homo sapiens
ggccaagcaagaggt

SEQ ID NO: 4172553 - DNA, 16 bp, Homo sapiens
ggccaagcctggccct

SEQ ID NO: 4172554 - DNA, 20 bp, Homo sapiens
ggccaagcgggggcgtggct

SEQ ID NO: 4172555 - DNA, 11 bp, Homo sapiens
ggccaccagga

SEQ ID NO: 4172556 - DNA, 14 bp, Homo sapiens
ggccaccaggatgg

SEQ ID NO: 4172557 - DNA, 23 bp, Homo sapiens
ggccagatgattttcctccctgg

SEQ ID NO: 4172558 - DNA, 17 bp, Homo sapiens
ggccaggaatctgccat

SEQ ID NO: 4172559 - DNA, 17 bp, Homo sapiens
ggccaggccaccaggat

SEQ ID NO: 4172560 - DNA, 16 bp, Homo sapiens
ggccagggtgagagct

SEQ ID NO: 4172561 - DNA, 18 bp, Homo sapiens
ggccagtgagggctgggc

SEQ ID NO: 4172562 - DNA, 19 bp, Homo sapiens
ggccagtgtgatcccaagt

SEQ ID NO: 4172563 - DNA, 18 bp, Homo sapiens
ggcccaaagcccagctct

SEQ ID NO: 4172564 - DNA, 22 bp, Homo sapiens
ggcccagagaccccttcctttc

SEQ ID NO: 4172565 - DNA, 14 bp, Homo sapiens
ggcccagcaggcag

SEQ ID NO: 4172566 - DNA, 19 bp, Homo sapiens
ggcccagcaggcaggcact

SEQ ID NO: 4172567 - DNA, 23 bp, Homo sapiens
ggcccaggaggtcaagcctgcag

SEQ ID NO: 4172568 - DNA, 17 bp, Homo sapiens
ggccccagggctaccct

SEQ ID NO: 4172569 - DNA, 16 bp, Homo sapiens
ggcccccctccaggca

SEQ ID NO: 4172570 - DNA, 20 bp, Homo sapiens
ggcccccctccttgctctgc

SEQ ID NO: 4172571 - DNA, 15 bp, Homo sapiens
ggcccgtcatgttcc

SEQ ID NO: 4172572 - DNA, 20 bp, Homo sapiens
ggccctcagtgggctccctg

SEQ ID NO: 4172573 - DNA, 19 bp, Homo sapiens
ggccctcttcttattcatg

SEQ ID NO: 4172574 - DNA, 22 bp, Homo sapiens
ggccctgcaagacacaggctca

SEQ ID NO: 4172575 - DNA, 19 bp, Homo sapiens
ggccgatcggggcactgca

SEQ ID NO: 4172576 - DNA, 18 bp, Homo sapiens
ggccgtacatctctgtga

SEQ ID NO: 4172577 - DNA, 22 bp, Homo sapiens
ggcctcaaagttggggcaggct

SEQ ID NO: 4172578 - DNA, 17 bp, Homo sapiens
ggcctcactcaagcctg

SEQ ID NO: 4172579 - DNA, 18 bp, Homo sapiens
ggcctcacttaattagaa

SEQ ID NO: 4172580 - DNA, 17 bp, Homo sapiens
ggcctcccaataaagct

SEQ ID NO: 4172581 - DNA, 19 bp, Homo sapiens
ggcctcgtaccagccagga

SEQ ID NO: 4172582 - DNA, 22 bp, Homo sapiens
ggcctctgctttctcctgtagc

SEQ ID NO: 4172583 - DNA, 21 bp, Homo sapiens
ggcctgcgtgccgggagagga

SEQ ID NO: 4172584 - DNA, 11 bp, Homo sapiens
ggcctgctgcg

SEQ ID NO: 4172585 - DNA, 17 bp, Homo sapiens
ttttcagatgtgaacca

SEQ ID NO: 4172586 - DNA, 12 bp, Homo sapiens
ttttccaaagat

SEQ ID NO: 4172587 - DNA, 18 bp, Homo sapiens
ttttcccaaaatgttgaa

SEQ ID NO: 4172588 - DNA, 22 bp, Homo sapiens
ttttccctacttcctctgcaaa

SEQ ID NO: 4172589 - DNA, 21 bp, Homo sapiens
ttttcgcttgcttctgcagca

SEQ ID NO: 4172590 - DNA, 23 bp, Homo sapiens
ttttctacctttttttctctcct

SEQ ID NO: 4172591 - DNA, 17 bp, Homo sapiens
ttttctccctagaaaca

SEQ ID NO: 4172592 - DNA, 21 bp, Homo sapiens
ttttctcgctgtcctttctag

SEQ ID NO: 4172593 - DNA, 21 bp, Homo sapiens
ttttcttccttctttctcttc

SEQ ID NO: 4172594 - DNA, 13 bp, Homo sapiens
ttttgcactgaca

SEQ ID NO: 4172595 - DNA, 11 bp, Homo sapiens
ttttgctgctg

SEQ ID NO: 4172596 - DNA, 20 bp, Homo sapiens
ttttgggaggggatggcaga

SEQ ID NO: 4172597 - DNA, 20 bp, Homo sapiens
ttttgggaggtccaggcagg

SEQ ID NO: 4172598 - DNA, 23 bp, Homo sapiens
ttttggggggcccccctccttgc

SEQ ID NO: 4172599 - DNA, 18 bp, Homo sapiens
ttttgtcgagtttacttc

SEQ ID NO: 4172600 - DNA, 13 bp, Homo sapiens
ttttgtgagatgt

SEQ ID NO: 4172601 - DNA, 13 bp, Homo sapiens
ttttgtgtacagt

SEQ ID NO: 4172602 - DNA, 22 bp, Homo sapiens
ttttgttgttgttgtttgtaaa

SEQ ID NO: 4172603 - DNA, 18 bp, Homo sapiens
tttttaaaaagtactctt

SEQ ID NO: 4172604 - DNA, 20 bp, Homo sapiens
tttttaaaggtagagatgtg

SEQ ID NO: 4172605 - DNA, 22 bp, Homo sapiens
tttttaactttgtggtaacttc

SEQ ID NO: 4172606 - DNA, 18 bp, Homo sapiens
tttttaatgtatagtaaa

SEQ ID NO: 4172607 - DNA, 15 bp, Homo sapiens
tttttacaaagccct

SEQ ID NO: 4172608 - DNA, 17 bp, Homo sapiens
tttttaccttgttttct

SEQ ID NO: 4172609 - DNA, 17 bp, Homo sapiens
tttttaggccacattga

SEQ ID NO: 4172610 - DNA, 19 bp, Homo sapiens
tttttccttcaaagtttaa

SEQ ID NO: 4172611 - DNA, 15 bp, Homo sapiens
tttttcttacacatt

SEQ ID NO: 4172612 - DNA, 22 bp, Homo sapiens
tttttcttgagtactagaattt

SEQ ID NO: 4172613 - DNA, 17 bp, Homo sapiens
tttttgaaaaagcgaaa

SEQ ID NO: 4172614 - DNA, 13 bp, Homo sapiens
ttttttaaaaaag

SEQ ID NO: 4172615 - DNA, 10 bp, Homo sapiens
tttttttcca

SEQ ID NO: 4172616 - DNA, 12 bp, Homo sapiens
tttttttgagat

SEQ ID NO: 4172617 - DNA, 13 bp, Homo sapiens
tttttttgctggt

SEQ ID NO: 4172618 - DNA, 18 bp, Homo sapiens
tttatatttggaaagaga

SEQ ID NO: 4172619 - DNA, 15 bp, Homo sapiens
tttatcatgacatgt

SEQ ID NO: 4172620 - DNA, 23 bp, Homo sapiens
tttatcatgacatgttatatatt

SEQ ID NO: 4172621 - DNA, 21 bp, Homo sapiens
tttatctgtattttttacagt

SEQ ID NO: 4172622 - DNA, 19 bp, Homo sapiens
tttatgtctaaagagcttt

SEQ ID NO: 4172623 - DNA, 12 bp, Homo sapiens
tttatgttctag

SEQ ID NO: 4172624 - DNA, 23 bp, Homo sapiens
tttattaaaatgattgtaaaata

SEQ ID NO: 4172625 - DNA, 13 bp, Homo sapiens
tttattgtataaa

SEQ ID NO: 4172626 - DNA, 19 bp, Homo sapiens
tttattgtctgtctacatt

SEQ ID NO: 4172627 - DNA, 22 bp, Homo sapiens
tttattgtctgtctacatttct

SEQ ID NO: 4172628 - DNA, 19 bp, Homo sapiens
tttatttagtttttaacaa

SEQ ID NO: 4172629 - DNA, 13 bp, Homo sapiens
tttatttttgaac

SEQ ID NO: 4172630 - DNA, 13 bp, Homo sapiens
tttcaaaaataaa

SEQ ID NO: 4172631 - DNA, 23 bp, Homo sapiens
tttcaacaagtagctaaagtctg

SEQ ID NO: 4172632 - DNA, 17 bp, Homo sapiens
tttcaacagtgaagaca

SEQ ID NO: 4172633 - DNA, 13 bp, Homo sapiens
tttcaactccaga

SEQ ID NO: 4172634 - DNA, 20 bp, Homo sapiens
tttcaacttggaaaaagaaa

SEQ ID NO: 4172635 - DNA, 13 bp, Homo sapiens
tttcaagtgccta

SEQ ID NO: 4172636 - DNA, 15 bp, Homo sapiens
tttcaagtgcctaga

SEQ ID NO: 4172637 - DNA, 19 bp, Homo sapiens
tttcaagtgcctagactgt

SEQ ID NO: 4172638 - DNA, 22 bp, Homo sapiens
tttcaagtgcctagactgttac

SEQ ID NO: 4172639 - DNA, 23 bp, Homo sapiens
tttcacaacagcctgacaacatt

SEQ ID NO: 4172640 - DNA, 18 bp, Homo sapiens
tttcacattagaagacaa

SEQ ID NO: 4172641 - DNA, 19 bp, Homo sapiens
tttcacattagaagacaat

SEQ ID NO: 4172642 - DNA, 19 bp, Homo sapiens
tttcacctctttaaccact

SEQ ID NO: 4172643 - DNA, 18 bp, Homo sapiens
tttcagaagcaggcaggg

SEQ ID NO: 4172644 - DNA, 11 bp, Homo sapiens
tttcagatgtg

SEQ ID NO: 4172645 - DNA, 18 bp, Homo sapiens
tttcagatgtgaaccatt

SEQ ID NO: 4172646 - DNA, 14 bp, Homo sapiens
tttcagctgtgaac

SEQ ID NO: 4172647 - DNA, 21 bp, Homo sapiens
tttcaggatactctgtcagat

SEQ ID NO: 4172648 - DNA, 20 bp, Homo sapiens
tttcatagattgagaagttt

SEQ ID NO: 4172649 - DNA, 15 bp, Homo sapiens
tttcattttaattta

SEQ ID NO: 4172650 - DNA, 18 bp, Homo sapiens
tttccaaagataatgtta

SEQ ID NO: 4172651 - DNA, 15 bp, Homo sapiens
tttccaaataaaatg

SEQ ID NO: 4172652 - DNA, 19 bp, Homo sapiens
tttccaagttcctgcactc

SEQ ID NO: 4172653 - DNA, 13 bp, Homo sapiens
tttccatgtatct

SEQ ID NO: 4172654 - DNA, 20 bp, Homo sapiens
tttccccacctcttccttcc

SEQ ID NO: 4172655 - DNA, 21 bp, Homo sapiens
tttcccgagcaaagtctaaag

SEQ ID NO: 4172656 - DNA, 15 bp, Homo sapiens
tttcctacaaaatgg

SEQ ID NO: 4172657 - DNA, 20 bp, Homo sapiens
tttcctcaatggacttcaaa

SEQ ID NO: 4172658 - DNA, 12 bp, Homo sapiens
tttcctccccac

SEQ ID NO: 4172659 - DNA, 15 bp, Homo sapiens
tttcgcttgcttctg

SEQ ID NO: 4172660 - DNA, 16 bp, Homo sapiens
tttcggagcctgcctc

SEQ ID NO: 4172661 - DNA, 16 bp, Homo sapiens
tttctagtttggcaca

SEQ ID NO: 4172662 - DNA, 14 bp, Homo sapiens
tttctattccaaag

SEQ ID NO: 4172663 - DNA, 21 bp, Homo sapiens
tttctccaagagctacataat

SEQ ID NO: 4172664 - DNA, 22 bp, Homo sapiens
tttctcgctgtcctttctagag

SEQ ID NO: 4172665 - DNA, 19 bp, Homo sapiens
tttctctccttcttccctg

SEQ ID NO: 4172666 - DNA, 20 bp, Homo sapiens
tttctcttccctccttccct

SEQ ID NO: 4172667 - DNA, 16 bp, Homo sapiens
tttctgaactgttaca

SEQ ID NO: 4172668 - DNA, 18 bp, Homo sapiens
tttctgagattttagttc

SEQ ID NO: 4172669 - DNA, 11 bp, Homo sapiens
tttctggagtc

SEQ ID NO: 4172670 - DNA, 22 bp, Homo sapiens
tttctgtaagaaacctactgcc

SEQ ID NO: 4172671 - DNA, 17 bp, Homo sapiens
tttctgtacacagaagt

SEQ ID NO: 4172672 - DNA, 15 bp, Homo sapiens
tttctgttggtgtat

SEQ ID NO: 4172673 - DNA, 12 bp, Homo sapiens
tttcttaaataa

SEQ ID NO: 4172674 - DNA, 18 bp, Homo sapiens
tttcttaaataagaaact

SEQ ID NO: 4172675 - DNA, 19 bp, Homo sapiens
tttcttaaataagaaactt

SEQ ID NO: 4172676 - DNA, 22 bp, Homo sapiens
tttctttgaatgctttttgaat

SEQ ID NO: 4172677 - DNA, 15 bp, Homo sapiens
tttgaaaaagcgaaa

SEQ ID NO: 4172678 - DNA, 20 bp, Homo sapiens
tttgaaaaagcgaaaaaatc

SEQ ID NO: 4172679 - DNA, 23 bp, Homo sapiens
tttgaaaaagcgaaaaaatcagg

SEQ ID NO: 4172680 - DNA, 20 bp, Homo sapiens
tttgaaaacgtttcaaagca

SEQ ID NO: 4172681 - DNA, 17 bp, Homo sapiens
tttgaaattttatttag

SEQ ID NO: 4172682 - DNA, 13 bp, Homo sapiens
tttgaactaattt

SEQ ID NO: 4172683 - DNA, 22 bp, Homo sapiens
tttgaagttatttagaaatatc

SEQ ID NO: 4172684 - DNA, 20 bp, Homo sapiens
tttgaatgttatttgttatt

SEQ ID NO: 4172685 - DNA, 13 bp, Homo sapiens
tttgacagtgtgg

SEQ ID NO: 4172686 - DNA, 20 bp, Homo sapiens
tttgaggagcagcttcagtt

SEQ ID NO: 4172687 - DNA, 19 bp, Homo sapiens
tttgatattaaaggagtta

SEQ ID NO: 4172688 - DNA, 20 bp, Homo sapiens
tttgatgcccagataatata

SEQ ID NO: 4172689 - DNA, 16 bp, Homo sapiens
tttgcaaaactgtgct

SEQ ID NO: 4172690 - DNA, 19 bp, Homo sapiens
tttgcaatggctatatggc

SEQ ID NO: 4172691 - DNA, 17 bp, Homo sapiens
tttgcagttgagagggg

SEQ ID NO: 4172692 - DNA, 21 bp, Homo sapiens
tttgcatggaatttgtaagtt

SEQ ID NO: 4172693 - DNA, 21 bp, Homo sapiens
tttgccctgtggattccagca

SEQ ID NO: 4172694 - DNA, 16 bp, Homo sapiens
tttgcctaattcctgg

SEQ ID NO: 4172695 - DNA, 13 bp, Homo sapiens
tttgcctctgaaa

SEQ ID NO: 4172696 - DNA, 23 bp, Homo sapiens
tttgctcacacggggtattttag

SEQ ID NO: 4172697 - DNA, 12 bp, Homo sapiens
tttgctgctgct

SEQ ID NO: 4172698 - DNA, 21 bp, Homo sapiens
tttgcttaaaattttactttt

SEQ ID NO: 4172699 - DNA, 16 bp, Homo sapiens
tttgcttggcagagag

SEQ ID NO: 4172700 - DNA, 14 bp, Homo sapiens
tttggaaagagacc

SEQ ID NO: 4172701 - DNA, 15 bp, Homo sapiens
tttggaaagagacca

SEQ ID NO: 4172702 - DNA, 15 bp, Homo sapiens
tttggacaaaatgga

SEQ ID NO: 4172703 - DNA, 19 bp, Homo sapiens
tttggagactctgtggggc

SEQ ID NO: 4172704 - DNA, 23 bp, Homo sapiens
tttggcaggagaatcaataaaaa

SEQ ID NO: 4172705 - DNA, 19 bp, Homo sapiens
tttggcatgcttaaatatt

SEQ ID NO: 4172706 - DNA, 23 bp, Homo sapiens
tttggccaatgcacctaaagaaa

SEQ ID NO: 4172707 - DNA, 20 bp, Homo sapiens
tttgggcagaagggagaagg

SEQ ID NO: 4172708 - DNA, 20 bp, Homo sapiens
tttggggagggggaagagaa

SEQ ID NO: 4172709 - DNA, 23 bp, Homo sapiens
tttgggtgtggtgtcaccagcct

SEQ ID NO: 4172710 - DNA, 13 bp, Homo sapiens
tttggtatattac

SEQ ID NO: 4172711 - DNA, 12 bp, Homo sapiens
tttggtggtccc

SEQ ID NO: 4172712 - DNA, 13 bp, Homo sapiens
tttggttacatgg

SEQ ID NO: 4172713 - DNA, 21 bp, Homo sapiens
tttggtttcccaagagctacg

SEQ ID NO: 4172714 - DNA, 16 bp, Homo sapiens
tttgtaagttgaagca

SEQ ID NO: 4172715 - DNA, 13 bp, Homo sapiens
tttgtaagtttat

SEQ ID NO: 4172716 - DNA, 10 bp, Homo sapiens
tttgtacaga

SEQ ID NO: 4172717 - DNA, 17 bp, Homo sapiens
tttgtaccatggtgtga

SEQ ID NO: 4172718 - DNA, 23 bp, Homo sapiens
tttgtaggggtcaaagaaatgct

SEQ ID NO: 4172719 - DNA, 13 bp, Homo sapiens
tttgtattttgct

SEQ ID NO: 4172720 - DNA, 14 bp, Homo sapiens
tttgtatttttagt

SEQ ID NO: 4172721 - DNA, 21 bp, Homo sapiens
tttgtcaacacaaagacacag

SEQ ID NO: 4172722 - DNA, 19 bp, Homo sapiens
tttgtctgtgtgctgtaac

SEQ ID NO: 4172723 - DNA, 17 bp, Homo sapiens
tttgtgatttagaactg

SEQ ID NO: 4172724 - DNA, 17 bp, Homo sapiens
tttgtggcaccttttct

SEQ ID NO: 4172725 - DNA, 19 bp, Homo sapiens
tttgtggtaacttctttga

SEQ ID NO: 4172726 - DNA, 12 bp, Homo sapiens
tttgttatttgt

SEQ ID NO: 4172727 - DNA, 17 bp, Homo sapiens
tttgttatttgtacagt

SEQ ID NO: 4172728 - DNA, 18 bp, Homo sapiens
tttgttatttgtacagtt

SEQ ID NO: 4172729 - DNA, 20 bp, Homo sapiens
tttgttattttcagtatttt

SEQ ID NO: 4172730 - DNA, 14 bp, Homo sapiens
tttgttttgcactg

SEQ ID NO: 4172731 - DNA, 22 bp, Homo sapiens
tttgtttttttccaactgtgtt

SEQ ID NO: 4172732 - DNA, 17 bp, Homo sapiens
ttttaaaaaagcttaaa

SEQ ID NO: 4172733 - DNA, 12 bp, Homo sapiens
ttttaaaagaaa

SEQ ID NO: 4172734 - DNA, 20 bp, Homo sapiens
ttttaaacaaaatagaagct

SEQ ID NO: 4172735 - DNA, 13 bp, Homo sapiens
ttttaaagaattg

SEQ ID NO: 4172736 - DNA, 20 bp, Homo sapiens
ttttaaaggtagagatgtgt

SEQ ID NO: 4172737 - DNA, 12 bp, Homo sapiens
ttttaaataaga

SEQ ID NO: 4172738 - DNA, 12 bp, Homo sapiens
ttttaaatgttt

SEQ ID NO: 4172739 - DNA, 12 bp, Homo sapiens
ttttaactttgt

SEQ ID NO: 4172740 - DNA, 20 bp, Homo sapiens
ttttaactttgtggtaactt

SEQ ID NO: 4172741 - DNA, 17 bp, Homo sapiens
ttttaagcttgaagatt

SEQ ID NO: 4172742 - DNA, 12 bp, Homo sapiens
ttttacaataat

SEQ ID NO: 4172743 - DNA, 17 bp, Homo sapiens
ttttactgattaacaaa

SEQ ID NO: 4172744 - DNA, 22 bp, Homo sapiens
ttttagagccccccgtgtggct

SEQ ID NO: 4172745 - DNA, 18 bp, Homo sapiens
ttttagctccataagcaa

SEQ ID NO: 4172746 - DNA, 14 bp, Homo sapiens
ttttaggaaacctg

SEQ ID NO: 4172747 - DNA, 18 bp, Homo sapiens
ttttaggcagggatttga

SEQ ID NO: 4172748 - DNA, 19 bp, Homo sapiens
ttttaggcagggatttgag

SEQ ID NO: 4172749 - DNA, 14 bp, Homo sapiens
ttttataaatatgt

SEQ ID NO: 4172750 - DNA, 12 bp, Homo sapiens
ttttatactgta

SEQ ID NO: 4172751 - DNA, 15 bp, Homo sapiens
ttttatcatgacatg

SEQ ID NO: 4172752 - DNA, 20 bp, Homo sapiens
ttttattgtataaactatca

SEQ ID NO: 4172753 - DNA, 13 bp, Homo sapiens
ttttatttaaaaa

SEQ ID NO: 4172754 - DNA, 13 bp, Homo sapiens
ttttatttagttc

SEQ ID NO: 4172755 - DNA, 22 bp, Homo sapiens
ttttatttttgaacccctgtgt

SEQ ID NO: 4172756 - DNA, 15 bp, Homo sapiens
ttttcaataatgtga

SEQ ID NO: 4172757 - DNA, 15 bp, Homo sapiens
ttgccgtctaggatt

SEQ ID NO: 4172758 - DNA, 16 bp, Homo sapiens
ttgccttaaagaaagt

SEQ ID NO: 4172759 - DNA, 23 bp, Homo sapiens
ttgccttcctcgtgcagagctgg

SEQ ID NO: 4172760 - DNA, 17 bp, Homo sapiens
ttgccttgatgttgtgt

SEQ ID NO: 4172761 - DNA, 19 bp, Homo sapiens
ttgcgggggagctggaaat

SEQ ID NO: 4172762 - DNA, 14 bp, Homo sapiens
ttgcggttcaggaa

SEQ ID NO: 4172763 - DNA, 16 bp, Homo sapiens
ttgctacataattatc

SEQ ID NO: 4172764 - DNA, 21 bp, Homo sapiens
ttgctctagtcttgctttgct

SEQ ID NO: 4172765 - DNA, 11 bp, Homo sapiens
ttgctgagggg

SEQ ID NO: 4172766 - DNA, 22 bp, Homo sapiens
ttgcttaaaattttacttttgt

SEQ ID NO: 4172767 - DNA, 13 bp, Homo sapiens
ttgcttctgcagc

SEQ ID NO: 4172768 - DNA, 22 bp, Homo sapiens
ttgcttctgcagcaactcccac

SEQ ID NO: 4172769 - DNA, 14 bp, Homo sapiens
ttgcttggcagaga

SEQ ID NO: 4172770 - DNA, 21 bp, Homo sapiens
ttgcttgtaaaaccaactaaa

SEQ ID NO: 4172771 - DNA, 23 bp, Homo sapiens
ttgctttaatgtgtattgaagaa

SEQ ID NO: 4172772 - DNA, 20 bp, Homo sapiens
ttggaaaaagaaagaaacac

SEQ ID NO: 4172773 - DNA, 14 bp, Homo sapiens
ttggaacaattatt

SEQ ID NO: 4172774 - DNA, 21 bp, Homo sapiens
ttggaagagaggcacctgctg

SEQ ID NO: 4172775 - DNA, 13 bp, Homo sapiens
ttggaagtttcat

SEQ ID NO: 4172776 - DNA, 13 bp, Homo sapiens
ttggacaaaatgg

SEQ ID NO: 4172777 - DNA, 14 bp, Homo sapiens
ttggacacagtgtt

SEQ ID NO: 4172778 - DNA, 13 bp, Homo sapiens
ttggactcctccc

SEQ ID NO: 4172779 - DNA, 14 bp, Homo sapiens
ttggactcctccca

SEQ ID NO: 4172780 - DNA, 13 bp, Homo sapiens
ttggacttgagga

SEQ ID NO: 4172781 - DNA, 20 bp, Homo sapiens
ttggagactctgtggggcct

SEQ ID NO: 4172782 - DNA, 23 bp, Homo sapiens
ttggagggtgggagagcccagcc

SEQ ID NO: 4172783 - DNA, 20 bp, Homo sapiens
ttggatatgtaaaacattta

SEQ ID NO: 4172784 - DNA, 20 bp, Homo sapiens
ttggcaatagtttgcataga

SEQ ID NO: 4172785 - DNA, 16 bp, Homo sapiens
ttggcaatttcctggc

SEQ ID NO: 4172786 - DNA, 13 bp, Homo sapiens
ttggcagagagga

SEQ ID NO: 4172787 - DNA, 23 bp, Homo sapiens
ttggccgtggccatcagggtggg

SEQ ID NO: 4172788 - DNA, 12 bp, Homo sapiens
ttggcctgtgtc

SEQ ID NO: 4172789 - DNA, 21 bp, Homo sapiens
ttggctggatgaaattttcta

SEQ ID NO: 4172790 - DNA, 23 bp, Homo sapiens
ttggctggatgaaattttctaga

SEQ ID NO: 4172791 - DNA, 13 bp, Homo sapiens
ttggcttattttt

SEQ ID NO: 4172792 - DNA, 15 bp, Homo sapiens
ttgggaggctgaggc

SEQ ID NO: 4172793 - DNA, 15 bp, Homo sapiens
ttgggatatctcctg

SEQ ID NO: 4172794 - DNA, 22 bp, Homo sapiens
ttgggatgagaatgaaagctta

SEQ ID NO: 4172795 - DNA, 21 bp, Homo sapiens
ttgggcctcccataattgctt

SEQ ID NO: 4172796 - DNA, 16 bp, Homo sapiens
ttggggtcagccaggg

SEQ ID NO: 4172797 - DNA, 22 bp, Homo sapiens
ttgggtcctgcaatctccaggg

SEQ ID NO: 4172798 - DNA, 23 bp, Homo sapiens
ttggtcccgtgcagcttctgtcc

SEQ ID NO: 4172799 - DNA, 23 bp, Homo sapiens
ttggtggagtcaggaaagacagg

SEQ ID NO: 4172800 - DNA, 17 bp, Homo sapiens
ttggtggccaagcctgg

SEQ ID NO: 4172801 - DNA, 18 bp, Homo sapiens
ttggtgggctggcccagc

SEQ ID NO: 4172802 - DNA, 14 bp, Homo sapiens
ttggtttgccttcc

SEQ ID NO: 4172803 - DNA, 18 bp, Homo sapiens
ttgtaaaaacaaaaagac

SEQ ID NO: 4172804 - DNA, 14 bp, Homo sapiens
ttgtaaaactacac

SEQ ID NO: 4172805 - DNA, 21 bp, Homo sapiens
ttgtaaaatagcttgtatagt

SEQ ID NO: 4172806 - DNA, 14 bp, Homo sapiens
ttgtaaataaaagt

SEQ ID NO: 4172807 - DNA, 21 bp, Homo sapiens
ttgtaatagatgtttgataga

SEQ ID NO: 4172808 - DNA, 15 bp, Homo sapiens
ttgtacaagctcagg

SEQ ID NO: 4172809 - DNA, 13 bp, Homo sapiens
ttgtacacagtct

SEQ ID NO: 4172810 - DNA, 15 bp, Homo sapiens
ttgtacacagtctgt

SEQ ID NO: 4172811 - DNA, 16 bp, Homo sapiens
ttgtacgtaatgtatt

SEQ ID NO: 4172812 - DNA, 16 bp, Homo sapiens
ttgtactaaagccaaa

SEQ ID NO: 4172813 - DNA, 15 bp, Homo sapiens
ttgtactccagcctg

SEQ ID NO: 4172814 - DNA, 15 bp, Homo sapiens
ttgtatagtgtaaaa

SEQ ID NO: 4172815 - DNA, 16 bp, Homo sapiens
ttgtattttaaatgtt

SEQ ID NO: 4172816 - DNA, 21 bp, Homo sapiens
ttgtattttttgttgaaagta

SEQ ID NO: 4172817 - DNA, 22 bp, Homo sapiens
ttgtattttttgttgaaagtaa

SEQ ID NO: 4172818 - DNA, 17 bp, Homo sapiens
ttgtcaacacaaagaca

SEQ ID NO: 4172819 - DNA, 20 bp, Homo sapiens
ttgtcactatcttcacaagt

SEQ ID NO: 4172820 - DNA, 14 bp, Homo sapiens
ttgtcactgaagat

SEQ ID NO: 4172821 - DNA, 19 bp, Homo sapiens
ttgtcaggttggagtgtaa

SEQ ID NO: 4172822 - DNA, 14 bp, Homo sapiens
ttgtcattatgtac

SEQ ID NO: 4172823 - DNA, 18 bp, Homo sapiens
ttgtcatttaccctggtg

SEQ ID NO: 4172824 - DNA, 21 bp, Homo sapiens
ttgtctagaggtgagaccaaa

SEQ ID NO: 4172825 - DNA, 14 bp, Homo sapiens
ttgtctctgcatct

SEQ ID NO: 4172826 - DNA, 18 bp, Homo sapiens
ttgtctgtctacatttct

SEQ ID NO: 4172827 - DNA, 16 bp, Homo sapiens
ttgtcttataaacaaa

SEQ ID NO: 4172828 - DNA, 13 bp, Homo sapiens
ttgtctttttaga

SEQ ID NO: 4172829 - DNA, 14 bp, Homo sapiens
ttgtgaactggaag

SEQ ID NO: 4172830 - DNA, 18 bp, Homo sapiens
ttgtgcaatgtaaatatt

SEQ ID NO: 4172831 - DNA, 22 bp, Homo sapiens
ttgtgcaatgtaaatattttaa

SEQ ID NO: 4172832 - DNA, 17 bp, Homo sapiens
ttgtgcccactgtctct

SEQ ID NO: 4172833 - DNA, 21 bp, Homo sapiens
ttgtgtttcacaaaattaagt

SEQ ID NO: 4172834 - DNA, 18 bp, Homo sapiens
ttgttaaaaatattttct

SEQ ID NO: 4172835 - DNA, 22 bp, Homo sapiens
ttgttaatttagaaaactttaa

SEQ ID NO: 4172836 - DNA, 17 bp, Homo sapiens
ttgttaccatgaagata

SEQ ID NO: 4172837 - DNA, 18 bp, Homo sapiens
ttgttatcatttaagatt

SEQ ID NO: 4172838 - DNA, 15 bp, Homo sapiens
ttgttatttgtacag

SEQ ID NO: 4172839 - DNA, 17 bp, Homo sapiens
ttgttcagttgacttac

SEQ ID NO: 4172840 - DNA, 21 bp, Homo sapiens
ttgttgataaattccactgga

SEQ ID NO: 4172841 - DNA, 13 bp, Homo sapiens
ttgttgtgctttt

SEQ ID NO: 4172842 - DNA, 20 bp, Homo sapiens
ttgttgttattttttgagaa

SEQ ID NO: 4172843 - DNA, 13 bp, Homo sapiens
ttgttgtttgtaa

SEQ ID NO: 4172844 - DNA, 15 bp, Homo sapiens
ttgtttcttgactct

SEQ ID NO: 4172845 - DNA, 22 bp, Homo sapiens
ttgtttgtaaatgcctcttaaa

SEQ ID NO: 4172846 - DNA, 19 bp, Homo sapiens
ttgttttatcatgacatgt

SEQ ID NO: 4172847 - DNA, 23 bp, Homo sapiens
ttgttttccctttaaagcctttt

SEQ ID NO: 4172848 - DNA, 13 bp, Homo sapiens
ttgttttgcactg

SEQ ID NO: 4172849 - DNA, 21 bp, Homo sapiens
tttaaaaaagcttaaaacttt

SEQ ID NO: 4172850 - DNA, 17 bp, Homo sapiens
tttaaaagatgctttta

SEQ ID NO: 4172851 - DNA, 20 bp, Homo sapiens
tttaaaatgtaaagccatgc

SEQ ID NO: 4172852 - DNA, 15 bp, Homo sapiens
tttaaacaagtattt

SEQ ID NO: 4172853 - DNA, 21 bp, Homo sapiens
tttaaaccgctaaaagaaact

SEQ ID NO: 4172854 - DNA, 22 bp, Homo sapiens
tttaaaccgctaaaagaaactt

SEQ ID NO: 4172855 - DNA, 23 bp, Homo sapiens
tttaaaccgctaaaagaaacttt

SEQ ID NO: 4172856 - DNA, 12 bp, Homo sapiens
tttaaagaattg

SEQ ID NO: 4172857 - DNA, 12 bp, Homo sapiens
tttaaagtctat

SEQ ID NO: 4172858 - DNA, 20 bp, Homo sapiens
tttaaatacgcactacatgt

SEQ ID NO: 4172859 - DNA, 21 bp, Homo sapiens
tttaaatcaggcccaatatca

SEQ ID NO: 4172860 - DNA, 20 bp, Homo sapiens
tttaaatgatgattccttga

SEQ ID NO: 4172861 - DNA, 19 bp, Homo sapiens
tttaaattataagatgtca

SEQ ID NO: 4172862 - DNA, 20 bp, Homo sapiens
tttaaatttttgtgaaccaa

SEQ ID NO: 4172863 - DNA, 16 bp, Homo sapiens
tttaacaatctaacaa

SEQ ID NO: 4172864 - DNA, 23 bp, Homo sapiens
tttaacaatttcctttatattta

SEQ ID NO: 4172865 - DNA, 13 bp, Homo sapiens
tttaacttaaata

SEQ ID NO: 4172866 - DNA, 15 bp, Homo sapiens
tttaagcttgaagat

SEQ ID NO: 4172867 - DNA, 14 bp, Homo sapiens
tttaataaatttat

SEQ ID NO: 4172868 - DNA, 13 bp, Homo sapiens
tttaataaggaaa

SEQ ID NO: 4172869 - DNA, 16 bp, Homo sapiens
tttaatcttatgctta

SEQ ID NO: 4172870 - DNA, 20 bp, Homo sapiens
tttaatgtatagtaaatcac

SEQ ID NO: 4172871 - DNA, 17 bp, Homo sapiens
tttaatgtgtattgaag

SEQ ID NO: 4172872 - DNA, 17 bp, Homo sapiens
tttaatttatatttgaa

SEQ ID NO: 4172873 - DNA, 16 bp, Homo sapiens
tttaatttgatacaaa

SEQ ID NO: 4172874 - DNA, 15 bp, Homo sapiens
tttacactctctgta

SEQ ID NO: 4172875 - DNA, 18 bp, Homo sapiens
tttacactctctgtacaa

SEQ ID NO: 4172876 - DNA, 19 bp, Homo sapiens
tttacagtgaatttctgat

SEQ ID NO: 4172877 - DNA, 18 bp, Homo sapiens
tttacatagttcttacta

SEQ ID NO: 4172878 - DNA, 18 bp, Homo sapiens
tttacccaaaaactaaat

SEQ ID NO: 4172879 - DNA, 19 bp, Homo sapiens
tttacctaccaccttccct

SEQ ID NO: 4172880 - DNA, 13 bp, Homo sapiens
tttactaaaagaa

SEQ ID NO: 4172881 - DNA, 24 bp, Homo sapiens
tttactaaagagacatatttatca

SEQ ID NO: 4172882 - DNA, 21 bp, Homo sapiens
tttactccagtggtgaagaaa

SEQ ID NO: 4172883 - DNA, 15 bp, Homo sapiens
tttagaaaactttaa

SEQ ID NO: 4172884 - DNA, 16 bp, Homo sapiens
tttagacactgggaga

SEQ ID NO: 4172885 - DNA, 16 bp, Homo sapiens
tttagctctgttcttt

SEQ ID NO: 4172886 - DNA, 19 bp, Homo sapiens
tttaggcagggatttgagg

SEQ ID NO: 4172887 - DNA, 17 bp, Homo sapiens
tttaggggaagtatgtg

SEQ ID NO: 4172888 - DNA, 21 bp, Homo sapiens
tttagtaaatcctattatgtg

SEQ ID NO: 4172889 - DNA, 21 bp, Homo sapiens
tttagtagcagtgattgtctt

SEQ ID NO: 4172890 - DNA, 21 bp, Homo sapiens
tttataaatatgtgaaaatga

SEQ ID NO: 4172891 - DNA, 17 bp, Homo sapiens
tttatagctattactgt

SEQ ID NO: 4172892 - DNA, 20 bp, Homo sapiens
tttatagctattactgtctg

SEQ ID NO: 4172893 - DNA, 12 bp, Homo sapiens
tttatatatttg

SEQ ID NO: 4172894 - DNA, 16 bp, Homo sapiens
tttatattctataact

SEQ ID NO: 4172895 - DNA, 13 bp, Homo sapiens
tttatatttggaa

SEQ ID NO: 4172896 - DNA, 17 bp, Homo sapiens
tgcccggattctgggag

SEQ ID NO: 4172897 - DNA, 14 bp, Homo sapiens
tgccctccctgctg

SEQ ID NO: 4172898 - DNA, 22 bp, Homo sapiens
tgccctccctgctgccaggctc

SEQ ID NO: 4172899 - DNA, 19 bp, Homo sapiens
tgccctgccacctgtctgt

SEQ ID NO: 4172900 - DNA, 20 bp, Homo sapiens
tgccctgccacctgtctgtc

SEQ ID NO: 4172901 - DNA, 22 bp, Homo sapiens
tgccctgccacctgtctgtctg

SEQ ID NO: 4172902 - DNA, 14 bp, Homo sapiens
tgccctgccctgcc

SEQ ID NO: 4172903 - DNA, 15 bp, Homo sapiens
tgccctgccctgcca

SEQ ID NO: 4172904 - DNA, 23 bp, Homo sapiens
tgccctgctgccgcctcccagcc

SEQ ID NO: 4172905 - DNA, 11 bp, Homo sapiens
tgccctgggtc

SEQ ID NO: 4172906 - DNA, 20 bp, Homo sapiens
tgccctgggtcacctagctg

SEQ ID NO: 4172907 - DNA, 15 bp, Homo sapiens
tgcccttcataccct

SEQ ID NO: 4172908 - DNA, 22 bp, Homo sapiens
tgccctttggggttgcccagcc

SEQ ID NO: 4172909 - DNA, 21 bp, Homo sapiens
tgcccttttcatctccagtgt

SEQ ID NO: 4172910 - DNA, 23 bp, Homo sapiens
tgcccttttcatctccagtgtga

SEQ ID NO: 4172911 - DNA, 15 bp, Homo sapiens
tgccgacgtccccaa

SEQ ID NO: 4172912 - DNA, 19 bp, Homo sapiens
tgccgccccgtgcctgtac

SEQ ID NO: 4172913 - DNA, 19 bp, Homo sapiens
tgccgccgtctctgtcccg

SEQ ID NO: 4172914 - DNA, 17 bp, Homo sapiens
tgccgcctcccagcctg

SEQ ID NO: 4172915 - DNA, 17 bp, Homo sapiens
tgccggttaaattccat

SEQ ID NO: 4172916 - DNA, 15 bp, Homo sapiens
tgcctagactgttac

SEQ ID NO: 4172917 - DNA, 16 bp, Homo sapiens
tgcctatccatcctgc

SEQ ID NO: 4172918 - DNA, 17 bp, Homo sapiens
tgcctatccatcctgcg

SEQ ID NO: 4172919 - DNA, 19 bp, Homo sapiens
tgcctcaatgtgaccaggg

SEQ ID NO: 4172920 - DNA, 19 bp, Homo sapiens
tgcctctctgctccagaga

SEQ ID NO: 4172921 - DNA, 12 bp, Homo sapiens
tgcctctgctac

SEQ ID NO: 4172922 - DNA, 18 bp, Homo sapiens
tgcctctgtcttctggac

SEQ ID NO: 4172923 - DNA, 19 bp, Homo sapiens
tgcctcttaaattatatat

SEQ ID NO: 4172924 - DNA, 15 bp, Homo sapiens
tgcctgcagagagaa

SEQ ID NO: 4172925 - DNA, 16 bp, Homo sapiens
tgcctgcagagagaag

SEQ ID NO: 4172926 - DNA, 17 bp, Homo sapiens
tgcctgccctggaggga

SEQ ID NO: 4172927 - DNA, 21 bp, Homo sapiens
tgcctgcctgtggagacagcc

SEQ ID NO: 4172928 - DNA, 21 bp, Homo sapiens
tgcctggaggatccctccatc

SEQ ID NO: 4172929 - DNA, 12 bp, Homo sapiens
tgcctggccccc

SEQ ID NO: 4172930 - DNA, 16 bp, Homo sapiens
tgcctggcccccctcc

SEQ ID NO: 4172931 - DNA, 18 bp, Homo sapiens
tgcctggcccccctccag

SEQ ID NO: 4172932 - DNA, 13 bp, Homo sapiens
tgcctggcttgct

SEQ ID NO: 4172933 - DNA, 18 bp, Homo sapiens
tgcctggcttgctgtggc

SEQ ID NO: 4172934 - DNA, 20 bp, Homo sapiens
tgcctgtagctttcctggtc

SEQ ID NO: 4172935 - DNA, 13 bp, Homo sapiens
tgcctgtagttag

SEQ ID NO: 4172936 - DNA, 16 bp, Homo sapiens
tgcctgtagttaggaa

SEQ ID NO: 4172937 - DNA, 23 bp, Homo sapiens
tgcctgtagttaggaaataaaac

SEQ ID NO: 4172938 - DNA, 23 bp, Homo sapiens
tgcctgtgcatgacctgatcatt

SEQ ID NO: 4172939 - DNA, 19 bp, Homo sapiens
tgccttaaaaatcaagaca

SEQ ID NO: 4172940 - DNA, 15 bp, Homo sapiens
tgccttaaagaaagt

SEQ ID NO: 4172941 - DNA, 20 bp, Homo sapiens
tgccttaggctgctgggaga

SEQ ID NO: 4172942 - DNA, 17 bp, Homo sapiens
tgccttcctcgtgcaga

SEQ ID NO: 4172943 - DNA, 22 bp, Homo sapiens
tgccttcctcgtgcagagctgg

SEQ ID NO: 4172944 - DNA, 23 bp, Homo sapiens
tgcctttctcgtggtagaagcca

SEQ ID NO: 4172945 - DNA, 18 bp, Homo sapiens
tgcctttctctggctcca

SEQ ID NO: 4172946 - DNA, 19 bp, Homo sapiens
tgcctttctctggctccag

SEQ ID NO: 4172947 - DNA, 16 bp, Homo sapiens
tgccttttttcacagc

SEQ ID NO: 4172948 - DNA, 22 bp, Homo sapiens
tgcgaaacaacttgtgttctat

SEQ ID NO: 4172949 - DNA, 16 bp, Homo sapiens
tgcgaaggggccctgg

SEQ ID NO: 4172950 - DNA, 18 bp, Homo sapiens
tgcgatcttcagagcagg

SEQ ID NO: 4172951 - DNA, 17 bp, Homo sapiens
tgcgggagctctgtatg

SEQ ID NO: 4172952 - DNA, 19 bp, Homo sapiens
tgcgggatggtcctggggc

SEQ ID NO: 4172953 - DNA, 18 bp, Homo sapiens
tgcgggggagctggaaat

SEQ ID NO: 4172954 - DNA, 21 bp, Homo sapiens
tgcggtggctcacgcctgtaa

SEQ ID NO: 4172955 - DNA, 19 bp, Homo sapiens
tgcgtgactattttttaat

SEQ ID NO: 4172956 - DNA, 12 bp, Homo sapiens
tgcgtgtgtgca

SEQ ID NO: 4172957 - DNA, 13 bp, Homo sapiens
tgctaagagaagt

SEQ ID NO: 4172958 - DNA, 17 bp, Homo sapiens
tgctaggcgagtgccag

SEQ ID NO: 4172959 - DNA, 22 bp, Homo sapiens
tgctaggcgagtgccaggactc

SEQ ID NO: 4172960 - DNA, 12 bp, Homo sapiens
tgctagggcccc

SEQ ID NO: 4172961 - DNA, 23 bp, Homo sapiens
tgctatagatttgtattttaaaa

SEQ ID NO: 4172962 - DNA, 23 bp, Homo sapiens
tgctataggctggagaagctcac

SEQ ID NO: 4172963 - DNA, 16 bp, Homo sapiens
tgctatattttcatga

SEQ ID NO: 4172964 - DNA, 18 bp, Homo sapiens
tgctatattttcatgact

SEQ ID NO: 4172965 - DNA, 14 bp, Homo sapiens
tgctatggttttct

SEQ ID NO: 4172966 - DNA, 15 bp, Homo sapiens
tgctattacatgtgt

SEQ ID NO: 4172967 - DNA, 13 bp, Homo sapiens
tgctcacagtctc

SEQ ID NO: 4172968 - DNA, 12 bp, Homo sapiens
tgctctcccctg

SEQ ID NO: 4172969 - DNA, 19 bp, Homo sapiens
tgctctcctaccccacctc

SEQ ID NO: 4172970 - DNA, 19 bp, Homo sapiens
tgctctggaaaatgtgacc

SEQ ID NO: 4172971 - DNA, 14 bp, Homo sapiens
tgctgaagaggcaa

SEQ ID NO: 4172972 - DNA, 19 bp, Homo sapiens
tgctgacatggctttgctt

SEQ ID NO: 4172973 - DNA, 23 bp, Homo sapiens
tgctgacatggctttgctttgtg

SEQ ID NO: 4172974 - DNA, 20 bp, Homo sapiens
tgctgagatacatacagaat

SEQ ID NO: 4172975 - DNA, 16 bp, Homo sapiens
tgctgagcagcccagc

SEQ ID NO: 4172976 - DNA, 11 bp, Homo sapiens
tgctgccctgc

SEQ ID NO: 4172977 - DNA, 11 bp, Homo sapiens
tgctgcttctc

SEQ ID NO: 4172978 - DNA, 19 bp, Homo sapiens
tgctgcttctcctcccagc

SEQ ID NO: 4172979 - DNA, 21 bp, Homo sapiens
tgctggcctcccaataaagct

SEQ ID NO: 4172980 - DNA, 22 bp, Homo sapiens
tgctggcctcccaataaagctg

SEQ ID NO: 4172981 - DNA, 18 bp, Homo sapiens
tgctggctgacctgggcc

SEQ ID NO: 4172982 - DNA, 16 bp, Homo sapiens
tgctgggaacacagcc

SEQ ID NO: 4172983 - DNA, 16 bp, Homo sapiens
tgctgggtaaactgtg

SEQ ID NO: 4172984 - DNA, 17 bp, Homo sapiens
tgctgtaacctgaagtc

SEQ ID NO: 4172985 - DNA, 21 bp, Homo sapiens
tgctgtaactcagacattcca

SEQ ID NO: 4172986 - DNA, 22 bp, Homo sapiens
tgctgtaactcagacattccaa

SEQ ID NO: 4172987 - DNA, 22 bp, Homo sapiens
tgctgtagctaggtatcttact

SEQ ID NO: 4172988 - DNA, 19 bp, Homo sapiens
tgctgtcactggcagagca

SEQ ID NO: 4172989 - DNA, 20 bp, Homo sapiens
tgctgtcactggcagagcac

SEQ ID NO: 4172990 - DNA, 16 bp, Homo sapiens
tgctgtcctaggccac

SEQ ID NO: 4172991 - DNA, 23 bp, Homo sapiens
tgctgtcctaggccacaccatct

SEQ ID NO: 4172992 - DNA, 18 bp, Homo sapiens
tgctgtgctgtgctatgg

SEQ ID NO: 4172993 - DNA, 23 bp, Homo sapiens
tgctgtggccagggtgagagctg

SEQ ID NO: 4172994 - DNA, 12 bp, Homo sapiens
tgctgtggcctg

SEQ ID NO: 4172995 - DNA, 14 bp, Homo sapiens
tgctgtggcctggg

SEQ ID NO: 4172996 - DNA, 16 bp, Homo sapiens
tgctgtggcctgggca

SEQ ID NO: 4172997 - DNA, 14 bp, Homo sapiens
tgctgtggctatgg

SEQ ID NO: 4172998 - DNA, 17 bp, Homo sapiens
tgctgtttcaaaaataa

SEQ ID NO: 4172999 - DNA, 23 bp, Homo sapiens
tgcttacaatggagtctgcagtg

SEQ ID NO: 4173000 - DNA, 18 bp, Homo sapiens
tgcttactaatgtgcccc

SEQ ID NO: 4173001 - DNA, 18 bp, Homo sapiens
tgcttagcctcctgacct

SEQ ID NO: 4173002 - DNA, 19 bp, Homo sapiens
tgcttagcctcctgacctg

SEQ ID NO: 4173003 - DNA, 14 bp, Homo sapiens
tgcttaggatgttt

SEQ ID NO: 4173004 - DNA, 23 bp, Homo sapiens
tgcttaggatgtttttcatgaaa

SEQ ID NO: 4173005 - DNA, 18 bp, Homo sapiens
tgcttcaaaccctcaaga

SEQ ID NO: 4173006 - DNA, 19 bp, Homo sapiens
tgcttcaaatccatccaga

SEQ ID NO: 4173007 - DNA, 17 bp, Homo sapiens
tgcttcagcctgaggct

SEQ ID NO: 4173008 - DNA, 23 bp, Homo sapiens
tgcttcagcctgaggctgagact

SEQ ID NO: 4173009 - DNA, 17 bp, Homo sapiens
tgcttcatgctcagccc

SEQ ID NO: 4173010 - DNA, 20 bp, Homo sapiens
tgcttccctaggctgagctg

SEQ ID NO: 4173011 - DNA, 18 bp, Homo sapiens
tgcttctgcagcaactcc

SEQ ID NO: 4173012 - DNA, 20 bp, Homo sapiens
tgcttctgcagcaactccca

SEQ ID NO: 4173013 - DNA, 18 bp, Homo sapiens
tgcttcttcatcttgaca

SEQ ID NO: 4173014 - DNA, 13 bp, Homo sapiens
tgcttgatagaaa

SEQ ID NO: 4173015 - DNA, 22 bp, Homo sapiens
tgcttgctggtactaagaggct

SEQ ID NO: 4173016 - DNA, 15 bp, Homo sapiens
tgcttggagctgagc

SEQ ID NO: 4173017 - DNA, 17 bp, Homo sapiens
tgcttggagctgagcaa

SEQ ID NO: 4173018 - DNA, 12 bp, Homo sapiens
tgcttggcagag

SEQ ID NO: 4173019 - DNA, 16 bp, Homo sapiens
tgctttgaaacagaaa

SEQ ID NO: 4173020 - DNA, 15 bp, Homo sapiens
tggaaaaagaaagaa

SEQ ID NO: 4173021 - DNA, 16 bp, Homo sapiens
tggaaaaagaaagaaa

SEQ ID NO: 4173022 - DNA, 22 bp, Homo sapiens
tggaaaagaatccctgcagcct

SEQ ID NO: 4173023 - DNA, 19 bp, Homo sapiens
tggaaaccaaataggcttt

SEQ ID NO: 4173024 - DNA, 19 bp, Homo sapiens
tggaaaccacacttcttga

SEQ ID NO: 4173025 - DNA, 10 bp, Homo sapiens
tggaaagaga

SEQ ID NO: 4173026 - DNA, 19 bp, Homo sapiens
tggaaagcatcacctcagg

SEQ ID NO: 4173027 - DNA, 12 bp, Homo sapiens
tggaaagcctct

SEQ ID NO: 4173028 - DNA, 14 bp, Homo sapiens
tggaaagcctctgc

SEQ ID NO: 4173029 - DNA, 23 bp, Homo sapiens
tggaaaggctcagtctcaggagc

SEQ ID NO: 4173030 - DNA, 23 bp, Homo sapiens
tggaaaggtttcaagacttgata

SEQ ID NO: 4173031 - DNA, 17 bp, Homo sapiens
tggaaagttcagccaga

SEQ ID NO: 4173032 - DNA, 21 bp, Homo sapiens
tggaaataaacctggagatga

SEQ ID NO: 4173033 - DNA, 22 bp, Homo sapiens
tggaaataaacctggagatgat

SEQ ID NO: 4173034 - DNA, 18 bp, Homo sapiens
tgatgaatgacaacattg

SEQ ID NO: 4173035 - DNA, 15 bp, Homo sapiens
tgatgattattattt

SEQ ID NO: 4173036 - DNA, 14 bp, Homo sapiens
tgatgccaaaaaaa

SEQ ID NO: 4173037 - DNA, 18 bp, Homo sapiens
tgatgccaaaaaaaaata

SEQ ID NO: 4173038 - DNA, 16 bp, Homo sapiens
tgatgcccagataata

SEQ ID NO: 4173039 - DNA, 14 bp, Homo sapiens
tgatgcctctgtct

SEQ ID NO: 4173040 - DNA, 14 bp, Homo sapiens
tgatggagaaggaa

SEQ ID NO: 4173041 - DNA, 15 bp, Homo sapiens
tgatggagaaggaag

SEQ ID NO: 4173042 - DNA, 13 bp, Homo sapiens
tgatgtcagcctt

SEQ ID NO: 4173043 - DNA, 18 bp, Homo sapiens
tgatgtcagccttgcatc

SEQ ID NO: 4173044 - DNA, 12 bp, Homo sapiens
tgatgttaaaaa

SEQ ID NO: 4173045 - DNA, 14 bp, Homo sapiens
tgatgttaaaaaaa

SEQ ID NO: 4173046 - DNA, 23 bp, Homo sapiens
tgatgttaaaaaaataagaagaa

SEQ ID NO: 4173047 - DNA, 17 bp, Homo sapiens
tgatgttgtgttgttat

SEQ ID NO: 4173048 - DNA, 16 bp, Homo sapiens
tgattaacaaataaat

SEQ ID NO: 4173049 - DNA, 19 bp, Homo sapiens
tgattaacaaataaattgg

SEQ ID NO: 4173050 - DNA, 14 bp, Homo sapiens
tgattacagtgcag

SEQ ID NO: 4173051 - DNA, 16 bp, Homo sapiens
tgattacagtgcagtg

SEQ ID NO: 4173052 - DNA, 11 bp, Homo sapiens
tgattagatga

SEQ ID NO: 4173053 - DNA, 15 bp, Homo sapiens
tgattctcctgtcag

SEQ ID NO: 4173054 - DNA, 12 bp, Homo sapiens
tgattggctcac

SEQ ID NO: 4173055 - DNA, 16 bp, Homo sapiens
tgattgtataatgtga

SEQ ID NO: 4173056 - DNA, 18 bp, Homo sapiens
tgattgtcttaatattgt

SEQ ID NO: 4173057 - DNA, 16 bp, Homo sapiens
tgatttaacactatcc

SEQ ID NO: 4173058 - DNA, 14 bp, Homo sapiens
tgatttaatccaga

SEQ ID NO: 4173059 - DNA, 18 bp, Homo sapiens
tgatttaatccagatctg

SEQ ID NO: 4173060 - DNA, 21 bp, Homo sapiens
tgatttcagactgcagagggg

SEQ ID NO: 4173061 - DNA, 23 bp, Homo sapiens
tgatttcaggatactctgtcaga

SEQ ID NO: 4173062 - DNA, 20 bp, Homo sapiens
tgatttggaagagaggcacc

SEQ ID NO: 4173063 - DNA, 23 bp, Homo sapiens
tgattttgagcaaaccacataat

SEQ ID NO: 4173064 - DNA, 20 bp, Homo sapiens
tgatttttagatgagattgt

SEQ ID NO: 4173065 - DNA, 13 bp, Homo sapiens
tgatttttgctat

SEQ ID NO: 4173066 - DNA, 12 bp, Homo sapiens
tgcaaaaatgag

SEQ ID NO: 4173067 - DNA, 23 bp, Homo sapiens
tgcaaaagactaatttaaaaaat

SEQ ID NO: 4173068 - DNA, 19 bp, Homo sapiens
tgcaaaatggaaatgtaat

SEQ ID NO: 4173069 - DNA, 22 bp, Homo sapiens
tgcaaaatggaaatgtaataat

SEQ ID NO: 4173070 - DNA, 13 bp, Homo sapiens
tgcaaacctcaga

SEQ ID NO: 4173071 - DNA, 13 bp, Homo sapiens
tgcaaatttcaaa

SEQ ID NO: 4173072 - DNA, 18 bp, Homo sapiens
tgcaagagactctggcct

SEQ ID NO: 4173073 - DNA, 13 bp, Homo sapiens
tgcaagcacaaat

SEQ ID NO: 4173074 - DNA, 20 bp, Homo sapiens
tgcaagcagggctctgcccc

SEQ ID NO: 4173075 - DNA, 19 bp, Homo sapiens
tgcaatataaaaatgtgaa

SEQ ID NO: 4173076 - DNA, 16 bp, Homo sapiens
tgcaatctccagggct

SEQ ID NO: 4173077 - DNA, 22 bp, Homo sapiens
tgcaatctccagggctgcccct

SEQ ID NO: 4173078 - DNA, 18 bp, Homo sapiens
tgcaattggggaagaaaa

SEQ ID NO: 4173079 - DNA, 14 bp, Homo sapiens
tgcaatttattaaa

SEQ ID NO: 4173080 - DNA, 15 bp, Homo sapiens
tgcaatttattaaaa

SEQ ID NO: 4173081 - DNA, 22 bp, Homo sapiens
tgcaatttattaaaatgattgt

SEQ ID NO: 4173082 - DNA, 13 bp, Homo sapiens
tgcacactgttgg

SEQ ID NO: 4173083 - DNA, 14 bp, Homo sapiens
tgcacacttgtata

SEQ ID NO: 4173084 - DNA, 23 bp, Homo sapiens
tgcacagcgcgggcggaggcggc

SEQ ID NO: 4173085 - DNA, 14 bp, Homo sapiens
tgcaccctccgcct

SEQ ID NO: 4173086 - DNA, 13 bp, Homo sapiens
tgcaccttaccaa

SEQ ID NO: 4173087 - DNA, 18 bp, Homo sapiens
tgcactaaagtatgtaaa

SEQ ID NO: 4173088 - DNA, 15 bp, Homo sapiens
tgcactacacttttg

SEQ ID NO: 4173089 - DNA, 15 bp, Homo sapiens
tgcactatctttcag

SEQ ID NO: 4173090 - DNA, 15 bp, Homo sapiens
tgcactcagcttttt

SEQ ID NO: 4173091 - DNA, 12 bp, Homo sapiens
tgcactccagcc

SEQ ID NO: 4173092 - DNA, 19 bp, Homo sapiens
tgcactccagcctgggcga

SEQ ID NO: 4173093 - DNA, 18 bp, Homo sapiens
tgcactgacaagatggaa

SEQ ID NO: 4173094 - DNA, 16 bp, Homo sapiens
tgcactggccccaccc

SEQ ID NO: 4173095 - DNA, 18 bp, Homo sapiens
tgcagaagcagtgtttct

SEQ ID NO: 4173096 - DNA, 15 bp, Homo sapiens
tgcagaagtgcatga

SEQ ID NO: 4173097 - DNA, 13 bp, Homo sapiens
tgcagacaggaat

SEQ ID NO: 4173098 - DNA, 15 bp, Homo sapiens
tgcagacaggaatct

SEQ ID NO: 4173099 - DNA, 18 bp, Homo sapiens
tgcagaggacagagctgg

SEQ ID NO: 4173100 - DNA, 15 bp, Homo sapiens
tgcagaggggaaaga

SEQ ID NO: 4173101 - DNA, 18 bp, Homo sapiens
tgcagaggggaaagactt

SEQ ID NO: 4173102 - DNA, 14 bp, Homo sapiens
tgcagcaactccca

SEQ ID NO: 4173103 - DNA, 17 bp, Homo sapiens
tgcagcaactcccacga

SEQ ID NO: 4173104 - DNA, 13 bp, Homo sapiens
tgcagcagaggac

SEQ ID NO: 4173105 - DNA, 22 bp, Homo sapiens
tgcagcagaggacagtctggag

SEQ ID NO: 4173106 - DNA, 23 bp, Homo sapiens
tgcagcagaggacagtctggaga

SEQ ID NO: 4173107 - DNA, 21 bp, Homo sapiens
tgcagccccgcgcctccttcc

SEQ ID NO: 4173108 - DNA, 16 bp, Homo sapiens
tgcaggcaccttagtg

SEQ ID NO: 4173109 - DNA, 16 bp, Homo sapiens
tgcaggcccagcagac

SEQ ID NO: 4173110 - DNA, 24 bp, Homo sapiens
tgcagggaggaggtggcagccctg

SEQ ID NO: 4173111 - DNA, 13 bp, Homo sapiens
tgcagggctgctg

SEQ ID NO: 4173112 - DNA, 22 bp, Homo sapiens
tgcagggctgctgtggcccagt

SEQ ID NO: 4173113 - DNA, 23 bp, Homo sapiens
tgcaggggtcagtgcagcagagg

SEQ ID NO: 4173114 - DNA, 19 bp, Homo sapiens
tgcaggtattttaactgtg

SEQ ID NO: 4173115 - DNA, 20 bp, Homo sapiens
tgcaggtattttaactgtgt

SEQ ID NO: 4173116 - DNA, 14 bp, Homo sapiens
tgcagtatctcttg

SEQ ID NO: 4173117 - DNA, 14 bp, Homo sapiens
tgcagttgagaggg

SEQ ID NO: 4173118 - DNA, 18 bp, Homo sapiens
tgcataagattaaaggaa

SEQ ID NO: 4173119 - DNA, 21 bp, Homo sapiens
tgcataagattaaaggaagga

SEQ ID NO: 4173120 - DNA, 23 bp, Homo sapiens
tgcataagattaaaggaaggaaa

SEQ ID NO: 4173121 - DNA, 16 bp, Homo sapiens
tgcatatatactacat

SEQ ID NO: 4173122 - DNA, 20 bp, Homo sapiens
tgcatctgggattcccacca

SEQ ID NO: 4173123 - DNA, 13 bp, Homo sapiens
tgcatgaacaggg

SEQ ID NO: 4173124 - DNA, 15 bp, Homo sapiens
tgcatgcgcaggctc

SEQ ID NO: 4173125 - DNA, 16 bp, Homo sapiens
tgcatgtatgtgtgtg

SEQ ID NO: 4173126 - DNA, 14 bp, Homo sapiens
tgcatttgttacag

SEQ ID NO: 4173127 - DNA, 19 bp, Homo sapiens
tgccaaaataccagagcct

SEQ ID NO: 4173128 - DNA, 21 bp, Homo sapiens
tgccaaaataccagagccttc

SEQ ID NO: 4173129 - DNA, 13 bp, Homo sapiens
tgccaaacagagt

SEQ ID NO: 4173130 - DNA, 20 bp, Homo sapiens
tgccaaagcaaaagaagtaa

SEQ ID NO: 4173131 - DNA, 15 bp, Homo sapiens
tgccaagtctcagaa

SEQ ID NO: 4173132 - DNA, 17 bp, Homo sapiens
tgccaagtctcagaaga

SEQ ID NO: 4173133 - DNA, 15 bp, Homo sapiens
tgccaagtggccctc

SEQ ID NO: 4173134 - DNA, 23 bp, Homo sapiens
tgccaattgctaccgagaaggtt

SEQ ID NO: 4173135 - DNA, 18 bp, Homo sapiens
tgccacaccaatcagaga

SEQ ID NO: 4173136 - DNA, 20 bp, Homo sapiens
tgccacaccaatcagagagc

SEQ ID NO: 4173137 - DNA, 21 bp, Homo sapiens
tgccacaccaatcagagagcc

SEQ ID NO: 4173138 - DNA, 22 bp, Homo sapiens
tgccacaccaatcagagagcct

SEQ ID NO: 4173139 - DNA, 23 bp, Homo sapiens
tgccacaccaatcagagagccta

SEQ ID NO: 4173140 - DNA, 13 bp, Homo sapiens
tgccacaccccat

SEQ ID NO: 4173141 - DNA, 14 bp, Homo sapiens
tgccacagagaaga

SEQ ID NO: 4173142 - DNA, 20 bp, Homo sapiens
tgccacccagcaacacagag

SEQ ID NO: 4173143 - DNA, 10 bp, Homo sapiens
tgccacctgt

SEQ ID NO: 4173144 - DNA, 13 bp, Homo sapiens
tgccacctgtctg

SEQ ID NO: 4173145 - DNA, 23 bp, Homo sapiens
tgccactgcgggagctctgtatg

SEQ ID NO: 4173146 - DNA, 12 bp, Homo sapiens
tgccagcctggc

SEQ ID NO: 4173147 - DNA, 16 bp, Homo sapiens
tgccagcctggcttct

SEQ ID NO: 4173148 - DNA, 22 bp, Homo sapiens
tgccaggactccccaggccagg

SEQ ID NO: 4173149 - DNA, 16 bp, Homo sapiens
tgccaggctgtaagca

SEQ ID NO: 4173150 - DNA, 20 bp, Homo sapiens
tgccatagagtttaacacaa

SEQ ID NO: 4173151 - DNA, 17 bp, Homo sapiens
tgccatgatgcctctgt

SEQ ID NO: 4173152 - DNA, 19 bp, Homo sapiens
tgccatgatgcctctgtct

SEQ ID NO: 4173153 - DNA, 14 bp, Homo sapiens
tgccattctccagt

SEQ ID NO: 4173154 - DNA, 13 bp, Homo sapiens
tgccattcttctg

SEQ ID NO: 4173155 - DNA, 17 bp, Homo sapiens
tgccattgggaccctcc

SEQ ID NO: 4173156 - DNA, 16 bp, Homo sapiens
tgccatttgcaccctc

SEQ ID NO: 4173157 - DNA, 19 bp, Homo sapiens
tgccatttgcaccctccgc

SEQ ID NO: 4173158 - DNA, 19 bp, Homo sapiens
tgcccagagggcccaggca

SEQ ID NO: 4173159 - DNA, 20 bp, Homo sapiens
tgcccagagggcccaggcag

SEQ ID NO: 4173160 - DNA, 21 bp, Homo sapiens
tgcccagagggcccaggcagg

SEQ ID NO: 4173161 - DNA, 15 bp, Homo sapiens
tgcccaggcactgca

SEQ ID NO: 4173162 - DNA, 16 bp, Homo sapiens
tgcccagtctggaaga

SEQ ID NO: 4173163 - DNA, 22 bp, Homo sapiens
tgcccagtctggaagaagagga

SEQ ID NO: 4173164 - DNA, 21 bp, Homo sapiens
tgcccagttattcttaagtaa

SEQ ID NO: 4173165 - DNA, 16 bp, Homo sapiens
tgccccagaggcctct

SEQ ID NO: 4173166 - DNA, 16 bp, Homo sapiens
tgccccagctctggct

SEQ ID NO: 4173167 - DNA, 13 bp, Homo sapiens
tgccccctggtgg

SEQ ID NO: 4173168 - DNA, 13 bp, Homo sapiens
tgccccgcccagc

SEQ ID NO: 4173169 - DNA, 17 bp, Homo sapiens
tgcccctccccagccct

SEQ ID NO: 4173170 - DNA, 13 bp, Homo sapiens
tgcccctgcacct

SEQ ID NO: 4173171 - DNA, 20 bp, Homo sapiens
tgccccttgacaactggcag

SEQ ID NO: 4173172 - DNA, 19 bp, Homo sapiens
tgcccgcagagcccacgcc

SEQ ID NO: 4173173 - DNA, 15 bp, Homo sapiens
tgcccggattctggg

SEQ ID NO: 4173174 - DNA, 16 bp, Homo sapiens
tgacaagataaaggaa

SEQ ID NO: 4173175 - DNA, 19 bp, Homo sapiens
tgacaagatggaaaataaa

SEQ ID NO: 4173176 - DNA, 15 bp, Homo sapiens
tgacaagcactgcta

SEQ ID NO: 4173177 - DNA, 19 bp, Homo sapiens
tgacaatagaagaaataat

SEQ ID NO: 4173178 - DNA, 23 bp, Homo sapiens
tgacaatcctgaagaaaccacag

SEQ ID NO: 4173179 - DNA, 13 bp, Homo sapiens
tgacacaaacaca

SEQ ID NO: 4173180 - DNA, 20 bp, Homo sapiens
tgacacaaattgaagcatgt

SEQ ID NO: 4173181 - DNA, 18 bp, Homo sapiens
tgacactgtctgctgccc

SEQ ID NO: 4173182 - DNA, 18 bp, Homo sapiens
tgacagaatgctgtttta

SEQ ID NO: 4173183 - DNA, 14 bp, Homo sapiens
tgacagactctcgt

SEQ ID NO: 4173184 - DNA, 14 bp, Homo sapiens
tgacagtggtgggc

SEQ ID NO: 4173185 - DNA, 14 bp, Homo sapiens
tgacatgtgcctgt

SEQ ID NO: 4173186 - DNA, 18 bp, Homo sapiens
tgacatgttatatatttt

SEQ ID NO: 4173187 - DNA, 16 bp, Homo sapiens
tgacattgcctcaggc

SEQ ID NO: 4173188 - DNA, 19 bp, Homo sapiens
tgacatttgacagtgtggg

SEQ ID NO: 4173189 - DNA, 16 bp, Homo sapiens
tgaccaaattgggaga

SEQ ID NO: 4173190 - DNA, 22 bp, Homo sapiens
tgaccaggggtgatttcagaga

SEQ ID NO: 4173191 - DNA, 19 bp, Homo sapiens
tgaccccaaagagcctgga

SEQ ID NO: 4173192 - DNA, 16 bp, Homo sapiens
tgacccctttccccca

SEQ ID NO: 4173193 - DNA, 18 bp, Homo sapiens
tgacccctttcccccacc

SEQ ID NO: 4173194 - DNA, 22 bp, Homo sapiens
tgaccctctgaatggtccaggg

SEQ ID NO: 4173195 - DNA, 23 bp, Homo sapiens
tgaccctctgaatggtccagggt

SEQ ID NO: 4173196 - DNA, 17 bp, Homo sapiens
tgaccctgagctgacca

SEQ ID NO: 4173197 - DNA, 11 bp, Homo sapiens
tgacctgcagg

SEQ ID NO: 4173198 - DNA, 20 bp, Homo sapiens
tgacctgcaggccaagagca

SEQ ID NO: 4173199 - DNA, 19 bp, Homo sapiens
tgacctgccccgcccagct

SEQ ID NO: 4173200 - DNA, 12 bp, Homo sapiens
tgacctgggccc

SEQ ID NO: 4173201 - DNA, 13 bp, Homo sapiens
tgacctgggccca

SEQ ID NO: 4173202 - DNA, 20 bp, Homo sapiens
tgacggaagccaacttggct

SEQ ID NO: 4173203 - DNA, 21 bp, Homo sapiens
tgacggtcccacactggtgac

SEQ ID NO: 4173204 - DNA, 23 bp, Homo sapiens
tgacggtcccacactggtgactg

SEQ ID NO: 4173205 - DNA, 20 bp, Homo sapiens
tgacggtcctttaggcagcc

SEQ ID NO: 4173206 - DNA, 21 bp, Homo sapiens
tgacggtcctttaggcagcct

SEQ ID NO: 4173207 - DNA, 22 bp, Homo sapiens
tgacggtcctttaggcagcctg

SEQ ID NO: 4173208 - DNA, 16 bp, Homo sapiens
tgacgtgaccatggtg

SEQ ID NO: 4173209 - DNA, 19 bp, Homo sapiens
tgacgtgcacctgtactca

SEQ ID NO: 4173210 - DNA, 16 bp, Homo sapiens
tgactaatggcatgag

SEQ ID NO: 4173211 - DNA, 17 bp, Homo sapiens
tgactagaccccaccct

SEQ ID NO: 4173212 - DNA, 17 bp, Homo sapiens
tgactagggagccatgt

SEQ ID NO: 4173213 - DNA, 18 bp, Homo sapiens
tgactagggagccatgtt

SEQ ID NO: 4173214 - DNA, 21 bp, Homo sapiens
tgactagggagccatgtttca

SEQ ID NO: 4173215 - DNA, 19 bp, Homo sapiens
tgactattttttaataaaa

SEQ ID NO: 4173216 - DNA, 18 bp, Homo sapiens
tgactcaggagcctccta

SEQ ID NO: 4173217 - DNA, 19 bp, Homo sapiens
tgactcaggagcctcctag

SEQ ID NO: 4173218 - DNA, 21 bp, Homo sapiens
tgactcgagggttgggttcat

SEQ ID NO: 4173219 - DNA, 23 bp, Homo sapiens
tgactgaaaaaaaaaaagaagaa

SEQ ID NO: 4173220 - DNA, 19 bp, Homo sapiens
tgacttactgtttcttacc

SEQ ID NO: 4173221 - DNA, 17 bp, Homo sapiens
tgacttcctggtgaggc

SEQ ID NO: 4173222 - DNA, 14 bp, Homo sapiens
tgacttctcttgaa

SEQ ID NO: 4173223 - DNA, 18 bp, Homo sapiens
tgacttctcttgaattat

SEQ ID NO: 4173224 - DNA, 17 bp, Homo sapiens
tgacttctgctgaagga

SEQ ID NO: 4173225 - DNA, 23 bp, Homo sapiens
tgacttgaaaaatattcatgtag

SEQ ID NO: 4173226 - DNA, 14 bp, Homo sapiens
tgacttgaataaag

SEQ ID NO: 4173227 - DNA, 17 bp, Homo sapiens
tgacttgaataaagtac

SEQ ID NO: 4173228 - DNA, 18 bp, Homo sapiens
tgacttttctggaagaca

SEQ ID NO: 4173229 - DNA, 21 bp, Homo sapiens
tgagaaactttgatctctgct

SEQ ID NO: 4173230 - DNA, 22 bp, Homo sapiens
tgagaaactttgatctctgctt

SEQ ID NO: 4173231 - DNA, 12 bp, Homo sapiens
tgagaacctggg

SEQ ID NO: 4173232 - DNA, 22 bp, Homo sapiens
tgagaagccatgtactcaagta

SEQ ID NO: 4173233 - DNA, 19 bp, Homo sapiens
tgagaagctgggcatgaac

SEQ ID NO: 4173234 - DNA, 15 bp, Homo sapiens
tgagaatagtgtctg

SEQ ID NO: 4173235 - DNA, 15 bp, Homo sapiens
tgagacaggagaatc

SEQ ID NO: 4173236 - DNA, 19 bp, Homo sapiens
tgagaccacctctcaatat

SEQ ID NO: 4173237 - DNA, 12 bp, Homo sapiens
tgagaccctgtc

SEQ ID NO: 4173238 - DNA, 23 bp, Homo sapiens
tgagactgcgggatggtcctggg

SEQ ID NO: 4173239 - DNA, 19 bp, Homo sapiens
tgagagtatattatgtatt

SEQ ID NO: 4173240 - DNA, 15 bp, Homo sapiens
tgagatacatacaga

SEQ ID NO: 4173241 - DNA, 21 bp, Homo sapiens
tgagatacatacagaattact

SEQ ID NO: 4173242 - DNA, 17 bp, Homo sapiens
tgagatcacaccactgc

SEQ ID NO: 4173243 - DNA, 18 bp, Homo sapiens
tgagatcacaccactgca

SEQ ID NO: 4173244 - DNA, 15 bp, Homo sapiens
tgagatccagcacaa

SEQ ID NO: 4173245 - DNA, 15 bp, Homo sapiens
tgagatgctggcttg

SEQ ID NO: 4173246 - DNA, 18 bp, Homo sapiens
tgagatggagtctcactc

SEQ ID NO: 4173247 - DNA, 14 bp, Homo sapiens
tgagcaattctcct

SEQ ID NO: 4173248 - DNA, 13 bp, Homo sapiens
tgagcaccccctc

SEQ ID NO: 4173249 - DNA, 23 bp, Homo sapiens
tgagcaccccctcattcccctcg

SEQ ID NO: 4173250 - DNA, 14 bp, Homo sapiens
tgagcagcccagca

SEQ ID NO: 4173251 - DNA, 19 bp, Homo sapiens
tgagcaggagcagaaagat

SEQ ID NO: 4173252 - DNA, 23 bp, Homo sapiens
tgagcagtgagttacagcgagag

SEQ ID NO: 4173253 - DNA, 14 bp, Homo sapiens
tgagcatcacagaa

SEQ ID NO: 4173254 - DNA, 21 bp, Homo sapiens
tgagctactgccgtcagtgct

SEQ ID NO: 4173255 - DNA, 18 bp, Homo sapiens
tgagcttctattaaatgt

SEQ ID NO: 4173256 - DNA, 20 bp, Homo sapiens
tgagcttggcagctgaacta

SEQ ID NO: 4173257 - DNA, 13 bp, Homo sapiens
tgaggacacatgt

SEQ ID NO: 4173258 - DNA, 16 bp, Homo sapiens
tgaggacacatgtcca

SEQ ID NO: 4173259 - DNA, 14 bp, Homo sapiens
tgaggactgggggc

SEQ ID NO: 4173260 - DNA, 17 bp, Homo sapiens
tgaggatgtgagcctga

SEQ ID NO: 4173261 - DNA, 13 bp, Homo sapiens
tgaggattcctga

SEQ ID NO: 4173262 - DNA, 23 bp, Homo sapiens
tgaggcaggggagtagtggagag

SEQ ID NO: 4173263 - DNA, 15 bp, Homo sapiens
tgaggcccagcctgt

SEQ ID NO: 4173264 - DNA, 13 bp, Homo sapiens
tgaggccccaggc

SEQ ID NO: 4173265 - DNA, 17 bp, Homo sapiens
tgaggcctgccctcagg

SEQ ID NO: 4173266 - DNA, 18 bp, Homo sapiens
tgaggcctgccctcaggg

SEQ ID NO: 4173267 - DNA, 17 bp, Homo sapiens
tgaggcctggccaggca

SEQ ID NO: 4173268 - DNA, 20 bp, Homo sapiens
tgaggctctattgagccaag

SEQ ID NO: 4173269 - DNA, 16 bp, Homo sapiens
tgaggctctttctggg

SEQ ID NO: 4173270 - DNA, 18 bp, Homo sapiens
tgaggctgagactgcggg

SEQ ID NO: 4173271 - DNA, 12 bp, Homo sapiens
tgaggctgggaa

SEQ ID NO: 4173272 - DNA, 14 bp, Homo sapiens
tgaggctttccatg

SEQ ID NO: 4173273 - DNA, 19 bp, Homo sapiens
tgaggctttccatgggacc

SEQ ID NO: 4173274 - DNA, 19 bp, Homo sapiens
tgagggcagtggggagcat

SEQ ID NO: 4173275 - DNA, 11 bp, Homo sapiens
tgagggctggg

SEQ ID NO: 4173276 - DNA, 14 bp, Homo sapiens
tgagggctgggccc

SEQ ID NO: 4173277 - DNA, 14 bp, Homo sapiens
tgaggggctcctgg

SEQ ID NO: 4173278 - DNA, 20 bp, Homo sapiens
tgaggggggccgtgcccagg

SEQ ID NO: 4173279 - DNA, 21 bp, Homo sapiens
tgagggtaataaacttagaat

SEQ ID NO: 4173280 - DNA, 22 bp, Homo sapiens
tgagggtaataaacttagaata

SEQ ID NO: 4173281 - DNA, 21 bp, Homo sapiens
tgagggtttttctaagtaaga

SEQ ID NO: 4173282 - DNA, 15 bp, Homo sapiens
tgaggtgaaacaatt

SEQ ID NO: 4173283 - DNA, 16 bp, Homo sapiens
tgagtcacccatgaag

SEQ ID NO: 4173284 - DNA, 14 bp, Homo sapiens
tgagtcagaggaca

SEQ ID NO: 4173285 - DNA, 22 bp, Homo sapiens
tgagtcagaggacaccatccaa

SEQ ID NO: 4173286 - DNA, 15 bp, Homo sapiens
tgagtctgaggcccc

SEQ ID NO: 4173287 - DNA, 19 bp, Homo sapiens
tgagtgacaatagaagaaa

SEQ ID NO: 4173288 - DNA, 16 bp, Homo sapiens
tgagtgatctcaaatc

SEQ ID NO: 4173289 - DNA, 22 bp, Homo sapiens
tgagtgatctcaaatccactga

SEQ ID NO: 4173290 - DNA, 21 bp, Homo sapiens
tgagtttaggcagcttctctg

SEQ ID NO: 4173291 - DNA, 22 bp, Homo sapiens
tgagtttgcttatgtaatctca

SEQ ID NO: 4173292 - DNA, 13 bp, Homo sapiens
tgagttttccatg

SEQ ID NO: 4173293 - DNA, 19 bp, Homo sapiens
tgataaattccactggact

SEQ ID NO: 4173294 - DNA, 16 bp, Homo sapiens
tgataactatttacat

SEQ ID NO: 4173295 - DNA, 23 bp, Homo sapiens
tgataacttgttttgacttgaat

SEQ ID NO: 4173296 - DNA, 16 bp, Homo sapiens
tgataagcaggaagga

SEQ ID NO: 4173297 - DNA, 21 bp, Homo sapiens
tgatacgtgttcctataaaat

SEQ ID NO: 4173298 - DNA, 17 bp, Homo sapiens
tgatactaaaagttctt

SEQ ID NO: 4173299 - DNA, 15 bp, Homo sapiens
tgatagagtgatttt

SEQ ID NO: 4173300 - DNA, 24 bp, Homo sapiens
tgatagcaggtgtaataagactat

SEQ ID NO: 4173301 - DNA, 20 bp, Homo sapiens
tgatatccagtaagcacatg

SEQ ID NO: 4173302 - DNA, 12 bp, Homo sapiens
tgatcaaggcct

SEQ ID NO: 4173303 - DNA, 14 bp, Homo sapiens
tgatcaatgaaatg

SEQ ID NO: 4173304 - DNA, 12 bp, Homo sapiens
tgatcacactct

SEQ ID NO: 4173305 - DNA, 15 bp, Homo sapiens
tgatcacactctggg

SEQ ID NO: 4173306 - DNA, 20 bp, Homo sapiens
tgatcataggtatttcaaaa

SEQ ID NO: 4173307 - DNA, 14 bp, Homo sapiens
tgatcattgaaagt

SEQ ID NO: 4173308 - DNA, 12 bp, Homo sapiens
tgatcccagcac

SEQ ID NO: 4173309 - DNA, 21 bp, Homo sapiens
tgatccggctgctcctccagc

SEQ ID NO: 4173310 - DNA, 23 bp, Homo sapiens
tgatccggctgctcctccagccc

SEQ ID NO: 4173311 - DNA, 14 bp, Homo sapiens
tgatgaaaataata

SEQ ID NO: 4173312 - DNA, 23 bp, Homo sapiens
tgatgaactttctcttcatactt

SEQ ID NO: 4173313 - DNA, 15 bp, Homo sapiens
tctgtctacttgctc

SEQ ID NO: 4173314 - DNA, 14 bp, Homo sapiens
tctgtcttctggac

SEQ ID NO: 4173315 - DNA, 15 bp, Homo sapiens
tctgtgacccatctg

SEQ ID NO: 4173316 - DNA, 20 bp, Homo sapiens
tctgtgagagaccccctcca

SEQ ID NO: 4173317 - DNA, 14 bp, Homo sapiens
tctgtgcgtctgtg

SEQ ID NO: 4173318 - DNA, 16 bp, Homo sapiens
tctgtgcgtctgtgtg

SEQ ID NO: 4173319 - DNA, 20 bp, Homo sapiens
tctgtgcgtctgtgtgttta

SEQ ID NO: 4173320 - DNA, 14 bp, Homo sapiens
tctgtgggagctca

SEQ ID NO: 4173321 - DNA, 16 bp, Homo sapiens
tctgtgggagctcagc

SEQ ID NO: 4173322 - DNA, 22 bp, Homo sapiens
tctgtgggagctcagctcgctg

SEQ ID NO: 4173323 - DNA, 11 bp, Homo sapiens
tctgtggtggg

SEQ ID NO: 4173324 - DNA, 12 bp, Homo sapiens
tctgtgtatgtg

SEQ ID NO: 4173325 - DNA, 18 bp, Homo sapiens
tctgttatgcaagcacaa

SEQ ID NO: 4173326 - DNA, 23 bp, Homo sapiens
tcttaaagctgcctgtagttagg

SEQ ID NO: 4173327 - DNA, 14 bp, Homo sapiens
tcttacatggccac

SEQ ID NO: 4173328 - DNA, 15 bp, Homo sapiens
tcttaccaaaacaga

SEQ ID NO: 4173329 - DNA, 18 bp, Homo sapiens
tcttaccttaaaaagtaa

SEQ ID NO: 4173330 - DNA, 13 bp, Homo sapiens
tcttactgcagta

SEQ ID NO: 4173331 - DNA, 15 bp, Homo sapiens
tcttatagaaagcac

SEQ ID NO: 4173332 - DNA, 16 bp, Homo sapiens
tcttcaccaaatcttg

SEQ ID NO: 4173333 - DNA, 14 bp, Homo sapiens
tcttcactcagcca

SEQ ID NO: 4173334 - DNA, 17 bp, Homo sapiens
tcttcactcagccacac

SEQ ID NO: 4173335 - DNA, 18 bp, Homo sapiens
tcttcagaagacactgca

SEQ ID NO: 4173336 - DNA, 16 bp, Homo sapiens
tcttcagagcaggggt

SEQ ID NO: 4173337 - DNA, 16 bp, Homo sapiens
tcttcagcagcatcta

SEQ ID NO: 4173338 - DNA, 16 bp, Homo sapiens
tcttccagtgcaacaa

SEQ ID NO: 4173339 - DNA, 19 bp, Homo sapiens
tcttccagtgcaacaaaat

SEQ ID NO: 4173340 - DNA, 16 bp, Homo sapiens
tcttccctccttccct

SEQ ID NO: 4173341 - DNA, 19 bp, Homo sapiens
tcttccctgttttaaatta

SEQ ID NO: 4173342 - DNA, 21 bp, Homo sapiens
tcttccgtggtcagagtgcca

SEQ ID NO: 4173343 - DNA, 19 bp, Homo sapiens
tcttcctctgggcagcgct

SEQ ID NO: 4173344 - DNA, 12 bp, Homo sapiens
tcttccttcccc

SEQ ID NO: 4173345 - DNA, 11 bp, Homo sapiens
tcttccttccg

SEQ ID NO: 4173346 - DNA, 14 bp, Homo sapiens
tcttccttgtgatt

SEQ ID NO: 4173347 - DNA, 14 bp, Homo sapiens
tcttcgtcctgccc

SEQ ID NO: 4173348 - DNA, 15 bp, Homo sapiens
tcttctaaaattgaa

SEQ ID NO: 4173349 - DNA, 21 bp, Homo sapiens
tcttcttattcatgctttctc

SEQ ID NO: 4173350 - DNA, 14 bp, Homo sapiens
tcttcttcttcaga

SEQ ID NO: 4173351 - DNA, 20 bp, Homo sapiens
tcttcttgagcagaccgtga

SEQ ID NO: 4173352 - DNA, 16 bp, Homo sapiens
tcttcttgtgtcctga

SEQ ID NO: 4173353 - DNA, 13 bp, Homo sapiens
tcttgaatcccat

SEQ ID NO: 4173354 - DNA, 17 bp, Homo sapiens
tcttgaattattttgca

SEQ ID NO: 4173355 - DNA, 11 bp, Homo sapiens
tcttgacccta

SEQ ID NO: 4173356 - DNA, 23 bp, Homo sapiens
tcttgagtactagaatttgtatt

SEQ ID NO: 4173357 - DNA, 16 bp, Homo sapiens
tcttgattctctccct

SEQ ID NO: 4173358 - DNA, 13 bp, Homo sapiens
tcttgatttcttt

SEQ ID NO: 4173359 - DNA, 20 bp, Homo sapiens
tcttgcccctccagagacag

SEQ ID NO: 4173360 - DNA, 12 bp, Homo sapiens
tcttggcctctg

SEQ ID NO: 4173361 - DNA, 14 bp, Homo sapiens
tcttggcctctgct

SEQ ID NO: 4173362 - DNA, 13 bp, Homo sapiens
tcttggctcactg

SEQ ID NO: 4173363 - DNA, 20 bp, Homo sapiens
tcttggggctcgccccaccc

SEQ ID NO: 4173364 - DNA, 19 bp, Homo sapiens
tcttggtgatggagtgtgc

SEQ ID NO: 4173365 - DNA, 23 bp, Homo sapiens
tcttgtcccctcttgacccatct

SEQ ID NO: 4173366 - DNA, 21 bp, Homo sapiens
tctttaaccactcctcaggaa

SEQ ID NO: 4173367 - DNA, 18 bp, Homo sapiens
tctttaagtattgtttta

SEQ ID NO: 4173368 - DNA, 12 bp, Homo sapiens
tctttcatcttt

SEQ ID NO: 4173369 - DNA, 13 bp, Homo sapiens
tctttccccacct

SEQ ID NO: 4173370 - DNA, 22 bp, Homo sapiens
tctttccccacctcttccttcc

SEQ ID NO: 4173371 - DNA, 20 bp, Homo sapiens
tctttctagcagcagatctg

SEQ ID NO: 4173372 - DNA, 13 bp, Homo sapiens
tctttctcttccc

SEQ ID NO: 4173373 - DNA, 21 bp, Homo sapiens
tctttgaagttatttagaaat

SEQ ID NO: 4173374 - DNA, 17 bp, Homo sapiens
tctttgattcagacagc

SEQ ID NO: 4173375 - DNA, 12 bp, Homo sapiens
tctttgcatgga

SEQ ID NO: 4173376 - DNA, 20 bp, Homo sapiens
tctttgtggtttcaaatcag

SEQ ID NO: 4173377 - DNA, 19 bp, Homo sapiens
tctttgttcagttgactta

SEQ ID NO: 4173378 - DNA, 21 bp, Homo sapiens
tcttttgaaacagattccatt

SEQ ID NO: 4173379 - DNA, 15 bp, Homo sapiens
tctttttttaaattg

SEQ ID NO: 4173380 - DNA, 18 bp, Homo sapiens
tgaaaaaaaaaaagaaga

SEQ ID NO: 4173381 - DNA, 16 bp, Homo sapiens
tgaaaaaaagtttaca

SEQ ID NO: 4173382 - DNA, 20 bp, Homo sapiens
tgaaaaatatgtgcttgaaa

SEQ ID NO: 4173383 - DNA, 21 bp, Homo sapiens
tgaaaacagcccaggtcctcc

SEQ ID NO: 4173384 - DNA, 21 bp, Homo sapiens
tgaaaaggtttatgaaaaaga

SEQ ID NO: 4173385 - DNA, 15 bp, Homo sapiens
tgaaaatagcaggac

SEQ ID NO: 4173386 - DNA, 20 bp, Homo sapiens
tgaaaatatgatgtttcaca

SEQ ID NO: 4173387 - DNA, 15 bp, Homo sapiens
tgaaaatctaatatt

SEQ ID NO: 4173388 - DNA, 17 bp, Homo sapiens
tgaaaatctaatattaa

SEQ ID NO: 4173389 - DNA, 21 bp, Homo sapiens
tgaaaatgggttggtgcttct

SEQ ID NO: 4173390 - DNA, 14 bp, Homo sapiens
tgaaaatgtcaaag

SEQ ID NO: 4173391 - DNA, 16 bp, Homo sapiens
tgaaaattattttaaa

SEQ ID NO: 4173392 - DNA, 23 bp, Homo sapiens
tgaaacaattattgtacactaac

SEQ ID NO: 4173393 - DNA, 15 bp, Homo sapiens
tgaaacagaaaaata

SEQ ID NO: 4173394 - DNA, 13 bp, Homo sapiens
tgaaaccaaaatt

SEQ ID NO: 4173395 - DNA, 16 bp, Homo sapiens
tgaaaccctgtctcta

SEQ ID NO: 4173396 - DNA, 16 bp, Homo sapiens
tgaaagaaagtgttaa

SEQ ID NO: 4173397 - DNA, 18 bp, Homo sapiens
tgaaagtcagatgcccag

SEQ ID NO: 4173398 - DNA, 17 bp, Homo sapiens
tgaaagtttgcactgta

SEQ ID NO: 4173399 - DNA, 15 bp, Homo sapiens
tgaaattgaacctgg

SEQ ID NO: 4173400 - DNA, 23 bp, Homo sapiens
tgaacacagctgctgaagaggca

SEQ ID NO: 4173401 - DNA, 15 bp, Homo sapiens
tgaacagagagaacc

SEQ ID NO: 4173402 - DNA, 19 bp, Homo sapiens
tgaacagagagaaccagga

SEQ ID NO: 4173403 - DNA, 18 bp, Homo sapiens
tgaacagggtccctggat

SEQ ID NO: 4173404 - DNA, 21 bp, Homo sapiens
tgaacccagagtcaggaagag

SEQ ID NO: 4173405 - DNA, 14 bp, Homo sapiens
tgaactaatttctt

SEQ ID NO: 4173406 - DNA, 15 bp, Homo sapiens
tgaactaatttctta

SEQ ID NO: 4173407 - DNA, 17 bp, Homo sapiens
tgaactggaagaaagca

SEQ ID NO: 4173408 - DNA, 13 bp, Homo sapiens
tgaactgttacaa

SEQ ID NO: 4173409 - DNA, 19 bp, Homo sapiens
tgaacttattacctaatta

SEQ ID NO: 4173410 - DNA, 22 bp, Homo sapiens
tgaactttctcttcatactttt

SEQ ID NO: 4173411 - DNA, 17 bp, Homo sapiens
tgaagaaaactccttta

SEQ ID NO: 4173412 - DNA, 16 bp, Homo sapiens
tgaagaatacttctca

SEQ ID NO: 4173413 - DNA, 16 bp, Homo sapiens
tgaagaatcaagaggg

SEQ ID NO: 4173414 - DNA, 13 bp, Homo sapiens
tgaagacagaagt

SEQ ID NO: 4173415 - DNA, 14 bp, Homo sapiens
tgaagacaggacag

SEQ ID NO: 4173416 - DNA, 20 bp, Homo sapiens
tgaagaccacatccacacac

SEQ ID NO: 4173417 - DNA, 24 bp, Homo sapiens
tgaagacctccacattaagtggct

SEQ ID NO: 4173418 - DNA, 14 bp, Homo sapiens
tgaagcaaaaagat

SEQ ID NO: 4173419 - DNA, 17 bp, Homo sapiens
tgaagcaaagcaccagc

SEQ ID NO: 4173420 - DNA, 13 bp, Homo sapiens
tgaagccacagga

SEQ ID NO: 4173421 - DNA, 16 bp, Homo sapiens
tgaagccactgaagct

SEQ ID NO: 4173422 - DNA, 23 bp, Homo sapiens
tgaagctttggccctcagtgggc

SEQ ID NO: 4173423 - DNA, 13 bp, Homo sapiens
tgaaggaggtgag

SEQ ID NO: 4173424 - DNA, 19 bp, Homo sapiens
tgaagggaaagaaattctt

SEQ ID NO: 4173425 - DNA, 22 bp, Homo sapiens
tgaagtcaaaccttaagataat

SEQ ID NO: 4173426 - DNA, 14 bp, Homo sapiens
tgaagtttctgtag

SEQ ID NO: 4173427 - DNA, 13 bp, Homo sapiens
tgaatacacaaat

SEQ ID NO: 4173428 - DNA, 13 bp, Homo sapiens
tgaatagcacagg

SEQ ID NO: 4173429 - DNA, 18 bp, Homo sapiens
tgaatatttcaaaataaa

SEQ ID NO: 4173430 - DNA, 22 bp, Homo sapiens
tgaatatttcaaaataaactgg

SEQ ID NO: 4173431 - DNA, 20 bp, Homo sapiens
tgaatctgcagggagcaact

SEQ ID NO: 4173432 - DNA, 13 bp, Homo sapiens
tgaatgacaagca

SEQ ID NO: 4173433 - DNA, 14 bp, Homo sapiens
tgaatgagtctgct

SEQ ID NO: 4173434 - DNA, 15 bp, Homo sapiens
tgaatgagtctgctt

SEQ ID NO: 4173435 - DNA, 17 bp, Homo sapiens
tgaatgataagcaggaa

SEQ ID NO: 4173436 - DNA, 20 bp, Homo sapiens
tgaatgccttccgggccggg

SEQ ID NO: 4173437 - DNA, 12 bp, Homo sapiens
tgaatgcttttt

SEQ ID NO: 4173438 - DNA, 18 bp, Homo sapiens
tgaatgctttttgaatgt

SEQ ID NO: 4173439 - DNA, 19 bp, Homo sapiens
tgaatgctttttgaatgtt

SEQ ID NO: 4173440 - DNA, 23 bp, Homo sapiens
tgaatgctttttgaatgttattt

SEQ ID NO: 4173441 - DNA, 12 bp, Homo sapiens
tgaatggcctgc

SEQ ID NO: 4173442 - DNA, 17 bp, Homo sapiens
tgaatggcctgccttga

SEQ ID NO: 4173443 - DNA, 21 bp, Homo sapiens
tgaatggcctgccttgaagcc

SEQ ID NO: 4173444 - DNA, 17 bp, Homo sapiens
tgaatgtgtgtatgtat

SEQ ID NO: 4173445 - DNA, 17 bp, Homo sapiens
tgaattcttatgcttat

SEQ ID NO: 4173446 - DNA, 12 bp, Homo sapiens
tgaattcttgag

SEQ ID NO: 4173447 - DNA, 21 bp, Homo sapiens
tgaattgtattttttgttgaa

SEQ ID NO: 4173448 - DNA, 18 bp, Homo sapiens
tgaatttattattgttct

SEQ ID NO: 4173449 - DNA, 21 bp, Homo sapiens
tgaatttcttcactgttgaaa

SEQ ID NO: 4173450 - DNA, 21 bp, Homo sapiens
tgaatttttaaacaagtattt

SEQ ID NO: 4173451 - DNA, 14 bp, Homo sapiens
tgacaacagaagct

SEQ ID NO: 4173452 - DNA, 14 bp, Homo sapiens
tgacaactggcagg

SEQ ID NO: 4173453 - DNA, 19 bp, Homo sapiens
tggaaatataggctatgta

SEQ ID NO: 4173454 - DNA, 20 bp, Homo sapiens
tggaacactagacaagccag

SEQ ID NO: 4173455 - DNA, 21 bp, Homo sapiens
tggaacactagacaagccaga

SEQ ID NO: 4173456 - DNA, 13 bp, Homo sapiens
tggaacttctaat

SEQ ID NO: 4173457 - DNA, 16 bp, Homo sapiens
tggaacttctaatata

SEQ ID NO: 4173458 - DNA, 18 bp, Homo sapiens
tggaacttctaatatatt

SEQ ID NO: 4173459 - DNA, 21 bp, Homo sapiens
tggaacttctaatatattttt

SEQ ID NO: 4173460 - DNA, 12 bp, Homo sapiens
tggaagagaggc

SEQ ID NO: 4173461 - DNA, 17 bp, Homo sapiens
tggaagagaggcacctg

SEQ ID NO: 4173462 - DNA, 20 bp, Homo sapiens
tggaagagaggcacctgctg

SEQ ID NO: 4173463 - DNA, 21 bp, Homo sapiens
tggaagagaggcacctgctgg

SEQ ID NO: 4173464 - DNA, 17 bp, Homo sapiens
tggaagatattcctttt

SEQ ID NO: 4173465 - DNA, 20 bp, Homo sapiens
tggaaggtttggtgtgtgga

SEQ ID NO: 4173466 - DNA, 19 bp, Homo sapiens
tggaagtgtgtggaaggca

SEQ ID NO: 4173467 - DNA, 13 bp, Homo sapiens
tggaagttttcag

SEQ ID NO: 4173468 - DNA, 15 bp, Homo sapiens
tggaagttttcagga

SEQ ID NO: 4173469 - DNA, 13 bp, Homo sapiens
tggaatcactgta

SEQ ID NO: 4173470 - DNA, 17 bp, Homo sapiens
tggaatttaatttatgt

SEQ ID NO: 4173471 - DNA, 13 bp, Homo sapiens
tggacacagtgtt

SEQ ID NO: 4173472 - DNA, 20 bp, Homo sapiens
tggacaccccttatccagga

SEQ ID NO: 4173473 - DNA, 10 bp, Homo sapiens
tggacacctg

SEQ ID NO: 4173474 - DNA, 12 bp, Homo sapiens
tggacacctgcc

SEQ ID NO: 4173475 - DNA, 15 bp, Homo sapiens
tggacacctgccctg

SEQ ID NO: 4173476 - DNA, 17 bp, Homo sapiens
tggacacctgccctgcc

SEQ ID NO: 4173477 - DNA, 18 bp, Homo sapiens
tggacacctgccctgccc

SEQ ID NO: 4173478 - DNA, 23 bp, Homo sapiens
tggacacctgccctgccctgcca

SEQ ID NO: 4173479 - DNA, 18 bp, Homo sapiens
tggacagatagacagtgc

SEQ ID NO: 4173480 - DNA, 14 bp, Homo sapiens
tggacagtcctggg

SEQ ID NO: 4173481 - DNA, 17 bp, Homo sapiens
tggacagtcctgggaga

SEQ ID NO: 4173482 - DNA, 17 bp, Homo sapiens
tggaccgcttcccagag

SEQ ID NO: 4173483 - DNA, 20 bp, Homo sapiens
tggacctatgacaggctgaa

SEQ ID NO: 4173484 - DNA, 17 bp, Homo sapiens
tggacgccgagggcagc

SEQ ID NO: 4173485 - DNA, 16 bp, Homo sapiens
tggactcctcccacaa

SEQ ID NO: 4173486 - DNA, 20 bp, Homo sapiens
tggactcgtaaagctgctag

SEQ ID NO: 4173487 - DNA, 18 bp, Homo sapiens
tggacttgaggattttga

SEQ ID NO: 4173488 - DNA, 11 bp, Homo sapiens
tggagaaatta

SEQ ID NO: 4173489 - DNA, 21 bp, Homo sapiens
tggagaaattatttaataaaa

SEQ ID NO: 4173490 - DNA, 13 bp, Homo sapiens
tggagaaggaagg

SEQ ID NO: 4173491 - DNA, 15 bp, Homo sapiens
tggagaataaattat

SEQ ID NO: 4173492 - DNA, 17 bp, Homo sapiens
tggagacagccctgcct

SEQ ID NO: 4173493 - DNA, 18 bp, Homo sapiens
tggagacagccctgccta

SEQ ID NO: 4173494 - DNA, 19 bp, Homo sapiens
tggagactggtcctgtgtg

SEQ ID NO: 4173495 - DNA, 11 bp, Homo sapiens
tggagagaagt

SEQ ID NO: 4173496 - DNA, 20 bp, Homo sapiens
tggagaggtttgtcaacaca

SEQ ID NO: 4173497 - DNA, 14 bp, Homo sapiens
tggagatgcagagg

SEQ ID NO: 4173498 - DNA, 14 bp, Homo sapiens
tggagcatcccagg

SEQ ID NO: 4173499 - DNA, 20 bp, Homo sapiens
tggagccaaggcagagggga

SEQ ID NO: 4173500 - DNA, 15 bp, Homo sapiens
tggagcggagcttgc

SEQ ID NO: 4173501 - DNA, 13 bp, Homo sapiens
tggagctgactgt

SEQ ID NO: 4173502 - DNA, 16 bp, Homo sapiens
tggagctgactgttct

SEQ ID NO: 4173503 - DNA, 19 bp, Homo sapiens
tggaggcttcttgcccaga

SEQ ID NO: 4173504 - DNA, 20 bp, Homo sapiens
tggagggatgccacccagca

SEQ ID NO: 4173505 - DNA, 20 bp, Homo sapiens
tggagggcaaggggtttcca

SEQ ID NO: 4173506 - DNA, 22 bp, Homo sapiens
tggagggcaaggggtttccaca

SEQ ID NO: 4173507 - DNA, 19 bp, Homo sapiens
tggagggggcaagcctgta

SEQ ID NO: 4173508 - DNA, 20 bp, Homo sapiens
tggagggtgggagagcccag

SEQ ID NO: 4173509 - DNA, 18 bp, Homo sapiens
tggaggtcacattcagga

SEQ ID NO: 4173510 - DNA, 22 bp, Homo sapiens
tggaggtcacattcaggaagat

SEQ ID NO: 4173511 - DNA, 14 bp, Homo sapiens
tggaggtggggaag

SEQ ID NO: 4173512 - DNA, 22 bp, Homo sapiens
tggaggttgcagtgagctgaga

SEQ ID NO: 4173513 - DNA, 21 bp, Homo sapiens
tggagtctgcagtgaggggag

SEQ ID NO: 4173514 - DNA, 16 bp, Homo sapiens
tggatatatttaaaaa

SEQ ID NO: 4173515 - DNA, 16 bp, Homo sapiens
tggatatgtaaaacat

SEQ ID NO: 4173516 - DNA, 13 bp, Homo sapiens
tggatctcctgac

SEQ ID NO: 4173517 - DNA, 18 bp, Homo sapiens
tggatctgtccaaggaaa

SEQ ID NO: 4173518 - DNA, 20 bp, Homo sapiens
tggatctgtccaaggaaact

SEQ ID NO: 4173519 - DNA, 15 bp, Homo sapiens
tggatgaaattttct

SEQ ID NO: 4173520 - DNA, 18 bp, Homo sapiens
tggatgaaattttctaga

SEQ ID NO: 4173521 - DNA, 20 bp, Homo sapiens
tggatgcagtggctcatgcc

SEQ ID NO: 4173522 - DNA, 16 bp, Homo sapiens
tggatgctagtgctgt

SEQ ID NO: 4173523 - DNA, 22 bp, Homo sapiens
tggatggcccagcaggcaggca

SEQ ID NO: 4173524 - DNA, 20 bp, Homo sapiens
tggatgggccctgcaagaca

SEQ ID NO: 4173525 - DNA, 13 bp, Homo sapiens
tggatttgaagca

SEQ ID NO: 4173526 - DNA, 15 bp, Homo sapiens
tggcaaaataaagaa

SEQ ID NO: 4173527 - DNA, 19 bp, Homo sapiens
tggcaagaaagctggtaaa

SEQ ID NO: 4173528 - DNA, 16 bp, Homo sapiens
tggcaagggggcgggg

SEQ ID NO: 4173529 - DNA, 18 bp, Homo sapiens
tggcaatttcctggccct

SEQ ID NO: 4173530 - DNA, 23 bp, Homo sapiens
tggcacaatggctaattcccaga

SEQ ID NO: 4173531 - DNA, 21 bp, Homo sapiens
tggcacttagctatcagaaga

SEQ ID NO: 4173532 - DNA, 15 bp, Homo sapiens
tggcagagcacagcc

SEQ ID NO: 4173533 - DNA, 20 bp, Homo sapiens
tggcagataatcagcctctt

SEQ ID NO: 4173534 - DNA, 14 bp, Homo sapiens
tggcagcattcaga

SEQ ID NO: 4173535 - DNA, 17 bp, Homo sapiens
tggcaggaaggcttgtt

SEQ ID NO: 4173536 - DNA, 11 bp, Homo sapiens
tggcaggacca

SEQ ID NO: 4173537 - DNA, 20 bp, Homo sapiens
tggcaggcaggctcccaggg

SEQ ID NO: 4173538 - DNA, 20 bp, Homo sapiens
tggcagtttatatttaactc

SEQ ID NO: 4173539 - DNA, 20 bp, Homo sapiens
tggcatcacagggcagagcc

SEQ ID NO: 4173540 - DNA, 20 bp, Homo sapiens
tggcatgtcagagccaggct

SEQ ID NO: 4173541 - DNA, 20 bp, Homo sapiens
tggcatgttagcccttcctc

SEQ ID NO: 4173542 - DNA, 16 bp, Homo sapiens
tggccaaattatttgt

SEQ ID NO: 4173543 - DNA, 14 bp, Homo sapiens
tggccaagcctggc

SEQ ID NO: 4173544 - DNA, 17 bp, Homo sapiens
tggccaagcctggccct

SEQ ID NO: 4173545 - DNA, 15 bp, Homo sapiens
tggccagaggcattt

SEQ ID NO: 4173546 - DNA, 13 bp, Homo sapiens
tggccaggaagct

SEQ ID NO: 4173547 - DNA, 21 bp, Homo sapiens
tggccaggcaccccctggaga

SEQ ID NO: 4173548 - DNA, 12 bp, Homo sapiens
tggccagggtga

SEQ ID NO: 4173549 - DNA, 13 bp, Homo sapiens
tggccagggtgag

SEQ ID NO: 4173550 - DNA, 19 bp, Homo sapiens
tggccagggtgagagctgc

SEQ ID NO: 4173551 - DNA, 21 bp, Homo sapiens
tggcccagcaggcaggcactg

SEQ ID NO: 4173552 - DNA, 22 bp, Homo sapiens
tggccccaccctcgtggacacc

SEQ ID NO: 4173553 - DNA, 23 bp, Homo sapiens
tggcccccctccaggcatgctgg

SEQ ID NO: 4173554 - DNA, 15 bp, Homo sapiens
tggccccgcagtgcc

SEQ ID NO: 4173555 - DNA, 11 bp, Homo sapiens
tggccctccac

SEQ ID NO: 4173556 - DNA, 16 bp, Homo sapiens
tggccctggggccatg

SEQ ID NO: 4173557 - DNA, 15 bp, Homo sapiens
tggcctcaaagcaag

SEQ ID NO: 4173558 - DNA, 21 bp, Homo sapiens
tggcctccacagttcgacctg

SEQ ID NO: 4173559 - DNA, 18 bp, Homo sapiens
tggcctcccaataaagct

SEQ ID NO: 4173560 - DNA, 20 bp, Homo sapiens
tggcctcccaataaagctgg

SEQ ID NO: 4173561 - DNA, 19 bp, Homo sapiens
tggcctcctgggggcccat

SEQ ID NO: 4173562 - DNA, 11 bp, Homo sapiens
tggcctgggca

SEQ ID NO: 4173563 - DNA, 15 bp, Homo sapiens
tggccttctcagcct

SEQ ID NO: 4173564 - DNA, 19 bp, Homo sapiens
tggcctttcaggtccaggc

SEQ ID NO: 4173565 - DNA, 19 bp, Homo sapiens
tggctaggaaagggaagcc

SEQ ID NO: 4173566 - DNA, 19 bp, Homo sapiens
tggctatgggaatcagctg

SEQ ID NO: 4173567 - DNA, 18 bp, Homo sapiens
tggctccaaggtgctctg

SEQ ID NO: 4173568 - DNA, 16 bp, Homo sapiens
tggctctcagaaggta

SEQ ID NO: 4173569 - DNA, 14 bp, Homo sapiens
tggctcttcacctg

SEQ ID NO: 4173570 - DNA, 20 bp, Homo sapiens
tggctgaccccaaagagcct

SEQ ID NO: 4173571 - DNA, 15 bp, Homo sapiens
tggctgacctgggcc

SEQ ID NO: 4173572 - DNA, 16 bp, Homo sapiens
tggctgcaggaatctt

SEQ ID NO: 4173573 - DNA, 13 bp, Homo sapiens
tggctggctgcag

SEQ ID NO: 4173574 - DNA, 22 bp, Homo sapiens
tggctgtggttcctaagcctgt

SEQ ID NO: 4173575 - DNA, 23 bp, Homo sapiens
tggcttccagaaaaccccagcat

SEQ ID NO: 4173576 - DNA, 17 bp, Homo sapiens
tggcttctccatcctca

SEQ ID NO: 4173577 - DNA, 21 bp, Homo sapiens
tggcttctggccaggaagctt

SEQ ID NO: 4173578 - DNA, 13 bp, Homo sapiens
tggctttgtctct

SEQ ID NO: 4173579 - DNA, 17 bp, Homo sapiens
tgggaaaagtgttatta

SEQ ID NO: 4173580 - DNA, 22 bp, Homo sapiens
tgggaaatggtatgagctgagg

SEQ ID NO: 4173581 - DNA, 23 bp, Homo sapiens
tgggaaatggtatgagctgaggg

SEQ ID NO: 4173582 - DNA, 15 bp, Homo sapiens
tgggaagagaaggga

SEQ ID NO: 4173583 - DNA, 20 bp, Homo sapiens
tgggaagagaagggaagcct

SEQ ID NO: 4173584 - DNA, 11 bp, Homo sapiens
tgggaagccat

SEQ ID NO: 4173585 - DNA, 13 bp, Homo sapiens
tgggaatcctgct

SEQ ID NO: 4173586 - DNA, 15 bp, Homo sapiens
tgggaatcctgctgc

SEQ ID NO: 4173587 - DNA, 21 bp, Homo sapiens
tgggacctgaatgacctgcag

SEQ ID NO: 4173588 - DNA, 23 bp, Homo sapiens
tgggactggccaggtttctgccc

SEQ ID NO: 4173589 - DNA, 21 bp, Homo sapiens
tgggacttctacccagatgga

SEQ ID NO: 4173590 - DNA, 15 bp, Homo sapiens
tgggagaagagaacc

SEQ ID NO: 4173591 - DNA, 23 bp, Homo sapiens
tgggagacgaacggaagggttgg

SEQ ID NO: 4173592 - DNA, 21 bp, Homo sapiens
tgggagagagacgtgtacata

SEQ ID NO: 4173593 - DNA, 14 bp, Homo sapiens
tgggagagccagct

SEQ ID NO: 4173594 - DNA, 23 bp, Homo sapiens
tgggagataattatcagtcatga

SEQ ID NO: 4173595 - DNA, 11 bp, Homo sapiens
tgggagctcag

SEQ ID NO: 4173596 - DNA, 22 bp, Homo sapiens
tgggaggcctcgtaccagccag

SEQ ID NO: 4173597 - DNA, 18 bp, Homo sapiens
tgggaggggatggcagac

SEQ ID NO: 4173598 - DNA, 16 bp, Homo sapiens
tgggaggtccaggcag

SEQ ID NO: 4173599 - DNA, 20 bp, Homo sapiens
tgggaggtccaggcaggagg

SEQ ID NO: 4173600 - DNA, 14 bp, Homo sapiens
tgggatcagcctcc

SEQ ID NO: 4173601 - DNA, 21 bp, Homo sapiens
tgggatgagaatgaaagctta

SEQ ID NO: 4173602 - DNA, 21 bp, Homo sapiens
tgggatgcggggcagagccac

SEQ ID NO: 4173603 - DNA, 20 bp, Homo sapiens
tgggattcccaccaaggtct

SEQ ID NO: 4173604 - DNA, 21 bp, Homo sapiens
tgggattctggacaggatgtg

SEQ ID NO: 4173605 - DNA, 18 bp, Homo sapiens
tgggcaatgaaaccaaag

SEQ ID NO: 4173606 - DNA, 19 bp, Homo sapiens
tgggcaatgaaaccaaagc

SEQ ID NO: 4173607 - DNA, 17 bp, Homo sapiens
tgggcagaagggagaag

SEQ ID NO: 4173608 - DNA, 22 bp, Homo sapiens
tgggcataggctgcccaatctg

SEQ ID NO: 4173609 - DNA, 14 bp, Homo sapiens
tgggccactctccc

SEQ ID NO: 4173610 - DNA, 20 bp, Homo sapiens
tgggccactctcccctccct

SEQ ID NO: 4173611 - DNA, 15 bp, Homo sapiens
tgggccagctgtcgc

SEQ ID NO: 4173612 - DNA, 14 bp, Homo sapiens
tgggcccacagagc

SEQ ID NO: 4173613 - DNA, 17 bp, Homo sapiens
tgggcccacagagcctg

SEQ ID NO: 4173614 - DNA, 18 bp, Homo sapiens
tgggcccacagagcctgg

SEQ ID NO: 4173615 - DNA, 13 bp, Homo sapiens
tgggcccaggagg

SEQ ID NO: 4173616 - DNA, 14 bp, Homo sapiens
tgggcccaggaggt

SEQ ID NO: 4173617 - DNA, 20 bp, Homo sapiens
tgggccctgcaagacacagg

SEQ ID NO: 4173618 - DNA, 12 bp, Homo sapiens
tgggcctgctgc

SEQ ID NO: 4173619 - DNA, 13 bp, Homo sapiens
tgggcctgctgcg

SEQ ID NO: 4173620 - DNA, 18 bp, Homo sapiens
tgggctccctggcccagc

SEQ ID NO: 4173621 - DNA, 19 bp, Homo sapiens
tgggctccctggcccagcc

SEQ ID NO: 4173622 - DNA, 15 bp, Homo sapiens
tgggctctgccccag

SEQ ID NO: 4173623 - DNA, 12 bp, Homo sapiens
tgggctgagccc

SEQ ID NO: 4173624 - DNA, 15 bp, Homo sapiens
tgggctgcagaagat

SEQ ID NO: 4173625 - DNA, 14 bp, Homo sapiens
tgggctggcccagc

SEQ ID NO: 4173626 - DNA, 19 bp, Homo sapiens
tgggctgtcaacattcaaa

SEQ ID NO: 4173627 - DNA, 13 bp, Homo sapiens
tggggaagaaaaa

SEQ ID NO: 4173628 - DNA, 20 bp, Homo sapiens
tggggacactaatgaagata

SEQ ID NO: 4173629 - DNA, 14 bp, Homo sapiens
tggggactgctacc

SEQ ID NO: 4173630 - DNA, 14 bp, Homo sapiens
tggggagggggaag

SEQ ID NO: 4173631 - DNA, 15 bp, Homo sapiens
tggggcatggtttta

SEQ ID NO: 4173632 - DNA, 21 bp, Homo sapiens
tggggcatggttttacagtga

SEQ ID NO: 4173633 - DNA, 20 bp, Homo sapiens
tggggccatgggtgcatgga

SEQ ID NO: 4173634 - DNA, 17 bp, Homo sapiens
tggggctccggagggga

SEQ ID NO: 4173635 - DNA, 18 bp, Homo sapiens
tggggctcgccccaccca

SEQ ID NO: 4173636 - DNA, 18 bp, Homo sapiens
tggggctgccagcctgag

SEQ ID NO: 4173637 - DNA, 22 bp, Homo sapiens
tggggctgcgaaaacgttgacc

SEQ ID NO: 4173638 - DNA, 23 bp, Homo sapiens
tggggctgcgaaaacgttgaccc

SEQ ID NO: 4173639 - DNA, 24 bp, Homo sapiens
tggggtatttaccacagcagctga

SEQ ID NO: 4173640 - DNA, 15 bp, Homo sapiens
tggggtcagccaggg

SEQ ID NO: 4173641 - DNA, 21 bp, Homo sapiens
tggggtcagccagggccaggg

SEQ ID NO: 4173642 - DNA, 18 bp, Homo sapiens
tggggttggggcaaagcc

SEQ ID NO: 4173643 - DNA, 14 bp, Homo sapiens
tgggtaacgtgaga

SEQ ID NO: 4173644 - DNA, 16 bp, Homo sapiens
tgggtacatgtgagga

SEQ ID NO: 4173645 - DNA, 15 bp, Homo sapiens
tgggtatttcctgct

SEQ ID NO: 4173646 - DNA, 21 bp, Homo sapiens
tgggtcacacctgacaaatgg

SEQ ID NO: 4173647 - DNA, 15 bp, Homo sapiens
tgggtcacctagctg

SEQ ID NO: 4173648 - DNA, 19 bp, Homo sapiens
tgggtcctgcaatctccag

SEQ ID NO: 4173649 - DNA, 23 bp, Homo sapiens
tgggtcctgcaatctccagggct

SEQ ID NO: 4173650 - DNA, 15 bp, Homo sapiens
tgggtctggctgagc

SEQ ID NO: 4173651 - DNA, 15 bp, Homo sapiens
tgggtgctggaggat

SEQ ID NO: 4173652 - DNA, 12 bp, Homo sapiens
tgggtgggagag

SEQ ID NO: 4173653 - DNA, 23 bp, Homo sapiens
tgggttcctttttcaacttggaa

SEQ ID NO: 4173654 - DNA, 16 bp, Homo sapiens
tgggttgcagacagga

SEQ ID NO: 4173655 - DNA, 16 bp, Homo sapiens
tgggttggtgcttcta

SEQ ID NO: 4173656 - DNA, 17 bp, Homo sapiens
tgggtttgtattttaaa

SEQ ID NO: 4173657 - DNA, 17 bp, Homo sapiens
tgggttttgtctctgca

SEQ ID NO: 4173658 - DNA, 21 bp, Homo sapiens
tggtaactgattacctgccaa

SEQ ID NO: 4173659 - DNA, 20 bp, Homo sapiens
tggtaacttctttgaagtta

SEQ ID NO: 4173660 - DNA, 13 bp, Homo sapiens
tggtaagctctgg

SEQ ID NO: 4173661 - DNA, 14 bp, Homo sapiens
tggtaagctctggc

SEQ ID NO: 4173662 - DNA, 14 bp, Homo sapiens
tggtacagcagggt

SEQ ID NO: 4173663 - DNA, 20 bp, Homo sapiens
tggtacagcagggtcttgct

SEQ ID NO: 4173664 - DNA, 15 bp, Homo sapiens
tggtacatggccagt

SEQ ID NO: 4173665 - DNA, 16 bp, Homo sapiens
tggtagaagccagtac

SEQ ID NO: 4173666 - DNA, 22 bp, Homo sapiens
tggtatgaacttgaggacacat

SEQ ID NO: 4173667 - DNA, 17 bp, Homo sapiens
tggtattgtattgtaaa

SEQ ID NO: 4173668 - DNA, 14 bp, Homo sapiens
tggtcaaaccgcac

SEQ ID NO: 4173669 - DNA, 21 bp, Homo sapiens
tggtcagacattttatttttg

SEQ ID NO: 4173670 - DNA, 14 bp, Homo sapiens
tggtccagggttga

SEQ ID NO: 4173671 - DNA, 23 bp, Homo sapiens
tggtccagtttctagagggcact

SEQ ID NO: 4173672 - DNA, 12 bp, Homo sapiens
tggtcctgcact

SEQ ID NO: 4173673 - DNA, 14 bp, Homo sapiens
tggtcctggggctc

SEQ ID NO: 4173674 - DNA, 20 bp, Homo sapiens
tggtcctgtgtgcagtgaag

SEQ ID NO: 4173675 - DNA, 20 bp, Homo sapiens
tggtccttctcgtttgctct

SEQ ID NO: 4173676 - DNA, 15 bp, Homo sapiens
tggtcctttctggaa

SEQ ID NO: 4173677 - DNA, 17 bp, Homo sapiens
tggtcctttctggaagt

SEQ ID NO: 4173678 - DNA, 22 bp, Homo sapiens
tggtcggggagctggggtacag

SEQ ID NO: 4173679 - DNA, 23 bp, Homo sapiens
tggtctagtagcggatctcactc

SEQ ID NO: 4173680 - DNA, 17 bp, Homo sapiens
tggtcttatagaaagca

SEQ ID NO: 4173681 - DNA, 13 bp, Homo sapiens
tggtcttcactgc

SEQ ID NO: 4173682 - DNA, 11 bp, Homo sapiens
tggtcttggaa

SEQ ID NO: 4173683 - DNA, 22 bp, Homo sapiens
tggtctttcctatcatggagtg

SEQ ID NO: 4173684 - DNA, 24 bp, Homo sapiens
tggtgaaaccctgtctctactaaa

SEQ ID NO: 4173685 - DNA, 18 bp, Homo sapiens
tggtgaaatttattagtt

SEQ ID NO: 4173686 - DNA, 18 bp, Homo sapiens
tggtgacatgtgcctgta

SEQ ID NO: 4173687 - DNA, 17 bp, Homo sapiens
tggtgaggcccagcctg

SEQ ID NO: 4173688 - DNA, 23 bp, Homo sapiens
tggtgaggcccagcctgtcctgg

SEQ ID NO: 4173689 - DNA, 14 bp, Homo sapiens
tggtgaggtgtgga

SEQ ID NO: 4173690 - DNA, 14 bp, Homo sapiens
tggtgatttctgag

SEQ ID NO: 4173691 - DNA, 14 bp, Homo sapiens
tggtgccagaggtt

SEQ ID NO: 4173692 - DNA, 18 bp, Homo sapiens
tggtgctataggctggag

SEQ ID NO: 4173693 - DNA, 17 bp, Homo sapiens
tggtggacagtcctggg

SEQ ID NO: 4173694 - DNA, 18 bp, Homo sapiens
tggtggaggcttcttgcc

SEQ ID NO: 4173695 - DNA, 16 bp, Homo sapiens
tggtggatgggccctg

SEQ ID NO: 4173696 - DNA, 15 bp, Homo sapiens
tggtggccaagcctg

SEQ ID NO: 4173697 - DNA, 18 bp, Homo sapiens
tggtggccaagcctggcc

SEQ ID NO: 4173698 - DNA, 19 bp, Homo sapiens
tggtgggaagcaagcaggg

SEQ ID NO: 4173699 - DNA, 23 bp, Homo sapiens
tggtgggagacgaacggaagggt

SEQ ID NO: 4173700 - DNA, 23 bp, Homo sapiens
tggtgtatcccccccctgtatag

SEQ ID NO: 4173701 - DNA, 16 bp, Homo sapiens
tggtgtcaccagcctg

SEQ ID NO: 4173702 - DNA, 18 bp, Homo sapiens
tggtgtcaccagcctgtt

SEQ ID NO: 4173703 - DNA, 16 bp, Homo sapiens
tggtgtttgtaggctg

SEQ ID NO: 4173704 - DNA, 17 bp, Homo sapiens
tggttaatctttcctga

SEQ ID NO: 4173705 - DNA, 16 bp, Homo sapiens
tggttaatggcagcat

SEQ ID NO: 4173706 - DNA, 21 bp, Homo sapiens
tggttacatggaaaagttctt

SEQ ID NO: 4173707 - DNA, 18 bp, Homo sapiens
tggttcaggcataaatta

SEQ ID NO: 4173708 - DNA, 19 bp, Homo sapiens
tggttcatatttatacttt

SEQ ID NO: 4173709 - DNA, 20 bp, Homo sapiens
tggttgaactatgctgaaga

SEQ ID NO: 4173710 - DNA, 14 bp, Homo sapiens
tggttgatgccaaa

SEQ ID NO: 4173711 - DNA, 17 bp, Homo sapiens
tggttgccttaaagaaa

SEQ ID NO: 4173712 - DNA, 23 bp, Homo sapiens
tggtttattccctccagggtcta

SEQ ID NO: 4173713 - DNA, 13 bp, Homo sapiens
tggtttcccaaga

SEQ ID NO: 4173714 - DNA, 20 bp, Homo sapiens
tggttttctccaagagctac

SEQ ID NO: 4173715 - DNA, 13 bp, Homo sapiens
tgtaaaaaagatt

SEQ ID NO: 4173716 - DNA, 14 bp, Homo sapiens
tgtaaaaaagattt

SEQ ID NO: 4173717 - DNA, 17 bp, Homo sapiens
tgtaaaaacaaaaagac

SEQ ID NO: 4173718 - DNA, 19 bp, Homo sapiens
tgtaaaacatttattttga

SEQ ID NO: 4173719 - DNA, 14 bp, Homo sapiens
tgtaaaataagtat

SEQ ID NO: 4173720 - DNA, 12 bp, Homo sapiens
tgtaaacaacaa

SEQ ID NO: 4173721 - DNA, 20 bp, Homo sapiens
tgtaaacaggagacaggaag

SEQ ID NO: 4173722 - DNA, 16 bp, Homo sapiens
tgtaaagtgtaaatcc

SEQ ID NO: 4173723 - DNA, 14 bp, Homo sapiens
tgtaaatattttaa

SEQ ID NO: 4173724 - DNA, 22 bp, Homo sapiens
tgtaaatattttaaagaattgt

SEQ ID NO: 4173725 - DNA, 20 bp, Homo sapiens
tgtaaattttgtatgaaaaa

SEQ ID NO: 4173726 - DNA, 21 bp, Homo sapiens
tgtaacacagctgagagactt

SEQ ID NO: 4173727 - DNA, 17 bp, Homo sapiens
tgtaaccgcttctgggg

SEQ ID NO: 4173728 - DNA, 12 bp, Homo sapiens
tgtaagaaacct

SEQ ID NO: 4173729 - DNA, 14 bp, Homo sapiens
tgtaaggtcttctt

SEQ ID NO: 4173730 - DNA, 22 bp, Homo sapiens
tgtaaggtcttcttgtgtcctg

SEQ ID NO: 4173731 - DNA, 18 bp, Homo sapiens
tgtaagtacccctgataa

SEQ ID NO: 4173732 - DNA, 19 bp, Homo sapiens
tgtaagtttatgtctaaag

SEQ ID NO: 4173733 - DNA, 13 bp, Homo sapiens
tgtaataaaaggt

SEQ ID NO: 4173734 - DNA, 17 bp, Homo sapiens
tgtaatgagaacttcaa

SEQ ID NO: 4173735 - DNA, 22 bp, Homo sapiens
tgtaattatgaggtgaaacaat

SEQ ID NO: 4173736 - DNA, 20 bp, Homo sapiens
tgtaatttttttgaaaaaag

SEQ ID NO: 4173737 - DNA, 23 bp, Homo sapiens
tgtaatttttttgaaaaaagttc

SEQ ID NO: 4173738 - DNA, 16 bp, Homo sapiens
tgtacaaatgaaattt

SEQ ID NO: 4173739 - DNA, 19 bp, Homo sapiens
tgtacaatacataactagt

SEQ ID NO: 4173740 - DNA, 19 bp, Homo sapiens
tgtacagtgtgtaaagtgt

SEQ ID NO: 4173741 - DNA, 20 bp, Homo sapiens
tgtacagttcagttcctctt

SEQ ID NO: 4173742 - DNA, 16 bp, Homo sapiens
tgtactaaagccaaac

SEQ ID NO: 4173743 - DNA, 20 bp, Homo sapiens
tgtactaaagccaaacatat

SEQ ID NO: 4173744 - DNA, 16 bp, Homo sapiens
tgtagctcctctgctg

SEQ ID NO: 4173745 - DNA, 19 bp, Homo sapiens
tgtaggtgtctgcacccag

SEQ ID NO: 4173746 - DNA, 21 bp, Homo sapiens
tgtagtcgtacttaccaagct

SEQ ID NO: 4173747 - DNA, 15 bp, Homo sapiens
tgtagtctaagacct

SEQ ID NO: 4173748 - DNA, 18 bp, Homo sapiens
tgtagttaaagggcagaa

SEQ ID NO: 4173749 - DNA, 13 bp, Homo sapiens
tgtagttaggaaa

SEQ ID NO: 4173750 - DNA, 13 bp, Homo sapiens
tgtataatcccac

SEQ ID NO: 4173751 - DNA, 22 bp, Homo sapiens
tgtataatttaacagtgccctt

SEQ ID NO: 4173752 - DNA, 20 bp, Homo sapiens
tgtatagttaggatagcatt

SEQ ID NO: 4173753 - DNA, 17 bp, Homo sapiens
tgtatatatctgcttca

SEQ ID NO: 4173754 - DNA, 13 bp, Homo sapiens
tgtatatcagaaa

SEQ ID NO: 4173755 - DNA, 20 bp, Homo sapiens
tgtatcctgaggctgagaga

SEQ ID NO: 4173756 - DNA, 22 bp, Homo sapiens
tgtatctgaaggagattttcct

SEQ ID NO: 4173757 - DNA, 19 bp, Homo sapiens
tgtatcttctgcagacact

SEQ ID NO: 4173758 - DNA, 14 bp, Homo sapiens
tgtatgtatgtgtg

SEQ ID NO: 4173759 - DNA, 13 bp, Homo sapiens
tgtatgtgtgtgg

SEQ ID NO: 4173760 - DNA, 17 bp, Homo sapiens
tgtatttatatgttaat

SEQ ID NO: 4173761 - DNA, 21 bp, Homo sapiens
tgtatttatattttgtgctat

SEQ ID NO: 4173762 - DNA, 22 bp, Homo sapiens
tgtatttccaaacctggttcat

SEQ ID NO: 4173763 - DNA, 15 bp, Homo sapiens
tgtattttcttaata

SEQ ID NO: 4173764 - DNA, 21 bp, Homo sapiens
tgtattttttgttgaaagtaa

SEQ ID NO: 4173765 - DNA, 13 bp, Homo sapiens
tgtcaaaatcatg

SEQ ID NO: 4173766 - DNA, 14 bp, Homo sapiens
tgtcaacaaaaaga

SEQ ID NO: 4173767 - DNA, 18 bp, Homo sapiens
tgtcaacaaaaagacatg

SEQ ID NO: 4173768 - DNA, 23 bp, Homo sapiens
tgtcaacaaaaagacatggaagg

SEQ ID NO: 4173769 - DNA, 19 bp, Homo sapiens
tgtcaacacaaagacacag

SEQ ID NO: 4173770 - DNA, 23 bp, Homo sapiens
tgtcaacacaaagacacaggaag

SEQ ID NO: 4173771 - DNA, 20 bp, Homo sapiens
tgtcaacacaaagacatgga

SEQ ID NO: 4173772 - DNA, 14 bp, Homo sapiens
tgtcaagacatttc

SEQ ID NO: 4173773 - DNA, 19 bp, Homo sapiens
tgtcaatttccctgactcc

SEQ ID NO: 4173774 - DNA, 16 bp, Homo sapiens
tgtcaccgtgagcagc

SEQ ID NO: 4173775 - DNA, 20 bp, Homo sapiens
tgtcactcaaggcggtgctt

SEQ ID NO: 4173776 - DNA, 16 bp, Homo sapiens
tgtcactggcagagca

SEQ ID NO: 4173777 - DNA, 17 bp, Homo sapiens
tgtcagagccaggctct

SEQ ID NO: 4173778 - DNA, 19 bp, Homo sapiens
tgtcagagccaggctctgc

SEQ ID NO: 4173779 - DNA, 13 bp, Homo sapiens
tgtcagccttgca

SEQ ID NO: 4173780 - DNA, 23 bp, Homo sapiens
tgtcagcgcaggtttagtttact

SEQ ID NO: 4173781 - DNA, 21 bp, Homo sapiens
tgtcaggcattgaatgacaag

SEQ ID NO: 4173782 - DNA, 21 bp, Homo sapiens
tgtcatgaattcttatgctta

SEQ ID NO: 4173783 - DNA, 12 bp, Homo sapiens
tgtcatggtcct

SEQ ID NO: 4173784 - DNA, 20 bp, Homo sapiens
tgtcatttaccctggtggag

SEQ ID NO: 4173785 - DNA, 14 bp, Homo sapiens
tgtccaccagaccc

SEQ ID NO: 4173786 - DNA, 14 bp, Homo sapiens
tgtccatgtgcttc

SEQ ID NO: 4173787 - DNA, 17 bp, Homo sapiens
tgtccattcatctcatg

SEQ ID NO: 4173788 - DNA, 20 bp, Homo sapiens
tgtcccggagctcaggccct

SEQ ID NO: 4173789 - DNA, 15 bp, Homo sapiens
tgtccgcctctgccc

SEQ ID NO: 4173790 - DNA, 17 bp, Homo sapiens
tgtcctctccctgccaa

SEQ ID NO: 4173791 - DNA, 18 bp, Homo sapiens
tgtccttggaagtttcat

SEQ ID NO: 4173792 - DNA, 23 bp, Homo sapiens
tgtcgtagccaaggtgggctgag

SEQ ID NO: 4173793 - DNA, 23 bp, Homo sapiens
tgtctcaaaaaaaaaaaaaacaa

SEQ ID NO: 4173794 - DNA, 13 bp, Homo sapiens
tgtctcacagagg

SEQ ID NO: 4173795 - DNA, 15 bp, Homo sapiens
tgtctctagccactt

SEQ ID NO: 4173796 - DNA, 20 bp, Homo sapiens
tgtctctgcatctcattgta

SEQ ID NO: 4173797 - DNA, 15 bp, Homo sapiens
tgtctgatgtttgtt

SEQ ID NO: 4173798 - DNA, 14 bp, Homo sapiens
tgtctgccacagag

SEQ ID NO: 4173799 - DNA, 18 bp, Homo sapiens
tgtctgccttaggctgct

SEQ ID NO: 4173800 - DNA, 15 bp, Homo sapiens
tgtctgggagagcct

SEQ ID NO: 4173801 - DNA, 19 bp, Homo sapiens
tgtctgggagagcctggca

SEQ ID NO: 4173802 - DNA, 22 bp, Homo sapiens
tgtctggttttaacaatttcct

SEQ ID NO: 4173803 - DNA, 17 bp, Homo sapiens
tgtctgtcctcagagca

SEQ ID NO: 4173804 - DNA, 23 bp, Homo sapiens
tgtctgtcctcagagcaggggcc

SEQ ID NO: 4173805 - DNA, 12 bp, Homo sapiens
tgtctgtctaca

SEQ ID NO: 4173806 - DNA, 14 bp, Homo sapiens
tgtctgtctacatt

SEQ ID NO: 4173807 - DNA, 16 bp, Homo sapiens
tgtctgtctgtctgtc

SEQ ID NO: 4173808 - DNA, 15 bp, Homo sapiens
tgtctgtggattttt

SEQ ID NO: 4173809 - DNA, 16 bp, Homo sapiens
tgtctgtgtgctgtaa

SEQ ID NO: 4173810 - DNA, 16 bp, Homo sapiens
tgtctgtttgttctct

SEQ ID NO: 4173811 - DNA, 21 bp, Homo sapiens
tgtgaaagtcagatgcccaga

SEQ ID NO: 4173812 - DNA, 22 bp, Homo sapiens
tgtgaaagtcagatgcccagag

SEQ ID NO: 4173813 - DNA, 23 bp, Homo sapiens
tgtgaaataccacaagcctgaga

SEQ ID NO: 4173814 - DNA, 14 bp, Homo sapiens
tgtgaacatggact

SEQ ID NO: 4173815 - DNA, 19 bp, Homo sapiens
tgtgaactggaagaaagca

SEQ ID NO: 4173816 - DNA, 18 bp, Homo sapiens
tgtgaagggaaagaaatt

SEQ ID NO: 4173817 - DNA, 14 bp, Homo sapiens
tgtgaccctctgaa

SEQ ID NO: 4173818 - DNA, 16 bp, Homo sapiens
tgtgaccctctgaatg

SEQ ID NO: 4173819 - DNA, 20 bp, Homo sapiens
tgtgaggactgggggcacct

SEQ ID NO: 4173820 - DNA, 14 bp, Homo sapiens
tgtgaggcctggcc

SEQ ID NO: 4173821 - DNA, 18 bp, Homo sapiens
tgtgaggcctggccaggc

SEQ ID NO: 4173822 - DNA, 16 bp, Homo sapiens
tgtgatgttaactatt

SEQ ID NO: 4173823 - DNA, 13 bp, Homo sapiens
tgtgattggagtg

SEQ ID NO: 4173824 - DNA, 17 bp, Homo sapiens
tgtgcaatgtaaatatt

SEQ ID NO: 4173825 - DNA, 18 bp, Homo sapiens
tgtgcagtcagtgtcaat

SEQ ID NO: 4173826 - DNA, 18 bp, Homo sapiens
tgtgcatgtatgtgtgtg

SEQ ID NO: 4173827 - DNA, 18 bp, Homo sapiens
tgtgccatagagtttaac

SEQ ID NO: 4173828 - DNA, 16 bp, Homo sapiens
tgtgccccatgtccaa

SEQ ID NO: 4173829 - DNA, 18 bp, Homo sapiens
tgtgccctgccttcagct

SEQ ID NO: 4173830 - DNA, 22 bp, Homo sapiens
tgtgcctgccctggagggaggc

SEQ ID NO: 4173831 - DNA, 22 bp, Homo sapiens
tgtgccttaaaaatcaagacac

SEQ ID NO: 4173832 - DNA, 23 bp, Homo sapiens
tgtgcctttgggaggcagcatca

SEQ ID NO: 4173833 - DNA, 16 bp, Homo sapiens
tgtgccttttatagct

SEQ ID NO: 4173834 - DNA, 15 bp, Homo sapiens
tgtgctactttgcct

SEQ ID NO: 4173835 - DNA, 16 bp, Homo sapiens
tgtgctactttgcctt

SEQ ID NO: 4173836 - DNA, 21 bp, Homo sapiens
tgtgctgacggaagccaactt

SEQ ID NO: 4173837 - DNA, 19 bp, Homo sapiens
tgtgctgtgctatggtgct

SEQ ID NO: 4173838 - DNA, 19 bp, Homo sapiens
tgtggaaggcagggacaga

SEQ ID NO: 4173839 - DNA, 20 bp, Homo sapiens
tgtggaaggcagggacagag

SEQ ID NO: 4173840 - DNA, 20 bp, Homo sapiens
tgtggagaaggatagcctca

SEQ ID NO: 4173841 - DNA, 18 bp, Homo sapiens
tgtggattccagcatttg

SEQ ID NO: 4173842 - DNA, 15 bp, Homo sapiens
tgtggccttctcagc

SEQ ID NO: 4173843 - DNA, 16 bp, Homo sapiens
tgtggccttctcagcc

SEQ ID NO: 4173844 - DNA, 21 bp, Homo sapiens
tgtggccttctcagcctacag

SEQ ID NO: 4173845 - DNA, 12 bp, Homo sapiens
tgtggggccttg

SEQ ID NO: 4173846 - DNA, 24 bp, Homo sapiens
tgtggtatagtagaaaggccagct

SEQ ID NO: 4173847 - DNA, 18 bp, Homo sapiens
tgtggtgtcaccagcctg

SEQ ID NO: 4173848 - DNA, 18 bp, Homo sapiens
tgtggtttactagcagga

SEQ ID NO: 4173849 - DNA, 22 bp, Homo sapiens
tgtggtttcaaatcagccagct

SEQ ID NO: 4173850 - DNA, 15 bp, Homo sapiens
tgtgtacatgtacat

SEQ ID NO: 4173851 - DNA, 17 bp, Homo sapiens
tgtgtacctttgtgtaa

SEQ ID NO: 4173852 - DNA, 22 bp, Homo sapiens
tgtgtatccgactctaagctgt

SEQ ID NO: 4173853 - DNA, 16 bp, Homo sapiens
tgtgtcagagacagac

SEQ ID NO: 4173854 - DNA, 19 bp, Homo sapiens
tgtgtctgcgtctgtgttg

SEQ ID NO: 4173855 - DNA, 13 bp, Homo sapiens
tgtgtctggcccc

SEQ ID NO: 4173856 - DNA, 20 bp, Homo sapiens
tgtgtctgggagagcctggc

SEQ ID NO: 4173857 - DNA, 14 bp, Homo sapiens
tgtgtgaagaataa

SEQ ID NO: 4173858 - DNA, 17 bp, Homo sapiens
tgtgtgatgaactttct

SEQ ID NO: 4173859 - DNA, 17 bp, Homo sapiens
tgtgtgcaccttaccaa

SEQ ID NO: 4173860 - DNA, 16 bp, Homo sapiens
tgtgtgcatgtatgtg

SEQ ID NO: 4173861 - DNA, 16 bp, Homo sapiens
tgtgtggtgtgtgtgc

SEQ ID NO: 4173862 - DNA, 12 bp, Homo sapiens
tgtgtgtacatg

SEQ ID NO: 4173863 - DNA, 21 bp, Homo sapiens
tgtgtgtttaacattcacagc

SEQ ID NO: 4173864 - DNA, 21 bp, Homo sapiens
tgtgtttaaattattttatca

SEQ ID NO: 4173865 - DNA, 17 bp, Homo sapiens
tgtgtttggaagactat

SEQ ID NO: 4173866 - DNA, 19 bp, Homo sapiens
tgttaaaaaaataagaaga

SEQ ID NO: 4173867 - DNA, 22 bp, Homo sapiens
tgttaaaaaaataagaagaatg

SEQ ID NO: 4173868 - DNA, 23 bp, Homo sapiens
tgttaaaaaaataagaagaatgc

SEQ ID NO: 4173869 - DNA, 17 bp, Homo sapiens
tgttaaaatagacaact

SEQ ID NO: 4173870 - DNA, 15 bp, Homo sapiens
tgttaatttagaaaa

SEQ ID NO: 4173871 - DNA, 15 bp, Homo sapiens
tgttaatttatttag

SEQ ID NO: 4173872 - DNA, 12 bp, Homo sapiens
tgttacatcaca

SEQ ID NO: 4173873 - DNA, 22 bp, Homo sapiens
tgttacattgtcaaagcttgcc

SEQ ID NO: 4173874 - DNA, 18 bp, Homo sapiens
tgttactgattctcctgt

SEQ ID NO: 4173875 - DNA, 19 bp, Homo sapiens
tgttactttcactttttta

SEQ ID NO: 4173876 - DNA, 23 bp, Homo sapiens
tgttagagaggtagcgagctgct

SEQ ID NO: 4173877 - DNA, 23 bp, Homo sapiens
tgttaggtcaagctatttctctg

SEQ ID NO: 4173878 - DNA, 17 bp, Homo sapiens
tgttatttgtaatagat

SEQ ID NO: 4173879 - DNA, 18 bp, Homo sapiens
tgttattttcagtatttt

SEQ ID NO: 4173880 - DNA, 18 bp, Homo sapiens
tgttcaagtatctaactc

SEQ ID NO: 4173881 - DNA, 19 bp, Homo sapiens
tgttcatgatagtgtgatt

SEQ ID NO: 4173882 - DNA, 16 bp, Homo sapiens
tgttccagctgcctgg

SEQ ID NO: 4173883 - DNA, 17 bp, Homo sapiens
tgttcccaatatgtagc

SEQ ID NO: 4173884 - DNA, 20 bp, Homo sapiens
tgttcgggggacaacttgta

SEQ ID NO: 4173885 - DNA, 19 bp, Homo sapiens
tgttctatagagcctggcg

SEQ ID NO: 4173886 - DNA, 13 bp, Homo sapiens
tgttctcagaatc

SEQ ID NO: 4173887 - DNA, 14 bp, Homo sapiens
tgttctgtgataga

SEQ ID NO: 4173888 - DNA, 22 bp, Homo sapiens
tgttgaaaattattttaaacaa

SEQ ID NO: 4173889 - DNA, 19 bp, Homo sapiens
tgttgatacgtgtgtgaag

SEQ ID NO: 4173890 - DNA, 12 bp, Homo sapiens
tgttgatcccaa

SEQ ID NO: 4173891 - DNA, 16 bp, Homo sapiens
tgttgatcccaagaca

SEQ ID NO: 4173892 - DNA, 13 bp, Homo sapiens
tgttgccctgagt

SEQ ID NO: 4173893 - DNA, 15 bp, Homo sapiens
tgttgtacaagctca

SEQ ID NO: 4173894 - DNA, 17 bp, Homo sapiens
tgttgtctgtttgttct

SEQ ID NO: 4173895 - DNA, 24 bp, Homo sapiens
tgtttaaacacttatcttctggat

SEQ ID NO: 4173896 - DNA, 23 bp, Homo sapiens
tgtttaaagttcaacatgttatt

SEQ ID NO: 4173897 - DNA, 18 bp, Homo sapiens
tgtttaacattcacagcc

SEQ ID NO: 4173898 - DNA, 21 bp, Homo sapiens
tgtttaccaaggaaagaacaa

SEQ ID NO: 4173899 - DNA, 22 bp, Homo sapiens
tgtttcaaaaataaaagaacac

SEQ ID NO: 4173900 - DNA, 16 bp, Homo sapiens
tgtttgaagttacaaa

SEQ ID NO: 4173901 - DNA, 17 bp, Homo sapiens
tgtttggaaaagctaag

SEQ ID NO: 4173902 - DNA, 23 bp, Homo sapiens
tgttttacaaatttttcctgcaa

SEQ ID NO: 4173903 - DNA, 16 bp, Homo sapiens
tgttttagctgaggga

SEQ ID NO: 4173904 - DNA, 19 bp, Homo sapiens
tgttttatgagaaagcctt

SEQ ID NO: 4173905 - DNA, 14 bp, Homo sapiens
tgttttatgttcta

SEQ ID NO: 4173906 - DNA, 18 bp, Homo sapiens
tgttttattttttattgt

SEQ ID NO: 4173907 - DNA, 23 bp, Homo sapiens
tgttttattttttattgttttca

SEQ ID NO: 4173908 - DNA, 22 bp, Homo sapiens
tgttttcccgagcaaagtctaa

SEQ ID NO: 4173909 - DNA, 23 bp, Homo sapiens
tgttttctaaagttgttcacata

SEQ ID NO: 4173910 - DNA, 14 bp, Homo sapiens
tgttttgcactgac

SEQ ID NO: 4173911 - DNA, 14 bp, Homo sapiens
tgttttgtttcttg

SEQ ID NO: 4173912 - DNA, 14 bp, Homo sapiens
tgtttttcatgaaa

SEQ ID NO: 4173913 - DNA, 12 bp, Homo sapiens
ttaaaaaaataa

SEQ ID NO: 4173914 - DNA, 15 bp, Homo sapiens
ttaaaaacttccatc

SEQ ID NO: 4173915 - DNA, 16 bp, Homo sapiens
ttaaaaaggtttacag

SEQ ID NO: 4173916 - DNA, 20 bp, Homo sapiens
ttaaaaatatggaacttcta

SEQ ID NO: 4173917 - DNA, 14 bp, Homo sapiens
ttaaaacagcctgg

SEQ ID NO: 4173918 - DNA, 17 bp, Homo sapiens
ttaaaaccacagaacag

SEQ ID NO: 4173919 - DNA, 20 bp, Homo sapiens
ttaaaaccacagaacagttt

SEQ ID NO: 4173920 - DNA, 18 bp, Homo sapiens
ttaaaaccataaactgta

SEQ ID NO: 4173921 - DNA, 22 bp, Homo sapiens
ttaaaaccattatttaataaga

SEQ ID NO: 4173922 - DNA, 15 bp, Homo sapiens
ttaaaactttgaagt

SEQ ID NO: 4173923 - DNA, 22 bp, Homo sapiens
ttaaaatagcaaaagaagaagt

SEQ ID NO: 4173924 - DNA, 23 bp, Homo sapiens
ttaaaatagcaaaagaagaagtt

SEQ ID NO: 4173925 - DNA, 19 bp, Homo sapiens
ttaaaccgctaaaagaaac

SEQ ID NO: 4173926 - DNA, 12 bp, Homo sapiens
ttaaagatgtgt

SEQ ID NO: 4173927 - DNA, 14 bp, Homo sapiens
ttaaagctgcctgt

SEQ ID NO: 4173928 - DNA, 22 bp, Homo sapiens
ttaaagggcagaaggggaagat

SEQ ID NO: 4173929 - DNA, 21 bp, Homo sapiens
ttaaagtgactaatggcatga

SEQ ID NO: 4173930 - DNA, 15 bp, Homo sapiens
ttaaagttggagaca

SEQ ID NO: 4173931 - DNA, 22 bp, Homo sapiens
ttaaatacctctggcttagaaa

SEQ ID NO: 4173932 - DNA, 20 bp, Homo sapiens
ttaacagtgcccttttcatc

SEQ ID NO: 4173933 - DNA, 13 bp, Homo sapiens
ttaaccagatcta

SEQ ID NO: 4173934 - DNA, 22 bp, Homo sapiens
ttaaccagatctagtcaatcaa

SEQ ID NO: 4173935 - DNA, 15 bp, Homo sapiens
ttaactatgtgatgt

SEQ ID NO: 4173936 - DNA, 16 bp, Homo sapiens
ttaactgaataggaaa

SEQ ID NO: 4173937 - DNA, 21 bp, Homo sapiens
ttaactgggtaatgaaacaaa

SEQ ID NO: 4173938 - DNA, 15 bp, Homo sapiens
ttaacttaaatagta

SEQ ID NO: 4173939 - DNA, 17 bp, Homo sapiens
ttaacttggtcagagcc

SEQ ID NO: 4173940 - DNA, 21 bp, Homo sapiens
ttaacttgtattttcttaata

SEQ ID NO: 4173941 - DNA, 14 bp, Homo sapiens
ttaagagcaataaa

SEQ ID NO: 4173942 - DNA, 20 bp, Homo sapiens
ttaagagtagcaagttctag

SEQ ID NO: 4173943 - DNA, 16 bp, Homo sapiens
ttaagagtgaaataat

SEQ ID NO: 4173944 - DNA, 16 bp, Homo sapiens
ttaagatagaacaggc

SEQ ID NO: 4173945 - DNA, 17 bp, Homo sapiens
ttaaggtgtagccacac

SEQ ID NO: 4173946 - DNA, 16 bp, Homo sapiens
ttaagtgtttgaaaac

SEQ ID NO: 4173947 - DNA, 21 bp, Homo sapiens
ttaataagagtaaaaatatgt

SEQ ID NO: 4173948 - DNA, 13 bp, Homo sapiens
ttaataaggaaaa

SEQ ID NO: 4173949 - DNA, 15 bp, Homo sapiens
ttaataaggaaaaaa

SEQ ID NO: 4173950 - DNA, 17 bp, Homo sapiens
ttaatacaatattaatt

SEQ ID NO: 4173951 - DNA, 23 bp, Homo sapiens
ttaatactttttacccaaatatg

SEQ ID NO: 4173952 - DNA, 14 bp, Homo sapiens
ttaatatacaatct

SEQ ID NO: 4173953 - DNA, 19 bp, Homo sapiens
ttaatatacaatctatctt

SEQ ID NO: 4173954 - DNA, 17 bp, Homo sapiens
ttaatcagatagatatt

SEQ ID NO: 4173955 - DNA, 15 bp, Homo sapiens
ttaatcgtgtcttca

SEQ ID NO: 4173956 - DNA, 14 bp, Homo sapiens
ttaatctttcctga

SEQ ID NO: 4173957 - DNA, 16 bp, Homo sapiens
ttaatgcttaaaaatg

SEQ ID NO: 4173958 - DNA, 22 bp, Homo sapiens
ttaatgcttaaaaatgtatccc

SEQ ID NO: 4173959 - DNA, 16 bp, Homo sapiens
ttaatggctgataatt

SEQ ID NO: 4173960 - DNA, 18 bp, Homo sapiens
ttaattaactatgtgatg

SEQ ID NO: 4173961 - DNA, 17 bp, Homo sapiens
ttaattagaaacgtgat

SEQ ID NO: 4173962 - DNA, 15 bp, Homo sapiens
ttaatttagaaaact

SEQ ID NO: 4173963 - DNA, 16 bp, Homo sapiens
ttaatttagaaaactt

SEQ ID NO: 4173964 - DNA, 14 bp, Homo sapiens
ttaatttctattgt

SEQ ID NO: 4173965 - DNA, 16 bp, Homo sapiens
ttaatttgatacaaaa

SEQ ID NO: 4173966 - DNA, 22 bp, Homo sapiens
ttaattttcaggatttttggta

SEQ ID NO: 4173967 - DNA, 20 bp, Homo sapiens
ttaattttcctggaaagact

SEQ ID NO: 4173968 - DNA, 12 bp, Homo sapiens
ttaatttttgat

SEQ ID NO: 4173969 - DNA, 18 bp, Homo sapiens
ttacaaatttttcctgca

SEQ ID NO: 4173970 - DNA, 21 bp, Homo sapiens
ttacaagaattgtccatgtgc

SEQ ID NO: 4173971 - DNA, 16 bp, Homo sapiens
ttacaagtgtatatca

SEQ ID NO: 4173972 - DNA, 21 bp, Homo sapiens
ttacacaagtttaaaaatatt

SEQ ID NO: 4173973 - DNA, 17 bp, Homo sapiens
ttacacattatgttaga

SEQ ID NO: 4173974 - DNA, 11 bp, Homo sapiens
ttacagaactg

SEQ ID NO: 4173975 - DNA, 17 bp, Homo sapiens
ttacagtaaataaattg

SEQ ID NO: 4173976 - DNA, 22 bp, Homo sapiens
ttacagtaaataaattgtttga

SEQ ID NO: 4173977 - DNA, 14 bp, Homo sapiens
ttacagtgcagtgc

SEQ ID NO: 4173978 - DNA, 18 bp, Homo sapiens
ttacatataataaataga

SEQ ID NO: 4173979 - DNA, 12 bp, Homo sapiens
ttacatgaacac

SEQ ID NO: 4173980 - DNA, 16 bp, Homo sapiens
ttaccaactttctgta

SEQ ID NO: 4173981 - DNA, 21 bp, Homo sapiens
ttaccaatttaactagtcctg

SEQ ID NO: 4173982 - DNA, 24 bp, Homo sapiens
ttacccaaaaactaaatctctaat

SEQ ID NO: 4173983 - DNA, 17 bp, Homo sapiens
ttaccccagctgcggca

SEQ ID NO: 4173984 - DNA, 15 bp, Homo sapiens
ttacgtgagccaggt

SEQ ID NO: 4173985 - DNA, 17 bp, Homo sapiens
ttactaagccacaagaa

SEQ ID NO: 4173986 - DNA, 18 bp, Homo sapiens
ttactaagccacaagaaa

SEQ ID NO: 4173987 - DNA, 20 bp, Homo sapiens
ttactaagccacaagaaatt

SEQ ID NO: 4173988 - DNA, 22 bp, Homo sapiens
ttactaagccacaagaaatttg

SEQ ID NO: 4173989 - DNA, 23 bp, Homo sapiens
ttactataagaactttgagctac

SEQ ID NO: 4173990 - DNA, 22 bp, Homo sapiens
ttactctgcggtggtgccagag

SEQ ID NO: 4173991 - DNA, 19 bp, Homo sapiens
ttactgtgtgaagaataat

SEQ ID NO: 4173992 - DNA, 13 bp, Homo sapiens
ttacttgaaagat

SEQ ID NO: 4173993 - DNA, 14 bp, Homo sapiens
ttactttaatgcga

SEQ ID NO: 4173994 - DNA, 11 bp, Homo sapiens
ttactttctgt

SEQ ID NO: 4173995 - DNA, 18 bp, Homo sapiens
ttactttctgttgccaca

SEQ ID NO: 4173996 - DNA, 20 bp, Homo sapiens
ttactttggcaatttcctgg

SEQ ID NO: 4173997 - DNA, 19 bp, Homo sapiens
ttacttttgttctgtattt

SEQ ID NO: 4173998 - DNA, 14 bp, Homo sapiens
ttagaaatatcctt

SEQ ID NO: 4173999 - DNA, 19 bp, Homo sapiens
ttagaaatatcctttggaa

SEQ ID NO: 4174000 - DNA, 17 bp, Homo sapiens
ttagaagacaattgaca

SEQ ID NO: 4174001 - DNA, 10 bp, Homo sapiens
ttagaagcaa

SEQ ID NO: 4174002 - DNA, 15 bp, Homo sapiens
ttagaataaaattgt

SEQ ID NO: 4174003 - DNA, 14 bp, Homo sapiens
ttagactagttgaa

SEQ ID NO: 4174004 - DNA, 21 bp, Homo sapiens
ttagactagttgaacatctca

SEQ ID NO: 4174005 - DNA, 16 bp, Homo sapiens
ttagagaatatatttt

SEQ ID NO: 4174006 - DNA, 14 bp, Homo sapiens
ttagagaggaaaag

SEQ ID NO: 4174007 - DNA, 16 bp, Homo sapiens
ttagatgttactgtgt

SEQ ID NO: 4174008 - DNA, 21 bp, Homo sapiens
ttcccccacccctaacctggc

SEQ ID NO: 4174009 - DNA, 16 bp, Homo sapiens
ttccccgggggaggaa

SEQ ID NO: 4174010 - DNA, 13 bp, Homo sapiens
ttcccctccacca

SEQ ID NO: 4174011 - DNA, 12 bp, Homo sapiens
ttcccctgtggt

SEQ ID NO: 4174012 - DNA, 15 bp, Homo sapiens
ttcccgagggagctg

SEQ ID NO: 4174013 - DNA, 14 bp, Homo sapiens
ttcccgctctgcat

SEQ ID NO: 4174014 - DNA, 21 bp, Homo sapiens
ttcccggactgcaagcagggc

SEQ ID NO: 4174015 - DNA, 20 bp, Homo sapiens
ttccctccccacagtcctca

SEQ ID NO: 4174016 - DNA, 11 bp, Homo sapiens
ttccctctgag

SEQ ID NO: 4174017 - DNA, 17 bp, Homo sapiens
ttccctctttccccacc

SEQ ID NO: 4174018 - DNA, 12 bp, Homo sapiens
ttccctgtgctg

SEQ ID NO: 4174019 - DNA, 17 bp, Homo sapiens
ttcccttgtgtcaagac

SEQ ID NO: 4174020 - DNA, 21 bp, Homo sapiens
ttcctacacccttggacttga

SEQ ID NO: 4174021 - DNA, 23 bp, Homo sapiens
ttcctccccaccttccccagact

SEQ ID NO: 4174022 - DNA, 21 bp, Homo sapiens
ttcctcgtgcagagctggggc

SEQ ID NO: 4174023 - DNA, 19 bp, Homo sapiens
ttcctctagtgccctccac

SEQ ID NO: 4174024 - DNA, 18 bp, Homo sapiens
ttcctctcactaaacttt

SEQ ID NO: 4174025 - DNA, 21 bp, Homo sapiens
ttcctctgtttctccttctga

SEQ ID NO: 4174026 - DNA, 15 bp, Homo sapiens
ttcctctttgcatgg

SEQ ID NO: 4174027 - DNA, 23 bp, Homo sapiens
ttcctgagtgtgggcttctgaaa

SEQ ID NO: 4174028 - DNA, 14 bp, Homo sapiens
ttcctgggcaagaa

SEQ ID NO: 4174029 - DNA, 19 bp, Homo sapiens
ttcctggtgaggcccagcc

SEQ ID NO: 4174030 - DNA, 22 bp, Homo sapiens
ttcctggtgaggcccagcctgt

SEQ ID NO: 4174031 - DNA, 19 bp, Homo sapiens
ttccttccgctcctttacc

SEQ ID NO: 4174032 - DNA, 20 bp, Homo sapiens
ttccttccgctcctttacct

SEQ ID NO: 4174033 - DNA, 14 bp, Homo sapiens
ttccttggtttgga

SEQ ID NO: 4174034 - DNA, 14 bp, Homo sapiens
ttcctttatattta

SEQ ID NO: 4174035 - DNA, 18 bp, Homo sapiens
ttccttttcttccttctt

SEQ ID NO: 4174036 - DNA, 16 bp, Homo sapiens
ttcctttttgcagtat

SEQ ID NO: 4174037 - DNA, 12 bp, Homo sapiens
ttcgcctgtggg

SEQ ID NO: 4174038 - DNA, 16 bp, Homo sapiens
ttcgcctgtgggaaga

SEQ ID NO: 4174039 - DNA, 17 bp, Homo sapiens
ttcgcctgtgggaagag

SEQ ID NO: 4174040 - DNA, 15 bp, Homo sapiens
ttcgcttgcttctgc

SEQ ID NO: 4174041 - DNA, 16 bp, Homo sapiens
ttcgcttgcttctgca

SEQ ID NO: 4174042 - DNA, 18 bp, Homo sapiens
ttcgcttgcttctgcagc

SEQ ID NO: 4174043 - DNA, 13 bp, Homo sapiens
ttcgctttcctct

SEQ ID NO: 4174044 - DNA, 15 bp, Homo sapiens
ttctaaaatgattgt

SEQ ID NO: 4174045 - DNA, 16 bp, Homo sapiens
ttctaaaattgaagag

SEQ ID NO: 4174046 - DNA, 16 bp, Homo sapiens
ttctaaagctttctga

SEQ ID NO: 4174047 - DNA, 22 bp, Homo sapiens
ttctaatatatttttatattta

SEQ ID NO: 4174048 - DNA, 12 bp, Homo sapiens
ttctagagaaga

SEQ ID NO: 4174049 - DNA, 14 bp, Homo sapiens
ttctagagaagagg

SEQ ID NO: 4174050 - DNA, 22 bp, Homo sapiens
ttctagagaagaggctggtgct

SEQ ID NO: 4174051 - DNA, 22 bp, Homo sapiens
ttctaggaaacccaaggaacaa

SEQ ID NO: 4174052 - DNA, 17 bp, Homo sapiens
ttctaggtcctggcttc

SEQ ID NO: 4174053 - DNA, 18 bp, Homo sapiens
ttctagtagaaagaaaat

SEQ ID NO: 4174054 - DNA, 14 bp, Homo sapiens
ttctatagccaaaa

SEQ ID NO: 4174055 - DNA, 16 bp, Homo sapiens
ttctatagttattaag

SEQ ID NO: 4174056 - DNA, 12 bp, Homo sapiens
ttctatgtatgt

SEQ ID NO: 4174057 - DNA, 15 bp, Homo sapiens
ttctattacacaagt

SEQ ID NO: 4174058 - DNA, 20 bp, Homo sapiens
ttctattacacaagtttaaa

SEQ ID NO: 4174059 - DNA, 22 bp, Homo sapiens
ttctattcaaggtggccaaatt

SEQ ID NO: 4174060 - DNA, 15 bp, Homo sapiens
ttctcactaaatctt

SEQ ID NO: 4174061 - DNA, 20 bp, Homo sapiens
ttctcagtggcttctccatc

SEQ ID NO: 4174062 - DNA, 15 bp, Homo sapiens
ttctcatggggtggg

SEQ ID NO: 4174063 - DNA, 23 bp, Homo sapiens
ttctcattttttaaaaaagctta

SEQ ID NO: 4174064 - DNA, 19 bp, Homo sapiens
ttctccagacccaccacac

SEQ ID NO: 4174065 - DNA, 18 bp, Homo sapiens
ttctccaggctctttggg

SEQ ID NO: 4174066 - DNA, 19 bp, Homo sapiens
ttctccaggtttgctgtgt

SEQ ID NO: 4174067 - DNA, 20 bp, Homo sapiens
ttctccagtttcagaagcag

SEQ ID NO: 4174068 - DNA, 15 bp, Homo sapiens
ttctcccagcctctt

SEQ ID NO: 4174069 - DNA, 15 bp, Homo sapiens
ttctccctgggaact

SEQ ID NO: 4174070 - DNA, 23 bp, Homo sapiens
ttctccgactgctagggagtggt

SEQ ID NO: 4174071 - DNA, 23 bp, Homo sapiens
ttctctataggtcatgatttctg

SEQ ID NO: 4174072 - DNA, 18 bp, Homo sapiens
ttctctccttcttccctg

SEQ ID NO: 4174073 - DNA, 21 bp, Homo sapiens
ttctgaaacttcataaatgtt

SEQ ID NO: 4174074 - DNA, 14 bp, Homo sapiens
ttctgaatctgaaa

SEQ ID NO: 4174075 - DNA, 23 bp, Homo sapiens
ttctgacaagataaaggaagtca

SEQ ID NO: 4174076 - DNA, 22 bp, Homo sapiens
ttctgagatccagcacaactca

SEQ ID NO: 4174077 - DNA, 15 bp, Homo sapiens
ttctgagttctggtg

SEQ ID NO: 4174078 - DNA, 20 bp, Homo sapiens
ttctgcagatcttccgtggt

SEQ ID NO: 4174079 - DNA, 15 bp, Homo sapiens
ttctgcagcaactcc

SEQ ID NO: 4174080 - DNA, 19 bp, Homo sapiens
ttctgcccacattggaccc

SEQ ID NO: 4174081 - DNA, 21 bp, Homo sapiens
ttctgctactttgctgctatg

SEQ ID NO: 4174082 - DNA, 21 bp, Homo sapiens
ttctggattccccatctcagg

SEQ ID NO: 4174083 - DNA, 15 bp, Homo sapiens
ttctggccaggaagc

SEQ ID NO: 4174084 - DNA, 22 bp, Homo sapiens
ttctggctccaaggtgctctgt

SEQ ID NO: 4174085 - DNA, 19 bp, Homo sapiens
ttctgggagtcctgtcagc

SEQ ID NO: 4174086 - DNA, 21 bp, Homo sapiens
ttctggtatgaacttgaggac

SEQ ID NO: 4174087 - DNA, 19 bp, Homo sapiens
ttctgtaagaaacctactg

SEQ ID NO: 4174088 - DNA, 14 bp, Homo sapiens
ttctgtctttagat

SEQ ID NO: 4174089 - DNA, 17 bp, Homo sapiens
ttctgtgaagcaaaaag

SEQ ID NO: 4174090 - DNA, 23 bp, Homo sapiens
ttctgtgtgcaccttaccaactt

SEQ ID NO: 4174091 - DNA, 17 bp, Homo sapiens
ttcttaaacacttgcaa

SEQ ID NO: 4174092 - DNA, 11 bp, Homo sapiens
ttcttaaataa

SEQ ID NO: 4174093 - DNA, 16 bp, Homo sapiens
ttcttatcttctgcaa

SEQ ID NO: 4174094 - DNA, 14 bp, Homo sapiens
ttcttcagaagaca

SEQ ID NO: 4174095 - DNA, 16 bp, Homo sapiens
ttcttcatcttgacat

SEQ ID NO: 4174096 - DNA, 16 bp, Homo sapiens
ttcttctggtgctact

SEQ ID NO: 4174097 - DNA, 16 bp, Homo sapiens
ttcttgagtagatctg

SEQ ID NO: 4174098 - DNA, 21 bp, Homo sapiens
ttctttactggtgatttctga

SEQ ID NO: 4174099 - DNA, 22 bp, Homo sapiens
ttctttactggtgatttctgag

SEQ ID NO: 4174100 - DNA, 13 bp, Homo sapiens
ttctttataaact

SEQ ID NO: 4174101 - DNA, 12 bp, Homo sapiens
ttgaaagaaagt

SEQ ID NO: 4174102 - DNA, 12 bp, Homo sapiens
ttgaaattttaa

SEQ ID NO: 4174103 - DNA, 15 bp, Homo sapiens
ttgaacccctgtgtc

SEQ ID NO: 4174104 - DNA, 19 bp, Homo sapiens
ttgaacctgatgagcaaga

SEQ ID NO: 4174105 - DNA, 20 bp, Homo sapiens
ttgaagcaaatcgaatgaaa

SEQ ID NO: 4174106 - DNA, 18 bp, Homo sapiens
ttgaaggaggtgagggat

SEQ ID NO: 4174107 - DNA, 19 bp, Homo sapiens
ttgaagttagctttaactt

SEQ ID NO: 4174108 - DNA, 15 bp, Homo sapiens
ttgaagttatttaga

SEQ ID NO: 4174109 - DNA, 20 bp, Homo sapiens
ttgaagttatttagaaatat

SEQ ID NO: 4174110 - DNA, 13 bp, Homo sapiens
ttgaatacacaaa

SEQ ID NO: 4174111 - DNA, 15 bp, Homo sapiens
ttgaatgctttttga

SEQ ID NO: 4174112 - DNA, 18 bp, Homo sapiens
ttgaatggcctgccttga

SEQ ID NO: 4174113 - DNA, 16 bp, Homo sapiens
ttgaatgtttatgttc

SEQ ID NO: 4174114 - DNA, 15 bp, Homo sapiens
ttgacataaagttga

SEQ ID NO: 4174115 - DNA, 19 bp, Homo sapiens
ttgacataaagttgataaa

SEQ ID NO: 4174116 - DNA, 13 bp, Homo sapiens
ttgacccctttcc

SEQ ID NO: 4174117 - DNA, 20 bp, Homo sapiens
ttgacttctcttgaattatt

SEQ ID NO: 4174118 - DNA, 16 bp, Homo sapiens
ttgagcatcacagaat

SEQ ID NO: 4174119 - DNA, 11 bp, Homo sapiens
ttgaggacaca

SEQ ID NO: 4174120 - DNA, 13 bp, Homo sapiens
ttgaggacacatg

SEQ ID NO: 4174121 - DNA, 14 bp, Homo sapiens
ttgaggacacatgt

SEQ ID NO: 4174122 - DNA, 15 bp, Homo sapiens
ttgaggattttgagt

SEQ ID NO: 4174123 - DNA, 23 bp, Homo sapiens
ttgagtactagaatttgtatttt

SEQ ID NO: 4174124 - DNA, 17 bp, Homo sapiens
ttgataaagatttttta

SEQ ID NO: 4174125 - DNA, 20 bp, Homo sapiens
ttgataaagattttttaata

SEQ ID NO: 4174126 - DNA, 18 bp, Homo sapiens
ttgatacgtgtgtgaagt

SEQ ID NO: 4174127 - DNA, 18 bp, Homo sapiens
ttgatgagttaactgtga

SEQ ID NO: 4174128 - DNA, 13 bp, Homo sapiens
ttgatgtcagcct

SEQ ID NO: 4174129 - DNA, 12 bp, Homo sapiens
ttgattcttcct

SEQ ID NO: 4174130 - DNA, 19 bp, Homo sapiens
ttgatttatgcatggaaac

SEQ ID NO: 4174131 - DNA, 14 bp, Homo sapiens
ttgattttctggat

SEQ ID NO: 4174132 - DNA, 19 bp, Homo sapiens
ttgcaaaaactacaaccaa

SEQ ID NO: 4174133 - DNA, 18 bp, Homo sapiens
ttgcaatcccttaatatc

SEQ ID NO: 4174134 - DNA, 15 bp, Homo sapiens
ttgcactaaagtatg

SEQ ID NO: 4174135 - DNA, 15 bp, Homo sapiens
ttgcactgacaagat

SEQ ID NO: 4174136 - DNA, 15 bp, Homo sapiens
ttgcagacaggaatc

SEQ ID NO: 4174137 - DNA, 18 bp, Homo sapiens
ttgcagacaggaatctta

SEQ ID NO: 4174138 - DNA, 15 bp, Homo sapiens
ttgcaggtgcctggc

SEQ ID NO: 4174139 - DNA, 17 bp, Homo sapiens
ttgcataagattaaagg

SEQ ID NO: 4174140 - DNA, 22 bp, Homo sapiens
ttgccaaaataccagagccttc

SEQ ID NO: 4174141 - DNA, 23 bp, Homo sapiens
ttgccaaaataccagagccttca

SEQ ID NO: 4174142 - DNA, 20 bp, Homo sapiens
ttgccacaccaatcagagag

SEQ ID NO: 4174143 - DNA, 23 bp, Homo sapiens
ttgccacaccaatcagagagcct

SEQ ID NO: 4174144 - DNA, 17 bp, Homo sapiens
ttgccatgggcctgctg

SEQ ID NO: 4174145 - DNA, 18 bp, Homo sapiens
ttgccatgggcctgctgc

SEQ ID NO: 4174146 - DNA, 17 bp, Homo sapiens
ttgcccggattctggga

SEQ ID NO: 4174147 - DNA, 18 bp, Homo sapiens
ttagcagaagtgaccaaa

SEQ ID NO: 4174148 - DNA, 18 bp, Homo sapiens
ttagctgggatatgtagt

SEQ ID NO: 4174149 - DNA, 13 bp, Homo sapiens
ttagctttaactt

SEQ ID NO: 4174150 - DNA, 20 bp, Homo sapiens
ttaggaaataaaacctttca

SEQ ID NO: 4174151 - DNA, 18 bp, Homo sapiens
ttaggaagcaagcttaat

SEQ ID NO: 4174152 - DNA, 15 bp, Homo sapiens
ttaggcagactcttt

SEQ ID NO: 4174153 - DNA, 16 bp, Homo sapiens
ttaggcagactcttta

SEQ ID NO: 4174154 - DNA, 14 bp, Homo sapiens
ttaggctgctggga

SEQ ID NO: 4174155 - DNA, 19 bp, Homo sapiens
ttaggggaagtatgtgtgg

SEQ ID NO: 4174156 - DNA, 13 bp, Homo sapiens
ttaggtgccaggc

SEQ ID NO: 4174157 - DNA, 16 bp, Homo sapiens
ttagtacggctgctgc

SEQ ID NO: 4174158 - DNA, 17 bp, Homo sapiens
ttagtacggctgctgca

SEQ ID NO: 4174159 - DNA, 18 bp, Homo sapiens
ttagtcattaatgttctt

SEQ ID NO: 4174160 - DNA, 15 bp, Homo sapiens
ttagtgtatgtgaat

SEQ ID NO: 4174161 - DNA, 13 bp, Homo sapiens
ttataaaaagtga

SEQ ID NO: 4174162 - DNA, 17 bp, Homo sapiens
ttataaaaagtgaaata

SEQ ID NO: 4174163 - DNA, 12 bp, Homo sapiens
ttataaaaatac

SEQ ID NO: 4174164 - DNA, 16 bp, Homo sapiens
ttataaatatgtgaaa

SEQ ID NO: 4174165 - DNA, 20 bp, Homo sapiens
ttataaatatgtgaaaatga

SEQ ID NO: 4174166 - DNA, 21 bp, Homo sapiens
ttataataaaggtcacataaa

SEQ ID NO: 4174167 - DNA, 14 bp, Homo sapiens
ttatacacagaaaa

SEQ ID NO: 4174168 - DNA, 14 bp, Homo sapiens
ttatacataataaa

SEQ ID NO: 4174169 - DNA, 18 bp, Homo sapiens
ttatacataataaagtgt

SEQ ID NO: 4174170 - DNA, 22 bp, Homo sapiens
ttatactgtacttaataaattc

SEQ ID NO: 4174171 - DNA, 22 bp, Homo sapiens
ttatagccacatccctttgaaa

SEQ ID NO: 4174172 - DNA, 20 bp, Homo sapiens
ttatagctcatcactgtgcc

SEQ ID NO: 4174173 - DNA, 24 bp, Homo sapiens
ttataggatttatttaaaatagca

SEQ ID NO: 4174174 - DNA, 15 bp, Homo sapiens
ttatagtttgtacat

SEQ ID NO: 4174175 - DNA, 18 bp, Homo sapiens
ttatataggttgtgcaaa

SEQ ID NO: 4174176 - DNA, 22 bp, Homo sapiens
ttatatgacaatcctgaagaaa

SEQ ID NO: 4174177 - DNA, 16 bp, Homo sapiens
ttatatgttaatttgt

SEQ ID NO: 4174178 - DNA, 21 bp, Homo sapiens
ttatatgttaatttgttatgt

SEQ ID NO: 4174179 - DNA, 18 bp, Homo sapiens
ttatatttagttatagtt

SEQ ID NO: 4174180 - DNA, 13 bp, Homo sapiens
ttatcaaaagaca

SEQ ID NO: 4174181 - DNA, 15 bp, Homo sapiens
ttatcaacttcctaa

SEQ ID NO: 4174182 - DNA, 21 bp, Homo sapiens
ttatcctgagcagtgtacact

SEQ ID NO: 4174183 - DNA, 20 bp, Homo sapiens
ttatctgaatttttaaacaa

SEQ ID NO: 4174184 - DNA, 23 bp, Homo sapiens
ttatgagatgatgaaaataataa

SEQ ID NO: 4174185 - DNA, 20 bp, Homo sapiens
ttatgaggtgaaacaattat

SEQ ID NO: 4174186 - DNA, 14 bp, Homo sapiens
ttatgcaagcacaa

SEQ ID NO: 4174187 - DNA, 20 bp, Homo sapiens
ttatgcagagtcagccattc

SEQ ID NO: 4174188 - DNA, 23 bp, Homo sapiens
ttatgtatatactatacaacaat

SEQ ID NO: 4174189 - DNA, 16 bp, Homo sapiens
ttatgtatatagatgt

SEQ ID NO: 4174190 - DNA, 14 bp, Homo sapiens
ttattaaaatgatt

SEQ ID NO: 4174191 - DNA, 19 bp, Homo sapiens
ttattaaaatgattgtaaa

SEQ ID NO: 4174192 - DNA, 13 bp, Homo sapiens
ttattactgtaat

SEQ ID NO: 4174193 - DNA, 15 bp, Homo sapiens
ttattagttaatata

SEQ ID NO: 4174194 - DNA, 16 bp, Homo sapiens
ttattcaagttattgt

SEQ ID NO: 4174195 - DNA, 15 bp, Homo sapiens
ttattcattgtatga

SEQ ID NO: 4174196 - DNA, 14 bp, Homo sapiens
ttattgtctgtcta

SEQ ID NO: 4174197 - DNA, 21 bp, Homo sapiens
ttattgtctgtctacatttct

SEQ ID NO: 4174198 - DNA, 12 bp, Homo sapiens
ttatttaataag

SEQ ID NO: 4174199 - DNA, 14 bp, Homo sapiens
ttatttaataagag

SEQ ID NO: 4174200 - DNA, 14 bp, Homo sapiens
ttatttacttgaaa

SEQ ID NO: 4174201 - DNA, 18 bp, Homo sapiens
ttatttgtaatagatgtt

SEQ ID NO: 4174202 - DNA, 21 bp, Homo sapiens
ttatttgtgtaatagaaaact

SEQ ID NO: 4174203 - DNA, 14 bp, Homo sapiens
ttattttaaacaaa

SEQ ID NO: 4174204 - DNA, 17 bp, Homo sapiens
ttattttaaacaaaata

SEQ ID NO: 4174205 - DNA, 12 bp, Homo sapiens
ttattttcagta

SEQ ID NO: 4174206 - DNA, 17 bp, Homo sapiens
ttattttgacataaagt

SEQ ID NO: 4174207 - DNA, 16 bp, Homo sapiens
ttattttttaaaataa

SEQ ID NO: 4174208 - DNA, 17 bp, Homo sapiens
ttattttttaaaataat

SEQ ID NO: 4174209 - DNA, 23 bp, Homo sapiens
ttcaaagctgtgtgtttggaaga

SEQ ID NO: 4174210 - DNA, 19 bp, Homo sapiens
ttcaaagtttaataaattt

SEQ ID NO: 4174211 - DNA, 15 bp, Homo sapiens
ttcaacaattctaaa

SEQ ID NO: 4174212 - DNA, 18 bp, Homo sapiens
ttcaacgttggtatgata

SEQ ID NO: 4174213 - DNA, 21 bp, Homo sapiens
ttcaactccagaagtggggct

SEQ ID NO: 4174214 - DNA, 13 bp, Homo sapiens
ttcaagacttgat

SEQ ID NO: 4174215 - DNA, 14 bp, Homo sapiens
ttcaagacttgata

SEQ ID NO: 4174216 - DNA, 21 bp, Homo sapiens
ttcaagagtgcagttgattct

SEQ ID NO: 4174217 - DNA, 22 bp, Homo sapiens
ttcaagctctctgttgcgctcc

SEQ ID NO: 4174218 - DNA, 17 bp, Homo sapiens
ttcaaggtctgcttttc

SEQ ID NO: 4174219 - DNA, 18 bp, Homo sapiens
ttcaaggtggccaaatta

SEQ ID NO: 4174220 - DNA, 14 bp, Homo sapiens
ttcaagtgccaaac

SEQ ID NO: 4174221 - DNA, 16 bp, Homo sapiens
ttcaagttagctcagg

SEQ ID NO: 4174222 - DNA, 20 bp, Homo sapiens
ttcaagttattgtacagctg

SEQ ID NO: 4174223 - DNA, 12 bp, Homo sapiens
ttcaataaagct

SEQ ID NO: 4174224 - DNA, 14 bp, Homo sapiens
ttcaattcctgggc

SEQ ID NO: 4174225 - DNA, 13 bp, Homo sapiens
ttcaattctcaaa

SEQ ID NO: 4174226 - DNA, 19 bp, Homo sapiens
ttcacacctcacgctctgg

SEQ ID NO: 4174227 - DNA, 22 bp, Homo sapiens
ttcacatgtttatatttggctc

SEQ ID NO: 4174228 - DNA, 14 bp, Homo sapiens
ttcaccaaatcttg

SEQ ID NO: 4174229 - DNA, 12 bp, Homo sapiens
ttcactcagcca

SEQ ID NO: 4174230 - DNA, 15 bp, Homo sapiens
ttcactcagccacac

SEQ ID NO: 4174231 - DNA, 20 bp, Homo sapiens
ttcactgttgtacacagtct

SEQ ID NO: 4174232 - DNA, 16 bp, Homo sapiens
ttcacttccccaactc

SEQ ID NO: 4174233 - DNA, 15 bp, Homo sapiens
ttcacttttttacaa

SEQ ID NO: 4174234 - DNA, 12 bp, Homo sapiens
ttcagaagaaaa

SEQ ID NO: 4174235 - DNA, 16 bp, Homo sapiens
ttcagaagcaggcagg

SEQ ID NO: 4174236 - DNA, 23 bp, Homo sapiens
ttcagaagtttggcaatagtttg

SEQ ID NO: 4174237 - DNA, 20 bp, Homo sapiens
ttcagagagggcagaggggt

SEQ ID NO: 4174238 - DNA, 18 bp, Homo sapiens
ttcagatgtgaaccatta

SEQ ID NO: 4174239 - DNA, 15 bp, Homo sapiens
ttcagcactcagaaa

SEQ ID NO: 4174240 - DNA, 16 bp, Homo sapiens
ttcagcatatttatag

SEQ ID NO: 4174241 - DNA, 20 bp, Homo sapiens
ttcagctgtgaacatggact

SEQ ID NO: 4174242 - DNA, 13 bp, Homo sapiens
ttcaggaaaattg

SEQ ID NO: 4174243 - DNA, 21 bp, Homo sapiens
ttcaggggggttgtgaggcct

SEQ ID NO: 4174244 - DNA, 18 bp, Homo sapiens
ttcagtattttggagaaa

SEQ ID NO: 4174245 - DNA, 12 bp, Homo sapiens
ttcagtggagaa

SEQ ID NO: 4174246 - DNA, 22 bp, Homo sapiens
ttcagttcccgctctgcattgc

SEQ ID NO: 4174247 - DNA, 12 bp, Homo sapiens
ttcataaggaaa

SEQ ID NO: 4174248 - DNA, 23 bp, Homo sapiens
ttcataatatatggaagataatt

SEQ ID NO: 4174249 - DNA, 21 bp, Homo sapiens
ttcataccctctacctggatg

SEQ ID NO: 4174250 - DNA, 15 bp, Homo sapiens
ttcatacttctaaat

SEQ ID NO: 4174251 - DNA, 14 bp, Homo sapiens
ttcatctccagtgt

SEQ ID NO: 4174252 - DNA, 12 bp, Homo sapiens
ttcatgataatg

SEQ ID NO: 4174253 - DNA, 18 bp, Homo sapiens
ttcatgataatgaacaga

SEQ ID NO: 4174254 - DNA, 15 bp, Homo sapiens
ttcatgatagtgtga

SEQ ID NO: 4174255 - DNA, 15 bp, Homo sapiens
ttcattttaatttat

SEQ ID NO: 4174256 - DNA, 20 bp, Homo sapiens
ttcattttaatttatatttg

SEQ ID NO: 4174257 - DNA, 19 bp, Homo sapiens
ttccaaataaggatttgtt

SEQ ID NO: 4174258 - DNA, 14 bp, Homo sapiens
ttccaacagtgagt

SEQ ID NO: 4174259 - DNA, 22 bp, Homo sapiens
ttccaactcgtatagcatgcat

SEQ ID NO: 4174260 - DNA, 21 bp, Homo sapiens
ttccaagggtatgggaagcca

SEQ ID NO: 4174261 - DNA, 19 bp, Homo sapiens
ttccaagtcaacactcttc

SEQ ID NO: 4174262 - DNA, 19 bp, Homo sapiens
ttccaagttcctgcactcc

SEQ ID NO: 4174263 - DNA, 22 bp, Homo sapiens
ttccaagttcctgcactccaga

SEQ ID NO: 4174264 - DNA, 11 bp, Homo sapiens
ttccaccctgg

SEQ ID NO: 4174265 - DNA, 12 bp, Homo sapiens
ttccactggact

SEQ ID NO: 4174266 - DNA, 17 bp, Homo sapiens
ttccagaaaaccccagc

SEQ ID NO: 4174267 - DNA, 18 bp, Homo sapiens
ttccagagcactgctcca

SEQ ID NO: 4174268 - DNA, 19 bp, Homo sapiens
ttccaggtatctccaggat

SEQ ID NO: 4174269 - DNA, 16 bp, Homo sapiens
ttccagtgcaacaaaa

SEQ ID NO: 4174270 - DNA, 16 bp, Homo sapiens
ttccatgatactttaa

SEQ ID NO: 4174271 - DNA, 23 bp, Homo sapiens
ttccatgcctgtagctttcctgg

SEQ ID NO: 4174272 - DNA, 19 bp, Homo sapiens
ttccatggcaggaaggctt

SEQ ID NO: 4174273 - DNA, 17 bp, Homo sapiens
ttccatgggatgttaag

SEQ ID NO: 4174274 - DNA, 14 bp, Homo sapiens
ttccatgtccctgt

SEQ ID NO: 4174275 - DNA, 12 bp, Homo sapiens
ttccatgttaaa

SEQ ID NO: 4174276 - DNA, 21 bp, Homo sapiens
ttccatgttgtcttataaaca

SEQ ID NO: 4174277 - DNA, 15 bp, Homo sapiens
ttcccaccaaggtct

SEQ ID NO: 4174278 - DNA, 19 bp, Homo sapiens
ttcccactaagctttctcc

SEQ ID NO: 4174279 - DNA, 21 bp, Homo sapiens
ttcccactaagctttctcctt

SEQ ID NO: 4174280 - DNA, 18 bp, Homo sapiens
ttcccatatacaatcttc

SEQ ID NO: 4174281 - DNA, 16 bp, Homo sapiens
ttccccacctcttcct

SEQ ID NO: 4174282 - DNA, 13 bp, Homo sapiens
ttccccagactca

SEQ ID NO: 4174283 - DNA, 21 bp, Homo sapiens
ttccccagactcagctccaga

SEQ ID NO: 4174284 - DNA, 22 bp, Homo sapiens
ttccccaggagctctctgctga

SEQ ID NO: 4174285 - DNA, 16 bp, Homo sapiens
ttcccccaccccagag

SEQ ID NO: 4174286 - DNA, 17 bp, Homo sapiens
ttcccccaccccagagt

SEQ ID NO: 4174287 - DNA, 13 bp, Homo sapiens
aaaatgttgaaat

SEQ ID NO: 4174288 - DNA, 21 bp, Homo sapiens
aaaattgaatgcaaaccatag

SEQ ID NO: 4174289 - DNA, 23 bp, Homo sapiens
aaaattttacttttgttctgtat

SEQ ID NO: 4174290 - DNA, 14 bp, Homo sapiens
aaacaaaaagacag

SEQ ID NO: 4174291 - DNA, 12 bp, Homo sapiens
aaacaaaacaac

SEQ ID NO: 4174292 - DNA, 13 bp, Homo sapiens
aaacaaaacaaca

SEQ ID NO: 4174293 - DNA, 14 bp, Homo sapiens
aaacaacaacaata

SEQ ID NO: 4174294 - DNA, 12 bp, Homo sapiens
aaacaacttgtg

SEQ ID NO: 4174295 - DNA, 16 bp, Homo sapiens
aaacaaggttttcagt

SEQ ID NO: 4174296 - DNA, 13 bp, Homo sapiens
aaacaagtatttg

SEQ ID NO: 4174297 - DNA, 20 bp, Homo sapiens
aaacacaaaagttagctgag

SEQ ID NO: 4174298 - DNA, 15 bp, Homo sapiens
aaacaccaacataaa

SEQ ID NO: 4174299 - DNA, 22 bp, Homo sapiens
aaacactgcctatatatgtaaa

SEQ ID NO: 4174300 - DNA, 17 bp, Homo sapiens
aaacagatggtagagag

SEQ ID NO: 4174301 - DNA, 11 bp, Homo sapiens
aaacagcctgg

SEQ ID NO: 4174302 - DNA, 16 bp, Homo sapiens
aaacagcctgggtagg

SEQ ID NO: 4174303 - DNA, 16 bp, Homo sapiens
aaacaggagacaggaa

SEQ ID NO: 4174304 - DNA, 13 bp, Homo sapiens
aaacatatttata

SEQ ID NO: 4174305 - DNA, 19 bp, Homo sapiens
aaacatatttatagtttaa

SEQ ID NO: 4174306 - DNA, 13 bp, Homo sapiens
aaaccaactaaat

SEQ ID NO: 4174307 - DNA, 19 bp, Homo sapiens
aaaccagtgtagccttgcc

SEQ ID NO: 4174308 - DNA, 21 bp, Homo sapiens
aaaccagttaagaatggaaga

SEQ ID NO: 4174309 - DNA, 20 bp, Homo sapiens
aaaccataaactgtacaaat

SEQ ID NO: 4174310 - DNA, 14 bp, Homo sapiens
aaaccatttcaaat

SEQ ID NO: 4174311 - DNA, 16 bp, Homo sapiens
aaacccccgctccaga

SEQ ID NO: 4174312 - DNA, 17 bp, Homo sapiens
aaacccccgctccagat

SEQ ID NO: 4174313 - DNA, 21 bp, Homo sapiens
aaaccctgtggggcctgatgg

SEQ ID NO: 4174314 - DNA, 19 bp, Homo sapiens
aaacctagaacttcaaaat

SEQ ID NO: 4174315 - DNA, 21 bp, Homo sapiens
aaacctagaacttcaaaatgt

SEQ ID NO: 4174316 - DNA, 16 bp, Homo sapiens
aaacctgaaaaaaagt

SEQ ID NO: 4174317 - DNA, 17 bp, Homo sapiens
aaacctggagatgatga

SEQ ID NO: 4174318 - DNA, 22 bp, Homo sapiens
aaaccttttcatgcctttagat

SEQ ID NO: 4174319 - DNA, 13 bp, Homo sapiens
aaacgttgacccc

SEQ ID NO: 4174320 - DNA, 13 bp, Homo sapiens
aaactaaatctct

SEQ ID NO: 4174321 - DNA, 17 bp, Homo sapiens
aaactaaatctctaata

SEQ ID NO: 4174322 - DNA, 22 bp, Homo sapiens
aaactacacatccctaatgtgt

SEQ ID NO: 4174323 - DNA, 16 bp, Homo sapiens
aaactagaagtcaaaa

SEQ ID NO: 4174324 - DNA, 22 bp, Homo sapiens
aaactcaaaacttaacatattt

SEQ ID NO: 4174325 - DNA, 20 bp, Homo sapiens
aaactctaaacattaatcaa

SEQ ID NO: 4174326 - DNA, 18 bp, Homo sapiens
aaactctacaccctctgc

SEQ ID NO: 4174327 - DNA, 17 bp, Homo sapiens
aaactcttggcctctgc

SEQ ID NO: 4174328 - DNA, 22 bp, Homo sapiens
aaactcttgtgtacctttgtgt

SEQ ID NO: 4174329 - DNA, 17 bp, Homo sapiens
aaactgaaaatctaata

SEQ ID NO: 4174330 - DNA, 17 bp, Homo sapiens
aaactgtacaaatgaaa

SEQ ID NO: 4174331 - DNA, 17 bp, Homo sapiens
aaacttaacatatttac

SEQ ID NO: 4174332 - DNA, 21 bp, Homo sapiens
aaacttaattacatccagaaa

SEQ ID NO: 4174333 - DNA, 17 bp, Homo sapiens
aaacttagaataaaatt

SEQ ID NO: 4174334 - DNA, 12 bp, Homo sapiens
aaacttatttga

SEQ ID NO: 4174335 - DNA, 14 bp, Homo sapiens
aaacttatttgagt

SEQ ID NO: 4174336 - DNA, 21 bp, Homo sapiens
aaactttagagtagcatgaga

SEQ ID NO: 4174337 - DNA, 13 bp, Homo sapiens
aaactttataaat

SEQ ID NO: 4174338 - DNA, 18 bp, Homo sapiens
aaactttcatttttggta

SEQ ID NO: 4174339 - DNA, 13 bp, Homo sapiens
aaagaaaaccttt

SEQ ID NO: 4174340 - DNA, 13 bp, Homo sapiens
aaagaaagaaaca

SEQ ID NO: 4174341 - DNA, 22 bp, Homo sapiens
aaagaaccaaaagttttcctga

SEQ ID NO: 4174342 - DNA, 13 bp, Homo sapiens
aaagaaggaaata

SEQ ID NO: 4174343 - DNA, 21 bp, Homo sapiens
aaagacagcactacagatatc

SEQ ID NO: 4174344 - DNA, 16 bp, Homo sapiens
aaagacagtgtgtgtg

SEQ ID NO: 4174345 - DNA, 14 bp, Homo sapiens
aaagacatggaaga

SEQ ID NO: 4174346 - DNA, 10 bp, Homo sapiens
aaagagacca

SEQ ID NO: 4174347 - DNA, 14 bp, Homo sapiens
aaagagaccagcac

SEQ ID NO: 4174348 - DNA, 22 bp, Homo sapiens
aaagagagaaaacttatttgag

SEQ ID NO: 4174349 - DNA, 22 bp, Homo sapiens
aaagagggagttggctggatct

SEQ ID NO: 4174350 - DNA, 11 bp, Homo sapiens
aaagatgtgtt

SEQ ID NO: 4174351 - DNA, 22 bp, Homo sapiens
aaagatttgtgaactggaagaa

SEQ ID NO: 4174352 - DNA, 13 bp, Homo sapiens
aaagcaaaagaag

SEQ ID NO: 4174353 - DNA, 17 bp, Homo sapiens
aaagcaaaaggctgaga

SEQ ID NO: 4174354 - DNA, 12 bp, Homo sapiens
aaagcaataaaa

SEQ ID NO: 4174355 - DNA, 16 bp, Homo sapiens
aaagcacctgaaccac

SEQ ID NO: 4174356 - DNA, 18 bp, Homo sapiens
aaagcacctgaaccactg

SEQ ID NO: 4174357 - DNA, 20 bp, Homo sapiens
aaagcacctgaaccactgtg

SEQ ID NO: 4174358 - DNA, 21 bp, Homo sapiens
aaagcacctgaaccactgtgg

SEQ ID NO: 4174359 - DNA, 14 bp, Homo sapiens
aaagcactttttaa

SEQ ID NO: 4174360 - DNA, 13 bp, Homo sapiens
aaagcatgtctca

SEQ ID NO: 4174361 - DNA, 16 bp, Homo sapiens
aaagcccaacctcctg

SEQ ID NO: 4174362 - DNA, 21 bp, Homo sapiens
aaagcccagctctttgttcag

SEQ ID NO: 4174363 - DNA, 10 bp, Homo sapiens
aaagcctttt

SEQ ID NO: 4174364 - DNA, 13 bp, Homo sapiens
aaagctagaattg

SEQ ID NO: 4174365 - DNA, 14 bp, Homo sapiens
aaagctagaattga

SEQ ID NO: 4174366 - DNA, 13 bp, Homo sapiens
aaagctcatattt

SEQ ID NO: 4174367 - DNA, 16 bp, Homo sapiens
aaagctgcctgtagtt

SEQ ID NO: 4174368 - DNA, 15 bp, Homo sapiens
aaaggaaataattgc

SEQ ID NO: 4174369 - DNA, 12 bp, Homo sapiens
aaaggaaggaaa

SEQ ID NO: 4174370 - DNA, 13 bp, Homo sapiens
aaaggaaggaaaa

SEQ ID NO: 4174371 - DNA, 21 bp, Homo sapiens
aaaggcataagaccctaagcc

SEQ ID NO: 4174372 - DNA, 14 bp, Homo sapiens
aaaggctgagaagg

SEQ ID NO: 4174373 - DNA, 15 bp, Homo sapiens
aaaggtagagatgtg

SEQ ID NO: 4174374 - DNA, 20 bp, Homo sapiens
aaaggtagagatgtgtgtgt

SEQ ID NO: 4174375 - DNA, 19 bp, Homo sapiens
aaaggtttatgaaaaagaa

SEQ ID NO: 4174376 - DNA, 21 bp, Homo sapiens
aaagtaaaagttatatctaac

SEQ ID NO: 4174377 - DNA, 15 bp, Homo sapiens
aaagtcgaattaata

SEQ ID NO: 4174378 - DNA, 19 bp, Homo sapiens
aaagtctaaagtttacagt

SEQ ID NO: 4174379 - DNA, 22 bp, Homo sapiens
aaagtctaaagtttacagtaaa

SEQ ID NO: 4174380 - DNA, 18 bp, Homo sapiens
aaagtggaatcactgtat

SEQ ID NO: 4174381 - DNA, 20 bp, Homo sapiens
aaagtgtaaatcctttttct

SEQ ID NO: 4174382 - DNA, 20 bp, Homo sapiens
aaagtgttattatttggcat

SEQ ID NO: 4174383 - DNA, 14 bp, Homo sapiens
aaagttcagccaga

SEQ ID NO: 4174384 - DNA, 19 bp, Homo sapiens
aaagttggagacagcaatt

SEQ ID NO: 4174385 - DNA, 15 bp, Homo sapiens
aaagtttacagtaaa

SEQ ID NO: 4174386 - DNA, 13 bp, Homo sapiens
aaataaaaccttt

SEQ ID NO: 4174387 - DNA, 11 bp, Homo sapiens
aaataaacctg

SEQ ID NO: 4174388 - DNA, 21 bp, Homo sapiens
aaataaacctggagatgatga

SEQ ID NO: 4174389 - DNA, 13 bp, Homo sapiens
aaataaattgttt

SEQ ID NO: 4174390 - DNA, 12 bp, Homo sapiens
aaataagaaact

SEQ ID NO: 4174391 - DNA, 14 bp, Homo sapiens
aaataagaaacttt

SEQ ID NO: 4174392 - DNA, 15 bp, Homo sapiens
aaataagaaactttt

SEQ ID NO: 4174393 - DNA, 21 bp, Homo sapiens
aaataagaaacttttttattt

SEQ ID NO: 4174394 - DNA, 15 bp, Homo sapiens
aaataagaagaatgc

SEQ ID NO: 4174395 - DNA, 17 bp, Homo sapiens
aaataatactgctgaga

SEQ ID NO: 4174396 - DNA, 21 bp, Homo sapiens
aaataatatccatacagtcaa

SEQ ID NO: 4174397 - DNA, 21 bp, Homo sapiens
aaatacattcataaggaaatg

SEQ ID NO: 4174398 - DNA, 13 bp, Homo sapiens
aaataccagagcc

SEQ ID NO: 4174399 - DNA, 22 bp, Homo sapiens
aaataccagagccttcaagtgc

SEQ ID NO: 4174400 - DNA, 15 bp, Homo sapiens
aaatacctaggccca

SEQ ID NO: 4174401 - DNA, 20 bp, Homo sapiens
aaatacctctggcttagaaa

SEQ ID NO: 4174402 - DNA, 19 bp, Homo sapiens
aaatagagattaattttaa

SEQ ID NO: 4174403 - DNA, 13 bp, Homo sapiens
aaatagctctttc

SEQ ID NO: 4174404 - DNA, 16 bp, Homo sapiens
aaataggcttagagag

SEQ ID NO: 4174405 - DNA, 22 bp, Homo sapiens
aaataggcttagagaggaaaag

SEQ ID NO: 4174406 - DNA, 16 bp, Homo sapiens
aaataggctttagaag

SEQ ID NO: 4174407 - DNA, 21 bp, Homo sapiens
aaatagtttggatatgtaaaa

SEQ ID NO: 4174408 - DNA, 17 bp, Homo sapiens
aaatataaatggtaagc

SEQ ID NO: 4174409 - DNA, 21 bp, Homo sapiens
aaatatgagtgggaaataaat

SEQ ID NO: 4174410 - DNA, 20 bp, Homo sapiens
aaatatgatcacttcatact

SEQ ID NO: 4174411 - DNA, 17 bp, Homo sapiens
aaatatggaacttctaa

SEQ ID NO: 4174412 - DNA, 19 bp, Homo sapiens
aaatatggaacttctaata

SEQ ID NO: 4174413 - DNA, 20 bp, Homo sapiens
aaatatggaacttctaatat

SEQ ID NO: 4174414 - DNA, 14 bp, Homo sapiens
aaatattttaaaga

SEQ ID NO: 4174415 - DNA, 18 bp, Homo sapiens
aaatattttaaagaattg

SEQ ID NO: 4174416 - DNA, 22 bp, Homo sapiens
aactatgtgatgttaactatta

SEQ ID NO: 4174417 - DNA, 19 bp, Homo sapiens
aactatttgtctttcagga

SEQ ID NO: 4174418 - DNA, 13 bp, Homo sapiens
aactattttcaga

SEQ ID NO: 4174419 - DNA, 20 bp, Homo sapiens
aactattttcagatgtgaac

SEQ ID NO: 4174420 - DNA, 14 bp, Homo sapiens
aactcagagcctcc

SEQ ID NO: 4174421 - DNA, 12 bp, Homo sapiens
aactcagtctgt

SEQ ID NO: 4174422 - DNA, 21 bp, Homo sapiens
aactcctttagcaggtggtcc

SEQ ID NO: 4174423 - DNA, 21 bp, Homo sapiens
aactcgtatagcatgcatctg

SEQ ID NO: 4174424 - DNA, 15 bp, Homo sapiens
aactcgttttttaca

SEQ ID NO: 4174425 - DNA, 22 bp, Homo sapiens
aactctatagttattgttttat

SEQ ID NO: 4174426 - DNA, 17 bp, Homo sapiens
aactctggcttccaggt

SEQ ID NO: 4174427 - DNA, 18 bp, Homo sapiens
aactctggcttccaggta

SEQ ID NO: 4174428 - DNA, 19 bp, Homo sapiens
aactcttcaaggtctgctt

SEQ ID NO: 4174429 - DNA, 17 bp, Homo sapiens
aactcttcactcttcaa

SEQ ID NO: 4174430 - DNA, 15 bp, Homo sapiens
aactcttctggaaac

SEQ ID NO: 4174431 - DNA, 16 bp, Homo sapiens
aactcttggcctctgc

SEQ ID NO: 4174432 - DNA, 18 bp, Homo sapiens
aactcttggcctctgctt

SEQ ID NO: 4174433 - DNA, 13 bp, Homo sapiens
aaaaaataagaga

SEQ ID NO: 4174434 - DNA, 19 bp, Homo sapiens
aaaaactacaaccaatgga

SEQ ID NO: 4174435 - DNA, 12 bp, Homo sapiens
aaaaagaaaaac

SEQ ID NO: 4174436 - DNA, 20 bp, Homo sapiens
aaaaagatgccttttaccat

SEQ ID NO: 4174437 - DNA, 13 bp, Homo sapiens
aaaaagatttgtt

SEQ ID NO: 4174438 - DNA, 18 bp, Homo sapiens
aaaaagcgaaaaaatcag

SEQ ID NO: 4174439 - DNA, 20 bp, Homo sapiens
aaaaagcttaaaactttgaa

SEQ ID NO: 4174440 - DNA, 17 bp, Homo sapiens
aaaaaggctagtttatt

SEQ ID NO: 4174441 - DNA, 18 bp, Homo sapiens
aaaaaggtttacagaatt

SEQ ID NO: 4174442 - DNA, 21 bp, Homo sapiens
aaaaagtaagtaccactcagg

SEQ ID NO: 4174443 - DNA, 21 bp, Homo sapiens
aaaaagtaattgtagatggaa

SEQ ID NO: 4174444 - DNA, 13 bp, Homo sapiens
aaaaagtattttt

SEQ ID NO: 4174445 - DNA, 17 bp, Homo sapiens
aaaaagtttacaagtgt

SEQ ID NO: 4174446 - DNA, 13 bp, Homo sapiens
aaaaagtttgttt

SEQ ID NO: 4174447 - DNA, 13 bp, Homo sapiens
aaaaatactcaga

SEQ ID NO: 4174448 - DNA, 15 bp, Homo sapiens
aaaaatattttctga

SEQ ID NO: 4174449 - DNA, 10 bp, Homo sapiens
aaaaatccac

SEQ ID NO: 4174450 - DNA, 14 bp, Homo sapiens
aaaaatgatctaaa

SEQ ID NO: 4174451 - DNA, 17 bp, Homo sapiens
aaaaatgtgaatctctt

SEQ ID NO: 4174452 - DNA, 16 bp, Homo sapiens
aaaaattctgatacat

SEQ ID NO: 4174453 - DNA, 15 bp, Homo sapiens
aaaacaaaactgcat

SEQ ID NO: 4174454 - DNA, 16 bp, Homo sapiens
aaaacatttattttga

SEQ ID NO: 4174455 - DNA, 21 bp, Homo sapiens
aaaaccagtgaagtgccacat

SEQ ID NO: 4174456 - DNA, 19 bp, Homo sapiens
aaaaccattatttaataag

SEQ ID NO: 4174457 - DNA, 24 bp, Homo sapiens
aaaaccattatttaataagagtaa

SEQ ID NO: 4174458 - DNA, 19 bp, Homo sapiens
aaaacgatgaagttatgct

SEQ ID NO: 4174459 - DNA, 16 bp, Homo sapiens
aaaacgtttcaaagca

SEQ ID NO: 4174460 - DNA, 16 bp, Homo sapiens
aaaactaaaaactaga

SEQ ID NO: 4174461 - DNA, 21 bp, Homo sapiens
aaaactctacaccctctgccc

SEQ ID NO: 4174462 - DNA, 23 bp, Homo sapiens
aaaacttcgtgcatttgttacag

SEQ ID NO: 4174463 - DNA, 14 bp, Homo sapiens
aaaagaaaaccatt

SEQ ID NO: 4174464 - DNA, 15 bp, Homo sapiens
aaaagaaatttgatg

SEQ ID NO: 4174465 - DNA, 12 bp, Homo sapiens
aaaagaagaagt

SEQ ID NO: 4174466 - DNA, 19 bp, Homo sapiens
aaaagagagaaaacttatt

SEQ ID NO: 4174467 - DNA, 13 bp, Homo sapiens
aaaagatttgttt

SEQ ID NO: 4174468 - DNA, 14 bp, Homo sapiens
aaaagcacttttta

SEQ ID NO: 4174469 - DNA, 11 bp, Homo sapiens
aaaagctcttt

SEQ ID NO: 4174470 - DNA, 23 bp, Homo sapiens
aaaagggacagtattctcagtgc

SEQ ID NO: 4174471 - DNA, 18 bp, Homo sapiens
aaaagggcaatcagcaat

SEQ ID NO: 4174472 - DNA, 15 bp, Homo sapiens
aaaaggtgagctcag

SEQ ID NO: 4174473 - DNA, 14 bp, Homo sapiens
aaaaggtttatgaa

SEQ ID NO: 4174474 - DNA, 20 bp, Homo sapiens
aaaaggtttatgaaaaagaa

SEQ ID NO: 4174475 - DNA, 14 bp, Homo sapiens
aaaagtaattgtag

SEQ ID NO: 4174476 - DNA, 19 bp, Homo sapiens
aaaagtatgtgaatatgaa

SEQ ID NO: 4174477 - DNA, 20 bp, Homo sapiens
aaaataaagaatagcaatta

SEQ ID NO: 4174478 - DNA, 19 bp, Homo sapiens
aaaataacaactatttttg

SEQ ID NO: 4174479 - DNA, 15 bp, Homo sapiens
aaaataccagagcct

SEQ ID NO: 4174480 - DNA, 19 bp, Homo sapiens
aaaataccagagccttcaa

SEQ ID NO: 4174481 - DNA, 22 bp, Homo sapiens
aaaataccagagccttcaagtg

SEQ ID NO: 4174482 - DNA, 21 bp, Homo sapiens
aaaatactatgaaatgaaaga

SEQ ID NO: 4174483 - DNA, 20 bp, Homo sapiens
aaaatagctaaatacctcaa

SEQ ID NO: 4174484 - DNA, 19 bp, Homo sapiens
aaaatagcttgtatagtgt

SEQ ID NO: 4174485 - DNA, 19 bp, Homo sapiens
aaaatagtagaacaagcaa

SEQ ID NO: 4174486 - DNA, 21 bp, Homo sapiens
aaaatagtagaacaagcaaca

SEQ ID NO: 4174487 - DNA, 13 bp, Homo sapiens
aaaatagtttgga

SEQ ID NO: 4174488 - DNA, 16 bp, Homo sapiens
aaaatagtttggatat

SEQ ID NO: 4174489 - DNA, 20 bp, Homo sapiens
aaaatagtttggatatgtaa

SEQ ID NO: 4174490 - DNA, 14 bp, Homo sapiens
aaaatatatttatg

SEQ ID NO: 4174491 - DNA, 14 bp, Homo sapiens
aaaatatgtaccaa

SEQ ID NO: 4174492 - DNA, 12 bp, Homo sapiens
aaaatcagaagc

SEQ ID NO: 4174493 - DNA, 18 bp, Homo sapiens
aaaatcatgaatatttca

SEQ ID NO: 4174494 - DNA, 22 bp, Homo sapiens
aaaatgaaagcatgtctcaata

SEQ ID NO: 4174495 - DNA, 16 bp, Homo sapiens
aaaatgaggacatgtt

SEQ ID NO: 4174496 - DNA, 18 bp, Homo sapiens
aaaatgccagatgttgtt

SEQ ID NO: 4174497 - DNA, 23 bp, Homo sapiens
aagcattttgtaagttgaagcaa

SEQ ID NO: 4174498 - DNA, 18 bp, Homo sapiens
aagccaaaacaatgttta

SEQ ID NO: 4174499 - DNA, 14 bp, Homo sapiens
aagccaaactctgc

SEQ ID NO: 4174500 - DNA, 22 bp, Homo sapiens
aagccaacttggctttcccgga

SEQ ID NO: 4174501 - DNA, 19 bp, Homo sapiens
aagccacaggagccccacc

SEQ ID NO: 4174502 - DNA, 14 bp, Homo sapiens
aagccactgaagct

SEQ ID NO: 4174503 - DNA, 20 bp, Homo sapiens
aagccagtatttctttccct

SEQ ID NO: 4174504 - DNA, 18 bp, Homo sapiens
aagccatggcatgctcct

SEQ ID NO: 4174505 - DNA, 18 bp, Homo sapiens
aagccatgtactcaagta

SEQ ID NO: 4174506 - DNA, 17 bp, Homo sapiens
aagcccaacctcctgac

SEQ ID NO: 4174507 - DNA, 22 bp, Homo sapiens
aagcccaacctcctgacctgtc

SEQ ID NO: 4174508 - DNA, 17 bp, Homo sapiens
aagcccaaggtgctgat

SEQ ID NO: 4174509 - DNA, 16 bp, Homo sapiens
aagcccagctctttgt

SEQ ID NO: 4174510 - DNA, 21 bp, Homo sapiens
aagccccttgctctcccctgc

SEQ ID NO: 4174511 - DNA, 14 bp, Homo sapiens
aagccgtgcctttc

SEQ ID NO: 4174512 - DNA, 15 bp, Homo sapiens
aagcctgaggctggg

SEQ ID NO: 4174513 - DNA, 11 bp, Homo sapiens
aagcctggccc

SEQ ID NO: 4174514 - DNA, 12 bp, Homo sapiens
aagcctggccct

SEQ ID NO: 4174515 - DNA, 19 bp, Homo sapiens
aagccttactcacctctct

SEQ ID NO: 4174516 - DNA, 15 bp, Homo sapiens
aagcgaaaaaatcag

SEQ ID NO: 4174517 - DNA, 20 bp, Homo sapiens
aagcgatgaatttggagact

SEQ ID NO: 4174518 - DNA, 22 bp, Homo sapiens
aagcgctcatctggcttttcgc

SEQ ID NO: 4174519 - DNA, 19 bp, Homo sapiens
aagcgggggcgtggctggc

SEQ ID NO: 4174520 - DNA, 15 bp, Homo sapiens
aagctatttatgtaa

SEQ ID NO: 4174521 - DNA, 24 bp, Homo sapiens
aagctatttatgtaaaatcaataa

SEQ ID NO: 4174522 - DNA, 22 bp, Homo sapiens
aagctcttacactacattagaa

SEQ ID NO: 4174523 - DNA, 16 bp, Homo sapiens
aagctgaaattgtgtt

SEQ ID NO: 4174524 - DNA, 23 bp, Homo sapiens
aagctgagcaacctcttcagctg

SEQ ID NO: 4174525 - DNA, 21 bp, Homo sapiens
aagctgcctgtagttaggaaa

SEQ ID NO: 4174526 - DNA, 21 bp, Homo sapiens
aagctgctgagaatctagcct

SEQ ID NO: 4174527 - DNA, 20 bp, Homo sapiens
aagctggacaagaagctgct

SEQ ID NO: 4174528 - DNA, 19 bp, Homo sapiens
aagctggatgcagtggctc

SEQ ID NO: 4174529 - DNA, 15 bp, Homo sapiens
aagctgggggaaggg

SEQ ID NO: 4174530 - DNA, 19 bp, Homo sapiens
aagctgggggaagggtggt

SEQ ID NO: 4174531 - DNA, 11 bp, Homo sapiens
aagctgtgtgc

SEQ ID NO: 4174532 - DNA, 12 bp, Homo sapiens
aagctgtgtgca

SEQ ID NO: 4174533 - DNA, 17 bp, Homo sapiens
aagcttaaaactttgaa

SEQ ID NO: 4174534 - DNA, 19 bp, Homo sapiens
aagctttctgacaagataa

SEQ ID NO: 4174535 - DNA, 15 bp, Homo sapiens
aagctttggccctca

SEQ ID NO: 4174536 - DNA, 12 bp, Homo sapiens
aaggaaaaaata

SEQ ID NO: 4174537 - DNA, 23 bp, Homo sapiens
aaggaaaactcttggcctctgct

SEQ ID NO: 4174538 - DNA, 19 bp, Homo sapiens
aaggaaagatttgtgaact

SEQ ID NO: 4174539 - DNA, 20 bp, Homo sapiens
aaggaactctggcttccagg

SEQ ID NO: 4174540 - DNA, 12 bp, Homo sapiens
aaggaaggaaaa

SEQ ID NO: 4174541 - DNA, 17 bp, Homo sapiens
aaggaaggcagggagga

SEQ ID NO: 4174542 - DNA, 21 bp, Homo sapiens
aaggactacgttaagggaagg

SEQ ID NO: 4174543 - DNA, 17 bp, Homo sapiens
aaggagagcaagaagga

SEQ ID NO: 4174544 - DNA, 18 bp, Homo sapiens
aaggagattttccttcct

SEQ ID NO: 4174545 - DNA, 17 bp, Homo sapiens
aaggagctgttggggca

SEQ ID NO: 4174546 - DNA, 15 bp, Homo sapiens
aaggaggtgagggat

SEQ ID NO: 4174547 - DNA, 19 bp, Homo sapiens
aaggagtgagatcattttc

SEQ ID NO: 4174548 - DNA, 22 bp, Homo sapiens
aaggatatttactacttttgca

SEQ ID NO: 4174549 - DNA, 23 bp, Homo sapiens
aaggatccagagacttggggacc

SEQ ID NO: 4174550 - DNA, 21 bp, Homo sapiens
aaggatcctggaaccactgat

SEQ ID NO: 4174551 - DNA, 15 bp, Homo sapiens
aaggatggcaagcac

SEQ ID NO: 4174552 - DNA, 21 bp, Homo sapiens
aaggcatttgtttaatttata

SEQ ID NO: 4174553 - DNA, 19 bp, Homo sapiens
aaggccagctgactagatc

SEQ ID NO: 4174554 - DNA, 20 bp, Homo sapiens
aaggcttgttgtgcttttag

SEQ ID NO: 4174555 - DNA, 16 bp, Homo sapiens
aaggctttgccatggg

SEQ ID NO: 4174556 - DNA, 21 bp, Homo sapiens
aaggctttgccatgggcctgc

SEQ ID NO: 4174557 - DNA, 17 bp, Homo sapiens
aagggaaagggctcttt

SEQ ID NO: 4174558 - DNA, 17 bp, Homo sapiens
aagggaactgaagacct

SEQ ID NO: 4174559 - DNA, 15 bp, Homo sapiens
aagggaagcctgact

SEQ ID NO: 4174560 - DNA, 19 bp, Homo sapiens
aagggacagtattctcagt

SEQ ID NO: 4174561 - DNA, 18 bp, Homo sapiens
aagggcaatcagcaatca

SEQ ID NO: 4174562 - DNA, 16 bp, Homo sapiens
aagggccatgctgaag

SEQ ID NO: 4174563 - DNA, 20 bp, Homo sapiens
aagggctataagtagaaact

SEQ ID NO: 4174564 - DNA, 23 bp, Homo sapiens
aaggggacgcgggctgtgcctta

SEQ ID NO: 4174565 - DNA, 13 bp, Homo sapiens
aaggggccctggt

SEQ ID NO: 4174566 - DNA, 18 bp, Homo sapiens
aagggtggtctgagcacc

SEQ ID NO: 4174567 - DNA, 18 bp, Homo sapiens
aagggttggtgggctggc

SEQ ID NO: 4174568 - DNA, 19 bp, Homo sapiens
aagggttggtgggctggcc

SEQ ID NO: 4174569 - DNA, 19 bp, Homo sapiens
aagggttttccaccctgga

SEQ ID NO: 4174570 - DNA, 19 bp, Homo sapiens
aaggtacaagaagcatttt

SEQ ID NO: 4174571 - DNA, 22 bp, Homo sapiens
aaggtattccttttgtgtacag

SEQ ID NO: 4174572 - DNA, 14 bp, Homo sapiens
aaggtgagctcagc

SEQ ID NO: 4174573 - DNA, 13 bp, Homo sapiens
aaggtgctctgtg

SEQ ID NO: 4174574 - DNA, 18 bp, Homo sapiens
aaggtgggctgagccctg

SEQ ID NO: 4174575 - DNA, 20 bp, Homo sapiens
aaggtgggctgagccctggc

SEQ ID NO: 4174576 - DNA, 21 bp, Homo sapiens
aaggtgggctgagccctggca

SEQ ID NO: 4174577 - DNA, 23 bp, Homo sapiens
aaggtggggtatttaccacagca

SEQ ID NO: 4174578 - DNA, 14 bp, Homo sapiens
aaggttagaggttt

SEQ ID NO: 4174579 - DNA, 15 bp, Homo sapiens
aaggttagaggtttg

SEQ ID NO: 4174580 - DNA, 18 bp, Homo sapiens
aaggttaggtttgtcaac

SEQ ID NO: 4174581 - DNA, 20 bp, Homo sapiens
aaggttaggtttgtcaacac

SEQ ID NO: 4174582 - DNA, 15 bp, Homo sapiens
aagtaaaaaataact

SEQ ID NO: 4174583 - DNA, 21 bp, Homo sapiens
aagtaaaagcaaaaaagaaaa

SEQ ID NO: 4174584 - DNA, 20 bp, Homo sapiens
aagtaagtaccactcaggcc

SEQ ID NO: 4174585 - DNA, 13 bp, Homo sapiens
aagtagaaatcat

SEQ ID NO: 4174586 - DNA, 14 bp, Homo sapiens
aagtagaagaggag

SEQ ID NO: 4174587 - DNA, 16 bp, Homo sapiens
aagtagaagaggagga

SEQ ID NO: 4174588 - DNA, 18 bp, Homo sapiens
aagtagatcatggcagca

SEQ ID NO: 4174589 - DNA, 13 bp, Homo sapiens
aagtaggaaggaa

SEQ ID NO: 4174590 - DNA, 14 bp, Homo sapiens
aagtaggaaggaaa

SEQ ID NO: 4174591 - DNA, 19 bp, Homo sapiens
aagtaggaaggaaaaaata

SEQ ID NO: 4174592 - DNA, 19 bp, Homo sapiens
aagtatcatcagtgtagaa

SEQ ID NO: 4174593 - DNA, 22 bp, Homo sapiens
aagtatgtaaagtatgtaaaca

SEQ ID NO: 4174594 - DNA, 15 bp, Homo sapiens
aagtattttatttgt

SEQ ID NO: 4174595 - DNA, 23 bp, Homo sapiens
aagtatttttttaagttagagaa

SEQ ID NO: 4174596 - DNA, 16 bp, Homo sapiens
aagtcaacactcttct

SEQ ID NO: 4174597 - DNA, 19 bp, Homo sapiens
aagtcaacactcttcttga

SEQ ID NO: 4174598 - DNA, 13 bp, Homo sapiens
aagtcaccaaaat

SEQ ID NO: 4174599 - DNA, 20 bp, Homo sapiens
aagtcattgtcgctcagcaa

SEQ ID NO: 4174600 - DNA, 17 bp, Homo sapiens
aagtccacctgcctatc

SEQ ID NO: 4174601 - DNA, 19 bp, Homo sapiens
aagtccctgactctctgtg

SEQ ID NO: 4174602 - DNA, 18 bp, Homo sapiens
aagtcctatcgactttat

SEQ ID NO: 4174603 - DNA, 11 bp, Homo sapiens
aagtctaaagt

SEQ ID NO: 4174604 - DNA, 13 bp, Homo sapiens
aagtctaaagttt

SEQ ID NO: 4174605 - DNA, 17 bp, Homo sapiens
aagtctaaagtttacag

SEQ ID NO: 4174606 - DNA, 13 bp, Homo sapiens
aagtctcagaaga

SEQ ID NO: 4174607 - DNA, 15 bp, Homo sapiens
accattaatgaaaac

SEQ ID NO: 4174608 - DNA, 22 bp, Homo sapiens
accattaatgaaaactttttca

SEQ ID NO: 4174609 - DNA, 17 bp, Homo sapiens
accattatttaataaga

SEQ ID NO: 4174610 - DNA, 15 bp, Homo sapiens
accatttgtgttttg

SEQ ID NO: 4174611 - DNA, 23 bp, Homo sapiens
acccaactttctcactgctgtca

SEQ ID NO: 4174612 - DNA, 15 bp, Homo sapiens
acccaagcaaggcca

SEQ ID NO: 4174613 - DNA, 16 bp, Homo sapiens
acccaatgctcctgga

SEQ ID NO: 4174614 - DNA, 23 bp, Homo sapiens
acccacacatgtttacagaactg

SEQ ID NO: 4174615 - DNA, 15 bp, Homo sapiens
acccacctggagccc

SEQ ID NO: 4174616 - DNA, 18 bp, Homo sapiens
acccactgtccgcctctg

SEQ ID NO: 4174617 - DNA, 14 bp, Homo sapiens
acccagagtcagga

SEQ ID NO: 4174618 - DNA, 13 bp, Homo sapiens
acccagctcctct

SEQ ID NO: 4174619 - DNA, 16 bp, Homo sapiens
acccagctcctctgag

SEQ ID NO: 4174620 - DNA, 11 bp, Homo sapiens
acccagctctc

SEQ ID NO: 4174621 - DNA, 17 bp, Homo sapiens
acccaggaggctgaggc

SEQ ID NO: 4174622 - DNA, 21 bp, Homo sapiens
acccaggaggctgaggcagga

SEQ ID NO: 4174623 - DNA, 20 bp, Homo sapiens
acccagggctccctcctgga

SEQ ID NO: 4174624 - DNA, 21 bp, Homo sapiens
acccagggctccctcctggag

SEQ ID NO: 4174625 - DNA, 13 bp, Homo sapiens
acccaggggtggg

SEQ ID NO: 4174626 - DNA, 15 bp, Homo sapiens
acccatcttccccgg

SEQ ID NO: 4174627 - DNA, 16 bp, Homo sapiens
acccatcttccccgga

SEQ ID NO: 4174628 - DNA, 14 bp, Homo sapiens
acccatgtgccaag

SEQ ID NO: 4174629 - DNA, 17 bp, Homo sapiens
acccatgtgccaaggtg

SEQ ID NO: 4174630 - DNA, 16 bp, Homo sapiens
acccattaggcatgcc

SEQ ID NO: 4174631 - DNA, 14 bp, Homo sapiens
acccattttcacat

SEQ ID NO: 4174632 - DNA, 21 bp, Homo sapiens
accccaaagagcctggagaag

SEQ ID NO: 4174633 - DNA, 15 bp, Homo sapiens
accccaagtccacct

SEQ ID NO: 4174634 - DNA, 12 bp, Homo sapiens
accccagagttg

SEQ ID NO: 4174635 - DNA, 15 bp, Homo sapiens
accccagctgcggca

SEQ ID NO: 4174636 - DNA, 21 bp, Homo sapiens
accccatgcacctcagggcca

SEQ ID NO: 4174637 - DNA, 19 bp, Homo sapiens
acccccagtgccacagaga

SEQ ID NO: 4174638 - DNA, 15 bp, Homo sapiens
acccccgctccagat

SEQ ID NO: 4174639 - DNA, 22 bp, Homo sapiens
acccccgctccagatctgcact

SEQ ID NO: 4174640 - DNA, 17 bp, Homo sapiens
accccctcattcccctc

SEQ ID NO: 4174641 - DNA, 14 bp, Homo sapiens
accccctccagctc

SEQ ID NO: 4174642 - DNA, 15 bp, Homo sapiens
acccctctcagcccc

SEQ ID NO: 4174643 - DNA, 23 bp, Homo sapiens
accccttggcttttgcttggcag

SEQ ID NO: 4174644 - DNA, 12 bp, Homo sapiens
acccctttcccc

SEQ ID NO: 4174645 - DNA, 13 bp, Homo sapiens
acccctttccccc

SEQ ID NO: 4174646 - DNA, 14 bp, Homo sapiens
acccggcccagaga

SEQ ID NO: 4174647 - DNA, 17 bp, Homo sapiens
accctcaaaccctgtgg

SEQ ID NO: 4174648 - DNA, 18 bp, Homo sapiens
accctccaccgcagaagg

SEQ ID NO: 4174649 - DNA, 15 bp, Homo sapiens
accctccgccttcac

SEQ ID NO: 4174650 - DNA, 15 bp, Homo sapiens
accctcgtggacacc

SEQ ID NO: 4174651 - DNA, 20 bp, Homo sapiens
accctcgtggacacctgccc

SEQ ID NO: 4174652 - DNA, 13 bp, Homo sapiens
accctctcttccc

SEQ ID NO: 4174653 - DNA, 23 bp, Homo sapiens
accctgcccagtctggaagaaga

SEQ ID NO: 4174654 - DNA, 16 bp, Homo sapiens
accctgggctctggtc

SEQ ID NO: 4174655 - DNA, 18 bp, Homo sapiens
acccttggacttgaggat

SEQ ID NO: 4174656 - DNA, 18 bp, Homo sapiens
accgaccatcgtccagcc

SEQ ID NO: 4174657 - DNA, 20 bp, Homo sapiens
accgaccatcgtccagccct

SEQ ID NO: 4174658 - DNA, 18 bp, Homo sapiens
accgagacggctggacct

SEQ ID NO: 4174659 - DNA, 19 bp, Homo sapiens
accgcgtagagagccgggc

SEQ ID NO: 4174660 - DNA, 15 bp, Homo sapiens
accgctaaaagaaac

SEQ ID NO: 4174661 - DNA, 14 bp, Homo sapiens
accgcttctggggc

SEQ ID NO: 4174662 - DNA, 15 bp, Homo sapiens
accggtcaccgagac

SEQ ID NO: 4174663 - DNA, 23 bp, Homo sapiens
accgtgatttggaagagaggcac

SEQ ID NO: 4174664 - DNA, 20 bp, Homo sapiens
accgtgcccggcccattcta

SEQ ID NO: 4174665 - DNA, 14 bp, Homo sapiens
accgtgttagccag

SEQ ID NO: 4174666 - DNA, 12 bp, Homo sapiens
acctaaagaaaa

SEQ ID NO: 4174667 - DNA, 17 bp, Homo sapiens
acctaatcaggctgagg

SEQ ID NO: 4174668 - DNA, 20 bp, Homo sapiens
acctactgaacccagagtca

SEQ ID NO: 4174669 - DNA, 19 bp, Homo sapiens
acctagaacttcaaaatgt

SEQ ID NO: 4174670 - DNA, 22 bp, Homo sapiens
acctagaatagccatgtactat

SEQ ID NO: 4174671 - DNA, 18 bp, Homo sapiens
acctaggcccattgctga

SEQ ID NO: 4174672 - DNA, 18 bp, Homo sapiens
acctatttcttaaacact

SEQ ID NO: 4174673 - DNA, 21 bp, Homo sapiens
acctcaaactaggaggaaaag

SEQ ID NO: 4174674 - DNA, 19 bp, Homo sapiens
acctcaagtttttgttttg

SEQ ID NO: 4174675 - DNA, 19 bp, Homo sapiens
acctcaatcagtctcagaa

SEQ ID NO: 4174676 - DNA, 21 bp, Homo sapiens
acctcaatcagtctcagaatg

SEQ ID NO: 4174677 - DNA, 14 bp, Homo sapiens
acctcacgctctgg

SEQ ID NO: 4174678 - DNA, 13 bp, Homo sapiens
acctcagcctaga

SEQ ID NO: 4174679 - DNA, 19 bp, Homo sapiens
acctcaggcttccttggca

SEQ ID NO: 4174680 - DNA, 19 bp, Homo sapiens
acctcagggacaacatttt

SEQ ID NO: 4174681 - DNA, 15 bp, Homo sapiens
acctcagggccaagc

SEQ ID NO: 4174682 - DNA, 15 bp, Homo sapiens
acctcagtaatttag

SEQ ID NO: 4174683 - DNA, 15 bp, Homo sapiens
acctcattcgcctgt

SEQ ID NO: 4174684 - DNA, 17 bp, Homo sapiens
acctcccctggtcctgc

SEQ ID NO: 4174685 - DNA, 17 bp, Homo sapiens
acctccctatactgctt

SEQ ID NO: 4174686 - DNA, 21 bp, Homo sapiens
acctcctatccttggagagca

SEQ ID NO: 4174687 - DNA, 12 bp, Homo sapiens
acctctcaatat

SEQ ID NO: 4174688 - DNA, 15 bp, Homo sapiens
acctcttcagctggg

SEQ ID NO: 4174689 - DNA, 15 bp, Homo sapiens
acctgaaaaaaagtt

SEQ ID NO: 4174690 - DNA, 18 bp, Homo sapiens
acctgaaaaaaagtttac

SEQ ID NO: 4174691 - DNA, 19 bp, Homo sapiens
acctgaaaaaaagtttaca

SEQ ID NO: 4174692 - DNA, 14 bp, Homo sapiens
acctgaaccactgt

SEQ ID NO: 4174693 - DNA, 15 bp, Homo sapiens
acctgaagtcaaacc

SEQ ID NO: 4174694 - DNA, 23 bp, Homo sapiens
acctgaggatgcaacaaatattt

SEQ ID NO: 4174695 - DNA, 18 bp, Homo sapiens
acctgagtctgctatatt

SEQ ID NO: 4174696 - DNA, 19 bp, Homo sapiens
acctgcaggccaagagcag

SEQ ID NO: 4174697 - DNA, 14 bp, Homo sapiens
acctgccagcctgg

SEQ ID NO: 4174698 - DNA, 22 bp, Homo sapiens
acctgccctgccctgccacctg

SEQ ID NO: 4174699 - DNA, 19 bp, Homo sapiens
acctgcctatccatcctgc

SEQ ID NO: 4174700 - DNA, 21 bp, Homo sapiens
acctgcctatccatcctgcga

SEQ ID NO: 4174701 - DNA, 21 bp, Homo sapiens
acctgcttcatgctcagccct

SEQ ID NO: 4174702 - DNA, 15 bp, Homo sapiens
acctggagatgatga

SEQ ID NO: 4174703 - DNA, 16 bp, Homo sapiens
acctggagatgatgat

SEQ ID NO: 4174704 - DNA, 17 bp, Homo sapiens
acctggagatgatgatg

SEQ ID NO: 4174705 - DNA, 14 bp, Homo sapiens
acctggagcccgct

SEQ ID NO: 4174706 - DNA, 22 bp, Homo sapiens
acctggagcccgcttcaagctc

SEQ ID NO: 4174707 - DNA, 13 bp, Homo sapiens
acctggccagagg

SEQ ID NO: 4174708 - DNA, 18 bp, Homo sapiens
acctgggcccacagagcc

SEQ ID NO: 4174709 - DNA, 20 bp, Homo sapiens
acctgggcccacagagcctg

SEQ ID NO: 4174710 - DNA, 16 bp, Homo sapiens
acctgggttgcagaca

SEQ ID NO: 4174711 - DNA, 15 bp, Homo sapiens
acctggttcatattt

SEQ ID NO: 4174712 - DNA, 17 bp, Homo sapiens
acctgtctcctttctca

SEQ ID NO: 4174713 - DNA, 11 bp, Homo sapiens
acctgtctgtc

SEQ ID NO: 4174714 - DNA, 12 bp, Homo sapiens
acctgtctgtct

SEQ ID NO: 4174715 - DNA, 18 bp, Homo sapiens
acctgtctgtctgtctgt

SEQ ID NO: 4174716 - DNA, 22 bp, Homo sapiens
acctgttgagcatcacagaatg

SEQ ID NO: 4174717 - DNA, 16 bp, Homo sapiens
accttcaattcctggg

SEQ ID NO: 4174718 - DNA, 16 bp, Homo sapiens
accttcatgcccttct

SEQ ID NO: 4174719 - DNA, 18 bp, Homo sapiens
accttcatgcccttctga

SEQ ID NO: 4174720 - DNA, 15 bp, Homo sapiens
accttccccagactc

SEQ ID NO: 4174721 - DNA, 16 bp, Homo sapiens
accttccccagactca

SEQ ID NO: 4174722 - DNA, 21 bp, Homo sapiens
accttctcaaaagattgtttt

SEQ ID NO: 4174723 - DNA, 19 bp, Homo sapiens
accttgcatctcattgctc

SEQ ID NO: 4174724 - DNA, 16 bp, Homo sapiens
accttgccgagagagg

SEQ ID NO: 4174725 - DNA, 13 bp, Homo sapiens
accttggactcct

SEQ ID NO: 4174726 - DNA, 15 bp, Homo sapiens
accttggactcctcc

SEQ ID NO: 4174727 - DNA, 16 bp, Homo sapiens
acctttcagctgtgaa

SEQ ID NO: 4174728 - DNA, 18 bp, Homo sapiens
acctttgggatcagcctc

SEQ ID NO: 4174729 - DNA, 19 bp, Homo sapiens
accttttgaagtagtttgt

SEQ ID NO: 4174730 - DNA, 17 bp, Homo sapiens
acctttttttctctcct

SEQ ID NO: 4174731 - DNA, 17 bp, Homo sapiens
acgactccgagaacaac

SEQ ID NO: 4174732 - DNA, 11 bp, Homo sapiens
acgactcttcc

SEQ ID NO: 4174733 - DNA, 14 bp, Homo sapiens
acgcacacatggac

SEQ ID NO: 4174734 - DNA, 15 bp, Homo sapiens
acgcacacatggaca

SEQ ID NO: 4174735 - DNA, 14 bp, Homo sapiens
acgcatcctgcagt

SEQ ID NO: 4174736 - DNA, 17 bp, Homo sapiens
acgcctatgatcccagc

SEQ ID NO: 4174737 - DNA, 13 bp, Homo sapiens
acgctctggacat

SEQ ID NO: 4174738 - DNA, 18 bp, Homo sapiens
acgctggtctggatggta

SEQ ID NO: 4174739 - DNA, 15 bp, Homo sapiens
acgcttgctcatttt

SEQ ID NO: 4174740 - DNA, 13 bp, Homo sapiens
acggctggacctg

SEQ ID NO: 4174741 - DNA, 15 bp, Homo sapiens
acggctggacctgca

SEQ ID NO: 4174742 - DNA, 18 bp, Homo sapiens
acggtcctttaggcagcc

SEQ ID NO: 4174743 - DNA, 20 bp, Homo sapiens
acggtcctttaggcagcctg

SEQ ID NO: 4174744 - DNA, 16 bp, Homo sapiens
acgtatttaatagcaa

SEQ ID NO: 4174745 - DNA, 19 bp, Homo sapiens
acgtgacacaaacacacac

SEQ ID NO: 4174746 - DNA, 14 bp, Homo sapiens
acgtgagccaggta

SEQ ID NO: 4174747 - DNA, 23 bp, Homo sapiens
acttcaagcatggctattttata

SEQ ID NO: 4174748 - DNA, 16 bp, Homo sapiens
acttcagaaggcctca

SEQ ID NO: 4174749 - DNA, 18 bp, Homo sapiens
acttcagtcttgcctagg

SEQ ID NO: 4174750 - DNA, 16 bp, Homo sapiens
acttccatgatacttt

SEQ ID NO: 4174751 - DNA, 18 bp, Homo sapiens
acttccatgatactttaa

SEQ ID NO: 4174752 - DNA, 23 bp, Homo sapiens
acttcctggtgaggcccagcctg

SEQ ID NO: 4174753 - DNA, 23 bp, Homo sapiens
acttcctggttttctcttactgc

SEQ ID NO: 4174754 - DNA, 13 bp, Homo sapiens
acttctaaatcag

SEQ ID NO: 4174755 - DNA, 17 bp, Homo sapiens
acttctaaatcagaaat

SEQ ID NO: 4174756 - DNA, 11 bp, Homo sapiens
acttctaatat

SEQ ID NO: 4174757 - DNA, 22 bp, Homo sapiens
acttctaatatatttttatatt

SEQ ID NO: 4174758 - DNA, 20 bp, Homo sapiens
acttctcattttttaaaaaa

SEQ ID NO: 4174759 - DNA, 14 bp, Homo sapiens
acttctgaagtaat

SEQ ID NO: 4174760 - DNA, 18 bp, Homo sapiens
acttcttgaaacagcctg

SEQ ID NO: 4174761 - DNA, 14 bp, Homo sapiens
acttctttgaagtt

SEQ ID NO: 4174762 - DNA, 13 bp, Homo sapiens
acttgaaaaatat

SEQ ID NO: 4174763 - DNA, 14 bp, Homo sapiens
acttgaccctgagc

SEQ ID NO: 4174764 - DNA, 14 bp, Homo sapiens
acttgaggacacat

SEQ ID NO: 4174765 - DNA, 17 bp, Homo sapiens
acttgagggtaataaac

SEQ ID NO: 4174766 - DNA, 20 bp, Homo sapiens
acttgctcaggtacttgtaa

SEQ ID NO: 4174767 - DNA, 22 bp, Homo sapiens
acttgctcaggtacttgtaaat

SEQ ID NO: 4174768 - DNA, 19 bp, Homo sapiens
acttggaaaggtttcaaga

SEQ ID NO: 4174769 - DNA, 16 bp, Homo sapiens
acttggctgcaggaat

SEQ ID NO: 4174770 - DNA, 15 bp, Homo sapiens
acttgggcccaggag

SEQ ID NO: 4174771 - DNA, 22 bp, Homo sapiens
acttgtatttccaaacctggtt

SEQ ID NO: 4174772 - DNA, 21 bp, Homo sapiens
acttgtattttcttaatatac

SEQ ID NO: 4174773 - DNA, 23 bp, Homo sapiens
acttgtattttcttaatatacaa

SEQ ID NO: 4174774 - DNA, 15 bp, Homo sapiens
acttgtgttctatta

SEQ ID NO: 4174775 - DNA, 19 bp, Homo sapiens
actttaaccctctcttccc

SEQ ID NO: 4174776 - DNA, 22 bp, Homo sapiens
actttaatttttataaatatgt

SEQ ID NO: 4174777 - DNA, 15 bp, Homo sapiens
actttagagtagcat

SEQ ID NO: 4174778 - DNA, 14 bp, Homo sapiens
actttataaattca

SEQ ID NO: 4174779 - DNA, 15 bp, Homo sapiens
actttatacagaact

SEQ ID NO: 4174780 - DNA, 18 bp, Homo sapiens
actttcctacaaaatgga

SEQ ID NO: 4174781 - DNA, 16 bp, Homo sapiens
actttctcactgctgt

SEQ ID NO: 4174782 - DNA, 19 bp, Homo sapiens
actttctgtaaactcaaaa

SEQ ID NO: 4174783 - DNA, 16 bp, Homo sapiens
actttctttctcacta

SEQ ID NO: 4174784 - DNA, 16 bp, Homo sapiens
actttgatctctgctt

SEQ ID NO: 4174785 - DNA, 19 bp, Homo sapiens
actttgcctcttcagcagc

SEQ ID NO: 4174786 - DNA, 16 bp, Homo sapiens
actttggcaatttcct

SEQ ID NO: 4174787 - DNA, 11 bp, Homo sapiens
actttgttcac

SEQ ID NO: 4174788 - DNA, 21 bp, Homo sapiens
acttttccatgtatctacctc

SEQ ID NO: 4174789 - DNA, 17 bp, Homo sapiens
acttttccattcccaat

SEQ ID NO: 4174790 - DNA, 23 bp, Homo sapiens
acttttgggaggtccaggcagga

SEQ ID NO: 4174791 - DNA, 15 bp, Homo sapiens
acttttttatttaaa

SEQ ID NO: 4174792 - DNA, 18 bp, Homo sapiens
agaaaaaggtccatgctt

SEQ ID NO: 4174793 - DNA, 16 bp, Homo sapiens
agaaaaatatgtacca

SEQ ID NO: 4174794 - DNA, 13 bp, Homo sapiens
agaaaacaaaact

SEQ ID NO: 4174795 - DNA, 21 bp, Homo sapiens
agaaaacaaaactgcatttca

SEQ ID NO: 4174796 - DNA, 16 bp, Homo sapiens
agaaaacatagcacta

SEQ ID NO: 4174797 - DNA, 16 bp, Homo sapiens
agaaaaccattttagt

SEQ ID NO: 4174798 - DNA, 16 bp, Homo sapiens
agaaaacctttcttca

SEQ ID NO: 4174799 - DNA, 21 bp, Homo sapiens
agaaaactcctttagcaggtg

SEQ ID NO: 4174800 - DNA, 15 bp, Homo sapiens
agaaaactgaaaatc

SEQ ID NO: 4174801 - DNA, 16 bp, Homo sapiens
agaaaactgaaaatct

SEQ ID NO: 4174802 - DNA, 16 bp, Homo sapiens
agaaaagaaaaccatt

SEQ ID NO: 4174803 - DNA, 22 bp, Homo sapiens
agaaaatggctttaatcaattc

SEQ ID NO: 4174804 - DNA, 19 bp, Homo sapiens
agaaaatggggcttgccct

SEQ ID NO: 4174805 - DNA, 23 bp, Homo sapiens
agaaacacaaatgtaaaataagt

SEQ ID NO: 4174806 - DNA, 16 bp, Homo sapiens
agaaacagaagtagaa

SEQ ID NO: 4174807 - DNA, 16 bp, Homo sapiens
agaaacctactgccca

SEQ ID NO: 4174808 - DNA, 15 bp, Homo sapiens
agaaacttttttatt

SEQ ID NO: 4174809 - DNA, 13 bp, Homo sapiens
agaaagaagagac

SEQ ID NO: 4174810 - DNA, 13 bp, Homo sapiens
agaaagccttctt

SEQ ID NO: 4174811 - DNA, 18 bp, Homo sapiens
agaaagctttatatgtaa

SEQ ID NO: 4174812 - DNA, 20 bp, Homo sapiens
agaaagtcgaattaatagct

SEQ ID NO: 4174813 - DNA, 21 bp, Homo sapiens
agaaagtggccatgccaccct

SEQ ID NO: 4174814 - DNA, 18 bp, Homo sapiens
agaaagtgttaaaactga

SEQ ID NO: 4174815 - DNA, 13 bp, Homo sapiens
agaaataagtttt

SEQ ID NO: 4174816 - DNA, 23 bp, Homo sapiens
agaaataagtttttgtttcacag

SEQ ID NO: 4174817 - DNA, 14 bp, Homo sapiens
agaaatacaaaaat

SEQ ID NO: 4174818 - DNA, 14 bp, Homo sapiens
agaaataggaagat

SEQ ID NO: 4174819 - DNA, 14 bp, Homo sapiens
agaaattatttaat

SEQ ID NO: 4174820 - DNA, 16 bp, Homo sapiens
agaaatttaaactata

SEQ ID NO: 4174821 - DNA, 15 bp, Homo sapiens
agaaatttgatttct

SEQ ID NO: 4174822 - DNA, 21 bp, Homo sapiens
agaacaacaacaacaataaca

SEQ ID NO: 4174823 - DNA, 22 bp, Homo sapiens
agaacaacaacaacaataacaa

SEQ ID NO: 4174824 - DNA, 14 bp, Homo sapiens
agaacaggctggtt

SEQ ID NO: 4174825 - DNA, 14 bp, Homo sapiens
agaacatccctggg

SEQ ID NO: 4174826 - DNA, 18 bp, Homo sapiens
agaacatccctgggcaag

SEQ ID NO: 4174827 - DNA, 19 bp, Homo sapiens
agaaccacttggctgctca

SEQ ID NO: 4174828 - DNA, 15 bp, Homo sapiens
agaacctaattcaat

SEQ ID NO: 4174829 - DNA, 21 bp, Homo sapiens
agaacctcaggcttccttggc

SEQ ID NO: 4174830 - DNA, 14 bp, Homo sapiens
agaaccttctctat

SEQ ID NO: 4174831 - DNA, 13 bp, Homo sapiens
agaacggaagaag

SEQ ID NO: 4174832 - DNA, 17 bp, Homo sapiens
agaactgaattttggga

SEQ ID NO: 4174833 - DNA, 20 bp, Homo sapiens
agaactgaggtcactgggtt

SEQ ID NO: 4174834 - DNA, 19 bp, Homo sapiens
agaactgccccatctcctc

SEQ ID NO: 4174835 - DNA, 19 bp, Homo sapiens
agaactgtatgtcagacat

SEQ ID NO: 4174836 - DNA, 13 bp, Homo sapiens
agaacttcaatca

SEQ ID NO: 4174837 - DNA, 20 bp, Homo sapiens
agaactttgagctactgccg

SEQ ID NO: 4174838 - DNA, 19 bp, Homo sapiens
agaactttgtgccagcgct

SEQ ID NO: 4174839 - DNA, 13 bp, Homo sapiens
agaagaaaaagaa

SEQ ID NO: 4174840 - DNA, 21 bp, Homo sapiens
agaagaaacaaggttttcagt

SEQ ID NO: 4174841 - DNA, 16 bp, Homo sapiens
agaagaaagaacggaa

SEQ ID NO: 4174842 - DNA, 12 bp, Homo sapiens
agaagaaagcaa

SEQ ID NO: 4174843 - DNA, 15 bp, Homo sapiens
agaagaagaagaagg

SEQ ID NO: 4174844 - DNA, 14 bp, Homo sapiens
agaagaaggagagc

SEQ ID NO: 4174845 - DNA, 22 bp, Homo sapiens
agaagaatctcatctcagtgaa

SEQ ID NO: 4174846 - DNA, 19 bp, Homo sapiens
agaagaatgcttaatcaga

SEQ ID NO: 4174847 - DNA, 23 bp, Homo sapiens
agaagacacaaggtgatttcaga

SEQ ID NO: 4174848 - DNA, 12 bp, Homo sapiens
agaagacactgc

SEQ ID NO: 4174849 - DNA, 17 bp, Homo sapiens
agaagagatcaggaaga

SEQ ID NO: 4174850 - DNA, 15 bp, Homo sapiens
agaagaggaggaaga

SEQ ID NO: 4174851 - DNA, 22 bp, Homo sapiens
agaagaggaggagggattctgg

SEQ ID NO: 4174852 - DNA, 15 bp, Homo sapiens
agaagaggagggacc

SEQ ID NO: 4174853 - DNA, 22 bp, Homo sapiens
agaagcaagctggatgcagtgg

SEQ ID NO: 4174854 - DNA, 12 bp, Homo sapiens
agaagcaggcag

SEQ ID NO: 4174855 - DNA, 17 bp, Homo sapiens
agaagcagtgtttctac

SEQ ID NO: 4174856 - DNA, 12 bp, Homo sapiens
agaagcctgagg

SEQ ID NO: 4174857 - DNA, 14 bp, Homo sapiens
agaagcctgaggct

SEQ ID NO: 4174858 - DNA, 16 bp, Homo sapiens
agaagcctgttttgtt

SEQ ID NO: 4174859 - DNA, 23 bp, Homo sapiens
agaagcgggacgagaccctacag

SEQ ID NO: 4174860 - DNA, 21 bp, Homo sapiens
agaaggaaggcagggaggagg

SEQ ID NO: 4174861 - DNA, 13 bp, Homo sapiens
agaaggaagggca

SEQ ID NO: 4174862 - DNA, 17 bp, Homo sapiens
agaaggatagcctcagc

SEQ ID NO: 4174863 - DNA, 18 bp, Homo sapiens
agaaggatagcctcagcc

SEQ ID NO: 4174864 - DNA, 16 bp, Homo sapiens
agaaggcaaaaatagt

SEQ ID NO: 4174865 - DNA, 20 bp, Homo sapiens
agaaggcctcactcaagcct

SEQ ID NO: 4174866 - DNA, 21 bp, Homo sapiens
agaaggcctcactcaagcctg

SEQ ID NO: 4174867 - DNA, 18 bp, Homo sapiens
agaaggggaagatactga

SEQ ID NO: 4174868 - DNA, 23 bp, Homo sapiens
agaagggggattggagggaagac

SEQ ID NO: 4174869 - DNA, 22 bp, Homo sapiens
agaagggttttccaccctggaa

SEQ ID NO: 4174870 - DNA, 23 bp, Homo sapiens
agaagggttttccaccctggaat

SEQ ID NO: 4174871 - DNA, 21 bp, Homo sapiens
agaaggtatacctgggaagat

SEQ ID NO: 4174872 - DNA, 21 bp, Homo sapiens
agaaggtattagcaaagcaaa

SEQ ID NO: 4174873 - DNA, 17 bp, Homo sapiens
agaagtagaaatcatag

SEQ ID NO: 4174874 - DNA, 23 bp, Homo sapiens
agaagtaggaaggaaaaaataag

SEQ ID NO: 4174875 - DNA, 21 bp, Homo sapiens
agaagtccctaggagggaagg

SEQ ID NO: 4174876 - DNA, 23 bp, Homo sapiens
agaagtttctggccctggctgac

SEQ ID NO: 4174877 - DNA, 16 bp, Homo sapiens
agaataataataaaaa

SEQ ID NO: 4174878 - DNA, 16 bp, Homo sapiens
agaatatatttttgat

SEQ ID NO: 4174879 - DNA, 21 bp, Homo sapiens
agaggcagagaaagaagagac

SEQ ID NO: 4174880 - DNA, 18 bp, Homo sapiens
agaggccaggaatctgcc

SEQ ID NO: 4174881 - DNA, 17 bp, Homo sapiens
agaggcgcgtctgcccc

SEQ ID NO: 4174882 - DNA, 18 bp, Homo sapiens
agaggcgcgtctgcccca

SEQ ID NO: 4174883 - DNA, 21 bp, Homo sapiens
agaggcgcgtctgccccaccc

SEQ ID NO: 4174884 - DNA, 21 bp, Homo sapiens
agagggaaggggcctacaccc

SEQ ID NO: 4174885 - DNA, 12 bp, Homo sapiens
agagggagagga

SEQ ID NO: 4174886 - DNA, 17 bp, Homo sapiens
agagggagaggaagcac

SEQ ID NO: 4174887 - DNA, 16 bp, Homo sapiens
agagggataaggcagt

SEQ ID NO: 4174888 - DNA, 18 bp, Homo sapiens
agagggatgtaactattg

SEQ ID NO: 4174889 - DNA, 14 bp, Homo sapiens
agagggcccaggca

SEQ ID NO: 4174890 - DNA, 16 bp, Homo sapiens
agagggcccaggcagg

SEQ ID NO: 4174891 - DNA, 17 bp, Homo sapiens
agagggcccaggcaggc

SEQ ID NO: 4174892 - DNA, 22 bp, Homo sapiens
agaggggtgctgctcctaaacc

SEQ ID NO: 4174893 - DNA, 16 bp, Homo sapiens
agaggtaaaagtgtga

SEQ ID NO: 4174894 - DNA, 18 bp, Homo sapiens
agaggtaatttttcacct

SEQ ID NO: 4174895 - DNA, 15 bp, Homo sapiens
agaggtagcgagctg

SEQ ID NO: 4174896 - DNA, 23 bp, Homo sapiens
agaggtagcgagctgctctgcta

SEQ ID NO: 4174897 - DNA, 20 bp, Homo sapiens
agaggtgacccaatgctcct

SEQ ID NO: 4174898 - DNA, 22 bp, Homo sapiens
agaggtggattcctgggcaaga

SEQ ID NO: 4174899 - DNA, 12 bp, Homo sapiens
agaggtttgtca

SEQ ID NO: 4174900 - DNA, 15 bp, Homo sapiens
agaggtttgtcaaca

SEQ ID NO: 4174901 - DNA, 17 bp, Homo sapiens
agaggtttgtcaacaaa

SEQ ID NO: 4174902 - DNA, 17 bp, Homo sapiens
agaggtttgtcaacaca

SEQ ID NO: 4174903 - DNA, 23 bp, Homo sapiens
agaggttttaggaaacctggcat

SEQ ID NO: 4174904 - DNA, 21 bp, Homo sapiens
agagtagatggtgaaatttat

SEQ ID NO: 4174905 - DNA, 22 bp, Homo sapiens
agagtagcaagttctagagaag

SEQ ID NO: 4174906 - DNA, 18 bp, Homo sapiens
agagtatattatgtattt

SEQ ID NO: 4174907 - DNA, 18 bp, Homo sapiens
agagtcaggaagagattt

SEQ ID NO: 4174908 - DNA, 13 bp, Homo sapiens
agagtgaaataaa

SEQ ID NO: 4174909 - DNA, 18 bp, Homo sapiens
agagtgaaataattaaaa

SEQ ID NO: 4174910 - DNA, 20 bp, Homo sapiens
agagtgaaataattaaaaac

SEQ ID NO: 4174911 - DNA, 19 bp, Homo sapiens
agagtgagactcgtctcaa

SEQ ID NO: 4174912 - DNA, 21 bp, Homo sapiens
agagttcaagaaataagtttt

SEQ ID NO: 4174913 - DNA, 18 bp, Homo sapiens
agataacaagatctttca

SEQ ID NO: 4174914 - DNA, 15 bp, Homo sapiens
agataactgaaaatt

SEQ ID NO: 4174915 - DNA, 19 bp, Homo sapiens
agataatggataatcttcg

SEQ ID NO: 4174916 - DNA, 23 bp, Homo sapiens
agataatgttatacatcctattt

SEQ ID NO: 4174917 - DNA, 19 bp, Homo sapiens
agataattatcagtcatga

SEQ ID NO: 4174918 - DNA, 11 bp, Homo sapiens
agataatttta

SEQ ID NO: 4174919 - DNA, 17 bp, Homo sapiens
agataattttatgtgtt

SEQ ID NO: 4174920 - DNA, 17 bp, Homo sapiens
agatacggttgcttcac

SEQ ID NO: 4174921 - DNA, 22 bp, Homo sapiens
agatacggttgcttcaccttgg

SEQ ID NO: 4174922 - DNA, 12 bp, Homo sapiens
agatagaacagg

SEQ ID NO: 4174923 - DNA, 13 bp, Homo sapiens
agatagaacaggc

SEQ ID NO: 4174924 - DNA, 23 bp, Homo sapiens
agatagacagtgctgccctgcga

SEQ ID NO: 4174925 - DNA, 12 bp, Homo sapiens
agatagcagagg

SEQ ID NO: 4174926 - DNA, 12 bp, Homo sapiens
agatagggaaca

SEQ ID NO: 4174927 - DNA, 13 bp, Homo sapiens
agatagggaacac

SEQ ID NO: 4174928 - DNA, 23 bp, Homo sapiens
agatagggaagagagaaacattt

SEQ ID NO: 4174929 - DNA, 16 bp, Homo sapiens
agatataaaataggct

SEQ ID NO: 4174930 - DNA, 17 bp, Homo sapiens
agatattgggacacaca

SEQ ID NO: 4174931 - DNA, 18 bp, Homo sapiens
agatcaacattccagggt

SEQ ID NO: 4174932 - DNA, 22 bp, Homo sapiens
agatcacgccactgcactccag

SEQ ID NO: 4174933 - DNA, 14 bp, Homo sapiens
agatcagccacgga

SEQ ID NO: 4174934 - DNA, 18 bp, Homo sapiens
agatcaggaagagaagga

SEQ ID NO: 4174935 - DNA, 19 bp, Homo sapiens
agatcaggaagagaaggag

SEQ ID NO: 4174936 - DNA, 22 bp, Homo sapiens
agatccatttggacaaaatgga

SEQ ID NO: 4174937 - DNA, 15 bp, Homo sapiens
agatcgcgccactgc

SEQ ID NO: 4174938 - DNA, 16 bp, Homo sapiens
agatctccctccaggg

SEQ ID NO: 4174939 - DNA, 16 bp, Homo sapiens
agatctgcactgggtg

SEQ ID NO: 4174940 - DNA, 17 bp, Homo sapiens
agatcttccgtggtcag

SEQ ID NO: 4174941 - DNA, 20 bp, Homo sapiens
agatcttccgtggtcagagt

SEQ ID NO: 4174942 - DNA, 12 bp, Homo sapiens
agatctttcagg

SEQ ID NO: 4174943 - DNA, 21 bp, Homo sapiens
agatgactcactccattccta

SEQ ID NO: 4174944 - DNA, 11 bp, Homo sapiens
agatgatgatg

SEQ ID NO: 4174945 - DNA, 14 bp, Homo sapiens
agatgattttcctc

SEQ ID NO: 4174946 - DNA, 19 bp, Homo sapiens
agatgattttcctccctgg

SEQ ID NO: 4174947 - DNA, 22 bp, Homo sapiens
agatgcaccacccatggagagg

SEQ ID NO: 4174948 - DNA, 18 bp, Homo sapiens
agatgcatgcgcaggctc

SEQ ID NO: 4174949 - DNA, 16 bp, Homo sapiens
agatgccattctccag

SEQ ID NO: 4174950 - DNA, 17 bp, Homo sapiens
agatgctggcttgggca

SEQ ID NO: 4174951 - DNA, 19 bp, Homo sapiens
agatgctggcttgggcagc

SEQ ID NO: 4174952 - DNA, 20 bp, Homo sapiens
agatggcgagcatcctggcc

SEQ ID NO: 4174953 - DNA, 15 bp, Homo sapiens
agatggtgaaattta

SEQ ID NO: 4174954 - DNA, 15 bp, Homo sapiens
agatgtcagactggc

SEQ ID NO: 4174955 - DNA, 15 bp, Homo sapiens
agatgttgtcattat

SEQ ID NO: 4174956 - DNA, 15 bp, Homo sapiens
agattaaaaccacag

SEQ ID NO: 4174957 - DNA, 16 bp, Homo sapiens
agattaaaggaaggaa

SEQ ID NO: 4174958 - DNA, 17 bp, Homo sapiens
agattaaaggaaggaaa

SEQ ID NO: 4174959 - DNA, 15 bp, Homo sapiens
agattagaagtgttt

SEQ ID NO: 4174960 - DNA, 15 bp, Homo sapiens
agattatctggcgtt

SEQ ID NO: 4174961 - DNA, 19 bp, Homo sapiens
agattgacctataaaacaa

SEQ ID NO: 4174962 - DNA, 20 bp, Homo sapiens
agcagctggctctccacctt

SEQ ID NO: 4174963 - DNA, 20 bp, Homo sapiens
agcaggcaggcactgtggcc

SEQ ID NO: 4174964 - DNA, 13 bp, Homo sapiens
agcaggcagggca

SEQ ID NO: 4174965 - DNA, 14 bp, Homo sapiens
agcagggacacccc

SEQ ID NO: 4174966 - DNA, 17 bp, Homo sapiens
agcaggtgggaaatggt

SEQ ID NO: 4174967 - DNA, 17 bp, Homo sapiens
agcaggtggtcctgaga

SEQ ID NO: 4174968 - DNA, 20 bp, Homo sapiens
agcaggtggtcctgagacct

SEQ ID NO: 4174969 - DNA, 21 bp, Homo sapiens
agcaggttgaggggctcctgg

SEQ ID NO: 4174970 - DNA, 17 bp, Homo sapiens
agcagtaagcaggcctt

SEQ ID NO: 4174971 - DNA, 23 bp, Homo sapiens
agcagtgagttacagcgagaggc

SEQ ID NO: 4174972 - DNA, 13 bp, Homo sapiens
agcagtggcagga

SEQ ID NO: 4174973 - DNA, 16 bp, Homo sapiens
agcagttccatgaaga

SEQ ID NO: 4174974 - DNA, 19 bp, Homo sapiens
agcagttccatgaagacac

SEQ ID NO: 4174975 - DNA, 14 bp, Homo sapiens
agcagttgtaaaat

SEQ ID NO: 4174976 - DNA, 14 bp, Homo sapiens
agcatcacagaatg

SEQ ID NO: 4174977 - DNA, 16 bp, Homo sapiens
agcatcacctcaggcc

SEQ ID NO: 4174978 - DNA, 18 bp, Homo sapiens
agcatcagtagctgagtg

SEQ ID NO: 4174979 - DNA, 19 bp, Homo sapiens
agcatgagagaattgtatc

SEQ ID NO: 4174980 - DNA, 22 bp, Homo sapiens
agcatgggactgtgcctttggg

SEQ ID NO: 4174981 - DNA, 20 bp, Homo sapiens
agcattacgtgagccaggta

SEQ ID NO: 4174982 - DNA, 15 bp, Homo sapiens
agcattcagaagaaa

SEQ ID NO: 4174983 - DNA, 15 bp, Homo sapiens
agcattgaatggcta

SEQ ID NO: 4174984 - DNA, 13 bp, Homo sapiens
agcattgcatgga

SEQ ID NO: 4174985 - DNA, 20 bp, Homo sapiens
agcatttgccctgtggattc

SEQ ID NO: 4174986 - DNA, 14 bp, Homo sapiens
agccaaaaatagct

SEQ ID NO: 4174987 - DNA, 18 bp, Homo sapiens
agccaaaaatagctaaat

SEQ ID NO: 4174988 - DNA, 15 bp, Homo sapiens
agccaacaggtggca

SEQ ID NO: 4174989 - DNA, 14 bp, Homo sapiens
agccaacttggctt

SEQ ID NO: 4174990 - DNA, 13 bp, Homo sapiens
agccaagaccaag

SEQ ID NO: 4174991 - DNA, 14 bp, Homo sapiens
agccaaggagtcag

SEQ ID NO: 4174992 - DNA, 18 bp, Homo sapiens
agccaaggagtcagatgg

SEQ ID NO: 4174993 - DNA, 17 bp, Homo sapiens
agccaaggcagagggga

SEQ ID NO: 4174994 - DNA, 23 bp, Homo sapiens
agccaaggccctgagttggcagt

SEQ ID NO: 4174995 - DNA, 17 bp, Homo sapiens
agccaagggctaggctc

SEQ ID NO: 4174996 - DNA, 19 bp, Homo sapiens
agccacaaaataaatgttg

SEQ ID NO: 4174997 - DNA, 19 bp, Homo sapiens
agccacaagaaatttgatt

SEQ ID NO: 4174998 - DNA, 17 bp, Homo sapiens
agccacaccaggataga

SEQ ID NO: 4174999 - DNA, 24 bp, Homo sapiens
agccacaccaggatagagactgga

SEQ ID NO: 4175000 - DNA, 15 bp, Homo sapiens
agccactcgggaggc

SEQ ID NO: 4175001 - DNA, 13 bp, Homo sapiens
agccactgaagct

SEQ ID NO: 4175002 - DNA, 22 bp, Homo sapiens
agccagaacttgaccctgagct

SEQ ID NO: 4175003 - DNA, 22 bp, Homo sapiens
agccagccaggaactggctcct

SEQ ID NO: 4175004 - DNA, 13 bp, Homo sapiens
agccagctctctc

SEQ ID NO: 4175005 - DNA, 14 bp, Homo sapiens
agccagctctctct

SEQ ID NO: 4175006 - DNA, 15 bp, Homo sapiens
agccagctctctcta

SEQ ID NO: 4175007 - DNA, 13 bp, Homo sapiens
agccaggatggtc

SEQ ID NO: 4175008 - DNA, 17 bp, Homo sapiens
agccatattcacacctc

SEQ ID NO: 4175009 - DNA, 18 bp, Homo sapiens
agccatattcacacctca

SEQ ID NO: 4175010 - DNA, 18 bp, Homo sapiens
agccatgctggaaaataa

SEQ ID NO: 4175011 - DNA, 20 bp, Homo sapiens
agccatgtactcaagtacca

SEQ ID NO: 4175012 - DNA, 20 bp, Homo sapiens
agccattaccatggagacaa

SEQ ID NO: 4175013 - DNA, 17 bp, Homo sapiens
agccatttgttggggca

SEQ ID NO: 4175014 - DNA, 22 bp, Homo sapiens
agccatttgttggggcagtggt

SEQ ID NO: 4175015 - DNA, 24 bp, Homo sapiens
agcccaaggtgctgatgtcaaagt

SEQ ID NO: 4175016 - DNA, 17 bp, Homo sapiens
agcccacggggatcaca

SEQ ID NO: 4175017 - DNA, 20 bp, Homo sapiens
agcccagcctagcccacttg

SEQ ID NO: 4175018 - DNA, 11 bp, Homo sapiens
agcccatctct

SEQ ID NO: 4175019 - DNA, 23 bp, Homo sapiens
agcccccactttcctacaaaatg

SEQ ID NO: 4175020 - DNA, 22 bp, Homo sapiens
agccccccccttgaatctgcag

SEQ ID NO: 4175021 - DNA, 18 bp, Homo sapiens
agccccgcgcctccttcc

SEQ ID NO: 4175022 - DNA, 21 bp, Homo sapiens
agcccctcttttcccacattc

SEQ ID NO: 4175023 - DNA, 21 bp, Homo sapiens
agcccgcttcaagctctctgt

SEQ ID NO: 4175024 - DNA, 21 bp, Homo sapiens
agcccgggtgtgcctgccctg

SEQ ID NO: 4175025 - DNA, 23 bp, Homo sapiens
agcccgggtgtgcctgccctgga

SEQ ID NO: 4175026 - DNA, 17 bp, Homo sapiens
agccctgactggtgcta

SEQ ID NO: 4175027 - DNA, 20 bp, Homo sapiens
agccctgctgggcccatgtg

SEQ ID NO: 4175028 - DNA, 21 bp, Homo sapiens
agccctgctgggcccatgtga

SEQ ID NO: 4175029 - DNA, 16 bp, Homo sapiens
agcccttccctgcctt

SEQ ID NO: 4175030 - DNA, 21 bp, Homo sapiens
agccctttgcaggcccagcag

SEQ ID NO: 4175031 - DNA, 14 bp, Homo sapiens
agccgcagcctccc

SEQ ID NO: 4175032 - DNA, 12 bp, Homo sapiens
agccggtgcctg

SEQ ID NO: 4175033 - DNA, 13 bp, Homo sapiens
agccggtgcctgg

SEQ ID NO: 4175034 - DNA, 17 bp, Homo sapiens
agcctcccaagtagctg

SEQ ID NO: 4175035 - DNA, 16 bp, Homo sapiens
agcctcctgacctgag

SEQ ID NO: 4175036 - DNA, 18 bp, Homo sapiens
agcctcctgacctgaggc

SEQ ID NO: 4175037 - DNA, 10 bp, Homo sapiens
agcctctccc

SEQ ID NO: 4175038 - DNA, 14 bp, Homo sapiens
agcctctgctgcca

SEQ ID NO: 4175039 - DNA, 20 bp, Homo sapiens
agcctcttaaagctgcctgt

SEQ ID NO: 4175040 - DNA, 17 bp, Homo sapiens
agcctcttatcactggc

SEQ ID NO: 4175041 - DNA, 12 bp, Homo sapiens
agcctcttccct

SEQ ID NO: 4175042 - DNA, 11 bp, Homo sapiens
agcctgactgc

SEQ ID NO: 4175043 - DNA, 21 bp, Homo sapiens
agcctgagcggaggctcggcc

SEQ ID NO: 4175044 - DNA, 17 bp, Homo sapiens
agcctgaggctgagact

SEQ ID NO: 4175045 - DNA, 16 bp, Homo sapiens
agcctgcagcgagctg

SEQ ID NO: 4175046 - DNA, 18 bp, Homo sapiens
agcctgcagcgagctgag

SEQ ID NO: 4175047 - DNA, 13 bp, Homo sapiens
agcctggagaagc

SEQ ID NO: 4175048 - DNA, 22 bp, Homo sapiens
agcctggcaaggcattcctcat

SEQ ID NO: 4175049 - DNA, 15 bp, Homo sapiens
agcctggcgtctgga

SEQ ID NO: 4175050 - DNA, 15 bp, Homo sapiens
agcctggcttctgga

SEQ ID NO: 4175051 - DNA, 20 bp, Homo sapiens
agcctggcttctggagccct

SEQ ID NO: 4175052 - DNA, 15 bp, Homo sapiens
agcctgggcgacaga

SEQ ID NO: 4175053 - DNA, 18 bp, Homo sapiens
agcctgggcgacagagca

SEQ ID NO: 4175054 - DNA, 23 bp, Homo sapiens
agcctgtccactaacttgtcttt

SEQ ID NO: 4175055 - DNA, 14 bp, Homo sapiens
agccttactcacct

SEQ ID NO: 4175056 - DNA, 12 bp, Homo sapiens
agccttcaagtg

SEQ ID NO: 4175057 - DNA, 15 bp, Homo sapiens
agccttcaagtgcca

SEQ ID NO: 4175058 - DNA, 17 bp, Homo sapiens
agccttcaagtgccaaa

SEQ ID NO: 4175059 - DNA, 18 bp, Homo sapiens
agccttcaagtgccaaac

SEQ ID NO: 4175060 - DNA, 20 bp, Homo sapiens
agcctttggatgaccagaac

SEQ ID NO: 4175061 - DNA, 20 bp, Homo sapiens
agcctttttttaggccacat

SEQ ID NO: 4175062 - DNA, 23 bp, Homo sapiens
agcgaaaaaatcaggtggctttt

SEQ ID NO: 4175063 - DNA, 16 bp, Homo sapiens
agcgagagtctgtctc

SEQ ID NO: 4175064 - DNA, 14 bp, Homo sapiens
agcgagctgctctg

SEQ ID NO: 4175065 - DNA, 18 bp, Homo sapiens
agcgatggtctcagaaac

SEQ ID NO: 4175066 - DNA, 21 bp, Homo sapiens
agcgcagccgccgggcaggcc

SEQ ID NO: 4175067 - DNA, 19 bp, Homo sapiens
agcgcaggtttagtttact

SEQ ID NO: 4175068 - DNA, 21 bp, Homo sapiens
agcgcatttgatttctccagg

SEQ ID NO: 4175069 - DNA, 12 bp, Homo sapiens
agcgcctcttcc

SEQ ID NO: 4175070 - DNA, 23 bp, Homo sapiens
agcgcctcttcctctgggcagcg

SEQ ID NO: 4175071 - DNA, 16 bp, Homo sapiens
agcgcgggcggaggcg

SEQ ID NO: 4175072 - DNA, 16 bp, Homo sapiens
agcgctttctggaaaa

SEQ ID NO: 4175073 - DNA, 21 bp, Homo sapiens
agcgctttctggaaaagagga

SEQ ID NO: 4175074 - DNA, 16 bp, Homo sapiens
agcggagcttgcctgc

SEQ ID NO: 4175075 - DNA, 21 bp, Homo sapiens
agcggggccccagggctaccc

SEQ ID NO: 4175076 - DNA, 14 bp, Homo sapiens
agcgggggcgtggc

SEQ ID NO: 4175077 - DNA, 21 bp, Homo sapiens
agcggttgcttctggctcctc

SEQ ID NO: 4175078 - DNA, 15 bp, Homo sapiens
agcgtctcggccctt

SEQ ID NO: 4175079 - DNA, 11 bp, Homo sapiens
agcgtgtgtat

SEQ ID NO: 4175080 - DNA, 23 bp, Homo sapiens
agcgtgtgtatccgactctaagc

SEQ ID NO: 4175081 - DNA, 20 bp, Homo sapiens
agctaaatacctcaatcagt

SEQ ID NO: 4175082 - DNA, 13 bp, Homo sapiens
agctaagagcagt

SEQ ID NO: 4175083 - DNA, 17 bp, Homo sapiens
agctaatttttgtattt

SEQ ID NO: 4175084 - DNA, 14 bp, Homo sapiens
agctacccaggagg

SEQ ID NO: 4175085 - DNA, 22 bp, Homo sapiens
agctacccaggaggctgaggca

SEQ ID NO: 4175086 - DNA, 16 bp, Homo sapiens
agctacgtatttaata

SEQ ID NO: 4175087 - DNA, 14 bp, Homo sapiens
agctactcagaagc

SEQ ID NO: 4175088 - DNA, 21 bp, Homo sapiens
agctactcagaagcctgaggc

SEQ ID NO: 4175089 - DNA, 14 bp, Homo sapiens
agctactctcttgc

SEQ ID NO: 4175090 - DNA, 13 bp, Homo sapiens
agctataagagaa

SEQ ID NO: 4175091 - DNA, 24 bp, Homo sapiens
agctatgtgattttgagcaaacca

SEQ ID NO: 4175092 - DNA, 21 bp, Homo sapiens
agctattactgtctggtttta

SEQ ID NO: 4175093 - DNA, 17 bp, Homo sapiens
agctcacccaataaaca

SEQ ID NO: 4175094 - DNA, 19 bp, Homo sapiens
agctcactggtccatttct

SEQ ID NO: 4175095 - DNA, 21 bp, Homo sapiens
agctcagctactgatttttgt

SEQ ID NO: 4175096 - DNA, 15 bp, Homo sapiens
agctcatattttgta

SEQ ID NO: 4175097 - DNA, 18 bp, Homo sapiens
agctcatattttgtatat

SEQ ID NO: 4175098 - DNA, 15 bp, Homo sapiens
agctcatcactgtgc

SEQ ID NO: 4175099 - DNA, 17 bp, Homo sapiens
agctcatcactgtgcct

SEQ ID NO: 4175100 - DNA, 18 bp, Homo sapiens
agctcatcactgtgcctt

SEQ ID NO: 4175101 - DNA, 16 bp, Homo sapiens
agctcatgttttctat

SEQ ID NO: 4175102 - DNA, 20 bp, Homo sapiens
agctccataagcaagtgagc

SEQ ID NO: 4175103 - DNA, 12 bp, Homo sapiens
agctcctctgag

SEQ ID NO: 4175104 - DNA, 13 bp, Homo sapiens
agctcctctgagc

SEQ ID NO: 4175105 - DNA, 15 bp, Homo sapiens
agctcctctgctgct

SEQ ID NO: 4175106 - DNA, 18 bp, Homo sapiens
agctctcagggctgtctt

SEQ ID NO: 4175107 - DNA, 19 bp, Homo sapiens
agctctctgctgagcagcc

SEQ ID NO: 4175108 - DNA, 16 bp, Homo sapiens
agctctgtatggtcag

SEQ ID NO: 4175109 - DNA, 15 bp, Homo sapiens
agctctttgttcagt

SEQ ID NO: 4175110 - DNA, 12 bp, Homo sapiens
agctgaaattgt

SEQ ID NO: 4175111 - DNA, 22 bp, Homo sapiens
agctgaacagccaaatgcatgg

SEQ ID NO: 4175112 - DNA, 19 bp, Homo sapiens
agctgaacccattttgagt

SEQ ID NO: 4175113 - DNA, 19 bp, Homo sapiens
agctgaccagccgtgagca

SEQ ID NO: 4175114 - DNA, 22 bp, Homo sapiens
agctgaccagccgtgagcatgt

SEQ ID NO: 4175115 - DNA, 13 bp, Homo sapiens
agctgactgttct

SEQ ID NO: 4175116 - DNA, 18 bp, Homo sapiens
agctgagaccctcgccac

SEQ ID NO: 4175117 - DNA, 16 bp, Homo sapiens
agctgaggatgacaga

SEQ ID NO: 4175118 - DNA, 17 bp, Homo sapiens
agctgaggatgacagag

SEQ ID NO: 4175119 - DNA, 14 bp, Homo sapiens
agctgatggagaag

SEQ ID NO: 4175120 - DNA, 17 bp, Homo sapiens
agctgatggagaaggaa

SEQ ID NO: 4175121 - DNA, 19 bp, Homo sapiens
agctgcaccatcacacatg

SEQ ID NO: 4175122 - DNA, 11 bp, Homo sapiens
agctgcctggg

SEQ ID NO: 4175123 - DNA, 14 bp, Homo sapiens
agctgcctgtagtt

SEQ ID NO: 4175124 - DNA, 22 bp, Homo sapiens
agctgcctgtagttaggaaata

SEQ ID NO: 4175125 - DNA, 20 bp, Homo sapiens
agctgcggcatccctgtgtt

SEQ ID NO: 4175126 - DNA, 13 bp, Homo sapiens
agctgctctgcta

SEQ ID NO: 4175127 - DNA, 14 bp, Homo sapiens
agctgctctggaaa

SEQ ID NO: 4175128 - DNA, 12 bp, Homo sapiens
agctgctgaaga

SEQ ID NO: 4175129 - DNA, 13 bp, Homo sapiens
agctgctggctga

SEQ ID NO: 4175130 - DNA, 16 bp, Homo sapiens
agctgctggctgacct

SEQ ID NO: 4175131 - DNA, 20 bp, Homo sapiens
agctgctggctgacctgggc

SEQ ID NO: 4175132 - DNA, 23 bp, Homo sapiens
agctgctggctgacctgggccca

SEQ ID NO: 4175133 - DNA, 11 bp, Homo sapiens
agctggaaata

SEQ ID NO: 4175134 - DNA, 24 bp, Homo sapiens
agctggaaataaacctggagatga

SEQ ID NO: 4175135 - DNA, 18 bp, Homo sapiens
agctggacaagaagctgc

SEQ ID NO: 4175136 - DNA, 19 bp, Homo sapiens
agctggagatgaggctgag

SEQ ID NO: 4175137 - DNA, 20 bp, Homo sapiens
agctggcattggtctgctga

SEQ ID NO: 4175138 - DNA, 16 bp, Homo sapiens
agctggcgactgcagc

SEQ ID NO: 4175139 - DNA, 16 bp, Homo sapiens
agctgggatatgtagt

SEQ ID NO: 4175140 - DNA, 18 bp, Homo sapiens
agctggggctgccagcct

SEQ ID NO: 4175141 - DNA, 18 bp, Homo sapiens
agctgggggaagggtggt

SEQ ID NO: 4175142 - DNA, 17 bp, Homo sapiens
agctggttaatggcagc

SEQ ID NO: 4175143 - DNA, 18 bp, Homo sapiens
agctggttaatggcagca

SEQ ID NO: 4175144 - DNA, 19 bp, Homo sapiens
agctgtaaaaagagagaaa

SEQ ID NO: 4175145 - DNA, 16 bp, Homo sapiens
agctgtagctcccgag

SEQ ID NO: 4175146 - DNA, 20 bp, Homo sapiens
agctgtagtagccctttctg

SEQ ID NO: 4175147 - DNA, 15 bp, Homo sapiens
agctgtcgcatctca

SEQ ID NO: 4175148 - DNA, 19 bp, Homo sapiens
agctgtggactttgttcac

SEQ ID NO: 4175149 - DNA, 21 bp, Homo sapiens
agctgtttccagttgttactg

SEQ ID NO: 4175150 - DNA, 17 bp, Homo sapiens
agctgttttcaaagccc

SEQ ID NO: 4175151 - DNA, 18 bp, Homo sapiens
agcttatggggtatttta

SEQ ID NO: 4175152 - DNA, 21 bp, Homo sapiens
agcttcagaagtttggcaata

SEQ ID NO: 4175153 - DNA, 19 bp, Homo sapiens
agcttcagttgttttcccg

SEQ ID NO: 4175154 - DNA, 22 bp, Homo sapiens
agcttccccaggagctctctgc

SEQ ID NO: 4175155 - DNA, 21 bp, Homo sapiens
agcttgagggacaatgccact

SEQ ID NO: 4175156 - DNA, 14 bp, Homo sapiens
agcttgcctgcctg

SEQ ID NO: 4175157 - DNA, 22 bp, Homo sapiens
agcttgctgaggggcagggaga

SEQ ID NO: 4175158 - DNA, 23 bp, Homo sapiens
agcttggtggctgagcttggccc

SEQ ID NO: 4175159 - DNA, 17 bp, Homo sapiens
agcttgttccctgtctt

SEQ ID NO: 4175160 - DNA, 18 bp, Homo sapiens
agctttaacttaaatagt

SEQ ID NO: 4175161 - DNA, 15 bp, Homo sapiens
agctttatatgtaat

SEQ ID NO: 4175162 - DNA, 18 bp, Homo sapiens
agctttcctggtccctca

SEQ ID NO: 4175163 - DNA, 20 bp, Homo sapiens
agctttcctggtccctcacc

SEQ ID NO: 4175164 - DNA, 19 bp, Homo sapiens
agctttcctttccttctgg

SEQ ID NO: 4175165 - DNA, 19 bp, Homo sapiens
agctttgaaggccgaaggc

SEQ ID NO: 4175166 - DNA, 13 bp, Homo sapiens
agctttggccctc

SEQ ID NO: 4175167 - DNA, 17 bp, Homo sapiens
agctttgtttgaaaatt

SEQ ID NO: 4175168 - DNA, 13 bp, Homo sapiens
agcttttcatcaa

SEQ ID NO: 4175169 - DNA, 16 bp, Homo sapiens
agctttttctctcagg

SEQ ID NO: 4175170 - DNA, 13 bp, Homo sapiens
aggaaaaaataat

SEQ ID NO: 4175171 - DNA, 14 bp, Homo sapiens
aggaaaactcttgg

SEQ ID NO: 4175172 - DNA, 18 bp, Homo sapiens
aggaaaactcttggcctc

SEQ ID NO: 4175173 - DNA, 16 bp, Homo sapiens
aggaaaagctgcctct

SEQ ID NO: 4175174 - DNA, 23 bp, Homo sapiens
aggaaaattagaagcaagctgga

SEQ ID NO: 4175175 - DNA, 12 bp, Homo sapiens
aggaaaccaaag

SEQ ID NO: 4175176 - DNA, 21 bp, Homo sapiens
aggaaagggaagcctgactgc

SEQ ID NO: 4175177 - DNA, 20 bp, Homo sapiens
aggaaataaaacctttcaaa

SEQ ID NO: 4175178 - DNA, 15 bp, Homo sapiens
aggaaatatcatcgt

SEQ ID NO: 4175179 - DNA, 23 bp, Homo sapiens
aggaacaagagaaaaaactagag

SEQ ID NO: 4175180 - DNA, 16 bp, Homo sapiens
aggaacccagctctca

SEQ ID NO: 4175181 - DNA, 18 bp, Homo sapiens
aggaacccagctctcagg

SEQ ID NO: 4175182 - DNA, 13 bp, Homo sapiens
aggaactcccagc

SEQ ID NO: 4175183 - DNA, 23 bp, Homo sapiens
aggaactcccagcaacacaagct

SEQ ID NO: 4175184 - DNA, 16 bp, Homo sapiens
aggaactctggcttcc

SEQ ID NO: 4175185 - DNA, 22 bp, Homo sapiens
aggaactggctcctttgcctct

SEQ ID NO: 4175186 - DNA, 11 bp, Homo sapiens
aggaagaaatc

SEQ ID NO: 4175187 - DNA, 21 bp, Homo sapiens
aggaagaatgggctgcagaag

SEQ ID NO: 4175188 - DNA, 18 bp, Homo sapiens
aggaagactctggagcca

SEQ ID NO: 4175189 - DNA, 20 bp, Homo sapiens
aggaagactctggagccaag

SEQ ID NO: 4175190 - DNA, 23 bp, Homo sapiens
actcatataaaaggtgagctcag

SEQ ID NO: 4175191 - DNA, 20 bp, Homo sapiens
actcatttttcatgataatg

SEQ ID NO: 4175192 - DNA, 18 bp, Homo sapiens
actccaccccctccagct

SEQ ID NO: 4175193 - DNA, 21 bp, Homo sapiens
actccaccccctccagctcca

SEQ ID NO: 4175194 - DNA, 19 bp, Homo sapiens
actccagcctgagcaacag

SEQ ID NO: 4175195 - DNA, 20 bp, Homo sapiens
actccagcctgagcaacaga

SEQ ID NO: 4175196 - DNA, 12 bp, Homo sapiens
actccagcctgg

SEQ ID NO: 4175197 - DNA, 18 bp, Homo sapiens
actccagcctgggcgaca

SEQ ID NO: 4175198 - DNA, 21 bp, Homo sapiens
actccagcctggggtgataga

SEQ ID NO: 4175199 - DNA, 18 bp, Homo sapiens
actccagtggtgaagaaa

SEQ ID NO: 4175200 - DNA, 18 bp, Homo sapiens
actccatatttatttaaa

SEQ ID NO: 4175201 - DNA, 13 bp, Homo sapiens
actccccaggcca

SEQ ID NO: 4175202 - DNA, 14 bp, Homo sapiens
actccgagaacaac

SEQ ID NO: 4175203 - DNA, 16 bp, Homo sapiens
actccggtgtgcctgc

SEQ ID NO: 4175204 - DNA, 19 bp, Homo sapiens
actccggtgtgcctgcagc

SEQ ID NO: 4175205 - DNA, 21 bp, Homo sapiens
actccggtgtgcctgcagccc

SEQ ID NO: 4175206 - DNA, 16 bp, Homo sapiens
actccgtgtgcctggg

SEQ ID NO: 4175207 - DNA, 21 bp, Homo sapiens
actcctcaaaagcaaatgaga

SEQ ID NO: 4175208 - DNA, 20 bp, Homo sapiens
actcctcaggaacagaacac

SEQ ID NO: 4175209 - DNA, 20 bp, Homo sapiens
actcctcatccccacaatct

SEQ ID NO: 4175210 - DNA, 21 bp, Homo sapiens
actcctctaagccactcttcc

SEQ ID NO: 4175211 - DNA, 19 bp, Homo sapiens
actcctgccattcttctgg

SEQ ID NO: 4175212 - DNA, 21 bp, Homo sapiens
actcctgccattcttctggtg

SEQ ID NO: 4175213 - DNA, 20 bp, Homo sapiens
actccttcaacaattctaaa

SEQ ID NO: 4175214 - DNA, 22 bp, Homo sapiens
actcgggaggctgagacaggag

SEQ ID NO: 4175215 - DNA, 14 bp, Homo sapiens
actcgttttttaca

SEQ ID NO: 4175216 - DNA, 13 bp, Homo sapiens
actctaagctgtg

SEQ ID NO: 4175217 - DNA, 15 bp, Homo sapiens
actctaagctgtgtg

SEQ ID NO: 4175218 - DNA, 20 bp, Homo sapiens
actctatactaccctgggct

SEQ ID NO: 4175219 - DNA, 20 bp, Homo sapiens
actctatagttattgtttta

SEQ ID NO: 4175220 - DNA, 19 bp, Homo sapiens
actctcccctccctcttcc

SEQ ID NO: 4175221 - DNA, 22 bp, Homo sapiens
actctcccctccctcttccttc

SEQ ID NO: 4175222 - DNA, 17 bp, Homo sapiens
actctctgagatgtgtt

SEQ ID NO: 4175223 - DNA, 21 bp, Homo sapiens
actctctgtacaaaaacaaaa

SEQ ID NO: 4175224 - DNA, 23 bp, Homo sapiens
actctgaggctctttctgggcca

SEQ ID NO: 4175225 - DNA, 15 bp, Homo sapiens
actctggcttccagg

SEQ ID NO: 4175226 - DNA, 18 bp, Homo sapiens
actctgggtccctcggag

SEQ ID NO: 4175227 - DNA, 14 bp, Homo sapiens
actctgtcagatgg

SEQ ID NO: 4175228 - DNA, 16 bp, Homo sapiens
actctgtggggccttg

SEQ ID NO: 4175229 - DNA, 17 bp, Homo sapiens
actctgtggggccttgg

SEQ ID NO: 4175230 - DNA, 20 bp, Homo sapiens
actcttcccccactcctctt

SEQ ID NO: 4175231 - DNA, 13 bp, Homo sapiens
actcttggcctct

SEQ ID NO: 4175232 - DNA, 16 bp, Homo sapiens
actcttggcctctgct

SEQ ID NO: 4175233 - DNA, 14 bp, Homo sapiens
actctttatgcttg

SEQ ID NO: 4175234 - DNA, 22 bp, Homo sapiens
actgaaaaaaaaaaagaagaag

SEQ ID NO: 4175235 - DNA, 23 bp, Homo sapiens
actgaaaaaaaaaaagaagaaga

SEQ ID NO: 4175236 - DNA, 24 bp, Homo sapiens
actgaaaaaaaaaaagaagaagaa

SEQ ID NO: 4175237 - DNA, 16 bp, Homo sapiens
actgaacatttgcttt

SEQ ID NO: 4175238 - DNA, 22 bp, Homo sapiens
actgaacccagagtcaggaaga

SEQ ID NO: 4175239 - DNA, 18 bp, Homo sapiens
actgaagagaccacagca

SEQ ID NO: 4175240 - DNA, 16 bp, Homo sapiens
actgaagttatctgtg

SEQ ID NO: 4175241 - DNA, 18 bp, Homo sapiens
actgaataggaaaatgta

SEQ ID NO: 4175242 - DNA, 15 bp, Homo sapiens
actgaattaagttat

SEQ ID NO: 4175243 - DNA, 16 bp, Homo sapiens
actgaattaagttatt

SEQ ID NO: 4175244 - DNA, 16 bp, Homo sapiens
actgacaagatggaaa

SEQ ID NO: 4175245 - DNA, 20 bp, Homo sapiens
actgagggattttagcctct

SEQ ID NO: 4175246 - DNA, 17 bp, Homo sapiens
actgaggtcactgggtt

SEQ ID NO: 4175247 - DNA, 13 bp, Homo sapiens
actgagttttcca

SEQ ID NO: 4175248 - DNA, 15 bp, Homo sapiens
actgatgaatgacaa

SEQ ID NO: 4175249 - DNA, 21 bp, Homo sapiens
actgatgttacatcacagtgt

SEQ ID NO: 4175250 - DNA, 17 bp, Homo sapiens
actgattacctgccaat

SEQ ID NO: 4175251 - DNA, 18 bp, Homo sapiens
actgattctcctgtcaga

SEQ ID NO: 4175252 - DNA, 23 bp, Homo sapiens
actgattttttagttaaattgat

SEQ ID NO: 4175253 - DNA, 14 bp, Homo sapiens
actgcactccagcc

SEQ ID NO: 4175254 - DNA, 20 bp, Homo sapiens
aggctgagaaggaacaggga

SEQ ID NO: 4175255 - DNA, 17 bp, Homo sapiens
aggctgagactgcggga

SEQ ID NO: 4175256 - DNA, 13 bp, Homo sapiens
aggctgaggcagg

SEQ ID NO: 4175257 - DNA, 22 bp, Homo sapiens
aggctgaggggaggatcactgg

SEQ ID NO: 4175258 - DNA, 19 bp, Homo sapiens
aggctgctgggagatgcca

SEQ ID NO: 4175259 - DNA, 13 bp, Homo sapiens
aggctggctggcc

SEQ ID NO: 4175260 - DNA, 20 bp, Homo sapiens
aggctggggctcgtaaatat

SEQ ID NO: 4175261 - DNA, 10 bp, Homo sapiens
aggctgtggg

SEQ ID NO: 4175262 - DNA, 18 bp, Homo sapiens
aggctgtgtttggctttc

SEQ ID NO: 4175263 - DNA, 17 bp, Homo sapiens
aggcttagagaggaaaa

SEQ ID NO: 4175264 - DNA, 15 bp, Homo sapiens
aggcttaggtgccag

SEQ ID NO: 4175265 - DNA, 16 bp, Homo sapiens
aggcttatcaaaatct

SEQ ID NO: 4175266 - DNA, 17 bp, Homo sapiens
aggcttatcaaaatctt

SEQ ID NO: 4175267 - DNA, 15 bp, Homo sapiens
aggcttgttgtgctt

SEQ ID NO: 4175268 - DNA, 16 bp, Homo sapiens
aggcttgttgtgcttt

SEQ ID NO: 4175269 - DNA, 19 bp, Homo sapiens
aggctttgccatgggcctg

SEQ ID NO: 4175270 - DNA, 19 bp, Homo sapiens
agggaacactcatccctgg

SEQ ID NO: 4175271 - DNA, 23 bp, Homo sapiens
agggaacccagctctaatacatt

SEQ ID NO: 4175272 - DNA, 19 bp, Homo sapiens
agggaaccgtctgttttta

SEQ ID NO: 4175273 - DNA, 14 bp, Homo sapiens
agggaagcagggac

SEQ ID NO: 4175274 - DNA, 23 bp, Homo sapiens
agggaaggaactctggcttccag

SEQ ID NO: 4175275 - DNA, 13 bp, Homo sapiens
agggaaggagctg

SEQ ID NO: 4175276 - DNA, 21 bp, Homo sapiens
agggaatccgcctgcagagga

SEQ ID NO: 4175277 - DNA, 14 bp, Homo sapiens
agggaatgggacag

SEQ ID NO: 4175278 - DNA, 14 bp, Homo sapiens
agggacacctggga

SEQ ID NO: 4175279 - DNA, 21 bp, Homo sapiens
agggacctactgaacccagag

SEQ ID NO: 4175280 - DNA, 23 bp, Homo sapiens
agggaccttcatgcccttctgat

SEQ ID NO: 4175281 - DNA, 19 bp, Homo sapiens
agggacggggactggccct

SEQ ID NO: 4175282 - DNA, 15 bp, Homo sapiens
agggactggaaccag

SEQ ID NO: 4175283 - DNA, 15 bp, Homo sapiens
agggagaaggatcta

SEQ ID NO: 4175284 - DNA, 16 bp, Homo sapiens
agggagccatgtttca

SEQ ID NO: 4175285 - DNA, 18 bp, Homo sapiens
gctgtaactcagacattc

SEQ ID NO: 4175286 - DNA, 23 bp, Homo sapiens
gctgtaactcagacattccaagg

SEQ ID NO: 4175287 - DNA, 19 bp, Homo sapiens
gctgtaagcattctgagct

SEQ ID NO: 4175288 - DNA, 22 bp, Homo sapiens
gctgtaagcattctgagctggg

SEQ ID NO: 4175289 - DNA, 21 bp, Homo sapiens
gctgtagtagccctttctgtg

SEQ ID NO: 4175290 - DNA, 12 bp, Homo sapiens
gctgtcactggc

SEQ ID NO: 4175291 - DNA, 14 bp, Homo sapiens
gctgtcactggcag

SEQ ID NO: 4175292 - DNA, 22 bp, Homo sapiens
gctgtcatggtcctttctggaa

SEQ ID NO: 4175293 - DNA, 19 bp, Homo sapiens
gctgtcattcaggacccca

SEQ ID NO: 4175294 - DNA, 13 bp, Homo sapiens
gctgtcctaggcc

SEQ ID NO: 4175295 - DNA, 18 bp, Homo sapiens
gctgtgaacatggactct

SEQ ID NO: 4175296 - DNA, 14 bp, Homo sapiens
gctgtgctgtgtct

SEQ ID NO: 4175297 - DNA, 13 bp, Homo sapiens
gctgtggccaggg

SEQ ID NO: 4175298 - DNA, 16 bp, Homo sapiens
gctgtggccagggtga

SEQ ID NO: 4175299 - DNA, 17 bp, Homo sapiens
gctgtggccagggtgag

SEQ ID NO: 4175300 - DNA, 19 bp, Homo sapiens
gctgtggccagggtgagag

SEQ ID NO: 4175301 - DNA, 17 bp, Homo sapiens
gctgtggggtctggctg

SEQ ID NO: 4175302 - DNA, 20 bp, Homo sapiens
gctgtggttcctaagcctgt

SEQ ID NO: 4175303 - DNA, 18 bp, Homo sapiens
gcttaaaactttgaagtt

SEQ ID NO: 4175304 - DNA, 20 bp, Homo sapiens
gcttaatggctgataatttt

SEQ ID NO: 4175305 - DNA, 12 bp, Homo sapiens
gcttaggatgtt

SEQ ID NO: 4175306 - DNA, 16 bp, Homo sapiens
gcttaggtgccaggct

SEQ ID NO: 4175307 - DNA, 15 bp, Homo sapiens
gcttatggtaccaga

SEQ ID NO: 4175308 - DNA, 19 bp, Homo sapiens
gcttattttttaaaataat

SEQ ID NO: 4175309 - DNA, 15 bp, Homo sapiens
gcttcaagctctctg

SEQ ID NO: 4175310 - DNA, 22 bp, Homo sapiens
gcttcagacttttatcaaaatc

SEQ ID NO: 4175311 - DNA, 19 bp, Homo sapiens
gcttcagcatatttatagc

SEQ ID NO: 4175312 - DNA, 18 bp, Homo sapiens
gcttcagttgttttcccg

SEQ ID NO: 4175313 - DNA, 14 bp, Homo sapiens
gcttcatgctcagc

SEQ ID NO: 4175314 - DNA, 21 bp, Homo sapiens
gcttccaggtatctccaggat

SEQ ID NO: 4175315 - DNA, 22 bp, Homo sapiens
gcttccttggcatcacagggca

SEQ ID NO: 4175316 - DNA, 20 bp, Homo sapiens
gcttctcctcccagcgtgtg

SEQ ID NO: 4175317 - DNA, 15 bp, Homo sapiens
gcttctgcagcaact

SEQ ID NO: 4175318 - DNA, 20 bp, Homo sapiens
gcttctgcagcaactcccac

SEQ ID NO: 4175319 - DNA, 21 bp, Homo sapiens
gcttctgcagcaactcccacg

SEQ ID NO: 4175320 - DNA, 23 bp, Homo sapiens
gcttctgcagcaactcccacgac

SEQ ID NO: 4175321 - DNA, 17 bp, Homo sapiens
gcttctggagcccttgg

SEQ ID NO: 4175322 - DNA, 14 bp, Homo sapiens
gcttctggccagga

SEQ ID NO: 4175323 - DNA, 18 bp, Homo sapiens
gcttctggccaggaagct

SEQ ID NO: 4175324 - DNA, 16 bp, Homo sapiens
gcttcttctcatgggg

SEQ ID NO: 4175325 - DNA, 13 bp, Homo sapiens
gcttcttgcccag

SEQ ID NO: 4175326 - DNA, 15 bp, Homo sapiens
gcttcttgcccagat

SEQ ID NO: 4175327 - DNA, 20 bp, Homo sapiens
gcttgatagaaatgccaagc

SEQ ID NO: 4175328 - DNA, 22 bp, Homo sapiens
gcttgcactttgtaacatgttt

SEQ ID NO: 4175329 - DNA, 14 bp, Homo sapiens
gcttgctcattttt

SEQ ID NO: 4175330 - DNA, 20 bp, Homo sapiens
gcttgctgaggggcagggag

SEQ ID NO: 4175331 - DNA, 13 bp, Homo sapiens
gcttgcttctgca

SEQ ID NO: 4175332 - DNA, 22 bp, Homo sapiens
gcttgggaaaggtggtgtttct

SEQ ID NO: 4175333 - DNA, 19 bp, Homo sapiens
gcttggtggccaagcctgg

SEQ ID NO: 4175334 - DNA, 22 bp, Homo sapiens
gcttggtggccaagcctggccc

SEQ ID NO: 4175335 - DNA, 16 bp, Homo sapiens
gcttggtggctgagct

SEQ ID NO: 4175336 - DNA, 18 bp, Homo sapiens
gctttaacttaaatagta

SEQ ID NO: 4175337 - DNA, 23 bp, Homo sapiens
gctttagtcctagaggacctgag

SEQ ID NO: 4175338 - DNA, 15 bp, Homo sapiens
gctttcctggtccct

SEQ ID NO: 4175339 - DNA, 17 bp, Homo sapiens
gctttgccaaaatacca

SEQ ID NO: 4175340 - DNA, 18 bp, Homo sapiens
gctttgccaaaataccag

SEQ ID NO: 4175341 - DNA, 20 bp, Homo sapiens
gctttgccatgggcctgctg

SEQ ID NO: 4175342 - DNA, 17 bp, Homo sapiens
gctttgcttttcctgga

SEQ ID NO: 4175343 - DNA, 19 bp, Homo sapiens
gcttttaacagagtctgaa

SEQ ID NO: 4175344 - DNA, 21 bp, Homo sapiens
gcttttagtattttagtgaac

SEQ ID NO: 4175345 - DNA, 20 bp, Homo sapiens
gcttttcgcttgcttctgca

SEQ ID NO: 4175346 - DNA, 12 bp, Homo sapiens
ggaaaaagaaaa

SEQ ID NO: 4175347 - DNA, 23 bp, Homo sapiens
ggaaaaagaaaaacatttcctct

SEQ ID NO: 4175348 - DNA, 16 bp, Homo sapiens
ggaaaactcttggcct

SEQ ID NO: 4175349 - DNA, 19 bp, Homo sapiens
ggaaaactcttggcctctg

SEQ ID NO: 4175350 - DNA, 16 bp, Homo sapiens
ggaaaataatactgct

SEQ ID NO: 4175351 - DNA, 23 bp, Homo sapiens
ggaaaattagaagcaagctggat

SEQ ID NO: 4175352 - DNA, 11 bp, Homo sapiens
ggaaaccaaat

SEQ ID NO: 4175353 - DNA, 22 bp, Homo sapiens
ggaaagaaagcacctgttttta

SEQ ID NO: 4175354 - DNA, 18 bp, Homo sapiens
ggaaagcatcacctcagg

SEQ ID NO: 4175355 - DNA, 20 bp, Homo sapiens
ggaaagcctcaggagagagt

SEQ ID NO: 4175356 - DNA, 14 bp, Homo sapiens
ggaaagcctctgct

SEQ ID NO: 4175357 - DNA, 12 bp, Homo sapiens
ggaaaggctcag

SEQ ID NO: 4175358 - DNA, 16 bp, Homo sapiens
ggaaaggtggtgtttc

SEQ ID NO: 4175359 - DNA, 19 bp, Homo sapiens
ggaaatggtatgagctgag

SEQ ID NO: 4175360 - DNA, 20 bp, Homo sapiens
ggaaatgtgtgttgtaacaa

SEQ ID NO: 4175361 - DNA, 22 bp, Homo sapiens
ggaaattctatatgatcctgaa

SEQ ID NO: 4175362 - DNA, 22 bp, Homo sapiens
ggaacagaacacttctaggact

SEQ ID NO: 4175363 - DNA, 21 bp, Homo sapiens
ggaacagctcttcactcagcc

SEQ ID NO: 4175364 - DNA, 19 bp, Homo sapiens
ggaactctggcttccaggt

SEQ ID NO: 4175365 - DNA, 20 bp, Homo sapiens
ggaactctggcttccaggta

SEQ ID NO: 4175366 - DNA, 19 bp, Homo sapiens
ggaactgaagacctccaca

SEQ ID NO: 4175367 - DNA, 14 bp, Homo sapiens
ggaagaaagcaaca

SEQ ID NO: 4175368 - DNA, 13 bp, Homo sapiens
ggaagaagaggag

SEQ ID NO: 4175369 - DNA, 16 bp, Homo sapiens
ggaagaagaggaggaa

SEQ ID NO: 4175370 - DNA, 19 bp, Homo sapiens
ggaagaatgggctgcagaa

SEQ ID NO: 4175371 - DNA, 21 bp, Homo sapiens
ggaagaatgggctgcagaaga

SEQ ID NO: 4175372 - DNA, 17 bp, Homo sapiens
ggaagagaggcacctgc

SEQ ID NO: 4175373 - DNA, 19 bp, Homo sapiens
ggaagagaggcacctgctg

SEQ ID NO: 4175374 - DNA, 18 bp, Homo sapiens
ggaagattaaaaccacag

SEQ ID NO: 4175375 - DNA, 22 bp, Homo sapiens
ggaagattaaaaccacagaaca

SEQ ID NO: 4175376 - DNA, 18 bp, Homo sapiens
ggaagattagaggtttgt

SEQ ID NO: 4175377 - DNA, 14 bp, Homo sapiens
ggaagcaagcaggg

SEQ ID NO: 4175378 - DNA, 15 bp, Homo sapiens
ggaagcaagcagggg

SEQ ID NO: 4175379 - DNA, 17 bp, Homo sapiens
ggaagcagggacacccc

SEQ ID NO: 4175380 - DNA, 17 bp, Homo sapiens
ggaagcctgactgctcg

SEQ ID NO: 4175381 - DNA, 20 bp, Homo sapiens
ggaagctttggtgagaacct

SEQ ID NO: 4175382 - DNA, 14 bp, Homo sapiens
ggaaggaaaaaata

SEQ ID NO: 4175383 - DNA, 17 bp, Homo sapiens
ggaaggaactctggctt

SEQ ID NO: 4175384 - DNA, 14 bp, Homo sapiens
ggaaggagctgttg

SEQ ID NO: 4175385 - DNA, 15 bp, Homo sapiens
ggaaggagctgttgg

SEQ ID NO: 4175386 - DNA, 16 bp, Homo sapiens
ggaaggagctgttggg

SEQ ID NO: 4175387 - DNA, 16 bp, Homo sapiens
ggaaggcagggacaga

SEQ ID NO: 4175388 - DNA, 17 bp, Homo sapiens
ggaagggcatccttctg

SEQ ID NO: 4175389 - DNA, 16 bp, Homo sapiens
ggaagggggtccaccc

SEQ ID NO: 4175390 - DNA, 22 bp, Homo sapiens
ggaagggttggtgggctggccc

SEQ ID NO: 4175391 - DNA, 22 bp, Homo sapiens
ggaaggttagaggtttgtcaac

SEQ ID NO: 4175392 - DNA, 16 bp, Homo sapiens
ggaaggttaggtttgt

SEQ ID NO: 4175393 - DNA, 19 bp, Homo sapiens
ggaaggtttggtgtgtgga

SEQ ID NO: 4175394 - DNA, 14 bp, Homo sapiens
ggaagtatgtgtgg

SEQ ID NO: 4175395 - DNA, 14 bp, Homo sapiens
ggaagttcactgga

SEQ ID NO: 4175396 - DNA, 11 bp, Homo sapiens
ggaagttttca

SEQ ID NO: 4175397 - DNA, 18 bp, Homo sapiens
ggaatatgactgttttta

SEQ ID NO: 4175398 - DNA, 18 bp, Homo sapiens
ggaatcagctggtggcta

SEQ ID NO: 4175399 - DNA, 19 bp, Homo sapiens
ggaatccgcctgcagagga

SEQ ID NO: 4175400 - DNA, 20 bp, Homo sapiens
ggaatccgcctgcagaggac

SEQ ID NO: 4175401 - DNA, 15 bp, Homo sapiens
ggaatggaaggcttt

SEQ ID NO: 4175402 - DNA, 13 bp, Homo sapiens
ggaatttaattta

SEQ ID NO: 4175403 - DNA, 14 bp, Homo sapiens
ggacaacctgcccc

SEQ ID NO: 4175404 - DNA, 14 bp, Homo sapiens
ggacaagaagctgc

SEQ ID NO: 4175405 - DNA, 14 bp, Homo sapiens
ggacacacatcaaa

SEQ ID NO: 4175406 - DNA, 15 bp, Homo sapiens
ggacacagacccaca

SEQ ID NO: 4175407 - DNA, 12 bp, Homo sapiens
ggacacagtgtt

SEQ ID NO: 4175408 - DNA, 19 bp, Homo sapiens
ggacacatgtccagtggga

SEQ ID NO: 4175409 - DNA, 19 bp, Homo sapiens
ggacaccccttatccagga

SEQ ID NO: 4175410 - DNA, 11 bp, Homo sapiens
ggacacctgcc

SEQ ID NO: 4175411 - DNA, 16 bp, Homo sapiens
ggacacctgccctgcc

SEQ ID NO: 4175412 - DNA, 19 bp, Homo sapiens
ggacacctgggagaaatct

SEQ ID NO: 4175413 - DNA, 18 bp, Homo sapiens
ggacaggaggggcccaca

SEQ ID NO: 4175414 - DNA, 19 bp, Homo sapiens
ggacaggtaagtggcagga

SEQ ID NO: 4175415 - DNA, 13 bp, Homo sapiens
ggacagtcctggg

SEQ ID NO: 4175416 - DNA, 14 bp, Homo sapiens
ggacagtcctggga

SEQ ID NO: 4175417 - DNA, 17 bp, Homo sapiens
ggacagtgcttcagcct

SEQ ID NO: 4175418 - DNA, 18 bp, Homo sapiens
ggacagtgcttcagcctg

SEQ ID NO: 4175419 - DNA, 19 bp, Homo sapiens
ggacagtgcttcagcctga

SEQ ID NO: 4175420 - DNA, 21 bp, Homo sapiens
ggacataaagcctctgactca

SEQ ID NO: 4175421 - DNA, 22 bp, Homo sapiens
ggaccacaaaaatgaaagcatg

SEQ ID NO: 4175422 - DNA, 11 bp, Homo sapiens
ggaccaggact

SEQ ID NO: 4175423 - DNA, 13 bp, Homo sapiens
ggacccagctcct

SEQ ID NO: 4175424 - DNA, 18 bp, Homo sapiens
ggacccagctcctctgag

SEQ ID NO: 4175425 - DNA, 19 bp, Homo sapiens
ggacccagctcctctgagc

SEQ ID NO: 4175426 - DNA, 20 bp, Homo sapiens
ggacccagctcctctgagcc

SEQ ID NO: 4175427 - DNA, 19 bp, Homo sapiens
ggacctactgaacccagag

SEQ ID NO: 4175428 - DNA, 22 bp, Homo sapiens
ggacctgaatgacctgcagtca

SEQ ID NO: 4175429 - DNA, 17 bp, Homo sapiens
ggacctttcagctgtga

SEQ ID NO: 4175430 - DNA, 14 bp, Homo sapiens
ggacgttggttctg

SEQ ID NO: 4175431 - DNA, 15 bp, Homo sapiens
ggactatagcccagg

SEQ ID NO: 4175432 - DNA, 14 bp, Homo sapiens
ggactcatggctta

SEQ ID NO: 4175433 - DNA, 11 bp, Homo sapiens
ggactctgagg

SEQ ID NO: 4175434 - DNA, 20 bp, Homo sapiens
ggactgatgaatgacaacat

SEQ ID NO: 4175435 - DNA, 15 bp, Homo sapiens
ggacttaaatgttaa

SEQ ID NO: 4175436 - DNA, 20 bp, Homo sapiens
ggactttcctaaatgtttaa

SEQ ID NO: 4175437 - DNA, 15 bp, Homo sapiens
ggagaacctcaggct

SEQ ID NO: 4175438 - DNA, 18 bp, Homo sapiens
ggagaagagatcttcatg

SEQ ID NO: 4175439 - DNA, 20 bp, Homo sapiens
ggagaaggatctagaatgtg

SEQ ID NO: 4175440 - DNA, 16 bp, Homo sapiens
ggagactctgtggggc

SEQ ID NO: 4175441 - DNA, 19 bp, Homo sapiens
ggagagagacgtgtacata

SEQ ID NO: 4175442 - DNA, 19 bp, Homo sapiens
ggagagccagctctctcta

SEQ ID NO: 4175443 - DNA, 13 bp, Homo sapiens
ggagagcctggca

SEQ ID NO: 4175444 - DNA, 21 bp, Homo sapiens
ggagagcgcctcttcctctgg

SEQ ID NO: 4175445 - DNA, 22 bp, Homo sapiens
ggagagcgcctcttcctctggg

SEQ ID NO: 4175446 - DNA, 13 bp, Homo sapiens
ggagaggactctg

SEQ ID NO: 4175447 - DNA, 14 bp, Homo sapiens
ggagaggtttgtca

SEQ ID NO: 4175448 - DNA, 14 bp, Homo sapiens
ggagagtgcttggg

SEQ ID NO: 4175449 - DNA, 15 bp, Homo sapiens
ggagcacagaggggc

SEQ ID NO: 4175450 - DNA, 12 bp, Homo sapiens
ggagcagaaaga

SEQ ID NO: 4175451 - DNA, 15 bp, Homo sapiens
ggagcagaaagatta

SEQ ID NO: 4175452 - DNA, 21 bp, Homo sapiens
ggagccgagatcacgccactg

SEQ ID NO: 4175453 - DNA, 12 bp, Homo sapiens
ggagcctgcctc

SEQ ID NO: 4175454 - DNA, 15 bp, Homo sapiens
ggagcgcacctgccc

SEQ ID NO: 4175455 - DNA, 19 bp, Homo sapiens
ggagcgcacctgccccctg

SEQ ID NO: 4175456 - DNA, 21 bp, Homo sapiens
ggagcgcacctgccccctggt

SEQ ID NO: 4175457 - DNA, 14 bp, Homo sapiens
ggagctgccagccg

SEQ ID NO: 4175458 - DNA, 12 bp, Homo sapiens
ggagctgctggc

SEQ ID NO: 4175459 - DNA, 14 bp, Homo sapiens
ggagctgctggctg

SEQ ID NO: 4175460 - DNA, 17 bp, Homo sapiens
ggagctgctggctgacc

SEQ ID NO: 4175461 - DNA, 14 bp, Homo sapiens
ggagctggaaataa

SEQ ID NO: 4175462 - DNA, 16 bp, Homo sapiens
ggagcttgagggacaa

SEQ ID NO: 4175463 - DNA, 16 bp, Homo sapiens
ggagcttgcctgcctg

SEQ ID NO: 4175464 - DNA, 19 bp, Homo sapiens
ggaggaagcaggttgaggg

SEQ ID NO: 4175465 - DNA, 16 bp, Homo sapiens
ggaggatcactggagc

SEQ ID NO: 4175466 - DNA, 20 bp, Homo sapiens
ggaggatcactggagcccag

SEQ ID NO: 4175467 - DNA, 21 bp, Homo sapiens
ggaggatcactggagcccagg

SEQ ID NO: 4175468 - DNA, 19 bp, Homo sapiens
ggaggcagagaagaaagaa

SEQ ID NO: 4175469 - DNA, 14 bp, Homo sapiens
cttttcatcaattc

SEQ ID NO: 4175470 - DNA, 19 bp, Homo sapiens
cttttctccctagaaacaa

SEQ ID NO: 4175471 - DNA, 23 bp, Homo sapiens
cttttgggaggtccaggcaggag

SEQ ID NO: 4175472 - DNA, 22 bp, Homo sapiens
ctttttaaaaagtactctttaa

SEQ ID NO: 4175473 - DNA, 17 bp, Homo sapiens
ctttttcaacttggaaa

SEQ ID NO: 4175474 - DNA, 15 bp, Homo sapiens
cttttttttaataag

SEQ ID NO: 4175475 - DNA, 15 bp, Homo sapiens
gaaaaaaatatatga

SEQ ID NO: 4175476 - DNA, 12 bp, Homo sapiens
gaaaaaatgata

SEQ ID NO: 4175477 - DNA, 14 bp, Homo sapiens
gaaaaaatgtagaa

SEQ ID NO: 4175478 - DNA, 21 bp, Homo sapiens
gaaaaacaaactcgtttttta

SEQ ID NO: 4175479 - DNA, 18 bp, Homo sapiens
gaaaaacacggcagctgt

SEQ ID NO: 4175480 - DNA, 15 bp, Homo sapiens
gaaaaacatttcctc

SEQ ID NO: 4175481 - DNA, 12 bp, Homo sapiens
gaaaaagaagca

SEQ ID NO: 4175482 - DNA, 18 bp, Homo sapiens
gaaaaatcagaagcacaa

SEQ ID NO: 4175483 - DNA, 14 bp, Homo sapiens
gaaaaccccagcat

SEQ ID NO: 4175484 - DNA, 11 bp, Homo sapiens
gaaaacctttc

SEQ ID NO: 4175485 - DNA, 15 bp, Homo sapiens
gaaaacgttgacccc

SEQ ID NO: 4175486 - DNA, 17 bp, Homo sapiens
gaaaactaacaaccaac

SEQ ID NO: 4175487 - DNA, 17 bp, Homo sapiens
gaaaactcattactttt

SEQ ID NO: 4175488 - DNA, 18 bp, Homo sapiens
gaaaactcttggcctctg

SEQ ID NO: 4175489 - DNA, 16 bp, Homo sapiens
gaaaacttatttgagt

SEQ ID NO: 4175490 - DNA, 16 bp, Homo sapiens
gaaaactttttcacag

SEQ ID NO: 4175491 - DNA, 22 bp, Homo sapiens
gaaaagaatccctgcagcctgg

SEQ ID NO: 4175492 - DNA, 17 bp, Homo sapiens
gaaaaggtttatgaaaa

SEQ ID NO: 4175493 - DNA, 18 bp, Homo sapiens
gaaaataaattttgaatg

SEQ ID NO: 4175494 - DNA, 13 bp, Homo sapiens
gaaaataattgtt

SEQ ID NO: 4175495 - DNA, 17 bp, Homo sapiens
gaaaataattgttccaa

SEQ ID NO: 4175496 - DNA, 12 bp, Homo sapiens
gaaaatgtacat

SEQ ID NO: 4175497 - DNA, 22 bp, Homo sapiens
gaaaatgtacatactatgttca

SEQ ID NO: 4175498 - DNA, 14 bp, Homo sapiens
gaaaattagaagca

SEQ ID NO: 4175499 - DNA, 21 bp, Homo sapiens
gaaaattcctattgattttct

SEQ ID NO: 4175500 - DNA, 11 bp, Homo sapiens
gaaacagaaaa

SEQ ID NO: 4175501 - DNA, 22 bp, Homo sapiens
gaaacagaaaaatatgtaccaa

SEQ ID NO: 4175502 - DNA, 15 bp, Homo sapiens
gaaacagaagtagaa

SEQ ID NO: 4175503 - DNA, 12 bp, Homo sapiens
gaaacagcctgg

SEQ ID NO: 4175504 - DNA, 22 bp, Homo sapiens
gaaacaggaccacaaaaatgaa

SEQ ID NO: 4175505 - DNA, 15 bp, Homo sapiens
gaaacatttatggaa

SEQ ID NO: 4175506 - DNA, 18 bp, Homo sapiens
gaaaccaaaattatatgg

SEQ ID NO: 4175507 - DNA, 14 bp, Homo sapiens
gaaaccaaagccag

SEQ ID NO: 4175508 - DNA, 20 bp, Homo sapiens
gaaactagtatctctggcct

SEQ ID NO: 4175509 - DNA, 16 bp, Homo sapiens
gaaactttctttctca

SEQ ID NO: 4175510 - DNA, 18 bp, Homo sapiens
gaaagaaggacacttgta

SEQ ID NO: 4175511 - DNA, 14 bp, Homo sapiens
gaaagccatttgtt

SEQ ID NO: 4175512 - DNA, 13 bp, Homo sapiens
gaaagcccaaggt

SEQ ID NO: 4175513 - DNA, 19 bp, Homo sapiens
gaaagcccaaggtgctgat

SEQ ID NO: 4175514 - DNA, 14 bp, Homo sapiens
gaaagcctctggaa

SEQ ID NO: 4175515 - DNA, 21 bp, Homo sapiens
gaaaggctcagtctcaggagc

SEQ ID NO: 4175516 - DNA, 14 bp, Homo sapiens
gaaaggtggtgttt

SEQ ID NO: 4175517 - DNA, 16 bp, Homo sapiens
gaaaggtggtgtttct

SEQ ID NO: 4175518 - DNA, 12 bp, Homo sapiens
gaaagtaaaaaa

SEQ ID NO: 4175519 - DNA, 15 bp, Homo sapiens
gaaagtaaaagttat

SEQ ID NO: 4175520 - DNA, 22 bp, Homo sapiens
gaaagtcgaattaatagctttt

SEQ ID NO: 4175521 - DNA, 12 bp, Homo sapiens
gaaagtgcagaa

SEQ ID NO: 4175522 - DNA, 15 bp, Homo sapiens
gaaagtgcagaatca

SEQ ID NO: 4175523 - DNA, 15 bp, Homo sapiens
gaaagttcagccaga

SEQ ID NO: 4175524 - DNA, 17 bp, Homo sapiens
gaaataaaacctttcaa

SEQ ID NO: 4175525 - DNA, 18 bp, Homo sapiens
gaaataaaacctttcaaa

SEQ ID NO: 4175526 - DNA, 18 bp, Homo sapiens
gaaataaacctggagatg

SEQ ID NO: 4175527 - DNA, 15 bp, Homo sapiens
gaaatactaatgtaa

SEQ ID NO: 4175528 - DNA, 13 bp, Homo sapiens
gaaatcacttaaa

SEQ ID NO: 4175529 - DNA, 18 bp, Homo sapiens
gaaatgctgatggataac

SEQ ID NO: 4175530 - DNA, 13 bp, Homo sapiens
gaaatgtaataat

SEQ ID NO: 4175531 - DNA, 16 bp, Homo sapiens
gaaatgtaataataat

SEQ ID NO: 4175532 - DNA, 20 bp, Homo sapiens
gaaattcagcttttgcagaa

SEQ ID NO: 4175533 - DNA, 15 bp, Homo sapiens
gaaattcttttcaaa

SEQ ID NO: 4175534 - DNA, 21 bp, Homo sapiens
gaaattgtctagcagagcagg

SEQ ID NO: 4175535 - DNA, 14 bp, Homo sapiens
gaaattttatttag

SEQ ID NO: 4175536 - DNA, 20 bp, Homo sapiens
gaaattttctagactttctg

SEQ ID NO: 4175537 - DNA, 21 bp, Homo sapiens
gaacaaaagttcgaaagaaaa

SEQ ID NO: 4175538 - DNA, 14 bp, Homo sapiens
gaacaacaacaaca

SEQ ID NO: 4175539 - DNA, 18 bp, Homo sapiens
gaacaagaccctgtctca

SEQ ID NO: 4175540 - DNA, 20 bp, Homo sapiens
gaacacactcagcagccccc

SEQ ID NO: 4175541 - DNA, 20 bp, Homo sapiens
gaacaccaggactttaatct

SEQ ID NO: 4175542 - DNA, 21 bp, Homo sapiens
gaacaccaggactttaatctt

SEQ ID NO: 4175543 - DNA, 21 bp, Homo sapiens
gaacacctttgttttgcactg

SEQ ID NO: 4175544 - DNA, 20 bp, Homo sapiens
gaacactagacaagccagaa

SEQ ID NO: 4175545 - DNA, 14 bp, Homo sapiens
gaacagagagaacc

SEQ ID NO: 4175546 - DNA, 19 bp, Homo sapiens
gaacagagagaaccaggag

SEQ ID NO: 4175547 - DNA, 23 bp, Homo sapiens
gaacagccaaatgcatggtgcag

SEQ ID NO: 4175548 - DNA, 15 bp, Homo sapiens
gaacaggctggttct

SEQ ID NO: 4175549 - DNA, 23 bp, Homo sapiens
gaacagggaacattggagctgac

SEQ ID NO: 4175550 - DNA, 20 bp, Homo sapiens
gaacagggtccctggatcag

SEQ ID NO: 4175551 - DNA, 17 bp, Homo sapiens
gaacatccctgggcaag

SEQ ID NO: 4175552 - DNA, 19 bp, Homo sapiens
gaacatgcaattggggaag

SEQ ID NO: 4175553 - DNA, 19 bp, Homo sapiens
gaacattcgaggtgtcacc

SEQ ID NO: 4175554 - DNA, 23 bp, Homo sapiens
gaacattcgaggtgtcaccctgc

SEQ ID NO: 4175555 - DNA, 16 bp, Homo sapiens
gaacattggagctgac

SEQ ID NO: 4175556 - DNA, 17 bp, Homo sapiens
gaaccactgtggccttc

SEQ ID NO: 4175557 - DNA, 18 bp, Homo sapiens
gaaccagggagaccgagc

SEQ ID NO: 4175558 - DNA, 16 bp, Homo sapiens
gaaccattaaccagat

SEQ ID NO: 4175559 - DNA, 19 bp, Homo sapiens
gaacccagctctcagggct

SEQ ID NO: 4175560 - DNA, 10 bp, Homo sapiens
gaacccctgt

SEQ ID NO: 4175561 - DNA, 13 bp, Homo sapiens
gaacccctgtgtc

SEQ ID NO: 4175562 - DNA, 20 bp, Homo sapiens
gaacctaactccccacccca

SEQ ID NO: 4175563 - DNA, 19 bp, Homo sapiens
gaacctcaaactaggagga

SEQ ID NO: 4175564 - DNA, 21 bp, Homo sapiens
gaacctcaaactaggaggaaa

SEQ ID NO: 4175565 - DNA, 14 bp, Homo sapiens
gaacctcaggcttc

SEQ ID NO: 4175566 - DNA, 21 bp, Homo sapiens
gaaccttggtaaattgtaaac

SEQ ID NO: 4175567 - DNA, 22 bp, Homo sapiens
gaactacgcttgctcatttttt

SEQ ID NO: 4175568 - DNA, 15 bp, Homo sapiens
gaactattggagggt

SEQ ID NO: 4175569 - DNA, 11 bp, Homo sapiens
gaactcccagc

SEQ ID NO: 4175570 - DNA, 19 bp, Homo sapiens
gaactctggcttccaggta

SEQ ID NO: 4175571 - DNA, 18 bp, Homo sapiens
gaactgaattaagttatt

SEQ ID NO: 4175572 - DNA, 18 bp, Homo sapiens
gaactgaattttgggact

SEQ ID NO: 4175573 - DNA, 20 bp, Homo sapiens
gaaggaactctggcttccag

SEQ ID NO: 4175574 - DNA, 22 bp, Homo sapiens
gaaggaactctggcttccaggt

SEQ ID NO: 4175575 - DNA, 13 bp, Homo sapiens
gaaggaggtgagg

SEQ ID NO: 4175576 - DNA, 20 bp, Homo sapiens
gaaggatcctggaaccactg

SEQ ID NO: 4175577 - DNA, 14 bp, Homo sapiens
gaaggcagggagga

SEQ ID NO: 4175578 - DNA, 17 bp, Homo sapiens
gaaggcagggaggaggc

SEQ ID NO: 4175579 - DNA, 13 bp, Homo sapiens
gaaggctggctgg

SEQ ID NO: 4175580 - DNA, 20 bp, Homo sapiens
gaaggcttgttgtgctttta

SEQ ID NO: 4175581 - DNA, 23 bp, Homo sapiens
gaaggctttgccatgggcctgct

SEQ ID NO: 4175582 - DNA, 17 bp, Homo sapiens
gaagggaagcctcttca

SEQ ID NO: 4175583 - DNA, 22 bp, Homo sapiens
gaagggaataaggtacaagaag

SEQ ID NO: 4175584 - DNA, 21 bp, Homo sapiens
gaagggagaaggatctagaat

SEQ ID NO: 4175585 - DNA, 15 bp, Homo sapiens
gaagggtgcatagct

SEQ ID NO: 4175586 - DNA, 19 bp, Homo sapiens
gaagggtggtctgagcacc

SEQ ID NO: 4175587 - DNA, 20 bp, Homo sapiens
gaagggttttccaccctgga

SEQ ID NO: 4175588 - DNA, 18 bp, Homo sapiens
gaaggtatacctgggaag

SEQ ID NO: 4175589 - DNA, 20 bp, Homo sapiens
gaagtcattgtcgctcagca

SEQ ID NO: 4175590 - DNA, 23 bp, Homo sapiens
gaagtgaccaaattgggagataa

SEQ ID NO: 4175591 - DNA, 17 bp, Homo sapiens
gaagtgtgtggaaggca

SEQ ID NO: 4175592 - DNA, 13 bp, Homo sapiens
gaagttatctgtg

SEQ ID NO: 4175593 - DNA, 15 bp, Homo sapiens
gaagttttgtacaga

SEQ ID NO: 4175594 - DNA, 12 bp, Homo sapiens
gaataaacatca

SEQ ID NO: 4175595 - DNA, 14 bp, Homo sapiens
gaataaagcaggga

SEQ ID NO: 4175596 - DNA, 15 bp, Homo sapiens
gaataaatgttcaaa

SEQ ID NO: 4175597 - DNA, 23 bp, Homo sapiens
gaataaggtacaagaagcatttt

SEQ ID NO: 4175598 - DNA, 16 bp, Homo sapiens
gaatagataaattttg

SEQ ID NO: 4175599 - DNA, 16 bp, Homo sapiens
gaataggcaaaatgtt

SEQ ID NO: 4175600 - DNA, 13 bp, Homo sapiens
gaatagtgtctga

SEQ ID NO: 4175601 - DNA, 23 bp, Homo sapiens
gaatatggacttaaatgttaatg

SEQ ID NO: 4175602 - DNA, 20 bp, Homo sapiens
gaatcaagatgtcagactgg

SEQ ID NO: 4175603 - DNA, 21 bp, Homo sapiens
gaatcaagatgtcagactggc

SEQ ID NO: 4175604 - DNA, 14 bp, Homo sapiens
gaatcaataaaaat

SEQ ID NO: 4175605 - DNA, 16 bp, Homo sapiens
gaatcaggttgacagt

SEQ ID NO: 4175606 - DNA, 20 bp, Homo sapiens
gaatcattgtgcttaataat

SEQ ID NO: 4175607 - DNA, 21 bp, Homo sapiens
gaatcattgtgcttaataata

SEQ ID NO: 4175608 - DNA, 18 bp, Homo sapiens
gaatccctgcagcctggt

SEQ ID NO: 4175609 - DNA, 18 bp, Homo sapiens
gaatccgcctgcagagga

SEQ ID NO: 4175610 - DNA, 15 bp, Homo sapiens
gaatcgtttcaaatg

SEQ ID NO: 4175611 - DNA, 19 bp, Homo sapiens
gaatctgcagggagcaact

SEQ ID NO: 4175612 - DNA, 15 bp, Homo sapiens
gaatcttggtttgcc

SEQ ID NO: 4175613 - DNA, 21 bp, Homo sapiens
gaatgacctgcagtcagggcc

SEQ ID NO: 4175614 - DNA, 14 bp, Homo sapiens
gaatgatttttaga

SEQ ID NO: 4175615 - DNA, 14 bp, Homo sapiens
gaatgcatgtaagg

SEQ ID NO: 4175616 - DNA, 20 bp, Homo sapiens
gaatgcctcaatgtgaccag

SEQ ID NO: 4175617 - DNA, 22 bp, Homo sapiens
gaatgcctcaatgtgaccaggg

SEQ ID NO: 4175618 - DNA, 19 bp, Homo sapiens
gaatgccttccgggccggg

SEQ ID NO: 4175619 - DNA, 21 bp, Homo sapiens
gaatggcctgccttgaagcca

SEQ ID NO: 4175620 - DNA, 17 bp, Homo sapiens
gaatggctatgttttta

SEQ ID NO: 4175621 - DNA, 15 bp, Homo sapiens
gaatggtccagggtt

SEQ ID NO: 4175622 - DNA, 18 bp, Homo sapiens
gaatgtatgctaattgaa

SEQ ID NO: 4175623 - DNA, 18 bp, Homo sapiens
gaatgtgataaggaaatc

SEQ ID NO: 4175624 - DNA, 18 bp, Homo sapiens
gaatgtgtacaaagtgta

SEQ ID NO: 4175625 - DNA, 13 bp, Homo sapiens
gaatgtgtgtatg

SEQ ID NO: 4175626 - DNA, 15 bp, Homo sapiens
gaatgtttatgttct

SEQ ID NO: 4175627 - DNA, 17 bp, Homo sapiens
gaatgtttatgttctca

SEQ ID NO: 4175628 - DNA, 14 bp, Homo sapiens
gaattcacacctta

SEQ ID NO: 4175629 - DNA, 15 bp, Homo sapiens
gaattccaactcact

SEQ ID NO: 4175630 - DNA, 14 bp, Homo sapiens
gaattctagaaaat

SEQ ID NO: 4175631 - DNA, 16 bp, Homo sapiens
gaattctagaaaattt

SEQ ID NO: 4175632 - DNA, 15 bp, Homo sapiens
gaattgagtgtttaa

SEQ ID NO: 4175633 - DNA, 21 bp, Homo sapiens
gaattgcctgcagagagaagc

SEQ ID NO: 4175634 - DNA, 20 bp, Homo sapiens
gaattgtattttttgttgaa

SEQ ID NO: 4175635 - DNA, 19 bp, Homo sapiens
gaattgtccatgtgcttcc

SEQ ID NO: 4175636 - DNA, 18 bp, Homo sapiens
gaatttaatttatgtgaa

SEQ ID NO: 4175637 - DNA, 13 bp, Homo sapiens
gaatttctgattt

SEQ ID NO: 4175638 - DNA, 17 bp, Homo sapiens
gaatttctgatttcact

SEQ ID NO: 4175639 - DNA, 20 bp, Homo sapiens
gaatttcttcactgttgaaa

SEQ ID NO: 4175640 - DNA, 19 bp, Homo sapiens
gaatttggagactctgtgg

SEQ ID NO: 4175641 - DNA, 13 bp, Homo sapiens
gaatttgtatttt

SEQ ID NO: 4175642 - DNA, 17 bp, Homo sapiens
gaatttttaaacaagta

SEQ ID NO: 4175643 - DNA, 20 bp, Homo sapiens
gacaaagccaaactctgcca

SEQ ID NO: 4175644 - DNA, 13 bp, Homo sapiens
gacaactggcagg

SEQ ID NO: 4175645 - DNA, 16 bp, Homo sapiens
gacaactggcaggcag

SEQ ID NO: 4175646 - DNA, 17 bp, Homo sapiens
gacaactggcaggcagg

SEQ ID NO: 4175647 - DNA, 15 bp, Homo sapiens
gacaacttgtatctt

SEQ ID NO: 4175648 - DNA, 18 bp, Homo sapiens
gacaatgccttgggagag

SEQ ID NO: 4175649 - DNA, 15 bp, Homo sapiens
gacaattgtcttttt

SEQ ID NO: 4175650 - DNA, 19 bp, Homo sapiens
gacacaaacacacacaaaa

SEQ ID NO: 4175651 - DNA, 19 bp, Homo sapiens
gacacaaggtgatttcaga

SEQ ID NO: 4175652 - DNA, 20 bp, Homo sapiens
gacacacagtctcagtccag

SEQ ID NO: 4175653 - DNA, 21 bp, Homo sapiens
gacacacagtctcagtccaga

SEQ ID NO: 4175654 - DNA, 22 bp, Homo sapiens
gacacagaagtccctaggaggg

SEQ ID NO: 4175655 - DNA, 23 bp, Homo sapiens
gacacagatttcggtcataaaga

SEQ ID NO: 4175656 - DNA, 12 bp, Homo sapiens
gacacaggaaga

SEQ ID NO: 4175657 - DNA, 14 bp, Homo sapiens
gacacaggaagaat

SEQ ID NO: 4175658 - DNA, 15 bp, Homo sapiens
gacacccattttcac

SEQ ID NO: 4175659 - DNA, 18 bp, Homo sapiens
gacaccccttatccagga

SEQ ID NO: 4175660 - DNA, 10 bp, Homo sapiens
gacacctgcc

SEQ ID NO: 4175661 - DNA, 12 bp, Homo sapiens
gacacctgccct

SEQ ID NO: 4175662 - DNA, 15 bp, Homo sapiens
gacacctgccctgcc

SEQ ID NO: 4175663 - DNA, 23 bp, Homo sapiens
gacacctgccctgccctgccacc

SEQ ID NO: 4175664 - DNA, 19 bp, Homo sapiens
gacaccttttttcaacagt

SEQ ID NO: 4175665 - DNA, 23 bp, Homo sapiens
gacacgctcttctattttattcc

SEQ ID NO: 4175666 - DNA, 17 bp, Homo sapiens
gacactagttcagagga

SEQ ID NO: 4175667 - DNA, 21 bp, Homo sapiens
gacactagttcagaggaagca

SEQ ID NO: 4175668 - DNA, 21 bp, Homo sapiens
gacactctagtgacttcctgg

SEQ ID NO: 4175669 - DNA, 18 bp, Homo sapiens
gacactgtctgctgcccc

SEQ ID NO: 4175670 - DNA, 17 bp, Homo sapiens
ccaggattgaagagcat

SEQ ID NO: 4175671 - DNA, 14 bp, Homo sapiens
ccaggattggcctg

SEQ ID NO: 4175672 - DNA, 15 bp, Homo sapiens
ccaggcaaagctgga

SEQ ID NO: 4175673 - DNA, 17 bp, Homo sapiens
ccaggcaccaaaagaag

SEQ ID NO: 4175674 - DNA, 16 bp, Homo sapiens
ccaggcaggggtggga

SEQ ID NO: 4175675 - DNA, 18 bp, Homo sapiens
ccaggcaggggtgggaga

SEQ ID NO: 4175676 - DNA, 13 bp, Homo sapiens
ccaggcatgctgg

SEQ ID NO: 4175677 - DNA, 15 bp, Homo sapiens
ccaggccagtgggcc

SEQ ID NO: 4175678 - DNA, 21 bp, Homo sapiens
ccaggccctaggattcctccc

SEQ ID NO: 4175679 - DNA, 23 bp, Homo sapiens
ccaggcgggcggcacgccaacag

SEQ ID NO: 4175680 - DNA, 11 bp, Homo sapiens
ccagggcactg

SEQ ID NO: 4175681 - DNA, 14 bp, Homo sapiens
ccagggccagggcc

SEQ ID NO: 4175682 - DNA, 21 bp, Homo sapiens
ccagggcccaaagcccagctc

SEQ ID NO: 4175683 - DNA, 18 bp, Homo sapiens
ccagggctccctcctgga

SEQ ID NO: 4175684 - DNA, 19 bp, Homo sapiens
ccaggggcccacagggaac

SEQ ID NO: 4175685 - DNA, 22 bp, Homo sapiens
ccagggtctaaagagaacaaga

SEQ ID NO: 4175686 - DNA, 15 bp, Homo sapiens
ccagggtgagagctg

SEQ ID NO: 4175687 - DNA, 17 bp, Homo sapiens
ccagggtgagagctgct

SEQ ID NO: 4175688 - DNA, 23 bp, Homo sapiens
ccaggtaatgagggactggaacc

SEQ ID NO: 4175689 - DNA, 17 bp, Homo sapiens
ccaggtatctccaggat

SEQ ID NO: 4175690 - DNA, 12 bp, Homo sapiens
ccaggtcaccag

SEQ ID NO: 4175691 - DNA, 13 bp, Homo sapiens
ccaggtcaccagc

SEQ ID NO: 4175692 - DNA, 16 bp, Homo sapiens
ccaggtcaccagcctg

SEQ ID NO: 4175693 - DNA, 10 bp, Homo sapiens
ccaggtcctc

SEQ ID NO: 4175694 - DNA, 14 bp, Homo sapiens
ccaggtgcagtggc

SEQ ID NO: 4175695 - DNA, 19 bp, Homo sapiens
ccagtaagtgataaatcta

SEQ ID NO: 4175696 - DNA, 14 bp, Homo sapiens
ccagtattcttgtc

SEQ ID NO: 4175697 - DNA, 19 bp, Homo sapiens
ccagtcgtccgctcagcca

SEQ ID NO: 4175698 - DNA, 14 bp, Homo sapiens
ccagtctaaaaata

SEQ ID NO: 4175699 - DNA, 19 bp, Homo sapiens
ccagtctggaagaagagga

SEQ ID NO: 4175700 - DNA, 18 bp, Homo sapiens
ccagtgacctgctgggta

SEQ ID NO: 4175701 - DNA, 22 bp, Homo sapiens
ccagtgacctgctgggtaaact

SEQ ID NO: 4175702 - DNA, 14 bp, Homo sapiens
ccagtgagggctgg

SEQ ID NO: 4175703 - DNA, 15 bp, Homo sapiens
ccagtgagggctggg

SEQ ID NO: 4175704 - DNA, 14 bp, Homo sapiens
ccagtgccacagag

SEQ ID NO: 4175705 - DNA, 22 bp, Homo sapiens
ccagtgcccaaagtctgtgtga

SEQ ID NO: 4175706 - DNA, 17 bp, Homo sapiens
ccagtgctacctctctc

SEQ ID NO: 4175707 - DNA, 23 bp, Homo sapiens
ccagtgggaggtgagaccacctc

SEQ ID NO: 4175708 - DNA, 14 bp, Homo sapiens
ccagtgggcctggt

SEQ ID NO: 4175709 - DNA, 14 bp, Homo sapiens
ccagtgtagccttg

SEQ ID NO: 4175710 - DNA, 22 bp, Homo sapiens
ccagtgtgtgtttaacattcac

SEQ ID NO: 4175711 - DNA, 15 bp, Homo sapiens
ccagttggagttttt

SEQ ID NO: 4175712 - DNA, 16 bp, Homo sapiens
ccagttgttactgaag

SEQ ID NO: 4175713 - DNA, 21 bp, Homo sapiens
ccagtttcagaagcaggcagg

SEQ ID NO: 4175714 - DNA, 17 bp, Homo sapiens
ccataatcaatctatca

SEQ ID NO: 4175715 - DNA, 21 bp, Homo sapiens
ccataccgaccatcgtccagc

SEQ ID NO: 4175716 - DNA, 22 bp, Homo sapiens
ccataccgaccatcgtccagcc

SEQ ID NO: 4175717 - DNA, 14 bp, Homo sapiens
ccatcagggtgggc

SEQ ID NO: 4175718 - DNA, 16 bp, Homo sapiens
ccatccaccctgcagg

SEQ ID NO: 4175719 - DNA, 18 bp, Homo sapiens
ccatcccctttcctcccc

SEQ ID NO: 4175720 - DNA, 14 bp, Homo sapiens
ccatctagtcacaa

SEQ ID NO: 4175721 - DNA, 18 bp, Homo sapiens
ccatctcctcccatggcc

SEQ ID NO: 4175722 - DNA, 17 bp, Homo sapiens
ccatctcctttcaggga

SEQ ID NO: 4175723 - DNA, 20 bp, Homo sapiens
ccatctctctactcctacct

SEQ ID NO: 4175724 - DNA, 13 bp, Homo sapiens
ccatgatccagaa

SEQ ID NO: 4175725 - DNA, 14 bp, Homo sapiens
ccatgatgcctctg

SEQ ID NO: 4175726 - DNA, 20 bp, Homo sapiens
ccatgatgcctctgtcttct

SEQ ID NO: 4175727 - DNA, 15 bp, Homo sapiens
ccatgcacctcaggg

SEQ ID NO: 4175728 - DNA, 19 bp, Homo sapiens
ccatgcaggggtcagtgca

SEQ ID NO: 4175729 - DNA, 17 bp, Homo sapiens
ccatgccctccctgctg

SEQ ID NO: 4175730 - DNA, 16 bp, Homo sapiens
ccatgcctcaagaaca

SEQ ID NO: 4175731 - DNA, 13 bp, Homo sapiens
ccatgctgaaggg

SEQ ID NO: 4175732 - DNA, 21 bp, Homo sapiens
ccatgctggcggcgcagaggg

SEQ ID NO: 4175733 - DNA, 12 bp, Homo sapiens
ccatgctttcct

SEQ ID NO: 4175734 - DNA, 17 bp, Homo sapiens
ccatgctttccttttct

SEQ ID NO: 4175735 - DNA, 15 bp, Homo sapiens
ccatggccccaggcc

SEQ ID NO: 4175736 - DNA, 11 bp, Homo sapiens
ccatggctctg

SEQ ID NO: 4175737 - DNA, 15 bp, Homo sapiens
ccatgggatgttaag

SEQ ID NO: 4175738 - DNA, 15 bp, Homo sapiens
ccatgggcctgctgc

SEQ ID NO: 4175739 - DNA, 18 bp, Homo sapiens
ccatgtactcaagtacca

SEQ ID NO: 4175740 - DNA, 23 bp, Homo sapiens
ccatgtccaagtccaacctgcct

SEQ ID NO: 4175741 - DNA, 15 bp, Homo sapiens
ccatgtccaatggag

SEQ ID NO: 4175742 - DNA, 18 bp, Homo sapiens
ccatgttagtttttactt

SEQ ID NO: 4175743 - DNA, 20 bp, Homo sapiens
ccatgttggccaggatggtc

SEQ ID NO: 4175744 - DNA, 13 bp, Homo sapiens
ccatgtttgtaaa

SEQ ID NO: 4175745 - DNA, 14 bp, Homo sapiens
ccattaccatggag

SEQ ID NO: 4175746 - DNA, 13 bp, Homo sapiens
ccattatttaata

SEQ ID NO: 4175747 - DNA, 16 bp, Homo sapiens
ccattatttaataaga

SEQ ID NO: 4175748 - DNA, 21 bp, Homo sapiens
ccattccaagtcaacactctt

SEQ ID NO: 4175749 - DNA, 12 bp, Homo sapiens
attcacagccca

SEQ ID NO: 4175750 - DNA, 23 bp, Homo sapiens
attcacagcccagaaccacagat

SEQ ID NO: 4175751 - DNA, 19 bp, Homo sapiens
attcacccagaaaaaagac

SEQ ID NO: 4175752 - DNA, 14 bp, Homo sapiens
attcagaagaaaaa

SEQ ID NO: 4175753 - DNA, 20 bp, Homo sapiens
attcagacagatgaggcttt

SEQ ID NO: 4175754 - DNA, 16 bp, Homo sapiens
attcaggaagatgaaa

SEQ ID NO: 4175755 - DNA, 17 bp, Homo sapiens
attcagtgctgtggcct

SEQ ID NO: 4175756 - DNA, 20 bp, Homo sapiens
attcagtgctgtggcctggg

SEQ ID NO: 4175757 - DNA, 22 bp, Homo sapiens
attcagtgctgtggcctgggca

SEQ ID NO: 4175758 - DNA, 12 bp, Homo sapiens
attcataaatct

SEQ ID NO: 4175759 - DNA, 14 bp, Homo sapiens
attcatgctttctc

SEQ ID NO: 4175760 - DNA, 17 bp, Homo sapiens
attcatgctttctcctt

SEQ ID NO: 4175761 - DNA, 19 bp, Homo sapiens
attccaactcgtatagcat

SEQ ID NO: 4175762 - DNA, 21 bp, Homo sapiens
attccaagtcaacactcttct

SEQ ID NO: 4175763 - DNA, 22 bp, Homo sapiens
attccacagtgcccagctaatt

SEQ ID NO: 4175764 - DNA, 12 bp, Homo sapiens
attccactggac

SEQ ID NO: 4175765 - DNA, 18 bp, Homo sapiens
attccatgggatgttaag

SEQ ID NO: 4175766 - DNA, 14 bp, Homo sapiens
attccatgtccctg

SEQ ID NO: 4175767 - DNA, 17 bp, Homo sapiens
attcccaactgctctgc

SEQ ID NO: 4175768 - DNA, 20 bp, Homo sapiens
attcccaactgctctgccca

SEQ ID NO: 4175769 - DNA, 21 bp, Homo sapiens
attcccactaagctttctcct

SEQ ID NO: 4175770 - DNA, 23 bp, Homo sapiens
attcccactaagctttctccttt

SEQ ID NO: 4175771 - DNA, 15 bp, Homo sapiens
attcccatctgtcac

SEQ ID NO: 4175772 - DNA, 17 bp, Homo sapiens
attcccattggttctcc

SEQ ID NO: 4175773 - DNA, 17 bp, Homo sapiens
attccctagatctttct

SEQ ID NO: 4175774 - DNA, 14 bp, Homo sapiens
attcctgttctctt

SEQ ID NO: 4175775 - DNA, 17 bp, Homo sapiens
attccttaccccagctg

SEQ ID NO: 4175776 - DNA, 22 bp, Homo sapiens
attcgaggtgtcaccctgcaga

SEQ ID NO: 4175777 - DNA, 22 bp, Homo sapiens
attcgtagatattggacaaaga

SEQ ID NO: 4175778 - DNA, 20 bp, Homo sapiens
attctaaaatgattgtagta

SEQ ID NO: 4175779 - DNA, 14 bp, Homo sapiens
attctaaaatgcct

SEQ ID NO: 4175780 - DNA, 17 bp, Homo sapiens
attctaaagctttctga

SEQ ID NO: 4175781 - DNA, 14 bp, Homo sapiens
attctataagctat

SEQ ID NO: 4175782 - DNA, 21 bp, Homo sapiens
attctatatgatcctgaaaaa

SEQ ID NO: 4175783 - DNA, 21 bp, Homo sapiens
attctatgtatgttaatttat

SEQ ID NO: 4175784 - DNA, 20 bp, Homo sapiens
attctccagtttcagaagca

SEQ ID NO: 4175785 - DNA, 14 bp, Homo sapiens
attctcctgcctca

SEQ ID NO: 4175786 - DNA, 17 bp, Homo sapiens
attctcgggaaattatt

SEQ ID NO: 4175787 - DNA, 15 bp, Homo sapiens
attctgaatctgaaa

SEQ ID NO: 4175788 - DNA, 13 bp, Homo sapiens
attctgatacatt

SEQ ID NO: 4175789 - DNA, 17 bp, Homo sapiens
attctgcatgccctccc

SEQ ID NO: 4175790 - DNA, 15 bp, Homo sapiens
attctggacaggatg

SEQ ID NO: 4175791 - DNA, 22 bp, Homo sapiens
attctggatggatttgaagcaa

SEQ ID NO: 4175792 - DNA, 16 bp, Homo sapiens
attctggtcttcactg

SEQ ID NO: 4175793 - DNA, 20 bp, Homo sapiens
attcttctggtgctactcca

SEQ ID NO: 4175794 - DNA, 12 bp, Homo sapiens
attgaacctggt

SEQ ID NO: 4175795 - DNA, 16 bp, Homo sapiens
attgaagaaaagcact

SEQ ID NO: 4175796 - DNA, 19 bp, Homo sapiens
attgaataagtattcttca

SEQ ID NO: 4175797 - DNA, 21 bp, Homo sapiens
attgaatggctatgtttttaa

SEQ ID NO: 4175798 - DNA, 14 bp, Homo sapiens
attgacctataaaa

SEQ ID NO: 4175799 - DNA, 15 bp, Homo sapiens
attgacttctcttga

SEQ ID NO: 4175800 - DNA, 21 bp, Homo sapiens
attgaggcctgccctcaggga

SEQ ID NO: 4175801 - DNA, 23 bp, Homo sapiens
attgatagcaggtgtaataagac

SEQ ID NO: 4175802 - DNA, 23 bp, Homo sapiens
attgatgcactacacttttgatg

SEQ ID NO: 4175803 - DNA, 17 bp, Homo sapiens
attgcagtatggtgtgg

SEQ ID NO: 4175804 - DNA, 14 bp, Homo sapiens
attgctttgccaaa

SEQ ID NO: 4175805 - DNA, 14 bp, Homo sapiens
attggacttccttg

SEQ ID NO: 4175806 - DNA, 12 bp, Homo sapiens
attggagctgac

SEQ ID NO: 4175807 - DNA, 23 bp, Homo sapiens
attggagggtgggagagcccagc

SEQ ID NO: 4175808 - DNA, 22 bp, Homo sapiens
attggatacaaggatcagaatg

SEQ ID NO: 4175809 - DNA, 20 bp, Homo sapiens
attggcctgtgtctggcccc

SEQ ID NO: 4175810 - DNA, 21 bp, Homo sapiens
attggcttattttttaaaata

SEQ ID NO: 4175811 - DNA, 15 bp, Homo sapiens
attgggagggatgag

SEQ ID NO: 4175812 - DNA, 14 bp, Homo sapiens
attggggaagaaaa

SEQ ID NO: 4175813 - DNA, 18 bp, Homo sapiens
attggtattcactaatct

SEQ ID NO: 4175814 - DNA, 19 bp, Homo sapiens
attgtaaaatagcttgtat

SEQ ID NO: 4175815 - DNA, 17 bp, Homo sapiens
attgtaaaattgtatag

SEQ ID NO: 4175816 - DNA, 15 bp, Homo sapiens
attgtactaaagcca

SEQ ID NO: 4175817 - DNA, 21 bp, Homo sapiens
attgtactaaagccaaacata

SEQ ID NO: 4175818 - DNA, 22 bp, Homo sapiens
attgtactaaagccaaacatat

SEQ ID NO: 4175819 - DNA, 13 bp, Homo sapiens
attgtataaacta

SEQ ID NO: 4175820 - DNA, 21 bp, Homo sapiens
attgtataaactatcagtttg

SEQ ID NO: 4175821 - DNA, 22 bp, Homo sapiens
attgtataaactatcagtttgt

SEQ ID NO: 4175822 - DNA, 17 bp, Homo sapiens
attgtataatgtgattt

SEQ ID NO: 4175823 - DNA, 18 bp, Homo sapiens
attgtataatgtgatttt

SEQ ID NO: 4175824 - DNA, 14 bp, Homo sapiens
attgtatcctgagg

SEQ ID NO: 4175825 - DNA, 22 bp, Homo sapiens
attgtattttagcagggtacat

SEQ ID NO: 4175826 - DNA, 15 bp, Homo sapiens
attgtccatgtgctt

SEQ ID NO: 4175827 - DNA, 17 bp, Homo sapiens
attgtccatgtgcttcc

SEQ ID NO: 4175828 - DNA, 14 bp, Homo sapiens
attgtctgtctaca

SEQ ID NO: 4175829 - DNA, 17 bp, Homo sapiens
attgtgcaatgtaaata

SEQ ID NO: 4175830 - DNA, 16 bp, Homo sapiens
attgtgcttaataata

SEQ ID NO: 4175831 - DNA, 16 bp, Homo sapiens
attgttaccatgaaga

SEQ ID NO: 4175832 - DNA, 20 bp, Homo sapiens
attgttagagagtataactt

SEQ ID NO: 4175833 - DNA, 16 bp, Homo sapiens
attgttagtaaacata

SEQ ID NO: 4175834 - DNA, 19 bp, Homo sapiens
attgttagtaaacataggt

SEQ ID NO: 4175835 - DNA, 17 bp, Homo sapiens
attgttgacaactggtt

SEQ ID NO: 4175836 - DNA, 20 bp, Homo sapiens
attgttttatggtgtgttcc

SEQ ID NO: 4175837 - DNA, 10 bp, Homo sapiens
attgttttca

SEQ ID NO: 4175838 - DNA, 13 bp, Homo sapiens
atttaaaaaaaga

SEQ ID NO: 4175839 - DNA, 22 bp, Homo sapiens
atttaaaaaaagaaatttgatg

SEQ ID NO: 4175840 - DNA, 13 bp, Homo sapiens
atttaaaaaataa

SEQ ID NO: 4175841 - DNA, 18 bp, Homo sapiens
atttaaaatagcaaaaga

SEQ ID NO: 4175842 - DNA, 20 bp, Homo sapiens
atttaaaatagcaaaagaag

SEQ ID NO: 4175843 - DNA, 20 bp, Homo sapiens
atttaaaccgctaaaagaaa

SEQ ID NO: 4175844 - DNA, 21 bp, Homo sapiens
atttaaaccgctaaaagaaac

SEQ ID NO: 4175845 - DNA, 12 bp, Homo sapiens
atttaaactata

SEQ ID NO: 4175846 - DNA, 19 bp, Homo sapiens
atttaaactataagcaaga

SEQ ID NO: 4175847 - DNA, 20 bp, Homo sapiens
atttaaactataagcaagaa

SEQ ID NO: 4175848 - DNA, 15 bp, Homo sapiens
atttaacactaaaaa

SEQ ID NO: 4175849 - DNA, 16 bp, Homo sapiens
atttaataaaaaaaca

SEQ ID NO: 4175850 - DNA, 14 bp, Homo sapiens
atttaataaatgta

SEQ ID NO: 4175851 - DNA, 18 bp, Homo sapiens
atttaatagcaaagaatt

SEQ ID NO: 4175852 - DNA, 20 bp, Homo sapiens
atttaatagcaaagaattga

SEQ ID NO: 4175853 - DNA, 12 bp, Homo sapiens
atttaatttatg

SEQ ID NO: 4175854 - DNA, 18 bp, Homo sapiens
atttaccacagcagctga

SEQ ID NO: 4175855 - DNA, 21 bp, Homo sapiens
atttaccacagcagctgaaca

SEQ ID NO: 4175856 - DNA, 21 bp, Homo sapiens
atttaccctggtggaggcttc

SEQ ID NO: 4175857 - DNA, 15 bp, Homo sapiens
atttactaagccaca

SEQ ID NO: 4175858 - DNA, 13 bp, Homo sapiens
atttacttgaaag

SEQ ID NO: 4175859 - DNA, 14 bp, Homo sapiens
atttagaaaacttt

SEQ ID NO: 4175860 - DNA, 13 bp, Homo sapiens
atttaggcaagag

SEQ ID NO: 4175861 - DNA, 16 bp, Homo sapiens
atttagttatagtttc

SEQ ID NO: 4175862 - DNA, 15 bp, Homo sapiens
atttagttgtgcagt

SEQ ID NO: 4175863 - DNA, 13 bp, Homo sapiens
atttatactttgc

SEQ ID NO: 4175864 - DNA, 22 bp, Homo sapiens
atttatactttgcaatccaaat

SEQ ID NO: 4175865 - DNA, 15 bp, Homo sapiens
atttatagtttaata

SEQ ID NO: 4175866 - DNA, 16 bp, Homo sapiens
atttatagtttgtaca

SEQ ID NO: 4175867 - DNA, 22 bp, Homo sapiens
atttatagtttgtacatgcatt

SEQ ID NO: 4175868 - DNA, 16 bp, Homo sapiens
atttatatttgaaatt

SEQ ID NO: 4175869 - DNA, 18 bp, Homo sapiens
atttatgtaaaatcaata

SEQ ID NO: 4175870 - DNA, 22 bp, Homo sapiens
cgttgacccctttcccccaccc

SEQ ID NO: 4175871 - DNA, 13 bp, Homo sapiens
ctaaaatgacagc

SEQ ID NO: 4175872 - DNA, 18 bp, Homo sapiens
ctaaacacgtgacacaaa

SEQ ID NO: 4175873 - DNA, 23 bp, Homo sapiens
ctaaacatcattcatttttgttg

SEQ ID NO: 4175874 - DNA, 13 bp, Homo sapiens
ctaaagaaaaaca

SEQ ID NO: 4175875 - DNA, 13 bp, Homo sapiens
ctaaagagaacaa

SEQ ID NO: 4175876 - DNA, 11 bp, Homo sapiens
ctaaagccaaa

SEQ ID NO: 4175877 - DNA, 17 bp, Homo sapiens
ctaaagcccaacctcct

SEQ ID NO: 4175878 - DNA, 14 bp, Homo sapiens
ctaaagtttacagt

SEQ ID NO: 4175879 - DNA, 15 bp, Homo sapiens
ctaaataaaaaattc

SEQ ID NO: 4175880 - DNA, 13 bp, Homo sapiens
ctaaattgaatac

SEQ ID NO: 4175881 - DNA, 17 bp, Homo sapiens
ctaaattgaatacacaa

SEQ ID NO: 4175882 - DNA, 16 bp, Homo sapiens
ctaacagctgaagtaa

SEQ ID NO: 4175883 - DNA, 17 bp, Homo sapiens
ctaacagctgaagtaat

SEQ ID NO: 4175884 - DNA, 22 bp, Homo sapiens
ctaacccccagtgccacagaga

SEQ ID NO: 4175885 - DNA, 14 bp, Homo sapiens
ctaacctggcttat

SEQ ID NO: 4175886 - DNA, 16 bp, Homo sapiens
ctaagaaagacatcac

SEQ ID NO: 4175887 - DNA, 21 bp, Homo sapiens
ctaagagtctctatttcacaa

SEQ ID NO: 4175888 - DNA, 11 bp, Homo sapiens
ctaagcctgtt

SEQ ID NO: 4175889 - DNA, 16 bp, Homo sapiens
ctgggaacacagccag

SEQ ID NO: 4175890 - DNA, 17 bp, Homo sapiens
ctgggaacacagccagt

SEQ ID NO: 4175891 - DNA, 23 bp, Homo sapiens
ctgggaactggttcaagagacac

SEQ ID NO: 4175892 - DNA, 13 bp, Homo sapiens
ctgggaagggaag

SEQ ID NO: 4175893 - DNA, 15 bp, Homo sapiens
ctgggaatcctgctg

SEQ ID NO: 4175894 - DNA, 16 bp, Homo sapiens
ctgggaatcctgctgc

SEQ ID NO: 4175895 - DNA, 17 bp, Homo sapiens
ctgggaatcctgctgcc

SEQ ID NO: 4175896 - DNA, 21 bp, Homo sapiens
ctgggaatggaaggctttgcc

SEQ ID NO: 4175897 - DNA, 20 bp, Homo sapiens
ctgggagaaatctggcttct

SEQ ID NO: 4175898 - DNA, 14 bp, Homo sapiens
ctgggagaacctca

SEQ ID NO: 4175899 - DNA, 15 bp, Homo sapiens
ctgggagaacctcag

SEQ ID NO: 4175900 - DNA, 12 bp, Homo sapiens
ctgggagagcct

SEQ ID NO: 4175901 - DNA, 14 bp, Homo sapiens
ctgggagagcctgg

SEQ ID NO: 4175902 - DNA, 16 bp, Homo sapiens
ctgggagagcctggca

SEQ ID NO: 4175903 - DNA, 17 bp, Homo sapiens
ctgggagagcctggcaa

SEQ ID NO: 4175904 - DNA, 14 bp, Homo sapiens
ctgggaggaagcag

SEQ ID NO: 4175905 - DNA, 13 bp, Homo sapiens
ctgggagtcctgt

SEQ ID NO: 4175906 - DNA, 18 bp, Homo sapiens
ctgggattacagacatga

SEQ ID NO: 4175907 - DNA, 20 bp, Homo sapiens
ctgggattacaggcatgagc

SEQ ID NO: 4175908 - DNA, 17 bp, Homo sapiens
ctgggattcccaccaag

SEQ ID NO: 4175909 - DNA, 12 bp, Homo sapiens
ctgggcaagaac

SEQ ID NO: 4175910 - DNA, 21 bp, Homo sapiens
ctgggcaagtggatggcccag

SEQ ID NO: 4175911 - DNA, 18 bp, Homo sapiens
ctgggcaatgaaaccaaa

SEQ ID NO: 4175912 - DNA, 15 bp, Homo sapiens
ctgggcccacagagc

SEQ ID NO: 4175913 - DNA, 19 bp, Homo sapiens
ctgggcccacagagcctgg

SEQ ID NO: 4175914 - DNA, 20 bp, Homo sapiens
ctgggcccacagagcctggc

SEQ ID NO: 4175915 - DNA, 23 bp, Homo sapiens
ctgggcctggaccgcttcccaga

SEQ ID NO: 4175916 - DNA, 15 bp, Homo sapiens
ctgggcgacagagca

SEQ ID NO: 4175917 - DNA, 16 bp, Homo sapiens
ctgggcgacagagcaa

SEQ ID NO: 4175918 - DNA, 20 bp, Homo sapiens
ctgggctctagtttcctggt

SEQ ID NO: 4175919 - DNA, 14 bp, Homo sapiens
ctggggcaagtccc

SEQ ID NO: 4175920 - DNA, 21 bp, Homo sapiens
ctggggcaagtccctgactct

SEQ ID NO: 4175921 - DNA, 14 bp, Homo sapiens
ctggggctctgtgc

SEQ ID NO: 4175922 - DNA, 16 bp, Homo sapiens
ctggggctgccagcct

SEQ ID NO: 4175923 - DNA, 17 bp, Homo sapiens
ctggggctgccagcctg

SEQ ID NO: 4175924 - DNA, 23 bp, Homo sapiens
ctggggctgccagcctgagcgga

SEQ ID NO: 4175925 - DNA, 17 bp, Homo sapiens
ctggggttcccgaggga

SEQ ID NO: 4175926 - DNA, 21 bp, Homo sapiens
ctggggttcccgagggagctg

SEQ ID NO: 4175927 - DNA, 14 bp, Homo sapiens
ctgggtaagaagaa

SEQ ID NO: 4175928 - DNA, 17 bp, Homo sapiens
ctgggtaagaagaaagc

SEQ ID NO: 4175929 - DNA, 23 bp, Homo sapiens
ctgggtaagaagaaagcaaaagc

SEQ ID NO: 4175930 - DNA, 22 bp, Homo sapiens
ctgggtaggaaaattagaagca

SEQ ID NO: 4175931 - DNA, 23 bp, Homo sapiens
ctgggtaggaaaattagaagcaa

SEQ ID NO: 4175932 - DNA, 12 bp, Homo sapiens
ctgggtcccggg

SEQ ID NO: 4175933 - DNA, 15 bp, Homo sapiens
ctgggtccctcggag

SEQ ID NO: 4175934 - DNA, 22 bp, Homo sapiens
ctgggtttattacatggcagtg

SEQ ID NO: 4175935 - DNA, 15 bp, Homo sapiens
ctgggttttgtctct

SEQ ID NO: 4175936 - DNA, 21 bp, Homo sapiens
ctgggttttgtctctgcatct

SEQ ID NO: 4175937 - DNA, 17 bp, Homo sapiens
ctggtaatttgtatctg

SEQ ID NO: 4175938 - DNA, 14 bp, Homo sapiens
ctggtacagcaggg

SEQ ID NO: 4175939 - DNA, 18 bp, Homo sapiens
ctggtagaattgggaagc

SEQ ID NO: 4175940 - DNA, 18 bp, Homo sapiens
ctggtatccattataaac

SEQ ID NO: 4175941 - DNA, 22 bp, Homo sapiens
ctggtatgaacttgaggacaca

SEQ ID NO: 4175942 - DNA, 14 bp, Homo sapiens
ctggtcctgtgtgc

SEQ ID NO: 4175943 - DNA, 16 bp, Homo sapiens
ctggtcttcactgcca

SEQ ID NO: 4175944 - DNA, 17 bp, Homo sapiens
ctggtgaggcccagcct

SEQ ID NO: 4175945 - DNA, 15 bp, Homo sapiens
ctggtgatttctgag

SEQ ID NO: 4175946 - DNA, 23 bp, Homo sapiens
ctggtgctataggctggagaagc

SEQ ID NO: 4175947 - DNA, 22 bp, Homo sapiens
ctggtggaggcttcttgcccag

SEQ ID NO: 4175948 - DNA, 23 bp, Homo sapiens
ctggtggaggcttcttgcccaga

SEQ ID NO: 4175949 - DNA, 15 bp, Homo sapiens
ctggttaatggcagc

SEQ ID NO: 4175950 - DNA, 20 bp, Homo sapiens
ctggttcacactgaccaaga

SEQ ID NO: 4175951 - DNA, 17 bp, Homo sapiens
ctggttttcacattaga

SEQ ID NO: 4175952 - DNA, 22 bp, Homo sapiens
ctggttttctcttactgcagta

SEQ ID NO: 4175953 - DNA, 19 bp, Homo sapiens
ctgtaactcagacattcca

SEQ ID NO: 4175954 - DNA, 17 bp, Homo sapiens
ctgtaacttaattttgt

SEQ ID NO: 4175955 - DNA, 21 bp, Homo sapiens
ctgtaagaaacctactgccca

SEQ ID NO: 4175956 - DNA, 22 bp, Homo sapiens
ctgtaagaaacctactgcccag

SEQ ID NO: 4175957 - DNA, 20 bp, Homo sapiens
ctgtaagcattctgagctgg

SEQ ID NO: 4175958 - DNA, 21 bp, Homo sapiens
ctgtaattaagtaaaccaaaa

SEQ ID NO: 4175959 - DNA, 15 bp, Homo sapiens
ctgtacaaaaacaaa

SEQ ID NO: 4175960 - DNA, 12 bp, Homo sapiens
ctgtacaaatga

SEQ ID NO: 4175961 - DNA, 17 bp, Homo sapiens
ctgtacccaatttaatt

SEQ ID NO: 4175962 - DNA, 12 bp, Homo sapiens
ctgtagcacaaa

SEQ ID NO: 4175963 - DNA, 14 bp, Homo sapiens
ctgtaggttgctta

SEQ ID NO: 4175964 - DNA, 22 bp, Homo sapiens
ctgtaggttgcttaaaagggac

SEQ ID NO: 4175965 - DNA, 16 bp, Homo sapiens
ctgtaggtttgtagta

SEQ ID NO: 4175966 - DNA, 19 bp, Homo sapiens
ctgtagtaatttattgtct

SEQ ID NO: 4175967 - DNA, 19 bp, Homo sapiens
ctgtagtagccctttctgt

SEQ ID NO: 4175968 - DNA, 17 bp, Homo sapiens
ctgtagtcccagccact

SEQ ID NO: 4175969 - DNA, 14 bp, Homo sapiens
ctgtagttaggaaa

SEQ ID NO: 4175970 - DNA, 17 bp, Homo sapiens
ctgtagttaggaaataa

SEQ ID NO: 4175971 - DNA, 18 bp, Homo sapiens
ctgtagttaggaaataaa

SEQ ID NO: 4175972 - DNA, 21 bp, Homo sapiens
ctgtataattctacaggatgg

SEQ ID NO: 4175973 - DNA, 17 bp, Homo sapiens
ctgtataatttaacagt

SEQ ID NO: 4175974 - DNA, 20 bp, Homo sapiens
ctgtataatttaacagtgcc

SEQ ID NO: 4175975 - DNA, 16 bp, Homo sapiens
ctgtatagacagcact

SEQ ID NO: 4175976 - DNA, 16 bp, Homo sapiens
ctgtatagttaggata

SEQ ID NO: 4175977 - DNA, 21 bp, Homo sapiens
ctgtatagttaggatagcatt

SEQ ID NO: 4175978 - DNA, 16 bp, Homo sapiens
ctgtattcagacagat

SEQ ID NO: 4175979 - DNA, 17 bp, Homo sapiens
ctgtcaatttccctgac

SEQ ID NO: 4175980 - DNA, 19 bp, Homo sapiens
ctgtcaatttccctgactc

SEQ ID NO: 4175981 - DNA, 14 bp, Homo sapiens
ctgtcacactaaac

SEQ ID NO: 4175982 - DNA, 15 bp, Homo sapiens
ctgtcactggcagag

SEQ ID NO: 4175983 - DNA, 19 bp, Homo sapiens
ctgtcagagatctgggagg

SEQ ID NO: 4175984 - DNA, 21 bp, Homo sapiens
ctgtcagatgggaagacatga

SEQ ID NO: 4175985 - DNA, 14 bp, Homo sapiens
ctgtcatggtcctt

SEQ ID NO: 4175986 - DNA, 21 bp, Homo sapiens
ctgtcccggagctcaggccct

SEQ ID NO: 4175987 - DNA, 14 bp, Homo sapiens
ctgtccgcctctgc

SEQ ID NO: 4175988 - DNA, 20 bp, Homo sapiens
ctgtcctagcaggatctgcc

SEQ ID NO: 4175989 - DNA, 14 bp, Homo sapiens
ctgtcctcagagca

SEQ ID NO: 4175990 - DNA, 19 bp, Homo sapiens
ctgtcctcagagcaggggc

SEQ ID NO: 4175991 - DNA, 13 bp, Homo sapiens
ctgtcctgcctct

SEQ ID NO: 4175992 - DNA, 17 bp, Homo sapiens
ctgtcctggctcccagg

SEQ ID NO: 4175993 - DNA, 16 bp, Homo sapiens
ctgtcgcatctcagcg

SEQ ID NO: 4175994 - DNA, 13 bp, Homo sapiens
ctgtctacatttc

SEQ ID NO: 4175995 - DNA, 20 bp, Homo sapiens
ctgtctacatttctgcagat

SEQ ID NO: 4175996 - DNA, 20 bp, Homo sapiens
ctgtctacttgctcaggtac

SEQ ID NO: 4175997 - DNA, 15 bp, Homo sapiens
ctgtctctagccact

SEQ ID NO: 4175998 - DNA, 18 bp, Homo sapiens
ctgtctggttttaacaat

SEQ ID NO: 4175999 - DNA, 14 bp, Homo sapiens
ctgtctgtctgtcc

SEQ ID NO: 4176000 - DNA, 15 bp, Homo sapiens
ctgtctgtctgtccc

SEQ ID NO: 4176001 - DNA, 16 bp, Homo sapiens
ctgtcttccactgtac

SEQ ID NO: 4176002 - DNA, 23 bp, Homo sapiens
ctgtcttggtggatgggccctgc

SEQ ID NO: 4176003 - DNA, 21 bp, Homo sapiens
ctgtctttctggccctttctg

SEQ ID NO: 4176004 - DNA, 13 bp, Homo sapiens
ctgtgaaatacca

SEQ ID NO: 4176005 - DNA, 21 bp, Homo sapiens
ctgtgaacaccaggactttaa

SEQ ID NO: 4176006 - DNA, 16 bp, Homo sapiens
ctgtgaagcaaaaaga

SEQ ID NO: 4176007 - DNA, 13 bp, Homo sapiens
ctgtgacccatct

SEQ ID NO: 4176008 - DNA, 14 bp, Homo sapiens
ctgtgacccatctg

SEQ ID NO: 4176009 - DNA, 15 bp, Homo sapiens
ctgtgacccatctgt

SEQ ID NO: 4176010 - DNA, 20 bp, Homo sapiens
ctttgcaggcccagcagact

SEQ ID NO: 4176011 - DNA, 22 bp, Homo sapiens
ctttgccaaaataccagagcct

SEQ ID NO: 4176012 - DNA, 11 bp, Homo sapiens
ctttgccacaa

SEQ ID NO: 4176013 - DNA, 12 bp, Homo sapiens
ctttgcctctgc

SEQ ID NO: 4176014 - DNA, 19 bp, Homo sapiens
ctttgcctcttcagcagca

SEQ ID NO: 4176015 - DNA, 18 bp, Homo sapiens
ctttgccttgatgttgtg

SEQ ID NO: 4176016 - DNA, 13 bp, Homo sapiens
ctttgctgtctgg

SEQ ID NO: 4176017 - DNA, 16 bp, Homo sapiens
ctttggcaatttcctg

SEQ ID NO: 4176018 - DNA, 17 bp, Homo sapiens
ctttggcaatttcctgg

SEQ ID NO: 4176019 - DNA, 22 bp, Homo sapiens
ctttggcaatttcctggccctc

SEQ ID NO: 4176020 - DNA, 15 bp, Homo sapiens
ctttggccctcagtg

SEQ ID NO: 4176021 - DNA, 21 bp, Homo sapiens
ctttggggtcagccagggcca

SEQ ID NO: 4176022 - DNA, 17 bp, Homo sapiens
ctttggggttgcccagc

SEQ ID NO: 4176023 - DNA, 22 bp, Homo sapiens
ctttggtacatggccagtgtga

SEQ ID NO: 4176024 - DNA, 18 bp, Homo sapiens
ctttggtccccagcattg

SEQ ID NO: 4176025 - DNA, 16 bp, Homo sapiens
ctttggtgaaagggag

SEQ ID NO: 4176026 - DNA, 23 bp, Homo sapiens
ctttgtataatcccacccacctc

SEQ ID NO: 4176027 - DNA, 12 bp, Homo sapiens
ctttgtgccagc

SEQ ID NO: 4176028 - DNA, 19 bp, Homo sapiens
ctttgttaaaaatattttc

SEQ ID NO: 4176029 - DNA, 23 bp, Homo sapiens
ctttgtttcctccttgtcactga

SEQ ID NO: 4176030 - DNA, 14 bp, Homo sapiens
ctttgttttgcact

SEQ ID NO: 4176031 - DNA, 21 bp, Homo sapiens
cttttaaagttggagacagca

SEQ ID NO: 4176032 - DNA, 12 bp, Homo sapiens
cttttatagcta

SEQ ID NO: 4176033 - DNA, 18 bp, Homo sapiens
cttttatagctattactg

SEQ ID NO: 4176034 - DNA, 19 bp, Homo sapiens
cttttatagctattactgt

SEQ ID NO: 4176035 - DNA, 21 bp, Homo sapiens
cttttataggatttatttaaa

SEQ ID NO: 4176036 - DNA, 13 bp, Homo sapiens
cttttatcaaaca

SEQ ID NO: 4176037 - DNA, 20 bp, Homo sapiens
cttttcaaaagtcagaccct

SEQ ID NO: 4176038 - DNA, 23 bp, Homo sapiens
cttttcaaggaaaaatgctgctt

SEQ ID NO: 4176039 - DNA, 15 bp, Homo sapiens
cttttcacctcttta

SEQ ID NO: 4176040 - DNA, 14 bp, Homo sapiens
caaatcgaatgaaa

SEQ ID NO: 4176041 - DNA, 16 bp, Homo sapiens
caaatctaatgtaaga

SEQ ID NO: 4176042 - DNA, 22 bp, Homo sapiens
caaatgaatgttgtctgtttgt

SEQ ID NO: 4176043 - DNA, 22 bp, Homo sapiens
caaatgctggggtcatataaaa

SEQ ID NO: 4176044 - DNA, 17 bp, Homo sapiens
caaatggactatacata

SEQ ID NO: 4176045 - DNA, 16 bp, Homo sapiens
caaatggtttttgcaa

SEQ ID NO: 4176046 - DNA, 21 bp, Homo sapiens
caaatggtttttgcaagattt

SEQ ID NO: 4176047 - DNA, 20 bp, Homo sapiens
caaattatttgtgtaataga

SEQ ID NO: 4176048 - DNA, 14 bp, Homo sapiens
caacaaaaagacat

SEQ ID NO: 4176049 - DNA, 18 bp, Homo sapiens
caacaaaaagacatggaa

SEQ ID NO: 4176050 - DNA, 14 bp, Homo sapiens
caacaaaccaaaac

SEQ ID NO: 4176051 - DNA, 17 bp, Homo sapiens
caacaaagattgagaag

SEQ ID NO: 4176052 - DNA, 13 bp, Homo sapiens
caacaacaataac

SEQ ID NO: 4176053 - DNA, 14 bp, Homo sapiens
caacaacaataaca

SEQ ID NO: 4176054 - DNA, 13 bp, Homo sapiens
caacaagaacaac

SEQ ID NO: 4176055 - DNA, 14 bp, Homo sapiens
caacaagagtttat

SEQ ID NO: 4176056 - DNA, 15 bp, Homo sapiens
caacaataacaacaa

SEQ ID NO: 4176057 - DNA, 19 bp, Homo sapiens
caacaatacaacaagaaca

SEQ ID NO: 4176058 - DNA, 20 bp, Homo sapiens
caacaatacaacaagaacaa

SEQ ID NO: 4176059 - DNA, 21 bp, Homo sapiens
caacaatacaacaagaacaac

SEQ ID NO: 4176060 - DNA, 22 bp, Homo sapiens
caacaatggtttacatgaacac

SEQ ID NO: 4176061 - DNA, 12 bp, Homo sapiens
caacacaaagac

SEQ ID NO: 4176062 - DNA, 15 bp, Homo sapiens
caacacaaagacatg

SEQ ID NO: 4176063 - DNA, 18 bp, Homo sapiens
caacacaaagacatggaa

SEQ ID NO: 4176064 - DNA, 20 bp, Homo sapiens
caacacaagctggaagcaca

SEQ ID NO: 4176065 - DNA, 11 bp, Homo sapiens
caacacagagc

SEQ ID NO: 4176066 - DNA, 24 bp, Homo sapiens
caacacagagctggcgactgcagc

SEQ ID NO: 4176067 - DNA, 17 bp, Homo sapiens
caacagaagcttcagaa

SEQ ID NO: 4176068 - DNA, 19 bp, Homo sapiens
caacagagtgagaccctgt

SEQ ID NO: 4176069 - DNA, 17 bp, Homo sapiens
caacagataaagttttt

SEQ ID NO: 4176070 - DNA, 22 bp, Homo sapiens
caacaggtggcaggaccaggac

SEQ ID NO: 4176071 - DNA, 16 bp, Homo sapiens
caacagttacataatt

SEQ ID NO: 4176072 - DNA, 20 bp, Homo sapiens
caacagttttcctatgcttt

SEQ ID NO: 4176073 - DNA, 22 bp, Homo sapiens
caacagttttcctatgctttga

SEQ ID NO: 4176074 - DNA, 21 bp, Homo sapiens
caacatagtattcatgactat

SEQ ID NO: 4176075 - DNA, 20 bp, Homo sapiens
caacatgtagctgagtttaa

SEQ ID NO: 4176076 - DNA, 23 bp, Homo sapiens
caacatgttatttgtaatagatg

SEQ ID NO: 4176077 - DNA, 16 bp, Homo sapiens
caacattccagggttg

SEQ ID NO: 4176078 - DNA, 16 bp, Homo sapiens
caaccccccacctgcc

SEQ ID NO: 4176079 - DNA, 17 bp, Homo sapiens
caaccctgttttatact

SEQ ID NO: 4176080 - DNA, 17 bp, Homo sapiens
caacctcccctggtcct

SEQ ID NO: 4176081 - DNA, 15 bp, Homo sapiens
caacctcttcagctg

SEQ ID NO: 4176082 - DNA, 14 bp, Homo sapiens
caacctgcccctcc

SEQ ID NO: 4176083 - DNA, 16 bp, Homo sapiens
caacctgcctgtgcat

SEQ ID NO: 4176084 - DNA, 18 bp, Homo sapiens
caacctgcctgtgcatga

SEQ ID NO: 4176085 - DNA, 15 bp, Homo sapiens
caacctggccagagg

SEQ ID NO: 4176086 - DNA, 13 bp, Homo sapiens
caacgacaaagcc

SEQ ID NO: 4176087 - DNA, 19 bp, Homo sapiens
caactacccccagctgtgc

SEQ ID NO: 4176088 - DNA, 21 bp, Homo sapiens
caactattttcagatgtgaac

SEQ ID NO: 4176089 - DNA, 13 bp, Homo sapiens
caactatttttgt

SEQ ID NO: 4176090 - DNA, 13 bp, Homo sapiens
caactcagtctgt

SEQ ID NO: 4176091 - DNA, 11 bp, Homo sapiens
caactccagaa

SEQ ID NO: 4176092 - DNA, 19 bp, Homo sapiens
caactcgtatagcatgcat

SEQ ID NO: 4176093 - DNA, 13 bp, Homo sapiens
caactgctctgcc

SEQ ID NO: 4176094 - DNA, 14 bp, Homo sapiens
caactggcaggcag

SEQ ID NO: 4176095 - DNA, 19 bp, Homo sapiens
caacttggaaaaagaaaga

SEQ ID NO: 4176096 - DNA, 21 bp, Homo sapiens
caacttggaaaaagaaagaaa

SEQ ID NO: 4176097 - DNA, 17 bp, Homo sapiens
caacttggctttcccgg

SEQ ID NO: 4176098 - DNA, 16 bp, Homo sapiens
caacttgtatttccaa

SEQ ID NO: 4176099 - DNA, 15 bp, Homo sapiens
caactttctcactgc

SEQ ID NO: 4176100 - DNA, 13 bp, Homo sapiens
caagaaacagaag

SEQ ID NO: 4176101 - DNA, 14 bp, Homo sapiens
caagaaacagaagt

SEQ ID NO: 4176102 - DNA, 18 bp, Homo sapiens
caagaaataagtttttgt

SEQ ID NO: 4176103 - DNA, 13 bp, Homo sapiens
caagaaatttgat

SEQ ID NO: 4176104 - DNA, 22 bp, Homo sapiens
caagaagggttttccaccctgg

SEQ ID NO: 4176105 - DNA, 23 bp, Homo sapiens
caagaagggttttccaccctgga

SEQ ID NO: 4176106 - DNA, 19 bp, Homo sapiens
caagaattataacagcaag

SEQ ID NO: 4176107 - DNA, 22 bp, Homo sapiens
caagaattataacagcaaggaa

SEQ ID NO: 4176108 - DNA, 19 bp, Homo sapiens
caagacacaggctcagcat

SEQ ID NO: 4176109 - DNA, 19 bp, Homo sapiens
caagaccaagtcctcaaag

SEQ ID NO: 4176110 - DNA, 13 bp, Homo sapiens
caagagaaaataa

SEQ ID NO: 4176111 - DNA, 18 bp, Homo sapiens
caagagatcagcagtggc

SEQ ID NO: 4176112 - DNA, 13 bp, Homo sapiens
caagagcaaaatg

SEQ ID NO: 4176113 - DNA, 19 bp, Homo sapiens
caagagcccagcagggcct

SEQ ID NO: 4176114 - DNA, 17 bp, Homo sapiens
caagatcaacattccag

SEQ ID NO: 4176115 - DNA, 12 bp, Homo sapiens
caagatctttca

SEQ ID NO: 4176116 - DNA, 18 bp, Homo sapiens
caagcaatggacctttgg

SEQ ID NO: 4176117 - DNA, 10 bp, Homo sapiens
caagcagggg

SEQ ID NO: 4176118 - DNA, 12 bp, Homo sapiens
caagcaggggtc

SEQ ID NO: 4176119 - DNA, 22 bp, Homo sapiens
caagcaggggtcgtaccttgct

SEQ ID NO: 4176120 - DNA, 18 bp, Homo sapiens
caagcatcagtagctgag

SEQ ID NO: 4176121 - DNA, 21 bp, Homo sapiens
caagcatcagtagctgagtgc

SEQ ID NO: 4176122 - DNA, 17 bp, Homo sapiens
caagcatttgccctgtg

SEQ ID NO: 4176123 - DNA, 18 bp, Homo sapiens
caagccaacgacaaagcc

SEQ ID NO: 4176124 - DNA, 19 bp, Homo sapiens
caagccttactcacctctc

SEQ ID NO: 4176125 - DNA, 23 bp, Homo sapiens
caagctctctgttgcgctcccgc

SEQ ID NO: 4176126 - DNA, 18 bp, Homo sapiens
caagctggatgcagtggc

SEQ ID NO: 4176127 - DNA, 19 bp, Homo sapiens
caagctggatgcagtggct

SEQ ID NO: 4176128 - DNA, 23 bp, Homo sapiens
caagctggatgcagtggctcatg

SEQ ID NO: 4176129 - DNA, 23 bp, Homo sapiens
caaggacaacctgcccctcccca

SEQ ID NO: 4176130 - DNA, 18 bp, Homo sapiens
caaggataattaaatata

SEQ ID NO: 4176131 - DNA, 20 bp, Homo sapiens
caaggcattcctcatcacca

SEQ ID NO: 4176132 - DNA, 22 bp, Homo sapiens
caaggccttattggaaagcagt

SEQ ID NO: 4176133 - DNA, 13 bp, Homo sapiens
caagggaccttca

SEQ ID NO: 4176134 - DNA, 15 bp, Homo sapiens
caagggaccttcatg

SEQ ID NO: 4176135 - DNA, 20 bp, Homo sapiens
caagggccatgctgaaggga

SEQ ID NO: 4176136 - DNA, 19 bp, Homo sapiens
caagggtatgggaagccat

SEQ ID NO: 4176137 - DNA, 21 bp, Homo sapiens
caaggtgatttcagactgcag

SEQ ID NO: 4176138 - DNA, 14 bp, Homo sapiens
caaggtgctctgtg

SEQ ID NO: 4176139 - DNA, 17 bp, Homo sapiens
caaggtggccaaattat

SEQ ID NO: 4176140 - DNA, 16 bp, Homo sapiens
caaggtgggctgagcc

SEQ ID NO: 4176141 - DNA, 19 bp, Homo sapiens
caaggtgggctgagccctg

SEQ ID NO: 4176142 - DNA, 23 bp, Homo sapiens
caaggtgggctgagccctggcag

SEQ ID NO: 4176143 - DNA, 12 bp, Homo sapiens
caagtaatcact

SEQ ID NO: 4176144 - DNA, 13 bp, Homo sapiens
caagtagaatctc

SEQ ID NO: 4176145 - DNA, 13 bp, Homo sapiens
caagtagatcatg

SEQ ID NO: 4176146 - DNA, 20 bp, Homo sapiens
caagtagatcatggcagcat

SEQ ID NO: 4176147 - DNA, 23 bp, Homo sapiens
caagtagatcatggcagcatgaa

SEQ ID NO: 4176148 - DNA, 14 bp, Homo sapiens
caagtagggcacaa

SEQ ID NO: 4176149 - DNA, 20 bp, Homo sapiens
caagtattaggggtaatata

SEQ ID NO: 4176150 - DNA, 15 bp, Homo sapiens
agtaaataaattgtt

SEQ ID NO: 4176151 - DNA, 16 bp, Homo sapiens
agtaaataaattgttt

SEQ ID NO: 4176152 - DNA, 23 bp, Homo sapiens
agtaacaggaaaccacttatcac

SEQ ID NO: 4176153 - DNA, 17 bp, Homo sapiens
agtaagtgataaatcta

SEQ ID NO: 4176154 - DNA, 22 bp, Homo sapiens
agtaagttactacttacaggtg

SEQ ID NO: 4176155 - DNA, 17 bp, Homo sapiens
agtaattgtagatggaa

SEQ ID NO: 4176156 - DNA, 12 bp, Homo sapiens
agtaatttagaa

SEQ ID NO: 4176157 - DNA, 18 bp, Homo sapiens
agtaatttgtaaaaaaga

SEQ ID NO: 4176158 - DNA, 17 bp, Homo sapiens
agtactagaatttgtat

SEQ ID NO: 4176159 - DNA, 15 bp, Homo sapiens
agtactgggaaggag

SEQ ID NO: 4176160 - DNA, 14 bp, Homo sapiens
agtagaaagaaaat

SEQ ID NO: 4176161 - DNA, 22 bp, Homo sapiens
agtagaaagaaaatgtctgttt

SEQ ID NO: 4176162 - DNA, 14 bp, Homo sapiens
agtagaaaggccag

SEQ ID NO: 4176163 - DNA, 14 bp, Homo sapiens
agtagaatctcagt

SEQ ID NO: 4176164 - DNA, 17 bp, Homo sapiens
agtagatcatggcagca

SEQ ID NO: 4176165 - DNA, 17 bp, Homo sapiens
agtagatggtgaaattt

SEQ ID NO: 4176166 - DNA, 21 bp, Homo sapiens
agtagatggtgaaatttatta

SEQ ID NO: 4176167 - DNA, 16 bp, Homo sapiens
agtagcaagttctaga

SEQ ID NO: 4176168 - DNA, 20 bp, Homo sapiens
agtagcaagttctagagaag

SEQ ID NO: 4176169 - DNA, 22 bp, Homo sapiens
agtagcaagttctagagaagag

SEQ ID NO: 4176170 - DNA, 14 bp, Homo sapiens
agtagcagtgattg

SEQ ID NO: 4176171 - DNA, 14 bp, Homo sapiens
agtagcatgagaga

SEQ ID NO: 4176172 - DNA, 23 bp, Homo sapiens
agtagcatgagagaattgtatca

SEQ ID NO: 4176173 - DNA, 20 bp, Homo sapiens
agtagccctttctgtgtgca

SEQ ID NO: 4176174 - DNA, 21 bp, Homo sapiens
agtagccctttctgtgtgcac

SEQ ID NO: 4176175 - DNA, 18 bp, Homo sapiens
agtagctgagtgcactcc

SEQ ID NO: 4176176 - DNA, 24 bp, Homo sapiens
agtagctgagtgcactcctggtga

SEQ ID NO: 4176177 - DNA, 17 bp, Homo sapiens
agtaggaaatcaggcag

SEQ ID NO: 4176178 - DNA, 17 bp, Homo sapiens
agtaggattaatttatt

SEQ ID NO: 4176179 - DNA, 21 bp, Homo sapiens
agtagttaaaagtttttgtca

SEQ ID NO: 4176180 - DNA, 15 bp, Homo sapiens
agtagttttgaaact

SEQ ID NO: 4176181 - DNA, 14 bp, Homo sapiens
agtataatactaaa

SEQ ID NO: 4176182 - DNA, 14 bp, Homo sapiens
agtatattatgtat

SEQ ID NO: 4176183 - DNA, 22 bp, Homo sapiens
agtatctaactcttctggaaac

SEQ ID NO: 4176184 - DNA, 13 bp, Homo sapiens
agtatctctggcc

SEQ ID NO: 4176185 - DNA, 23 bp, Homo sapiens
agtatctcttgctgggaacacag

SEQ ID NO: 4176186 - DNA, 12 bp, Homo sapiens
agtatgtgtggg

SEQ ID NO: 4176187 - DNA, 16 bp, Homo sapiens
agtattctcagtgctc

SEQ ID NO: 4176188 - DNA, 15 bp, Homo sapiens
agtattcttgtcaaa

SEQ ID NO: 4176189 - DNA, 15 bp, Homo sapiens
agtatttacagatgt

SEQ ID NO: 4176190 - DNA, 13 bp, Homo sapiens
agtatttgttaat

SEQ ID NO: 4176191 - DNA, 14 bp, Homo sapiens
agtatttgttaatt

SEQ ID NO: 4176192 - DNA, 21 bp, Homo sapiens
agtatttttttaagttagaga

SEQ ID NO: 4176193 - DNA, 12 bp, Homo sapiens
agtcaatcaagt

SEQ ID NO: 4176194 - DNA, 24 bp, Homo sapiens
agtcaatcaagtctgtttactgca

SEQ ID NO: 4176195 - DNA, 13 bp, Homo sapiens
agtcacaaagact

SEQ ID NO: 4176196 - DNA, 15 bp, Homo sapiens
agtcacactcagaaa

SEQ ID NO: 4176197 - DNA, 20 bp, Homo sapiens
agtcacccatgaagacagga

SEQ ID NO: 4176198 - DNA, 18 bp, Homo sapiens
agtcagaccctaggaagc

SEQ ID NO: 4176199 - DNA, 23 bp, Homo sapiens
agtcagatgcccagagggcccag

SEQ ID NO: 4176200 - DNA, 14 bp, Homo sapiens
agtcaggaagagat

SEQ ID NO: 4176201 - DNA, 22 bp, Homo sapiens
agtcatagaaatacctcattcg

SEQ ID NO: 4176202 - DNA, 15 bp, Homo sapiens
agtcatattcttatg

SEQ ID NO: 4176203 - DNA, 15 bp, Homo sapiens
agtcatgggtcacac

SEQ ID NO: 4176204 - DNA, 16 bp, Homo sapiens
agtccaacctgcctgt

SEQ ID NO: 4176205 - DNA, 22 bp, Homo sapiens
agtccagatgccttcctgtctt

SEQ ID NO: 4176206 - DNA, 17 bp, Homo sapiens
agtccagtgacctgctg

SEQ ID NO: 4176207 - DNA, 21 bp, Homo sapiens
agtcctcacagcctctccctt

SEQ ID NO: 4176208 - DNA, 21 bp, Homo sapiens
agtcctcgtagccatctctct

SEQ ID NO: 4176209 - DNA, 21 bp, Homo sapiens
agtcctgggagaacctcaggc

SEQ ID NO: 4176210 - DNA, 22 bp, Homo sapiens
agtcctgggagaacctcaggct

SEQ ID NO: 4176211 - DNA, 13 bp, Homo sapiens
agtcctgtcagct

SEQ ID NO: 4176212 - DNA, 18 bp, Homo sapiens
agtccttattatcccagc

SEQ ID NO: 4176213 - DNA, 20 bp, Homo sapiens
agtcgttggcaccttcaata

SEQ ID NO: 4176214 - DNA, 12 bp, Homo sapiens
agtctaaagttt

SEQ ID NO: 4176215 - DNA, 18 bp, Homo sapiens
agtctaaagtttacagta

SEQ ID NO: 4176216 - DNA, 20 bp, Homo sapiens
agtctaaagtttacagtaaa

SEQ ID NO: 4176217 - DNA, 16 bp, Homo sapiens
agtctacctcttcagt

SEQ ID NO: 4176218 - DNA, 17 bp, Homo sapiens
agtctagtgaagatgtt

SEQ ID NO: 4176219 - DNA, 17 bp, Homo sapiens
agtctcaggagcatggg

SEQ ID NO: 4176220 - DNA, 15 bp, Homo sapiens
agtctcagtccagat

SEQ ID NO: 4176221 - DNA, 20 bp, Homo sapiens
agtctgaacctatttcttaa

SEQ ID NO: 4176222 - DNA, 20 bp, Homo sapiens
agtctgaggccccaggccct

SEQ ID NO: 4176223 - DNA, 16 bp, Homo sapiens
agtctgagtaaaatct

SEQ ID NO: 4176224 - DNA, 11 bp, Homo sapiens
agtctggaaga

SEQ ID NO: 4176225 - DNA, 14 bp, Homo sapiens
agtctggagaaggt

SEQ ID NO: 4176226 - DNA, 16 bp, Homo sapiens
agtctgtgggagctca

SEQ ID NO: 4176227 - DNA, 21 bp, Homo sapiens
agtctgtgtgatgaactttct

SEQ ID NO: 4176228 - DNA, 17 bp, Homo sapiens
agtctgtttactgcaag

SEQ ID NO: 4176229 - DNA, 20 bp, Homo sapiens
agtcttgctttgctgtctgg

SEQ ID NO: 4176230 - DNA, 20 bp, Homo sapiens
agtctttcttagtgcctgtg

SEQ ID NO: 4176231 - DNA, 22 bp, Homo sapiens
agtgaagaatacttctcatttt

SEQ ID NO: 4176232 - DNA, 17 bp, Homo sapiens
agtgagaccctgtctct

SEQ ID NO: 4176233 - DNA, 17 bp, Homo sapiens
agtgagcagatgggaca

SEQ ID NO: 4176234 - DNA, 12 bp, Homo sapiens
agtgagggctgg

SEQ ID NO: 4176235 - DNA, 15 bp, Homo sapiens
agtgagttttttagt

SEQ ID NO: 4176236 - DNA, 13 bp, Homo sapiens
agtgattttgtct

SEQ ID NO: 4176237 - DNA, 14 bp, Homo sapiens
agtgcagcagagga

SEQ ID NO: 4176238 - DNA, 16 bp, Homo sapiens
agtgcagcagaggaca

SEQ ID NO: 4176239 - DNA, 20 bp, Homo sapiens
agtgcatgaacagggtccct

SEQ ID NO: 4176240 - DNA, 11 bp, Homo sapiens
agtgccacaga

SEQ ID NO: 4176241 - DNA, 21 bp, Homo sapiens
agtgccacccacctttgccac

SEQ ID NO: 4176242 - DNA, 24 bp, Homo sapiens
agtgccaggactccccaggccagg

SEQ ID NO: 4176243 - DNA, 21 bp, Homo sapiens
agtgccctccacagccgcagc

SEQ ID NO: 4176244 - DNA, 14 bp, Homo sapiens
agtgcctagactgt

SEQ ID NO: 4176245 - DNA, 15 bp, Homo sapiens
agtgcctagactgtt

SEQ ID NO: 4176246 - DNA, 19 bp, Homo sapiens
agtgctgagattacaggtg

SEQ ID NO: 4176247 - DNA, 20 bp, Homo sapiens
agtgctgagattacaggtgt

SEQ ID NO: 4176248 - DNA, 14 bp, Homo sapiens
agtgctgattcagc

SEQ ID NO: 4176249 - DNA, 12 bp, Homo sapiens
agtgctgccctg

SEQ ID NO: 4176250 - DNA, 12 bp, Homo sapiens
agtgctggattt

SEQ ID NO: 4176251 - DNA, 20 bp, Homo sapiens
agtgctgggattacaggcat

SEQ ID NO: 4176252 - DNA, 22 bp, Homo sapiens
agtgctgggattacaggcatga

SEQ ID NO: 4176253 - DNA, 20 bp, Homo sapiens
agtgctgggattacaggtgt

SEQ ID NO: 4176254 - DNA, 14 bp, Homo sapiens
agtgctgtggcctg

SEQ ID NO: 4176255 - DNA, 21 bp, Homo sapiens
agtgcttcatttgggaaattc

SEQ ID NO: 4176256 - DNA, 20 bp, Homo sapiens
agtggaaaaatcagaagcac

SEQ ID NO: 4176257 - DNA, 16 bp, Homo sapiens
agtggagaattatata

SEQ ID NO: 4176258 - DNA, 13 bp, Homo sapiens
agtggagcttttg

SEQ ID NO: 4176259 - DNA, 12 bp, Homo sapiens
agtggatctcaa

SEQ ID NO: 4176260 - DNA, 14 bp, Homo sapiens
agtggatctccaag

SEQ ID NO: 4176261 - DNA, 22 bp, Homo sapiens
agtggcaggaccctgtcaggat

SEQ ID NO: 4176262 - DNA, 16 bp, Homo sapiens
agtggcttctccatcc

SEQ ID NO: 4176263 - DNA, 21 bp, Homo sapiens
agtggcttttttcctcctgtg

SEQ ID NO: 4176264 - DNA, 15 bp, Homo sapiens
agtgggacaaaccag

SEQ ID NO: 4176265 - DNA, 13 bp, Homo sapiens
agtggggctctgg

SEQ ID NO: 4176266 - DNA, 19 bp, Homo sapiens
agtggtaagctctggcttt

SEQ ID NO: 4176267 - DNA, 16 bp, Homo sapiens
agtggtgggcggggag

SEQ ID NO: 4176268 - DNA, 20 bp, Homo sapiens
agtgtagaacctaattcaat

SEQ ID NO: 4176269 - DNA, 15 bp, Homo sapiens
agtgtagccttgccc

SEQ ID NO: 4176270 - DNA, 13 bp, Homo sapiens
agtgtatgtgaat

SEQ ID NO: 4176271 - DNA, 20 bp, Homo sapiens
agtgtcaatccaatctgtaa

SEQ ID NO: 4176272 - DNA, 18 bp, Homo sapiens
agtgtccccagagacatg

SEQ ID NO: 4176273 - DNA, 21 bp, Homo sapiens
agtgtgagcagtgagttacag

SEQ ID NO: 4176274 - DNA, 22 bp, Homo sapiens
agtgtgatttttttcacattta

SEQ ID NO: 4176275 - DNA, 22 bp, Homo sapiens
agtgtggagaaggatagcctca

SEQ ID NO: 4176276 - DNA, 13 bp, Homo sapiens
agtgtgtgtgtct

SEQ ID NO: 4176277 - DNA, 17 bp, Homo sapiens
agtgttattatttggca

SEQ ID NO: 4176278 - DNA, 13 bp, Homo sapiens
agttaaattgatg

SEQ ID NO: 4176279 - DNA, 21 bp, Homo sapiens
agttaacattaacatctatta

SEQ ID NO: 4176280 - DNA, 14 bp, Homo sapiens
agttaactgtgaaa

SEQ ID NO: 4176281 - DNA, 15 bp, Homo sapiens
agttaagtatttaca

SEQ ID NO: 4176282 - DNA, 19 bp, Homo sapiens
agttaagtatttacagatg

SEQ ID NO: 4176283 - DNA, 22 bp, Homo sapiens
agttacagcgagaggcagagaa

SEQ ID NO: 4176284 - DNA, 16 bp, Homo sapiens
agttagctcaggaggc

SEQ ID NO: 4176285 - DNA, 15 bp, Homo sapiens
agttagctttaactt

SEQ ID NO: 4176286 - DNA, 20 bp, Homo sapiens
agttagctttaacttaaata

SEQ ID NO: 4176287 - DNA, 22 bp, Homo sapiens
agttagctttaacttaaatagt

SEQ ID NO: 4176288 - DNA, 13 bp, Homo sapiens
agttaggaaataa

SEQ ID NO: 4176289 - DNA, 14 bp, Homo sapiens
agttaggaaataaa

SEQ ID NO: 4176290 - DNA, 18 bp, Homo sapiens
agttaggaaataaaacct

SEQ ID NO: 4176291 - DNA, 20 bp, Homo sapiens
agttaggaaataaaaccttt

SEQ ID NO: 4176292 - DNA, 21 bp, Homo sapiens
agttaggaaataaaacctttc

SEQ ID NO: 4176293 - DNA, 23 bp, Homo sapiens
agttagttctctcgtaactggtt

SEQ ID NO: 4176294 - DNA, 12 bp, Homo sapiens
agttataaaaat

SEQ ID NO: 4176295 - DNA, 16 bp, Homo sapiens
agttataaaaatacaa

SEQ ID NO: 4176296 - DNA, 22 bp, Homo sapiens
agttattgatttttgtaataaa

SEQ ID NO: 4176297 - DNA, 22 bp, Homo sapiens
agttattgtacagctgtttaag

SEQ ID NO: 4176298 - DNA, 19 bp, Homo sapiens
agttattgttttatgttct

SEQ ID NO: 4176299 - DNA, 19 bp, Homo sapiens
agttatttacttgaaagat

SEQ ID NO: 4176300 - DNA, 21 bp, Homo sapiens
agttatttagaaatatccttt

SEQ ID NO: 4176301 - DNA, 13 bp, Homo sapiens
agttcaacatgtt

SEQ ID NO: 4176302 - DNA, 13 bp, Homo sapiens
agttcaagaaata

SEQ ID NO: 4176303 - DNA, 20 bp, Homo sapiens
agttcaccccttatcctgag

SEQ ID NO: 4176304 - DNA, 14 bp, Homo sapiens
agttcagaggaagc

SEQ ID NO: 4176305 - DNA, 15 bp, Homo sapiens
agttcagccagaatc

SEQ ID NO: 4176306 - DNA, 24 bp, Homo sapiens
agttcagttcctctttgcatggaa

SEQ ID NO: 4176307 - DNA, 16 bp, Homo sapiens
agttcatgtctgctat

SEQ ID NO: 4176308 - DNA, 18 bp, Homo sapiens
atggtgtgaaagtcagat

SEQ ID NO: 4176309 - DNA, 18 bp, Homo sapiens
atggttgtctgtttttgt

SEQ ID NO: 4176310 - DNA, 23 bp, Homo sapiens
atggtttacatgaacacagctgc

SEQ ID NO: 4176311 - DNA, 20 bp, Homo sapiens
atgtaaaacatttattttga

SEQ ID NO: 4176312 - DNA, 16 bp, Homo sapiens
atgtaaaatcaataaa

SEQ ID NO: 4176313 - DNA, 19 bp, Homo sapiens
atgtaaaatcaataaaagt

SEQ ID NO: 4176314 - DNA, 17 bp, Homo sapiens
atgtaaagtatgtaaac

SEQ ID NO: 4176315 - DNA, 21 bp, Homo sapiens
atgtaaatattttaaagaatt

SEQ ID NO: 4176316 - DNA, 22 bp, Homo sapiens
atgtaacccaaatgtccaatat

SEQ ID NO: 4176317 - DNA, 14 bp, Homo sapiens
atgtaactattgaa

SEQ ID NO: 4176318 - DNA, 17 bp, Homo sapiens
atgtaactattgaattg

SEQ ID NO: 4176319 - DNA, 22 bp, Homo sapiens
atgtaactctatagttattgtt

SEQ ID NO: 4176320 - DNA, 18 bp, Homo sapiens
atgtaaggtaatttctgt

SEQ ID NO: 4176321 - DNA, 23 bp, Homo sapiens
atgtaataataatgaatgtcatg

SEQ ID NO: 4176322 - DNA, 14 bp, Homo sapiens
atgtaatgtaaata

SEQ ID NO: 4176323 - DNA, 19 bp, Homo sapiens
atgtagatcaagtgtgcat

SEQ ID NO: 4176324 - DNA, 14 bp, Homo sapiens
atgtagctaaacat

SEQ ID NO: 4176325 - DNA, 17 bp, Homo sapiens
atgtagctaaacattgt

SEQ ID NO: 4176326 - DNA, 15 bp, Homo sapiens
atgtaggtgtctgca

SEQ ID NO: 4176327 - DNA, 12 bp, Homo sapiens
atgtatagtaaa

SEQ ID NO: 4176328 - DNA, 15 bp, Homo sapiens
atgtatagtaaatca

SEQ ID NO: 4176329 - DNA, 16 bp, Homo sapiens
atgtatagtaaatcac

SEQ ID NO: 4176330 - DNA, 20 bp, Homo sapiens
atgtatatgtcatttatttt

SEQ ID NO: 4176331 - DNA, 12 bp, Homo sapiens
atgtatgttaat

SEQ ID NO: 4176332 - DNA, 13 bp, Homo sapiens
atgtatgttaatt

SEQ ID NO: 4176333 - DNA, 19 bp, Homo sapiens
atgtcaaagtgtaacagat

SEQ ID NO: 4176334 - DNA, 16 bp, Homo sapiens
atgtcagactggctgg

SEQ ID NO: 4176335 - DNA, 16 bp, Homo sapiens
atgtcagagccaggct

SEQ ID NO: 4176336 - DNA, 12 bp, Homo sapiens
atgtcagccttg

SEQ ID NO: 4176337 - DNA, 14 bp, Homo sapiens
atgtcagccttgca

SEQ ID NO: 4176338 - DNA, 22 bp, Homo sapiens
atgtcatccccttgtgtcagag

SEQ ID NO: 4176339 - DNA, 23 bp, Homo sapiens
atgtccaagtccaacctgcctgt

SEQ ID NO: 4176340 - DNA, 21 bp, Homo sapiens
atgtccgatggtatctgggta

SEQ ID NO: 4176341 - DNA, 19 bp, Homo sapiens
atgtctatttgcacaagat

SEQ ID NO: 4176342 - DNA, 14 bp, Homo sapiens
atgtctgttttcca

SEQ ID NO: 4176343 - DNA, 12 bp, Homo sapiens
atgtgaaaatga

SEQ ID NO: 4176344 - DNA, 18 bp, Homo sapiens
atgtgaattgcctgcaga

SEQ ID NO: 4176345 - DNA, 12 bp, Homo sapiens
atgtgacagaca

SEQ ID NO: 4176346 - DNA, 20 bp, Homo sapiens
atgtgacccagatcctcaca

SEQ ID NO: 4176347 - DNA, 21 bp, Homo sapiens
atgtgagattactttgtcccg

SEQ ID NO: 4176348 - DNA, 18 bp, Homo sapiens
atgtgataaggaaatcaa

SEQ ID NO: 4176349 - DNA, 17 bp, Homo sapiens
atgtgatgttaactatt

SEQ ID NO: 4176350 - DNA, 18 bp, Homo sapiens
atgtgatgttaactatta

SEQ ID NO: 4176351 - DNA, 23 bp, Homo sapiens
atgtgattttgagcaaaccacat

SEQ ID NO: 4176352 - DNA, 18 bp, Homo sapiens
atgtgccccatgtccaag

SEQ ID NO: 4176353 - DNA, 21 bp, Homo sapiens
atgtgcttccctaggctgagc

SEQ ID NO: 4176354 - DNA, 19 bp, Homo sapiens
atgtggtttatagagggcc

SEQ ID NO: 4176355 - DNA, 21 bp, Homo sapiens
atgtgtctgggagagcctggc

SEQ ID NO: 4176356 - DNA, 11 bp, Homo sapiens
atgtgtgccat

SEQ ID NO: 4176357 - DNA, 18 bp, Homo sapiens
atgtgtgccatagagttt

SEQ ID NO: 4176358 - DNA, 20 bp, Homo sapiens
atgtgtgccatagagtttaa

SEQ ID NO: 4176359 - DNA, 22 bp, Homo sapiens
atgtgtgccatagagtttaaca

SEQ ID NO: 4176360 - DNA, 13 bp, Homo sapiens
atgtgtgtctcac

SEQ ID NO: 4176361 - DNA, 16 bp, Homo sapiens
atgtgtgtggtgtgtg

SEQ ID NO: 4176362 - DNA, 17 bp, Homo sapiens
atgtgtgtggtgtgtgt

SEQ ID NO: 4176363 - DNA, 20 bp, Homo sapiens
atgtgtgtggtgtgtgtgct

SEQ ID NO: 4176364 - DNA, 18 bp, Homo sapiens
atgtgtgtgtctgtgcgt

SEQ ID NO: 4176365 - DNA, 15 bp, Homo sapiens
atgttaaaaaaataa

SEQ ID NO: 4176366 - DNA, 16 bp, Homo sapiens
atgttaatttatttag

SEQ ID NO: 4176367 - DNA, 15 bp, Homo sapiens
atgttatacatccta

SEQ ID NO: 4176368 - DNA, 15 bp, Homo sapiens
atgttatttgtaata

SEQ ID NO: 4176369 - DNA, 20 bp, Homo sapiens
atgttcatgatagtgtgatt

SEQ ID NO: 4176370 - DNA, 21 bp, Homo sapiens
atgttcatgatagtgtgattt

SEQ ID NO: 4176371 - DNA, 15 bp, Homo sapiens
atgttgtcattatgt

SEQ ID NO: 4176372 - DNA, 19 bp, Homo sapiens
atgttgtgttgttatcatt

SEQ ID NO: 4176373 - DNA, 15 bp, Homo sapiens
atgtttattaagaat

SEQ ID NO: 4176374 - DNA, 14 bp, Homo sapiens
atgtttattccttg

SEQ ID NO: 4176375 - DNA, 17 bp, Homo sapiens
atgtttcacaaggtctt

SEQ ID NO: 4176376 - DNA, 18 bp, Homo sapiens
atgtttgggcagaaggga

SEQ ID NO: 4176377 - DNA, 14 bp, Homo sapiens
atgtttgtaaaact

SEQ ID NO: 4176378 - DNA, 21 bp, Homo sapiens
atgtttgtctgtgtgctgtaa

SEQ ID NO: 4176379 - DNA, 20 bp, Homo sapiens
atgttttccatttgggcaca

SEQ ID NO: 4176380 - DNA, 23 bp, Homo sapiens
atgttttggccaatgcacctaaa

SEQ ID NO: 4176381 - DNA, 19 bp, Homo sapiens
atgtttttaatgtatagta

SEQ ID NO: 4176382 - DNA, 21 bp, Homo sapiens
atgtttttgttttctttgaat

SEQ ID NO: 4176383 - DNA, 12 bp, Homo sapiens
attaaaaaccac

SEQ ID NO: 4176384 - DNA, 19 bp, Homo sapiens
attaaaaaggtttacagaa

SEQ ID NO: 4176385 - DNA, 21 bp, Homo sapiens
attaaaaatatggaacttcta

SEQ ID NO: 4176386 - DNA, 19 bp, Homo sapiens
attaaaatgattgtaaaat

SEQ ID NO: 4176387 - DNA, 20 bp, Homo sapiens
attaaaatgattgtaaaata

SEQ ID NO: 4176388 - DNA, 18 bp, Homo sapiens
attaaaatgtaggaagaa

SEQ ID NO: 4176389 - DNA, 13 bp, Homo sapiens
attaaagatgtgt

SEQ ID NO: 4176390 - DNA, 19 bp, Homo sapiens
attaaatgaaagaatatct

SEQ ID NO: 4176391 - DNA, 19 bp, Homo sapiens
attaacaattaggcagact

SEQ ID NO: 4176392 - DNA, 15 bp, Homo sapiens
attaacatatcttta

SEQ ID NO: 4176393 - DNA, 15 bp, Homo sapiens
attaactatgtgatg

SEQ ID NO: 4176394 - DNA, 19 bp, Homo sapiens
attaactgggtaatgaaac

SEQ ID NO: 4176395 - DNA, 19 bp, Homo sapiens
attaacttgtattttctta

SEQ ID NO: 4176396 - DNA, 21 bp, Homo sapiens
attaacttgtattttcttaat

SEQ ID NO: 4176397 - DNA, 20 bp, Homo sapiens
attaagattgaggcctgccc

SEQ ID NO: 4176398 - DNA, 20 bp, Homo sapiens
attaaggggatcagaagtag

SEQ ID NO: 4176399 - DNA, 18 bp, Homo sapiens
attaagtggctttttaac

SEQ ID NO: 4176400 - DNA, 23 bp, Homo sapiens
attaagtggggtagactgaggga

SEQ ID NO: 4176401 - DNA, 13 bp, Homo sapiens
attaatacaatat

SEQ ID NO: 4176402 - DNA, 15 bp, Homo sapiens
attaatacaatatta

SEQ ID NO: 4176403 - DNA, 18 bp, Homo sapiens
attaatagcttttattgt

SEQ ID NO: 4176404 - DNA, 23 bp, Homo sapiens
attaatcaatcatctgtgtgaaa

SEQ ID NO: 4176405 - DNA, 20 bp, Homo sapiens
attaatgtgtgtctgaagac

SEQ ID NO: 4176406 - DNA, 16 bp, Homo sapiens
attaatttatgcagaa

SEQ ID NO: 4176407 - DNA, 17 bp, Homo sapiens
attaatttatgcagaat

SEQ ID NO: 4176408 - DNA, 14 bp, Homo sapiens
attacaacctggaa

SEQ ID NO: 4176409 - DNA, 15 bp, Homo sapiens
attacacaagtttaa

SEQ ID NO: 4176410 - DNA, 18 bp, Homo sapiens
attaccaaaaatcttggg

SEQ ID NO: 4176411 - DNA, 13 bp, Homo sapiens
attacgtgagcca

SEQ ID NO: 4176412 - DNA, 14 bp, Homo sapiens
attacgtgagccag

SEQ ID NO: 4176413 - DNA, 20 bp, Homo sapiens
attacgtgagccaggtaatg

SEQ ID NO: 4176414 - DNA, 18 bp, Homo sapiens
attactgtctggttttaa

SEQ ID NO: 4176415 - DNA, 18 bp, Homo sapiens
attactgtttttgctatt

SEQ ID NO: 4176416 - DNA, 20 bp, Homo sapiens
attagaggtttgtcaacaca

SEQ ID NO: 4176417 - DNA, 15 bp, Homo sapiens
attagagtcagcctt

SEQ ID NO: 4176418 - DNA, 18 bp, Homo sapiens
attagcacatatttcaca

SEQ ID NO: 4176419 - DNA, 19 bp, Homo sapiens
attagctgggatatgtagt

SEQ ID NO: 4176420 - DNA, 14 bp, Homo sapiens
attagtaattgtaa

SEQ ID NO: 4176421 - DNA, 16 bp, Homo sapiens
attagtaattgtaagt

SEQ ID NO: 4176422 - DNA, 15 bp, Homo sapiens
attagtaattgtcaa

SEQ ID NO: 4176423 - DNA, 20 bp, Homo sapiens
attatactctctgaaatata

SEQ ID NO: 4176424 - DNA, 20 bp, Homo sapiens
attatagtatgatttttaca

SEQ ID NO: 4176425 - DNA, 23 bp, Homo sapiens
attatataggttgtgcaaattaa

SEQ ID NO: 4176426 - DNA, 14 bp, Homo sapiens
attatatattgttg

SEQ ID NO: 4176427 - DNA, 13 bp, Homo sapiens
attatatctgttt

SEQ ID NO: 4176428 - DNA, 18 bp, Homo sapiens
attatatttttgtaaata

SEQ ID NO: 4176429 - DNA, 20 bp, Homo sapiens
attatatttttgtaaatagt

SEQ ID NO: 4176430 - DNA, 20 bp, Homo sapiens
attatcagtcatgaggaaag

SEQ ID NO: 4176431 - DNA, 12 bp, Homo sapiens
attatctccctt

SEQ ID NO: 4176432 - DNA, 17 bp, Homo sapiens
attatgtctcaaaataa

SEQ ID NO: 4176433 - DNA, 23 bp, Homo sapiens
attatgtgttcaaggaccacatg

SEQ ID NO: 4176434 - DNA, 14 bp, Homo sapiens
attattcactagta

SEQ ID NO: 4176435 - DNA, 13 bp, Homo sapiens
caatcagagagcc

SEQ ID NO: 4176436 - DNA, 15 bp, Homo sapiens
caatcagagagccta

SEQ ID NO: 4176437 - DNA, 15 bp, Homo sapiens
caatcatgagtcaga

SEQ ID NO: 4176438 - DNA, 14 bp, Homo sapiens
caatcatgtgttta

SEQ ID NO: 4176439 - DNA, 21 bp, Homo sapiens
caatccaatctgtaatttcac

SEQ ID NO: 4176440 - DNA, 22 bp, Homo sapiens
caatccaatctgtaatttcact

SEQ ID NO: 4176441 - DNA, 22 bp, Homo sapiens
caatccatgttagtttttactt

SEQ ID NO: 4176442 - DNA, 21 bp, Homo sapiens
caatccttcttatgtttgctt

SEQ ID NO: 4176443 - DNA, 15 bp, Homo sapiens
caatcctttgagtta

SEQ ID NO: 4176444 - DNA, 14 bp, Homo sapiens
caatctaacaataa

SEQ ID NO: 4176445 - DNA, 17 bp, Homo sapiens
caatctaacaataatat

SEQ ID NO: 4176446 - DNA, 20 bp, Homo sapiens
caatctccagggctgcccct

SEQ ID NO: 4176447 - DNA, 22 bp, Homo sapiens
caatctgagcaaacaccagtga

SEQ ID NO: 4176448 - DNA, 19 bp, Homo sapiens
caatctggcttagtgccac

SEQ ID NO: 4176449 - DNA, 16 bp, Homo sapiens
caatcttccttcctta

SEQ ID NO: 4176450 - DNA, 13 bp, Homo sapiens
caatgaaaccaaa

SEQ ID NO: 4176451 - DNA, 15 bp, Homo sapiens
caatgactttttatt

SEQ ID NO: 4176452 - DNA, 19 bp, Homo sapiens
caatgatcctgtattcaga

SEQ ID NO: 4176453 - DNA, 18 bp, Homo sapiens
caatgcacctaaagaaaa

SEQ ID NO: 4176454 - DNA, 23 bp, Homo sapiens
caatgcacctaaagaaaaacaaa

SEQ ID NO: 4176455 - DNA, 20 bp, Homo sapiens
caatgcccgtaatgcttaga

SEQ ID NO: 4176456 - DNA, 18 bp, Homo sapiens
caatgcctagactgtgta

SEQ ID NO: 4176457 - DNA, 12 bp, Homo sapiens
caatgccttggg

SEQ ID NO: 4176458 - DNA, 17 bp, Homo sapiens
caatgccttgggagaga

SEQ ID NO: 4176459 - DNA, 11 bp, Homo sapiens
caatggagtct

SEQ ID NO: 4176460 - DNA, 17 bp, Homo sapiens
caatggagttcagagat

SEQ ID NO: 4176461 - DNA, 23 bp, Homo sapiens
caatggtaaaatgagtgatctca

SEQ ID NO: 4176462 - DNA, 17 bp, Homo sapiens
caatggtgttgccctga

SEQ ID NO: 4176463 - DNA, 14 bp, Homo sapiens
caatgtaaatattt

SEQ ID NO: 4176464 - DNA, 13 bp, Homo sapiens
caatgtggcaaga

SEQ ID NO: 4176465 - DNA, 16 bp, Homo sapiens
caattaaacagccaaa

SEQ ID NO: 4176466 - DNA, 20 bp, Homo sapiens
caattatatttttgtaaata

SEQ ID NO: 4176467 - DNA, 18 bp, Homo sapiens
caattcacccagaaaaaa

SEQ ID NO: 4176468 - DNA, 16 bp, Homo sapiens
caattcctgggcccca

SEQ ID NO: 4176469 - DNA, 21 bp, Homo sapiens
caattgacaacagttacataa

SEQ ID NO: 4176470 - DNA, 15 bp, Homo sapiens
caattggggaagaaa

SEQ ID NO: 4176471 - DNA, 19 bp, Homo sapiens
caattggggaagaaaaaat

SEQ ID NO: 4176472 - DNA, 14 bp, Homo sapiens
caatttattaaaat

SEQ ID NO: 4176473 - DNA, 22 bp, Homo sapiens
caatttattaaaatgattgtaa

SEQ ID NO: 4176474 - DNA, 13 bp, Homo sapiens
caatttcctggcc

SEQ ID NO: 4176475 - DNA, 14 bp, Homo sapiens
caatttcctggccc

SEQ ID NO: 4176476 - DNA, 15 bp, Homo sapiens
caatttcctttatat

SEQ ID NO: 4176477 - DNA, 19 bp, Homo sapiens
caatttcctttatatttag

SEQ ID NO: 4176478 - DNA, 20 bp, Homo sapiens
caatttcctttatatttagt

SEQ ID NO: 4176479 - DNA, 21 bp, Homo sapiens
caatttcctttatatttagtg

SEQ ID NO: 4176480 - DNA, 16 bp, Homo sapiens
caattttaaataagat

SEQ ID NO: 4176481 - DNA, 12 bp, Homo sapiens
cacaaaaatgaa

SEQ ID NO: 4176482 - DNA, 13 bp, Homo sapiens
cacaaaagccaaa

SEQ ID NO: 4176483 - DNA, 23 bp, Homo sapiens
cacaaacttaacatggaagatat

SEQ ID NO: 4176484 - DNA, 18 bp, Homo sapiens
cacaaagacatggaagat

SEQ ID NO: 4176485 - DNA, 20 bp, Homo sapiens
cacaagaaatttgatttcta

SEQ ID NO: 4176486 - DNA, 21 bp, Homo sapiens
cacaagccttactcacctctc

SEQ ID NO: 4176487 - DNA, 20 bp, Homo sapiens
cacaagtcctgtgaatttct

SEQ ID NO: 4176488 - DNA, 18 bp, Homo sapiens
cacaatggagtgggagat

SEQ ID NO: 4176489 - DNA, 22 bp, Homo sapiens
cacaatggagtgggagatcagc

SEQ ID NO: 4176490 - DNA, 13 bp, Homo sapiens
cacacatcaaaaa

SEQ ID NO: 4176491 - DNA, 16 bp, Homo sapiens
cacacatggacacaga

SEQ ID NO: 4176492 - DNA, 18 bp, Homo sapiens
cacacatggctaattttt

SEQ ID NO: 4176493 - DNA, 16 bp, Homo sapiens
cacaccaatcagagag

SEQ ID NO: 4176494 - DNA, 20 bp, Homo sapiens
cacaccccaaaactctacac

SEQ ID NO: 4176495 - DNA, 12 bp, Homo sapiens
cacaccttaggt

SEQ ID NO: 4176496 - DNA, 14 bp, Homo sapiens
cacacgcaggaact

SEQ ID NO: 4176497 - DNA, 19 bp, Homo sapiens
cacacgcaggaactcccag

SEQ ID NO: 4176498 - DNA, 22 bp, Homo sapiens
cacacgcaggaactcccagcaa

SEQ ID NO: 4176499 - DNA, 22 bp, Homo sapiens
cacactatcacctattacattt

SEQ ID NO: 4176500 - DNA, 16 bp, Homo sapiens
cacactccccgcctgt

SEQ ID NO: 4176501 - DNA, 19 bp, Homo sapiens
cacactccccgcctgtcct

SEQ ID NO: 4176502 - DNA, 13 bp, Homo sapiens
cacagagatgcat

SEQ ID NO: 4176503 - DNA, 14 bp, Homo sapiens
cacagagcctggct

SEQ ID NO: 4176504 - DNA, 12 bp, Homo sapiens
cacagaggcagt

SEQ ID NO: 4176505 - DNA, 16 bp, Homo sapiens
cacagaggcagtagga

SEQ ID NO: 4176506 - DNA, 11 bp, Homo sapiens
cacagcccaga

SEQ ID NO: 4176507 - DNA, 17 bp, Homo sapiens
cacagcccagaaccaca

SEQ ID NO: 4176508 - DNA, 21 bp, Homo sapiens
cacagccgcagcctccctctg

SEQ ID NO: 4176509 - DNA, 22 bp, Homo sapiens
cacagcctttgcttccaggtgg

SEQ ID NO: 4176510 - DNA, 16 bp, Homo sapiens
cacagcgcgggcggag

SEQ ID NO: 4176511 - DNA, 20 bp, Homo sapiens
cacagctaggcatgcctggg

SEQ ID NO: 4176512 - DNA, 15 bp, Homo sapiens
cacagctgctgaaga

SEQ ID NO: 4176513 - DNA, 23 bp, Homo sapiens
cacaggaagaatgggctgcagaa

SEQ ID NO: 4176514 - DNA, 20 bp, Homo sapiens
cacaggatcctattctcacc

SEQ ID NO: 4176515 - DNA, 14 bp, Homo sapiens
cacagggcagagcc

SEQ ID NO: 4176516 - DNA, 17 bp, Homo sapiens
cacagggcagagccggg

SEQ ID NO: 4176517 - DNA, 19 bp, Homo sapiens
cacagtatgttacatgcat

SEQ ID NO: 4176518 - DNA, 13 bp, Homo sapiens
cacagtcctcaca

SEQ ID NO: 4176519 - DNA, 20 bp, Homo sapiens
cacagtcctcacagcctctc

SEQ ID NO: 4176520 - DNA, 17 bp, Homo sapiens
cacagtctcagtccaga

SEQ ID NO: 4176521 - DNA, 17 bp, Homo sapiens
cacagttgtaccattca

SEQ ID NO: 4176522 - DNA, 13 bp, Homo sapiens
cacatatttcaca

SEQ ID NO: 4176523 - DNA, 14 bp, Homo sapiens
cacatctttcctgt

SEQ ID NO: 4176524 - DNA, 17 bp, Homo sapiens
cacatgacgtaaaattt

SEQ ID NO: 4176525 - DNA, 18 bp, Homo sapiens
cacatgcatcatcagcct

SEQ ID NO: 4176526 - DNA, 17 bp, Homo sapiens
cacatgtccttgtgtgt

SEQ ID NO: 4176527 - DNA, 19 bp, Homo sapiens
cacatgtctgtcctcagag

SEQ ID NO: 4176528 - DNA, 16 bp, Homo sapiens
cacatgtttattcatg

SEQ ID NO: 4176529 - DNA, 18 bp, Homo sapiens
cacattatgttagagagg

SEQ ID NO: 4176530 - DNA, 14 bp, Homo sapiens
cacattcaggaaga

SEQ ID NO: 4176531 - DNA, 17 bp, Homo sapiens
cacattcaggaagatga

SEQ ID NO: 4176532 - DNA, 14 bp, Homo sapiens
cacattggacttcc

SEQ ID NO: 4176533 - DNA, 18 bp, Homo sapiens
cacatttacctcgaggct

SEQ ID NO: 4176534 - DNA, 21 bp, Homo sapiens
cacatttacctcgaggctctt

SEQ ID NO: 4176535 - DNA, 21 bp, Homo sapiens
cacatttgaaagaaagtgtta

SEQ ID NO: 4176536 - DNA, 15 bp, Homo sapiens
caccaaggtcttcag

SEQ ID NO: 4176537 - DNA, 24 bp, Homo sapiens
caccaattggttaatctttcctga

SEQ ID NO: 4176538 - DNA, 15 bp, Homo sapiens
cagaaaagaaaacca

SEQ ID NO: 4176539 - DNA, 16 bp, Homo sapiens
cagaaaagaaaaccat

SEQ ID NO: 4176540 - DNA, 17 bp, Homo sapiens
cagaaaagggaagttgt

SEQ ID NO: 4176541 - DNA, 18 bp, Homo sapiens
cagaaaagggaagttgtg

SEQ ID NO: 4176542 - DNA, 19 bp, Homo sapiens
cagaaaatggggcttgccc

SEQ ID NO: 4176543 - DNA, 23 bp, Homo sapiens
cagaaagtggccatgccaccctg

SEQ ID NO: 4176544 - DNA, 23 bp, Homo sapiens
cagaaattagaaaccttaatatg

SEQ ID NO: 4176545 - DNA, 21 bp, Homo sapiens
cagaacaaggttccctctgag

SEQ ID NO: 4176546 - DNA, 18 bp, Homo sapiens
cagaacaattctgcagag

SEQ ID NO: 4176547 - DNA, 19 bp, Homo sapiens
cagaacattgccttcctcg

SEQ ID NO: 4176548 - DNA, 23 bp, Homo sapiens
cagaacattgccttcctcgtgca

SEQ ID NO: 4176549 - DNA, 13 bp, Homo sapiens
cagaaccacagat

SEQ ID NO: 4176550 - DNA, 21 bp, Homo sapiens
cagaactgaattaagttattg

SEQ ID NO: 4176551 - DNA, 20 bp, Homo sapiens
cagaactgaggtcactgggt

SEQ ID NO: 4176552 - DNA, 21 bp, Homo sapiens
cagaacttgaccctgagctga

SEQ ID NO: 4176553 - DNA, 21 bp, Homo sapiens
cagaagaccacaaaaattgac

SEQ ID NO: 4176554 - DNA, 13 bp, Homo sapiens
cagaagcaggcag

SEQ ID NO: 4176555 - DNA, 14 bp, Homo sapiens
cagaagcttcagaa

SEQ ID NO: 4176556 - DNA, 11 bp, Homo sapiens
cagaaggaagg

SEQ ID NO: 4176557 - DNA, 15 bp, Homo sapiens
cagaaggaaggcagg

SEQ ID NO: 4176558 - DNA, 22 bp, Homo sapiens
cagaaggaaggcagggaggagg

SEQ ID NO: 4176559 - DNA, 14 bp, Homo sapiens
cagaaggcctcact

SEQ ID NO: 4176560 - DNA, 16 bp, Homo sapiens
cagaagtaggaaggaa

SEQ ID NO: 4176561 - DNA, 19 bp, Homo sapiens
cagaagtccctaggaggga

SEQ ID NO: 4176562 - DNA, 22 bp, Homo sapiens
cagaagtttgcactatctttca

SEQ ID NO: 4176563 - DNA, 23 bp, Homo sapiens
cagaataccttcttcgctgctag

SEQ ID NO: 4176564 - DNA, 20 bp, Homo sapiens
cagaatcttcgtcctgcccc

SEQ ID NO: 4176565 - DNA, 12 bp, Homo sapiens
cagaatgctgtt

SEQ ID NO: 4176566 - DNA, 15 bp, Homo sapiens
cagaatggaaagaaa

SEQ ID NO: 4176567 - DNA, 22 bp, Homo sapiens
cagaattactgtaactgattac

SEQ ID NO: 4176568 - DNA, 21 bp, Homo sapiens
cagacaaagtaattcctctca

SEQ ID NO: 4176569 - DNA, 16 bp, Homo sapiens
cagacaagtaatcact

SEQ ID NO: 4176570 - DNA, 17 bp, Homo sapiens
cagacagatgaggcttt

SEQ ID NO: 4176571 - DNA, 23 bp, Homo sapiens
cagacatccatgtttgtaaaact

SEQ ID NO: 4176572 - DNA, 15 bp, Homo sapiens
cagacccacacatgt

SEQ ID NO: 4176573 - DNA, 13 bp, Homo sapiens
cagacccacctgg

SEQ ID NO: 4176574 - DNA, 19 bp, Homo sapiens
cagacccacctggagcccg

SEQ ID NO: 4176575 - DNA, 19 bp, Homo sapiens
cagactctttatgcttgca

SEQ ID NO: 4176576 - DNA, 23 bp, Homo sapiens
cagactgcagaggggaaagactt

SEQ ID NO: 4176577 - DNA, 15 bp, Homo sapiens
cagactgctgggact

SEQ ID NO: 4176578 - DNA, 16 bp, Homo sapiens
cagactggctggctgc

SEQ ID NO: 4176579 - DNA, 13 bp, Homo sapiens
cagacttctccag

SEQ ID NO: 4176580 - DNA, 14 bp, Homo sapiens
cagacttctccaga

SEQ ID NO: 4176581 - DNA, 14 bp, Homo sapiens
cagctctggcttcc

SEQ ID NO: 4176582 - DNA, 23 bp, Homo sapiens
cagctcttcactcagccacaccc

SEQ ID NO: 4176583 - DNA, 16 bp, Homo sapiens
cagctctttgttcagt

SEQ ID NO: 4176584 - DNA, 15 bp, Homo sapiens
cagctgaacagccaa

SEQ ID NO: 4176585 - DNA, 19 bp, Homo sapiens
cagctgcggcatccctgtg

SEQ ID NO: 4176586 - DNA, 13 bp, Homo sapiens
cagctgctgaaga

SEQ ID NO: 4176587 - DNA, 17 bp, Homo sapiens
cagctgctgaagaggca

SEQ ID NO: 4176588 - DNA, 14 bp, Homo sapiens
cagctggctctcca

SEQ ID NO: 4176589 - DNA, 18 bp, Homo sapiens
cagctgtagctcccgagc

SEQ ID NO: 4176590 - DNA, 14 bp, Homo sapiens
cagctgtcgcatct

SEQ ID NO: 4176591 - DNA, 11 bp, Homo sapiens
cagctgtgctt

SEQ ID NO: 4176592 - DNA, 14 bp, Homo sapiens
cagctgtttaagat

SEQ ID NO: 4176593 - DNA, 22 bp, Homo sapiens
cagctgtttccagttgttactg

SEQ ID NO: 4176594 - DNA, 15 bp, Homo sapiens
cagctgttttcaaag

SEQ ID NO: 4176595 - DNA, 16 bp, Homo sapiens
cagctgttttcaaagc

SEQ ID NO: 4176596 - DNA, 18 bp, Homo sapiens
cagctgttttcaaagccc

SEQ ID NO: 4176597 - DNA, 16 bp, Homo sapiens
cagcttccccaggagc

SEQ ID NO: 4176598 - DNA, 21 bp, Homo sapiens
cagcttccccaggagctctct

SEQ ID NO: 4176599 - DNA, 22 bp, Homo sapiens
cagcttccccaggagctctctg

SEQ ID NO: 4176600 - DNA, 15 bp, Homo sapiens
cagcttctccaggct

SEQ ID NO: 4176601 - DNA, 14 bp, Homo sapiens
cagcttgctgaggg

SEQ ID NO: 4176602 - DNA, 21 bp, Homo sapiens
cagcttgctgaggggcaggga

SEQ ID NO: 4176603 - DNA, 17 bp, Homo sapiens
caggaaaattgaatgca

SEQ ID NO: 4176604 - DNA, 20 bp, Homo sapiens
caggaaagacaggctgagct

SEQ ID NO: 4176605 - DNA, 22 bp, Homo sapiens
caggaacacccgactcctcaaa

SEQ ID NO: 4176606 - DNA, 14 bp, Homo sapiens
caggaactcccagc

SEQ ID NO: 4176607 - DNA, 14 bp, Homo sapiens
caggaactggctcc

SEQ ID NO: 4176608 - DNA, 19 bp, Homo sapiens
caggaaggatggcaagcac

SEQ ID NO: 4176609 - DNA, 22 bp, Homo sapiens
caggaaggcttgttgtgctttt

SEQ ID NO: 4176610 - DNA, 15 bp, Homo sapiens
caggaatcttaaggt

SEQ ID NO: 4176611 - DNA, 13 bp, Homo sapiens
caggacaggagac

SEQ ID NO: 4176612 - DNA, 20 bp, Homo sapiens
caggacagtgcttcagcctg

SEQ ID NO: 4176613 - DNA, 21 bp, Homo sapiens
caggacagtgcttcagcctga

SEQ ID NO: 4176614 - DNA, 14 bp, Homo sapiens
caggaccaggacta

SEQ ID NO: 4176615 - DNA, 13 bp, Homo sapiens
caggaccttttga

SEQ ID NO: 4176616 - DNA, 20 bp, Homo sapiens
caggaccttttgaagtagtt

SEQ ID NO: 4176617 - DNA, 15 bp, Homo sapiens
caggactccccaggc

SEQ ID NO: 4176618 - DNA, 19 bp, Homo sapiens
caggactccccaggccagg

SEQ ID NO: 4176619 - DNA, 13 bp, Homo sapiens
caggagaatcgct

SEQ ID NO: 4176620 - DNA, 14 bp, Homo sapiens
caggagctctctgc

SEQ ID NO: 4176621 - DNA, 15 bp, Homo sapiens
caggagctctctgct

SEQ ID NO: 4176622 - DNA, 22 bp, Homo sapiens
caggagctctctgctgagcagc

SEQ ID NO: 4176623 - DNA, 17 bp, Homo sapiens
caggaggcgaataaatg

SEQ ID NO: 4176624 - DNA, 18 bp, Homo sapiens
caggaggcgaataaatgt

SEQ ID NO: 4176625 - DNA, 19 bp, Homo sapiens
caggaggcgaataaatgtt

SEQ ID NO: 4176626 - DNA, 20 bp, Homo sapiens
caggaggcggaggttgcagt

SEQ ID NO: 4176627 - DNA, 13 bp, Homo sapiens
caggaggctgagg

SEQ ID NO: 4176628 - DNA, 22 bp, Homo sapiens
caggaggctgaggcaggagaat

SEQ ID NO: 4176629 - DNA, 15 bp, Homo sapiens
caggaggtcaagcct

SEQ ID NO: 4176630 - DNA, 22 bp, Homo sapiens
caggaggtcaagcctgcagcga

SEQ ID NO: 4176631 - DNA, 21 bp, Homo sapiens
caggagtttgaggctgcagcg

SEQ ID NO: 4176632 - DNA, 14 bp, Homo sapiens
caggatagagactg

SEQ ID NO: 4176633 - DNA, 15 bp, Homo sapiens
caggatgaccctgcg

SEQ ID NO: 4176634 - DNA, 14 bp, Homo sapiens
caggatggggacac

SEQ ID NO: 4176635 - DNA, 15 bp, Homo sapiens
caggatgtgtttgct

SEQ ID NO: 4176636 - DNA, 22 bp, Homo sapiens
caggattactactttgcctctt

SEQ ID NO: 4176637 - DNA, 13 bp, Homo sapiens
caggattgaagag

SEQ ID NO: 4176638 - DNA, 15 bp, Homo sapiens
caggcaccccctgga

SEQ ID NO: 4176639 - DNA, 21 bp, Homo sapiens
caggcaccccctggagagaag

SEQ ID NO: 4176640 - DNA, 19 bp, Homo sapiens
caggcactgtggcccttct

SEQ ID NO: 4176641 - DNA, 12 bp, Homo sapiens
caggcagcgatg

SEQ ID NO: 4176642 - DNA, 21 bp, Homo sapiens
caggcagcgatggtctcagaa

SEQ ID NO: 4176643 - DNA, 11 bp, Homo sapiens
caggcaggagg

SEQ ID NO: 4176644 - DNA, 12 bp, Homo sapiens
caggcaggagga

SEQ ID NO: 4176645 - DNA, 19 bp, Homo sapiens
caggccaagagcagaggca

SEQ ID NO: 4176646 - DNA, 23 bp, Homo sapiens
caggccaagagcagaggcagcga

SEQ ID NO: 4176647 - DNA, 14 bp, Homo sapiens
caggccaggccacc

SEQ ID NO: 4176648 - DNA, 16 bp, Homo sapiens
caggccaggccaccag

SEQ ID NO: 4176649 - DNA, 16 bp, Homo sapiens
caggccaggtgcagtg

SEQ ID NO: 4176650 - DNA, 22 bp, Homo sapiens
caggcccacagcgtgggaactc

SEQ ID NO: 4176651 - DNA, 15 bp, Homo sapiens
caggcccccaccact

SEQ ID NO: 4176652 - DNA, 16 bp, Homo sapiens
caggcctgcgtgccgg

SEQ ID NO: 4176653 - DNA, 14 bp, Homo sapiens
caggctcagactct

SEQ ID NO: 4176654 - DNA, 15 bp, Homo sapiens
caggctcagactctg

SEQ ID NO: 4176655 - DNA, 14 bp, Homo sapiens
caggctcagcatgc

SEQ ID NO: 4176656 - DNA, 18 bp, Homo sapiens
caggctcagcatgcagaa

SEQ ID NO: 4176657 - DNA, 14 bp, Homo sapiens
caggctcccaggga

SEQ ID NO: 4176658 - DNA, 19 bp, Homo sapiens
caggctcccagggacacct

SEQ ID NO: 4176659 - DNA, 23 bp, Homo sapiens
caggctcccagggacacctggga

SEQ ID NO: 4176660 - DNA, 22 bp, Homo sapiens
caggctctttggggtcagccag

SEQ ID NO: 4176661 - DNA, 23 bp, Homo sapiens
caggctgtaagcattctgagctg

SEQ ID NO: 4176662 - DNA, 23 bp, Homo sapiens
cagggaatccgcctgcagaggac

SEQ ID NO: 4176663 - DNA, 18 bp, Homo sapiens
cagggagagcgcctcttc

SEQ ID NO: 4176664 - DNA, 22 bp, Homo sapiens
cagggagagcgcctcttcctct

SEQ ID NO: 4176665 - DNA, 17 bp, Homo sapiens
cagggagcaactctcca

SEQ ID NO: 4176666 - DNA, 15 bp, Homo sapiens
cagtaaataaattgt

SEQ ID NO: 4176667 - DNA, 24 bp, Homo sapiens
cagtaaataaattgtttgaccatg

SEQ ID NO: 4176668 - DNA, 18 bp, Homo sapiens
cagtaggaaatcaggcag

SEQ ID NO: 4176669 - DNA, 17 bp, Homo sapiens
cagtaggaacccagctc

SEQ ID NO: 4176670 - DNA, 20 bp, Homo sapiens
cagtaggaacccagctctca

SEQ ID NO: 4176671 - DNA, 22 bp, Homo sapiens
cagtaggaacccagctctcagg

SEQ ID NO: 4176672 - DNA, 22 bp, Homo sapiens
cagtaggttatttagcttggga

SEQ ID NO: 4176673 - DNA, 14 bp, Homo sapiens
cagtatatttatag

SEQ ID NO: 4176674 - DNA, 22 bp, Homo sapiens
cagtatatttatagtcacaaga

SEQ ID NO: 4176675 - DNA, 13 bp, Homo sapiens
cagtattcttgtc

SEQ ID NO: 4176676 - DNA, 14 bp, Homo sapiens
cagtattttggaga

SEQ ID NO: 4176677 - DNA, 16 bp, Homo sapiens
cagtcaaggagatgag

SEQ ID NO: 4176678 - DNA, 15 bp, Homo sapiens
cagtcagggcccaga

SEQ ID NO: 4176679 - DNA, 21 bp, Homo sapiens
cagtcatgaggaaagacacag

SEQ ID NO: 4176680 - DNA, 17 bp, Homo sapiens
cagtccagatgccttcc

SEQ ID NO: 4176681 - DNA, 22 bp, Homo sapiens
cagtccagatgccttcctgtct

SEQ ID NO: 4176682 - DNA, 15 bp, Homo sapiens
cagtccccagctagc

SEQ ID NO: 4176683 - DNA, 19 bp, Homo sapiens
cagtcctcacagcctctcc

SEQ ID NO: 4176684 - DNA, 22 bp, Homo sapiens
cagtcctgggagaacctcaggc

SEQ ID NO: 4176685 - DNA, 19 bp, Homo sapiens
cagtctagtgaagatgttg

SEQ ID NO: 4176686 - DNA, 19 bp, Homo sapiens
cagtctcagtccagatgcc

SEQ ID NO: 4176687 - DNA, 18 bp, Homo sapiens
cagtctgtgggagctcag

SEQ ID NO: 4176688 - DNA, 13 bp, Homo sapiens
cagtcttgcctag

SEQ ID NO: 4176689 - DNA, 22 bp, Homo sapiens
cagtgaatttctgatttcactc

SEQ ID NO: 4176690 - DNA, 19 bp, Homo sapiens
cagtgacctgctgggtaaa

SEQ ID NO: 4176691 - DNA, 17 bp, Homo sapiens
cagtgagatgacattgc

SEQ ID NO: 4176692 - DNA, 23 bp, Homo sapiens
cagtgagccaagatcgcgccact

SEQ ID NO: 4176693 - DNA, 14 bp, Homo sapiens
cagtgagggctggg

SEQ ID NO: 4176694 - DNA, 18 bp, Homo sapiens
cagtgagggctgggccca

SEQ ID NO: 4176695 - DNA, 19 bp, Homo sapiens
cagtgagggctgggcccac

SEQ ID NO: 4176696 - DNA, 23 bp, Homo sapiens
cagtgagttacagcgagaggcag

SEQ ID NO: 4176697 - DNA, 23 bp, Homo sapiens
cagtgcaagagactctggcctcc

SEQ ID NO: 4176698 - DNA, 14 bp, Homo sapiens
cagtgcagcagagg

SEQ ID NO: 4176699 - DNA, 21 bp, Homo sapiens
cagtgctggatttgatgagtt

SEQ ID NO: 4176700 - DNA, 16 bp, Homo sapiens
cagtgctgtgctgtgc

SEQ ID NO: 4176701 - DNA, 19 bp, Homo sapiens
cagtgctgtgctgtgctat

SEQ ID NO: 4176702 - DNA, 22 bp, Homo sapiens
cagtgctgtgctgtgctatggt

SEQ ID NO: 4176703 - DNA, 17 bp, Homo sapiens
cagtgctgtggcctggg

SEQ ID NO: 4176704 - DNA, 19 bp, Homo sapiens
cagtgctgtggcctgggca

SEQ ID NO: 4176705 - DNA, 17 bp, Homo sapiens
cagtgcttcagcctgag

SEQ ID NO: 4176706 - DNA, 19 bp, Homo sapiens
cagtggaaaaatcagaagc

SEQ ID NO: 4176707 - DNA, 14 bp, Homo sapiens
cagtggagaattat

SEQ ID NO: 4176708 - DNA, 20 bp, Homo sapiens
cagtggcttctccatcctca

SEQ ID NO: 4176709 - DNA, 20 bp, Homo sapiens
cagtgggacaaaccagagca

SEQ ID NO: 4176710 - DNA, 22 bp, Homo sapiens
cagtgggaggtgagaccacctc

SEQ ID NO: 4176711 - DNA, 20 bp, Homo sapiens
cagtgggctccctggcccag

SEQ ID NO: 4176712 - DNA, 21 bp, Homo sapiens
cagtgggctccctggcccagc

SEQ ID NO: 4176713 - DNA, 17 bp, Homo sapiens
cagtggtgaagaaaact

SEQ ID NO: 4176714 - DNA, 13 bp, Homo sapiens
cagtggtgggcgg

SEQ ID NO: 4176715 - DNA, 18 bp, Homo sapiens
cagtgtgatcccaagtgc

SEQ ID NO: 4176716 - DNA, 23 bp, Homo sapiens
cagtgttaagtgtttgaaaacgt

SEQ ID NO: 4176717 - DNA, 19 bp, Homo sapiens
cagttaactttaagactga

SEQ ID NO: 4176718 - DNA, 15 bp, Homo sapiens
cagttacaaaaatag

SEQ ID NO: 4176719 - DNA, 14 bp, Homo sapiens
cagttccctgttga

SEQ ID NO: 4176720 - DNA, 15 bp, Homo sapiens
cagttcctctttgca

SEQ ID NO: 4176721 - DNA, 17 bp, Homo sapiens
cagttcctctttgcatg

SEQ ID NO: 4176722 - DNA, 23 bp, Homo sapiens
cagttcctctttgcatggaattt

SEQ ID NO: 4176723 - DNA, 20 bp, Homo sapiens
cagttgaatgacaacagaag

SEQ ID NO: 4176724 - DNA, 21 bp, Homo sapiens
cagttgaatgacaacagaagc

SEQ ID NO: 4176725 - DNA, 20 bp, Homo sapiens
cagttgacttactgtttctt

SEQ ID NO: 4176726 - DNA, 22 bp, Homo sapiens
cagttgaggaatatgactgttt

SEQ ID NO: 4176727 - DNA, 15 bp, Homo sapiens
cagttgagtgaaatt

SEQ ID NO: 4176728 - DNA, 17 bp, Homo sapiens
cagttgattctgaatct

SEQ ID NO: 4176729 - DNA, 16 bp, Homo sapiens
cagttgattttctgga

SEQ ID NO: 4176730 - DNA, 19 bp, Homo sapiens
cagttgccgtctaggattg

SEQ ID NO: 4176731 - DNA, 15 bp, Homo sapiens
cagttgttactgaag

SEQ ID NO: 4176732 - DNA, 19 bp, Homo sapiens
cagttgttactgaagttat

SEQ ID NO: 4176733 - DNA, 24 bp, Homo sapiens
cagtttagcccatctctccagaga

SEQ ID NO: 4176734 - DNA, 21 bp, Homo sapiens
cagtttagcccttccctgcct

SEQ ID NO: 4176735 - DNA, 22 bp, Homo sapiens
cagtttagcccttccctgcctt

SEQ ID NO: 4176736 - DNA, 19 bp, Homo sapiens
cagtttatatttaactctc

SEQ ID NO: 4176737 - DNA, 13 bp, Homo sapiens
cagtttcagaagc

SEQ ID NO: 4176738 - DNA, 20 bp, Homo sapiens
cagtttcagaagcaggcagg

SEQ ID NO: 4176739 - DNA, 17 bp, Homo sapiens
cataaaccaatgtggca

SEQ ID NO: 4176740 - DNA, 16 bp, Homo sapiens
cataaactgtacaaat

SEQ ID NO: 4176741 - DNA, 18 bp, Homo sapiens
cataaactttataaattc

SEQ ID NO: 4176742 - DNA, 20 bp, Homo sapiens
cataaatgttcagcttcaga

SEQ ID NO: 4176743 - DNA, 20 bp, Homo sapiens
catgtctgtcctcagagcag

SEQ ID NO: 4176744 - DNA, 19 bp, Homo sapiens
catgtgaggactgggggca

SEQ ID NO: 4176745 - DNA, 21 bp, Homo sapiens
catgtgcttccctaggctgag

SEQ ID NO: 4176746 - DNA, 15 bp, Homo sapiens
catgtggtttataga

SEQ ID NO: 4176747 - DNA, 16 bp, Homo sapiens
catgtgtgctgtgctg

SEQ ID NO: 4176748 - DNA, 22 bp, Homo sapiens
catgttatatattttttgtagg

SEQ ID NO: 4176749 - DNA, 13 bp, Homo sapiens
catgttcctcaaa

SEQ ID NO: 4176750 - DNA, 21 bp, Homo sapiens
catgttcctcaaaagcaccct

SEQ ID NO: 4176751 - DNA, 22 bp, Homo sapiens
catgttggtcaaaagctggatt

SEQ ID NO: 4176752 - DNA, 23 bp, Homo sapiens
catgttgtcttataaacaaatga

SEQ ID NO: 4176753 - DNA, 13 bp, Homo sapiens
catgtttatattt

SEQ ID NO: 4176754 - DNA, 20 bp, Homo sapiens
catgtttgtctgtgtgctgt

SEQ ID NO: 4176755 - DNA, 14 bp, Homo sapiens
cattaaactttttt

SEQ ID NO: 4176756 - DNA, 20 bp, Homo sapiens
cattaaattggaattttctt

SEQ ID NO: 4176757 - DNA, 15 bp, Homo sapiens
cattaagagtgaatg

SEQ ID NO: 4176758 - DNA, 20 bp, Homo sapiens
cattaatgaaaactttttca

SEQ ID NO: 4176759 - DNA, 15 bp, Homo sapiens
cattaatgttcttta

SEQ ID NO: 4176760 - DNA, 17 bp, Homo sapiens
cattacatggctgtggt

SEQ ID NO: 4176761 - DNA, 16 bp, Homo sapiens
cattacgtgagccagg

SEQ ID NO: 4176762 - DNA, 17 bp, Homo sapiens
cattacgtgagccaggt

SEQ ID NO: 4176763 - DNA, 15 bp, Homo sapiens
cattactataagaac

SEQ ID NO: 4176764 - DNA, 17 bp, Homo sapiens
cattagaaatagacagt

SEQ ID NO: 4176765 - DNA, 19 bp, Homo sapiens
cattagaagacaattgaca

SEQ ID NO: 4176766 - DNA, 16 bp, Homo sapiens
cattatttaataagag

SEQ ID NO: 4176767 - DNA, 10 bp, Homo sapiens
cattcacagc

SEQ ID NO: 4176768 - DNA, 11 bp, Homo sapiens
cattcacagcc

SEQ ID NO: 4176769 - DNA, 13 bp, Homo sapiens
cattcacagccca

SEQ ID NO: 4176770 - DNA, 15 bp, Homo sapiens
cattcacagcccaga

SEQ ID NO: 4176771 - DNA, 20 bp, Homo sapiens
cattcaggaccccaacccct

SEQ ID NO: 4176772 - DNA, 19 bp, Homo sapiens
cattcaggtgttctcttct

SEQ ID NO: 4176773 - DNA, 21 bp, Homo sapiens
cattcatgccaaagcaaaaga

SEQ ID NO: 4176774 - DNA, 22 bp, Homo sapiens
cattcatgccaaagcaaaagaa

SEQ ID NO: 4176775 - DNA, 20 bp, Homo sapiens
cattccaagtcaacactctt

SEQ ID NO: 4176776 - DNA, 23 bp, Homo sapiens
cattcctaggtcacttgaagcca

SEQ ID NO: 4176777 - DNA, 20 bp, Homo sapiens
cattcgaggtgtcaccctgc

SEQ ID NO: 4176778 - DNA, 17 bp, Homo sapiens
cattctacataatggaa

SEQ ID NO: 4176779 - DNA, 21 bp, Homo sapiens
cattgaaaaaaatatatgatt

SEQ ID NO: 4176780 - DNA, 13 bp, Homo sapiens
cattgccttcctc

SEQ ID NO: 4176781 - DNA, 18 bp, Homo sapiens
cattggacccacatgagg

SEQ ID NO: 4176782 - DNA, 16 bp, Homo sapiens
cattggacttccttgg

SEQ ID NO: 4176783 - DNA, 19 bp, Homo sapiens
cattggagctgactgttct

SEQ ID NO: 4176784 - DNA, 17 bp, Homo sapiens
cattgtactccagcctg

SEQ ID NO: 4176785 - DNA, 14 bp, Homo sapiens
cattgtctttttag

SEQ ID NO: 4176786 - DNA, 15 bp, Homo sapiens
cattgtgcttaataa

SEQ ID NO: 4176787 - DNA, 15 bp, Homo sapiens
catttacatcaaatc

SEQ ID NO: 4176788 - DNA, 14 bp, Homo sapiens
catttattttgaca

SEQ ID NO: 4176789 - DNA, 14 bp, Homo sapiens
catttcaactccag

SEQ ID NO: 4176790 - DNA, 17 bp, Homo sapiens
catttcaactccagaag

SEQ ID NO: 4176791 - DNA, 18 bp, Homo sapiens
catttctcagtggcttct

SEQ ID NO: 4176792 - DNA, 20 bp, Homo sapiens
catttctctaactcctgcca

SEQ ID NO: 4176793 - DNA, 21 bp, Homo sapiens
catttctctaactcctgccat

SEQ ID NO: 4176794 - DNA, 15 bp, Homo sapiens
catttgcaccctccg

SEQ ID NO: 4176795 - DNA, 16 bp, Homo sapiens
catttggacaaaatgg

SEQ ID NO: 4176796 - DNA, 22 bp, Homo sapiens
catttgtgttttgaaagcccaa

SEQ ID NO: 4176797 - DNA, 22 bp, Homo sapiens
cattttacttagctggagaact

SEQ ID NO: 4176798 - DNA, 14 bp, Homo sapiens
cattttattactgt

SEQ ID NO: 4176799 - DNA, 18 bp, Homo sapiens
cattttattactgtaata

SEQ ID NO: 4176800 - DNA, 12 bp, Homo sapiens
cattttcccaga

SEQ ID NO: 4176801 - DNA, 18 bp, Homo sapiens
catttttaccatcactga

SEQ ID NO: 4176802 - DNA, 19 bp, Homo sapiens
ccaaaaaaaaatacatgct

SEQ ID NO: 4176803 - DNA, 17 bp, Homo sapiens
ccaaaagttttcctgag

SEQ ID NO: 4176804 - DNA, 20 bp, Homo sapiens
ccaaaataccagagccttca

SEQ ID NO: 4176805 - DNA, 14 bp, Homo sapiens
ccaaacaccggcag

SEQ ID NO: 4176806 - DNA, 19 bp, Homo sapiens
ccaaactgtgccctgcctt

SEQ ID NO: 4176807 - DNA, 20 bp, Homo sapiens
ccaaactgtgccctgccttc

SEQ ID NO: 4176808 - DNA, 12 bp, Homo sapiens
ccaaactgttgg

SEQ ID NO: 4176809 - DNA, 18 bp, Homo sapiens
ccaaagagcctggagaag

SEQ ID NO: 4176810 - DNA, 19 bp, Homo sapiens
ggtcctttaggcagcctgc

SEQ ID NO: 4176811 - DNA, 21 bp, Homo sapiens
ggtcctttaggcagcctgccg

SEQ ID NO: 4176812 - DNA, 18 bp, Homo sapiens
ggtctgagcaccccctca

SEQ ID NO: 4176813 - DNA, 22 bp, Homo sapiens
ggtctgagcaccccctcattcc

SEQ ID NO: 4176814 - DNA, 21 bp, Homo sapiens
ggtcttcttgtgtcctgatga

SEQ ID NO: 4176815 - DNA, 19 bp, Homo sapiens
ggtctttcctatcatggag

SEQ ID NO: 4176816 - DNA, 23 bp, Homo sapiens
ggtgaaatttattagttaatata

SEQ ID NO: 4176817 - DNA, 21 bp, Homo sapiens
ggtgaacagagagaaccagga

SEQ ID NO: 4176818 - DNA, 16 bp, Homo sapiens
ggtgaagaaaactcct

SEQ ID NO: 4176819 - DNA, 21 bp, Homo sapiens
ggtgacggtcctttaggcagc

SEQ ID NO: 4176820 - DNA, 12 bp, Homo sapiens
ggtgagggatgt

SEQ ID NO: 4176821 - DNA, 19 bp, Homo sapiens
ggtgcagtatctcttgctg

SEQ ID NO: 4176822 - DNA, 18 bp, Homo sapiens
ggtgcagttgacagcagg

SEQ ID NO: 4176823 - DNA, 11 bp, Homo sapiens
ggtgccagagg

SEQ ID NO: 4176824 - DNA, 21 bp, Homo sapiens
ggtgcccacaaaatagagatt

SEQ ID NO: 4176825 - DNA, 19 bp, Homo sapiens
ggtgccccccatgccctcc

SEQ ID NO: 4176826 - DNA, 17 bp, Homo sapiens
ggtgcctcagagcaggc

SEQ ID NO: 4176827 - DNA, 10 bp, Homo sapiens
ggtgcctggc

SEQ ID NO: 4176828 - DNA, 21 bp, Homo sapiens
ggtgcctggcttgctgtggct

SEQ ID NO: 4176829 - DNA, 14 bp, Homo sapiens
ggtgctagctctta

SEQ ID NO: 4176830 - DNA, 21 bp, Homo sapiens
ggtgctataggctggagaagc

SEQ ID NO: 4176831 - DNA, 18 bp, Homo sapiens
ggtgctcacgactcttcc

SEQ ID NO: 4176832 - DNA, 22 bp, Homo sapiens
ggtgctctgtgtccgtctgtgt

SEQ ID NO: 4176833 - DNA, 21 bp, Homo sapiens
ggtgctttcaggtctggggct

SEQ ID NO: 4176834 - DNA, 14 bp, Homo sapiens
ggtggacagtcctg

SEQ ID NO: 4176835 - DNA, 17 bp, Homo sapiens
ggtggacagtcctggga

SEQ ID NO: 4176836 - DNA, 16 bp, Homo sapiens
ttcctttctaaatctg

SEQ ID NO: 4176837 - DNA, 16 bp, Homo sapiens
ttccttttcttccttc

SEQ ID NO: 4176838 - DNA, 17 bp, Homo sapiens
ttccttttgtgtacagt

SEQ ID NO: 4176839 - DNA, 22 bp, Homo sapiens
ttcctttttctagtttggcaca

SEQ ID NO: 4176840 - DNA, 15 bp, Homo sapiens
ttcgaggtgtcaccc

SEQ ID NO: 4176841 - DNA, 16 bp, Homo sapiens
ttcgaggtgtcaccct

SEQ ID NO: 4176842 - DNA, 15 bp, Homo sapiens
ttcggagcctgcctc

SEQ ID NO: 4176843 - DNA, 21 bp, Homo sapiens
ttcggccaatttatgcagagt

SEQ ID NO: 4176844 - DNA, 14 bp, Homo sapiens
ttctaaatcagaaa

SEQ ID NO: 4176845 - DNA, 17 bp, Homo sapiens
ttctagtgatttcctgt

SEQ ID NO: 4176846 - DNA, 20 bp, Homo sapiens
ttctagtgatttcctgtata

SEQ ID NO: 4176847 - DNA, 16 bp, Homo sapiens
ttctagtttggcacat

SEQ ID NO: 4176848 - DNA, 16 bp, Homo sapiens
ttctatagagcctggc

SEQ ID NO: 4176849 - DNA, 13 bp, Homo sapiens
ttctcaccaggaa

SEQ ID NO: 4176850 - DNA, 19 bp, Homo sapiens
ttctcagtcggtgtgtaat

SEQ ID NO: 4176851 - DNA, 17 bp, Homo sapiens
ttctcattttttaaaaa

SEQ ID NO: 4176852 - DNA, 15 bp, Homo sapiens
ttctccaagtctagc

SEQ ID NO: 4176853 - DNA, 14 bp, Homo sapiens
ttctccccctgggc

SEQ ID NO: 4176854 - DNA, 15 bp, Homo sapiens
ttctccctagaaaca

SEQ ID NO: 4176855 - DNA, 22 bp, Homo sapiens
ttctcctcccagcgtgtgtatc

SEQ ID NO: 4176856 - DNA, 17 bp, Homo sapiens
ttctctaactcctgcca

SEQ ID NO: 4176857 - DNA, 20 bp, Homo sapiens
ttctctacagacttctccag

SEQ ID NO: 4176858 - DNA, 14 bp, Homo sapiens
ttctctccttccct

SEQ ID NO: 4176859 - DNA, 14 bp, Homo sapiens
ttctctggacacac

SEQ ID NO: 4176860 - DNA, 14 bp, Homo sapiens
ttctctggctccag

SEQ ID NO: 4176861 - DNA, 18 bp, Homo sapiens
ttctgaaaatagcaggac

SEQ ID NO: 4176862 - DNA, 17 bp, Homo sapiens
ttctgaaacttcataaa

SEQ ID NO: 4176863 - DNA, 18 bp, Homo sapiens
ttctgaagtctactttgt

SEQ ID NO: 4176864 - DNA, 14 bp, Homo sapiens
ttctgaattattat

SEQ ID NO: 4176865 - DNA, 14 bp, Homo sapiens
ttctgatacattag

SEQ ID NO: 4176866 - DNA, 22 bp, Homo sapiens
ttctgatgggtcccaaaagctt

SEQ ID NO: 4176867 - DNA, 18 bp, Homo sapiens
ttctgcagagtggtgaag

SEQ ID NO: 4176868 - DNA, 14 bp, Homo sapiens
ttctgcagcaactc

SEQ ID NO: 4176869 - DNA, 17 bp, Homo sapiens
ttctgcagcaactccca

SEQ ID NO: 4176870 - DNA, 19 bp, Homo sapiens
ttctgcatgccctccccac

SEQ ID NO: 4176871 - DNA, 23 bp, Homo sapiens
ttctgcattttattctggatgga

SEQ ID NO: 4176872 - DNA, 15 bp, Homo sapiens
ttctgccttttttat

SEQ ID NO: 4176873 - DNA, 16 bp, Homo sapiens
ttctgggaggaagcag

SEQ ID NO: 4176874 - DNA, 22 bp, Homo sapiens
ttctggtatgaacttgaggaca

SEQ ID NO: 4176875 - DNA, 15 bp, Homo sapiens
ttctggtcttcactg

SEQ ID NO: 4176876 - DNA, 19 bp, Homo sapiens
ttctgtaaactcaaaactt

SEQ ID NO: 4176877 - DNA, 15 bp, Homo sapiens
ttctgtaagaaacct

SEQ ID NO: 4176878 - DNA, 11 bp, Homo sapiens
ttctgtatttt

SEQ ID NO: 4176879 - DNA, 12 bp, Homo sapiens
ttctgtattttc

SEQ ID NO: 4176880 - DNA, 17 bp, Homo sapiens
ttctgtccaccagaccc

SEQ ID NO: 4176881 - DNA, 15 bp, Homo sapiens
ttctgtgacccatct

SEQ ID NO: 4176882 - DNA, 13 bp, Homo sapiens
ttcttacagactg

SEQ ID NO: 4176883 - DNA, 23 bp, Homo sapiens
ttcttagactagttgaacatctc

SEQ ID NO: 4176884 - DNA, 22 bp, Homo sapiens
ttcttccttaattcactcccac

SEQ ID NO: 4176885 - DNA, 20 bp, Homo sapiens
ttcttccttctttctcttcc

SEQ ID NO: 4176886 - DNA, 18 bp, Homo sapiens
ttcttcgctgctagagaa

SEQ ID NO: 4176887 - DNA, 17 bp, Homo sapiens
ttcttctaaaattgaag

SEQ ID NO: 4176888 - DNA, 14 bp, Homo sapiens
ttcttctggtgcta

SEQ ID NO: 4176889 - DNA, 13 bp, Homo sapiens
ttcttcttcagaa

SEQ ID NO: 4176890 - DNA, 13 bp, Homo sapiens
ttcttgactctgt

SEQ ID NO: 4176891 - DNA, 19 bp, Homo sapiens
ttcttgcccttcataccct

SEQ ID NO: 4176892 - DNA, 19 bp, Homo sapiens
ttcttggtaactgattacc

SEQ ID NO: 4176893 - DNA, 13 bp, Homo sapiens
ttcttgtcaaaaa

SEQ ID NO: 4176894 - DNA, 17 bp, Homo sapiens
ttcttgtgtcctgatga

SEQ ID NO: 4176895 - DNA, 14 bp, Homo sapiens
ttctttactggtga

SEQ ID NO: 4176896 - DNA, 14 bp, Homo sapiens
ttctttataaactt

SEQ ID NO: 4176897 - DNA, 13 bp, Homo sapiens
ttctttctcttcc

SEQ ID NO: 4176898 - DNA, 11 bp, Homo sapiens
ttctttgaatg

SEQ ID NO: 4176899 - DNA, 22 bp, Homo sapiens
ttctttggtttcccaagagcta

SEQ ID NO: 4176900 - DNA, 18 bp, Homo sapiens
ttgaaaaaagttcaatgt

SEQ ID NO: 4176901 - DNA, 17 bp, Homo sapiens
ttgaaactagaagtcaa

SEQ ID NO: 4176902 - DNA, 18 bp, Homo sapiens
ttgaaactagaagtcaaa

SEQ ID NO: 4176903 - DNA, 12 bp, Homo sapiens
ttgaaagtaaaa

SEQ ID NO: 4176904 - DNA, 18 bp, Homo sapiens
ttgaaatatcctgcttga

SEQ ID NO: 4176905 - DNA, 23 bp, Homo sapiens
ttgaagccaaactgttggaagtt

SEQ ID NO: 4176906 - DNA, 13 bp, Homo sapiens
ttgaagccactga

SEQ ID NO: 4176907 - DNA, 23 bp, Homo sapiens
ttgaaggcccaggtcaacatcta

SEQ ID NO: 4176908 - DNA, 18 bp, Homo sapiens
ttgaagggtaaagaagtt

SEQ ID NO: 4176909 - DNA, 19 bp, Homo sapiens
ttgaagggtaaagaagttt

SEQ ID NO: 4176910 - DNA, 23 bp, Homo sapiens
ttgaagttagctttaacttaaat

SEQ ID NO: 4176911 - DNA, 19 bp, Homo sapiens
ttgaagttatttagaaata

SEQ ID NO: 4176912 - DNA, 14 bp, Homo sapiens
ttgaataagtattc

SEQ ID NO: 4176913 - DNA, 20 bp, Homo sapiens
ttgaatgacaacagaagctt

SEQ ID NO: 4176914 - DNA, 16 bp, Homo sapiens
ttgaatgcaaaccata

SEQ ID NO: 4176915 - DNA, 20 bp, Homo sapiens
ttgaatgctttttgaatgtt

SEQ ID NO: 4176916 - DNA, 23 bp, Homo sapiens
ttgaatgctttttgaatgttatt

SEQ ID NO: 4176917 - DNA, 15 bp, Homo sapiens
ttgaccactggccct

SEQ ID NO: 4176918 - DNA, 15 bp, Homo sapiens
ttgacccctttcccc

SEQ ID NO: 4176919 - DNA, 17 bp, Homo sapiens
ttgacccctttccccca

SEQ ID NO: 4176920 - DNA, 15 bp, Homo sapiens
ttgacttactgtttc

SEQ ID NO: 4176921 - DNA, 19 bp, Homo sapiens
ttgagaagttttgtacaga

SEQ ID NO: 4176922 - DNA, 16 bp, Homo sapiens
ttgagcactcagtcta

SEQ ID NO: 4176923 - DNA, 15 bp, Homo sapiens
ttgagcatcacagaa

SEQ ID NO: 4176924 - DNA, 15 bp, Homo sapiens
ttgaggacacatgtc

SEQ ID NO: 4176925 - DNA, 16 bp, Homo sapiens
ttgaggattttgagta

SEQ ID NO: 4176926 - DNA, 17 bp, Homo sapiens
ttgaggattttgagtat

SEQ ID NO: 4176927 - DNA, 19 bp, Homo sapiens
ttgaggcctgccctcaggg

SEQ ID NO: 4176928 - DNA, 14 bp, Homo sapiens
ttgaggctgcagcg

SEQ ID NO: 4176929 - DNA, 18 bp, Homo sapiens
ttgataaattccactgga

SEQ ID NO: 4176930 - DNA, 16 bp, Homo sapiens
ttgatacgtgtgtgaa

SEQ ID NO: 4176931 - DNA, 15 bp, Homo sapiens
ttgatactaagcatt

SEQ ID NO: 4176932 - DNA, 16 bp, Homo sapiens
ttgatactgcaataaa

SEQ ID NO: 4176933 - DNA, 20 bp, Homo sapiens
ttgatgagttaactgtgaaa

SEQ ID NO: 4176934 - DNA, 17 bp, Homo sapiens
ttgattgtaaaaacaaa

SEQ ID NO: 4176935 - DNA, 19 bp, Homo sapiens
tttgcaaactttattttca

SEQ ID NO: 4176936 - DNA, 17 bp, Homo sapiens
tttgcactgtatgctgg

SEQ ID NO: 4176937 - DNA, 19 bp, Homo sapiens
tttgccatgggcctgctgc

SEQ ID NO: 4176938 - DNA, 19 bp, Homo sapiens
tttgccttttgcaaacttt

SEQ ID NO: 4176939 - DNA, 18 bp, Homo sapiens
tttggaacaattatttta

SEQ ID NO: 4176940 - DNA, 23 bp, Homo sapiens
tttggaagagaggcacctgctgg

SEQ ID NO: 4176941 - DNA, 14 bp, Homo sapiens
tttggaagttttca

SEQ ID NO: 4176942 - DNA, 22 bp, Homo sapiens
tttggagaaattatttaataaa

SEQ ID NO: 4176943 - DNA, 19 bp, Homo sapiens
tttggcaatttcctggccc

SEQ ID NO: 4176944 - DNA, 18 bp, Homo sapiens
tttggcacatgcaggtag

SEQ ID NO: 4176945 - DNA, 20 bp, Homo sapiens
tttgggaggggatggcagac

SEQ ID NO: 4176946 - DNA, 18 bp, Homo sapiens
tttgggaggtccaggcag

SEQ ID NO: 4176947 - DNA, 22 bp, Homo sapiens
tttggggagggggaagagaaat

SEQ ID NO: 4176948 - DNA, 14 bp, Homo sapiens
tttggggctgcgaa

SEQ ID NO: 4176949 - DNA, 23 bp, Homo sapiens
tttggggttgcccagcctggagc

SEQ ID NO: 4176950 - DNA, 23 bp, Homo sapiens
tttggtcccgtgcagcttctgtc

SEQ ID NO: 4176951 - DNA, 19 bp, Homo sapiens
tttggtgtgtggagatgca

SEQ ID NO: 4176952 - DNA, 14 bp, Homo sapiens
tttgtaaggcagcc

SEQ ID NO: 4176953 - DNA, 19 bp, Homo sapiens
tttgtaggggtcaaagaaa

SEQ ID NO: 4176954 - DNA, 19 bp, Homo sapiens
tttgtataacttcttaaaa

SEQ ID NO: 4176955 - DNA, 13 bp, Homo sapiens
tttgtcaacaaaa

SEQ ID NO: 4176956 - DNA, 20 bp, Homo sapiens
tttgtcaacaaaaagacatg

SEQ ID NO: 4176957 - DNA, 21 bp, Homo sapiens
tttgtcatgaattcttatgct

SEQ ID NO: 4176958 - DNA, 16 bp, Homo sapiens
tttgtctgacaaactc

SEQ ID NO: 4176959 - DNA, 15 bp, Homo sapiens
tttgtgaactggaag

SEQ ID NO: 4176960 - DNA, 21 bp, Homo sapiens
tttgtgaactggaagaaagca

SEQ ID NO: 4176961 - DNA, 22 bp, Homo sapiens
tttgtggtaacttctttgaagt

SEQ ID NO: 4176962 - DNA, 22 bp, Homo sapiens
tttgttaatttagaaaacttta

SEQ ID NO: 4176963 - DNA, 23 bp, Homo sapiens
tttgttaatttagaaaactttaa

SEQ ID NO: 4176964 - DNA, 23 bp, Homo sapiens
tttgttgaaagtaaaagttatat

SEQ ID NO: 4176965 - DNA, 12 bp, Homo sapiens
tttgttttaatt

SEQ ID NO: 4176966 - DNA, 13 bp, Homo sapiens
tttgttttctttg

SEQ ID NO: 4176967 - DNA, 22 bp, Homo sapiens
ttttaaaaaagcttaaaacttt

SEQ ID NO: 4176968 - DNA, 23 bp, Homo sapiens
ttttaaaaaagcttaaaactttg

SEQ ID NO: 4176969 - DNA, 11 bp, Homo sapiens
ttttaaaagaa

SEQ ID NO: 4176970 - DNA, 13 bp, Homo sapiens
ttttaaaagaaaa

SEQ ID NO: 4176971 - DNA, 16 bp, Homo sapiens
ttttaaaagataaaca

SEQ ID NO: 4176972 - DNA, 17 bp, Homo sapiens
ttttaaaagataaacag

SEQ ID NO: 4176973 - DNA, 21 bp, Homo sapiens
ttttaaaggtagagatgtgtg

SEQ ID NO: 4176974 - DNA, 20 bp, Homo sapiens
ttttaacacataactagaaa

SEQ ID NO: 4176975 - DNA, 12 bp, Homo sapiens
ttttaacatttt

SEQ ID NO: 4176976 - DNA, 16 bp, Homo sapiens
ttttaacttaaatttt

SEQ ID NO: 4176977 - DNA, 17 bp, Homo sapiens
ttttaagcattcttaga

SEQ ID NO: 4176978 - DNA, 22 bp, Homo sapiens
ttttaagctgtaaaaagagaga

SEQ ID NO: 4176979 - DNA, 13 bp, Homo sapiens
ttttaataaaagt

SEQ ID NO: 4176980 - DNA, 22 bp, Homo sapiens
ttttaatcagacaaagtaattc

SEQ ID NO: 4176981 - DNA, 23 bp, Homo sapiens
ttttaatccacagtatgttacat

SEQ ID NO: 4176982 - DNA, 17 bp, Homo sapiens
ttttaatttgatacaaa

SEQ ID NO: 4176983 - DNA, 20 bp, Homo sapiens
ttttacttccatgatacttt

SEQ ID NO: 4176984 - DNA, 19 bp, Homo sapiens
ttttagatgagattgtttt

SEQ ID NO: 4176985 - DNA, 16 bp, Homo sapiens
ttttagctctgttctt

SEQ ID NO: 4176986 - DNA, 18 bp, Homo sapiens
ttttaggaagcaagctta

SEQ ID NO: 4176987 - DNA, 17 bp, Homo sapiens
ttttagttcctttattt

SEQ ID NO: 4176988 - DNA, 18 bp, Homo sapiens
ttttatacacaacattta

SEQ ID NO: 4176989 - DNA, 13 bp, Homo sapiens
ttttatatttagt

SEQ ID NO: 4176990 - DNA, 23 bp, Homo sapiens
ttttatatttagttatagtttca

SEQ ID NO: 4176991 - DNA, 17 bp, Homo sapiens
ttttatcatgacatgtt

SEQ ID NO: 4176992 - DNA, 19 bp, Homo sapiens
ttttatgagaaagccttct

SEQ ID NO: 4176993 - DNA, 14 bp, Homo sapiens
ttttattgttttca

SEQ ID NO: 4176994 - DNA, 18 bp, Homo sapiens
ttttcaacagtgaagaca

SEQ ID NO: 4176995 - DNA, 15 bp, Homo sapiens
ttttcaacttggaaa

SEQ ID NO: 4176996 - DNA, 18 bp, Homo sapiens
ttttcagatgtgaaccat

SEQ ID NO: 4176997 - DNA, 21 bp, Homo sapiens
ttttcattcaggtatttgtaa

SEQ ID NO: 4176998 - DNA, 14 bp, Homo sapiens
ttttccaaagataa

SEQ ID NO: 4176999 - DNA, 15 bp, Homo sapiens
ttttccacaaatatg

SEQ ID NO: 4177000 - DNA, 15 bp, Homo sapiens
ttttccaccctggaa

SEQ ID NO: 4177001 - DNA, 22 bp, Homo sapiens
ttttccttattgtttgtaaaca

SEQ ID NO: 4177002 - DNA, 20 bp, Homo sapiens
ttttcgcttgcttctgcagc

SEQ ID NO: 4177003 - DNA, 17 bp, Homo sapiens
ttttctactttttttaa

SEQ ID NO: 4177004 - DNA, 14 bp, Homo sapiens
ttttctagactttc

SEQ ID NO: 4177005 - DNA, 16 bp, Homo sapiens
ttttctagtttggcac

SEQ ID NO: 4177006 - DNA, 13 bp, Homo sapiens
ttttcttacataa

SEQ ID NO: 4177007 - DNA, 16 bp, Homo sapiens
ttttgaaactagaagt

SEQ ID NO: 4177008 - DNA, 15 bp, Homo sapiens
ttttgagcaggagca

SEQ ID NO: 4177009 - DNA, 17 bp, Homo sapiens
ttttgcataagattaaa

SEQ ID NO: 4177010 - DNA, 12 bp, Homo sapiens
ttttgcatgaaa

SEQ ID NO: 4177011 - DNA, 15 bp, Homo sapiens
ttttgcctttaaatt

SEQ ID NO: 4177012 - DNA, 21 bp, Homo sapiens
ttttgcggttcaggaaaattg

SEQ ID NO: 4177013 - DNA, 15 bp, Homo sapiens
ttttgcttaaaattt

SEQ ID NO: 4177014 - DNA, 16 bp, Homo sapiens
ttttgcttaaaatttt

SEQ ID NO: 4177015 - DNA, 11 bp, Homo sapiens
ttttgtggatt

SEQ ID NO: 4177016 - DNA, 21 bp, Homo sapiens
ttttgttgtttcttaaataag

SEQ ID NO: 4177017 - DNA, 15 bp, Homo sapiens
tttttaaaaaagctt

SEQ ID NO: 4177018 - DNA, 18 bp, Homo sapiens
tttttaacaatctaacaa

SEQ ID NO: 4177019 - DNA, 12 bp, Homo sapiens
tttttaataaaa

SEQ ID NO: 4177020 - DNA, 20 bp, Homo sapiens
tttttaggaagcaagcttaa

SEQ ID NO: 4177021 - DNA, 15 bp, Homo sapiens
tttttatatttagtt

SEQ ID NO: 4177022 - DNA, 22 bp, Homo sapiens
tttttccttcaaagtttaataa

SEQ ID NO: 4177023 - DNA, 13 bp, Homo sapiens
tttttgatactaa

SEQ ID NO: 4177024 - DNA, 15 bp, Homo sapiens
tttttgatactaagc

SEQ ID NO: 4177025 - DNA, 12 bp, Homo sapiens
tttttgctattt

SEQ ID NO: 4177026 - DNA, 12 bp, Homo sapiens
tttttgtaccaa

SEQ ID NO: 4177027 - DNA, 20 bp, Homo sapiens
tttttgtgaaaatgtcaaag

SEQ ID NO: 4177028 - DNA, 13 bp, Homo sapiens
ttttttgtaccaa

SEQ ID NO: 4177029 - DNA, 18 bp, Homo sapiens
gatatgtaaaacatttat

SEQ ID NO: 4177030 - DNA, 22 bp, Homo sapiens
gatattcctattgtgcaatgta

SEQ ID NO: 4177031 - DNA, 17 bp, Homo sapiens
gatattgggacacacat

SEQ ID NO: 4177032 - DNA, 22 bp, Homo sapiens
gatcacaccactgcactccagc

SEQ ID NO: 4177033 - DNA, 13 bp, Homo sapiens
gatcactggagcc

SEQ ID NO: 4177034 - DNA, 18 bp, Homo sapiens
gatcactggagcccagga

SEQ ID NO: 4177035 - DNA, 16 bp, Homo sapiens
gatcagaagtaggaag

SEQ ID NO: 4177036 - DNA, 17 bp, Homo sapiens
gatcagaagtaggaagg

SEQ ID NO: 4177037 - DNA, 16 bp, Homo sapiens
gatcagcagtggcagg

SEQ ID NO: 4177038 - DNA, 15 bp, Homo sapiens
gatcaggaagagaag

SEQ ID NO: 4177039 - DNA, 23 bp, Homo sapiens
gatcattttagacactgggagaa

SEQ ID NO: 4177040 - DNA, 23 bp, Homo sapiens
gatccagagacttggggaccaga

SEQ ID NO: 4177041 - DNA, 22 bp, Homo sapiens
gatccagagtttcctagaacgc

SEQ ID NO: 4177042 - DNA, 19 bp, Homo sapiens
gatccatttggacaaaatg

SEQ ID NO: 4177043 - DNA, 21 bp, Homo sapiens
gatccatttggacaaaatgga

SEQ ID NO: 4177044 - DNA, 21 bp, Homo sapiens
gatcccgcctcttcttcttca

SEQ ID NO: 4177045 - DNA, 20 bp, Homo sapiens
gatccctccatccggctcct

SEQ ID NO: 4177046 - DNA, 22 bp, Homo sapiens
gatccctttcccatgatccaga

SEQ ID NO: 4177047 - DNA, 17 bp, Homo sapiens
gatccggctgctcctcc

SEQ ID NO: 4177048 - DNA, 20 bp, Homo sapiens
gatccggctgctcctccagc

SEQ ID NO: 4177049 - DNA, 19 bp, Homo sapiens
gatcctattctcaccagga

SEQ ID NO: 4177050 - DNA, 17 bp, Homo sapiens
gatcctggaaccactga

SEQ ID NO: 4177051 - DNA, 16 bp, Homo sapiens
gatctagaatgtgttt

SEQ ID NO: 4177052 - DNA, 20 bp, Homo sapiens
gatctagaatgtgttttctg

SEQ ID NO: 4177053 - DNA, 22 bp, Homo sapiens
gatctagttctcaatcactgct

SEQ ID NO: 4177054 - DNA, 18 bp, Homo sapiens
gatctcaaatccactgac

SEQ ID NO: 4177055 - DNA, 19 bp, Homo sapiens
gatctcaaatccactgaca

SEQ ID NO: 4177056 - DNA, 13 bp, Homo sapiens
gatctccaaggac

SEQ ID NO: 4177057 - DNA, 20 bp, Homo sapiens
gatctccaaggaccaggtta

SEQ ID NO: 4177058 - DNA, 19 bp, Homo sapiens
gatctctgaaacatattta

SEQ ID NO: 4177059 - DNA, 11 bp, Homo sapiens
gatctctgctt

SEQ ID NO: 4177060 - DNA, 17 bp, Homo sapiens
gatctgccattgggacc

SEQ ID NO: 4177061 - DNA, 15 bp, Homo sapiens
gatctgcttcttcat

SEQ ID NO: 4177062 - DNA, 15 bp, Homo sapiens
gatctgtccaaggaa

SEQ ID NO: 4177063 - DNA, 18 bp, Homo sapiens
gatcttccgtggtcagag

SEQ ID NO: 4177064 - DNA, 11 bp, Homo sapiens
gatctttcagg

SEQ ID NO: 4177065 - DNA, 21 bp, Homo sapiens
gatgaaattgaacctggtttt

SEQ ID NO: 4177066 - DNA, 14 bp, Homo sapiens
gatgagttaactgt

SEQ ID NO: 4177067 - DNA, 20 bp, Homo sapiens
gatgattaatacaatattaa

SEQ ID NO: 4177068 - DNA, 19 bp, Homo sapiens
gatgcagtggctcatgcct

SEQ ID NO: 4177069 - DNA, 22 bp, Homo sapiens
gatgccacccagcaacacagag

SEQ ID NO: 4177070 - DNA, 18 bp, Homo sapiens
gatgcccagagggcccag

SEQ ID NO: 4177071 - DNA, 20 bp, Homo sapiens
gatgcccagagggcccaggc

SEQ ID NO: 4177072 - DNA, 12 bp, Homo sapiens
gatgctgcctga

SEQ ID NO: 4177073 - DNA, 16 bp, Homo sapiens
gatgctgcctgagtca

SEQ ID NO: 4177074 - DNA, 22 bp, Homo sapiens
gatgctgtcactggcagagcac

SEQ ID NO: 4177075 - DNA, 16 bp, Homo sapiens
gatggaaaaataacaa

SEQ ID NO: 4177076 - DNA, 15 bp, Homo sapiens
gatggagaaggaagg

SEQ ID NO: 4177077 - DNA, 23 bp, Homo sapiens
gatggagactggtcctgtgtgca

SEQ ID NO: 4177078 - DNA, 22 bp, Homo sapiens
gatggagcgcacctgccccctg

SEQ ID NO: 4177079 - DNA, 14 bp, Homo sapiens
gatggcccagcagg

SEQ ID NO: 4177080 - DNA, 22 bp, Homo sapiens
gatggcccttcccactggaggt

SEQ ID NO: 4177081 - DNA, 17 bp, Homo sapiens
gatgggattctggacag

SEQ ID NO: 4177082 - DNA, 13 bp, Homo sapiens
gatggtcctgggg

SEQ ID NO: 4177083 - DNA, 15 bp, Homo sapiens
gatggtcctggggct

SEQ ID NO: 4177084 - DNA, 21 bp, Homo sapiens
gatggtcctggggctctgtgc

SEQ ID NO: 4177085 - DNA, 14 bp, Homo sapiens
gatggttctgtgac

SEQ ID NO: 4177086 - DNA, 18 bp, Homo sapiens
gatgtaactattgaattg

SEQ ID NO: 4177087 - DNA, 11 bp, Homo sapiens
gatgtcagcct

SEQ ID NO: 4177088 - DNA, 14 bp, Homo sapiens
gatgtcagccttgc

SEQ ID NO: 4177089 - DNA, 15 bp, Homo sapiens
gatgtcagccttgca

SEQ ID NO: 4177090 - DNA, 13 bp, Homo sapiens
gatgtcatcccct

SEQ ID NO: 4177091 - DNA, 23 bp, Homo sapiens
gatgtcatccccttgtgtcagag

SEQ ID NO: 4177092 - DNA, 21 bp, Homo sapiens
gatgtgaattgcctgcagaga

SEQ ID NO: 4177093 - DNA, 23 bp, Homo sapiens
gatgtgaattgcctgcagagaga

SEQ ID NO: 4177094 - DNA, 19 bp, Homo sapiens
gatgtgtctgggagagcct

SEQ ID NO: 4177095 - DNA, 16 bp, Homo sapiens
gatgtgtttgctttct

SEQ ID NO: 4177096 - DNA, 18 bp, Homo sapiens
gatgtgtttgctttctga

SEQ ID NO: 4177097 - DNA, 20 bp, Homo sapiens
gatgttacatcacagtgttt

SEQ ID NO: 4177098 - DNA, 23 bp, Homo sapiens
gatgttacatcacagtgtttgca

SEQ ID NO: 4177099 - DNA, 17 bp, Homo sapiens
gatgtttgttgctagga

SEQ ID NO: 4177100 - DNA, 21 bp, Homo sapiens
gattaattttaacttaaattt

SEQ ID NO: 4177101 - DNA, 13 bp, Homo sapiens
gattacagaggaa

SEQ ID NO: 4177102 - DNA, 14 bp, Homo sapiens
gattacctgccaat

SEQ ID NO: 4177103 - DNA, 19 bp, Homo sapiens
gattactactttgcctctt

SEQ ID NO: 4177104 - DNA, 21 bp, Homo sapiens
gattatagttgtgggtgggag

SEQ ID NO: 4177105 - DNA, 14 bp, Homo sapiens
gattatgtagctaa

SEQ ID NO: 4177106 - DNA, 19 bp, Homo sapiens
gattccagagcactgctcc

SEQ ID NO: 4177107 - DNA, 16 bp, Homo sapiens
gattccagcatttgcc

SEQ ID NO: 4177108 - DNA, 18 bp, Homo sapiens
gattcctcccccagagcc

SEQ ID NO: 4177109 - DNA, 20 bp, Homo sapiens
gcagagaggaccccactgga

SEQ ID NO: 4177110 - DNA, 15 bp, Homo sapiens
gcagagcacagccca

SEQ ID NO: 4177111 - DNA, 17 bp, Homo sapiens
gcagagcacagcccacg

SEQ ID NO: 4177112 - DNA, 20 bp, Homo sapiens
gcagagcaggggcagggtga

SEQ ID NO: 4177113 - DNA, 19 bp, Homo sapiens
gcagagccaccagggcact

SEQ ID NO: 4177114 - DNA, 19 bp, Homo sapiens
gcagagctgatggagaagg

SEQ ID NO: 4177115 - DNA, 21 bp, Homo sapiens
gcagagctgatggagaaggaa

SEQ ID NO: 4177116 - DNA, 16 bp, Homo sapiens
gcagaggaaaaagaaa

SEQ ID NO: 4177117 - DNA, 17 bp, Homo sapiens
gcagaggggagcttgag

SEQ ID NO: 4177118 - DNA, 12 bp, Homo sapiens
gcagaggggctt

SEQ ID NO: 4177119 - DNA, 16 bp, Homo sapiens
gcagataatcagcctc

SEQ ID NO: 4177120 - DNA, 20 bp, Homo sapiens
gcagatcttccgtggtcaga

SEQ ID NO: 4177121 - DNA, 22 bp, Homo sapiens
gcagatcttccgtggtcagagt

SEQ ID NO: 4177122 - DNA, 15 bp, Homo sapiens
gcagatggaaagaaa

SEQ ID NO: 4177123 - DNA, 15 bp, Homo sapiens
gcagcaactcccacg

SEQ ID NO: 4177124 - DNA, 19 bp, Homo sapiens
gcagcactttaaccctctc

SEQ ID NO: 4177125 - DNA, 21 bp, Homo sapiens
gcagcactttaaccctctctt

SEQ ID NO: 4177126 - DNA, 18 bp, Homo sapiens
gcagccagccggtgcctg

SEQ ID NO: 4177127 - DNA, 23 bp, Homo sapiens
gcagccccgcgcctccttccttg

SEQ ID NO: 4177128 - DNA, 14 bp, Homo sapiens
gcagcctccctctg

SEQ ID NO: 4177129 - DNA, 22 bp, Homo sapiens
gcagcctccctctgacctgcag

SEQ ID NO: 4177130 - DNA, 13 bp, Homo sapiens
gcagcgagctgag

SEQ ID NO: 4177131 - DNA, 14 bp, Homo sapiens
gcagcgagctgaga

SEQ ID NO: 4177132 - DNA, 14 bp, Homo sapiens
gcagcgcgtgcaca

SEQ ID NO: 4177133 - DNA, 18 bp, Homo sapiens
gcagctcaagagatccca

SEQ ID NO: 4177134 - DNA, 16 bp, Homo sapiens
gcagctgcaccatcac

SEQ ID NO: 4177135 - DNA, 15 bp, Homo sapiens
gcagctggctctcca

SEQ ID NO: 4177136 - DNA, 13 bp, Homo sapiens
gcagcttcagttg

SEQ ID NO: 4177137 - DNA, 14 bp, Homo sapiens
gcagcttctgtcct

SEQ ID NO: 4177138 - DNA, 23 bp, Homo sapiens
gcaggaaggactatgaaaagcta

SEQ ID NO: 4177139 - DNA, 21 bp, Homo sapiens
gcaggaccctgtcaggattgc

SEQ ID NO: 4177140 - DNA, 23 bp, Homo sapiens
gcaggactcggaattctcgggaa

SEQ ID NO: 4177141 - DNA, 13 bp, Homo sapiens
gcaggagcagaaa

SEQ ID NO: 4177142 - DNA, 15 bp, Homo sapiens
gcaggatctgcccac

SEQ ID NO: 4177143 - DNA, 20 bp, Homo sapiens
gcaggcaccttagtggcttt

SEQ ID NO: 4177144 - DNA, 16 bp, Homo sapiens
gcaggcactgtggccc

SEQ ID NO: 4177145 - DNA, 19 bp, Homo sapiens
gcagggagcaactctccac

SEQ ID NO: 4177146 - DNA, 16 bp, Homo sapiens
gcagggctctgcccca

SEQ ID NO: 4177147 - DNA, 21 bp, Homo sapiens
gcagggctctgccccagaggc

SEQ ID NO: 4177148 - DNA, 20 bp, Homo sapiens
gcagggctgctgtggcccag

SEQ ID NO: 4177149 - DNA, 22 bp, Homo sapiens
gcaggggtcagtgcagcagagg

SEQ ID NO: 4177150 - DNA, 15 bp, Homo sapiens
gcaggggtgggagag

SEQ ID NO: 4177151 - DNA, 13 bp, Homo sapiens
gcagggtcttgct

SEQ ID NO: 4177152 - DNA, 16 bp, Homo sapiens
gcaggtaggggcacag

SEQ ID NO: 4177153 - DNA, 20 bp, Homo sapiens
gcaggtagttggtgaacaga

SEQ ID NO: 4177154 - DNA, 12 bp, Homo sapiens
gcaggtgcctgg

SEQ ID NO: 4177155 - DNA, 15 bp, Homo sapiens
gcaggtggtcctgag

SEQ ID NO: 4177156 - DNA, 21 bp, Homo sapiens
gcaggtggtcctgagacctga

SEQ ID NO: 4177157 - DNA, 22 bp, Homo sapiens
gcaggttgaggggctcctggaa

SEQ ID NO: 4177158 - DNA, 15 bp, Homo sapiens
gcagtaagcaggcct

SEQ ID NO: 4177159 - DNA, 16 bp, Homo sapiens
gcagtatctcttgctg

SEQ ID NO: 4177160 - DNA, 19 bp, Homo sapiens
gcagtatctcttgctggga

SEQ ID NO: 4177161 - DNA, 17 bp, Homo sapiens
gcagtgagcttctatta

SEQ ID NO: 4177162 - DNA, 22 bp, Homo sapiens
gcagtgaggggagatgctggga

SEQ ID NO: 4177163 - DNA, 19 bp, Homo sapiens
gcagtgagttacagcgaga

SEQ ID NO: 4177164 - DNA, 20 bp, Homo sapiens
gcagtgcaagagactctggc

SEQ ID NO: 4177165 - DNA, 19 bp, Homo sapiens
gcagtgctgattcagcctg

SEQ ID NO: 4177166 - DNA, 16 bp, Homo sapiens
gcagtgcttctctaca

SEQ ID NO: 4177167 - DNA, 12 bp, Homo sapiens
gcagtggcagga

SEQ ID NO: 4177168 - DNA, 18 bp, Homo sapiens
gcagtggtaagctctggc

SEQ ID NO: 4177169 - DNA, 20 bp, Homo sapiens
gcagttactatttttatatt

SEQ ID NO: 4177170 - DNA, 16 bp, Homo sapiens
gcagttccctgttgaa

SEQ ID NO: 4177171 - DNA, 18 bp, Homo sapiens
gcagtttatatttaactc

SEQ ID NO: 4177172 - DNA, 15 bp, Homo sapiens
gcagttttccaggaa

SEQ ID NO: 4177173 - DNA, 14 bp, Homo sapiens
gcctctgcccgcag

SEQ ID NO: 4177174 - DNA, 15 bp, Homo sapiens
gcctctgcccgcaga

SEQ ID NO: 4177175 - DNA, 18 bp, Homo sapiens
gcctctgcccgcagagcc

SEQ ID NO: 4177176 - DNA, 15 bp, Homo sapiens
gcctctgctgccatg

SEQ ID NO: 4177177 - DNA, 22 bp, Homo sapiens
gcctcttcagcagcatctactc

SEQ ID NO: 4177178 - DNA, 19 bp, Homo sapiens
gcctgactagggagccatg

SEQ ID NO: 4177179 - DNA, 12 bp, Homo sapiens
gcctgactgctc

SEQ ID NO: 4177180 - DNA, 13 bp, Homo sapiens
gcctgactgctcg

SEQ ID NO: 4177181 - DNA, 17 bp, Homo sapiens
gcctgaggctgagactg

SEQ ID NO: 4177182 - DNA, 14 bp, Homo sapiens
gcctgcagagagaa

SEQ ID NO: 4177183 - DNA, 10 bp, Homo sapiens
gcctgcagcc

SEQ ID NO: 4177184 - DNA, 11 bp, Homo sapiens
gcctgcagccc

SEQ ID NO: 4177185 - DNA, 13 bp, Homo sapiens
gcctgccctggag

SEQ ID NO: 4177186 - DNA, 23 bp, Homo sapiens
gcctgcctgtggagacagccctg

SEQ ID NO: 4177187 - DNA, 19 bp, Homo sapiens
gcctggaccgcttcccaga

SEQ ID NO: 4177188 - DNA, 20 bp, Homo sapiens
gcctggaccgcttcccagag

SEQ ID NO: 4177189 - DNA, 21 bp, Homo sapiens
gcctggaccgcttcccagagg

SEQ ID NO: 4177190 - DNA, 20 bp, Homo sapiens
gcctggagcggagcttgcct

SEQ ID NO: 4177191 - DNA, 21 bp, Homo sapiens
gcctggaggatccctccatcc

SEQ ID NO: 4177192 - DNA, 15 bp, Homo sapiens
gcctggccaggcacc

SEQ ID NO: 4177193 - DNA, 18 bp, Homo sapiens
gcctggcccccctccagg

SEQ ID NO: 4177194 - DNA, 19 bp, Homo sapiens
gcctggcccccctccaggc

SEQ ID NO: 4177195 - DNA, 20 bp, Homo sapiens
gcctggcccccctccaggca

SEQ ID NO: 4177196 - DNA, 13 bp, Homo sapiens
gcctggcttctgg

SEQ ID NO: 4177197 - DNA, 14 bp, Homo sapiens
gcctggcttctgga

SEQ ID NO: 4177198 - DNA, 15 bp, Homo sapiens
gcctggcttctggag

SEQ ID NO: 4177199 - DNA, 17 bp, Homo sapiens
gcctggcttctggagcc

SEQ ID NO: 4177200 - DNA, 23 bp, Homo sapiens
gcctggcttctggagcccttggg

SEQ ID NO: 4177201 - DNA, 20 bp, Homo sapiens
gcctggctttggtccccagc

SEQ ID NO: 4177202 - DNA, 22 bp, Homo sapiens
gcctggctttggtccccagcat

SEQ ID NO: 4177203 - DNA, 23 bp, Homo sapiens
gcctggctttggtccccagcatt

SEQ ID NO: 4177204 - DNA, 21 bp, Homo sapiens
gcctgggaatcctgctgccag

SEQ ID NO: 4177205 - DNA, 12 bp, Homo sapiens
gcctgggcaaga

SEQ ID NO: 4177206 - DNA, 20 bp, Homo sapiens
gcctgggctggagtgcagtg

SEQ ID NO: 4177207 - DNA, 15 bp, Homo sapiens
gcctgggtaggaaaa

SEQ ID NO: 4177208 - DNA, 21 bp, Homo sapiens
gcctggtagaattgggaagct

SEQ ID NO: 4177209 - DNA, 18 bp, Homo sapiens
gcctgtaatcccagcact

SEQ ID NO: 4177210 - DNA, 20 bp, Homo sapiens
gcctgtagctttcctggtcc

SEQ ID NO: 4177211 - DNA, 17 bp, Homo sapiens
gcctgtagttaggaaat

SEQ ID NO: 4177212 - DNA, 19 bp, Homo sapiens
gcctgtagttaggaaataa

SEQ ID NO: 4177213 - DNA, 16 bp, Homo sapiens
gcctgtatagacagca

SEQ ID NO: 4177214 - DNA, 15 bp, Homo sapiens
gcctgtggagacagc

SEQ ID NO: 4177215 - DNA, 16 bp, Homo sapiens
gcctgtgggaagagaa

SEQ ID NO: 4177216 - DNA, 12 bp, Homo sapiens
gcctgtgtctgg

SEQ ID NO: 4177217 - DNA, 16 bp, Homo sapiens
gccttaaagaaagtcg

SEQ ID NO: 4177218 - DNA, 17 bp, Homo sapiens
gccttactcacctctct

SEQ ID NO: 4177219 - DNA, 22 bp, Homo sapiens
gccttattggaaagcagtcccc

SEQ ID NO: 4177220 - DNA, 17 bp, Homo sapiens
gccttcaagtgccaaac

SEQ ID NO: 4177221 - DNA, 23 bp, Homo sapiens
gccttccccctcccagggccagg

SEQ ID NO: 4177222 - DNA, 19 bp, Homo sapiens
gccttcctcgtgcagagct

SEQ ID NO: 4177223 - DNA, 20 bp, Homo sapiens
gccttcctcgtgcagagctg

SEQ ID NO: 4177224 - DNA, 12 bp, Homo sapiens
gccttctcagcc

SEQ ID NO: 4177225 - DNA, 17 bp, Homo sapiens
gccttctcagcctacag

SEQ ID NO: 4177226 - DNA, 19 bp, Homo sapiens
gcctttcaggtccaggcca

SEQ ID NO: 4177227 - DNA, 23 bp, Homo sapiens
gcctttctcgtggtagaagccag

SEQ ID NO: 4177228 - DNA, 20 bp, Homo sapiens
gcctttctctggctccagaa

SEQ ID NO: 4177229 - DNA, 14 bp, Homo sapiens
gccttttaaaagaa

SEQ ID NO: 4177230 - DNA, 22 bp, Homo sapiens
gcgaaaaaatcaggtggctttt

SEQ ID NO: 4177231 - DNA, 22 bp, Homo sapiens
gcgaacacaggtgttggaagcc

SEQ ID NO: 4177232 - DNA, 16 bp, Homo sapiens
gcgaaggggccctggt

SEQ ID NO: 4177233 - DNA, 11 bp, Homo sapiens
gcgaataaatg

SEQ ID NO: 4177234 - DNA, 14 bp, Homo sapiens
gcgaataaatgttc

SEQ ID NO: 4177235 - DNA, 16 bp, Homo sapiens
gcgaataaatgttcaa

SEQ ID NO: 4177236 - DNA, 14 bp, Homo sapiens
gcgacagagcaaga

SEQ ID NO: 4177237 - DNA, 19 bp, Homo sapiens
gcgacagagcgagagtctg

SEQ ID NO: 4177238 - DNA, 16 bp, Homo sapiens
gcgagaggcagagaaa

SEQ ID NO: 4177239 - DNA, 16 bp, Homo sapiens
gcgagcatcctggcca

SEQ ID NO: 4177240 - DNA, 21 bp, Homo sapiens
gcgagctatgatcgcgccact

SEQ ID NO: 4177241 - DNA, 19 bp, Homo sapiens
gcgagctgagatcacacca

SEQ ID NO: 4177242 - DNA, 13 bp, Homo sapiens
gcgagctgctctg

SEQ ID NO: 4177243 - DNA, 15 bp, Homo sapiens
gcgagtgccaggact

SEQ ID NO: 4177244 - DNA, 22 bp, Homo sapiens
gcgagtgccaggactccccagg

SEQ ID NO: 4177245 - DNA, 15 bp, Homo sapiens
gcgattttgtctacc

SEQ ID NO: 4177246 - DNA, 12 bp, Homo sapiens
gcgcacctgccc

SEQ ID NO: 4177247 - DNA, 19 bp, Homo sapiens
gcgcacctgccccctggtg

SEQ ID NO: 4177248 - DNA, 18 bp, Homo sapiens
gcgcagtgcttctctaca

SEQ ID NO: 4177249 - DNA, 24 bp, Homo sapiens
gcgccactacactccagcctgagc

SEQ ID NO: 4177250 - DNA, 15 bp, Homo sapiens
ggccacattgacagt

SEQ ID NO: 4177251 - DNA, 16 bp, Homo sapiens
ggccactctcccctcc

SEQ ID NO: 4177252 - DNA, 22 bp, Homo sapiens
ggccactctcccctccctcttc

SEQ ID NO: 4177253 - DNA, 15 bp, Homo sapiens
ggccactgtaggggt

SEQ ID NO: 4177254 - DNA, 17 bp, Homo sapiens
ggccagaggcagagtga

SEQ ID NO: 4177255 - DNA, 16 bp, Homo sapiens
ggccaggaatctgcca

SEQ ID NO: 4177256 - DNA, 13 bp, Homo sapiens
ggccagggccctg

SEQ ID NO: 4177257 - DNA, 17 bp, Homo sapiens
ggccatgggtgcatgga

SEQ ID NO: 4177258 - DNA, 14 bp, Homo sapiens
ggcccacagagcct

SEQ ID NO: 4177259 - DNA, 15 bp, Homo sapiens
ggcccacagagcctg

SEQ ID NO: 4177260 - DNA, 17 bp, Homo sapiens
ggcccacagagcctggc

SEQ ID NO: 4177261 - DNA, 20 bp, Homo sapiens
ggcccacagggaaccctgct

SEQ ID NO: 4177262 - DNA, 16 bp, Homo sapiens
ggcccagagacccctt

SEQ ID NO: 4177263 - DNA, 17 bp, Homo sapiens
ggcccagagaccccttc

SEQ ID NO: 4177264 - DNA, 23 bp, Homo sapiens
ggcccagagaccccttcctttcc

SEQ ID NO: 4177265 - DNA, 22 bp, Homo sapiens
ggcccagcctgtcctggtacag

SEQ ID NO: 4177266 - DNA, 17 bp, Homo sapiens
ggcccattctgcatgcc

SEQ ID NO: 4177267 - DNA, 18 bp, Homo sapiens
ggccccagggctaccctc

SEQ ID NO: 4177268 - DNA, 17 bp, Homo sapiens
ggcccccctccttgctc

SEQ ID NO: 4177269 - DNA, 20 bp, Homo sapiens
ggcccctagaaaccacctgg

SEQ ID NO: 4177270 - DNA, 22 bp, Homo sapiens
ggccctaggattcctcccccag

SEQ ID NO: 4177271 - DNA, 15 bp, Homo sapiens
ggccctggtccttcc

SEQ ID NO: 4177272 - DNA, 15 bp, Homo sapiens
ggcccttctgtccac

SEQ ID NO: 4177273 - DNA, 19 bp, Homo sapiens
ggccgtgggccgggaggca

SEQ ID NO: 4177274 - DNA, 23 bp, Homo sapiens
ggccgtgggccgggaggcagtgc

SEQ ID NO: 4177275 - DNA, 16 bp, Homo sapiens
ggcctcactcaagcct

SEQ ID NO: 4177276 - DNA, 18 bp, Homo sapiens
ggcctcactcaagcctga

SEQ ID NO: 4177277 - DNA, 21 bp, Homo sapiens
ggcctcagcacccctgtctct

SEQ ID NO: 4177278 - DNA, 18 bp, Homo sapiens
ggcctcccaataaagctg

SEQ ID NO: 4177279 - DNA, 19 bp, Homo sapiens
ggcctcccaataaagctgg

SEQ ID NO: 4177280 - DNA, 14 bp, Homo sapiens
ggcctcctgggggc

SEQ ID NO: 4177281 - DNA, 18 bp, Homo sapiens
ggcctcgtaccagccagg

SEQ ID NO: 4177282 - DNA, 14 bp, Homo sapiens
ggcctgatgacaga

SEQ ID NO: 4177283 - DNA, 16 bp, Homo sapiens
ggcctgccctcaggga

SEQ ID NO: 4177284 - DNA, 17 bp, Homo sapiens
ggcctgcgtgccgggag

SEQ ID NO: 4177285 - DNA, 18 bp, Homo sapiens
ggcctgctgcgtcagacc

SEQ ID NO: 4177286 - DNA, 19 bp, Homo sapiens
ggcctgctgcgtcagacca

SEQ ID NO: 4177287 - DNA, 17 bp, Homo sapiens
ggccttagtacggctgc

SEQ ID NO: 4177288 - DNA, 16 bp, Homo sapiens
ttaaaaccattattta

SEQ ID NO: 4177289 - DNA, 18 bp, Homo sapiens
ttaaaacctagaacttca

SEQ ID NO: 4177290 - DNA, 18 bp, Homo sapiens
ttaaaagataaacagttt

SEQ ID NO: 4177291 - DNA, 22 bp, Homo sapiens
ttaaaagatgcttttaacagag

SEQ ID NO: 4177292 - DNA, 17 bp, Homo sapiens
ttaaaatgctgttttgt

SEQ ID NO: 4177293 - DNA, 16 bp, Homo sapiens
ttaaaatgtaaagcca

SEQ ID NO: 4177294 - DNA, 19 bp, Homo sapiens
ttaaaattttacttttgtt

SEQ ID NO: 4177295 - DNA, 20 bp, Homo sapiens
ttaaacaaaatagaagctgt

SEQ ID NO: 4177296 - DNA, 14 bp, Homo sapiens
ttaaaccttttttg

SEQ ID NO: 4177297 - DNA, 16 bp, Homo sapiens
ttaaactttttttgtc

SEQ ID NO: 4177298 - DNA, 11 bp, Homo sapiens
ttaaagaaagt

SEQ ID NO: 4177299 - DNA, 18 bp, Homo sapiens
ttaaaggtagagatgtgt

SEQ ID NO: 4177300 - DNA, 17 bp, Homo sapiens
ttaaataagaaactttt

SEQ ID NO: 4177301 - DNA, 23 bp, Homo sapiens
ttaaataagatggagaataaatt

SEQ ID NO: 4177302 - DNA, 20 bp, Homo sapiens
ttaaatattgaataagtatt

SEQ ID NO: 4177303 - DNA, 20 bp, Homo sapiens
ttaaatgtatatgtcattta

SEQ ID NO: 4177304 - DNA, 18 bp, Homo sapiens
ttaaattatatatttatt

SEQ ID NO: 4177305 - DNA, 23 bp, Homo sapiens
ttaaattctctctcttgcaggaa

SEQ ID NO: 4177306 - DNA, 15 bp, Homo sapiens
ttaacaatctaacaa

SEQ ID NO: 4177307 - DNA, 13 bp, Homo sapiens
ttaacagagtctg

SEQ ID NO: 4177308 - DNA, 19 bp, Homo sapiens
ttaacagagtctgaaccta

SEQ ID NO: 4177309 - DNA, 17 bp, Homo sapiens
ttaacatatttactaag

SEQ ID NO: 4177310 - DNA, 20 bp, Homo sapiens
ttaacatggaagatattcct

SEQ ID NO: 4177311 - DNA, 10 bp, Homo sapiens
ttaacatttt

SEQ ID NO: 4177312 - DNA, 16 bp, Homo sapiens
ttaactatgtgatgtt

SEQ ID NO: 4177313 - DNA, 18 bp, Homo sapiens
ttaactcaggatgccaag

SEQ ID NO: 4177314 - DNA, 15 bp, Homo sapiens
ttaactctctttatg

SEQ ID NO: 4177315 - DNA, 17 bp, Homo sapiens
ttaactctctttatgtc

SEQ ID NO: 4177316 - DNA, 21 bp, Homo sapiens
ttaactgaataggaaaatgta

SEQ ID NO: 4177317 - DNA, 17 bp, Homo sapiens
ttaactgggtaatgaaa

SEQ ID NO: 4177318 - DNA, 16 bp, Homo sapiens
ttaactgtgaaatacc

SEQ ID NO: 4177319 - DNA, 13 bp, Homo sapiens
ttaacttaaatag

SEQ ID NO: 4177320 - DNA, 23 bp, Homo sapiens
ttaacttaaattttaagcttgaa

SEQ ID NO: 4177321 - DNA, 19 bp, Homo sapiens
ttaacttggtcagagccac

SEQ ID NO: 4177322 - DNA, 16 bp, Homo sapiens
ttaactttaagactga

SEQ ID NO: 4177323 - DNA, 17 bp, Homo sapiens
ttaagaatggaagaaaa

SEQ ID NO: 4177324 - DNA, 19 bp, Homo sapiens
ttaagagtgaaataattaa

SEQ ID NO: 4177325 - DNA, 16 bp, Homo sapiens
ttaagcaacagataaa

SEQ ID NO: 4177326 - DNA, 16 bp, Homo sapiens
ttaagccaaaacaatg

SEQ ID NO: 4177327 - DNA, 20 bp, Homo sapiens
ttaagcttgaagattaggta

SEQ ID NO: 4177328 - DNA, 23 bp, Homo sapiens
ttaaggcatttgtttaatttata

SEQ ID NO: 4177329 - DNA, 17 bp, Homo sapiens
ttaaggggatcagaagt

SEQ ID NO: 4177330 - DNA, 14 bp, Homo sapiens
ttaaggtgtagcca

SEQ ID NO: 4177331 - DNA, 15 bp, Homo sapiens
ttaagtaaaccaaaa

SEQ ID NO: 4177332 - DNA, 23 bp, Homo sapiens
ttaagtaaggacaaagaaggaaa

SEQ ID NO: 4177333 - DNA, 22 bp, Homo sapiens
ttaagtggggtagactgaggga

SEQ ID NO: 4177334 - DNA, 16 bp, Homo sapiens
ttaagtgttgttcatt

SEQ ID NO: 4177335 - DNA, 14 bp, Homo sapiens
ttaagttagagaat

SEQ ID NO: 4177336 - DNA, 23 bp, Homo sapiens
ttaagttagagaatatatttttg

SEQ ID NO: 4177337 - DNA, 20 bp, Homo sapiens
ttaataaattttaacatttt

SEQ ID NO: 4177338 - DNA, 23 bp, Homo sapiens
ttaataagagtaaaaatatgtga

SEQ ID NO: 4177339 - DNA, 22 bp, Homo sapiens
ttaataataccaagactaagca

SEQ ID NO: 4177340 - DNA, 21 bp, Homo sapiens
ttaatacaatattaattataa

SEQ ID NO: 4177341 - DNA, 22 bp, Homo sapiens
ttaatactttttacccaaatat

SEQ ID NO: 4177342 - DNA, 16 bp, Homo sapiens
ttaatagcaaagaatt

SEQ ID NO: 4177343 - DNA, 18 bp, Homo sapiens
ttaatagcaaagaattga

SEQ ID NO: 4177344 - DNA, 20 bp, Homo sapiens
ttaatagcaaagaattgact

SEQ ID NO: 4177345 - DNA, 18 bp, Homo sapiens
ttaatagcttttattgta

SEQ ID NO: 4177346 - DNA, 14 bp, Homo sapiens
ttaatatcctaaac

SEQ ID NO: 4177347 - DNA, 20 bp, Homo sapiens
ttaatccacagtatgttaca

SEQ ID NO: 4177348 - DNA, 20 bp, Homo sapiens
ttaatggcagcattcagaac

SEQ ID NO: 4177349 - DNA, 19 bp, Homo sapiens
ttaatgtatagtaaatcac

SEQ ID NO: 4177350 - DNA, 15 bp, Homo sapiens
ttaattcactcccac

SEQ ID NO: 4177351 - DNA, 21 bp, Homo sapiens
ttaattctcagccatgtgctt

SEQ ID NO: 4177352 - DNA, 19 bp, Homo sapiens
ttaatttatatttgaaatt

SEQ ID NO: 4177353 - DNA, 15 bp, Homo sapiens
ttaatttatttagtt

SEQ ID NO: 4177354 - DNA, 15 bp, Homo sapiens
ttaatttgttatgta

SEQ ID NO: 4177355 - DNA, 13 bp, Homo sapiens
ttaatttttgata

SEQ ID NO: 4177356 - DNA, 16 bp, Homo sapiens
ttacaagaattgtcca

SEQ ID NO: 4177357 - DNA, 20 bp, Homo sapiens
ttacaataattaatgtgtgt

SEQ ID NO: 4177358 - DNA, 14 bp, Homo sapiens
ttacacattatgtt

SEQ ID NO: 4177359 - DNA, 22 bp, Homo sapiens
ttacactacacactgtgtactg

SEQ ID NO: 4177360 - DNA, 19 bp, Homo sapiens
ttacactctctgtacaaaa

SEQ ID NO: 4177361 - DNA, 20 bp, Homo sapiens
ttacactctctgtacaaaaa

SEQ ID NO: 4177362 - DNA, 20 bp, Homo sapiens
ttacagaacacgctttcaca

SEQ ID NO: 4177363 - DNA, 15 bp, Homo sapiens
ttacagtaaataaat

SEQ ID NO: 4177364 - DNA, 18 bp, Homo sapiens
ttacagtaaataaattgt

SEQ ID NO: 4177365 - DNA, 18 bp, Homo sapiens
ttacagtgaatttctgat

SEQ ID NO: 4177366 - DNA, 12 bp, Homo sapiens
ttacatataata

SEQ ID NO: 4177367 - DNA, 13 bp, Homo sapiens
ttacatccttaaa

SEQ ID NO: 4177368 - DNA, 14 bp, Homo sapiens
ttacatgaacacag

SEQ ID NO: 4177369 - DNA, 23 bp, Homo sapiens
ttacatgcaatttattaaaatga

SEQ ID NO: 4177370 - DNA, 16 bp, Homo sapiens
ttaccaaaaaagtatt

SEQ ID NO: 4177371 - DNA, 14 bp, Homo sapiens
ttaccaactttctg

SEQ ID NO: 4177372 - DNA, 15 bp, Homo sapiens
ttaccaactttctgt

SEQ ID NO: 4177373 - DNA, 23 bp, Homo sapiens
ttaccaggcaccaaaagaagtaa

SEQ ID NO: 4177374 - DNA, 12 bp, Homo sapiens
ttacctgccaat

SEQ ID NO: 4177375 - DNA, 20 bp, Homo sapiens
ttacctgccaattgctaccg

SEQ ID NO: 4177376 - DNA, 12 bp, Homo sapiens
ttacgtgagcca

SEQ ID NO: 4177377 - DNA, 12 bp, Homo sapiens
ttactaaaagaa

SEQ ID NO: 4177378 - DNA, 21 bp, Homo sapiens
ttactaagccacaagaaattt

SEQ ID NO: 4177379 - DNA, 15 bp, Homo sapiens
ttactataagaactt

SEQ ID NO: 4177380 - DNA, 20 bp, Homo sapiens
ttactatgccacagattgtt

SEQ ID NO: 4177381 - DNA, 16 bp, Homo sapiens
ttactgattaacaaat

SEQ ID NO: 4177382 - DNA, 17 bp, Homo sapiens
ttactggtgatttctga

SEQ ID NO: 4177383 - DNA, 22 bp, Homo sapiens
ttactgtctggttttaacaatt

SEQ ID NO: 4177384 - DNA, 13 bp, Homo sapiens
ttactgtgtgaag

SEQ ID NO: 4177385 - DNA, 14 bp, Homo sapiens
ttactgtgtgaaga

SEQ ID NO: 4177386 - DNA, 17 bp, Homo sapiens
ttactgtttttgctatt

SEQ ID NO: 4177387 - DNA, 14 bp, Homo sapiens
ttagaaaactttaa

SEQ ID NO: 4177388 - DNA, 16 bp, Homo sapiens
ttagaaaactttaaag

SEQ ID NO: 4177389 - DNA, 13 bp, Homo sapiens
ttagaaatcattt

SEQ ID NO: 4177390 - DNA, 14 bp, Homo sapiens
ttagaataaaattg

SEQ ID NO: 4177391 - DNA, 16 bp, Homo sapiens
ttagacactgggagaa

SEQ ID NO: 4177392 - DNA, 23 bp, Homo sapiens
ttagacactgggagaagagaacc

SEQ ID NO: 4177393 - DNA, 16 bp, Homo sapiens
ttagactagttgaaca

SEQ ID NO: 4177394 - DNA, 19 bp, Homo sapiens
ttagagaatatatttttga

SEQ ID NO: 4177395 - DNA, 21 bp, Homo sapiens
ttagagaggtagcgagctgct

SEQ ID NO: 4177396 - DNA, 16 bp, Homo sapiens
ttagaggtttgtcaac

SEQ ID NO: 4177397 - DNA, 14 bp, Homo sapiens
ttagagtcagcctt

SEQ ID NO: 4177398 - DNA, 18 bp, Homo sapiens
ttataggatttatttaaa

SEQ ID NO: 4177399 - DNA, 12 bp, Homo sapiens
ttatagtttgta

SEQ ID NO: 4177400 - DNA, 16 bp, Homo sapiens
ttatatcttatatata

SEQ ID NO: 4177401 - DNA, 19 bp, Homo sapiens
ttatatcttatatataata

SEQ ID NO: 4177402 - DNA, 17 bp, Homo sapiens
ttatatttagttatagt

SEQ ID NO: 4177403 - DNA, 13 bp, Homo sapiens
ttatatttggaaa

SEQ ID NO: 4177404 - DNA, 19 bp, Homo sapiens
ttatatttggaaagagacc

SEQ ID NO: 4177405 - DNA, 18 bp, Homo sapiens
ttatcaaacttgtgctga

SEQ ID NO: 4177406 - DNA, 12 bp, Homo sapiens
ttatcccagctt

SEQ ID NO: 4177407 - DNA, 15 bp, Homo sapiens
ttatcccttggtaat

SEQ ID NO: 4177408 - DNA, 23 bp, Homo sapiens
ttatcctgagcagtgtacactgt

SEQ ID NO: 4177409 - DNA, 21 bp, Homo sapiens
ttatctgaatttttaaacaag

SEQ ID NO: 4177410 - DNA, 20 bp, Homo sapiens
ttatctgtattttttacagt

SEQ ID NO: 4177411 - DNA, 17 bp, Homo sapiens
ttatcttctagccacag

SEQ ID NO: 4177412 - DNA, 14 bp, Homo sapiens
ttatgaaaaagaag

SEQ ID NO: 4177413 - DNA, 17 bp, Homo sapiens
ttatgaaaaagaagaat

SEQ ID NO: 4177414 - DNA, 21 bp, Homo sapiens
ttatgagatgatgaaaataat

SEQ ID NO: 4177415 - DNA, 21 bp, Homo sapiens
ttatgtatatactatacaaca

SEQ ID NO: 4177416 - DNA, 17 bp, Homo sapiens
ttatgtatatagatgtg

SEQ ID NO: 4177417 - DNA, 12 bp, Homo sapiens
ttatgtgaaaga

SEQ ID NO: 4177418 - DNA, 16 bp, Homo sapiens
ttattaacaattaggc

SEQ ID NO: 4177419 - DNA, 19 bp, Homo sapiens
ttattaacaattaggcaga

SEQ ID NO: 4177420 - DNA, 19 bp, Homo sapiens
ttattaagaatcattgtgc

SEQ ID NO: 4177421 - DNA, 18 bp, Homo sapiens
ttattaattttcaggatt

SEQ ID NO: 4177422 - DNA, 21 bp, Homo sapiens
ttattcatgctttctcctttt

SEQ ID NO: 4177423 - DNA, 18 bp, Homo sapiens
ttattgatttttgtaata

SEQ ID NO: 4177424 - DNA, 16 bp, Homo sapiens
ttattgtctgtctaca

SEQ ID NO: 4177425 - DNA, 22 bp, Homo sapiens
ttattgtctgtctacatttctg

SEQ ID NO: 4177426 - DNA, 15 bp, Homo sapiens
ttatttaaaatagca

SEQ ID NO: 4177427 - DNA, 16 bp, Homo sapiens
ttatttaaaatagcaa

SEQ ID NO: 4177428 - DNA, 13 bp, Homo sapiens
ttatttaataaga

SEQ ID NO: 4177429 - DNA, 17 bp, Homo sapiens
ttatttccaaataaaat

SEQ ID NO: 4177430 - DNA, 16 bp, Homo sapiens
ttatttgtaatagatg

SEQ ID NO: 4177431 - DNA, 17 bp, Homo sapiens
ttatttgtaatagatgt

SEQ ID NO: 4177432 - DNA, 14 bp, Homo sapiens
ttatttgtacagtt

SEQ ID NO: 4177433 - DNA, 13 bp, Homo sapiens
ttatttgtgtaat

SEQ ID NO: 4177434 - DNA, 16 bp, Homo sapiens
ttatttgtgtaataga

SEQ ID NO: 4177435 - DNA, 16 bp, Homo sapiens
ttattttaaacaaaat

SEQ ID NO: 4177436 - DNA, 23 bp, Homo sapiens
ttattttgccatggatgagagtc

SEQ ID NO: 4177437 - DNA, 19 bp, Homo sapiens
ttattttgttacactaaag

SEQ ID NO: 4177438 - DNA, 20 bp, Homo sapiens
ttattttgtttaagtggctt

SEQ ID NO: 4177439 - DNA, 11 bp, Homo sapiens
ttatttttgaa

SEQ ID NO: 4177440 - DNA, 14 bp, Homo sapiens
ttcaaaaataaaag

SEQ ID NO: 4177441 - DNA, 11 bp, Homo sapiens
ttcaaaataaa

SEQ ID NO: 4177442 - DNA, 16 bp, Homo sapiens
ttcaaaccaggatttt

SEQ ID NO: 4177443 - DNA, 16 bp, Homo sapiens
ttcaaatgaacacgtg

SEQ ID NO: 4177444 - DNA, 16 bp, Homo sapiens
ttcaaatgtcagttca

SEQ ID NO: 4177445 - DNA, 18 bp, Homo sapiens
ttcaacaattctaaaatg

SEQ ID NO: 4177446 - DNA, 16 bp, Homo sapiens
ttcaacagtgaagaca

SEQ ID NO: 4177447 - DNA, 20 bp, Homo sapiens
ttcaacgttggtatgataat

SEQ ID NO: 4177448 - DNA, 16 bp, Homo sapiens
ttcaaggaaaaatgct

SEQ ID NO: 4177449 - DNA, 20 bp, Homo sapiens
ttcaaggaaaaatgctgctt

SEQ ID NO: 4177450 - DNA, 17 bp, Homo sapiens
ttcaaggtggccaaatt

SEQ ID NO: 4177451 - DNA, 22 bp, Homo sapiens
ttcaaggtggccaaattatttg

SEQ ID NO: 4177452 - DNA, 23 bp, Homo sapiens
ttcaagtgcctagactgttactt

SEQ ID NO: 4177453 - DNA, 13 bp, Homo sapiens
ttcaataaagctg

SEQ ID NO: 4177454 - DNA, 13 bp, Homo sapiens
ttcacagcccaga

SEQ ID NO: 4177455 - DNA, 15 bp, Homo sapiens
ttcacattagaagac

SEQ ID NO: 4177456 - DNA, 14 bp, Homo sapiens
ttcactcagccaca

SEQ ID NO: 4177457 - DNA, 19 bp, Homo sapiens
ttcactcagccacacccca

SEQ ID NO: 4177458 - DNA, 24 bp, Homo sapiens
ttcactccggtgtgcctgcagccc

SEQ ID NO: 4177459 - DNA, 20 bp, Homo sapiens
ttcactgtaagactcattcc

SEQ ID NO: 4177460 - DNA, 20 bp, Homo sapiens
ttcagaagtttggcaatagt

SEQ ID NO: 4177461 - DNA, 15 bp, Homo sapiens
ttcagacgagatcct

SEQ ID NO: 4177462 - DNA, 16 bp, Homo sapiens
ttcagaggaagcacat

SEQ ID NO: 4177463 - DNA, 18 bp, Homo sapiens
ttcagcagcatctactct

SEQ ID NO: 4177464 - DNA, 21 bp, Homo sapiens
ttcagccagaatcttcgtcct

SEQ ID NO: 4177465 - DNA, 18 bp, Homo sapiens
ttcagggaatttcaggaa

SEQ ID NO: 4177466 - DNA, 16 bp, Homo sapiens
ttcaggtccaggccag

SEQ ID NO: 4177467 - DNA, 21 bp, Homo sapiens
ttcagtaggtttgtgtggatg

SEQ ID NO: 4177468 - DNA, 19 bp, Homo sapiens
ttcagtattttggagaaat

SEQ ID NO: 4177469 - DNA, 19 bp, Homo sapiens
ttcagtgctgtggcctggg

SEQ ID NO: 4177470 - DNA, 17 bp, Homo sapiens
ttcagttcccgctctgc

SEQ ID NO: 4177471 - DNA, 18 bp, Homo sapiens
ttcagttcccgctctgca

SEQ ID NO: 4177472 - DNA, 17 bp, Homo sapiens
ttcagttcctctttgca

SEQ ID NO: 4177473 - DNA, 19 bp, Homo sapiens
ttcataactggtagctata

SEQ ID NO: 4177474 - DNA, 18 bp, Homo sapiens
ttcatctgttgttttgtt

SEQ ID NO: 4177475 - DNA, 22 bp, Homo sapiens
ttcatgaaaatagctctttcag

SEQ ID NO: 4177476 - DNA, 15 bp, Homo sapiens
ttcatgataatgaac

SEQ ID NO: 4177477 - DNA, 16 bp, Homo sapiens
ttccaaacctggttca

SEQ ID NO: 4177478 - DNA, 15 bp, Homo sapiens
ttccaaataaaatga

SEQ ID NO: 4177479 - DNA, 21 bp, Homo sapiens
ttccaaataaggatttgttca

SEQ ID NO: 4177480 - DNA, 17 bp, Homo sapiens
ttccaaatgaatgttgt

SEQ ID NO: 4177481 - DNA, 19 bp, Homo sapiens
ttccaactcgtatagcatg

SEQ ID NO: 4177482 - DNA, 17 bp, Homo sapiens
ttccaacttggctgcag

SEQ ID NO: 4177483 - DNA, 22 bp, Homo sapiens
ttccaacttggctgcaggaatc

SEQ ID NO: 4177484 - DNA, 16 bp, Homo sapiens
ttccaaggagttccat

SEQ ID NO: 4177485 - DNA, 13 bp, Homo sapiens
ttccaccctggaa

SEQ ID NO: 4177486 - DNA, 17 bp, Homo sapiens
ttccaggtatctccagg

SEQ ID NO: 4177487 - DNA, 18 bp, Homo sapiens
ttccaggtatctccagga

SEQ ID NO: 4177488 - DNA, 16 bp, Homo sapiens
ttccaggtggcaggat

SEQ ID NO: 4177489 - DNA, 14 bp, Homo sapiens
ttccatatgctcca

SEQ ID NO: 4177490 - DNA, 16 bp, Homo sapiens
ttccatatgctccagg

SEQ ID NO: 4177491 - DNA, 15 bp, Homo sapiens
ttccatccccaaact

SEQ ID NO: 4177492 - DNA, 18 bp, Homo sapiens
ttccatgaagaccacatc

SEQ ID NO: 4177493 - DNA, 20 bp, Homo sapiens
ttccatgaagtttgaacttc

SEQ ID NO: 4177494 - DNA, 14 bp, Homo sapiens
ttccatggctctgt

SEQ ID NO: 4177495 - DNA, 22 bp, Homo sapiens
ttcccaaaatgttgaaatatga

SEQ ID NO: 4177496 - DNA, 15 bp, Homo sapiens
ttcccaacctcccct

SEQ ID NO: 4177497 - DNA, 21 bp, Homo sapiens
ttcccaacctcccctggtcct

SEQ ID NO: 4177498 - DNA, 21 bp, Homo sapiens
ttcccagagtgtgaaacttcc

SEQ ID NO: 4177499 - DNA, 11 bp, Homo sapiens
ttcccatctgc

SEQ ID NO: 4177500 - DNA, 21 bp, Homo sapiens
ttccccacctcttccttccgc

SEQ ID NO: 4177501 - DNA, 19 bp, Homo sapiens
ttccccagactcagctcca

SEQ ID NO: 4177502 - DNA, 22 bp, Homo sapiens
ttccccagactcagctccagaa

SEQ ID NO: 4177503 - DNA, 19 bp, Homo sapiens
ttccccatctcaggccaga

SEQ ID NO: 4177504 - DNA, 15 bp, Homo sapiens
ttccccctcccaggg

SEQ ID NO: 4177505 - DNA, 17 bp, Homo sapiens
ttcccctttccccactc

SEQ ID NO: 4177506 - DNA, 21 bp, Homo sapiens
ttcccgagcaaagtctaaagt

SEQ ID NO: 4177507 - DNA, 23 bp, Homo sapiens
ttcccgagcaaagtctaaagttt

SEQ ID NO: 4177508 - DNA, 22 bp, Homo sapiens
ttccctctgagaattccaagga

SEQ ID NO: 4177509 - DNA, 20 bp, Homo sapiens
ttccctctttccccacctct

SEQ ID NO: 4177510 - DNA, 15 bp, Homo sapiens
ttccctgacactgtc

SEQ ID NO: 4177511 - DNA, 11 bp, Homo sapiens
ttccctgtgct

SEQ ID NO: 4177512 - DNA, 16 bp, Homo sapiens
ttccctgttttaaatt

SEQ ID NO: 4177513 - DNA, 17 bp, Homo sapiens
ttccctttaaagccttt

SEQ ID NO: 4177514 - DNA, 15 bp, Homo sapiens
ttccgctcctttacc

SEQ ID NO: 4177515 - DNA, 16 bp, Homo sapiens
ttccgctcctttacct

SEQ ID NO: 4177516 - DNA, 17 bp, Homo sapiens
ttcctaagtataaatgg

SEQ ID NO: 4177517 - DNA, 15 bp, Homo sapiens
ttcctacaaaatgga

SEQ ID NO: 4177518 - DNA, 23 bp, Homo sapiens
ttcctcatcaccatcgtgtttgc

SEQ ID NO: 4177519 - DNA, 21 bp, Homo sapiens
ttcctccccattagagtcagc

SEQ ID NO: 4177520 - DNA, 12 bp, Homo sapiens
ttcctccctgga

SEQ ID NO: 4177521 - DNA, 17 bp, Homo sapiens
ttcctcctgtgtacagg

SEQ ID NO: 4177522 - DNA, 19 bp, Homo sapiens
ttcctcgtgcagagctggg

SEQ ID NO: 4177523 - DNA, 19 bp, Homo sapiens
ttcctctgcaaaaagattt

SEQ ID NO: 4177524 - DNA, 18 bp, Homo sapiens
ttcctcttataacttctg

SEQ ID NO: 4177525 - DNA, 19 bp, Homo sapiens
ttcctgatggtacaggaaa

SEQ ID NO: 4177526 - DNA, 13 bp, Homo sapiens
ttcctgcactcca

SEQ ID NO: 4177527 - DNA, 14 bp, Homo sapiens
ttcctgcactccag

SEQ ID NO: 4177528 - DNA, 15 bp, Homo sapiens
ttcctgcactccaga

SEQ ID NO: 4177529 - DNA, 17 bp, Homo sapiens
ttcctgcactccagaat

SEQ ID NO: 4177530 - DNA, 16 bp, Homo sapiens
ttcctggccctccact

SEQ ID NO: 4177531 - DNA, 14 bp, Homo sapiens
ttcctggtccctca

SEQ ID NO: 4177532 - DNA, 13 bp, Homo sapiens
ttcctggtttgta

SEQ ID NO: 4177533 - DNA, 13 bp, Homo sapiens
ttccttctggagg

SEQ ID NO: 4177534 - DNA, 20 bp, Homo sapiens
ttccttgctgtcctaggcca

SEQ ID NO: 4177535 - DNA, 10 bp, Homo sapiens
ttcctttcct

SEQ ID NO: 4177536 - DNA, 21 bp, Homo sapiens
ttcctttcctctgcagcactt

SEQ ID NO: 4177537 - DNA, 12 bp, Homo sapiens
aaaaaaaataca

SEQ ID NO: 4177538 - DNA, 20 bp, Homo sapiens
aaaaaagtttacaagtgtat

SEQ ID NO: 4177539 - DNA, 22 bp, Homo sapiens
aaaaaatttgagaaagccttca

SEQ ID NO: 4177540 - DNA, 13 bp, Homo sapiens
aaaaacaaaacaa

SEQ ID NO: 4177541 - DNA, 16 bp, Homo sapiens
aaaaacacggcagctg

SEQ ID NO: 4177542 - DNA, 14 bp, Homo sapiens
aaaaactaaaaact

SEQ ID NO: 4177543 - DNA, 11 bp, Homo sapiens
aaaaagaaaaa

SEQ ID NO: 4177544 - DNA, 19 bp, Homo sapiens
aaaaagacatggaaggtta

SEQ ID NO: 4177545 - DNA, 15 bp, Homo sapiens
aaaaagctctttcat

SEQ ID NO: 4177546 - DNA, 20 bp, Homo sapiens
aaaaagtcagactgctggga

SEQ ID NO: 4177547 - DNA, 14 bp, Homo sapiens
aaaaataagaagaa

SEQ ID NO: 4177548 - DNA, 23 bp, Homo sapiens
aaaaatactatgaaatgaaagaa

SEQ ID NO: 4177549 - DNA, 14 bp, Homo sapiens
aaaaatactcagat

SEQ ID NO: 4177550 - DNA, 20 bp, Homo sapiens
aaaaatatggaacttctaat

SEQ ID NO: 4177551 - DNA, 14 bp, Homo sapiens
aaaaatgaaattat

SEQ ID NO: 4177552 - DNA, 12 bp, Homo sapiens
aaaaatgagttt

SEQ ID NO: 4177553 - DNA, 20 bp, Homo sapiens
aaaaatgctgcttctcctcc

SEQ ID NO: 4177554 - DNA, 23 bp, Homo sapiens
aaaaatggaaacatttattcctt

SEQ ID NO: 4177555 - DNA, 19 bp, Homo sapiens
aaaaatgtagaatgatttt

SEQ ID NO: 4177556 - DNA, 12 bp, Homo sapiens
aaaacaaaacaa

SEQ ID NO: 4177557 - DNA, 23 bp, Homo sapiens
aaaacaaagtctgggaaattcta

SEQ ID NO: 4177558 - DNA, 11 bp, Homo sapiens
aaaacatgaaa

SEQ ID NO: 4177559 - DNA, 22 bp, Homo sapiens
aaaacatttattttgacataaa

SEQ ID NO: 4177560 - DNA, 16 bp, Homo sapiens
aaaaccacagaacagt

SEQ ID NO: 4177561 - DNA, 18 bp, Homo sapiens
aaaaccctgctttttgac

SEQ ID NO: 4177562 - DNA, 14 bp, Homo sapiens
aaaacctggagtgc

SEQ ID NO: 4177563 - DNA, 17 bp, Homo sapiens
aaaacgcaaagggctga

SEQ ID NO: 4177564 - DNA, 13 bp, Homo sapiens
aaaacgtgggtat

SEQ ID NO: 4177565 - DNA, 21 bp, Homo sapiens
aaaacgttgacccctttcccc

SEQ ID NO: 4177566 - DNA, 13 bp, Homo sapiens
aaaactaaaaact

SEQ ID NO: 4177567 - DNA, 18 bp, Homo sapiens
aaaactaaatctctaata

SEQ ID NO: 4177568 - DNA, 19 bp, Homo sapiens
aaaactgaaaatctaatat

SEQ ID NO: 4177569 - DNA, 19 bp, Homo sapiens
aaaacttaacatatttact

SEQ ID NO: 4177570 - DNA, 15 bp, Homo sapiens
aaaacttatttgagt

SEQ ID NO: 4177571 - DNA, 11 bp, Homo sapiens
aaaagaaaacc

SEQ ID NO: 4177572 - DNA, 20 bp, Homo sapiens
aaaagaaaaccattttagtt

SEQ ID NO: 4177573 - DNA, 13 bp, Homo sapiens
aaaagacatggaa

SEQ ID NO: 4177574 - DNA, 13 bp, Homo sapiens
aaaagaccaatag

SEQ ID NO: 4177575 - DNA, 20 bp, Homo sapiens
aaaagaccacagacttctgg

SEQ ID NO: 4177576 - DNA, 16 bp, Homo sapiens
aaaagagtcagccctt

SEQ ID NO: 4177577 - DNA, 17 bp, Homo sapiens
aaaagatttgttttgtc

SEQ ID NO: 4177578 - DNA, 14 bp, Homo sapiens
aaaagcaaatgaga

SEQ ID NO: 4177579 - DNA, 14 bp, Homo sapiens
aaaagctcatattt

SEQ ID NO: 4177580 - DNA, 18 bp, Homo sapiens
aaaagctcatattttgta

SEQ ID NO: 4177581 - DNA, 20 bp, Homo sapiens
aaaagctcttacactacatt

SEQ ID NO: 4177582 - DNA, 19 bp, Homo sapiens
aaaagggaagttgtgcctt

SEQ ID NO: 4177583 - DNA, 18 bp, Homo sapiens
aaaaggtttacagaattt

SEQ ID NO: 4177584 - DNA, 19 bp, Homo sapiens
aaaaggtttatgaaaaaga

SEQ ID NO: 4177585 - DNA, 23 bp, Homo sapiens
aaaaggtttatgaaaaagaagaa

SEQ ID NO: 4177586 - DNA, 22 bp, Homo sapiens
aaaagtaagtaccactcaggcc

SEQ ID NO: 4177587 - DNA, 23 bp, Homo sapiens
aaaagtaagtaccactcaggcca

SEQ ID NO: 4177588 - DNA, 16 bp, Homo sapiens
aaaagtactgaagacc

SEQ ID NO: 4177589 - DNA, 22 bp, Homo sapiens
aaaagtttacaagtgtatatca

SEQ ID NO: 4177590 - DNA, 15 bp, Homo sapiens
aaaatagaagctgta

SEQ ID NO: 4177591 - DNA, 12 bp, Homo sapiens
aaaatagcttgt

SEQ ID NO: 4177592 - DNA, 21 bp, Homo sapiens
aaaatagcttgtatagtgtaa

SEQ ID NO: 4177593 - DNA, 20 bp, Homo sapiens
aaaatatggaacttctaata

SEQ ID NO: 4177594 - DNA, 21 bp, Homo sapiens
aaaatatggaacttctaatat

SEQ ID NO: 4177595 - DNA, 18 bp, Homo sapiens
aaaatcaaagaaaacata

SEQ ID NO: 4177596 - DNA, 21 bp, Homo sapiens
aaaatcaggtggcttttgcgg

SEQ ID NO: 4177597 - DNA, 17 bp, Homo sapiens
aaaatccctatttaatt

SEQ ID NO: 4177598 - DNA, 22 bp, Homo sapiens
aaaatccctatttaattttcct

SEQ ID NO: 4177599 - DNA, 12 bp, Homo sapiens
aaaatctttcag

SEQ ID NO: 4177600 - DNA, 15 bp, Homo sapiens
aaaatgaaatgtttt

SEQ ID NO: 4177601 - DNA, 22 bp, Homo sapiens
aaaatgaaatgtttttgctata

SEQ ID NO: 4177602 - DNA, 19 bp, Homo sapiens
aaaatgattgtaaaatagc

SEQ ID NO: 4177603 - DNA, 15 bp, Homo sapiens
aaaatggaaatgtaa

SEQ ID NO: 4177604 - DNA, 16 bp, Homo sapiens
aaaatgtgacccagat

SEQ ID NO: 4177605 - DNA, 18 bp, Homo sapiens
aaaatgttcgtattctat

SEQ ID NO: 4177606 - DNA, 17 bp, Homo sapiens
aaaattattttaaacaa

SEQ ID NO: 4177607 - DNA, 15 bp, Homo sapiens
aaaattgtaaaattg

SEQ ID NO: 4177608 - DNA, 13 bp, Homo sapiens
aaaattgtataga

SEQ ID NO: 4177609 - DNA, 16 bp, Homo sapiens
aaaattgtatagagat

SEQ ID NO: 4177610 - DNA, 16 bp, Homo sapiens
aaacaaaacaaaacaa

SEQ ID NO: 4177611 - DNA, 14 bp, Homo sapiens
aaacaaaacaacaa

SEQ ID NO: 4177612 - DNA, 20 bp, Homo sapiens
aaacaaactcgttttttaca

SEQ ID NO: 4177613 - DNA, 19 bp, Homo sapiens
aaacaaatgaattgtattt

SEQ ID NO: 4177614 - DNA, 12 bp, Homo sapiens
aaacaacaaaaa

SEQ ID NO: 4177615 - DNA, 21 bp, Homo sapiens
aaacaacaaaaacttagaatt

SEQ ID NO: 4177616 - DNA, 15 bp, Homo sapiens
aaacaacaacaatac

SEQ ID NO: 4177617 - DNA, 21 bp, Homo sapiens
aaacaacaacaatacaacaag

SEQ ID NO: 4177618 - DNA, 12 bp, Homo sapiens
aaacaagtattt

SEQ ID NO: 4177619 - DNA, 14 bp, Homo sapiens
aaacaatgtttaaa

SEQ ID NO: 4177620 - DNA, 18 bp, Homo sapiens
aaacaattattgtacact

SEQ ID NO: 4177621 - DNA, 20 bp, Homo sapiens
aaacacaaatgtaaaataag

SEQ ID NO: 4177622 - DNA, 19 bp, Homo sapiens
aacctagaacttcaaaatg

SEQ ID NO: 4177623 - DNA, 20 bp, Homo sapiens
aacctagaacttcaaaatgt

SEQ ID NO: 4177624 - DNA, 22 bp, Homo sapiens
aacctatttcttaaacacttgc

SEQ ID NO: 4177625 - DNA, 14 bp, Homo sapiens
aacctcagggacaa

SEQ ID NO: 4177626 - DNA, 17 bp, Homo sapiens
aacctcccctggtcctg

SEQ ID NO: 4177627 - DNA, 15 bp, Homo sapiens
aacctcttcagctgg

SEQ ID NO: 4177628 - DNA, 21 bp, Homo sapiens
aacctgaaaaaaagtttacaa

SEQ ID NO: 4177629 - DNA, 14 bp, Homo sapiens
aacctgcctgtgca

SEQ ID NO: 4177630 - DNA, 17 bp, Homo sapiens
aacctggaaaataaatc

SEQ ID NO: 4177631 - DNA, 14 bp, Homo sapiens
aacctggagatgat

SEQ ID NO: 4177632 - DNA, 21 bp, Homo sapiens
aacctggcatggtgctttcag

SEQ ID NO: 4177633 - DNA, 19 bp, Homo sapiens
aacctgggttgcagacagg

SEQ ID NO: 4177634 - DNA, 20 bp, Homo sapiens
aacctgggttgcagacagga

SEQ ID NO: 4177635 - DNA, 22 bp, Homo sapiens
aacctggttcatatttatactt

SEQ ID NO: 4177636 - DNA, 13 bp, Homo sapiens
aaccttctctatg

SEQ ID NO: 4177637 - DNA, 18 bp, Homo sapiens
aacctttcaaatttcaca

SEQ ID NO: 4177638 - DNA, 18 bp, Homo sapiens
aacctttcttcaccaaat

SEQ ID NO: 4177639 - DNA, 23 bp, Homo sapiens
aacgacaaagccaaactctgcca

SEQ ID NO: 4177640 - DNA, 18 bp, Homo sapiens
aacgcaaagggctgaaag

SEQ ID NO: 4177641 - DNA, 20 bp, Homo sapiens
aacgcaaagggctgaaagcc

SEQ ID NO: 4177642 - DNA, 14 bp, Homo sapiens
aacggaagaagaga

SEQ ID NO: 4177643 - DNA, 14 bp, Homo sapiens
aacggaagggttgg

SEQ ID NO: 4177644 - DNA, 21 bp, Homo sapiens
aacgtaatgattatatgacaa

SEQ ID NO: 4177645 - DNA, 14 bp, Homo sapiens
aacgtgataaatat

SEQ ID NO: 4177646 - DNA, 18 bp, Homo sapiens
aacgtgggtatttcctgc

SEQ ID NO: 4177647 - DNA, 22 bp, Homo sapiens
aacgtgggtatttcctgctaca

SEQ ID NO: 4177648 - DNA, 12 bp, Homo sapiens
aacgttgacccc

SEQ ID NO: 4177649 - DNA, 18 bp, Homo sapiens
aacgttgacccctttccc

SEQ ID NO: 4177650 - DNA, 18 bp, Homo sapiens
aactagtatctctggcct

SEQ ID NO: 4177651 - DNA, 13 bp, Homo sapiens
aactagtttaatt

SEQ ID NO: 4177652 - DNA, 13 bp, Homo sapiens
aactatattttct

SEQ ID NO: 4177653 - DNA, 13 bp, Homo sapiens
aactatgtgatgt

SEQ ID NO: 4177654 - DNA, 22 bp, Homo sapiens
aactattattaataaattttaa

SEQ ID NO: 4177655 - DNA, 23 bp, Homo sapiens
aactattattaataaattttaac

SEQ ID NO: 4177656 - DNA, 12 bp, Homo sapiens
aactattgaatt

SEQ ID NO: 4177657 - DNA, 13 bp, Homo sapiens
aactattgaattg

SEQ ID NO: 4177658 - DNA, 19 bp, Homo sapiens
aactcaaaacttaacatat

SEQ ID NO: 4177659 - DNA, 22 bp, Homo sapiens
aactcacgatgaaattgaacct

SEQ ID NO: 4177660 - DNA, 22 bp, Homo sapiens
aactcacttttttacaactcca

SEQ ID NO: 4177661 - DNA, 13 bp, Homo sapiens
aactcaggatgcc

SEQ ID NO: 4177662 - DNA, 18 bp, Homo sapiens
aactcctttagcaggtgg

SEQ ID NO: 4177663 - DNA, 19 bp, Homo sapiens
aactctacaccctctgccc

SEQ ID NO: 4177664 - DNA, 16 bp, Homo sapiens
aactctggcttccagg

SEQ ID NO: 4177665 - DNA, 14 bp, Homo sapiens
aactcttctggaaa

SEQ ID NO: 4177666 - DNA, 13 bp, Homo sapiens
aactcttggcctc

SEQ ID NO: 4177667 - DNA, 20 bp, Homo sapiens
aactcttggcctctgctttc

SEQ ID NO: 4177668 - DNA, 12 bp, Homo sapiens
aactgaaaatta

SEQ ID NO: 4177669 - DNA, 17 bp, Homo sapiens
aactgaagacctccaca

SEQ ID NO: 4177670 - DNA, 20 bp, Homo sapiens
aactgaagacctccacatta

SEQ ID NO: 4177671 - DNA, 19 bp, Homo sapiens
aactgctgatcaatgaaat

SEQ ID NO: 4177672 - DNA, 18 bp, Homo sapiens
aactgggtaatgaaacaa

SEQ ID NO: 4177673 - DNA, 19 bp, Homo sapiens
aactggtcaccatgaaact

SEQ ID NO: 4177674 - DNA, 22 bp, Homo sapiens
aactggttcaagagacactgct

SEQ ID NO: 4177675 - DNA, 13 bp, Homo sapiens
aactgtacaaatg

SEQ ID NO: 4177676 - DNA, 16 bp, Homo sapiens
aactgtgaacctggag

SEQ ID NO: 4177677 - DNA, 23 bp, Homo sapiens
aactgttacaacttgtatttcca

SEQ ID NO: 4177678 - DNA, 14 bp, Homo sapiens
aacttaacatattt

SEQ ID NO: 4177679 - DNA, 21 bp, Homo sapiens
aacttaccaggcaccaaaaga

SEQ ID NO: 4177680 - DNA, 16 bp, Homo sapiens
aacttagaataaaatt

SEQ ID NO: 4177681 - DNA, 14 bp, Homo sapiens
aacttctaatatat

SEQ ID NO: 4177682 - DNA, 16 bp, Homo sapiens
aacttctaatatattt

SEQ ID NO: 4177683 - DNA, 19 bp, Homo sapiens
aacttctatgtttatcttt

SEQ ID NO: 4177684 - DNA, 13 bp, Homo sapiens
aacttctttgaag

SEQ ID NO: 4177685 - DNA, 15 bp, Homo sapiens
aacttctttgaagtt

SEQ ID NO: 4177686 - DNA, 21 bp, Homo sapiens
aacttgaaatatcctgcttga

SEQ ID NO: 4177687 - DNA, 18 bp, Homo sapiens
aacttgaccctgagctga

SEQ ID NO: 4177688 - DNA, 19 bp, Homo sapiens
aacttgaccctgagctgac

SEQ ID NO: 4177689 - DNA, 17 bp, Homo sapiens
aacttgaggacacatgt

SEQ ID NO: 4177690 - DNA, 16 bp, Homo sapiens
aacttggaaaaagaaa

SEQ ID NO: 4177691 - DNA, 19 bp, Homo sapiens
aacttggaaaaagaaagaa

SEQ ID NO: 4177692 - DNA, 14 bp, Homo sapiens
aacttggtcagagc

SEQ ID NO: 4177693 - DNA, 17 bp, Homo sapiens
aacttggtcagagccac

SEQ ID NO: 4177694 - DNA, 22 bp, Homo sapiens
aacttggttttgctacataatt

SEQ ID NO: 4177695 - DNA, 17 bp, Homo sapiens
aacttgtgctgagaata

SEQ ID NO: 4177696 - DNA, 15 bp, Homo sapiens
aacttgtgttctatt

SEQ ID NO: 4177697 - DNA, 22 bp, Homo sapiens
aactttagagtagcatgagaga

SEQ ID NO: 4177698 - DNA, 20 bp, Homo sapiens
aactttctataacctaaatg

SEQ ID NO: 4177699 - DNA, 12 bp, Homo sapiens
aactttgatctc

SEQ ID NO: 4177700 - DNA, 17 bp, Homo sapiens
aactttgatctctgctt

SEQ ID NO: 4177701 - DNA, 15 bp, Homo sapiens
aagaaaaagaagcaa

SEQ ID NO: 4177702 - DNA, 16 bp, Homo sapiens
aagaaacaaggttttc

SEQ ID NO: 4177703 - DNA, 19 bp, Homo sapiens
aagaaacatcattctacat

SEQ ID NO: 4177704 - DNA, 22 bp, Homo sapiens
aagaaactagtatctctggcct

SEQ ID NO: 4177705 - DNA, 14 bp, Homo sapiens
aagaaagaacggaa

SEQ ID NO: 4177706 - DNA, 16 bp, Homo sapiens
aagaaagcaaaagcaa

SEQ ID NO: 4177707 - DNA, 17 bp, Homo sapiens
aagaaagtgttaaaact

SEQ ID NO: 4177708 - DNA, 15 bp, Homo sapiens
aagaaataagttttt

SEQ ID NO: 4177709 - DNA, 22 bp, Homo sapiens
aagaaccaaaagttttcctgag

SEQ ID NO: 4177710 - DNA, 13 bp, Homo sapiens
aagaactgcccca

SEQ ID NO: 4177711 - DNA, 18 bp, Homo sapiens
aagaactgccccatctcc

SEQ ID NO: 4177712 - DNA, 13 bp, Homo sapiens
aagaactttgagc

SEQ ID NO: 4177713 - DNA, 13 bp, Homo sapiens
aagaagaaagcaa

SEQ ID NO: 4177714 - DNA, 11 bp, Homo sapiens
aagaagagaca

SEQ ID NO: 4177715 - DNA, 14 bp, Homo sapiens
aagaagagacagga

SEQ ID NO: 4177716 - DNA, 21 bp, Homo sapiens
aagaagcaacctcagtaattt

SEQ ID NO: 4177717 - DNA, 14 bp, Homo sapiens
aagaaggagagcaa

SEQ ID NO: 4177718 - DNA, 16 bp, Homo sapiens
aagaaggagagcaaga

SEQ ID NO: 4177719 - DNA, 15 bp, Homo sapiens
aagaaggcaaaaata

SEQ ID NO: 4177720 - DNA, 15 bp, Homo sapiens
aagaagggaagcttt

SEQ ID NO: 4177721 - DNA, 15 bp, Homo sapiens
aagaagtttcatcat

SEQ ID NO: 4177722 - DNA, 12 bp, Homo sapiens
aagaatctcatc

SEQ ID NO: 4177723 - DNA, 13 bp, Homo sapiens
aagaatgcttaat

SEQ ID NO: 4177724 - DNA, 14 bp, Homo sapiens
aagacacaggaaga

SEQ ID NO: 4177725 - DNA, 16 bp, Homo sapiens
aagacacaggaagaat

SEQ ID NO: 4177726 - DNA, 14 bp, Homo sapiens
aagacacaggctca

SEQ ID NO: 4177727 - DNA, 16 bp, Homo sapiens
aagacagaagtttgca

SEQ ID NO: 4177728 - DNA, 14 bp, Homo sapiens
aagacagagcctcc

SEQ ID NO: 4177729 - DNA, 15 bp, Homo sapiens
aagacaggctgagct

SEQ ID NO: 4177730 - DNA, 20 bp, Homo sapiens
aagacatcacatccctctcc

SEQ ID NO: 4177731 - DNA, 21 bp, Homo sapiens
aagacatcacatccctctcct

SEQ ID NO: 4177732 - DNA, 18 bp, Homo sapiens
aagacatgaatgcacact

SEQ ID NO: 4177733 - DNA, 20 bp, Homo sapiens
aagacatggaaggttagagg

SEQ ID NO: 4177734 - DNA, 23 bp, Homo sapiens
aagacatggaaggttaggtttgt

SEQ ID NO: 4177735 - DNA, 17 bp, Homo sapiens
aagaccacaaaaattga

SEQ ID NO: 4177736 - DNA, 23 bp, Homo sapiens
aagacccaactttctcactgctg

SEQ ID NO: 4177737 - DNA, 17 bp, Homo sapiens
aagacttggcaacagaa

SEQ ID NO: 4177738 - DNA, 23 bp, Homo sapiens
aagagaactttcggagcctgcct

SEQ ID NO: 4177739 - DNA, 22 bp, Homo sapiens
aagagacaggagggcaagggcc

SEQ ID NO: 4177740 - DNA, 13 bp, Homo sapiens
aagagaccagcac

SEQ ID NO: 4177741 - DNA, 16 bp, Homo sapiens
aagagactctggcctc

SEQ ID NO: 4177742 - DNA, 12 bp, Homo sapiens
aagagaggcacc

SEQ ID NO: 4177743 - DNA, 19 bp, Homo sapiens
aagagaggcacctgctgga

SEQ ID NO: 4177744 - DNA, 16 bp, Homo sapiens
aagagatagcagagga

SEQ ID NO: 4177745 - DNA, 17 bp, Homo sapiens
aagagatagcagaggaa

SEQ ID NO: 4177746 - DNA, 13 bp, Homo sapiens
aagagatcagcag

SEQ ID NO: 4177747 - DNA, 19 bp, Homo sapiens
aagagatcagcagtggcag

SEQ ID NO: 4177748 - DNA, 21 bp, Homo sapiens
aagagatcagcagtggcagga

SEQ ID NO: 4177749 - DNA, 15 bp, Homo sapiens
aagagatcaggaaga

SEQ ID NO: 4177750 - DNA, 16 bp, Homo sapiens
aagagatcaggaagag

SEQ ID NO: 4177751 - DNA, 21 bp, Homo sapiens
aagagatttaacactaaaatt

SEQ ID NO: 4177752 - DNA, 18 bp, Homo sapiens
aagagatttcaacatatc

SEQ ID NO: 4177753 - DNA, 13 bp, Homo sapiens
aagagcaaaatga

SEQ ID NO: 4177754 - DNA, 18 bp, Homo sapiens
aagagctacgtatttaat

SEQ ID NO: 4177755 - DNA, 20 bp, Homo sapiens
aagagctacgtatttaatag

SEQ ID NO: 4177756 - DNA, 14 bp, Homo sapiens
aagagctttatata

SEQ ID NO: 4177757 - DNA, 22 bp, Homo sapiens
aatttcaagtttaataaaatag

SEQ ID NO: 4177758 - DNA, 23 bp, Homo sapiens
aatttgaaaacataatctgcaaa

SEQ ID NO: 4177759 - DNA, 14 bp, Homo sapiens
aatttgtaagttta

SEQ ID NO: 4177760 - DNA, 14 bp, Homo sapiens
aatttgtatctgaa

SEQ ID NO: 4177761 - DNA, 14 bp, Homo sapiens
aattttaaataaga

SEQ ID NO: 4177762 - DNA, 14 bp, Homo sapiens
aattttaacatttt

SEQ ID NO: 4177763 - DNA, 19 bp, Homo sapiens
aattttacaattatggaaa

SEQ ID NO: 4177764 - DNA, 15 bp, Homo sapiens
aattttctagacttt

SEQ ID NO: 4177765 - DNA, 18 bp, Homo sapiens
aattttctagactttctg

SEQ ID NO: 4177766 - DNA, 13 bp, Homo sapiens
aatttttaaacaa

SEQ ID NO: 4177767 - DNA, 15 bp, Homo sapiens
aatttttaaacaagt

SEQ ID NO: 4177768 - DNA, 18 bp, Homo sapiens
aatttttataaatatgtg

SEQ ID NO: 4177769 - DNA, 20 bp, Homo sapiens
aatttttcttacacatttta

SEQ ID NO: 4177770 - DNA, 22 bp, Homo sapiens
aatttttttgaaaaaagttcaa

SEQ ID NO: 4177771 - DNA, 20 bp, Homo sapiens
aatttttttgtaaaggaaat

SEQ ID NO: 4177772 - DNA, 17 bp, Homo sapiens
acaaaaagacatggaag

SEQ ID NO: 4177773 - DNA, 22 bp, Homo sapiens
acaaaaatgaaagcatgtctca

SEQ ID NO: 4177774 - DNA, 17 bp, Homo sapiens
acaaaacaaaacaacaa

SEQ ID NO: 4177775 - DNA, 14 bp, Homo sapiens
acaaaacaacaaca

SEQ ID NO: 4177776 - DNA, 18 bp, Homo sapiens
acaaaactctgtcaggca

SEQ ID NO: 4177777 - DNA, 14 bp, Homo sapiens
acaaaactgcattt

SEQ ID NO: 4177778 - DNA, 16 bp, Homo sapiens
acaaaactgcatttca

SEQ ID NO: 4177779 - DNA, 13 bp, Homo sapiens
acaaaacttcctg

SEQ ID NO: 4177780 - DNA, 12 bp, Homo sapiens
acaaaatagaag

SEQ ID NO: 4177781 - DNA, 15 bp, Homo sapiens
acaaaatagaagctg

SEQ ID NO: 4177782 - DNA, 23 bp, Homo sapiens
acaaaccaccctaaaatgacagc

SEQ ID NO: 4177783 - DNA, 21 bp, Homo sapiens
acaaactcgttttttacaaag

SEQ ID NO: 4177784 - DNA, 17 bp, Homo sapiens
acaaactgtaatacaat

SEQ ID NO: 4177785 - DNA, 14 bp, Homo sapiens
acaaagaaggaaat

SEQ ID NO: 4177786 - DNA, 22 bp, Homo sapiens
acaaagagggagttggctggat

SEQ ID NO: 4177787 - DNA, 16 bp, Homo sapiens
acaaagagttcaagaa

SEQ ID NO: 4177788 - DNA, 21 bp, Homo sapiens
acaaagagttcaagaaataag

SEQ ID NO: 4177789 - DNA, 19 bp, Homo sapiens
acaaagccaaactctgcca

SEQ ID NO: 4177790 - DNA, 15 bp, Homo sapiens
acaaagcccttttat

SEQ ID NO: 4177791 - DNA, 23 bp, Homo sapiens
acaaagctaggatggttctgtga

SEQ ID NO: 4177792 - DNA, 15 bp, Homo sapiens
acaaattctacagca

SEQ ID NO: 4177793 - DNA, 20 bp, Homo sapiens
acaaatttcccctctaatta

SEQ ID NO: 4177794 - DNA, 13 bp, Homo sapiens
acaacaaaccaaa

SEQ ID NO: 4177795 - DNA, 22 bp, Homo sapiens
acaacaaaccaaaacagaacaa

SEQ ID NO: 4177796 - DNA, 12 bp, Homo sapiens
acaacaagaaca

SEQ ID NO: 4177797 - DNA, 13 bp, Homo sapiens
acaacaagaacaa

SEQ ID NO: 4177798 - DNA, 13 bp, Homo sapiens
acaacaagagttt

SEQ ID NO: 4177799 - DNA, 12 bp, Homo sapiens
acaacaataaca

SEQ ID NO: 4177800 - DNA, 17 bp, Homo sapiens
acaacaattttaaataa

SEQ ID NO: 4177801 - DNA, 13 bp, Homo sapiens
acaacagaagctt

SEQ ID NO: 4177802 - DNA, 23 bp, Homo sapiens
acaacagttacataattcactct

SEQ ID NO: 4177803 - DNA, 13 bp, Homo sapiens
acaacatatttgg

SEQ ID NO: 4177804 - DNA, 14 bp, Homo sapiens
acaacattgcattg

SEQ ID NO: 4177805 - DNA, 14 bp, Homo sapiens
acaacatttctata

SEQ ID NO: 4177806 - DNA, 18 bp, Homo sapiens
acaacctgcccctcccca

SEQ ID NO: 4177807 - DNA, 15 bp, Homo sapiens
acaactattttcaga

SEQ ID NO: 4177808 - DNA, 23 bp, Homo sapiens
acaagaagggttttccaccctgg

SEQ ID NO: 4177809 - DNA, 19 bp, Homo sapiens
acaagaggttagaaatact

SEQ ID NO: 4177810 - DNA, 22 bp, Homo sapiens
acaagaggttagaaatactttt

SEQ ID NO: 4177811 - DNA, 22 bp, Homo sapiens
acaagagtttatttccaaataa

SEQ ID NO: 4177812 - DNA, 15 bp, Homo sapiens
acaagatctttcagg

SEQ ID NO: 4177813 - DNA, 14 bp, Homo sapiens
acaagcctgagaac

SEQ ID NO: 4177814 - DNA, 17 bp, Homo sapiens
acaagccttactcacct

SEQ ID NO: 4177815 - DNA, 18 bp, Homo sapiens
acaagccttactcacctc

SEQ ID NO: 4177816 - DNA, 21 bp, Homo sapiens
acaagccttactcacctctct

SEQ ID NO: 4177817 - DNA, 24 bp, Homo sapiens
acaagccttactcacctctctcta

SEQ ID NO: 4177818 - DNA, 23 bp, Homo sapiens
acaagctcaggaggcgaataaat

SEQ ID NO: 4177819 - DNA, 20 bp, Homo sapiens
acaaggtcaggagttcgaga

SEQ ID NO: 4177820 - DNA, 16 bp, Homo sapiens
acaaggtctttaaagt

SEQ ID NO: 4177821 - DNA, 20 bp, Homo sapiens
acaaggttccctctgagaat

SEQ ID NO: 4177822 - DNA, 18 bp, Homo sapiens
acaagtaatcactaaccc

SEQ ID NO: 4177823 - DNA, 15 bp, Homo sapiens
acaagtcctgtgaat

SEQ ID NO: 4177824 - DNA, 20 bp, Homo sapiens
acaagtgtatatcagaaaag

SEQ ID NO: 4177825 - DNA, 14 bp, Homo sapiens
acaataaagactga

SEQ ID NO: 4177826 - DNA, 19 bp, Homo sapiens
acaataattaatgtgtgtc

SEQ ID NO: 4177827 - DNA, 14 bp, Homo sapiens
acaatagaagaaat

SEQ ID NO: 4177828 - DNA, 23 bp, Homo sapiens
acaatattaattataataaaggt

SEQ ID NO: 4177829 - DNA, 22 bp, Homo sapiens
acaatcctttgagttatagttt

SEQ ID NO: 4177830 - DNA, 12 bp, Homo sapiens
acaatctaacaa

SEQ ID NO: 4177831 - DNA, 16 bp, Homo sapiens
acaatctgggactttc

SEQ ID NO: 4177832 - DNA, 16 bp, Homo sapiens
acaatgaaggaaaacc

SEQ ID NO: 4177833 - DNA, 15 bp, Homo sapiens
acaatggccatggaa

SEQ ID NO: 4177834 - DNA, 21 bp, Homo sapiens
acaatggctaattcccagagt

SEQ ID NO: 4177835 - DNA, 15 bp, Homo sapiens
acaatggtttacatg

SEQ ID NO: 4177836 - DNA, 19 bp, Homo sapiens
acaatggtttacatgaaca

SEQ ID NO: 4177837 - DNA, 17 bp, Homo sapiens
acaatgtttaaaccttt

SEQ ID NO: 4177838 - DNA, 20 bp, Homo sapiens
acaattaaacagccaaataa

SEQ ID NO: 4177839 - DNA, 17 bp, Homo sapiens
acaattatggaaatata

SEQ ID NO: 4177840 - DNA, 17 bp, Homo sapiens
acaatttcctttatatt

SEQ ID NO: 4177841 - DNA, 14 bp, Homo sapiens
acacaaacacacac

SEQ ID NO: 4177842 - DNA, 12 bp, Homo sapiens
acacaacattta

SEQ ID NO: 4177843 - DNA, 15 bp, Homo sapiens
acacaaggtgatttc

SEQ ID NO: 4177844 - DNA, 19 bp, Homo sapiens
acacaagtttaaaaatatt

SEQ ID NO: 4177845 - DNA, 20 bp, Homo sapiens
acacaagtttaaaaatatta

SEQ ID NO: 4177846 - DNA, 14 bp, Homo sapiens
acacacgcaggaac

SEQ ID NO: 4177847 - DNA, 17 bp, Homo sapiens
acacacgtatttatatt

SEQ ID NO: 4177848 - DNA, 15 bp, Homo sapiens
acacactcagcagcc

SEQ ID NO: 4177849 - DNA, 22 bp, Homo sapiens
acacagctgagagacttttaat

SEQ ID NO: 4177850 - DNA, 16 bp, Homo sapiens
acacagtctcagtcca

SEQ ID NO: 4177851 - DNA, 22 bp, Homo sapiens
acacagtgttccagctgcctgg

SEQ ID NO: 4177852 - DNA, 22 bp, Homo sapiens
acacatactcatttttcatgat

SEQ ID NO: 4177853 - DNA, 19 bp, Homo sapiens
acacatccctaatgtgtgc

SEQ ID NO: 4177854 - DNA, 13 bp, Homo sapiens
acacatctttcct

SEQ ID NO: 4177855 - DNA, 18 bp, Homo sapiens
acaccaacataaaaatga

SEQ ID NO: 4177856 - DNA, 19 bp, Homo sapiens
acaccaatcagagagccta

SEQ ID NO: 4177857 - DNA, 14 bp, Homo sapiens
acaccatcttttgt

SEQ ID NO: 4177858 - DNA, 14 bp, Homo sapiens
acacccatgtaaat

SEQ ID NO: 4177859 - DNA, 20 bp, Homo sapiens
acaccccccgccccccacct

SEQ ID NO: 4177860 - DNA, 21 bp, Homo sapiens
acaccccccgccccccacctt

SEQ ID NO: 4177861 - DNA, 17 bp, Homo sapiens
acacctgccctgccctg

SEQ ID NO: 4177862 - DNA, 20 bp, Homo sapiens
acacctgccctgccctgcca

SEQ ID NO: 4177863 - DNA, 22 bp, Homo sapiens
acacctgccctgccctgccacc

SEQ ID NO: 4177864 - DNA, 23 bp, Homo sapiens
acacctgccctgccctgccacct

SEQ ID NO: 4177865 - DNA, 16 bp, Homo sapiens
acacgatcttgtaaga

SEQ ID NO: 4177866 - DNA, 22 bp, Homo sapiens
ctattttcagatgtgaaccatt

SEQ ID NO: 4177867 - DNA, 15 bp, Homo sapiens
ctattttgtaatttt

SEQ ID NO: 4177868 - DNA, 18 bp, Homo sapiens
ctatttttatattctata

SEQ ID NO: 4177869 - DNA, 17 bp, Homo sapiens
ctattttttaataaaag

SEQ ID NO: 4177870 - DNA, 20 bp, Homo sapiens
ctcaaactcctggactcatg

SEQ ID NO: 4177871 - DNA, 21 bp, Homo sapiens
ctcaaagcacctgaaccactg

SEQ ID NO: 4177872 - DNA, 17 bp, Homo sapiens
ctcaaagtttaacacaa

SEQ ID NO: 4177873 - DNA, 23 bp, Homo sapiens
ctcaacaacaaaccaaaacagaa

SEQ ID NO: 4177874 - DNA, 18 bp, Homo sapiens
ctcaacaataaagactga

SEQ ID NO: 4177875 - DNA, 21 bp, Homo sapiens
ctcaagaggggaagcaactcc

SEQ ID NO: 4177876 - DNA, 17 bp, Homo sapiens
ctcaaggcggtgcttga

SEQ ID NO: 4177877 - DNA, 17 bp, Homo sapiens
ctcaatattcaataaag

SEQ ID NO: 4177878 - DNA, 15 bp, Homo sapiens
ctcaatgtgaccagg

SEQ ID NO: 4177879 - DNA, 18 bp, Homo sapiens
acactgtctgctgcccca

SEQ ID NO: 4177880 - DNA, 18 bp, Homo sapiens
acactgtgtactgcagtt

SEQ ID NO: 4177881 - DNA, 16 bp, Homo sapiens
acacttatcttctgga

SEQ ID NO: 4177882 - DNA, 16 bp, Homo sapiens
acacttcttgaaacag

SEQ ID NO: 4177883 - DNA, 14 bp, Homo sapiens
acacttggtaattg

SEQ ID NO: 4177884 - DNA, 19 bp, Homo sapiens
acagaaaaatatgtaccaa

SEQ ID NO: 4177885 - DNA, 14 bp, Homo sapiens
acagaacagtttgt

SEQ ID NO: 4177886 - DNA, 19 bp, Homo sapiens
acagaacattgccttcctc

SEQ ID NO: 4177887 - DNA, 12 bp, Homo sapiens
acagaagaaaca

SEQ ID NO: 4177888 - DNA, 13 bp, Homo sapiens
acagaagaggagg

SEQ ID NO: 4177889 - DNA, 15 bp, Homo sapiens
acagaagaggaggga

SEQ ID NO: 4177890 - DNA, 21 bp, Homo sapiens
acagaagtccctaggagggaa

SEQ ID NO: 4177891 - DNA, 17 bp, Homo sapiens
acagacattttcaataa

SEQ ID NO: 4177892 - DNA, 19 bp, Homo sapiens
acagacattttcaataatg

SEQ ID NO: 4177893 - DNA, 15 bp, Homo sapiens
acagacccacacatg

SEQ ID NO: 4177894 - DNA, 17 bp, Homo sapiens
acagacgtctcaagact

SEQ ID NO: 4177895 - DNA, 21 bp, Homo sapiens
acagacgtctcaagactgaaa

SEQ ID NO: 4177896 - DNA, 17 bp, Homo sapiens
acagacttctccagacc

SEQ ID NO: 4177897 - DNA, 14 bp, Homo sapiens
acagactttagctt

SEQ ID NO: 4177898 - DNA, 12 bp, Homo sapiens
acagagagaacc

SEQ ID NO: 4177899 - DNA, 14 bp, Homo sapiens
acagagagaaccag

SEQ ID NO: 4177900 - DNA, 18 bp, Homo sapiens
acagagagaaccaggagg

SEQ ID NO: 4177901 - DNA, 23 bp, Homo sapiens
acagagatggaggccgagccaat

SEQ ID NO: 4177902 - DNA, 11 bp, Homo sapiens
acagagcctcc

SEQ ID NO: 4177903 - DNA, 11 bp, Homo sapiens
acagagcctgg

SEQ ID NO: 4177904 - DNA, 21 bp, Homo sapiens
acagagtaaatagcattctct

SEQ ID NO: 4177905 - DNA, 18 bp, Homo sapiens
acagataactgaaaatta

SEQ ID NO: 4177906 - DNA, 19 bp, Homo sapiens
acagatagacagtgctgcc

SEQ ID NO: 4177907 - DNA, 16 bp, Homo sapiens
acagatataaaatagg

SEQ ID NO: 4177908 - DNA, 16 bp, Homo sapiens
acagatatcagtgtct

SEQ ID NO: 4177909 - DNA, 16 bp, Homo sapiens
acagatggtagagaga

SEQ ID NO: 4177910 - DNA, 13 bp, Homo sapiens
acagattccatta

SEQ ID NO: 4177911 - DNA, 15 bp, Homo sapiens
acagcaaggaaacat

SEQ ID NO: 4177912 - DNA, 15 bp, Homo sapiens
acagcaattggctcc

SEQ ID NO: 4177913 - DNA, 13 bp, Homo sapiens
acagccaacaggt

SEQ ID NO: 4177914 - DNA, 18 bp, Homo sapiens
acagcccagaaccacaga

SEQ ID NO: 4177915 - DNA, 22 bp, Homo sapiens
acagcccagaaccacagatgtg

SEQ ID NO: 4177916 - DNA, 12 bp, Homo sapiens
acagccctgcct

SEQ ID NO: 4177917 - DNA, 13 bp, Homo sapiens
acagccctgccta

SEQ ID NO: 4177918 - DNA, 17 bp, Homo sapiens
acagccctgcctatcct

SEQ ID NO: 4177919 - DNA, 20 bp, Homo sapiens
acagccgcagcctccctctg

SEQ ID NO: 4177920 - DNA, 17 bp, Homo sapiens
acagcctgacaacattt

SEQ ID NO: 4177921 - DNA, 22 bp, Homo sapiens
acagcgagaggcagagaaagaa

SEQ ID NO: 4177922 - DNA, 21 bp, Homo sapiens
acagctcatgttttctatatg

SEQ ID NO: 4177923 - DNA, 21 bp, Homo sapiens
acagctcttcactcagccaca

SEQ ID NO: 4177924 - DNA, 20 bp, Homo sapiens
acagcttatggggtatttta

SEQ ID NO: 4177925 - DNA, 20 bp, Homo sapiens
acaggaaggtggtgcttaca

SEQ ID NO: 4177926 - DNA, 13 bp, Homo sapiens
acaggctcagcat

SEQ ID NO: 4177927 - DNA, 21 bp, Homo sapiens
acaggctgagctttctagcct

SEQ ID NO: 4177928 - DNA, 14 bp, Homo sapiens
acaggctggttctg

SEQ ID NO: 4177929 - DNA, 22 bp, Homo sapiens
acagggaaccctgcttgcactt

SEQ ID NO: 4177930 - DNA, 23 bp, Homo sapiens
acagggaaccctgcttgcacttt

SEQ ID NO: 4177931 - DNA, 16 bp, Homo sapiens
acagggcagagccggg

SEQ ID NO: 4177932 - DNA, 23 bp, Homo sapiens
acagggctgatagagtgattttg

SEQ ID NO: 4177933 - DNA, 15 bp, Homo sapiens
acaggtctagacttt

SEQ ID NO: 4177934 - DNA, 17 bp, Homo sapiens
acaggtctagactttct

SEQ ID NO: 4177935 - DNA, 15 bp, Homo sapiens
acaggtggcaggacc

SEQ ID NO: 4177936 - DNA, 19 bp, Homo sapiens
acaggtggcaggaccagga

SEQ ID NO: 4177937 - DNA, 12 bp, Homo sapiens
acagtaaataaa

SEQ ID NO: 4177938 - DNA, 15 bp, Homo sapiens
acagtaaataaattg

SEQ ID NO: 4177939 - DNA, 23 bp, Homo sapiens
acagtaaataaattgtttgacca

SEQ ID NO: 4177940 - DNA, 18 bp, Homo sapiens
acagtattctcagtgctc

SEQ ID NO: 4177941 - DNA, 14 bp, Homo sapiens
acagtcaagataca

SEQ ID NO: 4177942 - DNA, 21 bp, Homo sapiens
acagtcctcacagcctctccc

SEQ ID NO: 4177943 - DNA, 22 bp, Homo sapiens
acagtcctcacagcctctccct

SEQ ID NO: 4177944 - DNA, 23 bp, Homo sapiens
acagtcctgggagaacctcaggc

SEQ ID NO: 4177945 - DNA, 16 bp, Homo sapiens
acagtctggagaaggt

SEQ ID NO: 4177946 - DNA, 22 bp, Homo sapiens
acagtgaatttctgatttcact

SEQ ID NO: 4177947 - DNA, 14 bp, Homo sapiens
acagtgctgccctg

SEQ ID NO: 4177948 - DNA, 15 bp, Homo sapiens
acagtgcttcagcct

SEQ ID NO: 4177949 - DNA, 17 bp, Homo sapiens
acagtgcttcagcctga

SEQ ID NO: 4177950 - DNA, 17 bp, Homo sapiens
acagtggtgggcgggga

SEQ ID NO: 4177951 - DNA, 13 bp, Homo sapiens
acagttacataat

SEQ ID NO: 4177952 - DNA, 19 bp, Homo sapiens
acagttacataattcactc

SEQ ID NO: 4177953 - DNA, 15 bp, Homo sapiens
acagttgagtgaaat

SEQ ID NO: 4177954 - DNA, 20 bp, Homo sapiens
acagttgtaccattcaccgt

SEQ ID NO: 4177955 - DNA, 20 bp, Homo sapiens
acagttttcctatgctttga

SEQ ID NO: 4177956 - DNA, 12 bp, Homo sapiens
acataaagttga

SEQ ID NO: 4177957 - DNA, 15 bp, Homo sapiens
acataagccattatt

SEQ ID NO: 4177958 - DNA, 15 bp, Homo sapiens
acataatctctctag

SEQ ID NO: 4177959 - DNA, 23 bp, Homo sapiens
acataattatccaggaagggaat

SEQ ID NO: 4177960 - DNA, 20 bp, Homo sapiens
acataattcactctgagtgt

SEQ ID NO: 4177961 - DNA, 20 bp, Homo sapiens
acatacagaattactgtaac

SEQ ID NO: 4177962 - DNA, 17 bp, Homo sapiens
acatacgtgttctatag

SEQ ID NO: 4177963 - DNA, 14 bp, Homo sapiens
acatactcattttt

SEQ ID NO: 4177964 - DNA, 17 bp, Homo sapiens
acatagcactagcattc

SEQ ID NO: 4177965 - DNA, 20 bp, Homo sapiens
acataggaatatgactcagg

SEQ ID NO: 4177966 - DNA, 15 bp, Homo sapiens
acataggtataatta

SEQ ID NO: 4177967 - DNA, 15 bp, Homo sapiens
acatagtaaatggta

SEQ ID NO: 4177968 - DNA, 14 bp, Homo sapiens
acatcaaaaatggg

SEQ ID NO: 4177969 - DNA, 15 bp, Homo sapiens
acatcattactataa

SEQ ID NO: 4177970 - DNA, 16 bp, Homo sapiens
acatcattctacataa

SEQ ID NO: 4177971 - DNA, 15 bp, Homo sapiens
acatcattcttgaga

SEQ ID NO: 4177972 - DNA, 20 bp, Homo sapiens
acatccatgtttgtaaaact

SEQ ID NO: 4177973 - DNA, 19 bp, Homo sapiens
acatctattataaaaccat

SEQ ID NO: 4177974 - DNA, 15 bp, Homo sapiens
acatgaatgcacact

SEQ ID NO: 4177975 - DNA, 21 bp, Homo sapiens
acatgatttagggaagcaggg

SEQ ID NO: 4177976 - DNA, 22 bp, Homo sapiens
acatgcaattggggaagaaaaa

SEQ ID NO: 4177977 - DNA, 18 bp, Homo sapiens
acatgctaagagaagtag

SEQ ID NO: 4177978 - DNA, 19 bp, Homo sapiens
acatgctaagagaagtaga

SEQ ID NO: 4177979 - DNA, 14 bp, Homo sapiens
acatggacacagac

SEQ ID NO: 4177980 - DNA, 14 bp, Homo sapiens
acatggccagtgtg

SEQ ID NO: 4177981 - DNA, 21 bp, Homo sapiens
acatgtccagtgggaggtgag

SEQ ID NO: 4177982 - DNA, 16 bp, Homo sapiens
acatgtccttgtgtgt

SEQ ID NO: 4177983 - DNA, 18 bp, Homo sapiens
acatgtctgtcctcagag

SEQ ID NO: 4177984 - DNA, 21 bp, Homo sapiens
acatgtctgtcctcagagcag

SEQ ID NO: 4177985 - DNA, 13 bp, Homo sapiens
acatgtggtttat

SEQ ID NO: 4177986 - DNA, 14 bp, Homo sapiens
acatgttatttgta

SEQ ID NO: 4177987 - DNA, 23 bp, Homo sapiens
acatgtttatttattctgcattt

SEQ ID NO: 4177988 - DNA, 23 bp, Homo sapiens
acatgtttttgttttctttgaat

SEQ ID NO: 4177989 - DNA, 14 bp, Homo sapiens
acattaaattaaat

SEQ ID NO: 4177990 - DNA, 15 bp, Homo sapiens
acattaacatctatt

SEQ ID NO: 4177991 - DNA, 15 bp, Homo sapiens
acattagaagacaat

SEQ ID NO: 4177992 - DNA, 20 bp, Homo sapiens
acattagaagacaattgaca

SEQ ID NO: 4177993 - DNA, 21 bp, Homo sapiens
acattagaagacaattgacaa

SEQ ID NO: 4177994 - DNA, 22 bp, Homo sapiens
acattagatgttactgtgtgaa

SEQ ID NO: 4177995 - DNA, 13 bp, Homo sapiens
acattcacagccc

SEQ ID NO: 4177996 - DNA, 22 bp, Homo sapiens
acattcgaggtgtcaccctgca

SEQ ID NO: 4177997 - DNA, 23 bp, Homo sapiens
acattcgaggtgtcaccctgcag

SEQ ID NO: 4177998 - DNA, 14 bp, Homo sapiens
acattgcattgtga

SEQ ID NO: 4177999 - DNA, 16 bp, Homo sapiens
acattgcattgtgact

SEQ ID NO: 4178000 - DNA, 21 bp, Homo sapiens
acattgtcaaagcttgccgta

SEQ ID NO: 4178001 - DNA, 18 bp, Homo sapiens
acattgtgatgattatta

SEQ ID NO: 4178002 - DNA, 18 bp, Homo sapiens
acatttgcaaaatggaaa

SEQ ID NO: 4178003 - DNA, 12 bp, Homo sapiens
acattttcattt

SEQ ID NO: 4178004 - DNA, 22 bp, Homo sapiens
accaaaaaagtatttttttaag

SEQ ID NO: 4178005 - DNA, 21 bp, Homo sapiens
accaaaagaagtaaaagcaaa

SEQ ID NO: 4178006 - DNA, 23 bp, Homo sapiens
accaaagatatatacacaggatc

SEQ ID NO: 4178007 - DNA, 12 bp, Homo sapiens
accaaataggct

SEQ ID NO: 4178008 - DNA, 19 bp, Homo sapiens
accaactttctgtaaactc

SEQ ID NO: 4178009 - DNA, 19 bp, Homo sapiens
accaaggaaagaacaaatg

SEQ ID NO: 4178010 - DNA, 19 bp, Homo sapiens
accaaggtcttcagccatc

SEQ ID NO: 4178011 - DNA, 18 bp, Homo sapiens
accaatgcttttatcaaa

SEQ ID NO: 4178012 - DNA, 15 bp, Homo sapiens
accacaagcctgaga

SEQ ID NO: 4178013 - DNA, 16 bp, Homo sapiens
accacaagcctgagaa

SEQ ID NO: 4178014 - DNA, 15 bp, Homo sapiens
actcctacctcagcc

SEQ ID NO: 4178015 - DNA, 16 bp, Homo sapiens
actcctacctcagcct

SEQ ID NO: 4178016 - DNA, 13 bp, Homo sapiens
actcctcccacaa

SEQ ID NO: 4178017 - DNA, 14 bp, Homo sapiens
actcctcttatttg

SEQ ID NO: 4178018 - DNA, 22 bp, Homo sapiens
actcggtcaaaatattttttaa

SEQ ID NO: 4178019 - DNA, 17 bp, Homo sapiens
actctaagctgtgtgca

SEQ ID NO: 4178020 - DNA, 16 bp, Homo sapiens
actctagtgacttcct

SEQ ID NO: 4178021 - DNA, 18 bp, Homo sapiens
actctagtgacttcctgg

SEQ ID NO: 4178022 - DNA, 23 bp, Homo sapiens
actctagtgacttcctggtgagg

SEQ ID NO: 4178023 - DNA, 19 bp, Homo sapiens
actctatagttattgtttt

SEQ ID NO: 4178024 - DNA, 12 bp, Homo sapiens
actctcccctcc

SEQ ID NO: 4178025 - DNA, 13 bp, Homo sapiens
actctcccctccc

SEQ ID NO: 4178026 - DNA, 16 bp, Homo sapiens
actctcccctccctct

SEQ ID NO: 4178027 - DNA, 20 bp, Homo sapiens
actctcccctccctcttcct

SEQ ID NO: 4178028 - DNA, 15 bp, Homo sapiens
actctctgaaatata

SEQ ID NO: 4178029 - DNA, 15 bp, Homo sapiens
actctctgtacaaaa

SEQ ID NO: 4178030 - DNA, 21 bp, Homo sapiens
actctgaggctctttctgggc

SEQ ID NO: 4178031 - DNA, 20 bp, Homo sapiens
actctgagtgttttatgaga

SEQ ID NO: 4178032 - DNA, 16 bp, Homo sapiens
actctgccagccacat

SEQ ID NO: 4178033 - DNA, 20 bp, Homo sapiens
actctgcggtggtgccagag

SEQ ID NO: 4178034 - DNA, 21 bp, Homo sapiens
actctgcggtggtgccagagg

SEQ ID NO: 4178035 - DNA, 17 bp, Homo sapiens
actctggcttccaggta

SEQ ID NO: 4178036 - DNA, 19 bp, Homo sapiens
actctgggtccctcggagc

SEQ ID NO: 4178037 - DNA, 15 bp, Homo sapiens
actcttcaaatgcct

SEQ ID NO: 4178038 - DNA, 16 bp, Homo sapiens
actcttcctgcaagga

SEQ ID NO: 4178039 - DNA, 20 bp, Homo sapiens
actgaacccagagtcaggaa

SEQ ID NO: 4178040 - DNA, 22 bp, Homo sapiens
actgaataggaaaatgtacata

SEQ ID NO: 4178041 - DNA, 19 bp, Homo sapiens
actgaatgtttattccttg

SEQ ID NO: 4178042 - DNA, 17 bp, Homo sapiens
actgaattaagttattg

SEQ ID NO: 4178043 - DNA, 19 bp, Homo sapiens
actgaattttgggacttct

SEQ ID NO: 4178044 - DNA, 14 bp, Homo sapiens
actgacaagatgga

SEQ ID NO: 4178045 - DNA, 22 bp, Homo sapiens
actgacaagatggaaaataaat

SEQ ID NO: 4178046 - DNA, 16 bp, Homo sapiens
actgagagcagatggt

SEQ ID NO: 4178047 - DNA, 14 bp, Homo sapiens
actgaggatgtgag

SEQ ID NO: 4178048 - DNA, 16 bp, Homo sapiens
actgaggatgtgagcc

SEQ ID NO: 4178049 - DNA, 14 bp, Homo sapiens
actgaggcagggga

SEQ ID NO: 4178050 - DNA, 23 bp, Homo sapiens
actgagggattttagcctcttcc

SEQ ID NO: 4178051 - DNA, 18 bp, Homo sapiens
actgagttttccatggca

SEQ ID NO: 4178052 - DNA, 16 bp, Homo sapiens
actgatagtgtccaaa

SEQ ID NO: 4178053 - DNA, 17 bp, Homo sapiens
actgatagtgtccaaat

SEQ ID NO: 4178054 - DNA, 14 bp, Homo sapiens
actgattaacaaat

SEQ ID NO: 4178055 - DNA, 15 bp, Homo sapiens
actgattaacaaata

SEQ ID NO: 4178056 - DNA, 15 bp, Homo sapiens
actgattacctgcca

SEQ ID NO: 4178057 - DNA, 16 bp, Homo sapiens
actgattacctgccaa

SEQ ID NO: 4178058 - DNA, 13 bp, Homo sapiens
actgattctcctg

SEQ ID NO: 4178059 - DNA, 15 bp, Homo sapiens
actgatttttgtgat

SEQ ID NO: 4178060 - DNA, 16 bp, Homo sapiens
actgcactccagcctg

SEQ ID NO: 4178061 - DNA, 15 bp, Homo sapiens
actgcagaggggaaa

SEQ ID NO: 4178062 - DNA, 14 bp, Homo sapiens
actgcagggctgct

SEQ ID NO: 4178063 - DNA, 18 bp, Homo sapiens
actgcagggctgctgtgg

SEQ ID NO: 4178064 - DNA, 19 bp, Homo sapiens
actgcagggctgctgtggc

SEQ ID NO: 4178065 - DNA, 19 bp, Homo sapiens
actgcagtaacactggcct

SEQ ID NO: 4178066 - DNA, 20 bp, Homo sapiens
actgccatgcctcaagaaca

SEQ ID NO: 4178067 - DNA, 17 bp, Homo sapiens
actgcccaggcactgca

SEQ ID NO: 4178068 - DNA, 22 bp, Homo sapiens
actgccccgggtgcctcagagc

SEQ ID NO: 4178069 - DNA, 21 bp, Homo sapiens
actgcccctgcacctgcttct

SEQ ID NO: 4178070 - DNA, 18 bp, Homo sapiens
actgccctccgcccttcc

SEQ ID NO: 4178071 - DNA, 19 bp, Homo sapiens
actgcgatcttcagagcag

SEQ ID NO: 4178072 - DNA, 22 bp, Homo sapiens
actgcgggatggtcctggggct

SEQ ID NO: 4178073 - DNA, 14 bp, Homo sapiens
actgctacctctga

SEQ ID NO: 4178074 - DNA, 23 bp, Homo sapiens
actgctaggcgagtgccaggact

SEQ ID NO: 4178075 - DNA, 16 bp, Homo sapiens
actgctcggtcaggag

SEQ ID NO: 4178076 - DNA, 11 bp, Homo sapiens
actgctctgcc

SEQ ID NO: 4178077 - DNA, 19 bp, Homo sapiens
actgctgggactggccagg

SEQ ID NO: 4178078 - DNA, 16 bp, Homo sapiens
actggaacactagaca

SEQ ID NO: 4178079 - DNA, 16 bp, Homo sapiens
actggaaccagggaga

SEQ ID NO: 4178080 - DNA, 21 bp, Homo sapiens
actggactgggttttgtctct

SEQ ID NO: 4178081 - DNA, 22 bp, Homo sapiens
actggacttgagcttggcagct

SEQ ID NO: 4178082 - DNA, 13 bp, Homo sapiens
actggagcccagg

SEQ ID NO: 4178083 - DNA, 14 bp, Homo sapiens
actggagcccagga

SEQ ID NO: 4178084 - DNA, 16 bp, Homo sapiens
actggagcccaggagt

SEQ ID NO: 4178085 - DNA, 20 bp, Homo sapiens
actggaggtcacattcagga

SEQ ID NO: 4178086 - DNA, 21 bp, Homo sapiens
actggaggtcacattcaggaa

SEQ ID NO: 4178087 - DNA, 22 bp, Homo sapiens
actggctcctttgcctctgcta

SEQ ID NO: 4178088 - DNA, 16 bp, Homo sapiens
actggctggctgcagt

SEQ ID NO: 4178089 - DNA, 16 bp, Homo sapiens
actgggagaagagaac

SEQ ID NO: 4178090 - DNA, 19 bp, Homo sapiens
actggggagttataaaaat

SEQ ID NO: 4178091 - DNA, 20 bp, Homo sapiens
actggggagttataaaaata

SEQ ID NO: 4178092 - DNA, 14 bp, Homo sapiens
actgggtaatgaaa

SEQ ID NO: 4178093 - DNA, 20 bp, Homo sapiens
actgggtaatgaaacaaaga

SEQ ID NO: 4178094 - DNA, 14 bp, Homo sapiens
actggtcctgtgtg

SEQ ID NO: 4178095 - DNA, 20 bp, Homo sapiens
actggtcctgtgtgcagtga

SEQ ID NO: 4178096 - DNA, 15 bp, Homo sapiens
actggtgatttctga

SEQ ID NO: 4178097 - DNA, 22 bp, Homo sapiens
actggtgatttctgagatttta

SEQ ID NO: 4178098 - DNA, 13 bp, Homo sapiens
actgtacaaatga

SEQ ID NO: 4178099 - DNA, 20 bp, Homo sapiens
actgtagtttaatacttttt

SEQ ID NO: 4178100 - DNA, 23 bp, Homo sapiens
actgtatctaggcaacatagtat

SEQ ID NO: 4178101 - DNA, 18 bp, Homo sapiens
actgtgaacctggagggc

SEQ ID NO: 4178102 - DNA, 17 bp, Homo sapiens
actgtgataatcagaag

SEQ ID NO: 4178103 - DNA, 16 bp, Homo sapiens
actgtgccctgccttc

SEQ ID NO: 4178104 - DNA, 14 bp, Homo sapiens
actgtgttcattag

SEQ ID NO: 4178105 - DNA, 21 bp, Homo sapiens
actgttacaacttgtatttcc

SEQ ID NO: 4178106 - DNA, 13 bp, Homo sapiens
actgttgaaaatt

SEQ ID NO: 4178107 - DNA, 14 bp, Homo sapiens
actgttgaaaatta

SEQ ID NO: 4178108 - DNA, 21 bp, Homo sapiens
actgttgaaaattattttaaa

SEQ ID NO: 4178109 - DNA, 15 bp, Homo sapiens
actgttggaagttca

SEQ ID NO: 4178110 - DNA, 23 bp, Homo sapiens
actgtttaccaaggaaagaacaa

SEQ ID NO: 4178111 - DNA, 20 bp, Homo sapiens
actgtttggctgacatgact

SEQ ID NO: 4178112 - DNA, 23 bp, Homo sapiens
actgtttttatatgcacatgtaa

SEQ ID NO: 4178113 - DNA, 23 bp, Homo sapiens
actgtttttgctattacatgtgt

SEQ ID NO: 4178114 - DNA, 16 bp, Homo sapiens
acttaaatagtatttc

SEQ ID NO: 4178115 - DNA, 18 bp, Homo sapiens
acttaaatgttaatgaga

SEQ ID NO: 4178116 - DNA, 18 bp, Homo sapiens
acttaccaggcaccaaaa

SEQ ID NO: 4178117 - DNA, 17 bp, Homo sapiens
acttagctggagaacta

SEQ ID NO: 4178118 - DNA, 18 bp, Homo sapiens
acttagctggagaactag

SEQ ID NO: 4178119 - DNA, 20 bp, Homo sapiens
acttatcaaaagacagcact

SEQ ID NO: 4178120 - DNA, 17 bp, Homo sapiens
acttatcttctggatta

SEQ ID NO: 4178121 - DNA, 12 bp, Homo sapiens
acttattaacaa

SEQ ID NO: 4178122 - DNA, 11 bp, Homo sapiens
acttatttgag

SEQ ID NO: 4178123 - DNA, 19 bp, Homo sapiens
acttcaagcatggctattt

SEQ ID NO: 4178124 - DNA, 19 bp, Homo sapiens
acttctaaatcagaaatag

SEQ ID NO: 4178125 - DNA, 19 bp, Homo sapiens
acttctacccagatggaaa

SEQ ID NO: 4178126 - DNA, 15 bp, Homo sapiens
acttctcttgaatta

SEQ ID NO: 4178127 - DNA, 21 bp, Homo sapiens
acttctgaagtaatttgtaaa

SEQ ID NO: 4178128 - DNA, 11 bp, Homo sapiens
acttctgctga

SEQ ID NO: 4178129 - DNA, 22 bp, Homo sapiens
acttctgctgaaggacagaaca

SEQ ID NO: 4178130 - DNA, 14 bp, Homo sapiens
acttgaagccaaac

SEQ ID NO: 4178131 - DNA, 19 bp, Homo sapiens
acttgaataaagtactaca

SEQ ID NO: 4178132 - DNA, 15 bp, Homo sapiens
acttgaggacacatg

SEQ ID NO: 4178133 - DNA, 16 bp, Homo sapiens
acttgaggacacatgt

SEQ ID NO: 4178134 - DNA, 17 bp, Homo sapiens
acttgaggacacatgtc

SEQ ID NO: 4178135 - DNA, 18 bp, Homo sapiens
acttgaggattttgagta

SEQ ID NO: 4178136 - DNA, 15 bp, Homo sapiens
acttgagggtaataa

SEQ ID NO: 4178137 - DNA, 21 bp, Homo sapiens
acttgcttatcaacttcctaa

SEQ ID NO: 4178138 - DNA, 18 bp, Homo sapiens
acttggaaaaagaaagaa

SEQ ID NO: 4178139 - DNA, 13 bp, Homo sapiens
acttggctgctca

SEQ ID NO: 4178140 - DNA, 17 bp, Homo sapiens
acttgggcccaggaggt

SEQ ID NO: 4178141 - DNA, 16 bp, Homo sapiens
acttggtaattgtact

SEQ ID NO: 4178142 - DNA, 14 bp, Homo sapiens
acttggttttgcta

SEQ ID NO: 4178143 - DNA, 14 bp, Homo sapiens
acttgtatttccaa

SEQ ID NO: 4178144 - DNA, 17 bp, Homo sapiens
acttgtattttcttaat

SEQ ID NO: 4178145 - DNA, 18 bp, Homo sapiens
acttgtcaagaatgagaa

SEQ ID NO: 4178146 - DNA, 12 bp, Homo sapiens
actttaaagcgt

SEQ ID NO: 4178147 - DNA, 13 bp, Homo sapiens
actttaattttta

SEQ ID NO: 4178148 - DNA, 21 bp, Homo sapiens
actttaatttttataaatatg

SEQ ID NO: 4178149 - DNA, 19 bp, Homo sapiens
agagtttgaaggaggtgag

SEQ ID NO: 4178150 - DNA, 22 bp, Homo sapiens
agataaattttgacttgaaaaa

SEQ ID NO: 4178151 - DNA, 18 bp, Homo sapiens
agataacccttattccat

SEQ ID NO: 4178152 - DNA, 14 bp, Homo sapiens
agataactgagaat

SEQ ID NO: 4178153 - DNA, 14 bp, Homo sapiens
agataatcagcctc

SEQ ID NO: 4178154 - DNA, 15 bp, Homo sapiens
agataatcagcctct

SEQ ID NO: 4178155 - DNA, 24 bp, Homo sapiens
agataattatcagtcatgaggaaa

SEQ ID NO: 4178156 - DNA, 12 bp, Homo sapiens
agataatttatg

SEQ ID NO: 4178157 - DNA, 16 bp, Homo sapiens
agataattttatgtgt

SEQ ID NO: 4178158 - DNA, 14 bp, Homo sapiens
agatacatagtaaa

SEQ ID NO: 4178159 - DNA, 21 bp, Homo sapiens
agatacatcttataaactgac

SEQ ID NO: 4178160 - DNA, 17 bp, Homo sapiens
agatagaaagcaataaa

SEQ ID NO: 4178161 - DNA, 19 bp, Homo sapiens
agatagaaagcaataaaaa

SEQ ID NO: 4178162 - DNA, 13 bp, Homo sapiens
agatagaatttcc

SEQ ID NO: 4178163 - DNA, 20 bp, Homo sapiens
agatagacagtgctgccctg

SEQ ID NO: 4178164 - DNA, 16 bp, Homo sapiens
agatagcagaggaaaa

SEQ ID NO: 4178165 - DNA, 12 bp, Homo sapiens
agatataaaata

SEQ ID NO: 4178166 - DNA, 13 bp, Homo sapiens
agatatatatcat

SEQ ID NO: 4178167 - DNA, 18 bp, Homo sapiens
agatattcctattgtgca

SEQ ID NO: 4178168 - DNA, 14 bp, Homo sapiens
agatattggacaaa

SEQ ID NO: 4178169 - DNA, 16 bp, Homo sapiens
agatattggacaaaga

SEQ ID NO: 4178170 - DNA, 18 bp, Homo sapiens
agatattgggacacacat

SEQ ID NO: 4178171 - DNA, 22 bp, Homo sapiens
agatattgggacacacatcaaa

SEQ ID NO: 4178172 - DNA, 16 bp, Homo sapiens
agatcagcagtggcag

SEQ ID NO: 4178173 - DNA, 18 bp, Homo sapiens
agatcagcagtggcagga

SEQ ID NO: 4178174 - DNA, 13 bp, Homo sapiens
agatcaggaagag

SEQ ID NO: 4178175 - DNA, 13 bp, Homo sapiens
agatcatggcagc

SEQ ID NO: 4178176 - DNA, 14 bp, Homo sapiens
agatcatggcagca

SEQ ID NO: 4178177 - DNA, 23 bp, Homo sapiens
agatccagcacaactcagtctgt

SEQ ID NO: 4178178 - DNA, 20 bp, Homo sapiens
agatccatttggacaaaatg

SEQ ID NO: 4178179 - DNA, 19 bp, Homo sapiens
agatctatggcgaacacag

SEQ ID NO: 4178180 - DNA, 15 bp, Homo sapiens
agatctccctccagg

SEQ ID NO: 4178181 - DNA, 17 bp, Homo sapiens
agatctccctccaggga

SEQ ID NO: 4178182 - DNA, 13 bp, Homo sapiens
agatctgaaagtt

SEQ ID NO: 4178183 - DNA, 15 bp, Homo sapiens
agatctgcactgggt

SEQ ID NO: 4178184 - DNA, 23 bp, Homo sapiens
agatctggaaccttaccacgtta

SEQ ID NO: 4178185 - DNA, 13 bp, Homo sapiens
agatgaaagagga

SEQ ID NO: 4178186 - DNA, 17 bp, Homo sapiens
agatgaaagaggaggtt

SEQ ID NO: 4178187 - DNA, 23 bp, Homo sapiens
agatgaaagaggaggtttggggt

SEQ ID NO: 4178188 - DNA, 23 bp, Homo sapiens
agatgaagctttggccctcagtg

SEQ ID NO: 4178189 - DNA, 15 bp, Homo sapiens
agatgactgagtcct

SEQ ID NO: 4178190 - DNA, 18 bp, Homo sapiens
agatgattttcctccctg

SEQ ID NO: 4178191 - DNA, 16 bp, Homo sapiens
agatgccacacctgct

SEQ ID NO: 4178192 - DNA, 15 bp, Homo sapiens
agatgcccaaatcct

SEQ ID NO: 4178193 - DNA, 22 bp, Homo sapiens
agatgcccagagggcccaggca

SEQ ID NO: 4178194 - DNA, 22 bp, Homo sapiens
agatgctgtcactggcagagca

SEQ ID NO: 4178195 - DNA, 23 bp, Homo sapiens
agatgctgtcactggcagagcac

SEQ ID NO: 4178196 - DNA, 11 bp, Homo sapiens
agatgctttta

SEQ ID NO: 4178197 - DNA, 16 bp, Homo sapiens
agatggaaaaataaca

SEQ ID NO: 4178198 - DNA, 21 bp, Homo sapiens
agatggaaaaataacaactat

SEQ ID NO: 4178199 - DNA, 17 bp, Homo sapiens
agatggaaagaaagcac

SEQ ID NO: 4178200 - DNA, 15 bp, Homo sapiens
agatggagaataaat

SEQ ID NO: 4178201 - DNA, 21 bp, Homo sapiens
agatggagaataaattattga

SEQ ID NO: 4178202 - DNA, 21 bp, Homo sapiens
agatgggacaagttagtcttt

SEQ ID NO: 4178203 - DNA, 24 bp, Homo sapiens
agatgggtctccgcacttggaaag

SEQ ID NO: 4178204 - DNA, 17 bp, Homo sapiens
agatgggtctggctgag

SEQ ID NO: 4178205 - DNA, 19 bp, Homo sapiens
agatgggtctggctgagct

SEQ ID NO: 4178206 - DNA, 22 bp, Homo sapiens
agatgggtctggctgagctgaa

SEQ ID NO: 4178207 - DNA, 15 bp, Homo sapiens
agatggtagagagag

SEQ ID NO: 4178208 - DNA, 20 bp, Homo sapiens
agatgtgtctgggagagcct

SEQ ID NO: 4178209 - DNA, 23 bp, Homo sapiens
agatgtgtctgggagagcctggc

SEQ ID NO: 4178210 - DNA, 16 bp, Homo sapiens
agatgttactgtgtga

SEQ ID NO: 4178211 - DNA, 17 bp, Homo sapiens
agatgttactgtgtgaa

SEQ ID NO: 4178212 - DNA, 15 bp, Homo sapiens
agattaaaggaagga

SEQ ID NO: 4178213 - DNA, 17 bp, Homo sapiens
agattagaagtgtttta

SEQ ID NO: 4178214 - DNA, 19 bp, Homo sapiens
agattctagccaaactatt

SEQ ID NO: 4178215 - DNA, 16 bp, Homo sapiens
agattgaaaccattcc

SEQ ID NO: 4178216 - DNA, 17 bp, Homo sapiens
agattgagaagccatgt

SEQ ID NO: 4178217 - DNA, 22 bp, Homo sapiens
agattgaggcctgccctcaggg

SEQ ID NO: 4178218 - DNA, 21 bp, Homo sapiens
agattgttaattcctcagtta

SEQ ID NO: 4178219 - DNA, 12 bp, Homo sapiens
agatttaacaaa

SEQ ID NO: 4178220 - DNA, 13 bp, Homo sapiens
agatttcaacata

SEQ ID NO: 4178221 - DNA, 15 bp, Homo sapiens
agatttcaacatatc

SEQ ID NO: 4178222 - DNA, 18 bp, Homo sapiens
agatttgtgaactggaag

SEQ ID NO: 4178223 - DNA, 12 bp, Homo sapiens
agcaaaaaagaa

SEQ ID NO: 4178224 - DNA, 18 bp, Homo sapiens
agcaaacaccagtgaggc

SEQ ID NO: 4178225 - DNA, 22 bp, Homo sapiens
agcaaacctcagtcatattctt

SEQ ID NO: 4178226 - DNA, 12 bp, Homo sapiens
agcaaagagtgg

SEQ ID NO: 4178227 - DNA, 20 bp, Homo sapiens
agcaaagcaaaaggctgaga

SEQ ID NO: 4178228 - DNA, 15 bp, Homo sapiens
agcaaaggaaaccaa

SEQ ID NO: 4178229 - DNA, 16 bp, Homo sapiens
agcaaaggaaaccaaa

SEQ ID NO: 4178230 - DNA, 14 bp, Homo sapiens
agcaaagtctaaag

SEQ ID NO: 4178231 - DNA, 23 bp, Homo sapiens
agcaaatcaccacaaactgtaat

SEQ ID NO: 4178232 - DNA, 15 bp, Homo sapiens
agcaaatcgaatgaa

SEQ ID NO: 4178233 - DNA, 22 bp, Homo sapiens
agcaaatcgaatgaaattaact

SEQ ID NO: 4178234 - DNA, 14 bp, Homo sapiens
agcaaattagtaat

SEQ ID NO: 4178235 - DNA, 20 bp, Homo sapiens
agcaacaaagattgagaagc

SEQ ID NO: 4178236 - DNA, 19 bp, Homo sapiens
agcaacaaatccatggacc

SEQ ID NO: 4178237 - DNA, 13 bp, Homo sapiens
agcaacacagagc

SEQ ID NO: 4178238 - DNA, 11 bp, Homo sapiens
agcaactccca

SEQ ID NO: 4178239 - DNA, 22 bp, Homo sapiens
agcaagaaggaaagatttgtga

SEQ ID NO: 4178240 - DNA, 21 bp, Homo sapiens
agcaagactccatttcaaaaa

SEQ ID NO: 4178241 - DNA, 17 bp, Homo sapiens
agcaagagctggcaaag

SEQ ID NO: 4178242 - DNA, 23 bp, Homo sapiens
agcaagagctggcaaaggtggct

SEQ ID NO: 4178243 - DNA, 12 bp, Homo sapiens
agcaagcagggg

SEQ ID NO: 4178244 - DNA, 13 bp, Homo sapiens
agcaagcaggggt

SEQ ID NO: 4178245 - DNA, 15 bp, Homo sapiens
agcaaggaaacatta

SEQ ID NO: 4178246 - DNA, 20 bp, Homo sapiens
agcaaggacaacctgcccct

SEQ ID NO: 4178247 - DNA, 20 bp, Homo sapiens
agcaagtgagcagatgggac

SEQ ID NO: 4178248 - DNA, 17 bp, Homo sapiens
agcaagtttcaccttgg

SEQ ID NO: 4178249 - DNA, 22 bp, Homo sapiens
agcaatccatgttagtttttac

SEQ ID NO: 4178250 - DNA, 20 bp, Homo sapiens
agcaatgcccgtaatgctta

SEQ ID NO: 4178251 - DNA, 13 bp, Homo sapiens
agcaatggacctt

SEQ ID NO: 4178252 - DNA, 13 bp, Homo sapiens
agcaattggctcc

SEQ ID NO: 4178253 - DNA, 15 bp, Homo sapiens
agcaattgtagacag

SEQ ID NO: 4178254 - DNA, 20 bp, Homo sapiens
agcacaaatttcatctccta

SEQ ID NO: 4178255 - DNA, 16 bp, Homo sapiens
agcacaactcagtctg

SEQ ID NO: 4178256 - DNA, 23 bp, Homo sapiens
agcacaactcagtctgtgggagc

SEQ ID NO: 4178257 - DNA, 15 bp, Homo sapiens
agcacactgcagggc

SEQ ID NO: 4178258 - DNA, 19 bp, Homo sapiens
agcacactgcagggctgct

SEQ ID NO: 4178259 - DNA, 17 bp, Homo sapiens
agcacaggctaattttt

SEQ ID NO: 4178260 - DNA, 17 bp, Homo sapiens
agcacataatgtccaga

SEQ ID NO: 4178261 - DNA, 22 bp, Homo sapiens
agcacatgtctgtcctcagagc

SEQ ID NO: 4178262 - DNA, 17 bp, Homo sapiens
agcaccagcttctccag

SEQ ID NO: 4178263 - DNA, 20 bp, Homo sapiens
agcaccccctcattcccctc

SEQ ID NO: 4178264 - DNA, 13 bp, Homo sapiens
agcacccctgtct

SEQ ID NO: 4178265 - DNA, 23 bp, Homo sapiens
agcacgggttaagatctgaaagt

SEQ ID NO: 4178266 - DNA, 17 bp, Homo sapiens
agcactcagaaaagaaa

SEQ ID NO: 4178267 - DNA, 22 bp, Homo sapiens
agcactcagaaaagaaaaccat

SEQ ID NO: 4178268 - DNA, 17 bp, Homo sapiens
agcactttaaccctctc

SEQ ID NO: 4178269 - DNA, 20 bp, Homo sapiens
agcactttaaccctctcttc

SEQ ID NO: 4178270 - DNA, 22 bp, Homo sapiens
agcactttaaccctctcttccc

SEQ ID NO: 4178271 - DNA, 15 bp, Homo sapiens
agcactttgggaggc

SEQ ID NO: 4178272 - DNA, 22 bp, Homo sapiens
agcactttgggaggccaaggtg

SEQ ID NO: 4178273 - DNA, 21 bp, Homo sapiens
agcactttgggaggctgaggc

SEQ ID NO: 4178274 - DNA, 18 bp, Homo sapiens
agcagaaaccaagtctac

SEQ ID NO: 4178275 - DNA, 11 bp, Homo sapiens
agcagaaagat

SEQ ID NO: 4178276 - DNA, 19 bp, Homo sapiens
agcagaaagattaaatatg

SEQ ID NO: 4178277 - DNA, 17 bp, Homo sapiens
agcagaagtgaccaaat

SEQ ID NO: 4178278 - DNA, 19 bp, Homo sapiens
agcagagctgatggagaag

SEQ ID NO: 4178279 - DNA, 23 bp, Homo sapiens
agcagagctgatggagaaggaag

SEQ ID NO: 4178280 - DNA, 18 bp, Homo sapiens
agcagaggaaaaagaaaa

SEQ ID NO: 4178281 - DNA, 21 bp, Homo sapiens
agcagaggacagtctggagaa

SEQ ID NO: 4178282 - DNA, 15 bp, Homo sapiens
agcagatggaaagaa

SEQ ID NO: 4178283 - DNA, 19 bp, Homo sapiens
aggagtttcgaggtagagt

SEQ ID NO: 4178284 - DNA, 19 bp, Homo sapiens
aggagtttgaggctgcagc

SEQ ID NO: 4178285 - DNA, 24 bp, Homo sapiens
aggagtttgaggctgcagcgagct

SEQ ID NO: 4178286 - DNA, 14 bp, Homo sapiens
aggatagcattttt

SEQ ID NO: 4178287 - DNA, 17 bp, Homo sapiens
aggatagcctcagccac

SEQ ID NO: 4178288 - DNA, 18 bp, Homo sapiens
aggatagcctcagccaca

SEQ ID NO: 4178289 - DNA, 15 bp, Homo sapiens
aggatcactggagcc

SEQ ID NO: 4178290 - DNA, 16 bp, Homo sapiens
aggatcactggagccc

SEQ ID NO: 4178291 - DNA, 16 bp, Homo sapiens
aggatctagaatgtgt

SEQ ID NO: 4178292 - DNA, 14 bp, Homo sapiens
aggatctgcccaca

SEQ ID NO: 4178293 - DNA, 15 bp, Homo sapiens
aggatctttgactga

SEQ ID NO: 4178294 - DNA, 16 bp, Homo sapiens
aggatgcaacaaatat

SEQ ID NO: 4178295 - DNA, 22 bp, Homo sapiens
aggatggctaggaaagggaagc

SEQ ID NO: 4178296 - DNA, 13 bp, Homo sapiens
aggatgtgtttgc

SEQ ID NO: 4178297 - DNA, 19 bp, Homo sapiens
aggatgtgtttgctttctg

SEQ ID NO: 4178298 - DNA, 14 bp, Homo sapiens
aggattaatttatt

SEQ ID NO: 4178299 - DNA, 21 bp, Homo sapiens
aggattgcaggtgcctggctt

SEQ ID NO: 4178300 - DNA, 15 bp, Homo sapiens
aggattggcctgtgt

SEQ ID NO: 4178301 - DNA, 13 bp, Homo sapiens
aggcaaagctgga

SEQ ID NO: 4178302 - DNA, 12 bp, Homo sapiens
aggcaagagaaa

SEQ ID NO: 4178303 - DNA, 17 bp, Homo sapiens
aggcaccaaaagaagta

SEQ ID NO: 4178304 - DNA, 19 bp, Homo sapiens
aggcaccccctggagagaa

SEQ ID NO: 4178305 - DNA, 19 bp, Homo sapiens
aggcaccttagtggctttt

SEQ ID NO: 4178306 - DNA, 22 bp, Homo sapiens
aggcagacgtggggagggtgga

SEQ ID NO: 4178307 - DNA, 18 bp, Homo sapiens
aggcagagaaagaagaga

SEQ ID NO: 4178308 - DNA, 19 bp, Homo sapiens
aggcagagaaagaagagac

SEQ ID NO: 4178309 - DNA, 21 bp, Homo sapiens
aggcagagaaagaagagacag

SEQ ID NO: 4178310 - DNA, 17 bp, Homo sapiens
aggcagagtgaaataaa

SEQ ID NO: 4178311 - DNA, 22 bp, Homo sapiens
aggcagagtgaaataaaatgct

SEQ ID NO: 4178312 - DNA, 12 bp, Homo sapiens
aggcagcctgcc

SEQ ID NO: 4178313 - DNA, 16 bp, Homo sapiens
aggcaggctcccaggg

SEQ ID NO: 4178314 - DNA, 12 bp, Homo sapiens
aggcagtagact

SEQ ID NO: 4178315 - DNA, 15 bp, Homo sapiens
aggcagttgaacctg

SEQ ID NO: 4178316 - DNA, 23 bp, Homo sapiens
aggcatagagggagaggaagcac

SEQ ID NO: 4178317 - DNA, 16 bp, Homo sapiens
aggcatgctggcctcc

SEQ ID NO: 4178318 - DNA, 14 bp, Homo sapiens
aggcattcctcatc

SEQ ID NO: 4178319 - DNA, 21 bp, Homo sapiens
aggcatttgcctaattcctgg

SEQ ID NO: 4178320 - DNA, 23 bp, Homo sapiens
aggccaaaattaccaaaaatctt

SEQ ID NO: 4178321 - DNA, 18 bp, Homo sapiens
aggccacgctcaggcccg

SEQ ID NO: 4178322 - DNA, 19 bp, Homo sapiens
aggccaggccaccaggatg

SEQ ID NO: 4178323 - DNA, 14 bp, Homo sapiens
aggccaggtgcagt

SEQ ID NO: 4178324 - DNA, 18 bp, Homo sapiens
aggccagtgggcctggta

SEQ ID NO: 4178325 - DNA, 14 bp, Homo sapiens
aggcccagcctgtc

SEQ ID NO: 4178326 - DNA, 14 bp, Homo sapiens
aggccccaggccct

SEQ ID NO: 4178327 - DNA, 13 bp, Homo sapiens
aggccctgtgccc

SEQ ID NO: 4178328 - DNA, 17 bp, Homo sapiens
aggcctcgtaccagcca

SEQ ID NO: 4178329 - DNA, 16 bp, Homo sapiens
aggcctgccctcaggg

SEQ ID NO: 4178330 - DNA, 17 bp, Homo sapiens
aggcctgccctcaggga

SEQ ID NO: 4178331 - DNA, 16 bp, Homo sapiens
aggcctggccaggcac

SEQ ID NO: 4178332 - DNA, 22 bp, Homo sapiens
aggccttagtacggctgctgca

SEQ ID NO: 4178333 - DNA, 18 bp, Homo sapiens
aggcgagtgccaggactc

SEQ ID NO: 4178334 - DNA, 16 bp, Homo sapiens
aggcgcgtctgcccca

SEQ ID NO: 4178335 - DNA, 22 bp, Homo sapiens
aggcgcgtctgccccaccctca

SEQ ID NO: 4178336 - DNA, 20 bp, Homo sapiens
aggcggaggttgcagtgagc

SEQ ID NO: 4178337 - DNA, 15 bp, Homo sapiens
aggcggctccaggtc

SEQ ID NO: 4178338 - DNA, 23 bp, Homo sapiens
aggctaatttttttgtattttag

SEQ ID NO: 4178339 - DNA, 17 bp, Homo sapiens
aggctcagcatgcagaa

SEQ ID NO: 4178340 - DNA, 18 bp, Homo sapiens
aggctcagcatgcagaag

SEQ ID NO: 4178341 - DNA, 17 bp, Homo sapiens
aggctcagtctcaggag

SEQ ID NO: 4178342 - DNA, 19 bp, Homo sapiens
aggctcagtctcaggagca

SEQ ID NO: 4178343 - DNA, 18 bp, Homo sapiens
aggctcccactgcccctg

SEQ ID NO: 4178344 - DNA, 19 bp, Homo sapiens
aggctcctgtgctactttg

SEQ ID NO: 4178345 - DNA, 22 bp, Homo sapiens
aggctcggccgtgggccgggag

SEQ ID NO: 4178346 - DNA, 13 bp, Homo sapiens
aggctgagacagg

SEQ ID NO: 4178347 - DNA, 14 bp, Homo sapiens
aggctgagacagga

SEQ ID NO: 4178348 - DNA, 16 bp, Homo sapiens
aggctgagactgcggg

SEQ ID NO: 4178349 - DNA, 13 bp, Homo sapiens
aggctgagctggc

SEQ ID NO: 4178350 - DNA, 16 bp, Homo sapiens
aggctgaggcaggaga

SEQ ID NO: 4178351 - DNA, 11 bp, Homo sapiens
aggctgaggcg

SEQ ID NO: 4178352 - DNA, 21 bp, Homo sapiens
aggctgaggcgggtggatcac

SEQ ID NO: 4178353 - DNA, 15 bp, Homo sapiens
aggctgcagcgagct

SEQ ID NO: 4178354 - DNA, 15 bp, Homo sapiens
aggctgcccaatctg

SEQ ID NO: 4178355 - DNA, 19 bp, Homo sapiens
aggctgcccaatctgagca

SEQ ID NO: 4178356 - DNA, 15 bp, Homo sapiens
aggctgctgggagat

SEQ ID NO: 4178357 - DNA, 12 bp, Homo sapiens
aggctggagaag

SEQ ID NO: 4178358 - DNA, 13 bp, Homo sapiens
aggctggagaagc

SEQ ID NO: 4178359 - DNA, 14 bp, Homo sapiens
aggctggagaagct

SEQ ID NO: 4178360 - DNA, 20 bp, Homo sapiens
aggctggagaagctcaccca

SEQ ID NO: 4178361 - DNA, 22 bp, Homo sapiens
aggctggctggcccgtcatgtt

SEQ ID NO: 4178362 - DNA, 20 bp, Homo sapiens
aggctggtgctgtggccagg

SEQ ID NO: 4178363 - DNA, 22 bp, Homo sapiens
aggctggtgctgtggccagggt

SEQ ID NO: 4178364 - DNA, 19 bp, Homo sapiens
aggctgtggggtctggctg

SEQ ID NO: 4178365 - DNA, 22 bp, Homo sapiens
aggctgtgtttggctttcaggg

SEQ ID NO: 4178366 - DNA, 16 bp, Homo sapiens
aggcttaggtgccagg

SEQ ID NO: 4178367 - DNA, 20 bp, Homo sapiens
aggcttcagcatatttatag

SEQ ID NO: 4178368 - DNA, 22 bp, Homo sapiens
aggcttcagggagcatatgaaa

SEQ ID NO: 4178369 - DNA, 14 bp, Homo sapiens
aggcttcttgccca

SEQ ID NO: 4178370 - DNA, 16 bp, Homo sapiens
aggcttcttgcccaga

SEQ ID NO: 4178371 - DNA, 16 bp, Homo sapiens
aggctttagaagagat

SEQ ID NO: 4178372 - DNA, 21 bp, Homo sapiens
agggaagacaggtctagactt

SEQ ID NO: 4178373 - DNA, 14 bp, Homo sapiens
agggaagagtgcat

SEQ ID NO: 4178374 - DNA, 12 bp, Homo sapiens
agggaagcaggg

SEQ ID NO: 4178375 - DNA, 17 bp, Homo sapiens
agggaagcctgactgct

SEQ ID NO: 4178376 - DNA, 19 bp, Homo sapiens
agggaagcctgactgctcg

SEQ ID NO: 4178377 - DNA, 18 bp, Homo sapiens
agggaaggaactctggct

SEQ ID NO: 4178378 - DNA, 19 bp, Homo sapiens
agggaataaggtacaagaa

SEQ ID NO: 4178379 - DNA, 15 bp, Homo sapiens
agggaatgggacagg

SEQ ID NO: 4178380 - DNA, 14 bp, Homo sapiens
agggacaacatttt

SEQ ID NO: 4178381 - DNA, 19 bp, Homo sapiens
agggacacacagtgacaaa

SEQ ID NO: 4178382 - DNA, 21 bp, Homo sapiens
agggacacctgggagaaatct

SEQ ID NO: 4178383 - DNA, 17 bp, Homo sapiens
agggacagagatggagg

SEQ ID NO: 4178384 - DNA, 19 bp, Homo sapiens
agggacctactgaacccag

SEQ ID NO: 4178385 - DNA, 14 bp, Homo sapiens
agggaccttgaagg

SEQ ID NO: 4178386 - DNA, 15 bp, Homo sapiens
agggaccttgaaggg

SEQ ID NO: 4178387 - DNA, 22 bp, Homo sapiens
agggagaaggatctagaatgtg

SEQ ID NO: 4178388 - DNA, 17 bp, Homo sapiens
agggagagcgcctcttc

SEQ ID NO: 4178389 - DNA, 15 bp, Homo sapiens
agggagaggaagcac

SEQ ID NO: 4178390 - DNA, 20 bp, Homo sapiens
agggagctaaattgaataca

SEQ ID NO: 4178391 - DNA, 22 bp, Homo sapiens
agggagctaaattgaatacaca

SEQ ID NO: 4178392 - DNA, 15 bp, Homo sapiens
agggagctgctggct

SEQ ID NO: 4178393 - DNA, 12 bp, Homo sapiens
agggagttggct

SEQ ID NO: 4178394 - DNA, 16 bp, Homo sapiens
agggagttggctggat

SEQ ID NO: 4178395 - DNA, 17 bp, Homo sapiens
agggataaggcagttga

SEQ ID NO: 4178396 - DNA, 22 bp, Homo sapiens
agggatgtgaattgcctgcaga

SEQ ID NO: 4178397 - DNA, 23 bp, Homo sapiens
agggatgtgaattgcctgcagag

SEQ ID NO: 4178398 - DNA, 18 bp, Homo sapiens
agggcaaaccatttcaaa

SEQ ID NO: 4178399 - DNA, 22 bp, Homo sapiens
agggcaagggccatgctgaagg

SEQ ID NO: 4178400 - DNA, 13 bp, Homo sapiens
agggcagaagggg

SEQ ID NO: 4178401 - DNA, 16 bp, Homo sapiens
agggcagcccccactt

SEQ ID NO: 4178402 - DNA, 16 bp, Homo sapiens
agggccaagacttggc

SEQ ID NO: 4178403 - DNA, 14 bp, Homo sapiens
agggccagggccct

SEQ ID NO: 4178404 - DNA, 13 bp, Homo sapiens
agggccctgcaga

SEQ ID NO: 4178405 - DNA, 14 bp, Homo sapiens
agggcccttcccaa

SEQ ID NO: 4178406 - DNA, 18 bp, Homo sapiens
agggcccttcccaacctc

SEQ ID NO: 4178407 - DNA, 20 bp, Homo sapiens
agggcccttcccaacctccc

SEQ ID NO: 4178408 - DNA, 16 bp, Homo sapiens
agggccttttgtggat

SEQ ID NO: 4178409 - DNA, 16 bp, Homo sapiens
agggctccctcctgga

SEQ ID NO: 4178410 - DNA, 20 bp, Homo sapiens
agggctccctcctggagcat

SEQ ID NO: 4178411 - DNA, 20 bp, Homo sapiens
agggctgatagagtgatttt

SEQ ID NO: 4178412 - DNA, 12 bp, Homo sapiens
agggctgcccct

SEQ ID NO: 4178413 - DNA, 22 bp, Homo sapiens
agggctgcccctgtaggttgct

SEQ ID NO: 4178414 - DNA, 13 bp, Homo sapiens
agggctgctgtgg

SEQ ID NO: 4178415 - DNA, 15 bp, Homo sapiens
agggctgctgtggcc

SEQ ID NO: 4178416 - DNA, 12 bp, Homo sapiens
agggctgggccc

SEQ ID NO: 4178417 - DNA, 14 bp, Homo sapiens
agggctgggcccac

SEQ ID NO: 4178418 - DNA, 13 bp, Homo sapiens
agttcttctccaa

SEQ ID NO: 4178419 - DNA, 17 bp, Homo sapiens
agttctttaaaatgtaa

SEQ ID NO: 4178420 - DNA, 14 bp, Homo sapiens
agttctttactggt

SEQ ID NO: 4178421 - DNA, 13 bp, Homo sapiens
agttgaacatctc

SEQ ID NO: 4178422 - DNA, 14 bp, Homo sapiens
agttgaagcaaatc

SEQ ID NO: 4178423 - DNA, 21 bp, Homo sapiens
agttgaatgacaacagaagct

SEQ ID NO: 4178424 - DNA, 13 bp, Homo sapiens
agttgacagcagg

SEQ ID NO: 4178425 - DNA, 16 bp, Homo sapiens
agttgacttactgttt

SEQ ID NO: 4178426 - DNA, 20 bp, Homo sapiens
agttgagtcgtcatcacttt

SEQ ID NO: 4178427 - DNA, 14 bp, Homo sapiens
agttgagtgaaatt

SEQ ID NO: 4178428 - DNA, 23 bp, Homo sapiens
agttgataaagattttttaataa

SEQ ID NO: 4178429 - DNA, 18 bp, Homo sapiens
agttgccgtctaggattg

SEQ ID NO: 4178430 - DNA, 19 bp, Homo sapiens
agttggtcttatagaaagc

SEQ ID NO: 4178431 - DNA, 18 bp, Homo sapiens
agttggtgaacagagaga

SEQ ID NO: 4178432 - DNA, 18 bp, Homo sapiens
agttgtacgtaatgtatt

SEQ ID NO: 4178433 - DNA, 19 bp, Homo sapiens
agttgtgccttttatagct

SEQ ID NO: 4178434 - DNA, 22 bp, Homo sapiens
agttgtgccttttatagctatt

SEQ ID NO: 4178435 - DNA, 18 bp, Homo sapiens
agttgtggaaagcctctg

SEQ ID NO: 4178436 - DNA, 18 bp, Homo sapiens
agttgttactgaagttat

SEQ ID NO: 4178437 - DNA, 23 bp, Homo sapiens
agttgttactgaagttatctgtg

SEQ ID NO: 4178438 - DNA, 15 bp, Homo sapiens
agttgttcacatata

SEQ ID NO: 4178439 - DNA, 15 bp, Homo sapiens
agtttaaaaatatta

SEQ ID NO: 4178440 - DNA, 21 bp, Homo sapiens
agtttaagaatcacatacagt

SEQ ID NO: 4178441 - DNA, 17 bp, Homo sapiens
agtttaataaatttatt

SEQ ID NO: 4178442 - DNA, 17 bp, Homo sapiens
agtttaatactcagagg

SEQ ID NO: 4178443 - DNA, 20 bp, Homo sapiens
agtttaattaactatgtgat

SEQ ID NO: 4178444 - DNA, 15 bp, Homo sapiens
agtttacaagtgtat

SEQ ID NO: 4178445 - DNA, 14 bp, Homo sapiens
agtttacagtaaat

SEQ ID NO: 4178446 - DNA, 20 bp, Homo sapiens
agtttacagtaaataaattg

SEQ ID NO: 4178447 - DNA, 22 bp, Homo sapiens
agtttacagtaaataaattgtt

SEQ ID NO: 4178448 - DNA, 13 bp, Homo sapiens
agtttacttcatg

SEQ ID NO: 4178449 - DNA, 21 bp, Homo sapiens
agtttagaagcgctcatctgg

SEQ ID NO: 4178450 - DNA, 16 bp, Homo sapiens
agtttagcccatctct

SEQ ID NO: 4178451 - DNA, 21 bp, Homo sapiens
agtttagcccttccctgcctt

SEQ ID NO: 4178452 - DNA, 15 bp, Homo sapiens
agtttatatttaact

SEQ ID NO: 4178453 - DNA, 18 bp, Homo sapiens
agtttatatttaactctc

SEQ ID NO: 4178454 - DNA, 13 bp, Homo sapiens
agtttcagaagca

SEQ ID NO: 4178455 - DNA, 23 bp, Homo sapiens
agtttcagatatatatcatattg

SEQ ID NO: 4178456 - DNA, 16 bp, Homo sapiens
agtttcatataaagta

SEQ ID NO: 4178457 - DNA, 21 bp, Homo sapiens
agtttgaaggaggtgagggat

SEQ ID NO: 4178458 - DNA, 17 bp, Homo sapiens
agtttgatattaaagga

SEQ ID NO: 4178459 - DNA, 17 bp, Homo sapiens
agtttgatcaaatctaa

SEQ ID NO: 4178460 - DNA, 20 bp, Homo sapiens
agtttgcactgtatgctgga

SEQ ID NO: 4178461 - DNA, 20 bp, Homo sapiens
agtttggatatgtaaaacat

SEQ ID NO: 4178462 - DNA, 18 bp, Homo sapiens
agtttgtacatgcattca

SEQ ID NO: 4178463 - DNA, 14 bp, Homo sapiens
agtttgtataactt

SEQ ID NO: 4178464 - DNA, 12 bp, Homo sapiens
agtttgttttac

SEQ ID NO: 4178465 - DNA, 20 bp, Homo sapiens
agtttgttttacaaattttt

SEQ ID NO: 4178466 - DNA, 22 bp, Homo sapiens
agttttccatggcaggaaggct

SEQ ID NO: 4178467 - DNA, 18 bp, Homo sapiens
agttttcctatgctttga

SEQ ID NO: 4178468 - DNA, 14 bp, Homo sapiens
agttttgggagggg

SEQ ID NO: 4178469 - DNA, 21 bp, Homo sapiens
agtttttaacaatctaacaat

SEQ ID NO: 4178470 - DNA, 15 bp, Homo sapiens
agttttttgtaccaa

SEQ ID NO: 4178471 - DNA, 15 bp, Homo sapiens
ataaaaataccttaa

SEQ ID NO: 4178472 - DNA, 11 bp, Homo sapiens
ataaaaccatg

SEQ ID NO: 4178473 - DNA, 20 bp, Homo sapiens
ataaaacctttcaaatttca

SEQ ID NO: 4178474 - DNA, 22 bp, Homo sapiens
ataaaacctttcaaatttcaca

SEQ ID NO: 4178475 - DNA, 15 bp, Homo sapiens
ataaaactgctttgt

SEQ ID NO: 4178476 - DNA, 21 bp, Homo sapiens
ataaaataggcttagagagga

SEQ ID NO: 4178477 - DNA, 19 bp, Homo sapiens
ataaaatgaggacatgttt

SEQ ID NO: 4178478 - DNA, 11 bp, Homo sapiens
ataaacaaatg

SEQ ID NO: 4178479 - DNA, 21 bp, Homo sapiens
ataaacactgcctatatatgt

SEQ ID NO: 4178480 - DNA, 23 bp, Homo sapiens
ataaacattaagattgaggcctg

SEQ ID NO: 4178481 - DNA, 15 bp, Homo sapiens
ataaacttagaataa

SEQ ID NO: 4178482 - DNA, 13 bp, Homo sapiens
ataaagagttaga

SEQ ID NO: 4178483 - DNA, 13 bp, Homo sapiens
ataaagatttttt

SEQ ID NO: 4178484 - DNA, 16 bp, Homo sapiens
ataaagattttttaat

SEQ ID NO: 4178485 - DNA, 20 bp, Homo sapiens
ataaagctggacaagaagct

SEQ ID NO: 4178486 - DNA, 22 bp, Homo sapiens
ataaagctggacaagaagctgc

SEQ ID NO: 4178487 - DNA, 15 bp, Homo sapiens
ataaagtatcatcag

SEQ ID NO: 4178488 - DNA, 14 bp, Homo sapiens
ataaatatgtgaaa

SEQ ID NO: 4178489 - DNA, 23 bp, Homo sapiens
ataaatcagcacatttgaaagaa

SEQ ID NO: 4178490 - DNA, 12 bp, Homo sapiens
ataaatgttcaa

SEQ ID NO: 4178491 - DNA, 12 bp, Homo sapiens
ataaattcagat

SEQ ID NO: 4178492 - DNA, 13 bp, Homo sapiens
ataaattcagata

SEQ ID NO: 4178493 - DNA, 13 bp, Homo sapiens
ataaattcataac

SEQ ID NO: 4178494 - DNA, 17 bp, Homo sapiens
ataacagcaaggaaaca

SEQ ID NO: 4178495 - DNA, 19 bp, Homo sapiens
ataaccaagaaatactaat

SEQ ID NO: 4178496 - DNA, 18 bp, Homo sapiens
ataacctatatgatttat

SEQ ID NO: 4178497 - DNA, 17 bp, Homo sapiens
ataacgtttaagccaaa

SEQ ID NO: 4178498 - DNA, 18 bp, Homo sapiens
ataacgtttaagccaaaa

SEQ ID NO: 4178499 - DNA, 21 bp, Homo sapiens
ataactgaaaattatttaaac

SEQ ID NO: 4178500 - DNA, 16 bp, Homo sapiens
ataacttcttaaaagt

SEQ ID NO: 4178501 - DNA, 19 bp, Homo sapiens
ataacttcttaaaagttgt

SEQ ID NO: 4178502 - DNA, 16 bp, Homo sapiens
ataagaactttgagct

SEQ ID NO: 4178503 - DNA, 20 bp, Homo sapiens
ataagaagaatgcttaatca

SEQ ID NO: 4178504 - DNA, 18 bp, Homo sapiens
ataagaatggttgcctta

SEQ ID NO: 4178505 - DNA, 17 bp, Homo sapiens
ataagatggagaataaa

SEQ ID NO: 4178506 - DNA, 18 bp, Homo sapiens
ataagatggagaataaat

SEQ ID NO: 4178507 - DNA, 16 bp, Homo sapiens
ataagcaagaaggcaa

SEQ ID NO: 4178508 - DNA, 21 bp, Homo sapiens
ataagccaagggctaggctct

SEQ ID NO: 4178509 - DNA, 15 bp, Homo sapiens
ataagctatttatgt

SEQ ID NO: 4178510 - DNA, 20 bp, Homo sapiens
ataaggaaatcaacttgctt

SEQ ID NO: 4178511 - DNA, 19 bp, Homo sapiens
ataagttggagaaatgttt

SEQ ID NO: 4178512 - DNA, 14 bp, Homo sapiens
ataataaaaagata

SEQ ID NO: 4178513 - DNA, 17 bp, Homo sapiens
ataataaaggtcacata

SEQ ID NO: 4178514 - DNA, 21 bp, Homo sapiens
ataataaaggtcacataaact

SEQ ID NO: 4178515 - DNA, 21 bp, Homo sapiens
ataatacactaattcctttct

SEQ ID NO: 4178516 - DNA, 19 bp, Homo sapiens
ataatatttcaagtgccta

SEQ ID NO: 4178517 - DNA, 20 bp, Homo sapiens
ataatatttcaagtgcctag

SEQ ID NO: 4178518 - DNA, 13 bp, Homo sapiens
ataatcagaagct

SEQ ID NO: 4178519 - DNA, 20 bp, Homo sapiens
ataatcagcgccctggagtc

SEQ ID NO: 4178520 - DNA, 17 bp, Homo sapiens
ataatgaacagaacata

SEQ ID NO: 4178521 - DNA, 15 bp, Homo sapiens
ataatgccttgtatg

SEQ ID NO: 4178522 - DNA, 15 bp, Homo sapiens
ataattaatgtgtgt

SEQ ID NO: 4178523 - DNA, 22 bp, Homo sapiens
ataattcttccagtgcaacaaa

SEQ ID NO: 4178524 - DNA, 18 bp, Homo sapiens
ataattgctttgccaaaa

SEQ ID NO: 4178525 - DNA, 13 bp, Homo sapiens
ataatttaacagt

SEQ ID NO: 4178526 - DNA, 17 bp, Homo sapiens
ataatttatggtattgt

SEQ ID NO: 4178527 - DNA, 13 bp, Homo sapiens
ataattttatgtg

SEQ ID NO: 4178528 - DNA, 16 bp, Homo sapiens
ataattttttattcaa

SEQ ID NO: 4178529 - DNA, 18 bp, Homo sapiens
atacaaaaatactcagat

SEQ ID NO: 4178530 - DNA, 15 bp, Homo sapiens
atacaacaagaacaa

SEQ ID NO: 4178531 - DNA, 17 bp, Homo sapiens
atacaacaagaacaaca

SEQ ID NO: 4178532 - DNA, 16 bp, Homo sapiens
atacaactagagatat

SEQ ID NO: 4178533 - DNA, 14 bp, Homo sapiens
atacaatattaatt

SEQ ID NO: 4178534 - DNA, 13 bp, Homo sapiens
atacatagtaaat

SEQ ID NO: 4178535 - DNA, 13 bp, Homo sapiens
atacatcctattt

SEQ ID NO: 4178536 - DNA, 20 bp, Homo sapiens
atacattagcagctatgtaa

SEQ ID NO: 4178537 - DNA, 13 bp, Homo sapiens
ataccacaagcct

SEQ ID NO: 4178538 - DNA, 15 bp, Homo sapiens
ataccagagccttca

SEQ ID NO: 4178539 - DNA, 19 bp, Homo sapiens
ataccagagccttcaagtg

SEQ ID NO: 4178540 - DNA, 22 bp, Homo sapiens
ataccagagccttcaagtgcca

SEQ ID NO: 4178541 - DNA, 23 bp, Homo sapiens
ataccagagccttcaagtgccaa

SEQ ID NO: 4178542 - DNA, 20 bp, Homo sapiens
ataccagctttttctctcag

SEQ ID NO: 4178543 - DNA, 14 bp, Homo sapiens
ataccgaccatcgt

SEQ ID NO: 4178544 - DNA, 18 bp, Homo sapiens
atacctctggcttagaaa

SEQ ID NO: 4178545 - DNA, 16 bp, Homo sapiens
atacgcactacatgtg

SEQ ID NO: 4178546 - DNA, 17 bp, Homo sapiens
atacgcactacatgtgg

SEQ ID NO: 4178547 - DNA, 20 bp, Homo sapiens
atacgtgttcctataaaatc

SEQ ID NO: 4178548 - DNA, 17 bp, Homo sapiens
atactaagcattgaatg

SEQ ID NO: 4178549 - DNA, 12 bp, Homo sapiens
atactatacaac

SEQ ID NO: 4178550 - DNA, 17 bp, Homo sapiens
atactatacaacaatgt

SEQ ID NO: 4178551 - DNA, 13 bp, Homo sapiens
atactcagagggg

SEQ ID NO: 4178552 - DNA, 17 bp, Homo sapiens
atactcatttttcatga

SEQ ID NO: 4178553 - DNA, 23 bp, Homo sapiens
atgagaaactttgatctctgctt

SEQ ID NO: 4178554 - DNA, 22 bp, Homo sapiens
atgagaaatacaaaaatactca

SEQ ID NO: 4178555 - DNA, 19 bp, Homo sapiens
atgagatgctggcttgggc

SEQ ID NO: 4178556 - DNA, 22 bp, Homo sapiens
atgagatgctggcttgggcagc

SEQ ID NO: 4178557 - DNA, 22 bp, Homo sapiens
atgagattgttttatcatgaca

SEQ ID NO: 4178558 - DNA, 20 bp, Homo sapiens
atgagcgtcctaaggcatgt

SEQ ID NO: 4178559 - DNA, 13 bp, Homo sapiens
atgaggaaagaca

SEQ ID NO: 4178560 - DNA, 17 bp, Homo sapiens
atgaggaaagacacaga

SEQ ID NO: 4178561 - DNA, 13 bp, Homo sapiens
atgaggacatgtt

SEQ ID NO: 4178562 - DNA, 13 bp, Homo sapiens
atgagggactgga

SEQ ID NO: 4178563 - DNA, 14 bp, Homo sapiens
atgagttggacttc

SEQ ID NO: 4178564 - DNA, 18 bp, Homo sapiens
atgagttggacttcagtc

SEQ ID NO: 4178565 - DNA, 14 bp, Homo sapiens
atgagtttgcttat

SEQ ID NO: 4178566 - DNA, 16 bp, Homo sapiens
atgatagtgtgatttt

SEQ ID NO: 4178567 - DNA, 23 bp, Homo sapiens
atgatcattgaaagtaaaaaata

SEQ ID NO: 4178568 - DNA, 20 bp, Homo sapiens
atgatcctgtattcagacag

SEQ ID NO: 4178569 - DNA, 16 bp, Homo sapiens
atgatgaaacattcat

SEQ ID NO: 4178570 - DNA, 15 bp, Homo sapiens
atgatgataaacact

SEQ ID NO: 4178571 - DNA, 22 bp, Homo sapiens
atgatgcctctgtcttctggac

SEQ ID NO: 4178572 - DNA, 17 bp, Homo sapiens
atgatggagcgcacctg

SEQ ID NO: 4178573 - DNA, 22 bp, Homo sapiens
atgatgttaaaaaaataagaag

SEQ ID NO: 4178574 - DNA, 15 bp, Homo sapiens
atgatgtttcacata

SEQ ID NO: 4178575 - DNA, 15 bp, Homo sapiens
atgattattatttaa

SEQ ID NO: 4178576 - DNA, 18 bp, Homo sapiens
atgattgtaaaatagctt

SEQ ID NO: 4178577 - DNA, 17 bp, Homo sapiens
atgattgtataatgtga

SEQ ID NO: 4178578 - DNA, 21 bp, Homo sapiens
atgattgtataatgtgatttt

SEQ ID NO: 4178579 - DNA, 20 bp, Homo sapiens
atgatttagggaagcaggga

SEQ ID NO: 4178580 - DNA, 13 bp, Homo sapiens
atgatttatagtt

SEQ ID NO: 4178581 - DNA, 15 bp, Homo sapiens
atgatttatagtttg

SEQ ID NO: 4178582 - DNA, 19 bp, Homo sapiens
atgatttctgtgaagcaaa

SEQ ID NO: 4178583 - DNA, 12 bp, Homo sapiens
atgattttcctc

SEQ ID NO: 4178584 - DNA, 13 bp, Homo sapiens
atgatttttagat

SEQ ID NO: 4178585 - DNA, 16 bp, Homo sapiens
atgatttttgctattt

SEQ ID NO: 4178586 - DNA, 19 bp, Homo sapiens
atgatttttgctatttcta

SEQ ID NO: 4178587 - DNA, 21 bp, Homo sapiens
atgcaaaataatacctgtcca

SEQ ID NO: 4178588 - DNA, 16 bp, Homo sapiens
atgcaacaaatattta

SEQ ID NO: 4178589 - DNA, 19 bp, Homo sapiens
atgcaattggggaagaaaa

SEQ ID NO: 4178590 - DNA, 20 bp, Homo sapiens
atgcacactgttggaatgta

SEQ ID NO: 4178591 - DNA, 21 bp, Homo sapiens
atgcaccacccatggagaggt

SEQ ID NO: 4178592 - DNA, 15 bp, Homo sapiens
atgcacctaaagaaa

SEQ ID NO: 4178593 - DNA, 16 bp, Homo sapiens
atgcacctcagggcca

SEQ ID NO: 4178594 - DNA, 20 bp, Homo sapiens
atgcactacacttttgatgt

SEQ ID NO: 4178595 - DNA, 19 bp, Homo sapiens
atgcagaatgttgattaca

SEQ ID NO: 4178596 - DNA, 21 bp, Homo sapiens
atgcagaatgttgattacagt

SEQ ID NO: 4178597 - DNA, 21 bp, Homo sapiens
atgcagaggggtgctgctcct

SEQ ID NO: 4178598 - DNA, 16 bp, Homo sapiens
atgcaggggtcagtgc

SEQ ID NO: 4178599 - DNA, 20 bp, Homo sapiens
atgcatctgtttattctata

SEQ ID NO: 4178600 - DNA, 18 bp, Homo sapiens
atgcatgcgcaggctcat

SEQ ID NO: 4178601 - DNA, 20 bp, Homo sapiens
atgcatggaaacctgaaaaa

SEQ ID NO: 4178602 - DNA, 23 bp, Homo sapiens
atgcatggaaacctgaaaaaaag

SEQ ID NO: 4178603 - DNA, 23 bp, Homo sapiens
atgcatggtgcagttgacagcag

SEQ ID NO: 4178604 - DNA, 18 bp, Homo sapiens
atgccaaaaaaaaataca

SEQ ID NO: 4178605 - DNA, 18 bp, Homo sapiens
atgccaaagcaaaagaag

SEQ ID NO: 4178606 - DNA, 18 bp, Homo sapiens
atgccaagtggccctcag

SEQ ID NO: 4178607 - DNA, 19 bp, Homo sapiens
atgccaccctgttttcagc

SEQ ID NO: 4178608 - DNA, 20 bp, Homo sapiens
atgccaccctgttttcagct

SEQ ID NO: 4178609 - DNA, 23 bp, Homo sapiens
atgcccagagggcccaggcaggc

SEQ ID NO: 4178610 - DNA, 14 bp, Homo sapiens
atgcccagataata

SEQ ID NO: 4178611 - DNA, 13 bp, Homo sapiens
atgccgggcgtgg

SEQ ID NO: 4178612 - DNA, 20 bp, Homo sapiens
atgccggttaaattccatat

SEQ ID NO: 4178613 - DNA, 22 bp, Homo sapiens
atgccgtgtgtctcgtctcctg

SEQ ID NO: 4178614 - DNA, 23 bp, Homo sapiens
atgccgtgtgtctcgtctcctga

SEQ ID NO: 4178615 - DNA, 15 bp, Homo sapiens
atgcctcaatgtgac

SEQ ID NO: 4178616 - DNA, 13 bp, Homo sapiens
atgcctggccccc

SEQ ID NO: 4178617 - DNA, 21 bp, Homo sapiens
atgcctggcccccctccaggc

SEQ ID NO: 4178618 - DNA, 16 bp, Homo sapiens
atgcctggtctttcct

SEQ ID NO: 4178619 - DNA, 18 bp, Homo sapiens
atgcctggtctttcctct

SEQ ID NO: 4178620 - DNA, 24 bp, Homo sapiens
atgcctgtagctttcctggtccct

SEQ ID NO: 4178621 - DNA, 20 bp, Homo sapiens
atgccttttaccatgaattc

SEQ ID NO: 4178622 - DNA, 23 bp, Homo sapiens
atgccttttcccaaaatgttgaa

SEQ ID NO: 4178623 - DNA, 15 bp, Homo sapiens
atgctaagagaagta

SEQ ID NO: 4178624 - DNA, 18 bp, Homo sapiens
atgctaagagaagtagaa

SEQ ID NO: 4178625 - DNA, 15 bp, Homo sapiens
atgctcacagtctca

SEQ ID NO: 4178626 - DNA, 13 bp, Homo sapiens
atgctcagccctg

SEQ ID NO: 4178627 - DNA, 18 bp, Homo sapiens
atgctcagccctgactgg

SEQ ID NO: 4178628 - DNA, 12 bp, Homo sapiens
atgctgaaggga

SEQ ID NO: 4178629 - DNA, 13 bp, Homo sapiens
atgctgcctgagt

SEQ ID NO: 4178630 - DNA, 15 bp, Homo sapiens
atgctgcttctcctc

SEQ ID NO: 4178631 - DNA, 23 bp, Homo sapiens
atgctggcctcccaataaagctg

SEQ ID NO: 4178632 - DNA, 22 bp, Homo sapiens
atgctggggcaagtccctgact

SEQ ID NO: 4178633 - DNA, 15 bp, Homo sapiens
atgctttccttttct

SEQ ID NO: 4178634 - DNA, 14 bp, Homo sapiens
atggaaaaataaca

SEQ ID NO: 4178635 - DNA, 17 bp, Homo sapiens
atggaaaacatttacat

SEQ ID NO: 4178636 - DNA, 23 bp, Homo sapiens
atggaaaacatttacatcaaatc

SEQ ID NO: 4178637 - DNA, 16 bp, Homo sapiens
atggaaacctgaaaaa

SEQ ID NO: 4178638 - DNA, 13 bp, Homo sapiens
atggaaaggccag

SEQ ID NO: 4178639 - DNA, 17 bp, Homo sapiens
atggaaatataggctat

SEQ ID NO: 4178640 - DNA, 24 bp, Homo sapiens
atggaacattttctgtgtgtacat

SEQ ID NO: 4178641 - DNA, 19 bp, Homo sapiens
atggaacttctaatatatt

SEQ ID NO: 4178642 - DNA, 18 bp, Homo sapiens
atggaagataattttatg

SEQ ID NO: 4178643 - DNA, 23 bp, Homo sapiens
atggaaggttaggtttgtcaaca

SEQ ID NO: 4178644 - DNA, 18 bp, Homo sapiens
atggaatttaatttatgt

SEQ ID NO: 4178645 - DNA, 12 bp, Homo sapiens
atggaatttgta

SEQ ID NO: 4178646 - DNA, 21 bp, Homo sapiens
atggaatttgtaagtttatgt

SEQ ID NO: 4178647 - DNA, 13 bp, Homo sapiens
atggacacagacc

SEQ ID NO: 4178648 - DNA, 22 bp, Homo sapiens
atggacacagacccacacatgt

SEQ ID NO: 4178649 - DNA, 17 bp, Homo sapiens
atggacttaaatgttaa

SEQ ID NO: 4178650 - DNA, 14 bp, Homo sapiens
atggacttcaaatt

SEQ ID NO: 4178651 - DNA, 17 bp, Homo sapiens
atggagagggggtacaa

SEQ ID NO: 4178652 - DNA, 23 bp, Homo sapiens
atggagaggtttgtcaacacaaa

SEQ ID NO: 4178653 - DNA, 17 bp, Homo sapiens
atggagcgcacctgccc

SEQ ID NO: 4178654 - DNA, 15 bp, Homo sapiens
atggagtctgcagtg

SEQ ID NO: 4178655 - DNA, 11 bp, Homo sapiens
atggagtgacg

SEQ ID NO: 4178656 - DNA, 19 bp, Homo sapiens
atggagtgggagatcagcc

SEQ ID NO: 4178657 - DNA, 14 bp, Homo sapiens
atggatttgaagca

SEQ ID NO: 4178658 - DNA, 15 bp, Homo sapiens
atggatttgaagcaa

SEQ ID NO: 4178659 - DNA, 14 bp, Homo sapiens
atggcaaaaatggc

SEQ ID NO: 4178660 - DNA, 21 bp, Homo sapiens
atggcaaagcggttgcttctg

SEQ ID NO: 4178661 - DNA, 19 bp, Homo sapiens
atggcatgagaaatacaaa

SEQ ID NO: 4178662 - DNA, 15 bp, Homo sapiens
atggcatgctccttg

SEQ ID NO: 4178663 - DNA, 18 bp, Homo sapiens
atggccacaaagggacac

SEQ ID NO: 4178664 - DNA, 19 bp, Homo sapiens
atggcctgccttgaagcca

SEQ ID NO: 4178665 - DNA, 20 bp, Homo sapiens
atggcgtgtccctctcggaa

SEQ ID NO: 4178666 - DNA, 15 bp, Homo sapiens
atggctctgttatgc

SEQ ID NO: 4178667 - DNA, 20 bp, Homo sapiens
atggctgataattttaaatt

SEQ ID NO: 4178668 - DNA, 12 bp, Homo sapiens
atgggaagccat

SEQ ID NO: 4178669 - DNA, 22 bp, Homo sapiens
atgggaagccatattcacacct

SEQ ID NO: 4178670 - DNA, 23 bp, Homo sapiens
atgggaattctttacaataaaca

SEQ ID NO: 4178671 - DNA, 18 bp, Homo sapiens
atgggactgtgcctttgg

SEQ ID NO: 4178672 - DNA, 15 bp, Homo sapiens
atgggagagtagatg

SEQ ID NO: 4178673 - DNA, 17 bp, Homo sapiens
atgggattctggacagg

SEQ ID NO: 4178674 - DNA, 13 bp, Homo sapiens
atgggcctgctgc

SEQ ID NO: 4178675 - DNA, 20 bp, Homo sapiens
atgggtactccagcaggtag

SEQ ID NO: 4178676 - DNA, 21 bp, Homo sapiens
atgggtcacacctgacaaatg

SEQ ID NO: 4178677 - DNA, 16 bp, Homo sapiens
atggtaccagatgcag

SEQ ID NO: 4178678 - DNA, 17 bp, Homo sapiens
atggtattgtattgtaa

SEQ ID NO: 4178679 - DNA, 22 bp, Homo sapiens
atggtattgtattgtaaaccat

SEQ ID NO: 4178680 - DNA, 17 bp, Homo sapiens
atggtcctggggctctg

SEQ ID NO: 4178681 - DNA, 19 bp, Homo sapiens
atggtcctggggctctgtg

SEQ ID NO: 4178682 - DNA, 14 bp, Homo sapiens
atggtctcagaaac

SEQ ID NO: 4178683 - DNA, 18 bp, Homo sapiens
atggtctttgggcaggga

SEQ ID NO: 4178684 - DNA, 17 bp, Homo sapiens
atggtgaaatttattag

SEQ ID NO: 4178685 - DNA, 19 bp, Homo sapiens
atggtgcattacgtgggca

SEQ ID NO: 4178686 - DNA, 14 bp, Homo sapiens
atttgtatctgaag

SEQ ID NO: 4178687 - DNA, 21 bp, Homo sapiens
atttgtatctgaaggagattt

SEQ ID NO: 4178688 - DNA, 14 bp, Homo sapiens
atttgtattttaaa

SEQ ID NO: 4178689 - DNA, 15 bp, Homo sapiens
atttgtgaactggaa

SEQ ID NO: 4178690 - DNA, 17 bp, Homo sapiens
atttgttatttgtacag

SEQ ID NO: 4178691 - DNA, 19 bp, Homo sapiens
atttgttatttgtacagtt

SEQ ID NO: 4178692 - DNA, 17 bp, Homo sapiens
atttgttattttcagta

SEQ ID NO: 4178693 - DNA, 19 bp, Homo sapiens
attttaaaaagatttgttt

SEQ ID NO: 4178694 - DNA, 15 bp, Homo sapiens
attttaaataagatg

SEQ ID NO: 4178695 - DNA, 11 bp, Homo sapiens
attttaaatgt

SEQ ID NO: 4178696 - DNA, 16 bp, Homo sapiens
attttaaatgttttac

SEQ ID NO: 4178697 - DNA, 21 bp, Homo sapiens
attttaagcattcttagacta

SEQ ID NO: 4178698 - DNA, 14 bp, Homo sapiens
attttaatttatat

SEQ ID NO: 4178699 - DNA, 19 bp, Homo sapiens
attttaatttatatttgaa

SEQ ID NO: 4178700 - DNA, 19 bp, Homo sapiens
attttaatttgatacaaaa

SEQ ID NO: 4178701 - DNA, 20 bp, Homo sapiens
attttactgattaacaaata

SEQ ID NO: 4178702 - DNA, 23 bp, Homo sapiens
attttagacactgggagaagaga

SEQ ID NO: 4178703 - DNA, 16 bp, Homo sapiens
attttatggtgcatta

SEQ ID NO: 4178704 - DNA, 19 bp, Homo sapiens
attttattctatgtatgtt

SEQ ID NO: 4178705 - DNA, 12 bp, Homo sapiens
attttcagtatt

SEQ ID NO: 4178706 - DNA, 17 bp, Homo sapiens
attttcattttaattta

SEQ ID NO: 4178707 - DNA, 19 bp, Homo sapiens
attttctagactttctgtt

SEQ ID NO: 4178708 - DNA, 22 bp, Homo sapiens
attttctggattccccatctca

SEQ ID NO: 4178709 - DNA, 23 bp, Homo sapiens
attttctgtgtgtacatgtacat

SEQ ID NO: 4178710 - DNA, 24 bp, Homo sapiens
attttgacataaagttgataaaga

SEQ ID NO: 4178711 - DNA, 19 bp, Homo sapiens
attttgacttgaaaaatat

SEQ ID NO: 4178712 - DNA, 23 bp, Homo sapiens
attttgagtgactcgagggttgg

SEQ ID NO: 4178713 - DNA, 18 bp, Homo sapiens
attttgagtggcaaaata

SEQ ID NO: 4178714 - DNA, 13 bp, Homo sapiens
attttgcctgtgt

SEQ ID NO: 4178715 - DNA, 12 bp, Homo sapiens
attttgtctacc

SEQ ID NO: 4178716 - DNA, 17 bp, Homo sapiens
attttgttctttaagga

SEQ ID NO: 4178717 - DNA, 13 bp, Homo sapiens
atttttaaacaag

SEQ ID NO: 4178718 - DNA, 14 bp, Homo sapiens
atttttaaacaagt

SEQ ID NO: 4178719 - DNA, 13 bp, Homo sapiens
atttttacaataa

SEQ ID NO: 4178720 - DNA, 15 bp, Homo sapiens
atttttataaatatg

SEQ ID NO: 4178721 - DNA, 14 bp, Homo sapiens
atttttcaatattt

SEQ ID NO: 4178722 - DNA, 16 bp, Homo sapiens
atttttgaaacccatt

SEQ ID NO: 4178723 - DNA, 21 bp, Homo sapiens
atttttgaaacccattaggca

SEQ ID NO: 4178724 - DNA, 17 bp, Homo sapiens
atttttgagcaggagca

SEQ ID NO: 4178725 - DNA, 22 bp, Homo sapiens
atttttgagcaggagcagaaag

SEQ ID NO: 4178726 - DNA, 19 bp, Homo sapiens
atttttgtatttttagtag

SEQ ID NO: 4178727 - DNA, 14 bp, Homo sapiens
attttttaaaaaag

SEQ ID NO: 4178728 - DNA, 19 bp, Homo sapiens
attttttaaaaaagcttaa

SEQ ID NO: 4178729 - DNA, 14 bp, Homo sapiens
attttttaataaaa

SEQ ID NO: 4178730 - DNA, 16 bp, Homo sapiens
atttttttgaaaaaag

SEQ ID NO: 4178731 - DNA, 16 bp, Homo sapiens
atttttttgtaaagga

SEQ ID NO: 4178732 - DNA, 21 bp, Homo sapiens
atttttttgtaaaggaaataa

SEQ ID NO: 4178733 - DNA, 12 bp, Homo sapiens
caaaaaagaaaa

SEQ ID NO: 4178734 - DNA, 14 bp, Homo sapiens
caaaaaagaaaacc

SEQ ID NO: 4178735 - DNA, 19 bp, Homo sapiens
caaaaaagtatttttttaa

SEQ ID NO: 4178736 - DNA, 22 bp, Homo sapiens
caaaaagctcttacactacatt

SEQ ID NO: 4178737 - DNA, 17 bp, Homo sapiens
caaaacaaaacaacaac

SEQ ID NO: 4178738 - DNA, 16 bp, Homo sapiens
caaaacaatgtttaaa

SEQ ID NO: 4178739 - DNA, 21 bp, Homo sapiens
caaaacacttaggaagaaatc

SEQ ID NO: 4178740 - DNA, 16 bp, Homo sapiens
caaaacttcctgtttg

SEQ ID NO: 4178741 - DNA, 20 bp, Homo sapiens
caaaagaagaagtttcatca

SEQ ID NO: 4178742 - DNA, 12 bp, Homo sapiens
caaaagaagtaa

SEQ ID NO: 4178743 - DNA, 15 bp, Homo sapiens
caaaagattgtttta

SEQ ID NO: 4178744 - DNA, 15 bp, Homo sapiens
caaaagcaaatgaga

SEQ ID NO: 4178745 - DNA, 15 bp, Homo sapiens
caaaagccaaaaggt

SEQ ID NO: 4178746 - DNA, 16 bp, Homo sapiens
caaaaggctgagaagg

SEQ ID NO: 4178747 - DNA, 17 bp, Homo sapiens
caaaagttttcctgaga

SEQ ID NO: 4178748 - DNA, 14 bp, Homo sapiens
caaaataaagaata

SEQ ID NO: 4178749 - DNA, 23 bp, Homo sapiens
caaaataccagagccttcaagtg

SEQ ID NO: 4178750 - DNA, 13 bp, Homo sapiens
caaaatagaagct

SEQ ID NO: 4178751 - DNA, 23 bp, Homo sapiens
caaaatattatgcaaactactgt

SEQ ID NO: 4178752 - DNA, 12 bp, Homo sapiens
caaaatattttc

SEQ ID NO: 4178753 - DNA, 22 bp, Homo sapiens
caaaatgttgaaatatgatgtt

SEQ ID NO: 4178754 - DNA, 20 bp, Homo sapiens
caaaattaccaaaaatcttg

SEQ ID NO: 4178755 - DNA, 18 bp, Homo sapiens
caaaattctagaagcaga

SEQ ID NO: 4178756 - DNA, 22 bp, Homo sapiens
caaacagagtatgtccgatggt

SEQ ID NO: 4178757 - DNA, 21 bp, Homo sapiens
caaacatatatatactattaa

SEQ ID NO: 4178758 - DNA, 15 bp, Homo sapiens
caaactaggaggaaa

SEQ ID NO: 4178759 - DNA, 16 bp, Homo sapiens
caaactattgggaggg

SEQ ID NO: 4178760 - DNA, 19 bp, Homo sapiens
caaactgcggtatacattt

SEQ ID NO: 4178761 - DNA, 15 bp, Homo sapiens
caaactgtgccctgc

SEQ ID NO: 4178762 - DNA, 20 bp, Homo sapiens
caaactgtgccctgccttca

SEQ ID NO: 4178763 - DNA, 21 bp, Homo sapiens
caaactgtgccctgccttcag

SEQ ID NO: 4178764 - DNA, 12 bp, Homo sapiens
caaactttattt

SEQ ID NO: 4178765 - DNA, 20 bp, Homo sapiens
caaagaactgccccatctcc

SEQ ID NO: 4178766 - DNA, 22 bp, Homo sapiens
caaagaactgccccatctcctc

SEQ ID NO: 4178767 - DNA, 16 bp, Homo sapiens
caaagacacaggaaga

SEQ ID NO: 4178768 - DNA, 15 bp, Homo sapiens
caaagacatggaagg

SEQ ID NO: 4178769 - DNA, 22 bp, Homo sapiens
caaagagtgggctgcatctggg

SEQ ID NO: 4178770 - DNA, 16 bp, Homo sapiens
caaagagttcaagaaa

SEQ ID NO: 4178771 - DNA, 22 bp, Homo sapiens
caaagcaaaagaagtaaaagct

SEQ ID NO: 4178772 - DNA, 23 bp, Homo sapiens
caaagcaagcattcagaagaaaa

SEQ ID NO: 4178773 - DNA, 18 bp, Homo sapiens
caaagcacctgaaccact

SEQ ID NO: 4178774 - DNA, 17 bp, Homo sapiens
caaagccaaactctgcc

SEQ ID NO: 4178775 - DNA, 11 bp, Homo sapiens
caaagcccccg

SEQ ID NO: 4178776 - DNA, 15 bp, Homo sapiens
caaagcccttttata

SEQ ID NO: 4178777 - DNA, 16 bp, Homo sapiens
caaagctaggatggtt

SEQ ID NO: 4178778 - DNA, 18 bp, Homo sapiens
caaagctaggatggttct

SEQ ID NO: 4178779 - DNA, 23 bp, Homo sapiens
caaagctaggatggttctgtgac

SEQ ID NO: 4178780 - DNA, 15 bp, Homo sapiens
caaagctggagatga

SEQ ID NO: 4178781 - DNA, 19 bp, Homo sapiens
caaaggaaaactcttggcc

SEQ ID NO: 4178782 - DNA, 23 bp, Homo sapiens
caaaggaaaactcttggcctctg

SEQ ID NO: 4178783 - DNA, 20 bp, Homo sapiens
caaaggaaaccaaaggaatc

SEQ ID NO: 4178784 - DNA, 23 bp, Homo sapiens
caaaggatccagagacttgggga

SEQ ID NO: 4178785 - DNA, 23 bp, Homo sapiens
caaaggcgcagtgcttctctaca

SEQ ID NO: 4178786 - DNA, 19 bp, Homo sapiens
caaagggacacacagtgac

SEQ ID NO: 4178787 - DNA, 17 bp, Homo sapiens
caaagtctaaagtttac

SEQ ID NO: 4178788 - DNA, 19 bp, Homo sapiens
caaagtctaaagtttacag

SEQ ID NO: 4178789 - DNA, 17 bp, Homo sapiens
caaagtctgggaaattc

SEQ ID NO: 4178790 - DNA, 18 bp, Homo sapiens
caaagtctgggaaattct

SEQ ID NO: 4178791 - DNA, 15 bp, Homo sapiens
caaagtttaacacaa

SEQ ID NO: 4178792 - DNA, 15 bp, Homo sapiens
caaataaattggaat

SEQ ID NO: 4178793 - DNA, 16 bp, Homo sapiens
caaataaggatttgtt

SEQ ID NO: 4178794 - DNA, 14 bp, Homo sapiens
caaatatattgcaa

SEQ ID NO: 4178795 - DNA, 21 bp, Homo sapiens
caaatggcagcagttccatga

SEQ ID NO: 4178796 - DNA, 15 bp, Homo sapiens
caaattccatgtccc

SEQ ID NO: 4178797 - DNA, 22 bp, Homo sapiens
caaattgctcctaagcttcaaa

SEQ ID NO: 4178798 - DNA, 14 bp, Homo sapiens
caacaaaatcaatt

SEQ ID NO: 4178799 - DNA, 13 bp, Homo sapiens
caacaaaccaaaa

SEQ ID NO: 4178800 - DNA, 21 bp, Homo sapiens
caacaaagattgagaagccat

SEQ ID NO: 4178801 - DNA, 15 bp, Homo sapiens
caacaacaaaccaaa

SEQ ID NO: 4178802 - DNA, 12 bp, Homo sapiens
caacaacaacaa

SEQ ID NO: 4178803 - DNA, 12 bp, Homo sapiens
caacaacaatac

SEQ ID NO: 4178804 - DNA, 13 bp, Homo sapiens
caacaacaataca

SEQ ID NO: 4178805 - DNA, 18 bp, Homo sapiens
caacaacaatacaacaag

SEQ ID NO: 4178806 - DNA, 17 bp, Homo sapiens
caacaagaacaacaaca

SEQ ID NO: 4178807 - DNA, 17 bp, Homo sapiens
caacaatggtttacatg

SEQ ID NO: 4178808 - DNA, 21 bp, Homo sapiens
caacaatggtttacatgaaca

SEQ ID NO: 4178809 - DNA, 14 bp, Homo sapiens
caacacaaagacac

SEQ ID NO: 4178810 - DNA, 14 bp, Homo sapiens
caacacaaagacat

SEQ ID NO: 4178811 - DNA, 21 bp, Homo sapiens
caacacaaagacatggaaggt

SEQ ID NO: 4178812 - DNA, 17 bp, Homo sapiens
caacacaagctggaagc

SEQ ID NO: 4178813 - DNA, 14 bp, Homo sapiens
caacactcttcttg

SEQ ID NO: 4178814 - DNA, 15 bp, Homo sapiens
caacactcttcttga

SEQ ID NO: 4178815 - DNA, 23 bp, Homo sapiens
caacagagtgagaccctgtctct

SEQ ID NO: 4178816 - DNA, 18 bp, Homo sapiens
caacaggtggcaggacca

SEQ ID NO: 4178817 - DNA, 11 bp, Homo sapiens
caacagtaaca

SEQ ID NO: 4178818 - DNA, 19 bp, Homo sapiens
caacagttgggctgtcaac

SEQ ID NO: 4178819 - DNA, 15 bp, Homo sapiens
caacatatcattttt

SEQ ID NO: 4178820 - DNA, 13 bp, Homo sapiens
caacatggtccag

SEQ ID NO: 4178821 - DNA, 20 bp, Homo sapiens
cagcctgggcgacagagcaa

SEQ ID NO: 4178822 - DNA, 14 bp, Homo sapiens
cagcctgggtgacg

SEQ ID NO: 4178823 - DNA, 13 bp, Homo sapiens
cagcctgtcctgg

SEQ ID NO: 4178824 - DNA, 13 bp, Homo sapiens
cagcgagaggcag

SEQ ID NO: 4178825 - DNA, 18 bp, Homo sapiens
cagcgagaggcagagaaa

SEQ ID NO: 4178826 - DNA, 21 bp, Homo sapiens
cagcgcagccgccgggcaggc

SEQ ID NO: 4178827 - DNA, 22 bp, Homo sapiens
cagcgccctggagtcccctggg

SEQ ID NO: 4178828 - DNA, 14 bp, Homo sapiens
cagcgcggctcccg

SEQ ID NO: 4178829 - DNA, 15 bp, Homo sapiens
cagcgcggctcccgc

SEQ ID NO: 4178830 - DNA, 22 bp, Homo sapiens
cagcgtgggaactcactttccc

SEQ ID NO: 4178831 - DNA, 12 bp, Homo sapiens
cagcgtgtgtat

SEQ ID NO: 4178832 - DNA, 13 bp, Homo sapiens
cagcgtgtgtatc

SEQ ID NO: 4178833 - DNA, 16 bp, Homo sapiens
cagctaaatgcaggga

SEQ ID NO: 4178834 - DNA, 23 bp, Homo sapiens
cagctacccaggaggctgaggca

SEQ ID NO: 4178835 - DNA, 21 bp, Homo sapiens
cagctactcagaagcctgagg

SEQ ID NO: 4178836 - DNA, 13 bp, Homo sapiens
cagctaggcatgc

SEQ ID NO: 4178837 - DNA, 14 bp, Homo sapiens
cagctaggcatgcc

SEQ ID NO: 4178838 - DNA, 17 bp, Homo sapiens
cagctatgcactgtaaa

SEQ ID NO: 4178839 - DNA, 22 bp, Homo sapiens
cagctcaagagatcccaagtag

SEQ ID NO: 4178840 - DNA, 16 bp, Homo sapiens
cagctccagttggagt

SEQ ID NO: 4178841 - DNA, 12 bp, Homo sapiens
cagctcctctga

SEQ ID NO: 4178842 - DNA, 14 bp, Homo sapiens
cagctcctctgagc

SEQ ID NO: 4178843 - DNA, 15 bp, Homo sapiens
cagctcctctgagcc

SEQ ID NO: 4178844 - DNA, 14 bp, Homo sapiens
cagctcgctgccca

SEQ ID NO: 4178845 - DNA, 15 bp, Homo sapiens
cagctctcagggctg

SEQ ID NO: 4178846 - DNA, 15 bp, Homo sapiens
cagctctctctaccc

SEQ ID NO: 4178847 - DNA, 16 bp, Homo sapiens
cagctcttcactcagc

SEQ ID NO: 4178848 - DNA, 17 bp, Homo sapiens
cagctcttcactcagcc

SEQ ID NO: 4178849 - DNA, 16 bp, Homo sapiens
cagctgcacctgccag

SEQ ID NO: 4178850 - DNA, 18 bp, Homo sapiens
cagctgcacctgccagcc

SEQ ID NO: 4178851 - DNA, 11 bp, Homo sapiens
cagctgcctgg

SEQ ID NO: 4178852 - DNA, 15 bp, Homo sapiens
cagctgctgaagagg

SEQ ID NO: 4178853 - DNA, 20 bp, Homo sapiens
cagctggctctccaccttgt

SEQ ID NO: 4178854 - DNA, 15 bp, Homo sapiens
cagctgtcattcagg

SEQ ID NO: 4178855 - DNA, 17 bp, Homo sapiens
cagctgttttcaaagcc

SEQ ID NO: 4178856 - DNA, 19 bp, Homo sapiens
cagcttatggggtatttta

SEQ ID NO: 4178857 - DNA, 17 bp, Homo sapiens
cagcttccccaggagct

SEQ ID NO: 4178858 - DNA, 12 bp, Homo sapiens
cagcttctccag

SEQ ID NO: 4178859 - DNA, 15 bp, Homo sapiens
cagcttgctgagggg

SEQ ID NO: 4178860 - DNA, 15 bp, Homo sapiens
cagctttacatgcaa

SEQ ID NO: 4178861 - DNA, 17 bp, Homo sapiens
cagctttttctctcagg

SEQ ID NO: 4178862 - DNA, 11 bp, Homo sapiens
caggaaagaat

SEQ ID NO: 4178863 - DNA, 13 bp, Homo sapiens
caggaacagaaca

SEQ ID NO: 4178864 - DNA, 15 bp, Homo sapiens
caggaacagaacact

SEQ ID NO: 4178865 - DNA, 15 bp, Homo sapiens
caggaactcccagca

SEQ ID NO: 4178866 - DNA, 16 bp, Homo sapiens
caggaactcccagcaa

SEQ ID NO: 4178867 - DNA, 17 bp, Homo sapiens
caggaactcccagcaac

SEQ ID NO: 4178868 - DNA, 13 bp, Homo sapiens
caggaactggctc

SEQ ID NO: 4178869 - DNA, 15 bp, Homo sapiens
caggaagagaaggag

SEQ ID NO: 4178870 - DNA, 17 bp, Homo sapiens
caggaagagaaggagca

SEQ ID NO: 4178871 - DNA, 17 bp, Homo sapiens
caggaagagatttaaca

SEQ ID NO: 4178872 - DNA, 14 bp, Homo sapiens
caggaagaggtaat

SEQ ID NO: 4178873 - DNA, 18 bp, Homo sapiens
caggaagaggtaattttt

SEQ ID NO: 4178874 - DNA, 23 bp, Homo sapiens
caggaagctttggtgagaacctg

SEQ ID NO: 4178875 - DNA, 16 bp, Homo sapiens
caggaaggactatgaa

SEQ ID NO: 4178876 - DNA, 23 bp, Homo sapiens
caggaagggggtccacccagcaa

SEQ ID NO: 4178877 - DNA, 16 bp, Homo sapiens
caggacagtgcttcag

SEQ ID NO: 4178878 - DNA, 22 bp, Homo sapiens
caggacagtgcttcagcctgag

SEQ ID NO: 4178879 - DNA, 13 bp, Homo sapiens
caggaccaggact

SEQ ID NO: 4178880 - DNA, 15 bp, Homo sapiens
caggaccctgtcagg

SEQ ID NO: 4178881 - DNA, 17 bp, Homo sapiens
caggactatagcccagg

SEQ ID NO: 4178882 - DNA, 21 bp, Homo sapiens
caggactatagcccaggtcct

SEQ ID NO: 4178883 - DNA, 17 bp, Homo sapiens
caggactccccaggcca

SEQ ID NO: 4178884 - DNA, 12 bp, Homo sapiens
caggagacaaga

SEQ ID NO: 4178885 - DNA, 14 bp, Homo sapiens
caggagagagtcta

SEQ ID NO: 4178886 - DNA, 16 bp, Homo sapiens
caggagctctctgctg

SEQ ID NO: 4178887 - DNA, 19 bp, Homo sapiens
caggagctctctgctgagc

SEQ ID NO: 4178888 - DNA, 16 bp, Homo sapiens
caggaggcgaataaat

SEQ ID NO: 4178889 - DNA, 17 bp, Homo sapiens
caggaggctgaggcagg

SEQ ID NO: 4178890 - DNA, 18 bp, Homo sapiens
caggaggctgaggcagga

SEQ ID NO: 4178891 - DNA, 16 bp, Homo sapiens
caggagggcaagggcc

SEQ ID NO: 4178892 - DNA, 19 bp, Homo sapiens
caggagggcaagggccatg

SEQ ID NO: 4178893 - DNA, 19 bp, Homo sapiens
caggaggggcccacaatgg

SEQ ID NO: 4178894 - DNA, 15 bp, Homo sapiens
caggagggtgcagta

SEQ ID NO: 4178895 - DNA, 22 bp, Homo sapiens
caggagtttgaggctgcagcga

SEQ ID NO: 4178896 - DNA, 17 bp, Homo sapiens
caggatactctgtcaga

SEQ ID NO: 4178897 - DNA, 16 bp, Homo sapiens
caggatcccaagcgtc

SEQ ID NO: 4178898 - DNA, 23 bp, Homo sapiens
caggatcccaagcgtcccgtccc

SEQ ID NO: 4178899 - DNA, 15 bp, Homo sapiens
caggatctttgactg

SEQ ID NO: 4178900 - DNA, 17 bp, Homo sapiens
caggatctttgactgaa

SEQ ID NO: 4178901 - DNA, 16 bp, Homo sapiens
caggatgccaagtggc

SEQ ID NO: 4178902 - DNA, 23 bp, Homo sapiens
caggatggcccttcccactggag

SEQ ID NO: 4178903 - DNA, 23 bp, Homo sapiens
caggatggggtatggattctaaa

SEQ ID NO: 4178904 - DNA, 18 bp, Homo sapiens
caggatgtgtttgctttc

SEQ ID NO: 4178905 - DNA, 21 bp, Homo sapiens
caggattactactttgcctct

SEQ ID NO: 4178906 - DNA, 15 bp, Homo sapiens
caggattgaagagca

SEQ ID NO: 4178907 - DNA, 16 bp, Homo sapiens
caggattgcaggtgcc

SEQ ID NO: 4178908 - DNA, 20 bp, Homo sapiens
caggattgcaggtgcctggc

SEQ ID NO: 4178909 - DNA, 13 bp, Homo sapiens
caggattggcctg

SEQ ID NO: 4178910 - DNA, 17 bp, Homo sapiens
caggattttgtgttttt

SEQ ID NO: 4178911 - DNA, 14 bp, Homo sapiens
caggcaaagctgga

SEQ ID NO: 4178912 - DNA, 19 bp, Homo sapiens
caggcaccaaaagaagtaa

SEQ ID NO: 4178913 - DNA, 14 bp, Homo sapiens
caggcactgcaaac

SEQ ID NO: 4178914 - DNA, 13 bp, Homo sapiens
caggcactgtggc

SEQ ID NO: 4178915 - DNA, 16 bp, Homo sapiens
caggcactgtggccct

SEQ ID NO: 4178916 - DNA, 18 bp, Homo sapiens
caggcagcgatggtctca

SEQ ID NO: 4178917 - DNA, 16 bp, Homo sapiens
caggcaggctcccagg

SEQ ID NO: 4178918 - DNA, 20 bp, Homo sapiens
caggcaggggtgggagagcc

SEQ ID NO: 4178919 - DNA, 11 bp, Homo sapiens
caggcatgctg

SEQ ID NO: 4178920 - DNA, 14 bp, Homo sapiens
caggcatgctggcc

SEQ ID NO: 4178921 - DNA, 19 bp, Homo sapiens
caggcatgctggcctccca

SEQ ID NO: 4178922 - DNA, 23 bp, Homo sapiens
caggccaccatattcagtgctgt

SEQ ID NO: 4178923 - DNA, 15 bp, Homo sapiens
caggccacgctcagg

SEQ ID NO: 4178924 - DNA, 16 bp, Homo sapiens
caggccacgctcaggc

SEQ ID NO: 4178925 - DNA, 17 bp, Homo sapiens
caggccacgctcaggcc

SEQ ID NO: 4178926 - DNA, 18 bp, Homo sapiens
caggccaggccaccagga

SEQ ID NO: 4178927 - DNA, 15 bp, Homo sapiens
caggccaggtgcagt

SEQ ID NO: 4178928 - DNA, 15 bp, Homo sapiens
caggccagtgggcct

SEQ ID NO: 4178929 - DNA, 19 bp, Homo sapiens
caggccggtgtgggctgtg

SEQ ID NO: 4178930 - DNA, 19 bp, Homo sapiens
caggccttagtacggctgc

SEQ ID NO: 4178931 - DNA, 13 bp, Homo sapiens
caggcgggagggg

SEQ ID NO: 4178932 - DNA, 20 bp, Homo sapiens
caggcgggaggggcagaaca

SEQ ID NO: 4178933 - DNA, 22 bp, Homo sapiens
caggctaatttttttgtatttt

SEQ ID NO: 4178934 - DNA, 16 bp, Homo sapiens
caggctcagactctgg

SEQ ID NO: 4178935 - DNA, 22 bp, Homo sapiens
caggctcccactgcccctgcac

SEQ ID NO: 4178936 - DNA, 22 bp, Homo sapiens
caggctcccagggacacctggg

SEQ ID NO: 4178937 - DNA, 16 bp, Homo sapiens
caggctctgcctggag

SEQ ID NO: 4178938 - DNA, 23 bp, Homo sapiens
caggctctttggggtcagccagg

SEQ ID NO: 4178939 - DNA, 20 bp, Homo sapiens
cagggaacattggagctgac

SEQ ID NO: 4178940 - DNA, 22 bp, Homo sapiens
cagggaaccctgcttgcacttt

SEQ ID NO: 4178941 - DNA, 19 bp, Homo sapiens
cagggagaccgagcgcttt

SEQ ID NO: 4178942 - DNA, 14 bp, Homo sapiens
cagggagagcgcct

SEQ ID NO: 4178943 - DNA, 22 bp, Homo sapiens
cagggcaaaggtcaagactgtg

SEQ ID NO: 4178944 - DNA, 18 bp, Homo sapiens
cagggcactgtctgcgtg

SEQ ID NO: 4178945 - DNA, 12 bp, Homo sapiens
cagggcagagcc

SEQ ID NO: 4178946 - DNA, 16 bp, Homo sapiens
cagggcagagccggga

SEQ ID NO: 4178947 - DNA, 18 bp, Homo sapiens
cagggccaagcgggggcg

SEQ ID NO: 4178948 - DNA, 16 bp, Homo sapiens
cagggccagggccctg

SEQ ID NO: 4178949 - DNA, 14 bp, Homo sapiens
cagggccctgcaga

SEQ ID NO: 4178950 - DNA, 16 bp, Homo sapiens
cagggctccctcctgg

SEQ ID NO: 4178951 - DNA, 20 bp, Homo sapiens
cagggctccctcctggagca

SEQ ID NO: 4178952 - DNA, 23 bp, Homo sapiens
cagggctccctcctggagcatcc

SEQ ID NO: 4178953 - DNA, 19 bp, Homo sapiens
cagggctctgccccagagg

SEQ ID NO: 4178954 - DNA, 12 bp, Homo sapiens
cagggctgcccc

SEQ ID NO: 4178955 - DNA, 18 bp, Homo sapiens
cagggctgctgtggccca

SEQ ID NO: 4178956 - DNA, 20 bp, Homo sapiens
cagggctgctgtggcccagt

SEQ ID NO: 4178957 - DNA, 20 bp, Homo sapiens
ccatgctggcggcgcagagg

SEQ ID NO: 4178958 - DNA, 17 bp, Homo sapiens
ccatggagacaagaagg

SEQ ID NO: 4178959 - DNA, 16 bp, Homo sapiens
ccatggccccaggccc

SEQ ID NO: 4178960 - DNA, 21 bp, Homo sapiens
ccatggccttccctccccaca

SEQ ID NO: 4178961 - DNA, 11 bp, Homo sapiens
ccatgggacca

SEQ ID NO: 4178962 - DNA, 15 bp, Homo sapiens
ccatgggaccacaac

SEQ ID NO: 4178963 - DNA, 16 bp, Homo sapiens
ccatgggcctgctgcg

SEQ ID NO: 4178964 - DNA, 23 bp, Homo sapiens
ccatgggcctgctgcgtcagacc

SEQ ID NO: 4178965 - DNA, 19 bp, Homo sapiens
ccatgtccaagtccaacct

SEQ ID NO: 4178966 - DNA, 14 bp, Homo sapiens
ccatgtttgtaaaa

SEQ ID NO: 4178967 - DNA, 15 bp, Homo sapiens
ccatgtttgtaaaac

SEQ ID NO: 4178968 - DNA, 23 bp, Homo sapiens
ccattactctgcggtggtgccag

SEQ ID NO: 4178969 - DNA, 15 bp, Homo sapiens
ccattaggcatgcct

SEQ ID NO: 4178970 - DNA, 14 bp, Homo sapiens
ccattatttaataa

SEQ ID NO: 4178971 - DNA, 15 bp, Homo sapiens
ccattatttaataag

SEQ ID NO: 4178972 - DNA, 18 bp, Homo sapiens
ccattcatgccaaagcaa

SEQ ID NO: 4178973 - DNA, 14 bp, Homo sapiens
ccattcctgttctc

SEQ ID NO: 4178974 - DNA, 15 bp, Homo sapiens
ccattcctgttctct

SEQ ID NO: 4178975 - DNA, 22 bp, Homo sapiens
ccattctccagtttcagaagca

SEQ ID NO: 4178976 - DNA, 17 bp, Homo sapiens
ccattctgcatgccctc

SEQ ID NO: 4178977 - DNA, 15 bp, Homo sapiens
ccattgctgacgatt

SEQ ID NO: 4178978 - DNA, 20 bp, Homo sapiens
ccattggcttcctcactcca

SEQ ID NO: 4178979 - DNA, 17 bp, Homo sapiens
ccattgggaccctccag

SEQ ID NO: 4178980 - DNA, 14 bp, Homo sapiens
ccattggttctcct

SEQ ID NO: 4178981 - DNA, 20 bp, Homo sapiens
ccattgtactccagcctggg

SEQ ID NO: 4178982 - DNA, 16 bp, Homo sapiens
ccatttcaactccaga

SEQ ID NO: 4178983 - DNA, 17 bp, Homo sapiens
ccatttcaactccagaa

SEQ ID NO: 4178984 - DNA, 22 bp, Homo sapiens
ccatttgtgttttgaaagccca

SEQ ID NO: 4178985 - DNA, 12 bp, Homo sapiens
ccattttcgctt

SEQ ID NO: 4178986 - DNA, 16 bp, Homo sapiens
cccaacctcctgacct

SEQ ID NO: 4178987 - DNA, 15 bp, Homo sapiens
cccaactcttctcca

SEQ ID NO: 4178988 - DNA, 15 bp, Homo sapiens
cccaactgctctgcc

SEQ ID NO: 4178989 - DNA, 17 bp, Homo sapiens
cccaactgctctgccca

SEQ ID NO: 4178990 - DNA, 21 bp, Homo sapiens
cccaactttctcactgctgtc

SEQ ID NO: 4178991 - DNA, 22 bp, Homo sapiens
cccaactttctcactgctgtca

SEQ ID NO: 4178992 - DNA, 21 bp, Homo sapiens
cccaaggtgctgatgtcaaag

SEQ ID NO: 4178993 - DNA, 18 bp, Homo sapiens
cccaagtgccagtcttgt

SEQ ID NO: 4178994 - DNA, 21 bp, Homo sapiens
cccaataaacattaagattga

SEQ ID NO: 4178995 - DNA, 15 bp, Homo sapiens
cccaataaagctgga

SEQ ID NO: 4178996 - DNA, 16 bp, Homo sapiens
cccaataaagctggac

SEQ ID NO: 4178997 - DNA, 14 bp, Homo sapiens
cccaatgctcctgg

SEQ ID NO: 4178998 - DNA, 12 bp, Homo sapiens
cccaatttaatt

SEQ ID NO: 4178999 - DNA, 21 bp, Homo sapiens
cccacaagccttactcacctc

SEQ ID NO: 4179000 - DNA, 22 bp, Homo sapiens
cccacaagccttactcacctct

SEQ ID NO: 4179001 - DNA, 17 bp, Homo sapiens
cccacagagcctggctt

SEQ ID NO: 4179002 - DNA, 21 bp, Homo sapiens
cccacatttacctcgaggctc

SEQ ID NO: 4179003 - DNA, 18 bp, Homo sapiens
cccaccaccttggactcc

SEQ ID NO: 4179004 - DNA, 20 bp, Homo sapiens
cccaccacgtgctcaatcat

SEQ ID NO: 4179005 - DNA, 23 bp, Homo sapiens
cccaccactaggactctgaggct

SEQ ID NO: 4179006 - DNA, 23 bp, Homo sapiens
cccacccagggctccctcctgga

SEQ ID NO: 4179007 - DNA, 19 bp, Homo sapiens
cccaccctcaaaccctgtg

SEQ ID NO: 4179008 - DNA, 23 bp, Homo sapiens
cccaccctcgtggacacctgccc

SEQ ID NO: 4179009 - DNA, 16 bp, Homo sapiens
cccacctcatgcctgg

SEQ ID NO: 4179010 - DNA, 20 bp, Homo sapiens
cccacctcatgcctggcccc

SEQ ID NO: 4179011 - DNA, 16 bp, Homo sapiens
cccacctcttccttcc

SEQ ID NO: 4179012 - DNA, 17 bp, Homo sapiens
cccacctcttccttccg

SEQ ID NO: 4179013 - DNA, 13 bp, Homo sapiens
cccacctggagcc

SEQ ID NO: 4179014 - DNA, 14 bp, Homo sapiens
cccacctggagccc

SEQ ID NO: 4179015 - DNA, 16 bp, Homo sapiens
cccacctggagcccgc

SEQ ID NO: 4179016 - DNA, 22 bp, Homo sapiens
cccaccttcaattcctgggccc

SEQ ID NO: 4179017 - DNA, 21 bp, Homo sapiens
cccacctttgggatcagcctc

SEQ ID NO: 4179018 - DNA, 20 bp, Homo sapiens
cccactccctggctctcaga

SEQ ID NO: 4179019 - DNA, 22 bp, Homo sapiens
cccactccctggctctcagaag

SEQ ID NO: 4179020 - DNA, 16 bp, Homo sapiens
cccactggactgggtt

SEQ ID NO: 4179021 - DNA, 16 bp, Homo sapiens
cccacttgtcatccat

SEQ ID NO: 4179022 - DNA, 19 bp, Homo sapiens
cccactttcctacaaaatg

SEQ ID NO: 4179023 - DNA, 22 bp, Homo sapiens
cccagagcattacgtgagccag

SEQ ID NO: 4179024 - DNA, 14 bp, Homo sapiens
cccagaggccagga

SEQ ID NO: 4179025 - DNA, 14 bp, Homo sapiens
cccagagggcccag

SEQ ID NO: 4179026 - DNA, 15 bp, Homo sapiens
cccagagggcccagg

SEQ ID NO: 4179027 - DNA, 23 bp, Homo sapiens
cccagagggcccaggcaggccac

SEQ ID NO: 4179028 - DNA, 22 bp, Homo sapiens
cccagaggtgacccaatgctcc

SEQ ID NO: 4179029 - DNA, 13 bp, Homo sapiens
cccagagtcagga

SEQ ID NO: 4179030 - DNA, 15 bp, Homo sapiens
cccagagtgtgaaac

SEQ ID NO: 4179031 - DNA, 17 bp, Homo sapiens
cccagagtgtgaaactt

SEQ ID NO: 4179032 - DNA, 12 bp, Homo sapiens
cccagatcctca

SEQ ID NO: 4179033 - DNA, 15 bp, Homo sapiens
cccagcaacacaagc

SEQ ID NO: 4179034 - DNA, 20 bp, Homo sapiens
cccagcaacacaagctggaa

SEQ ID NO: 4179035 - DNA, 21 bp, Homo sapiens
cccagcatccttttctgcaga

SEQ ID NO: 4179036 - DNA, 18 bp, Homo sapiens
cccagcattgcagtatgg

SEQ ID NO: 4179037 - DNA, 20 bp, Homo sapiens
cccagccattaccatggaga

SEQ ID NO: 4179038 - DNA, 11 bp, Homo sapiens
cccagcctgga

SEQ ID NO: 4179039 - DNA, 13 bp, Homo sapiens
cccagcctggagc

SEQ ID NO: 4179040 - DNA, 21 bp, Homo sapiens
cccagcctgtcctggtacagc

SEQ ID NO: 4179041 - DNA, 14 bp, Homo sapiens
cccagcgtgtgtat

SEQ ID NO: 4179042 - DNA, 17 bp, Homo sapiens
cccagctcctctgagcc

SEQ ID NO: 4179043 - DNA, 20 bp, Homo sapiens
cccagctcctctgagccata

SEQ ID NO: 4179044 - DNA, 21 bp, Homo sapiens
cccagctcctctgagccatac

SEQ ID NO: 4179045 - DNA, 17 bp, Homo sapiens
cccagctctcagggctg

SEQ ID NO: 4179046 - DNA, 13 bp, Homo sapiens
cccagctctggct

SEQ ID NO: 4179047 - DNA, 23 bp, Homo sapiens
cccagctctttgttcagttgact

SEQ ID NO: 4179048 - DNA, 13 bp, Homo sapiens
cccagctgcggca

SEQ ID NO: 4179049 - DNA, 15 bp, Homo sapiens
cccagcttgctgagg

SEQ ID NO: 4179050 - DNA, 17 bp, Homo sapiens
cccagcttgctgagggg

SEQ ID NO: 4179051 - DNA, 14 bp, Homo sapiens
cccaggagctctct

SEQ ID NO: 4179052 - DNA, 17 bp, Homo sapiens
cccaggagctctctgct

SEQ ID NO: 4179053 - DNA, 20 bp, Homo sapiens
cccaggaggcggaggttgca

SEQ ID NO: 4179054 - DNA, 22 bp, Homo sapiens
cccaggagtttgaggctgcagc

SEQ ID NO: 4179055 - DNA, 17 bp, Homo sapiens
cccaggggcccacaggg

SEQ ID NO: 4179056 - DNA, 21 bp, Homo sapiens
cccagtccgccaaacactcca

SEQ ID NO: 4179057 - DNA, 18 bp, Homo sapiens
cccagtcgtccgctcagc

SEQ ID NO: 4179058 - DNA, 20 bp, Homo sapiens
cccagtctggaagaagagga

SEQ ID NO: 4179059 - DNA, 19 bp, Homo sapiens
cccagtgagattacagagg

SEQ ID NO: 4179060 - DNA, 13 bp, Homo sapiens
cccagtgccacag

SEQ ID NO: 4179061 - DNA, 16 bp, Homo sapiens
cccagtgccacagaga

SEQ ID NO: 4179062 - DNA, 16 bp, Homo sapiens
cccatcccctttcctc

SEQ ID NO: 4179063 - DNA, 13 bp, Homo sapiens
cccatctcctccc

SEQ ID NO: 4179064 - DNA, 20 bp, Homo sapiens
cccatctcctcccatggcct

SEQ ID NO: 4179065 - DNA, 19 bp, Homo sapiens
cccatgaagacaggacagt

SEQ ID NO: 4179066 - DNA, 12 bp, Homo sapiens
cccatgccctcc

SEQ ID NO: 4179067 - DNA, 18 bp, Homo sapiens
cccattaggcatgcctaa

SEQ ID NO: 4179068 - DNA, 22 bp, Homo sapiens
ccccaaactgtgccctgccttc

SEQ ID NO: 4179069 - DNA, 14 bp, Homo sapiens
ccccaaagagcctg

SEQ ID NO: 4179070 - DNA, 19 bp, Homo sapiens
ccccaaagagcctggagaa

SEQ ID NO: 4179071 - DNA, 12 bp, Homo sapiens
ccccaaagcccc

SEQ ID NO: 4179072 - DNA, 19 bp, Homo sapiens
ccccaacatctccctccca

SEQ ID NO: 4179073 - DNA, 15 bp, Homo sapiens
ccccaccccagagtt

SEQ ID NO: 4179074 - DNA, 18 bp, Homo sapiens
ccccaccccagagttggg

SEQ ID NO: 4179075 - DNA, 21 bp, Homo sapiens
ccccaccctcgtggacacctg

SEQ ID NO: 4179076 - DNA, 18 bp, Homo sapiens
ccccacctcatgcctggc

SEQ ID NO: 4179077 - DNA, 13 bp, Homo sapiens
ccccaccttcccc

SEQ ID NO: 4179078 - DNA, 14 bp, Homo sapiens
ccccacctttggga

SEQ ID NO: 4179079 - DNA, 22 bp, Homo sapiens
ccccactttcctacaaaatgga

SEQ ID NO: 4179080 - DNA, 19 bp, Homo sapiens
ccccagactcagctccaga

SEQ ID NO: 4179081 - DNA, 14 bp, Homo sapiens
ccccagctgcggca

SEQ ID NO: 4179082 - DNA, 17 bp, Homo sapiens
ccccaggagctctctgc

SEQ ID NO: 4179083 - DNA, 15 bp, Homo sapiens
ccccaggccaatgca

SEQ ID NO: 4179084 - DNA, 22 bp, Homo sapiens
ccccaggccaggccaccaggat

SEQ ID NO: 4179085 - DNA, 18 bp, Homo sapiens
ccccagtgctacctctct

SEQ ID NO: 4179086 - DNA, 15 bp, Homo sapiens
ccccatcccctttcc

SEQ ID NO: 4179087 - DNA, 17 bp, Homo sapiens
ccccatctcaggccaga

SEQ ID NO: 4179088 - DNA, 14 bp, Homo sapiens
ccccatctctacta

SEQ ID NO: 4179089 - DNA, 18 bp, Homo sapiens
ccccatggccccaggccc

SEQ ID NO: 4179090 - DNA, 15 bp, Homo sapiens
cccccaccccagagt

SEQ ID NO: 4179091 - DNA, 15 bp, Homo sapiens
cctgtagttaggaaa

SEQ ID NO: 4179092 - DNA, 18 bp, Homo sapiens
cctgtagttaggaaataa

SEQ ID NO: 4179093 - DNA, 23 bp, Homo sapiens
cctgtagttaggaaataaaacct

SEQ ID NO: 4179094 - DNA, 15 bp, Homo sapiens
cctgtattcagacag

SEQ ID NO: 4179095 - DNA, 13 bp, Homo sapiens
cctgtcctgcctc

SEQ ID NO: 4179096 - DNA, 22 bp, Homo sapiens
cctgtcctgcctctctgctcca

SEQ ID NO: 4179097 - DNA, 20 bp, Homo sapiens
cctgtctgtctgtctgtccc

SEQ ID NO: 4179098 - DNA, 15 bp, Homo sapiens
cctgtgctactttgc

SEQ ID NO: 4179099 - DNA, 18 bp, Homo sapiens
cctgtggagacagccctg

SEQ ID NO: 4179100 - DNA, 22 bp, Homo sapiens
cctgtggagacagccctgccta

SEQ ID NO: 4179101 - DNA, 18 bp, Homo sapiens
cctgtggattccagcatt

SEQ ID NO: 4179102 - DNA, 13 bp, Homo sapiens
cctgtgggaagag

SEQ ID NO: 4179103 - DNA, 22 bp, Homo sapiens
cctgtgggaagagaagggaagc

SEQ ID NO: 4179104 - DNA, 14 bp, Homo sapiens
cctgtggggcctga

SEQ ID NO: 4179105 - DNA, 12 bp, Homo sapiens
cctgtgtacagg

SEQ ID NO: 4179106 - DNA, 20 bp, Homo sapiens
cctgtgttaactcaggatgc

SEQ ID NO: 4179107 - DNA, 18 bp, Homo sapiens
cctgttgttcccatctgc

SEQ ID NO: 4179108 - DNA, 15 bp, Homo sapiens
cctgttttaaattat

SEQ ID NO: 4179109 - DNA, 17 bp, Homo sapiens
cctgttttgttggaagg

SEQ ID NO: 4179110 - DNA, 17 bp, Homo sapiens
ccttaattcactcccac

SEQ ID NO: 4179111 - DNA, 17 bp, Homo sapiens
ccttaccaactttctgt

SEQ ID NO: 4179112 - DNA, 18 bp, Homo sapiens
ccttaccaactttctgta

SEQ ID NO: 4179113 - DNA, 21 bp, Homo sapiens
ccttactcacctctctctaag

SEQ ID NO: 4179114 - DNA, 14 bp, Homo sapiens
ccttagatctggca

SEQ ID NO: 4179115 - DNA, 19 bp, Homo sapiens
ccttaggctgctgggagat

SEQ ID NO: 4179116 - DNA, 17 bp, Homo sapiens
ccttagtacggctgctg

SEQ ID NO: 4179117 - DNA, 18 bp, Homo sapiens
ccttagtacggctgctgc

SEQ ID NO: 4179118 - DNA, 19 bp, Homo sapiens
ccttagtacggctgctgca

SEQ ID NO: 4179119 - DNA, 16 bp, Homo sapiens
ccttagtggctttttt

SEQ ID NO: 4179120 - DNA, 23 bp, Homo sapiens
ccttagtttttaccttgttttct

SEQ ID NO: 4179121 - DNA, 18 bp, Homo sapiens
ccttattgtttgtaaaca

SEQ ID NO: 4179122 - DNA, 15 bp, Homo sapiens
ccttcaagtgccaaa

SEQ ID NO: 4179123 - DNA, 15 bp, Homo sapiens
ccttcaattcctggg

SEQ ID NO: 4179124 - DNA, 14 bp, Homo sapiens
ccttcactccggtg

SEQ ID NO: 4179125 - DNA, 20 bp, Homo sapiens
ccttcagtgacaagtagggc

SEQ ID NO: 4179126 - DNA, 20 bp, Homo sapiens
ccttcatctggattccagag

SEQ ID NO: 4179127 - DNA, 13 bp, Homo sapiens
ccttccaggcccc

SEQ ID NO: 4179128 - DNA, 17 bp, Homo sapiens
ccttcccaacctcccct

SEQ ID NO: 4179129 - DNA, 14 bp, Homo sapiens
ccttccccagactc

SEQ ID NO: 4179130 - DNA, 22 bp, Homo sapiens
ccttcccccatcccctttcctc

SEQ ID NO: 4179131 - DNA, 15 bp, Homo sapiens
ccttccctctttccc

SEQ ID NO: 4179132 - DNA, 13 bp, Homo sapiens
ccttccctgcctt

SEQ ID NO: 4179133 - DNA, 20 bp, Homo sapiens
ccttccgctcctttacctac

SEQ ID NO: 4179134 - DNA, 20 bp, Homo sapiens
ccttccttgctgtcctaggc

SEQ ID NO: 4179135 - DNA, 13 bp, Homo sapiens
ccttcctttcctc

SEQ ID NO: 4179136 - DNA, 15 bp, Homo sapiens
ccttctccatctttg

SEQ ID NO: 4179137 - DNA, 15 bp, Homo sapiens
ccttctccctgggaa

SEQ ID NO: 4179138 - DNA, 15 bp, Homo sapiens
ccttctctccttccc

SEQ ID NO: 4179139 - DNA, 18 bp, Homo sapiens
ccttctctccttccctct

SEQ ID NO: 4179140 - DNA, 22 bp, Homo sapiens
ccttctggaggacacacagtct

SEQ ID NO: 4179141 - DNA, 19 bp, Homo sapiens
ccttctggtacaatccttt

SEQ ID NO: 4179142 - DNA, 15 bp, Homo sapiens
ccttctgtccaccag

SEQ ID NO: 4179143 - DNA, 13 bp, Homo sapiens
ccttcttcgctgc

SEQ ID NO: 4179144 - DNA, 14 bp, Homo sapiens
ccttcttcgctgct

SEQ ID NO: 4179145 - DNA, 16 bp, Homo sapiens
ccttctttctcttccc

SEQ ID NO: 4179146 - DNA, 17 bp, Homo sapiens
ccttctttctcttccct

SEQ ID NO: 4179147 - DNA, 14 bp, Homo sapiens
ccttgaagccactg

SEQ ID NO: 4179148 - DNA, 13 bp, Homo sapiens
ccttgagcactca

SEQ ID NO: 4179149 - DNA, 17 bp, Homo sapiens
ccttgatgttgtgttgt

SEQ ID NO: 4179150 - DNA, 23 bp, Homo sapiens
ccttgccaaattccatgtccctg

SEQ ID NO: 4179151 - DNA, 19 bp, Homo sapiens
ccttgccgccccgtgcctg

SEQ ID NO: 4179152 - DNA, 22 bp, Homo sapiens
ccttgctctcccctgccctgct

SEQ ID NO: 4179153 - DNA, 17 bp, Homo sapiens
ccttgctctgcaggcac

SEQ ID NO: 4179154 - DNA, 18 bp, Homo sapiens
ccttggactcctcccaca

SEQ ID NO: 4179155 - DNA, 14 bp, Homo sapiens
ccttggagagcagc

SEQ ID NO: 4179156 - DNA, 17 bp, Homo sapiens
ccttggagagcagctgg

SEQ ID NO: 4179157 - DNA, 13 bp, Homo sapiens
ccttggagcctga

SEQ ID NO: 4179158 - DNA, 11 bp, Homo sapiens
ccttgggagag

SEQ ID NO: 4179159 - DNA, 22 bp, Homo sapiens
ccttgtggatgctagtgctgta

SEQ ID NO: 4179160 - DNA, 13 bp, Homo sapiens
cctttacctacca

SEQ ID NO: 4179161 - DNA, 15 bp, Homo sapiens
cctttaggcagcctg

SEQ ID NO: 4179162 - DNA, 16 bp, Homo sapiens
cctttaggcagcctgc

SEQ ID NO: 4179163 - DNA, 19 bp, Homo sapiens
cctttaggcagcctgccgc

SEQ ID NO: 4179164 - DNA, 19 bp, Homo sapiens
cctttatagctctcatcac

SEQ ID NO: 4179165 - DNA, 12 bp, Homo sapiens
cctttcagggaa

SEQ ID NO: 4179166 - DNA, 17 bp, Homo sapiens
cctttcccatgatccag

SEQ ID NO: 4179167 - DNA, 18 bp, Homo sapiens
cctttcccatgatccaga

SEQ ID NO: 4179168 - DNA, 14 bp, Homo sapiens
cctttcccccaccc

SEQ ID NO: 4179169 - DNA, 22 bp, Homo sapiens
cctttcccccaccccagagttg

SEQ ID NO: 4179170 - DNA, 16 bp, Homo sapiens
cctttcctccccacct

SEQ ID NO: 4179171 - DNA, 19 bp, Homo sapiens
cctttcctctgcagcactt

SEQ ID NO: 4179172 - DNA, 16 bp, Homo sapiens
cctttctctggctcca

SEQ ID NO: 4179173 - DNA, 17 bp, Homo sapiens
cctttctggaagtttct

SEQ ID NO: 4179174 - DNA, 12 bp, Homo sapiens
cctttctggacc

SEQ ID NO: 4179175 - DNA, 11 bp, Homo sapiens
cctttctgtgt

SEQ ID NO: 4179176 - DNA, 22 bp, Homo sapiens
cctttgagggcagtggggagca

SEQ ID NO: 4179177 - DNA, 18 bp, Homo sapiens
cctttgcaggcccagcag

SEQ ID NO: 4179178 - DNA, 14 bp, Homo sapiens
cctttgcctctgct

SEQ ID NO: 4179179 - DNA, 18 bp, Homo sapiens
cctttggggttgcccagc

SEQ ID NO: 4179180 - DNA, 13 bp, Homo sapiens
ccttttaaaagaa

SEQ ID NO: 4179181 - DNA, 15 bp, Homo sapiens
ccttttaaagttgga

SEQ ID NO: 4179182 - DNA, 15 bp, Homo sapiens
ccttttcttccttct

SEQ ID NO: 4179183 - DNA, 18 bp, Homo sapiens
ccttttgcataagattaa

SEQ ID NO: 4179184 - DNA, 15 bp, Homo sapiens
ccttttgctgctgct

SEQ ID NO: 4179185 - DNA, 18 bp, Homo sapiens
ccttttgcttgaaaccaa

SEQ ID NO: 4179186 - DNA, 19 bp, Homo sapiens
ccttttgtaccatggtgtg

SEQ ID NO: 4179187 - DNA, 14 bp, Homo sapiens
cctttttaactttg

SEQ ID NO: 4179188 - DNA, 16 bp, Homo sapiens
cctttttctacctttt

SEQ ID NO: 4179189 - DNA, 22 bp, Homo sapiens
ccttttttaggaagcaagctta

SEQ ID NO: 4179190 - DNA, 19 bp, Homo sapiens
cgaaaacgttgaccccttt

SEQ ID NO: 4179191 - DNA, 23 bp, Homo sapiens
cgaaaacgttgacccctttcccc

SEQ ID NO: 4179192 - DNA, 18 bp, Homo sapiens
cgaaacaacttgtgttct

SEQ ID NO: 4179193 - DNA, 18 bp, Homo sapiens
cgaagctttgaaggccga

SEQ ID NO: 4179194 - DNA, 11 bp, Homo sapiens
cgaagtggctc

SEQ ID NO: 4179195 - DNA, 13 bp, Homo sapiens
cgaataaatgttc

SEQ ID NO: 4179196 - DNA, 14 bp, Homo sapiens
cgaataaatgttca

SEQ ID NO: 4179197 - DNA, 16 bp, Homo sapiens
cgaattaatagctttt

SEQ ID NO: 4179198 - DNA, 20 bp, Homo sapiens
cgaccatcgtccagccctcc

SEQ ID NO: 4179199 - DNA, 13 bp, Homo sapiens
cgactagcaggca

SEQ ID NO: 4179200 - DNA, 13 bp, Homo sapiens
cgagaccagcctg

SEQ ID NO: 4179201 - DNA, 15 bp, Homo sapiens
cgagacggctggacc

SEQ ID NO: 4179202 - DNA, 22 bp, Homo sapiens
cgagagaggcgcgtctgcccca

SEQ ID NO: 4179203 - DNA, 14 bp, Homo sapiens
cgagaggcagagaa

SEQ ID NO: 4179204 - DNA, 15 bp, Homo sapiens
cgagagtctgtctca

SEQ ID NO: 4179205 - DNA, 20 bp, Homo sapiens
cgagcaaagtctaaagttta

SEQ ID NO: 4179206 - DNA, 18 bp, Homo sapiens
cgagcgctttctggaaaa

SEQ ID NO: 4179207 - DNA, 14 bp, Homo sapiens
cgagctgctctgct

SEQ ID NO: 4179208 - DNA, 10 bp, Homo sapiens
cgaggctctt

SEQ ID NO: 4179209 - DNA, 15 bp, Homo sapiens
cgaggctcttccatc

SEQ ID NO: 4179210 - DNA, 17 bp, Homo sapiens
cgagggagctgctggct

SEQ ID NO: 4179211 - DNA, 22 bp, Homo sapiens
cgagggagctgctggctgacct

SEQ ID NO: 4179212 - DNA, 18 bp, Homo sapiens
cgaggtgtcaccctgcag

SEQ ID NO: 4179213 - DNA, 19 bp, Homo sapiens
cgaggtgtcaccctgcaga

SEQ ID NO: 4179214 - DNA, 23 bp, Homo sapiens
cgaggtgtcaccctgcagagcta

SEQ ID NO: 4179215 - DNA, 11 bp, Homo sapiens
cgagtgccagg

SEQ ID NO: 4179216 - DNA, 22 bp, Homo sapiens
cgagttgtggaaagcctctgct

SEQ ID NO: 4179217 - DNA, 19 bp, Homo sapiens
cgatatcaccatgatttaa

SEQ ID NO: 4179218 - DNA, 22 bp, Homo sapiens
cgatgccgtgtgtctcgtctcc

SEQ ID NO: 4179219 - DNA, 13 bp, Homo sapiens
cgattcagagact

SEQ ID NO: 4179220 - DNA, 21 bp, Homo sapiens
cgcaagaggcatagagggaga

SEQ ID NO: 4179221 - DNA, 19 bp, Homo sapiens
cgcacacatggacacagac

SEQ ID NO: 4179222 - DNA, 17 bp, Homo sapiens
cgcacctgccccctggt

SEQ ID NO: 4179223 - DNA, 21 bp, Homo sapiens
cgcagccagccggtgcctggc

SEQ ID NO: 4179224 - DNA, 21 bp, Homo sapiens
cgcagccgccgggcaggcctg

SEQ ID NO: 4179225 - DNA, 15 bp, Homo sapiens
cgcaggaactcccag

SEQ ID NO: 4179226 - DNA, 18 bp, Homo sapiens
cgcaggaactcccagcaa

SEQ ID NO: 4179227 - DNA, 17 bp, Homo sapiens
ctcgtggtagaagccag

SEQ ID NO: 4179228 - DNA, 20 bp, Homo sapiens
ctcgtggtagaagccagtac

SEQ ID NO: 4179229 - DNA, 20 bp, Homo sapiens
ctctaacccccagtgccaca

SEQ ID NO: 4179230 - DNA, 13 bp, Homo sapiens
ctctaagccactc

SEQ ID NO: 4179231 - DNA, 16 bp, Homo sapiens
ctctaagctgtgtgca

SEQ ID NO: 4179232 - DNA, 15 bp, Homo sapiens
ctctaagtttagaag

SEQ ID NO: 4179233 - DNA, 22 bp, Homo sapiens
ctctaattccttaccccagctg

SEQ ID NO: 4179234 - DNA, 17 bp, Homo sapiens
ctctacccggcccagag

SEQ ID NO: 4179235 - DNA, 21 bp, Homo sapiens
ctctacccggcccagagaccc

SEQ ID NO: 4179236 - DNA, 21 bp, Homo sapiens
ctctagtcttgctttgctgtc

SEQ ID NO: 4179237 - DNA, 18 bp, Homo sapiens
ctctagtgccctccacag

SEQ ID NO: 4179238 - DNA, 13 bp, Homo sapiens
ctctatttcacaa

SEQ ID NO: 4179239 - DNA, 21 bp, Homo sapiens
ctctcactaaactttacccaa

SEQ ID NO: 4179240 - DNA, 14 bp, Homo sapiens
ctctccagagagca

SEQ ID NO: 4179241 - DNA, 19 bp, Homo sapiens
ctctcccctccctcttcct

SEQ ID NO: 4179242 - DNA, 22 bp, Homo sapiens
ctctcccctccctcttccttcc

SEQ ID NO: 4179243 - DNA, 17 bp, Homo sapiens
ctctcccctgccctgct

SEQ ID NO: 4179244 - DNA, 21 bp, Homo sapiens
ctctccctgccaagtctcaga

SEQ ID NO: 4179245 - DNA, 13 bp, Homo sapiens
ctctcctccgcca

SEQ ID NO: 4179246 - DNA, 19 bp, Homo sapiens
ctctcctctcctcctctgt

SEQ ID NO: 4179247 - DNA, 14 bp, Homo sapiens
ctctccttccctct

SEQ ID NO: 4179248 - DNA, 18 bp, Homo sapiens
ctctcggaaggctggctg

SEQ ID NO: 4179249 - DNA, 17 bp, Homo sapiens
ctctcgtaactggtttc

SEQ ID NO: 4179250 - DNA, 22 bp, Homo sapiens
ctctctactcctacctcagcct

SEQ ID NO: 4179251 - DNA, 16 bp, Homo sapiens
ctctctcctttttgct

SEQ ID NO: 4179252 - DNA, 12 bp, Homo sapiens
ctctctgctcca

SEQ ID NO: 4179253 - DNA, 21 bp, Homo sapiens
ctctctgctgagcagcccagc

SEQ ID NO: 4179254 - DNA, 23 bp, Homo sapiens
ctctctgctgagcagcccagcac

SEQ ID NO: 4179255 - DNA, 13 bp, Homo sapiens
ctctcttccctat

SEQ ID NO: 4179256 - DNA, 17 bp, Homo sapiens
ctctcttttttttttct

SEQ ID NO: 4179257 - DNA, 14 bp, Homo sapiens
ctctgaaacatatt

SEQ ID NO: 4179258 - DNA, 14 bp, Homo sapiens
ctctgaaggatcct

SEQ ID NO: 4179259 - DNA, 14 bp, Homo sapiens
ctctgacctgcagg

SEQ ID NO: 4179260 - DNA, 19 bp, Homo sapiens
ctctgagaattccaaggag

SEQ ID NO: 4179261 - DNA, 21 bp, Homo sapiens
ctctgcggtggtgccagaggt

SEQ ID NO: 4179262 - DNA, 16 bp, Homo sapiens
ctctgctactgaggca

SEQ ID NO: 4179263 - DNA, 15 bp, Homo sapiens
ctctgctgagcagcc

SEQ ID NO: 4179264 - DNA, 13 bp, Homo sapiens
ctctgctgccatg

SEQ ID NO: 4179265 - DNA, 21 bp, Homo sapiens
ctctggaaaactcaggattct

SEQ ID NO: 4179266 - DNA, 20 bp, Homo sapiens
ctctggaaaatgtgacccag

SEQ ID NO: 4179267 - DNA, 21 bp, Homo sapiens
ctctggaaaatgtgacccaga

SEQ ID NO: 4179268 - DNA, 17 bp, Homo sapiens
ctctggagccaaggcag

SEQ ID NO: 4179269 - DNA, 18 bp, Homo sapiens
ctctggcctcctgggggc

SEQ ID NO: 4179270 - DNA, 13 bp, Homo sapiens
ctctggctccaga

SEQ ID NO: 4179271 - DNA, 14 bp, Homo sapiens
ctctggctttgtct

SEQ ID NO: 4179272 - DNA, 18 bp, Homo sapiens
ctctggctttgtctctag

SEQ ID NO: 4179273 - DNA, 21 bp, Homo sapiens
ctctgtaaccgcttctggggc

SEQ ID NO: 4179274 - DNA, 14 bp, Homo sapiens
ctctgtacaaaaac

SEQ ID NO: 4179275 - DNA, 20 bp, Homo sapiens
ctctgtgttgtgaatgtcat

SEQ ID NO: 4179276 - DNA, 14 bp, Homo sapiens
ctctgttgcgctcc

SEQ ID NO: 4179277 - DNA, 18 bp, Homo sapiens
ctcttaccaaaacagatg

SEQ ID NO: 4179278 - DNA, 18 bp, Homo sapiens
ctcttataacttctgaag

SEQ ID NO: 4179279 - DNA, 15 bp, Homo sapiens
ctcttcactcagcca

SEQ ID NO: 4179280 - DNA, 12 bp, Homo sapiens
ctcttccctcct

SEQ ID NO: 4179281 - DNA, 12 bp, Homo sapiens
ctcttcctctgg

SEQ ID NO: 4179282 - DNA, 20 bp, Homo sapiens
ctcttccttcccccatcccc

SEQ ID NO: 4179283 - DNA, 22 bp, Homo sapiens
ctcttccttcccccatcccctt

SEQ ID NO: 4179284 - DNA, 23 bp, Homo sapiens
ctcttccttccgctcctttacct

SEQ ID NO: 4179285 - DNA, 17 bp, Homo sapiens
ctcttcttcttcagaag

SEQ ID NO: 4179286 - DNA, 18 bp, Homo sapiens
ctcttcttcttcagaaga

SEQ ID NO: 4179287 - DNA, 17 bp, Homo sapiens
ctcttcttgagcagacc

SEQ ID NO: 4179288 - DNA, 15 bp, Homo sapiens
ctctttaaccactcc

SEQ ID NO: 4179289 - DNA, 14 bp, Homo sapiens
ctctttccccacct

SEQ ID NO: 4179290 - DNA, 20 bp, Homo sapiens
ctctttgttcagttgactta

SEQ ID NO: 4179291 - DNA, 18 bp, Homo sapiens
ctgaaaaaaaaaaagaag

SEQ ID NO: 4179292 - DNA, 21 bp, Homo sapiens
ctgaaaaaaaaaaagaagaag

SEQ ID NO: 4179293 - DNA, 14 bp, Homo sapiens
ctgaaaaaaagttt

SEQ ID NO: 4179294 - DNA, 18 bp, Homo sapiens
ctgaaaaaaagtttacaa

SEQ ID NO: 4179295 - DNA, 16 bp, Homo sapiens
ctgaaaatctaatatt

SEQ ID NO: 4179296 - DNA, 13 bp, Homo sapiens
ctgaaacatattt

SEQ ID NO: 4179297 - DNA, 13 bp, Homo sapiens
ctgaaacggcccc

SEQ ID NO: 4179298 - DNA, 16 bp, Homo sapiens
ctgaacaattctctct

SEQ ID NO: 4179299 - DNA, 13 bp, Homo sapiens
ctgaaccactttg

SEQ ID NO: 4179300 - DNA, 12 bp, Homo sapiens
ctgaaggagatt

SEQ ID NO: 4179301 - DNA, 18 bp, Homo sapiens
ctgaaggagattttcctt

SEQ ID NO: 4179302 - DNA, 18 bp, Homo sapiens
ctgaagggaaagggctct

SEQ ID NO: 4179303 - DNA, 18 bp, Homo sapiens
ctgaagtaatgacagatt

SEQ ID NO: 4179304 - DNA, 21 bp, Homo sapiens
ctgaagtaatttgtaaaaaag

SEQ ID NO: 4179305 - DNA, 22 bp, Homo sapiens
ctgaagtcattgtcgctcagca

SEQ ID NO: 4179306 - DNA, 14 bp, Homo sapiens
ctgaagttatctgt

SEQ ID NO: 4179307 - DNA, 15 bp, Homo sapiens
ctgaataacatttgt

SEQ ID NO: 4179308 - DNA, 18 bp, Homo sapiens
ctgaataggaaaatgtac

SEQ ID NO: 4179309 - DNA, 15 bp, Homo sapiens
ctgaatgagtctgct

SEQ ID NO: 4179310 - DNA, 20 bp, Homo sapiens
ctgaattttgggacttctac

SEQ ID NO: 4179311 - DNA, 20 bp, Homo sapiens
ctgacaagatggaaaataaa

SEQ ID NO: 4179312 - DNA, 18 bp, Homo sapiens
ctgacagatataaaatag

SEQ ID NO: 4179313 - DNA, 13 bp, Homo sapiens
ctgacatgtctca

SEQ ID NO: 4179314 - DNA, 23 bp, Homo sapiens
ctgaccagccgtgagcatgtttg

SEQ ID NO: 4179315 - DNA, 22 bp, Homo sapiens
ctgaccctcctccactccacct

SEQ ID NO: 4179316 - DNA, 21 bp, Homo sapiens
ctgacctgatcacctctggct

SEQ ID NO: 4179317 - DNA, 12 bp, Homo sapiens
ctgacctgggcc

SEQ ID NO: 4179318 - DNA, 21 bp, Homo sapiens
ctgacctgggcccacagagcc

SEQ ID NO: 4179319 - DNA, 13 bp, Homo sapiens
ctgacgacactga

SEQ ID NO: 4179320 - DNA, 22 bp, Homo sapiens
ctgacggaagccaacttggctt

SEQ ID NO: 4179321 - DNA, 17 bp, Homo sapiens
ctgactcctctaagcca

SEQ ID NO: 4179322 - DNA, 22 bp, Homo sapiens
ctgagaactgaattttgggact

SEQ ID NO: 4179323 - DNA, 21 bp, Homo sapiens
ctgagaaggaacagggaacat

SEQ ID NO: 4179324 - DNA, 15 bp, Homo sapiens
ctgagaataagaaag

SEQ ID NO: 4179325 - DNA, 15 bp, Homo sapiens
ctgagaattccaagg

SEQ ID NO: 4179326 - DNA, 13 bp, Homo sapiens
ctgagacaggaga

SEQ ID NO: 4179327 - DNA, 19 bp, Homo sapiens
ctgagagaagttgggaggg

SEQ ID NO: 4179328 - DNA, 13 bp, Homo sapiens
ctgagagactttt

SEQ ID NO: 4179329 - DNA, 22 bp, Homo sapiens
ctgagagcagatggtcctccat

SEQ ID NO: 4179330 - DNA, 13 bp, Homo sapiens
ctgagattttagt

SEQ ID NO: 4179331 - DNA, 18 bp, Homo sapiens
ctgagcaaacaccagtga

SEQ ID NO: 4179332 - DNA, 23 bp, Homo sapiens
ctgagcaacagagtgagaccctg

SEQ ID NO: 4179333 - DNA, 17 bp, Homo sapiens
ctgagcaagagctggca

SEQ ID NO: 4179334 - DNA, 18 bp, Homo sapiens
ctgagcaccccctcattc

SEQ ID NO: 4179335 - DNA, 23 bp, Homo sapiens
ctgagcagtgtacactgttccca

SEQ ID NO: 4179336 - DNA, 17 bp, Homo sapiens
ctgagccataccgacca

SEQ ID NO: 4179337 - DNA, 14 bp, Homo sapiens
ctgagcggaggctc

SEQ ID NO: 4179338 - DNA, 14 bp, Homo sapiens
ctgaggatgacaga

SEQ ID NO: 4179339 - DNA, 13 bp, Homo sapiens
ctgaggcaggaga

SEQ ID NO: 4179340 - DNA, 19 bp, Homo sapiens
ctgaggcaggggagtagtg

SEQ ID NO: 4179341 - DNA, 18 bp, Homo sapiens
ctgaggccccaggcccta

SEQ ID NO: 4179342 - DNA, 15 bp, Homo sapiens
ctgaggctgagactg

SEQ ID NO: 4179343 - DNA, 19 bp, Homo sapiens
ctgagggattttagcctct

SEQ ID NO: 4179344 - DNA, 12 bp, Homo sapiens
ctgagggccctt

SEQ ID NO: 4179345 - DNA, 23 bp, Homo sapiens
ctgaggggaggatcactggagcc

SEQ ID NO: 4179346 - DNA, 20 bp, Homo sapiens
ctgaggggggccgtgcccag

SEQ ID NO: 4179347 - DNA, 22 bp, Homo sapiens
ctgagtcacccatgaagacagg

SEQ ID NO: 4179348 - DNA, 22 bp, Homo sapiens
ctgagtcagaggacaccatcca

SEQ ID NO: 4179349 - DNA, 22 bp, Homo sapiens
ctgagtctgctatattttcatg

SEQ ID NO: 4179350 - DNA, 19 bp, Homo sapiens
ctgagtgcactcctggtga

SEQ ID NO: 4179351 - DNA, 15 bp, Homo sapiens
ctgagttctggtgag

SEQ ID NO: 4179352 - DNA, 14 bp, Homo sapiens
ctgatacccagagc

SEQ ID NO: 4179353 - DNA, 16 bp, Homo sapiens
ctgatagagtgatttt

SEQ ID NO: 4179354 - DNA, 12 bp, Homo sapiens
ctgatcaaggcc

SEQ ID NO: 4179355 - DNA, 18 bp, Homo sapiens
ctgatccctttcccatga

SEQ ID NO: 4179356 - DNA, 21 bp, Homo sapiens
ctgatccggctgctcctccag

SEQ ID NO: 4179357 - DNA, 17 bp, Homo sapiens
ctgatgctttgcttcaa

SEQ ID NO: 4179358 - DNA, 13 bp, Homo sapiens
ctgatggagaagg

SEQ ID NO: 4179359 - DNA, 15 bp, Homo sapiens
ctgatggagaaggaa

SEQ ID NO: 4179360 - DNA, 16 bp, Homo sapiens
ctgatggagaaggaag

SEQ ID NO: 4179361 - DNA, 16 bp, Homo sapiens
ctgatggtacaggaaa

SEQ ID NO: 4179362 - DNA, 22 bp, Homo sapiens
ctgtagctttcctggtccctca

SEQ ID NO: 4179363 - DNA, 18 bp, Homo sapiens
ctgtagtaggcattttta

SEQ ID NO: 4179364 - DNA, 22 bp, Homo sapiens
ctgtagtaggcatttttaccat

SEQ ID NO: 4179365 - DNA, 18 bp, Homo sapiens
ctgtagtcccagccactc

SEQ ID NO: 4179366 - DNA, 23 bp, Homo sapiens
ctgtagtcccagccactcgggag

SEQ ID NO: 4179367 - DNA, 15 bp, Homo sapiens
ctgtagttaggaaat

SEQ ID NO: 4179368 - DNA, 22 bp, Homo sapiens
ctgtagttaggaaataaaacct

SEQ ID NO: 4179369 - DNA, 16 bp, Homo sapiens
ctgtatataggccttc

SEQ ID NO: 4179370 - DNA, 23 bp, Homo sapiens
ctgtcactggcagagcacagccc

SEQ ID NO: 4179371 - DNA, 22 bp, Homo sapiens
ctgtcagatgggaagacatgaa

SEQ ID NO: 4179372 - DNA, 17 bp, Homo sapiens
ctgtcagcgcaggttta

SEQ ID NO: 4179373 - DNA, 23 bp, Homo sapiens
ctgtcatggtcctttctggaagt

SEQ ID NO: 4179374 - DNA, 13 bp, Homo sapiens
ctgtcattcagga

SEQ ID NO: 4179375 - DNA, 17 bp, Homo sapiens
ctgtcccggagctcagg

SEQ ID NO: 4179376 - DNA, 16 bp, Homo sapiens
ctgtccgcctctgccc

SEQ ID NO: 4179377 - DNA, 23 bp, Homo sapiens
ctgtcctagcaggatctgcccac

SEQ ID NO: 4179378 - DNA, 15 bp, Homo sapiens
ctgtcctcagagcag

SEQ ID NO: 4179379 - DNA, 12 bp, Homo sapiens
ctgtcctgcctc

SEQ ID NO: 4179380 - DNA, 14 bp, Homo sapiens
ctgtcctggctccc

SEQ ID NO: 4179381 - DNA, 20 bp, Homo sapiens
ctgtcctggtacagcagggt

SEQ ID NO: 4179382 - DNA, 21 bp, Homo sapiens
ctgtcctttctagagcactgc

SEQ ID NO: 4179383 - DNA, 11 bp, Homo sapiens
ctgtctacatt

SEQ ID NO: 4179384 - DNA, 14 bp, Homo sapiens
ctgtctacatttct

SEQ ID NO: 4179385 - DNA, 18 bp, Homo sapiens
ctgtctacttgctcaggt

SEQ ID NO: 4179386 - DNA, 23 bp, Homo sapiens
ctgtctggtgtagctcctctgct

SEQ ID NO: 4179387 - DNA, 17 bp, Homo sapiens
ctgtctggttttaacaa

SEQ ID NO: 4179388 - DNA, 16 bp, Homo sapiens
ctgtctgtctgtccca

SEQ ID NO: 4179389 - DNA, 17 bp, Homo sapiens
ctgtctgtctgtcccaa

SEQ ID NO: 4179390 - DNA, 15 bp, Homo sapiens
ctgtctgtctgtctg

SEQ ID NO: 4179391 - DNA, 15 bp, Homo sapiens
ctgtcttggtggatg

SEQ ID NO: 4179392 - DNA, 22 bp, Homo sapiens
ctgtcttggtggatgggccctg

SEQ ID NO: 4179393 - DNA, 24 bp, Homo sapiens
ctgtgaaataccacaagcctgaga

SEQ ID NO: 4179394 - DNA, 19 bp, Homo sapiens
ctgtgaacaccaggacttt

SEQ ID NO: 4179395 - DNA, 22 bp, Homo sapiens
ctgtgacctgccccgcccagct

SEQ ID NO: 4179396 - DNA, 14 bp, Homo sapiens
ctgtgactgatgtt

SEQ ID NO: 4179397 - DNA, 18 bp, Homo sapiens
ctgtgatgctttgaagta

SEQ ID NO: 4179398 - DNA, 11 bp, Homo sapiens
ctgtgccttac

SEQ ID NO: 4179399 - DNA, 12 bp, Homo sapiens
ctgtgcctttgg

SEQ ID NO: 4179400 - DNA, 15 bp, Homo sapiens
ctgtgcgtctgtgtg

SEQ ID NO: 4179401 - DNA, 21 bp, Homo sapiens
ctgtgctatggtgctctgtct

SEQ ID NO: 4179402 - DNA, 12 bp, Homo sapiens
ctgtgctcctgt

SEQ ID NO: 4179403 - DNA, 17 bp, Homo sapiens
ctgtgctcctgtccctc

SEQ ID NO: 4179404 - DNA, 16 bp, Homo sapiens
ctgtgcttatggtacc

SEQ ID NO: 4179405 - DNA, 20 bp, Homo sapiens
ctgtggagacagccctgcct

SEQ ID NO: 4179406 - DNA, 17 bp, Homo sapiens
ctgtggattccagcatt

SEQ ID NO: 4179407 - DNA, 19 bp, Homo sapiens
ctgtggattttgtccattc

SEQ ID NO: 4179408 - DNA, 12 bp, Homo sapiens
ctgtggcccagt

SEQ ID NO: 4179409 - DNA, 17 bp, Homo sapiens
ctgtggcccttctgtcc

SEQ ID NO: 4179410 - DNA, 12 bp, Homo sapiens
ctgtgggaagag

SEQ ID NO: 4179411 - DNA, 23 bp, Homo sapiens
ctgtgggaagagaagggaagcct

SEQ ID NO: 4179412 - DNA, 13 bp, Homo sapiens
ctgtggggtctgg

SEQ ID NO: 4179413 - DNA, 20 bp, Homo sapiens
ctgtggtgggaacattcgag

SEQ ID NO: 4179414 - DNA, 19 bp, Homo sapiens
ctgtggttcctaagcctgt

SEQ ID NO: 4179415 - DNA, 20 bp, Homo sapiens
ctgtgtccgtctgtgtatgt

SEQ ID NO: 4179416 - DNA, 21 bp, Homo sapiens
ctgtgtccgtctgtgtatgtg

SEQ ID NO: 4179417 - DNA, 16 bp, Homo sapiens
ctgtgtcgtagccaag

SEQ ID NO: 4179418 - DNA, 17 bp, Homo sapiens
ctgtgtctcacagaggc

SEQ ID NO: 4179419 - DNA, 13 bp, Homo sapiens
ctgtgtctggccc

SEQ ID NO: 4179420 - DNA, 16 bp, Homo sapiens
ctgtgtgatgaacttt

SEQ ID NO: 4179421 - DNA, 14 bp, Homo sapiens
ctgtgtgccttcgc

SEQ ID NO: 4179422 - DNA, 16 bp, Homo sapiens
ctgtgtgtacatgtac

SEQ ID NO: 4179423 - DNA, 18 bp, Homo sapiens
ctgtgtgtctgatgtttg

SEQ ID NO: 4179424 - DNA, 23 bp, Homo sapiens
ctgtgtttttgctatcacacagt

SEQ ID NO: 4179425 - DNA, 22 bp, Homo sapiens
ctgttacaacttgtatttccaa

SEQ ID NO: 4179426 - DNA, 15 bp, Homo sapiens
ctgttactttggcaa

SEQ ID NO: 4179427 - DNA, 23 bp, Homo sapiens
ctgttactttggcaatttcctgg

SEQ ID NO: 4179428 - DNA, 23 bp, Homo sapiens
ctgttccagcccaggcagagatc

SEQ ID NO: 4179429 - DNA, 12 bp, Homo sapiens
ctgttgaaaatt

SEQ ID NO: 4179430 - DNA, 22 bp, Homo sapiens
ctgttgaaaattattttaaaca

SEQ ID NO: 4179431 - DNA, 17 bp, Homo sapiens
ctgttgagcatcacaga

SEQ ID NO: 4179432 - DNA, 20 bp, Homo sapiens
ctgttggaagttcactggag

SEQ ID NO: 4179433 - DNA, 12 bp, Homo sapiens
ctgttgtacaag

SEQ ID NO: 4179434 - DNA, 16 bp, Homo sapiens
ctgttgtacacagtct

SEQ ID NO: 4179435 - DNA, 15 bp, Homo sapiens
ctgttgtagaataat

SEQ ID NO: 4179436 - DNA, 21 bp, Homo sapiens
ctgttgtagaataataataaa

SEQ ID NO: 4179437 - DNA, 16 bp, Homo sapiens
ctgttgttttgtttta

SEQ ID NO: 4179438 - DNA, 21 bp, Homo sapiens
ctgtttccagttgttactgaa

SEQ ID NO: 4179439 - DNA, 24 bp, Homo sapiens
ctgttttaaaaacaaagaaataaa

SEQ ID NO: 4179440 - DNA, 13 bp, Homo sapiens
ctgttttaaatta

SEQ ID NO: 4179441 - DNA, 16 bp, Homo sapiens
ctgttttagctgaggg

SEQ ID NO: 4179442 - DNA, 17 bp, Homo sapiens
ctgttttagctgaggga

SEQ ID NO: 4179443 - DNA, 14 bp, Homo sapiens
ctgtttttgctatt

SEQ ID NO: 4179444 - DNA, 22 bp, Homo sapiens
ctgttttttctgtacacagaag

SEQ ID NO: 4179445 - DNA, 18 bp, Homo sapiens
cttaaattatatatttat

SEQ ID NO: 4179446 - DNA, 17 bp, Homo sapiens
cttaacatatttactaa

SEQ ID NO: 4179447 - DNA, 17 bp, Homo sapiens
cttaagcagagcagaac

SEQ ID NO: 4179448 - DNA, 14 bp, Homo sapiens
cttaaggtgtagcc

SEQ ID NO: 4179449 - DNA, 16 bp, Homo sapiens
cttaagtgctgcaatt

SEQ ID NO: 4179450 - DNA, 17 bp, Homo sapiens
cttaataaattcagata

SEQ ID NO: 4179451 - DNA, 22 bp, Homo sapiens
cttaatatacaatctatctttt

SEQ ID NO: 4179452 - DNA, 18 bp, Homo sapiens
cttacagttttaaattct

SEQ ID NO: 4179453 - DNA, 22 bp, Homo sapiens
cttacataattttttattcaag

SEQ ID NO: 4179454 - DNA, 14 bp, Homo sapiens
cttaccaactttct

SEQ ID NO: 4179455 - DNA, 16 bp, Homo sapiens
cttaccaagctgagca

SEQ ID NO: 4179456 - DNA, 15 bp, Homo sapiens
cttactcacctctct

SEQ ID NO: 4179457 - DNA, 18 bp, Homo sapiens
cttactcacctctctcta

SEQ ID NO: 4179458 - DNA, 20 bp, Homo sapiens
cttacttaagtcgggggtgg

SEQ ID NO: 4179459 - DNA, 15 bp, Homo sapiens
cttagaataaaattg

SEQ ID NO: 4179460 - DNA, 16 bp, Homo sapiens
cttagaataaaattgt

SEQ ID NO: 4179461 - DNA, 20 bp, Homo sapiens
cttagaataaaattgtaaaa

SEQ ID NO: 4179462 - DNA, 21 bp, Homo sapiens
cttagagaatagttatatttt

SEQ ID NO: 4179463 - DNA, 14 bp, Homo sapiens
cttagagaggaaaa

SEQ ID NO: 4179464 - DNA, 15 bp, Homo sapiens
cttagagaggaaaag

SEQ ID NO: 4179465 - DNA, 15 bp, Homo sapiens
cttagatctggcatg

SEQ ID NO: 4179466 - DNA, 21 bp, Homo sapiens
cttagatctggcatgttagcc

SEQ ID NO: 4179467 - DNA, 22 bp, Homo sapiens
cttagcctcctgacctgaggct

SEQ ID NO: 4179468 - DNA, 14 bp, Homo sapiens
cttagctatcagaa

SEQ ID NO: 4179469 - DNA, 17 bp, Homo sapiens
cttaggctgatagacaa

SEQ ID NO: 4179470 - DNA, 17 bp, Homo sapiens
cttaggctgctgggaga

SEQ ID NO: 4179471 - DNA, 14 bp, Homo sapiens
cttaggtgccaggc

SEQ ID NO: 4179472 - DNA, 16 bp, Homo sapiens
cttagtgccacccacc

SEQ ID NO: 4179473 - DNA, 18 bp, Homo sapiens
cttagtgccacccacctt

SEQ ID NO: 4179474 - DNA, 13 bp, Homo sapiens
cttagtggctttt

SEQ ID NO: 4179475 - DNA, 15 bp, Homo sapiens
cttataaacaaatga

SEQ ID NO: 4179476 - DNA, 21 bp, Homo sapiens
cttatagaaagcactactgca

SEQ ID NO: 4179477 - DNA, 15 bp, Homo sapiens
cttatatataataat

SEQ ID NO: 4179478 - DNA, 19 bp, Homo sapiens
cttatccaggactctgtca

SEQ ID NO: 4179479 - DNA, 15 bp, Homo sapiens
cttatcttctggatt

SEQ ID NO: 4179480 - DNA, 16 bp, Homo sapiens
cttatcttctggatta

SEQ ID NO: 4179481 - DNA, 13 bp, Homo sapiens
cttatggtaccag

SEQ ID NO: 4179482 - DNA, 19 bp, Homo sapiens
cttatggtaccagatgcag

SEQ ID NO: 4179483 - DNA, 20 bp, Homo sapiens
cttattcatgctttctcctt

SEQ ID NO: 4179484 - DNA, 11 bp, Homo sapiens
cttatttgagt

SEQ ID NO: 4179485 - DNA, 21 bp, Homo sapiens
cttcaaaccctcaagagggga

SEQ ID NO: 4179486 - DNA, 16 bp, Homo sapiens
cttcaaagtttaataa

SEQ ID NO: 4179487 - DNA, 13 bp, Homo sapiens
cttcaagtgccaa

SEQ ID NO: 4179488 - DNA, 15 bp, Homo sapiens
cttcaagtgccaaac

SEQ ID NO: 4179489 - DNA, 19 bp, Homo sapiens
cttcaagttagctcaggag

SEQ ID NO: 4179490 - DNA, 20 bp, Homo sapiens
cttcaagttagctcaggagg

SEQ ID NO: 4179491 - DNA, 22 bp, Homo sapiens
cttcacctgggcgccaactgct

SEQ ID NO: 4179492 - DNA, 23 bp, Homo sapiens
cttcaccttggagcctgaacatg

SEQ ID NO: 4179493 - DNA, 16 bp, Homo sapiens
cttcactcagccacac

SEQ ID NO: 4179494 - DNA, 19 bp, Homo sapiens
cttcactccggtgtgcctg

SEQ ID NO: 4179495 - DNA, 15 bp, Homo sapiens
cttcactgttgaaaa

SEQ ID NO: 4179496 - DNA, 13 bp, Homo sapiens
gctttcagggagg

SEQ ID NO: 4179497 - DNA, 21 bp, Homo sapiens
gctttccccgggggaggaagg

SEQ ID NO: 4179498 - DNA, 20 bp, Homo sapiens
gctttcctttccttctggct

SEQ ID NO: 4179499 - DNA, 23 bp, Homo sapiens
gctttcctttccttctggctcca

SEQ ID NO: 4179500 - DNA, 20 bp, Homo sapiens
gctttccttttcttccttct

SEQ ID NO: 4179501 - DNA, 16 bp, Homo sapiens
gctttggccctcagtg

SEQ ID NO: 4179502 - DNA, 18 bp, Homo sapiens
gctttgtatccatgaggg

SEQ ID NO: 4179503 - DNA, 19 bp, Homo sapiens
gctttgtgacttaagcagg

SEQ ID NO: 4179504 - DNA, 14 bp, Homo sapiens
gcttttgcttggca

SEQ ID NO: 4179505 - DNA, 15 bp, Homo sapiens
gctttttctctcagg

SEQ ID NO: 4179506 - DNA, 18 bp, Homo sapiens
gctttttctctcagggtt

SEQ ID NO: 4179507 - DNA, 18 bp, Homo sapiens
ggaaaaagaaaaacattt

SEQ ID NO: 4179508 - DNA, 21 bp, Homo sapiens
ggaaaactcttggcctctgct

SEQ ID NO: 4179509 - DNA, 22 bp, Homo sapiens
ggaaaactcttggcctctgctt

SEQ ID NO: 4179510 - DNA, 12 bp, Homo sapiens
ggaaaagtgtta

SEQ ID NO: 4179511 - DNA, 16 bp, Homo sapiens
ggaaaattagaagcaa

SEQ ID NO: 4179512 - DNA, 15 bp, Homo sapiens
ggaaacaggaccaca

SEQ ID NO: 4179513 - DNA, 12 bp, Homo sapiens
ggaaagagacca

SEQ ID NO: 4179514 - DNA, 20 bp, Homo sapiens
ggaaagatttgtgaactgga

SEQ ID NO: 4179515 - DNA, 16 bp, Homo sapiens
ggaaagcctctgctgc

SEQ ID NO: 4179516 - DNA, 23 bp, Homo sapiens
ggaaagctcagctactgattttt

SEQ ID NO: 4179517 - DNA, 18 bp, Homo sapiens
ggaaataaaacctttcaa

SEQ ID NO: 4179518 - DNA, 22 bp, Homo sapiens
ggaaataaaacctttcaaattt

SEQ ID NO: 4179519 - DNA, 18 bp, Homo sapiens
ggaaataaacctggagat

SEQ ID NO: 4179520 - DNA, 23 bp, Homo sapiens
ggaaataaacctggagatgatga

SEQ ID NO: 4179521 - DNA, 16 bp, Homo sapiens
ggaaatcaacttgctt

SEQ ID NO: 4179522 - DNA, 20 bp, Homo sapiens
ggaaatcattaaactttttt

SEQ ID NO: 4179523 - DNA, 13 bp, Homo sapiens
ggaaatgtgtgtt

SEQ ID NO: 4179524 - DNA, 21 bp, Homo sapiens
ggaacactggaaaataaattt

SEQ ID NO: 4179525 - DNA, 17 bp, Homo sapiens
ggaacccagctctcagg

SEQ ID NO: 4179526 - DNA, 18 bp, Homo sapiens
ggaacggggtccttcaag

SEQ ID NO: 4179527 - DNA, 15 bp, Homo sapiens
ggaacttctaatata

SEQ ID NO: 4179528 - DNA, 13 bp, Homo sapiens
ggaagaaaaaatg

SEQ ID NO: 4179529 - DNA, 21 bp, Homo sapiens
ggaagaagagatcaggaagag

SEQ ID NO: 4179530 - DNA, 18 bp, Homo sapiens
ggaagaagaggaggaaga

SEQ ID NO: 4179531 - DNA, 19 bp, Homo sapiens
ggaagacaggtctagactt

SEQ ID NO: 4179532 - DNA, 15 bp, Homo sapiens
ggaagagaaattttt

SEQ ID NO: 4179533 - DNA, 12 bp, Homo sapiens
ggaagagaagga

SEQ ID NO: 4179534 - DNA, 17 bp, Homo sapiens
ggaagagaaggagcaga

SEQ ID NO: 4179535 - DNA, 18 bp, Homo sapiens
ggaagagaggcacctgct

SEQ ID NO: 4179536 - DNA, 16 bp, Homo sapiens
ggaagaggtaattttt

SEQ ID NO: 4179537 - DNA, 15 bp, Homo sapiens
ggaagatattccttt

SEQ ID NO: 4179538 - DNA, 22 bp, Homo sapiens
ggaagatattcctttttaactt

SEQ ID NO: 4179539 - DNA, 17 bp, Homo sapiens
ggaagcacactgcaggg

SEQ ID NO: 4179540 - DNA, 23 bp, Homo sapiens
ggaagcacatgtttatttattct

SEQ ID NO: 4179541 - DNA, 22 bp, Homo sapiens
ggaagcggaggttgcagggagc

SEQ ID NO: 4179542 - DNA, 22 bp, Homo sapiens
ggaagctgggggaagggtggtc

SEQ ID NO: 4179543 - DNA, 21 bp, Homo sapiens
ggaagctttggtgagaacctg

SEQ ID NO: 4179544 - DNA, 13 bp, Homo sapiens
ggaaggaaaaaat

SEQ ID NO: 4179545 - DNA, 16 bp, Homo sapiens
ggaaggaactctggct

SEQ ID NO: 4179546 - DNA, 19 bp, Homo sapiens
ggaaggcttgttgtgcttt

SEQ ID NO: 4179547 - DNA, 23 bp, Homo sapiens
ggaagggttggtgggctggccca

SEQ ID NO: 4179548 - DNA, 12 bp, Homo sapiens
ggaagtatgtgt

SEQ ID NO: 4179549 - DNA, 17 bp, Homo sapiens
ggaatcagctggtggct

SEQ ID NO: 4179550 - DNA, 20 bp, Homo sapiens
ggaatcctgctgccagagaa

SEQ ID NO: 4179551 - DNA, 13 bp, Homo sapiens
ggaatcgtttcaa

SEQ ID NO: 4179552 - DNA, 23 bp, Homo sapiens
ggaatgcaatataaaaatgtgaa

SEQ ID NO: 4179553 - DNA, 20 bp, Homo sapiens
ggaattctttacaataaaca

SEQ ID NO: 4179554 - DNA, 21 bp, Homo sapiens
ggaattctttacaataaacat

SEQ ID NO: 4179555 - DNA, 19 bp, Homo sapiens
ggaatttgtaagtttatgt

SEQ ID NO: 4179556 - DNA, 14 bp, Homo sapiens
ggacaaagaacctt

SEQ ID NO: 4179557 - DNA, 19 bp, Homo sapiens
ggacaacctgcccctcccc

SEQ ID NO: 4179558 - DNA, 13 bp, Homo sapiens
ggacaagaagctg

SEQ ID NO: 4179559 - DNA, 15 bp, Homo sapiens
ggacaagaagctgct

SEQ ID NO: 4179560 - DNA, 13 bp, Homo sapiens
ggacaatgccact

SEQ ID NO: 4179561 - DNA, 14 bp, Homo sapiens
ggacaatgccacta

SEQ ID NO: 4179562 - DNA, 16 bp, Homo sapiens
ggacaatgccttggga

SEQ ID NO: 4179563 - DNA, 19 bp, Homo sapiens
ggacacacagtgacaaaag

SEQ ID NO: 4179564 - DNA, 21 bp, Homo sapiens
ggacacagaagtccctaggag

SEQ ID NO: 4179565 - DNA, 22 bp, Homo sapiens
ggacaccccccgccccccacct

SEQ ID NO: 4179566 - DNA, 21 bp, Homo sapiens
ggacaccccttatccaggact

SEQ ID NO: 4179567 - DNA, 12 bp, Homo sapiens
ggacacctgccc

SEQ ID NO: 4179568 - DNA, 14 bp, Homo sapiens
ggacacctgccctg

SEQ ID NO: 4179569 - DNA, 15 bp, Homo sapiens
ggacacctgccctgc

SEQ ID NO: 4179570 - DNA, 15 bp, Homo sapiens
ggacagagatggagg

SEQ ID NO: 4179571 - DNA, 18 bp, Homo sapiens
ggacaggatgtgtttgct

SEQ ID NO: 4179572 - DNA, 20 bp, Homo sapiens
ggacaggatgtgtttgcttt

SEQ ID NO: 4179573 - DNA, 22 bp, Homo sapiens
ggacagggtgaataaagcaggg

SEQ ID NO: 4179574 - DNA, 23 bp, Homo sapiens
ggacagggtgaataaagcaggga

SEQ ID NO: 4179575 - DNA, 20 bp, Homo sapiens
ggacagtattctcagtgctc

SEQ ID NO: 4179576 - DNA, 16 bp, Homo sapiens
ggacagtcctgggaga

SEQ ID NO: 4179577 - DNA, 19 bp, Homo sapiens
ggacagtcctgggagaacc

SEQ ID NO: 4179578 - DNA, 14 bp, Homo sapiens
ggacagtgcttcag

SEQ ID NO: 4179579 - DNA, 20 bp, Homo sapiens
ggacagtgcttcagcctgag

SEQ ID NO: 4179580 - DNA, 22 bp, Homo sapiens
ggacagtgcttcagcctgaggc

SEQ ID NO: 4179581 - DNA, 21 bp, Homo sapiens
ggacatgtttttgttttcttt

SEQ ID NO: 4179582 - DNA, 16 bp, Homo sapiens
ggaccgcgtagagagc

SEQ ID NO: 4179583 - DNA, 19 bp, Homo sapiens
ggaccgcttcccagaggcc

SEQ ID NO: 4179584 - DNA, 23 bp, Homo sapiens
ggacctgaatgacctgcagtcag

SEQ ID NO: 4179585 - DNA, 16 bp, Homo sapiens
ggacctttggggaagg

SEQ ID NO: 4179586 - DNA, 15 bp, Homo sapiens
ggacgcgcacacaca

SEQ ID NO: 4179587 - DNA, 16 bp, Homo sapiens
ggacgcgcacacacac

SEQ ID NO: 4179588 - DNA, 13 bp, Homo sapiens
ggacgcgggctgt

SEQ ID NO: 4179589 - DNA, 19 bp, Homo sapiens
ggacgcgggctgtgcctta

SEQ ID NO: 4179590 - DNA, 15 bp, Homo sapiens
ggacggttgtaagca

SEQ ID NO: 4179591 - DNA, 21 bp, Homo sapiens
ggactacgttaagggaaggaa

SEQ ID NO: 4179592 - DNA, 19 bp, Homo sapiens
ggactatgaaaagctagaa

SEQ ID NO: 4179593 - DNA, 16 bp, Homo sapiens
ggactccccaggccag

SEQ ID NO: 4179594 - DNA, 18 bp, Homo sapiens
ggactccccaggccaggc

SEQ ID NO: 4179595 - DNA, 13 bp, Homo sapiens
ggactcctcccac

SEQ ID NO: 4179596 - DNA, 17 bp, Homo sapiens
ggactggaaccagggag

SEQ ID NO: 4179597 - DNA, 18 bp, Homo sapiens
ggactggaaccagggaga

SEQ ID NO: 4179598 - DNA, 14 bp, Homo sapiens
ggactgggggtctt

SEQ ID NO: 4179599 - DNA, 22 bp, Homo sapiens
ggactgtagtttaatacttttt

SEQ ID NO: 4179600 - DNA, 18 bp, Homo sapiens
ggactgtgataatcagaa

SEQ ID NO: 4179601 - DNA, 22 bp, Homo sapiens
ggagaaatctggcttctggcca

SEQ ID NO: 4179602 - DNA, 16 bp, Homo sapiens
ggagaagctgatgctt

SEQ ID NO: 4179603 - DNA, 17 bp, Homo sapiens
ggagaaggatagcctca

SEQ ID NO: 4179604 - DNA, 21 bp, Homo sapiens
ggagaaggatagcctcagcca

SEQ ID NO: 4179605 - DNA, 12 bp, Homo sapiens
ggagaaggatct

SEQ ID NO: 4179606 - DNA, 14 bp, Homo sapiens
ggagaaggatctag

SEQ ID NO: 4179607 - DNA, 17 bp, Homo sapiens
ggagaatcaataaaaat

SEQ ID NO: 4179608 - DNA, 15 bp, Homo sapiens
ggagacagccctgcc

SEQ ID NO: 4179609 - DNA, 17 bp, Homo sapiens
ggagaccccggtggcag

SEQ ID NO: 4179610 - DNA, 21 bp, Homo sapiens
ggagaccccggtggcagtgga

SEQ ID NO: 4179611 - DNA, 13 bp, Homo sapiens
ggagactctgtgg

SEQ ID NO: 4179612 - DNA, 20 bp, Homo sapiens
ggagactctgtggggccttg

SEQ ID NO: 4179613 - DNA, 20 bp, Homo sapiens
ggagactggtcctgtgtgca

SEQ ID NO: 4179614 - DNA, 10 bp, Homo sapiens
ggagagcagc

SEQ ID NO: 4179615 - DNA, 11 bp, Homo sapiens
ggagagcagct

SEQ ID NO: 4179616 - DNA, 14 bp, Homo sapiens
ggagagcagctggc

SEQ ID NO: 4179617 - DNA, 15 bp, Homo sapiens
ggagagcagctggct

SEQ ID NO: 4179618 - DNA, 12 bp, Homo sapiens
ggagaggaagca

SEQ ID NO: 4179619 - DNA, 13 bp, Homo sapiens
ggagaggaagcac

SEQ ID NO: 4179620 - DNA, 23 bp, Homo sapiens
ggagaggaagcacactgcagggc

SEQ ID NO: 4179621 - DNA, 20 bp, Homo sapiens
ggagagtacagtgagccaag

SEQ ID NO: 4179622 - DNA, 12 bp, Homo sapiens
ggagatgatgat

SEQ ID NO: 4179623 - DNA, 14 bp, Homo sapiens
ggagatgatgatga

SEQ ID NO: 4179624 - DNA, 15 bp, Homo sapiens
ggagatgatgatgat

SEQ ID NO: 4179625 - DNA, 19 bp, Homo sapiens
ggagcagagctgatggaga

SEQ ID NO: 4179626 - DNA, 23 bp, Homo sapiens
ggagcagagctgatggagaagga

SEQ ID NO: 4179627 - DNA, 13 bp, Homo sapiens
ggagcatcccagg

SEQ ID NO: 4179628 - DNA, 19 bp, Homo sapiens
ggagcccgcttcaagctct

SEQ ID NO: 4179629 - DNA, 18 bp, Homo sapiens
ggagcggagcttgcctgc

SEQ ID NO: 4179630 - DNA, 17 bp, Homo sapiens
gtcccttgtttccagct

SEQ ID NO: 4179631 - DNA, 12 bp, Homo sapiens
gtccgcctctgc

SEQ ID NO: 4179632 - DNA, 15 bp, Homo sapiens
gtccgtccaccacct

SEQ ID NO: 4179633 - DNA, 13 bp, Homo sapiens
gtcctcacagcct

SEQ ID NO: 4179634 - DNA, 17 bp, Homo sapiens
gtcctcacagcctctcc

SEQ ID NO: 4179635 - DNA, 20 bp, Homo sapiens
gtcctcacagcctctccctt

SEQ ID NO: 4179636 - DNA, 19 bp, Homo sapiens
gtcctccatttcaactcca

SEQ ID NO: 4179637 - DNA, 18 bp, Homo sapiens
gtcctctccctgccaagt

SEQ ID NO: 4179638 - DNA, 13 bp, Homo sapiens
gtcctgagacctg

SEQ ID NO: 4179639 - DNA, 17 bp, Homo sapiens
gtcctgcaatctccagg

SEQ ID NO: 4179640 - DNA, 18 bp, Homo sapiens
gtcctgcaatctccaggg

SEQ ID NO: 4179641 - DNA, 21 bp, Homo sapiens
gtcctgcaatctccagggctg

SEQ ID NO: 4179642 - DNA, 13 bp, Homo sapiens
gtcctgcactgtc

SEQ ID NO: 4179643 - DNA, 22 bp, Homo sapiens
gtcctgcccccgacagcccagc

SEQ ID NO: 4179644 - DNA, 16 bp, Homo sapiens
gtcctgcctctctgct

SEQ ID NO: 4179645 - DNA, 21 bp, Homo sapiens
gtcctgcctctctgctccaga

SEQ ID NO: 4179646 - DNA, 22 bp, Homo sapiens
gtcctgcctctctgctccagag

SEQ ID NO: 4179647 - DNA, 19 bp, Homo sapiens
gtcctgcgtcgaagctttg

SEQ ID NO: 4179648 - DNA, 19 bp, Homo sapiens
gtcctgggagaacctcagg

SEQ ID NO: 4179649 - DNA, 15 bp, Homo sapiens
gtcctggggctctgt

SEQ ID NO: 4179650 - DNA, 14 bp, Homo sapiens
gtcctgggggctgc

SEQ ID NO: 4179651 - DNA, 18 bp, Homo sapiens
gtcctgggggctgctgca

SEQ ID NO: 4179652 - DNA, 17 bp, Homo sapiens
gtccttattatcccagc

SEQ ID NO: 4179653 - DNA, 21 bp, Homo sapiens
gtcctttaggcagcctgccgc

SEQ ID NO: 4179654 - DNA, 17 bp, Homo sapiens
gtccttttgtaccatgg

SEQ ID NO: 4179655 - DNA, 20 bp, Homo sapiens
gtcgtagccaaggtgggctg

SEQ ID NO: 4179656 - DNA, 14 bp, Homo sapiens
gtcgtgggtgtgtg

SEQ ID NO: 4179657 - DNA, 16 bp, Homo sapiens
gtctaaagtttacagt

SEQ ID NO: 4179658 - DNA, 17 bp, Homo sapiens
gtctaaagtttacagta

SEQ ID NO: 4179659 - DNA, 17 bp, Homo sapiens
gtctacatttctgcaga

SEQ ID NO: 4179660 - DNA, 15 bp, Homo sapiens
gtctacttgctcagg

SEQ ID NO: 4179661 - DNA, 18 bp, Homo sapiens
gtctagctttcctttcct

SEQ ID NO: 4179662 - DNA, 21 bp, Homo sapiens
gtctagtgaagatgttgtcat

SEQ ID NO: 4179663 - DNA, 15 bp, Homo sapiens
gtctcacagaggcag

SEQ ID NO: 4179664 - DNA, 23 bp, Homo sapiens
gtctcagtccagatgccttcctg

SEQ ID NO: 4179665 - DNA, 15 bp, Homo sapiens
gtctccactgaggat

SEQ ID NO: 4179666 - DNA, 16 bp, Homo sapiens
gtctccctggagtgca

SEQ ID NO: 4179667 - DNA, 16 bp, Homo sapiens
gtctccgcacttggaa

SEQ ID NO: 4179668 - DNA, 23 bp, Homo sapiens
gtctctatttcacaattatattt

SEQ ID NO: 4179669 - DNA, 15 bp, Homo sapiens
gtctgagcaccccct

SEQ ID NO: 4179670 - DNA, 15 bp, Homo sapiens
gtctgaggccccagg

SEQ ID NO: 4179671 - DNA, 15 bp, Homo sapiens
gtctgcacccagggg

SEQ ID NO: 4179672 - DNA, 18 bp, Homo sapiens
gtctgctatattttcatg

SEQ ID NO: 4179673 - DNA, 22 bp, Homo sapiens
gtctggaagaagaggaggaaga

SEQ ID NO: 4179674 - DNA, 19 bp, Homo sapiens
gtctggacgccgagggcag

SEQ ID NO: 4179675 - DNA, 19 bp, Homo sapiens
gtctggctgtgtggccaag

SEQ ID NO: 4179676 - DNA, 21 bp, Homo sapiens
gtctgggagagcctggcaagg

SEQ ID NO: 4179677 - DNA, 22 bp, Homo sapiens
gtctgggagagcctggcaaggc

SEQ ID NO: 4179678 - DNA, 16 bp, Homo sapiens
gtctgtcctcagagca

SEQ ID NO: 4179679 - DNA, 17 bp, Homo sapiens
gtctgtcctcagagcag

SEQ ID NO: 4179680 - DNA, 21 bp, Homo sapiens
gtctgtcctcagagcaggggc

SEQ ID NO: 4179681 - DNA, 16 bp, Homo sapiens
gtctgtctacatttct

SEQ ID NO: 4179682 - DNA, 21 bp, Homo sapiens
gtctgtctacatttctgcaga

SEQ ID NO: 4179683 - DNA, 21 bp, Homo sapiens
gtctgtgcgtctgtgtgttta

SEQ ID NO: 4179684 - DNA, 16 bp, Homo sapiens
gtctgtgggagctcag

SEQ ID NO: 4179685 - DNA, 14 bp, Homo sapiens
gtctgtgtgctgta

SEQ ID NO: 4179686 - DNA, 15 bp, Homo sapiens
gtcttcttgtgtcct

SEQ ID NO: 4179687 - DNA, 17 bp, Homo sapiens
gtcttgctttgctgtct

SEQ ID NO: 4179688 - DNA, 20 bp, Homo sapiens
gtgaaacaattattgtacac

SEQ ID NO: 4179689 - DNA, 16 bp, Homo sapiens
gtgaaacttcctaagt

SEQ ID NO: 4179690 - DNA, 15 bp, Homo sapiens
gtgaaagtgtaatac

SEQ ID NO: 4179691 - DNA, 13 bp, Homo sapiens
gtgaaataaaatg

SEQ ID NO: 4179692 - DNA, 14 bp, Homo sapiens
gtgaaataaaatgc

SEQ ID NO: 4179693 - DNA, 21 bp, Homo sapiens
gtgaaataattaaaaaccact

SEQ ID NO: 4179694 - DNA, 18 bp, Homo sapiens
gtgaaataccacaagcct

SEQ ID NO: 4179695 - DNA, 14 bp, Homo sapiens
gtgaagacagaagt

SEQ ID NO: 4179696 - DNA, 12 bp, Homo sapiens
gtgaatttctga

SEQ ID NO: 4179697 - DNA, 11 bp, Homo sapiens
gtgacaacatg

SEQ ID NO: 4179698 - DNA, 13 bp, Homo sapiens
gtgacacaaacac

SEQ ID NO: 4179699 - DNA, 18 bp, Homo sapiens
gtgacacaaacacacaca

SEQ ID NO: 4179700 - DNA, 19 bp, Homo sapiens
gtgacccaatgctcctgga

SEQ ID NO: 4179701 - DNA, 22 bp, Homo sapiens
gtgacggtcccacactggtgac

SEQ ID NO: 4179702 - DNA, 21 bp, Homo sapiens
gtgacggtcctttaggcagcc

SEQ ID NO: 4179703 - DNA, 17 bp, Homo sapiens
gtgactaatggcatgag

SEQ ID NO: 4179704 - DNA, 15 bp, Homo sapiens
gtgacttcctggtga

SEQ ID NO: 4179705 - DNA, 15 bp, Homo sapiens
gtgagaaatttaaac

SEQ ID NO: 4179706 - DNA, 20 bp, Homo sapiens
gtgagaacctgggttgcaga

SEQ ID NO: 4179707 - DNA, 20 bp, Homo sapiens
gtgagccaggtaatgaggga

SEQ ID NO: 4179708 - DNA, 16 bp, Homo sapiens
gtgagctcagctcact

SEQ ID NO: 4179709 - DNA, 14 bp, Homo sapiens
gtgaggcccagcct

SEQ ID NO: 4179710 - DNA, 19 bp, Homo sapiens
gtgaggtcctgtcctggct

SEQ ID NO: 4179711 - DNA, 15 bp, Homo sapiens
gtgatgaactttctc

SEQ ID NO: 4179712 - DNA, 22 bp, Homo sapiens
gtgatggagtgtgcgtgtgtgc

SEQ ID NO: 4179713 - DNA, 19 bp, Homo sapiens
gtgattatttgttatttgt

SEQ ID NO: 4179714 - DNA, 23 bp, Homo sapiens
gtgatttcagactgcagagggga

SEQ ID NO: 4179715 - DNA, 11 bp, Homo sapiens
gtgatttctga

SEQ ID NO: 4179716 - DNA, 19 bp, Homo sapiens
gtgatttctgagattttag

SEQ ID NO: 4179717 - DNA, 23 bp, Homo sapiens
gtgatttggaagagaggcacctg

SEQ ID NO: 4179718 - DNA, 18 bp, Homo sapiens
gtgcaagagactctggcc

SEQ ID NO: 4179719 - DNA, 13 bp, Homo sapiens
gtgcaatgtaaat

SEQ ID NO: 4179720 - DNA, 17 bp, Homo sapiens
gtgcaatgtaaatattt

SEQ ID NO: 4179721 - DNA, 13 bp, Homo sapiens
gtgcacacttgta

SEQ ID NO: 4179722 - DNA, 18 bp, Homo sapiens
gtgcacagcgcgggcgga

SEQ ID NO: 4179723 - DNA, 21 bp, Homo sapiens
gtgcaccttaccaactttctg

SEQ ID NO: 4179724 - DNA, 13 bp, Homo sapiens
gtgcactggcccc

SEQ ID NO: 4179725 - DNA, 18 bp, Homo sapiens
gtgcactggccccaccct

SEQ ID NO: 4179726 - DNA, 15 bp, Homo sapiens
gtgcagcttctgtcc

SEQ ID NO: 4179727 - DNA, 16 bp, Homo sapiens
gtgcagcttctgtcct

SEQ ID NO: 4179728 - DNA, 16 bp, Homo sapiens
gtgcagtacacatcag

SEQ ID NO: 4179729 - DNA, 15 bp, Homo sapiens
gtgcagttttccagg

SEQ ID NO: 4179730 - DNA, 17 bp, Homo sapiens
gtgcattttcccagata

SEQ ID NO: 4179731 - DNA, 19 bp, Homo sapiens
gtgccacccacctttgcca

SEQ ID NO: 4179732 - DNA, 17 bp, Homo sapiens
gtgccaggctgtaagca

SEQ ID NO: 4179733 - DNA, 21 bp, Homo sapiens
gtgccatttctgaactgttac

SEQ ID NO: 4179734 - DNA, 19 bp, Homo sapiens
gtgcccaggggcccacagg

SEQ ID NO: 4179735 - DNA, 16 bp, Homo sapiens
gtgcccccacccagtc

SEQ ID NO: 4179736 - DNA, 19 bp, Homo sapiens
gtgccccccatgccctccc

SEQ ID NO: 4179737 - DNA, 23 bp, Homo sapiens
gtgccctttggggttgcccagcc

SEQ ID NO: 4179738 - DNA, 20 bp, Homo sapiens
gtgccgggagaggactctgc

SEQ ID NO: 4179739 - DNA, 14 bp, Homo sapiens
gtgcctcagagcag

SEQ ID NO: 4179740 - DNA, 16 bp, Homo sapiens
gtgcctcagagcaggc

SEQ ID NO: 4179741 - DNA, 11 bp, Homo sapiens
gtgcctgcagc

SEQ ID NO: 4179742 - DNA, 14 bp, Homo sapiens
gtgcctgccctgga

SEQ ID NO: 4179743 - DNA, 15 bp, Homo sapiens
gtgcctggcttgctg

SEQ ID NO: 4179744 - DNA, 18 bp, Homo sapiens
gtgcctggcttgctgtgg

SEQ ID NO: 4179745 - DNA, 19 bp, Homo sapiens
gtgccttacttaagtcggg

SEQ ID NO: 4179746 - DNA, 16 bp, Homo sapiens
gtgcctttctctggct

SEQ ID NO: 4179747 - DNA, 22 bp, Homo sapiens
gtgcctttctctggctccagaa

SEQ ID NO: 4179748 - DNA, 18 bp, Homo sapiens
gtgccttttatagctatt

SEQ ID NO: 4179749 - DNA, 19 bp, Homo sapiens
gtgctacctctctcttccc

SEQ ID NO: 4179750 - DNA, 18 bp, Homo sapiens
gtgctataggctggagaa

SEQ ID NO: 4179751 - DNA, 21 bp, Homo sapiens
gtgctataggctggagaagct

SEQ ID NO: 4179752 - DNA, 20 bp, Homo sapiens
gtgctcacgactcttcctgc

SEQ ID NO: 4179753 - DNA, 15 bp, Homo sapiens
gtgctgacggaagcc

SEQ ID NO: 4179754 - DNA, 12 bp, Homo sapiens
gtgctggaggat

SEQ ID NO: 4179755 - DNA, 20 bp, Homo sapiens
gtgctggaggattttccagt

SEQ ID NO: 4179756 - DNA, 11 bp, Homo sapiens
gtgctgtggcc

SEQ ID NO: 4179757 - DNA, 14 bp, Homo sapiens
gtgctgtggccagg

SEQ ID NO: 4179758 - DNA, 16 bp, Homo sapiens
gtgctgtggccagggt

SEQ ID NO: 4179759 - DNA, 15 bp, Homo sapiens
gtgcttcagcctgag

SEQ ID NO: 4179760 - DNA, 19 bp, Homo sapiens
gtgcttccctaggctgagc

SEQ ID NO: 4179761 - DNA, 14 bp, Homo sapiens
gtggaaagcctctg

SEQ ID NO: 4179762 - DNA, 23 bp, Homo sapiens
gtggaaagcctctgctgccatgg

SEQ ID NO: 4179763 - DNA, 11 bp, Homo sapiens
gtggacacctg

SEQ ID NO: 4179764 - DNA, 16 bp, Homo sapiens
gtggacacctgccctg

SEQ ID NO: 4179765 - DNA, 21 bp, Homo sapiens
taatggctgataattttaaat

SEQ ID NO: 4179766 - DNA, 15 bp, Homo sapiens
taatgtaaatacatc

SEQ ID NO: 4179767 - DNA, 19 bp, Homo sapiens
taatgtgccccatgtccaa

SEQ ID NO: 4179768 - DNA, 22 bp, Homo sapiens
taatgttatacatcctattttg

SEQ ID NO: 4179769 - DNA, 16 bp, Homo sapiens
taattataataaaggt

SEQ ID NO: 4179770 - DNA, 16 bp, Homo sapiens
taattatatctgtttt

SEQ ID NO: 4179771 - DNA, 14 bp, Homo sapiens
taattatccaggaa

SEQ ID NO: 4179772 - DNA, 15 bp, Homo sapiens
taattcctcagttat

SEQ ID NO: 4179773 - DNA, 17 bp, Homo sapiens
taattgctttgccaaaa

SEQ ID NO: 4179774 - DNA, 18 bp, Homo sapiens
taattgtactaaagccaa

SEQ ID NO: 4179775 - DNA, 22 bp, Homo sapiens
taattgtactaaagccaaacat

SEQ ID NO: 4179776 - DNA, 15 bp, Homo sapiens
taattgtagatggaa

SEQ ID NO: 4179777 - DNA, 14 bp, Homo sapiens
taatttagaaaact

SEQ ID NO: 4179778 - DNA, 14 bp, Homo sapiens
taatttagaaatca

SEQ ID NO: 4179779 - DNA, 22 bp, Homo sapiens
taatttagcagtccaaagaaca

SEQ ID NO: 4179780 - DNA, 16 bp, Homo sapiens
taatttagtttcatat

SEQ ID NO: 4179781 - DNA, 17 bp, Homo sapiens
taatttatgtgaaagag

SEQ ID NO: 4179782 - DNA, 20 bp, Homo sapiens
taatttattgtctgtctaca

SEQ ID NO: 4179783 - DNA, 17 bp, Homo sapiens
taatttgtaaaaaagat

SEQ ID NO: 4179784 - DNA, 15 bp, Homo sapiens
taatttgttatgtat

SEQ ID NO: 4179785 - DNA, 18 bp, Homo sapiens
taattttcaggatttttg

SEQ ID NO: 4179786 - DNA, 22 bp, Homo sapiens
taatttttgaaacccattaggc

SEQ ID NO: 4179787 - DNA, 20 bp, Homo sapiens
taatttttgatactaagcat

SEQ ID NO: 4179788 - DNA, 14 bp, Homo sapiens
taatttttttgaaa

SEQ ID NO: 4179789 - DNA, 21 bp, Homo sapiens
taatttttttgtaaaggaaat

SEQ ID NO: 4179790 - DNA, 13 bp, Homo sapiens
tacaaaaacaaaa

SEQ ID NO: 4179791 - DNA, 13 bp, Homo sapiens
tacaaaaatagta

SEQ ID NO: 4179792 - DNA, 17 bp, Homo sapiens
tacaaagcccttttata

SEQ ID NO: 4179793 - DNA, 15 bp, Homo sapiens
tacaaatttttcctg

SEQ ID NO: 4179794 - DNA, 13 bp, Homo sapiens
tacaacaagaaca

SEQ ID NO: 4179795 - DNA, 14 bp, Homo sapiens
tacaacaagaacaa

SEQ ID NO: 4179796 - DNA, 18 bp, Homo sapiens
tacaacaagaacaacaac

SEQ ID NO: 4179797 - DNA, 22 bp, Homo sapiens
tacaacaagagtttatttccaa

SEQ ID NO: 4179798 - DNA, 19 bp, Homo sapiens
tacaacctggccagaggca

SEQ ID NO: 4179799 - DNA, 16 bp, Homo sapiens
tacaactccaacttct

SEQ ID NO: 4179800 - DNA, 19 bp, Homo sapiens
tacaagaagcattttgtaa

SEQ ID NO: 4179801 - DNA, 21 bp, Homo sapiens
tacaagaagcattttgtaagt

SEQ ID NO: 4179802 - DNA, 14 bp, Homo sapiens
tacaagtgtatatc

SEQ ID NO: 4179803 - DNA, 21 bp, Homo sapiens
tacaagtgtatatcagaaaag

SEQ ID NO: 4179804 - DNA, 19 bp, Homo sapiens
tacaataattaatgtgtgt

SEQ ID NO: 4179805 - DNA, 19 bp, Homo sapiens
tacaatattaattataata

SEQ ID NO: 4179806 - DNA, 13 bp, Homo sapiens
tacaatggccatg

SEQ ID NO: 4179807 - DNA, 15 bp, Homo sapiens
tacacagaaaaggga

SEQ ID NO: 4179808 - DNA, 23 bp, Homo sapiens
tacacaggatcctattctcacca

SEQ ID NO: 4179809 - DNA, 17 bp, Homo sapiens
tacactccagcctgagc

SEQ ID NO: 4179810 - DNA, 18 bp, Homo sapiens
tacactccagcctgagca

SEQ ID NO: 4179811 - DNA, 18 bp, Homo sapiens
tacactctctgtacaaaa

SEQ ID NO: 4179812 - DNA, 18 bp, Homo sapiens
tacagaaattagccgggc

SEQ ID NO: 4179813 - DNA, 19 bp, Homo sapiens
tacagaacacgctttcaca

SEQ ID NO: 4179814 - DNA, 23 bp, Homo sapiens
tacagaattactgtaactgatta

SEQ ID NO: 4179815 - DNA, 14 bp, Homo sapiens
tacagacttctcca

SEQ ID NO: 4179816 - DNA, 20 bp, Homo sapiens
tacagagaaattctgtggtg

SEQ ID NO: 4179817 - DNA, 18 bp, Homo sapiens
tacagcagtgtggtctct

SEQ ID NO: 4179818 - DNA, 16 bp, Homo sapiens
tacagcgagaggcaga

SEQ ID NO: 4179819 - DNA, 15 bp, Homo sapiens
tacagtaaataaatt

SEQ ID NO: 4179820 - DNA, 20 bp, Homo sapiens
tacagtctttctttctgaat

SEQ ID NO: 4179821 - DNA, 18 bp, Homo sapiens
tacataatggaaaacatt

SEQ ID NO: 4179822 - DNA, 15 bp, Homo sapiens
tacataattcactct

SEQ ID NO: 4179823 - DNA, 17 bp, Homo sapiens
tacataattcactctga

SEQ ID NO: 4179824 - DNA, 15 bp, Homo sapiens
tacatcttataaact

SEQ ID NO: 4179825 - DNA, 13 bp, Homo sapiens
tacatgaacacag

SEQ ID NO: 4179826 - DNA, 18 bp, Homo sapiens
tacatgctaagagaagta

SEQ ID NO: 4179827 - DNA, 16 bp, Homo sapiens
tacatggccacaaagg

SEQ ID NO: 4179828 - DNA, 14 bp, Homo sapiens
tacattccaactcg

SEQ ID NO: 4179829 - DNA, 16 bp, Homo sapiens
tacatttccctgtgct

SEQ ID NO: 4179830 - DNA, 11 bp, Homo sapiens
tacatttctgc

SEQ ID NO: 4179831 - DNA, 13 bp, Homo sapiens
taccaactttctg

SEQ ID NO: 4179832 - DNA, 17 bp, Homo sapiens
taccaactttctgtaaa

SEQ ID NO: 4179833 - DNA, 21 bp, Homo sapiens
taccaaggataattaaatata

SEQ ID NO: 4179834 - DNA, 18 bp, Homo sapiens
taccacaagcctgagaac

SEQ ID NO: 4179835 - DNA, 12 bp, Homo sapiens
taccacagcagc

SEQ ID NO: 4179836 - DNA, 16 bp, Homo sapiens
taccaccttccctctt

SEQ ID NO: 4179837 - DNA, 15 bp, Homo sapiens
taccactacattttg

SEQ ID NO: 4179838 - DNA, 21 bp, Homo sapiens
taccagctttttctctcaggg

SEQ ID NO: 4179839 - DNA, 17 bp, Homo sapiens
taccatcactgagtttt

SEQ ID NO: 4179840 - DNA, 11 bp, Homo sapiens
taccatgaaga

SEQ ID NO: 4179841 - DNA, 18 bp, Homo sapiens
tacccaatttaattccat

SEQ ID NO: 4179842 - DNA, 20 bp, Homo sapiens
taccccaagtccacctgcct

SEQ ID NO: 4179843 - DNA, 16 bp, Homo sapiens
tacccccagctgtgct

SEQ ID NO: 4179844 - DNA, 13 bp, Homo sapiens
tacccggcccaga

SEQ ID NO: 4179845 - DNA, 20 bp, Homo sapiens
taccctggtggaggcttctt

SEQ ID NO: 4179846 - DNA, 19 bp, Homo sapiens
taccgaccatcgtccagcc

SEQ ID NO: 4179847 - DNA, 21 bp, Homo sapiens
taccgaccatcgtccagccct

SEQ ID NO: 4179848 - DNA, 23 bp, Homo sapiens
taccgaccatcgtccagccctcc

SEQ ID NO: 4179849 - DNA, 20 bp, Homo sapiens
tacctaggatgcatgacaat

SEQ ID NO: 4179850 - DNA, 11 bp, Homo sapiens
tacctcagcct

SEQ ID NO: 4179851 - DNA, 14 bp, Homo sapiens
tacctcagcctaga

SEQ ID NO: 4179852 - DNA, 19 bp, Homo sapiens
tacctcattcgcctgtggg

SEQ ID NO: 4179853 - DNA, 20 bp, Homo sapiens
tacctccattggcttcctca

SEQ ID NO: 4179854 - DNA, 17 bp, Homo sapiens
tacctctgagaagacac

SEQ ID NO: 4179855 - DNA, 21 bp, Homo sapiens
tacctgttgagcatcacagaa

SEQ ID NO: 4179856 - DNA, 15 bp, Homo sapiens
taccttcttcgctgc

SEQ ID NO: 4179857 - DNA, 18 bp, Homo sapiens
tacctttttttctctcct

SEQ ID NO: 4179858 - DNA, 16 bp, Homo sapiens
tacggttgtctagagg

SEQ ID NO: 4179859 - DNA, 16 bp, Homo sapiens
tacgtatttaatagca

SEQ ID NO: 4179860 - DNA, 19 bp, Homo sapiens
tacgtgggcattgtctttt

SEQ ID NO: 4179861 - DNA, 12 bp, Homo sapiens
tactaaaagaat

SEQ ID NO: 4179862 - DNA, 20 bp, Homo sapiens
tactaatgtaaagattgttt

SEQ ID NO: 4179863 - DNA, 22 bp, Homo sapiens
tactacatcagtgtggaaaaaa

SEQ ID NO: 4179864 - DNA, 20 bp, Homo sapiens
tactacttttgcatgaaaat

SEQ ID NO: 4179865 - DNA, 15 bp, Homo sapiens
tactagaatttgtat

SEQ ID NO: 4179866 - DNA, 17 bp, Homo sapiens
tactagaatttgtattt

SEQ ID NO: 4179867 - DNA, 17 bp, Homo sapiens
tactataagaactttga

SEQ ID NO: 4179868 - DNA, 16 bp, Homo sapiens
tactatacaacaatgt

SEQ ID NO: 4179869 - DNA, 18 bp, Homo sapiens
tactatgttcatgatagt

SEQ ID NO: 4179870 - DNA, 13 bp, Homo sapiens
tactcaagtacca

SEQ ID NO: 4179871 - DNA, 16 bp, Homo sapiens
tactcagataaggtaa

SEQ ID NO: 4179872 - DNA, 23 bp, Homo sapiens
tactcagataaggtaaaatgcca

SEQ ID NO: 4179873 - DNA, 11 bp, Homo sapiens
tactcattttt

SEQ ID NO: 4179874 - DNA, 16 bp, Homo sapiens
tactcatttttcatga

SEQ ID NO: 4179875 - DNA, 14 bp, Homo sapiens
tactccagtggtga

SEQ ID NO: 4179876 - DNA, 18 bp, Homo sapiens
tactgaagttatctgtgt

SEQ ID NO: 4179877 - DNA, 21 bp, Homo sapiens
tactgaagttatctgtgttat

SEQ ID NO: 4179878 - DNA, 21 bp, Homo sapiens
tactgattaacaaataaattg

SEQ ID NO: 4179879 - DNA, 15 bp, Homo sapiens
tactgatttttgtga

SEQ ID NO: 4179880 - DNA, 22 bp, Homo sapiens
tactgccgtcagtgctgtgctg

SEQ ID NO: 4179881 - DNA, 16 bp, Homo sapiens
tactggtgatttctga

SEQ ID NO: 4179882 - DNA, 17 bp, Homo sapiens
tactggtgatttctgag

SEQ ID NO: 4179883 - DNA, 17 bp, Homo sapiens
tacttaataaattcaga

SEQ ID NO: 4179884 - DNA, 17 bp, Homo sapiens
tacttgctcaggtactt

SEQ ID NO: 4179885 - DNA, 12 bp, Homo sapiens
tactttcacttt

SEQ ID NO: 4179886 - DNA, 22 bp, Homo sapiens
tactttgcaatccaaataaaga

SEQ ID NO: 4179887 - DNA, 20 bp, Homo sapiens
tactttgccttttgcaaact

SEQ ID NO: 4179888 - DNA, 23 bp, Homo sapiens
tactttggcaatttcctggccct

SEQ ID NO: 4179889 - DNA, 19 bp, Homo sapiens
tacttttgttctgtatttt

SEQ ID NO: 4179890 - DNA, 15 bp, Homo sapiens
tagaaaccttaatat

SEQ ID NO: 4179891 - DNA, 12 bp, Homo sapiens
tagaaagcacta

SEQ ID NO: 4179892 - DNA, 15 bp, Homo sapiens
tagaaatacctcatt

SEQ ID NO: 4179893 - DNA, 13 bp, Homo sapiens
tagaaatatcctt

SEQ ID NO: 4179894 - DNA, 19 bp, Homo sapiens
tagaaatatcctttggaac

SEQ ID NO: 4179895 - DNA, 13 bp, Homo sapiens
tagaaattttgtt

SEQ ID NO: 4179896 - DNA, 20 bp, Homo sapiens
tagaacaagaccctgtctca

SEQ ID NO: 4179897 - DNA, 15 bp, Homo sapiens
tagaacctaattcaa

SEQ ID NO: 4179898 - DNA, 23 bp, Homo sapiens
tagaacctaattcaattcaaagc

SEQ ID NO: 4179899 - DNA, 21 bp, Homo sapiens
tagaagaaataatttttctta

SEQ ID NO: 4179900 - DNA, 10 bp, Homo sapiens
tccctgccaa

SEQ ID NO: 4179901 - DNA, 22 bp, Homo sapiens
tccctgccaagtctcagaagag

SEQ ID NO: 4179902 - DNA, 16 bp, Homo sapiens
tccctgctgccaggct

SEQ ID NO: 4179903 - DNA, 22 bp, Homo sapiens
tccctgctgccaggctcccact

SEQ ID NO: 4179904 - DNA, 16 bp, Homo sapiens
tccctggcatgtcaga

SEQ ID NO: 4179905 - DNA, 12 bp, Homo sapiens
tccctggcccag

SEQ ID NO: 4179906 - DNA, 15 bp, Homo sapiens
tccctggctctcaga

SEQ ID NO: 4179907 - DNA, 18 bp, Homo sapiens
tccctggctctcagaagg

SEQ ID NO: 4179908 - DNA, 16 bp, Homo sapiens
tccctgggcagaaagt

SEQ ID NO: 4179909 - DNA, 18 bp, Homo sapiens
tccctggtttgcagctgt

SEQ ID NO: 4179910 - DNA, 16 bp, Homo sapiens
tccctgttttaaatta

SEQ ID NO: 4179911 - DNA, 15 bp, Homo sapiens
tcccttctctccttc

SEQ ID NO: 4179912 - DNA, 17 bp, Homo sapiens
tcccttctctccttccc

SEQ ID NO: 4179913 - DNA, 20 bp, Homo sapiens
tcccttctctccttccctct

SEQ ID NO: 4179914 - DNA, 20 bp, Homo sapiens
tcccttggaaagttcagcca

SEQ ID NO: 4179915 - DNA, 22 bp, Homo sapiens
tcccttggaaagttcagccaga

SEQ ID NO: 4179916 - DNA, 20 bp, Homo sapiens
tccctttcccatgatccaga

SEQ ID NO: 4179917 - DNA, 15 bp, Homo sapiens
tccgactctaagctg

SEQ ID NO: 4179918 - DNA, 18 bp, Homo sapiens
tccgactctaagctgtgt

SEQ ID NO: 4179919 - DNA, 19 bp, Homo sapiens
tccgactctaagctgtgtg

SEQ ID NO: 4179920 - DNA, 21 bp, Homo sapiens
tccgactctaagctgtgtgca

SEQ ID NO: 4179921 - DNA, 14 bp, Homo sapiens
tccgatggtatctg

SEQ ID NO: 4179922 - DNA, 17 bp, Homo sapiens
tccgatggtatctgggt

SEQ ID NO: 4179923 - DNA, 13 bp, Homo sapiens
tccgcacttggaa

SEQ ID NO: 4179924 - DNA, 14 bp, Homo sapiens
tccgcacttggaaa

SEQ ID NO: 4179925 - DNA, 21 bp, Homo sapiens
tccgccacccccgccgtgggg

SEQ ID NO: 4179926 - DNA, 15 bp, Homo sapiens
tccgccattccaagt

SEQ ID NO: 4179927 - DNA, 21 bp, Homo sapiens
tccgcctgcagaggacagagc

SEQ ID NO: 4179928 - DNA, 22 bp, Homo sapiens
tccgcctgcagaggacagagct

SEQ ID NO: 4179929 - DNA, 17 bp, Homo sapiens
tccgccttcactccggt

SEQ ID NO: 4179930 - DNA, 17 bp, Homo sapiens
tccggaggggacccagc

SEQ ID NO: 4179931 - DNA, 22 bp, Homo sapiens
tccggaggggttgcgggggagc

SEQ ID NO: 4179932 - DNA, 21 bp, Homo sapiens
tccggcctgatgacagagcga

SEQ ID NO: 4179933 - DNA, 20 bp, Homo sapiens
tccggctgctcctccagccc

SEQ ID NO: 4179934 - DNA, 21 bp, Homo sapiens
tccggctgctcctccagccct

SEQ ID NO: 4179935 - DNA, 12 bp, Homo sapiens
tccggtgtgcct

SEQ ID NO: 4179936 - DNA, 17 bp, Homo sapiens
tccggtgtgcctgcagc

SEQ ID NO: 4179937 - DNA, 21 bp, Homo sapiens
tccgtggtcagagtgccactg

SEQ ID NO: 4179938 - DNA, 13 bp, Homo sapiens
tcctaagcctgtt

SEQ ID NO: 4179939 - DNA, 15 bp, Homo sapiens
tcctacacataggag

SEQ ID NO: 4179940 - DNA, 17 bp, Homo sapiens
tcctacacccttggact

SEQ ID NO: 4179941 - DNA, 20 bp, Homo sapiens
tcctacacccttggacttga

SEQ ID NO: 4179942 - DNA, 21 bp, Homo sapiens
tcctaccccacctcatgcctg

SEQ ID NO: 4179943 - DNA, 12 bp, Homo sapiens
tcctacctcagc

SEQ ID NO: 4179944 - DNA, 16 bp, Homo sapiens
tcctacctcagcctag

SEQ ID NO: 4179945 - DNA, 23 bp, Homo sapiens
tcctaggtcacttgaagccaaac

SEQ ID NO: 4179946 - DNA, 17 bp, Homo sapiens
tcctatacatttctgtt

SEQ ID NO: 4179947 - DNA, 14 bp, Homo sapiens
tcctatgctttgaa

SEQ ID NO: 4179948 - DNA, 20 bp, Homo sapiens
tcctatgctttgaaacagaa

SEQ ID NO: 4179949 - DNA, 15 bp, Homo sapiens
tcctattatgtgttc

SEQ ID NO: 4179950 - DNA, 14 bp, Homo sapiens
tcctattctcacca

SEQ ID NO: 4179951 - DNA, 15 bp, Homo sapiens
tcctattctcaccag

SEQ ID NO: 4179952 - DNA, 16 bp, Homo sapiens
tcctattctcaccagg

SEQ ID NO: 4179953 - DNA, 18 bp, Homo sapiens
tcctattctcaccaggaa

SEQ ID NO: 4179954 - DNA, 20 bp, Homo sapiens
tcctattctcaccaggaagg

SEQ ID NO: 4179955 - DNA, 16 bp, Homo sapiens
tcctattctttgccac

SEQ ID NO: 4179956 - DNA, 18 bp, Homo sapiens
tcctcaatggacttcaaa

SEQ ID NO: 4179957 - DNA, 15 bp, Homo sapiens
tcctcacagcctctc

SEQ ID NO: 4179958 - DNA, 20 bp, Homo sapiens
tcctcagagcaggggccaga

SEQ ID NO: 4179959 - DNA, 19 bp, Homo sapiens
tcctcaggaacagaacact

SEQ ID NO: 4179960 - DNA, 22 bp, Homo sapiens
tcctcatttgcaaacctcagag

SEQ ID NO: 4179961 - DNA, 13 bp, Homo sapiens
tcctccagccctt

SEQ ID NO: 4179962 - DNA, 19 bp, Homo sapiens
tcctccatttcaactccag

SEQ ID NO: 4179963 - DNA, 20 bp, Homo sapiens
tcctccatttcaactccaga

SEQ ID NO: 4179964 - DNA, 21 bp, Homo sapiens
tcctccatttcaactccagaa

SEQ ID NO: 4179965 - DNA, 20 bp, Homo sapiens
tcctcccagcgtgtgtatcc

SEQ ID NO: 4179966 - DNA, 20 bp, Homo sapiens
tcctcccatggccttccctc

SEQ ID NO: 4179967 - DNA, 20 bp, Homo sapiens
tcctccctggtttgcagctg

SEQ ID NO: 4179968 - DNA, 15 bp, Homo sapiens
tcctcctcccccaga

SEQ ID NO: 4179969 - DNA, 11 bp, Homo sapiens
tcctcctctgt

SEQ ID NO: 4179970 - DNA, 18 bp, Homo sapiens
tcctccttcccctgtggt

SEQ ID NO: 4179971 - DNA, 22 bp, Homo sapiens
tcctcgtgcagagctggggctg

SEQ ID NO: 4179972 - DNA, 16 bp, Homo sapiens
tcctctccctgccaag

SEQ ID NO: 4179973 - DNA, 17 bp, Homo sapiens
tcctctccctgccaagt

SEQ ID NO: 4179974 - DNA, 15 bp, Homo sapiens
tcctctgatacccag

SEQ ID NO: 4179975 - DNA, 12 bp, Homo sapiens
tcctctgctgct

SEQ ID NO: 4179976 - DNA, 21 bp, Homo sapiens
tcctctgtgctcctgtccctc

SEQ ID NO: 4179977 - DNA, 13 bp, Homo sapiens
tcctcttatttgc

SEQ ID NO: 4179978 - DNA, 18 bp, Homo sapiens
tcctctttctctccttct

SEQ ID NO: 4179979 - DNA, 12 bp, Homo sapiens
tcctgaaaaaat

SEQ ID NO: 4179980 - DNA, 20 bp, Homo sapiens
tcctgaagaaaccacaggtt

SEQ ID NO: 4179981 - DNA, 22 bp, Homo sapiens
tcctgaatttattattgttctt

SEQ ID NO: 4179982 - DNA, 18 bp, Homo sapiens
tcctgacctcgtgatcca

SEQ ID NO: 4179983 - DNA, 13 bp, Homo sapiens
tcctgaggctgag

SEQ ID NO: 4179984 - DNA, 17 bp, Homo sapiens
tcctgcaaagggaactg

SEQ ID NO: 4179985 - DNA, 17 bp, Homo sapiens
tcctgcaatctccaggg

SEQ ID NO: 4179986 - DNA, 18 bp, Homo sapiens
tcctgcaatctccagggc

SEQ ID NO: 4179987 - DNA, 15 bp, Homo sapiens
tcctgcactccagaa

SEQ ID NO: 4179988 - DNA, 14 bp, Homo sapiens
tcctgcactgtccc

SEQ ID NO: 4179989 - DNA, 15 bp, Homo sapiens
tcctgcactgtcccg

SEQ ID NO: 4179990 - DNA, 17 bp, Homo sapiens
tcctgcactgtcccgga

SEQ ID NO: 4179991 - DNA, 12 bp, Homo sapiens
tcctgctgccag

SEQ ID NO: 4179992 - DNA, 13 bp, Homo sapiens
tcctgctgccaga

SEQ ID NO: 4179993 - DNA, 23 bp, Homo sapiens
tcctggaaagactgattgtttta

SEQ ID NO: 4179994 - DNA, 16 bp, Homo sapiens
tcctggagcatcccag

SEQ ID NO: 4179995 - DNA, 15 bp, Homo sapiens
tcctggctcccaggg

SEQ ID NO: 4179996 - DNA, 19 bp, Homo sapiens
tcctgggagaacctcaggc

SEQ ID NO: 4179997 - DNA, 18 bp, Homo sapiens
tcctggggctctgtgcag

SEQ ID NO: 4179998 - DNA, 22 bp, Homo sapiens
tcctgggggcccattctgcatg

SEQ ID NO: 4179999 - DNA, 17 bp, Homo sapiens
tcctgggggctgctgca

SEQ ID NO: 4180000 - DNA, 15 bp, Homo sapiens
tcctggtacagcagg

SEQ ID NO: 4180001 - DNA, 13 bp, Homo sapiens
tcctggtccctca

SEQ ID NO: 4180002 - DNA, 24 bp, Homo sapiens
tcctggtgaggcccagcctgtcct

SEQ ID NO: 4180003 - DNA, 17 bp, Homo sapiens
tcctgtattcagacaga

SEQ ID NO: 4180004 - DNA, 13 bp, Homo sapiens
tcctgtcctggct

SEQ ID NO: 4180005 - DNA, 16 bp, Homo sapiens
tcctgtcctggctccc

SEQ ID NO: 4180006 - DNA, 13 bp, Homo sapiens
tcctgtgtacagg

SEQ ID NO: 4180007 - DNA, 16 bp, Homo sapiens
tccttccaggccccca

SEQ ID NO: 4180008 - DNA, 18 bp, Homo sapiens
tccttcccccatcccctt

SEQ ID NO: 4180009 - DNA, 15 bp, Homo sapiens
tccttcccctgtggt

SEQ ID NO: 4180010 - DNA, 14 bp, Homo sapiens
tccttcccttctct

SEQ ID NO: 4180011 - DNA, 19 bp, Homo sapiens
tccttccttgctgtcctag

SEQ ID NO: 4180012 - DNA, 21 bp, Homo sapiens
tccttctcgtttgctctagtc

SEQ ID NO: 4180013 - DNA, 15 bp, Homo sapiens
tccttctggctccaa

SEQ ID NO: 4180014 - DNA, 12 bp, Homo sapiens
tccttctttctc

SEQ ID NO: 4180015 - DNA, 19 bp, Homo sapiens
tccttgctgtcctaggcca

SEQ ID NO: 4180016 - DNA, 21 bp, Homo sapiens
tccttgctgtcctaggccaca

SEQ ID NO: 4180017 - DNA, 18 bp, Homo sapiens
tccttggagagcagctgg

SEQ ID NO: 4180018 - DNA, 20 bp, Homo sapiens
tccttggcatcacagggcag

SEQ ID NO: 4180019 - DNA, 22 bp, Homo sapiens
tcctttacctaccaccttccct

SEQ ID NO: 4180020 - DNA, 21 bp, Homo sapiens
tcctttaggcagcctgccgcc

SEQ ID NO: 4180021 - DNA, 16 bp, Homo sapiens
tcctttatatttagtg

SEQ ID NO: 4180022 - DNA, 15 bp, Homo sapiens
tcctttcctctgcag

SEQ ID NO: 4180023 - DNA, 19 bp, Homo sapiens
tcctttctagagcactgcc

SEQ ID NO: 4180024 - DNA, 20 bp, Homo sapiens
tcctttctagagcactgcca

SEQ ID NO: 4180025 - DNA, 19 bp, Homo sapiens
tcctttctggaagtttctg

SEQ ID NO: 4180026 - DNA, 21 bp, Homo sapiens
tccttttcttccttctttctc

SEQ ID NO: 4180027 - DNA, 17 bp, Homo sapiens
tccttttgtgtacagtg

SEQ ID NO: 4180028 - DNA, 14 bp, Homo sapiens
tcctttttctttat

SEQ ID NO: 4180029 - DNA, 23 bp, Homo sapiens
tcctttttgcagtatatttctga

SEQ ID NO: 4180030 - DNA, 12 bp, Homo sapiens
tcgaatgaaatt

SEQ ID NO: 4180031 - DNA, 21 bp, Homo sapiens
tcgaattaatagcttttattg

SEQ ID NO: 4180032 - DNA, 19 bp, Homo sapiens
tcgaccccaaagccccttg

SEQ ID NO: 4180033 - DNA, 20 bp, Homo sapiens
tcgacctgcggctgctgtgt

SEQ ID NO: 4180034 - DNA, 17 bp, Homo sapiens
tcgactttatacagaac

SEQ ID NO: 4180035 - DNA, 20 bp, Homo sapiens
tgaggagcagcttcagttgt

SEQ ID NO: 4180036 - DNA, 13 bp, Homo sapiens
tgaggatgacaga

SEQ ID NO: 4180037 - DNA, 12 bp, Homo sapiens
tgaggcaggaga

SEQ ID NO: 4180038 - DNA, 18 bp, Homo sapiens
tgaggcaggggagtagtg

SEQ ID NO: 4180039 - DNA, 17 bp, Homo sapiens
tgaggcccagcctgtcc

SEQ ID NO: 4180040 - DNA, 16 bp, Homo sapiens
tgaggccccaggccct

SEQ ID NO: 4180041 - DNA, 19 bp, Homo sapiens
tgaggcctgccctcaggga

SEQ ID NO: 4180042 - DNA, 21 bp, Homo sapiens
tgaggcctgccctcagggatc

SEQ ID NO: 4180043 - DNA, 19 bp, Homo sapiens
tgaggctctattgagccaa

SEQ ID NO: 4180044 - DNA, 13 bp, Homo sapiens
tgaggctgagact

SEQ ID NO: 4180045 - DNA, 13 bp, Homo sapiens
tgagggacgtggt

SEQ ID NO: 4180046 - DNA, 16 bp, Homo sapiens
tgagggctgggcccac

SEQ ID NO: 4180047 - DNA, 21 bp, Homo sapiens
tgaggggaggatcactggagc

SEQ ID NO: 4180048 - DNA, 15 bp, Homo sapiens
tgaggggctcctgga

SEQ ID NO: 4180049 - DNA, 22 bp, Homo sapiens
tgaggggggccgtgcccagggg

SEQ ID NO: 4180050 - DNA, 18 bp, Homo sapiens
tgagggtaataaacttag

SEQ ID NO: 4180051 - DNA, 12 bp, Homo sapiens
tgaggttaggag

SEQ ID NO: 4180052 - DNA, 15 bp, Homo sapiens
tgagtacagcagaaa

SEQ ID NO: 4180053 - DNA, 15 bp, Homo sapiens
tgagtagatctgctt

SEQ ID NO: 4180054 - DNA, 23 bp, Homo sapiens
tgagtcacactcagaaaatgggg

SEQ ID NO: 4180055 - DNA, 18 bp, Homo sapiens
tgagtcgtcatcactttt

SEQ ID NO: 4180056 - DNA, 17 bp, Homo sapiens
tgagtgaatggcaaagc

SEQ ID NO: 4180057 - DNA, 19 bp, Homo sapiens
tgagttggacttcagtctt

SEQ ID NO: 4180058 - DNA, 16 bp, Homo sapiens
tgagtttaggcagctt

SEQ ID NO: 4180059 - DNA, 19 bp, Homo sapiens
tgagttttccatggcagga

SEQ ID NO: 4180060 - DNA, 18 bp, Homo sapiens
tgataaagattttttaat

SEQ ID NO: 4180061 - DNA, 20 bp, Homo sapiens
tgataaagattttttaataa

SEQ ID NO: 4180062 - DNA, 15 bp, Homo sapiens
tgataaatcagactc

SEQ ID NO: 4180063 - DNA, 15 bp, Homo sapiens
tgataatgaacagaa

SEQ ID NO: 4180064 - DNA, 16 bp, Homo sapiens
tgataatgaacagaac

SEQ ID NO: 4180065 - DNA, 18 bp, Homo sapiens
tgataatgaacagaacat

SEQ ID NO: 4180066 - DNA, 14 bp, Homo sapiens
tgatacgtgtgtga

SEQ ID NO: 4180067 - DNA, 22 bp, Homo sapiens
tgatacgtgtgtgaagtatttt

SEQ ID NO: 4180068 - DNA, 14 bp, Homo sapiens
tgatactaagcatt

SEQ ID NO: 4180069 - DNA, 19 bp, Homo sapiens
tgatagaaatgccaagcac

SEQ ID NO: 4180070 - DNA, 20 bp, Homo sapiens
tgatagcaggtgtaataaga

SEQ ID NO: 4180071 - DNA, 21 bp, Homo sapiens
tgatagcaggtgtaataagac

SEQ ID NO: 4180072 - DNA, 19 bp, Homo sapiens
tgatatccagtaagcacat

SEQ ID NO: 4180073 - DNA, 16 bp, Homo sapiens
tgatcacttcatactt

SEQ ID NO: 4180074 - DNA, 21 bp, Homo sapiens
tgatcactttgttaaaaatat

SEQ ID NO: 4180075 - DNA, 19 bp, Homo sapiens
tgatcataggtatttcaaa

SEQ ID NO: 4180076 - DNA, 21 bp, Homo sapiens
tgatcattacatggctgtggt

SEQ ID NO: 4180077 - DNA, 23 bp, Homo sapiens
tgatccaggattggcctgtgtct

SEQ ID NO: 4180078 - DNA, 19 bp, Homo sapiens
tgatcccaagtgccagtct

SEQ ID NO: 4180079 - DNA, 14 bp, Homo sapiens
tgatccctttccca

SEQ ID NO: 4180080 - DNA, 23 bp, Homo sapiens
tgatccctttcccatgatccaga

SEQ ID NO: 4180081 - DNA, 20 bp, Homo sapiens
tgatccggctgctcctccag

SEQ ID NO: 4180082 - DNA, 21 bp, Homo sapiens
tgatcctgtattcagacagat

SEQ ID NO: 4180083 - DNA, 21 bp, Homo sapiens
tgatctatagatgacctagaa

SEQ ID NO: 4180084 - DNA, 15 bp, Homo sapiens
tgatgaaaataataa

SEQ ID NO: 4180085 - DNA, 13 bp, Homo sapiens
tgatgaactttct

SEQ ID NO: 4180086 - DNA, 21 bp, Homo sapiens
tgatgccaaaaaaaaatacat

SEQ ID NO: 4180087 - DNA, 12 bp, Homo sapiens
tgatggagaagg

SEQ ID NO: 4180088 - DNA, 16 bp, Homo sapiens
tgatggagaaggaagg

SEQ ID NO: 4180089 - DNA, 17 bp, Homo sapiens
tgatggagaaggaaggc

SEQ ID NO: 4180090 - DNA, 19 bp, Homo sapiens
tgatgggagagtagatggt

SEQ ID NO: 4180091 - DNA, 17 bp, Homo sapiens
tgatgggattctggaca

SEQ ID NO: 4180092 - DNA, 24 bp, Homo sapiens
tgatgggattctggacaggatgtg

SEQ ID NO: 4180093 - DNA, 17 bp, Homo sapiens
tgatgggtcccaaaagc

SEQ ID NO: 4180094 - DNA, 23 bp, Homo sapiens
tgatgttaactattattaataaa

SEQ ID NO: 4180095 - DNA, 15 bp, Homo sapiens
tgattaaacagactt

SEQ ID NO: 4180096 - DNA, 14 bp, Homo sapiens
tgattacctgccaa

SEQ ID NO: 4180097 - DNA, 14 bp, Homo sapiens
tgattattatttaa

SEQ ID NO: 4180098 - DNA, 19 bp, Homo sapiens
tgattccattttacttcca

SEQ ID NO: 4180099 - DNA, 18 bp, Homo sapiens
tgattccttgagcatttt

SEQ ID NO: 4180100 - DNA, 19 bp, Homo sapiens
tgattggagtgtgtccgga

SEQ ID NO: 4180101 - DNA, 23 bp, Homo sapiens
tgattgtaaaatagcttgtatag

SEQ ID NO: 4180102 - DNA, 20 bp, Homo sapiens
tgattgtagtaatctgcatt

SEQ ID NO: 4180103 - DNA, 14 bp, Homo sapiens
tgattgtataatgt

SEQ ID NO: 4180104 - DNA, 18 bp, Homo sapiens
tgattgtataatgtgatt

SEQ ID NO: 4180105 - DNA, 20 bp, Homo sapiens
tgattgtataatgtgatttt

SEQ ID NO: 4180106 - DNA, 13 bp, Homo sapiens
tgattgtcttaat

SEQ ID NO: 4180107 - DNA, 20 bp, Homo sapiens
tgatttaatccagatctggg

SEQ ID NO: 4180108 - DNA, 21 bp, Homo sapiens
tgatttagaactgtatgtcag

SEQ ID NO: 4180109 - DNA, 19 bp, Homo sapiens
tgatttagggaagcaggga

SEQ ID NO: 4180110 - DNA, 22 bp, Homo sapiens
tgatttatgcatggaaacctga

SEQ ID NO: 4180111 - DNA, 18 bp, Homo sapiens
tgatttcaggatactctg

SEQ ID NO: 4180112 - DNA, 13 bp, Homo sapiens
tgatttctattca

SEQ ID NO: 4180113 - DNA, 20 bp, Homo sapiens
tgatttctattcaaggtggc

SEQ ID NO: 4180114 - DNA, 17 bp, Homo sapiens
tgatttctgagatttta

SEQ ID NO: 4180115 - DNA, 12 bp, Homo sapiens
tgattttcctcc

SEQ ID NO: 4180116 - DNA, 18 bp, Homo sapiens
tgcaaaaagatttaacaa

SEQ ID NO: 4180117 - DNA, 16 bp, Homo sapiens
tgcaaaaataaaagga

SEQ ID NO: 4180118 - DNA, 23 bp, Homo sapiens
tgcaaaaataaaaggaaaaccag

SEQ ID NO: 4180119 - DNA, 20 bp, Homo sapiens
tgcaaaatggaaatgtaata

SEQ ID NO: 4180120 - DNA, 21 bp, Homo sapiens
tgcaaaatggaaatgtaataa

SEQ ID NO: 4180121 - DNA, 16 bp, Homo sapiens
tgcaacaagagcaaaa

SEQ ID NO: 4180122 - DNA, 19 bp, Homo sapiens
tgcaagacacaggctcagc

SEQ ID NO: 4180123 - DNA, 17 bp, Homo sapiens
tgcaagagactctggcc

SEQ ID NO: 4180124 - DNA, 17 bp, Homo sapiens
tgcaagatttaacacta

SEQ ID NO: 4180125 - DNA, 17 bp, Homo sapiens
tgcaagcagggctctgc

SEQ ID NO: 4180126 - DNA, 17 bp, Homo sapiens
tgcaagtcatacttagg

SEQ ID NO: 4180127 - DNA, 16 bp, Homo sapiens
tgcaagtgagaagctg

SEQ ID NO: 4180128 - DNA, 16 bp, Homo sapiens
tgcaatataaaaatgt

SEQ ID NO: 4180129 - DNA, 18 bp, Homo sapiens
tgcaatataaaaatgtga

SEQ ID NO: 4180130 - DNA, 15 bp, Homo sapiens
tgcaatcccttaata

SEQ ID NO: 4180131 - DNA, 14 bp, Homo sapiens
tgcaatctccaggg

SEQ ID NO: 4180132 - DNA, 21 bp, Homo sapiens
tgcacacagctaggcatgcct

SEQ ID NO: 4180133 - DNA, 17 bp, Homo sapiens
tgcacagcgcgggcgga

SEQ ID NO: 4180134 - DNA, 15 bp, Homo sapiens
tgcacccaggggtgg

SEQ ID NO: 4180135 - DNA, 16 bp, Homo sapiens
tgcaccctccgccttc

SEQ ID NO: 4180136 - DNA, 13 bp, Homo sapiens
tgcacctaaagaa

SEQ ID NO: 4180137 - DNA, 21 bp, Homo sapiens
tgcacctaaagaaaaacaaac

SEQ ID NO: 4180138 - DNA, 15 bp, Homo sapiens
tgcacctgccagcct

SEQ ID NO: 4180139 - DNA, 17 bp, Homo sapiens
tgcacctgccagcctgg

SEQ ID NO: 4180140 - DNA, 18 bp, Homo sapiens
tgcacctgccagcctggc

SEQ ID NO: 4180141 - DNA, 22 bp, Homo sapiens
tgcacctgccagcctggcttct

SEQ ID NO: 4180142 - DNA, 21 bp, Homo sapiens
tgcaccttaccaactttctgt

SEQ ID NO: 4180143 - DNA, 14 bp, Homo sapiens
tgcactacactttt

SEQ ID NO: 4180144 - DNA, 13 bp, Homo sapiens
tgcactagcattt

SEQ ID NO: 4180145 - DNA, 12 bp, Homo sapiens
tgcactccagaa

SEQ ID NO: 4180146 - DNA, 13 bp, Homo sapiens
tgcactccagcct

SEQ ID NO: 4180147 - DNA, 14 bp, Homo sapiens
tgcactccagcctg

SEQ ID NO: 4180148 - DNA, 18 bp, Homo sapiens
tgcactccagcctgggcg

SEQ ID NO: 4180149 - DNA, 17 bp, Homo sapiens
tgcactccagcctgggg

SEQ ID NO: 4180150 - DNA, 15 bp, Homo sapiens
tgcactggccccacc

SEQ ID NO: 4180151 - DNA, 17 bp, Homo sapiens
tgcactggccccaccct

SEQ ID NO: 4180152 - DNA, 16 bp, Homo sapiens
tgcactgggtgtggcc

SEQ ID NO: 4180153 - DNA, 23 bp, Homo sapiens
tgcagaaggaagggcatccttct

SEQ ID NO: 4180154 - DNA, 18 bp, Homo sapiens
tgcagacaggaatcttaa

SEQ ID NO: 4180155 - DNA, 13 bp, Homo sapiens
tgcagagagaagc

SEQ ID NO: 4180156 - DNA, 15 bp, Homo sapiens
tgcagagagaagcct

SEQ ID NO: 4180157 - DNA, 22 bp, Homo sapiens
tgcagagctggggctgccagcc

SEQ ID NO: 4180158 - DNA, 13 bp, Homo sapiens
tgcagaggattta

SEQ ID NO: 4180159 - DNA, 18 bp, Homo sapiens
tgcagaggatttaactgt

SEQ ID NO: 4180160 - DNA, 20 bp, Homo sapiens
tgcagaggtaaaagtgtgag

SEQ ID NO: 4180161 - DNA, 23 bp, Homo sapiens
tgcagagtggtgaagttcacttc

SEQ ID NO: 4180162 - DNA, 21 bp, Homo sapiens
tgcagatcttccgtggtcaga

SEQ ID NO: 4180163 - DNA, 13 bp, Homo sapiens
tgcagcaactccc

SEQ ID NO: 4180164 - DNA, 19 bp, Homo sapiens
tgcagcactttaaccctct

SEQ ID NO: 4180165 - DNA, 20 bp, Homo sapiens
tgcagcactttaaccctctc

SEQ ID NO: 4180166 - DNA, 22 bp, Homo sapiens
tgcagcactttaaccctctctt

SEQ ID NO: 4180167 - DNA, 23 bp, Homo sapiens
tgcagcactttaaccctctcttc

SEQ ID NO: 4180168 - DNA, 14 bp, Homo sapiens
tgcagcagaggaca

SEQ ID NO: 4180169 - DNA, 15 bp, Homo sapiens
tgggcttccatgcct

SEQ ID NO: 4180170 - DNA, 14 bp, Homo sapiens
tggggaagaaaaaa

SEQ ID NO: 4180171 - DNA, 17 bp, Homo sapiens
tggggagttataaaaat

SEQ ID NO: 4180172 - DNA, 20 bp, Homo sapiens
tggggagttataaaaataca

SEQ ID NO: 4180173 - DNA, 19 bp, Homo sapiens
tggggcaacgacggtttca

SEQ ID NO: 4180174 - DNA, 20 bp, Homo sapiens
tggggctcgccccacccagg

SEQ ID NO: 4180175 - DNA, 22 bp, Homo sapiens
tggggctcgccccacccagggc

SEQ ID NO: 4180176 - DNA, 17 bp, Homo sapiens
tggggctgccagcctga

SEQ ID NO: 4180177 - DNA, 20 bp, Homo sapiens
tgggggcccattctgcatgc

SEQ ID NO: 4180178 - DNA, 22 bp, Homo sapiens
tgggggctgctgcactgccctc

SEQ ID NO: 4180179 - DNA, 17 bp, Homo sapiens
tggggtagactgaggga

SEQ ID NO: 4180180 - DNA, 20 bp, Homo sapiens
tggggtatggattctaaaat

SEQ ID NO: 4180181 - DNA, 20 bp, Homo sapiens
tggggtatttaccacagcag

SEQ ID NO: 4180182 - DNA, 19 bp, Homo sapiens
tggggtcagccagggccag

SEQ ID NO: 4180183 - DNA, 21 bp, Homo sapiens
tggggtgcatcccccagcact

SEQ ID NO: 4180184 - DNA, 18 bp, Homo sapiens
tggggttgcccagcctgg

SEQ ID NO: 4180185 - DNA, 14 bp, Homo sapiens
tgggtaagaagaaa

SEQ ID NO: 4180186 - DNA, 16 bp, Homo sapiens
tgggtaagaagaaagc

SEQ ID NO: 4180187 - DNA, 18 bp, Homo sapiens
tgggtaatgaaacaaaga

SEQ ID NO: 4180188 - DNA, 17 bp, Homo sapiens
tgggtactccagcaggt

SEQ ID NO: 4180189 - DNA, 13 bp, Homo sapiens
tgggtaggaaaat

SEQ ID NO: 4180190 - DNA, 21 bp, Homo sapiens
tgggtcctgcaatctccaggg

SEQ ID NO: 4180191 - DNA, 23 bp, Homo sapiens
tgggtgacggtcctttaggcagc

SEQ ID NO: 4180192 - DNA, 15 bp, Homo sapiens
tgggtggtggatctg

SEQ ID NO: 4180193 - DNA, 18 bp, Homo sapiens
tgggtgtgaagggatgag

SEQ ID NO: 4180194 - DNA, 21 bp, Homo sapiens
tgggttcctcttccccactcc

SEQ ID NO: 4180195 - DNA, 17 bp, Homo sapiens
tgggttttttcacataa

SEQ ID NO: 4180196 - DNA, 14 bp, Homo sapiens
tggtaaattgtaaa

SEQ ID NO: 4180197 - DNA, 16 bp, Homo sapiens
tggtaacttctttgaa

SEQ ID NO: 4180198 - DNA, 10 bp, Homo sapiens
tggtaattat

SEQ ID NO: 4180199 - DNA, 14 bp, Homo sapiens
tggtaattgtacta

SEQ ID NO: 4180200 - DNA, 22 bp, Homo sapiens
tggtaatttgtatctgaaggag

SEQ ID NO: 4180201 - DNA, 13 bp, Homo sapiens
tggtaccagatgc

SEQ ID NO: 4180202 - DNA, 23 bp, Homo sapiens
tggtactaagaggctatttaaaa

SEQ ID NO: 4180203 - DNA, 19 bp, Homo sapiens
tggtactctaatcagtcct

SEQ ID NO: 4180204 - DNA, 15 bp, Homo sapiens
tggtaggcttatcaa

SEQ ID NO: 4180205 - DNA, 19 bp, Homo sapiens
tggtatctgggtaagaaga

SEQ ID NO: 4180206 - DNA, 19 bp, Homo sapiens
tggtatgaacttgaggaca

SEQ ID NO: 4180207 - DNA, 14 bp, Homo sapiens
tggtatgagctgag

SEQ ID NO: 4180208 - DNA, 20 bp, Homo sapiens
tggtcaaaccgcactcaccc

SEQ ID NO: 4180209 - DNA, 21 bp, Homo sapiens
tggtcaaaccgcactcaccca

SEQ ID NO: 4180210 - DNA, 14 bp, Homo sapiens
tggtcaccatgaaa

SEQ ID NO: 4180211 - DNA, 17 bp, Homo sapiens
tggtcagagtgccactg

SEQ ID NO: 4180212 - DNA, 21 bp, Homo sapiens
tggtcagttgtacgtaatgta

SEQ ID NO: 4180213 - DNA, 16 bp, Homo sapiens
tggtcctccatttcaa

SEQ ID NO: 4180214 - DNA, 20 bp, Homo sapiens
tggtctgagcaccccctcat

SEQ ID NO: 4180215 - DNA, 18 bp, Homo sapiens
tggtctggatggtagaat

SEQ ID NO: 4180216 - DNA, 23 bp, Homo sapiens
tggtcttacatctgtgtggtata

SEQ ID NO: 4180217 - DNA, 19 bp, Homo sapiens
tggtgaaatttattagtta

SEQ ID NO: 4180218 - DNA, 18 bp, Homo sapiens
tggtgactgcgatcttca

SEQ ID NO: 4180219 - DNA, 15 bp, Homo sapiens
tggtgaggcccagcc

SEQ ID NO: 4180220 - DNA, 19 bp, Homo sapiens
tggtgaggcccagcctgtc

SEQ ID NO: 4180221 - DNA, 19 bp, Homo sapiens
tggtgaggttgtgctgcct

SEQ ID NO: 4180222 - DNA, 23 bp, Homo sapiens
tggtgctataggctggagaagct

SEQ ID NO: 4180223 - DNA, 20 bp, Homo sapiens
tggtgctgtggccagggtga

SEQ ID NO: 4180224 - DNA, 16 bp, Homo sapiens
tggtggccaagcctgg

SEQ ID NO: 4180225 - DNA, 19 bp, Homo sapiens
tggtggccaagcctggccc

SEQ ID NO: 4180226 - DNA, 14 bp, Homo sapiens
tggtgggctggccc

SEQ ID NO: 4180227 - DNA, 15 bp, Homo sapiens
tggtgggctggccca

SEQ ID NO: 4180228 - DNA, 13 bp, Homo sapiens
tggtgtccctgcg

SEQ ID NO: 4180229 - DNA, 15 bp, Homo sapiens
tggtgtgaaagtcag

SEQ ID NO: 4180230 - DNA, 15 bp, Homo sapiens
tggttcacactgacc

SEQ ID NO: 4180231 - DNA, 18 bp, Homo sapiens
tggttctgtgacccatct

SEQ ID NO: 4180232 - DNA, 19 bp, Homo sapiens
tggttctgtgacccatctg

SEQ ID NO: 4180233 - DNA, 18 bp, Homo sapiens
tggttgatgccaaaaaaa

SEQ ID NO: 4180234 - DNA, 17 bp, Homo sapiens
tggtttcccaagagcta

SEQ ID NO: 4180235 - DNA, 18 bp, Homo sapiens
tggtttcccaagagctac

SEQ ID NO: 4180236 - DNA, 16 bp, Homo sapiens
tggtttgccttccaga

SEQ ID NO: 4180237 - DNA, 19 bp, Homo sapiens
tggttttctccaagagcta

SEQ ID NO: 4180238 - DNA, 18 bp, Homo sapiens
tggtttttggttacatgg

SEQ ID NO: 4180239 - DNA, 18 bp, Homo sapiens
tgtaaaaccaactaaata

SEQ ID NO: 4180240 - DNA, 18 bp, Homo sapiens
tgtaaaataagaatgatt

SEQ ID NO: 4180241 - DNA, 17 bp, Homo sapiens
tgtaaaatagcttgtat

SEQ ID NO: 4180242 - DNA, 22 bp, Homo sapiens
tgtaaactcaaaacttaacata

SEQ ID NO: 4180243 - DNA, 14 bp, Homo sapiens
tgtaaagattgttt

SEQ ID NO: 4180244 - DNA, 12 bp, Homo sapiens
tgtaaaggaaat

SEQ ID NO: 4180245 - DNA, 15 bp, Homo sapiens
tgtaaaggaaataat

SEQ ID NO: 4180246 - DNA, 10 bp, Homo sapiens
tgtaaataaa

SEQ ID NO: 4180247 - DNA, 21 bp, Homo sapiens
tgtaaatacagtggatctcaa

SEQ ID NO: 4180248 - DNA, 20 bp, Homo sapiens
tgtaaatacatcaaaaatgg

SEQ ID NO: 4180249 - DNA, 11 bp, Homo sapiens
tgtaaatgcct

SEQ ID NO: 4180250 - DNA, 23 bp, Homo sapiens
tgtaacacagctgagagactttt

SEQ ID NO: 4180251 - DNA, 11 bp, Homo sapiens
tgtaactattg

SEQ ID NO: 4180252 - DNA, 14 bp, Homo sapiens
tgtaactattgaat

SEQ ID NO: 4180253 - DNA, 22 bp, Homo sapiens
tgtaagcattctgagctgggct

SEQ ID NO: 4180254 - DNA, 22 bp, Homo sapiens
tgtaaggtaatttctgtgtatt

SEQ ID NO: 4180255 - DNA, 16 bp, Homo sapiens
tgtaagttgaagcaaa

SEQ ID NO: 4180256 - DNA, 20 bp, Homo sapiens
tgtaagtttatgtctaaaga

SEQ ID NO: 4180257 - DNA, 11 bp, Homo sapiens
tgtaatacaat

SEQ ID NO: 4180258 - DNA, 18 bp, Homo sapiens
tgtaatagatgtttgata

SEQ ID NO: 4180259 - DNA, 16 bp, Homo sapiens
tgtaatgtaaatacat

SEQ ID NO: 4180260 - DNA, 15 bp, Homo sapiens
tgtacaaaaacaaaa

SEQ ID NO: 4180261 - DNA, 18 bp, Homo sapiens
tgtacaaaaacaaaacaa

SEQ ID NO: 4180262 - DNA, 21 bp, Homo sapiens
tgtacaatacataactagttt

SEQ ID NO: 4180263 - DNA, 17 bp, Homo sapiens
tgtacagtgtgtaaagt

SEQ ID NO: 4180264 - DNA, 20 bp, Homo sapiens
tgtacatacgtgttctatag

SEQ ID NO: 4180265 - DNA, 14 bp, Homo sapiens
tgtacatgcattca

SEQ ID NO: 4180266 - DNA, 13 bp, Homo sapiens
tgtacatgtacat

SEQ ID NO: 4180267 - DNA, 16 bp, Homo sapiens
tgtacccaatttaatt

SEQ ID NO: 4180268 - DNA, 14 bp, Homo sapiens
tgtacgtaatgtat

SEQ ID NO: 4180269 - DNA, 15 bp, Homo sapiens
tgtactaaagccaaa

SEQ ID NO: 4180270 - DNA, 18 bp, Homo sapiens
tgtactcaggaggctgag

SEQ ID NO: 4180271 - DNA, 17 bp, Homo sapiens
tgtagaacctaattcaa

SEQ ID NO: 4180272 - DNA, 21 bp, Homo sapiens
tgtagatggaaatcagttgtg

SEQ ID NO: 4180273 - DNA, 20 bp, Homo sapiens
tgtagcaactacagtctaaa

SEQ ID NO: 4180274 - DNA, 10 bp, Homo sapiens
tgtagccaag

SEQ ID NO: 4180275 - DNA, 17 bp, Homo sapiens
tgtagccacaccaggat

SEQ ID NO: 4180276 - DNA, 18 bp, Homo sapiens
tgtagccacaccaggata

SEQ ID NO: 4180277 - DNA, 23 bp, Homo sapiens
tgtagccttgccttttaaaagaa

SEQ ID NO: 4180278 - DNA, 15 bp, Homo sapiens
tgtagctttcctggt

SEQ ID NO: 4180279 - DNA, 22 bp, Homo sapiens
tgtaggggttaacttggtcaga

SEQ ID NO: 4180280 - DNA, 20 bp, Homo sapiens
tgtaggtattaaagatgtgt

SEQ ID NO: 4180281 - DNA, 20 bp, Homo sapiens
tgtaggtgtctgcacccagg

SEQ ID NO: 4180282 - DNA, 13 bp, Homo sapiens
tgtaggttgctta

SEQ ID NO: 4180283 - DNA, 19 bp, Homo sapiens
tgtagtaatctgcattatt

SEQ ID NO: 4180284 - DNA, 14 bp, Homo sapiens
tgtagtaatttatt

SEQ ID NO: 4180285 - DNA, 18 bp, Homo sapiens
tgtagtagccctttctgt

SEQ ID NO: 4180286 - DNA, 15 bp, Homo sapiens
tgtagtcccagccac

SEQ ID NO: 4180287 - DNA, 12 bp, Homo sapiens
tgtagttaggaa

SEQ ID NO: 4180288 - DNA, 14 bp, Homo sapiens
tgtagttaggaaat

SEQ ID NO: 4180289 - DNA, 11 bp, Homo sapiens
tgtagtttaat

SEQ ID NO: 4180290 - DNA, 15 bp, Homo sapiens
tgtagtttaatactt

SEQ ID NO: 4180291 - DNA, 13 bp, Homo sapiens
tgtataatgtgat

SEQ ID NO: 4180292 - DNA, 15 bp, Homo sapiens
tgtatagtaaatcac

SEQ ID NO: 4180293 - DNA, 15 bp, Homo sapiens
tgtatagtgtaaaat

SEQ ID NO: 4180294 - DNA, 16 bp, Homo sapiens
tgtatagtgtaaaata

SEQ ID NO: 4180295 - DNA, 24 bp, Homo sapiens
tgtatagtgtaaaataagaatgat

SEQ ID NO: 4180296 - DNA, 18 bp, Homo sapiens
tgtatatcagaaaaggga

SEQ ID NO: 4180297 - DNA, 17 bp, Homo sapiens
tgtatcatttgaacaac

SEQ ID NO: 4180298 - DNA, 22 bp, Homo sapiens
tgtatcccccccctgtatagtt

SEQ ID NO: 4180299 - DNA, 18 bp, Homo sapiens
tgtatccgactctaagct

SEQ ID NO: 4180300 - DNA, 20 bp, Homo sapiens
tgtatccgactctaagctgt

SEQ ID NO: 4180301 - DNA, 12 bp, Homo sapiens
tgtatgctggac

SEQ ID NO: 4180302 - DNA, 23 bp, Homo sapiens
tgtatgtgtgtggtgtgtgtgct

SEQ ID NO: 4180303 - DNA, 18 bp, Homo sapiens
tgtattcagacagatgag

SEQ ID NO: 4180304 - DNA, 17 bp, Homo sapiens
ttgcaaaagactaattt

SEQ ID NO: 4180305 - DNA, 18 bp, Homo sapiens
ttgcaagatttaacacta

SEQ ID NO: 4180306 - DNA, 19 bp, Homo sapiens
ttgcaatggctatatggca

SEQ ID NO: 4180307 - DNA, 16 bp, Homo sapiens
ttgcactgacaagatg

SEQ ID NO: 4180308 - DNA, 17 bp, Homo sapiens
ttgcaggcccagcagac

SEQ ID NO: 4180309 - DNA, 16 bp, Homo sapiens
ttgcaggtgcctggct

SEQ ID NO: 4180310 - DNA, 16 bp, Homo sapiens
ttgcagtgagctgaga

SEQ ID NO: 4180311 - DNA, 16 bp, Homo sapiens
ttgcataagattaaag

SEQ ID NO: 4180312 - DNA, 18 bp, Homo sapiens
ttgcataagattaaagga

SEQ ID NO: 4180313 - DNA, 23 bp, Homo sapiens
ttgcataagattaaaggaaggaa

SEQ ID NO: 4180314 - DNA, 18 bp, Homo sapiens
ttgccaaaataccagagc

SEQ ID NO: 4180315 - DNA, 19 bp, Homo sapiens
ttgccaaaataccagagcc

SEQ ID NO: 4180316 - DNA, 15 bp, Homo sapiens
ttgccacaaccctgt

SEQ ID NO: 4180317 - DNA, 21 bp, Homo sapiens
ttgccacaccaatcagagagc

SEQ ID NO: 4180318 - DNA, 12 bp, Homo sapiens
ttgccaggctag

SEQ ID NO: 4180319 - DNA, 14 bp, Homo sapiens
ttgccatgggcctg

SEQ ID NO: 4180320 - DNA, 14 bp, Homo sapiens
ttgccattcctgga

SEQ ID NO: 4180321 - DNA, 14 bp, Homo sapiens
ttgcccagcctgga

SEQ ID NO: 4180322 - DNA, 18 bp, Homo sapiens
ttgcctcttcagcagcat

SEQ ID NO: 4180323 - DNA, 19 bp, Homo sapiens
ttgcctgcagagagaagcc

SEQ ID NO: 4180324 - DNA, 22 bp, Homo sapiens
ttgcctgcctgcctgtggagac

SEQ ID NO: 4180325 - DNA, 16 bp, Homo sapiens
ttgccttttaaaagaa

SEQ ID NO: 4180326 - DNA, 18 bp, Homo sapiens
ttgccttttgcaaacttt

SEQ ID NO: 4180327 - DNA, 23 bp, Homo sapiens
ttgctaaacgactccgagaacaa

SEQ ID NO: 4180328 - DNA, 13 bp, Homo sapiens
ttgctacataatt

SEQ ID NO: 4180329 - DNA, 14 bp, Homo sapiens
ttgctattacatgt

SEQ ID NO: 4180330 - DNA, 19 bp, Homo sapiens
ttgctgattcaagaaacag

SEQ ID NO: 4180331 - DNA, 14 bp, Homo sapiens
ttgcttaaaatttt

SEQ ID NO: 4180332 - DNA, 24 bp, Homo sapiens
ttgcttaggatgtttttcatgaaa

SEQ ID NO: 4180333 - DNA, 19 bp, Homo sapiens
ttgcttatcaacttcctaa

SEQ ID NO: 4180334 - DNA, 13 bp, Homo sapiens
ttgcttgaaacca

SEQ ID NO: 4180335 - DNA, 14 bp, Homo sapiens
ttgctttgccaaaa

SEQ ID NO: 4180336 - DNA, 19 bp, Homo sapiens
ttgctttgccaaaatacca

SEQ ID NO: 4180337 - DNA, 18 bp, Homo sapiens
ttggaaagagaccagcac

SEQ ID NO: 4180338 - DNA, 13 bp, Homo sapiens
ttggaaatattca

SEQ ID NO: 4180339 - DNA, 16 bp, Homo sapiens
ttggaagagaggcacc

SEQ ID NO: 4180340 - DNA, 19 bp, Homo sapiens
ttggaagagaggcacctgc

SEQ ID NO: 4180341 - DNA, 13 bp, Homo sapiens
ttggagactctgt

SEQ ID NO: 4180342 - DNA, 17 bp, Homo sapiens
ttggagagcagctggct

SEQ ID NO: 4180343 - DNA, 14 bp, Homo sapiens
ttggagctgactgt

SEQ ID NO: 4180344 - DNA, 22 bp, Homo sapiens
ttggagggtgggagagcccagc

SEQ ID NO: 4180345 - DNA, 19 bp, Homo sapiens
ttggatatgtaaaacattt

SEQ ID NO: 4180346 - DNA, 14 bp, Homo sapiens
ttggcaacagaagc

SEQ ID NO: 4180347 - DNA, 15 bp, Homo sapiens
ttggcaacagaagca

SEQ ID NO: 4180348 - DNA, 16 bp, Homo sapiens
ttggcaatagtttgca

SEQ ID NO: 4180349 - DNA, 19 bp, Homo sapiens
ttggcaatttcctggccct

SEQ ID NO: 4180350 - DNA, 20 bp, Homo sapiens
ttggcaatttcctggccctc

SEQ ID NO: 4180351 - DNA, 20 bp, Homo sapiens
ttggcaccttcaatacttca

SEQ ID NO: 4180352 - DNA, 14 bp, Homo sapiens
ttggcagagaggac

SEQ ID NO: 4180353 - DNA, 23 bp, Homo sapiens
ttggccaatgcacctaaagaaaa

SEQ ID NO: 4180354 - DNA, 22 bp, Homo sapiens
ttggccgggtgcggtggctcac

SEQ ID NO: 4180355 - DNA, 22 bp, Homo sapiens
ttggccgtggccatcagggtgg

SEQ ID NO: 4180356 - DNA, 22 bp, Homo sapiens
ttggctcacccaagcaaggcca

SEQ ID NO: 4180357 - DNA, 20 bp, Homo sapiens
ttggctggatgaaattttct

SEQ ID NO: 4180358 - DNA, 22 bp, Homo sapiens
ttgggaggggatggcagacagt

SEQ ID NO: 4180359 - DNA, 18 bp, Homo sapiens
ttgggaggtccaggcagg

SEQ ID NO: 4180360 - DNA, 22 bp, Homo sapiens
ttgggcccaggaggtcaagcct

SEQ ID NO: 4180361 - DNA, 13 bp, Homo sapiens
ttggggaccagag

SEQ ID NO: 4180362 - DNA, 15 bp, Homo sapiens
ttggggtcagccagg

SEQ ID NO: 4180363 - DNA, 16 bp, Homo sapiens
ttggggtctgccacca

SEQ ID NO: 4180364 - DNA, 15 bp, Homo sapiens
ttggggttgcccagc

SEQ ID NO: 4180365 - DNA, 23 bp, Homo sapiens
ttgggtgtggtgtcaccagcctg

SEQ ID NO: 4180366 - DNA, 18 bp, Homo sapiens
ttggtggatgggccctgc

SEQ ID NO: 4180367 - DNA, 21 bp, Homo sapiens
ttggtgggaagcaagcagggg

SEQ ID NO: 4180368 - DNA, 14 bp, Homo sapiens
ttggttcccttgtg

SEQ ID NO: 4180369 - DNA, 16 bp, Homo sapiens
ttggttttgctacata

SEQ ID NO: 4180370 - DNA, 16 bp, Homo sapiens
ttgtaaaaaagatttg

SEQ ID NO: 4180371 - DNA, 14 bp, Homo sapiens
ttgtaaaaacaaaa

SEQ ID NO: 4180372 - DNA, 13 bp, Homo sapiens
ttgtaaaggaaat

SEQ ID NO: 4180373 - DNA, 18 bp, Homo sapiens
ttgtaaaggaaataattg

SEQ ID NO: 4180374 - DNA, 12 bp, Homo sapiens
ttgtaaatgcct

SEQ ID NO: 4180375 - DNA, 16 bp, Homo sapiens
ttgtaacaaatatatt

SEQ ID NO: 4180376 - DNA, 16 bp, Homo sapiens
ttgtacagctgtttaa

SEQ ID NO: 4180377 - DNA, 16 bp, Homo sapiens
ttgtacagttcagttc

SEQ ID NO: 4180378 - DNA, 15 bp, Homo sapiens
ttgtaccaactttta

SEQ ID NO: 4180379 - DNA, 16 bp, Homo sapiens
ttgtacctatgtgaca

SEQ ID NO: 4180380 - DNA, 14 bp, Homo sapiens
ttgtacgtaatgta

SEQ ID NO: 4180381 - DNA, 16 bp, Homo sapiens
ttgtactccagcctgg

SEQ ID NO: 4180382 - DNA, 17 bp, Homo sapiens
ttgtaggggtcaaagaa

SEQ ID NO: 4180383 - DNA, 19 bp, Homo sapiens
ttgtaggggtcaaagaaat

SEQ ID NO: 4180384 - DNA, 19 bp, Homo sapiens
ttgtatcatttgaacaact

SEQ ID NO: 4180385 - DNA, 22 bp, Homo sapiens
ttgtatgacttctgctgaagga

SEQ ID NO: 4180386 - DNA, 18 bp, Homo sapiens
ttgtattttcttaatata

SEQ ID NO: 4180387 - DNA, 20 bp, Homo sapiens
ttgtattttttgttgaaagt

SEQ ID NO: 4180388 - DNA, 15 bp, Homo sapiens
ttgtcaacacaaaga

SEQ ID NO: 4180389 - DNA, 13 bp, Homo sapiens
ttgtcattatgta

SEQ ID NO: 4180390 - DNA, 22 bp, Homo sapiens
ttgtccattcatctcatgctct

SEQ ID NO: 4180391 - DNA, 23 bp, Homo sapiens
ttgtctaataaatattgacttct

SEQ ID NO: 4180392 - DNA, 16 bp, Homo sapiens
ttgtgctcaaggaatc

SEQ ID NO: 4180393 - DNA, 14 bp, Homo sapiens
ttgtgcttaataat

SEQ ID NO: 4180394 - DNA, 13 bp, Homo sapiens
ttgtgggtgggag

SEQ ID NO: 4180395 - DNA, 15 bp, Homo sapiens
ttgtgtcaagacatt

SEQ ID NO: 4180396 - DNA, 19 bp, Homo sapiens
ttgtgtctggcagtttata

SEQ ID NO: 4180397 - DNA, 21 bp, Homo sapiens
ttgttatgtatatagatgtgc

SEQ ID NO: 4180398 - DNA, 13 bp, Homo sapiens
ttgttattttcag

SEQ ID NO: 4180399 - DNA, 18 bp, Homo sapiens
ttgttcaagtatctaact

SEQ ID NO: 4180400 - DNA, 16 bp, Homo sapiens
ttgttgtttttaagat

SEQ ID NO: 4180401 - DNA, 17 bp, Homo sapiens
ttgtttctccccctggg

SEQ ID NO: 4180402 - DNA, 14 bp, Homo sapiens
ttgtttcttaaata

SEQ ID NO: 4180403 - DNA, 15 bp, Homo sapiens
ttgttttatgttcta

SEQ ID NO: 4180404 - DNA, 14 bp, Homo sapiens
ttgttttgttttaa

SEQ ID NO: 4180405 - DNA, 15 bp, Homo sapiens
tttaaaaaaagaaat

SEQ ID NO: 4180406 - DNA, 15 bp, Homo sapiens
tttaaaaaactaaaa

SEQ ID NO: 4180407 - DNA, 21 bp, Homo sapiens
tttaaaaaactaaaaactaga

SEQ ID NO: 4180408 - DNA, 13 bp, Homo sapiens
tttaaaaaagctt

SEQ ID NO: 4180409 - DNA, 20 bp, Homo sapiens
tttaaaaaagcttaaaactt

SEQ ID NO: 4180410 - DNA, 23 bp, Homo sapiens
tttaaaaaagcttaaaactttga

SEQ ID NO: 4180411 - DNA, 18 bp, Homo sapiens
tttaaaaccataaactgt

SEQ ID NO: 4180412 - DNA, 17 bp, Homo sapiens
tttaaaatgaaatgttt

SEQ ID NO: 4180413 - DNA, 18 bp, Homo sapiens
tttaaaatgtaaagccat

SEQ ID NO: 4180414 - DNA, 21 bp, Homo sapiens
tttaaacacttatcttctgga

SEQ ID NO: 4180415 - DNA, 15 bp, Homo sapiens
tttaaactataagca

SEQ ID NO: 4180416 - DNA, 17 bp, Homo sapiens
tttaaagcgtttgcaca

SEQ ID NO: 4180417 - DNA, 14 bp, Homo sapiens
tttaaaggtagaga

SEQ ID NO: 4180418 - DNA, 12 bp, Homo sapiens
tttaaataagat

SEQ ID NO: 4180419 - DNA, 14 bp, Homo sapiens
tttaacacataact

SEQ ID NO: 4180420 - DNA, 18 bp, Homo sapiens
tttaaccctctcttccct

SEQ ID NO: 4180421 - DNA, 22 bp, Homo sapiens
tttaagagtgaaataattaaaa

SEQ ID NO: 4180422 - DNA, 21 bp, Homo sapiens
tttaagcaggaatgcaatata

SEQ ID NO: 4180423 - DNA, 20 bp, Homo sapiens
tttaagccaaaacaatgttt

SEQ ID NO: 4180424 - DNA, 13 bp, Homo sapiens
tttaagctgtaaa

SEQ ID NO: 4180425 - DNA, 13 bp, Homo sapiens
tttaataaaagta

SEQ ID NO: 4180426 - DNA, 22 bp, Homo sapiens
tttaataaaagtactgaagacc

SEQ ID NO: 4180427 - DNA, 14 bp, Homo sapiens
tttaataaggaaaa

SEQ ID NO: 4180428 - DNA, 11 bp, Homo sapiens
tttaataattt

SEQ ID NO: 4180429 - DNA, 18 bp, Homo sapiens
tttaatgtatagtaaatc

SEQ ID NO: 4180430 - DNA, 17 bp, Homo sapiens
tttaatgtttaaaacat

SEQ ID NO: 4180431 - DNA, 19 bp, Homo sapiens
tttacactctctgtacaaa

SEQ ID NO: 4180432 - DNA, 15 bp, Homo sapiens
tttacagtaaataaa

SEQ ID NO: 4180433 - DNA, 18 bp, Homo sapiens
tttacagtgaatttctga

SEQ ID NO: 4180434 - DNA, 14 bp, Homo sapiens
tttacatgaacaca

SEQ ID NO: 4180435 - DNA, 20 bp, Homo sapiens
tttacatgcaatttattaaa

SEQ ID NO: 4180436 - DNA, 14 bp, Homo sapiens
tttaccaaggaaag

SEQ ID NO: 4180437 - DNA, 23 bp, Homo sapiens
tttaccaaggaaagaacaaatgc

SEQ ID NO: 4180438 - DNA, 16 bp, Homo sapiens
tttaccttgttttctc

SEQ ID NO: 4180439 - DNA, 12 bp, Homo sapiens
aaaaaagatttg

SEQ ID NO: 4180440 - DNA, 11 bp, Homo sapiens
aaaaaccacaa

SEQ ID NO: 4180441 - DNA, 13 bp, Homo sapiens
aaaaactttcatt

SEQ ID NO: 4180442 - DNA, 14 bp, Homo sapiens
aaaaagaagaatct

SEQ ID NO: 4180443 - DNA, 18 bp, Homo sapiens
aaaaagaagcaacctcag

SEQ ID NO: 4180444 - DNA, 22 bp, Homo sapiens
aaaaagatttaacaaatacatt

SEQ ID NO: 4180445 - DNA, 18 bp, Homo sapiens
aaaaagctcatattttgt

SEQ ID NO: 4180446 - DNA, 12 bp, Homo sapiens
aaaaagctcttt

SEQ ID NO: 4180447 - DNA, 12 bp, Homo sapiens
aaaaagcttaaa

SEQ ID NO: 4180448 - DNA, 15 bp, Homo sapiens
aaaaagcttaaaact

SEQ ID NO: 4180449 - DNA, 19 bp, Homo sapiens
aaaaagcttaaaactttga

SEQ ID NO: 4180450 - DNA, 22 bp, Homo sapiens
aaaaaggctagtttattttgtt

SEQ ID NO: 4180451 - DNA, 13 bp, Homo sapiens
aaaaaggtttaca

SEQ ID NO: 4180452 - DNA, 12 bp, Homo sapiens
aaaaagtgaaat

SEQ ID NO: 4180453 - DNA, 16 bp, Homo sapiens
aaaaataagaagaatg

SEQ ID NO: 4180454 - DNA, 22 bp, Homo sapiens
aaaaataagaagaatgcttaat

SEQ ID NO: 4180455 - DNA, 21 bp, Homo sapiens
aaaaatagctaaatacctcaa

SEQ ID NO: 4180456 - DNA, 14 bp, Homo sapiens
aaaaatagtttgga

SEQ ID NO: 4180457 - DNA, 12 bp, Homo sapiens
aaaaatccactc

SEQ ID NO: 4180458 - DNA, 12 bp, Homo sapiens
aaaaatgaaagc

SEQ ID NO: 4180459 - DNA, 15 bp, Homo sapiens
aaaaatgctgcttct

SEQ ID NO: 4180460 - DNA, 16 bp, Homo sapiens
aaaaatgtagaatgat

SEQ ID NO: 4180461 - DNA, 18 bp, Homo sapiens
aaaaattctgatacatta

SEQ ID NO: 4180462 - DNA, 14 bp, Homo sapiens
aaaacaaaaagaca

SEQ ID NO: 4180463 - DNA, 14 bp, Homo sapiens
aaaacaacaacaat

SEQ ID NO: 4180464 - DNA, 17 bp, Homo sapiens
aaaacagcccaggtcct

SEQ ID NO: 4180465 - DNA, 13 bp, Homo sapiens
aaaacatttacat

SEQ ID NO: 4180466 - DNA, 12 bp, Homo sapiens
aaaacatttatt

SEQ ID NO: 4180467 - DNA, 13 bp, Homo sapiens
aaaacatttattt

SEQ ID NO: 4180468 - DNA, 15 bp, Homo sapiens
aaaaccattttagtt

SEQ ID NO: 4180469 - DNA, 19 bp, Homo sapiens
aaaacctagaacttcaaaa

SEQ ID NO: 4180470 - DNA, 21 bp, Homo sapiens
aaaacgtgggtatttcctgct

SEQ ID NO: 4180471 - DNA, 19 bp, Homo sapiens
aaaacgttgacccctttcc

SEQ ID NO: 4180472 - DNA, 19 bp, Homo sapiens
aaaactaaatctctaatat

SEQ ID NO: 4180473 - DNA, 22 bp, Homo sapiens
aaaactacaaccaatggaatgt

SEQ ID NO: 4180474 - DNA, 23 bp, Homo sapiens
aaaactatacttgtactccttaa

SEQ ID NO: 4180475 - DNA, 13 bp, Homo sapiens
aaaactcaggatt

SEQ ID NO: 4180476 - DNA, 14 bp, Homo sapiens
aaaactcttggcct

SEQ ID NO: 4180477 - DNA, 15 bp, Homo sapiens
aaaactcttggcctc

SEQ ID NO: 4180478 - DNA, 18 bp, Homo sapiens
aaaactgtgacccaaaga

SEQ ID NO: 4180479 - DNA, 17 bp, Homo sapiens
aaaacttaacatattta

SEQ ID NO: 4180480 - DNA, 11 bp, Homo sapiens
aaaacttattt

SEQ ID NO: 4180481 - DNA, 12 bp, Homo sapiens
aaaactttcatt

SEQ ID NO: 4180482 - DNA, 12 bp, Homo sapiens
aaaagaagaaga

SEQ ID NO: 4180483 - DNA, 14 bp, Homo sapiens
aaaagaagaagttt

SEQ ID NO: 4180484 - DNA, 23 bp, Homo sapiens
aaaagaatttgtgacattttaaa

SEQ ID NO: 4180485 - DNA, 21 bp, Homo sapiens
aaaagagagaaaacttatttg

SEQ ID NO: 4180486 - DNA, 15 bp, Homo sapiens
aaaagagtcagccct

SEQ ID NO: 4180487 - DNA, 17 bp, Homo sapiens
aaaagatttaacaaata

SEQ ID NO: 4180488 - DNA, 16 bp, Homo sapiens
aaaagcaaaaaagaaa

SEQ ID NO: 4180489 - DNA, 13 bp, Homo sapiens
aaaagccaaatta

SEQ ID NO: 4180490 - DNA, 14 bp, Homo sapiens
aaaaggctgagaag

SEQ ID NO: 4180491 - DNA, 13 bp, Homo sapiens
aaaaggtttacag

SEQ ID NO: 4180492 - DNA, 16 bp, Homo sapiens
aaaaggtttacagaat

SEQ ID NO: 4180493 - DNA, 19 bp, Homo sapiens
aaaagtggaatcactgtat

SEQ ID NO: 4180494 - DNA, 14 bp, Homo sapiens
aaaagttatatcta

SEQ ID NO: 4180495 - DNA, 16 bp, Homo sapiens
aaaagttcgaaagaaa

SEQ ID NO: 4180496 - DNA, 16 bp, Homo sapiens
aaaagtttacaagtgt

SEQ ID NO: 4180497 - DNA, 22 bp, Homo sapiens
aaaataagagatagcagaggaa

SEQ ID NO: 4180498 - DNA, 16 bp, Homo sapiens
aaaataatactgctga

SEQ ID NO: 4180499 - DNA, 23 bp, Homo sapiens
aaaataatactgctgagatacat

SEQ ID NO: 4180500 - DNA, 19 bp, Homo sapiens
aaaatactatgaaatgaaa

SEQ ID NO: 4180501 - DNA, 13 bp, Homo sapiens
aaaatagcttgta

SEQ ID NO: 4180502 - DNA, 15 bp, Homo sapiens
aaaatagtagaacaa

SEQ ID NO: 4180503 - DNA, 19 bp, Homo sapiens
aaaatagtttggatatgta

SEQ ID NO: 4180504 - DNA, 22 bp, Homo sapiens
aaaatagtttggatatgtaaaa

SEQ ID NO: 4180505 - DNA, 12 bp, Homo sapiens
aaaatatatgat

SEQ ID NO: 4180506 - DNA, 22 bp, Homo sapiens
aaaatatatttatgataactat

SEQ ID NO: 4180507 - DNA, 16 bp, Homo sapiens
aaaatatggaacttct

SEQ ID NO: 4180508 - DNA, 16 bp, Homo sapiens
aaaatattttctgaat

SEQ ID NO: 4180509 - DNA, 12 bp, Homo sapiens
aaaatcaaagaa

SEQ ID NO: 4180510 - DNA, 14 bp, Homo sapiens
aaaatccatggata

SEQ ID NO: 4180511 - DNA, 17 bp, Homo sapiens
aaaatgaaatgtttttg

SEQ ID NO: 4180512 - DNA, 18 bp, Homo sapiens
aaaatgagtgatctcaaa

SEQ ID NO: 4180513 - DNA, 16 bp, Homo sapiens
aaaatgattgtaaaat

SEQ ID NO: 4180514 - DNA, 22 bp, Homo sapiens
aaaatgctgaggtaataattat

SEQ ID NO: 4180515 - DNA, 14 bp, Homo sapiens
aaaatggaaatgta

SEQ ID NO: 4180516 - DNA, 14 bp, Homo sapiens
aaaatgtaaagcca

SEQ ID NO: 4180517 - DNA, 17 bp, Homo sapiens
aaaatgttgaaatatga

SEQ ID NO: 4180518 - DNA, 13 bp, Homo sapiens
aaaattagaagca

SEQ ID NO: 4180519 - DNA, 12 bp, Homo sapiens
aaaattagtaat

SEQ ID NO: 4180520 - DNA, 18 bp, Homo sapiens
aaaattattttaaacaaa

SEQ ID NO: 4180521 - DNA, 12 bp, Homo sapiens
aaaattgaatgc

SEQ ID NO: 4180522 - DNA, 15 bp, Homo sapiens
aaaattgtatagaga

SEQ ID NO: 4180523 - DNA, 20 bp, Homo sapiens
aaaatttcaacaagtagcta

SEQ ID NO: 4180524 - DNA, 19 bp, Homo sapiens
aaaattttacttttgttct

SEQ ID NO: 4180525 - DNA, 12 bp, Homo sapiens
aaacaaaataga

SEQ ID NO: 4180526 - DNA, 19 bp, Homo sapiens
aaacacttaggaagaaatc

SEQ ID NO: 4180527 - DNA, 18 bp, Homo sapiens
aaacacttatcttctgga

SEQ ID NO: 4180528 - DNA, 15 bp, Homo sapiens
aaacacttgcaacct

SEQ ID NO: 4180529 - DNA, 14 bp, Homo sapiens
aaacagccaaataa

SEQ ID NO: 4180530 - DNA, 21 bp, Homo sapiens
aaacagcctgggtaggaaaat

SEQ ID NO: 4180531 - DNA, 17 bp, Homo sapiens
aaacaggagacaggaag

SEQ ID NO: 4180532 - DNA, 14 bp, Homo sapiens
aaacataggaatat

SEQ ID NO: 4180533 - DNA, 20 bp, Homo sapiens
aaacattaagattgaggcct

SEQ ID NO: 4180534 - DNA, 14 bp, Homo sapiens
aaacatttattttg

SEQ ID NO: 4180535 - DNA, 17 bp, Homo sapiens
aaacatttattttgaca

SEQ ID NO: 4180536 - DNA, 20 bp, Homo sapiens
aaacatttattttgacataa

SEQ ID NO: 4180537 - DNA, 14 bp, Homo sapiens
aaaccaactaaata

SEQ ID NO: 4180538 - DNA, 18 bp, Homo sapiens
aaaccaagtctacttcac

SEQ ID NO: 4180539 - DNA, 21 bp, Homo sapiens
aaaccaccctaaaatgacagc

SEQ ID NO: 4180540 - DNA, 18 bp, Homo sapiens
aaaccattatttaataag

SEQ ID NO: 4180541 - DNA, 16 bp, Homo sapiens
aaaccgctaaaagaaa

SEQ ID NO: 4180542 - DNA, 23 bp, Homo sapiens
aaaccgctaaaagaaactttctt

SEQ ID NO: 4180543 - DNA, 18 bp, Homo sapiens
aaacctagaacttcaaaa

SEQ ID NO: 4180544 - DNA, 14 bp, Homo sapiens
aaacctcacttgaa

SEQ ID NO: 4180545 - DNA, 19 bp, Homo sapiens
aaacctcagggacaacatt

SEQ ID NO: 4180546 - DNA, 23 bp, Homo sapiens
aaacctgaggatgcaacaaatat

SEQ ID NO: 4180547 - DNA, 19 bp, Homo sapiens
aaacctggagatgatgatg

SEQ ID NO: 4180548 - DNA, 11 bp, Homo sapiens
aaacctttcaa

SEQ ID NO: 4180549 - DNA, 19 bp, Homo sapiens
aaacgactccgagaacaac

SEQ ID NO: 4180550 - DNA, 19 bp, Homo sapiens
aaacgcaaagggctgaaag

SEQ ID NO: 4180551 - DNA, 21 bp, Homo sapiens
aaacgttgacccctttccccc

SEQ ID NO: 4180552 - DNA, 13 bp, Homo sapiens
aaacgtttcaaag

SEQ ID NO: 4180553 - DNA, 15 bp, Homo sapiens
aaactaggaggaaaa

SEQ ID NO: 4180554 - DNA, 17 bp, Homo sapiens
aaactattacttacaaa

SEQ ID NO: 4180555 - DNA, 13 bp, Homo sapiens
aaactcaaaactt

SEQ ID NO: 4180556 - DNA, 18 bp, Homo sapiens
aaactcaaaacttaacat

SEQ ID NO: 4180557 - DNA, 22 bp, Homo sapiens
aaactcctcccttttatcttct

SEQ ID NO: 4180558 - DNA, 16 bp, Homo sapiens
aaactcgttttttaca

SEQ ID NO: 4180559 - DNA, 19 bp, Homo sapiens
aaactcttggcctctgctt

SEQ ID NO: 4180560 - DNA, 13 bp, Homo sapiens
aaactcttgtgta

SEQ ID NO: 4180561 - DNA, 13 bp, Homo sapiens
aaactgaaaatct

SEQ ID NO: 4180562 - DNA, 18 bp, Homo sapiens
aaactgttggaagttcac

SEQ ID NO: 4180563 - DNA, 17 bp, Homo sapiens
aaacttaacatggaaga

SEQ ID NO: 4180564 - DNA, 12 bp, Homo sapiens
aaacttcagaaa

SEQ ID NO: 4180565 - DNA, 22 bp, Homo sapiens
aaactttaaagcgtttgcacag

SEQ ID NO: 4180566 - DNA, 20 bp, Homo sapiens
aaactttacccaaaaactaa

SEQ ID NO: 4180567 - DNA, 13 bp, Homo sapiens
aaagaaaaacaaa

SEQ ID NO: 4180568 - DNA, 13 bp, Homo sapiens
aaagaaaaacatt

SEQ ID NO: 4180569 - DNA, 14 bp, Homo sapiens
aaagaaaaccattt

SEQ ID NO: 4180570 - DNA, 16 bp, Homo sapiens
aaagaaaaccatttta

SEQ ID NO: 4180571 - DNA, 19 bp, Homo sapiens
aaagaaaatgtctgttttc

SEQ ID NO: 4180572 - DNA, 12 bp, Homo sapiens
aaagaaactttc

SEQ ID NO: 4180573 - DNA, 19 bp, Homo sapiens
aaagaacggaagaagagat

SEQ ID NO: 4180574 - DNA, 19 bp, Homo sapiens
aaagaagaagaagaaggag

SEQ ID NO: 4180575 - DNA, 16 bp, Homo sapiens
aaagaagtaaaagcta

SEQ ID NO: 4180576 - DNA, 15 bp, Homo sapiens
aaagaagtttgatat

SEQ ID NO: 4180577 - DNA, 19 bp, Homo sapiens
aaagaatccctgcagcctg

SEQ ID NO: 4180578 - DNA, 22 bp, Homo sapiens
aaagaatgagaaggagtcagaa

SEQ ID NO: 4180579 - DNA, 20 bp, Homo sapiens
aaagacacagatttcggtca

SEQ ID NO: 4180580 - DNA, 15 bp, Homo sapiens
aaagacacaggaaga

SEQ ID NO: 4180581 - DNA, 13 bp, Homo sapiens
aaagacaggctga

SEQ ID NO: 4180582 - DNA, 14 bp, Homo sapiens
aaagacatggaagg

SEQ ID NO: 4180583 - DNA, 13 bp, Homo sapiens
aaagagagaaaac

SEQ ID NO: 4180584 - DNA, 18 bp, Homo sapiens
aaagagagaaaacttatt

SEQ ID NO: 4180585 - DNA, 22 bp, Homo sapiens
aaagagtgggctgcatctggga

SEQ ID NO: 4180586 - DNA, 14 bp, Homo sapiens
aaagagttcaagaa

SEQ ID NO: 4180587 - DNA, 13 bp, Homo sapiens
aaagataatgtta

SEQ ID NO: 4180588 - DNA, 17 bp, Homo sapiens
aaagatatatacacagg

SEQ ID NO: 4180589 - DNA, 19 bp, Homo sapiens
aaagatgcttttaacagag

SEQ ID NO: 4180590 - DNA, 10 bp, Homo sapiens
aaagatgtgt

SEQ ID NO: 4180591 - DNA, 20 bp, Homo sapiens
aaagatttgtgaactggaag

SEQ ID NO: 4180592 - DNA, 21 bp, Homo sapiens
aaagattttttaataatttag

SEQ ID NO: 4180593 - DNA, 23 bp, Homo sapiens
aaagcaacaaagattgagaagcc

SEQ ID NO: 4180594 - DNA, 20 bp, Homo sapiens
aaagcaagcattcagaagaa

SEQ ID NO: 4180595 - DNA, 22 bp, Homo sapiens
aaagcaagcattcagaagaaaa

SEQ ID NO: 4180596 - DNA, 22 bp, Homo sapiens
aaagcaccagcttctccaggct

SEQ ID NO: 4180597 - DNA, 21 bp, Homo sapiens
aaagcccttcaacttcagaag

SEQ ID NO: 4180598 - DNA, 22 bp, Homo sapiens
aaagcccttcaacttcagaagg

SEQ ID NO: 4180599 - DNA, 15 bp, Homo sapiens
aaagccgtgcctttc

SEQ ID NO: 4180600 - DNA, 16 bp, Homo sapiens
aaagcctctgctgcca

SEQ ID NO: 4180601 - DNA, 12 bp, Homo sapiens
aaagcgaaaaaa

SEQ ID NO: 4180602 - DNA, 15 bp, Homo sapiens
aaagcggttgcttct

SEQ ID NO: 4180603 - DNA, 21 bp, Homo sapiens
aaagctcatattttgtatata

SEQ ID NO: 4180604 - DNA, 23 bp, Homo sapiens
aaagctgctgagaatctagcctc

SEQ ID NO: 4180605 - DNA, 18 bp, Homo sapiens
aaagctggtttaatgttt

SEQ ID NO: 4180606 - DNA, 18 bp, Homo sapiens
aaagctgtgtgtttggaa

SEQ ID NO: 4180607 - DNA, 19 bp, Homo sapiens
aaagcttaaaactttgaag

SEQ ID NO: 4180608 - DNA, 16 bp, Homo sapiens
aaagctttctgacaag

SEQ ID NO: 4180609 - DNA, 21 bp, Homo sapiens
aaaggctcagtctcaggagca

SEQ ID NO: 4180610 - DNA, 17 bp, Homo sapiens
aaaggtagagatgtgtg

SEQ ID NO: 4180611 - DNA, 15 bp, Homo sapiens
aaaggtttacagaat

SEQ ID NO: 4180612 - DNA, 16 bp, Homo sapiens
aaaggtttacagaatt

SEQ ID NO: 4180613 - DNA, 18 bp, Homo sapiens
aaaggtttatgaaaaaga

SEQ ID NO: 4180614 - DNA, 15 bp, Homo sapiens
aaaggtttcatgtag

SEQ ID NO: 4180615 - DNA, 18 bp, Homo sapiens
aaagtaaaagttatatct

SEQ ID NO: 4180616 - DNA, 23 bp, Homo sapiens
aaagtactctttaagagtgaaat

SEQ ID NO: 4180617 - DNA, 19 bp, Homo sapiens
aaagtatgtaaagtatgta

SEQ ID NO: 4180618 - DNA, 20 bp, Homo sapiens
aaagtcagaccctaggaagc

SEQ ID NO: 4180619 - DNA, 16 bp, Homo sapiens
aaagtctaaagtttac

SEQ ID NO: 4180620 - DNA, 17 bp, Homo sapiens
aaagtctattgtttgtt

SEQ ID NO: 4180621 - DNA, 19 bp, Homo sapiens
aaagtgactaatggcatga

SEQ ID NO: 4180622 - DNA, 17 bp, Homo sapiens
aaagtggccatgccacc

SEQ ID NO: 4180623 - DNA, 14 bp, Homo sapiens
aaagtgtgagcagt

SEQ ID NO: 4180624 - DNA, 20 bp, Homo sapiens
aaagttgataaagatttttt

SEQ ID NO: 4180625 - DNA, 23 bp, Homo sapiens
aaagttgataaagattttttaat

SEQ ID NO: 4180626 - DNA, 14 bp, Homo sapiens
aaagttgtctggct

SEQ ID NO: 4180627 - DNA, 15 bp, Homo sapiens
aaagtttaataaatt

SEQ ID NO: 4180628 - DNA, 19 bp, Homo sapiens
aaagtttacaagtgtatat

SEQ ID NO: 4180629 - DNA, 21 bp, Homo sapiens
aaagtttacagtaaataaatt

SEQ ID NO: 4180630 - DNA, 22 bp, Homo sapiens
aaagtttacagtaaataaattg

SEQ ID NO: 4180631 - DNA, 15 bp, Homo sapiens
aaagttttcctgaga

SEQ ID NO: 4180632 - DNA, 18 bp, Homo sapiens
aaataaagaatagcaatt

SEQ ID NO: 4180633 - DNA, 12 bp, Homo sapiens
aaataaattgtt

SEQ ID NO: 4180634 - DNA, 23 bp, Homo sapiens
aaataaattttgaatgtttatgt

SEQ ID NO: 4180635 - DNA, 14 bp, Homo sapiens
aaataagaagaatg

SEQ ID NO: 4180636 - DNA, 14 bp, Homo sapiens
aaataagatggaaa

SEQ ID NO: 4180637 - DNA, 20 bp, Homo sapiens
aaataatttttcttacacat

SEQ ID NO: 4180638 - DNA, 12 bp, Homo sapiens
aaatacatcaaa

SEQ ID NO: 4180639 - DNA, 15 bp, Homo sapiens
aaataccacaagcct

SEQ ID NO: 4180640 - DNA, 14 bp, Homo sapiens
aaataccagagcct

SEQ ID NO: 4180641 - DNA, 13 bp, Homo sapiens
aaatactaatgta

SEQ ID NO: 4180642 - DNA, 14 bp, Homo sapiens
aaatactaatgtaa

SEQ ID NO: 4180643 - DNA, 15 bp, Homo sapiens
aaatagaaattttgt

SEQ ID NO: 4180644 - DNA, 18 bp, Homo sapiens
aaatagagttccaaataa

SEQ ID NO: 4180645 - DNA, 19 bp, Homo sapiens
aaatagcaattagcagaag

SEQ ID NO: 4180646 - DNA, 19 bp, Homo sapiens
aaataggctttagaagaga

SEQ ID NO: 4180647 - DNA, 12 bp, Homo sapiens
aaatagtatttc

SEQ ID NO: 4180648 - DNA, 20 bp, Homo sapiens
aaatagtgcagaatctcata

SEQ ID NO: 4180649 - DNA, 14 bp, Homo sapiens
aaatagtttggata

SEQ ID NO: 4180650 - DNA, 20 bp, Homo sapiens
aaatagtttggatatgtaaa

SEQ ID NO: 4180651 - DNA, 14 bp, Homo sapiens
aaatataaatggta

SEQ ID NO: 4180652 - DNA, 23 bp, Homo sapiens
aaatataggtttaatttcaaata

SEQ ID NO: 4180653 - DNA, 21 bp, Homo sapiens
aaatatcctttggaacaatta

SEQ ID NO: 4180654 - DNA, 16 bp, Homo sapiens
aaatatggaacttcta

SEQ ID NO: 4180655 - DNA, 16 bp, Homo sapiens
aaatatgtgaaaatga

SEQ ID NO: 4180656 - DNA, 13 bp, Homo sapiens
aaatattcatgta

SEQ ID NO: 4180657 - DNA, 20 bp, Homo sapiens
aaatattgacttctcttgaa

SEQ ID NO: 4180658 - DNA, 20 bp, Homo sapiens
aaatattgttaccatgaaga

SEQ ID NO: 4180659 - DNA, 19 bp, Homo sapiens
aaatattttaaagaattgt

SEQ ID NO: 4180660 - DNA, 23 bp, Homo sapiens
aaatattttaaagaattgtgtca

SEQ ID NO: 4180661 - DNA, 16 bp, Homo sapiens
aaatattttctgggtt

SEQ ID NO: 4180662 - DNA, 13 bp, Homo sapiens
aaatcaaagaaaa

SEQ ID NO: 4180663 - DNA, 18 bp, Homo sapiens
aaatcaacttgcttatca

SEQ ID NO: 4180664 - DNA, 20 bp, Homo sapiens
aaatcaccacaaactgtaat

SEQ ID NO: 4180665 - DNA, 17 bp, Homo sapiens
aaatcacgctttttgaa

SEQ ID NO: 4180666 - DNA, 11 bp, Homo sapiens
aaatcagccag

SEQ ID NO: 4180667 - DNA, 23 bp, Homo sapiens
aaatcaggcccaatatcagtatt

SEQ ID NO: 4180668 - DNA, 17 bp, Homo sapiens
aaatcatgaatatttca

SEQ ID NO: 4180669 - DNA, 10 bp, Homo sapiens
aaatccactc

SEQ ID NO: 4180670 - DNA, 20 bp, Homo sapiens
aaatcgaatgaaattaactg

SEQ ID NO: 4180671 - DNA, 19 bp, Homo sapiens
aaatctaatattaaaaata

SEQ ID NO: 4180672 - DNA, 19 bp, Homo sapiens
aaatctaatgtaagaaaat

SEQ ID NO: 4180673 - DNA, 21 bp, Homo sapiens
aaatctagaaaattgagtttt

SEQ ID NO: 4180674 - DNA, 21 bp, Homo sapiens
aaatctggcttctggccagga

SEQ ID NO: 4180675 - DNA, 22 bp, Homo sapiens
aaatcttggttgatgccaaaaa

SEQ ID NO: 4180676 - DNA, 12 bp, Homo sapiens
aaatgaattgta

SEQ ID NO: 4180677 - DNA, 14 bp, Homo sapiens
aaatgaggacatgt

SEQ ID NO: 4180678 - DNA, 18 bp, Homo sapiens
aaatgagtgatctcaaat

SEQ ID NO: 4180679 - DNA, 18 bp, Homo sapiens
aaatgatgttatagaatt

SEQ ID NO: 4180680 - DNA, 15 bp, Homo sapiens
aaatgattgtaaaat

SEQ ID NO: 4180681 - DNA, 22 bp, Homo sapiens
aaatgattgtaaaatagcttgt

SEQ ID NO: 4180682 - DNA, 14 bp, Homo sapiens
aaatgattgtagta

SEQ ID NO: 4180683 - DNA, 22 bp, Homo sapiens
aaatgccatgatgcctctgtct

SEQ ID NO: 4180684 - DNA, 13 bp, Homo sapiens
aaatgctgcttct

SEQ ID NO: 4180685 - DNA, 16 bp, Homo sapiens
aaatgctgcttctcct

SEQ ID NO: 4180686 - DNA, 20 bp, Homo sapiens
aaatgctgcttctcctccca

SEQ ID NO: 4180687 - DNA, 15 bp, Homo sapiens
aaatggaaatgtaat

SEQ ID NO: 4180688 - DNA, 21 bp, Homo sapiens
aaatggactatacatactata

SEQ ID NO: 4180689 - DNA, 21 bp, Homo sapiens
aaatggctttaatcaattcta

SEQ ID NO: 4180690 - DNA, 22 bp, Homo sapiens
aaatgggttggtgcttctaacc

SEQ ID NO: 4180691 - DNA, 13 bp, Homo sapiens
aaatgtaaagcca

SEQ ID NO: 4180692 - DNA, 19 bp, Homo sapiens
aaatgtaataataatgaat

SEQ ID NO: 4180693 - DNA, 16 bp, Homo sapiens
aaatgtcatcaaatat

SEQ ID NO: 4180694 - DNA, 17 bp, Homo sapiens
aaatgtcatcaaatatt

SEQ ID NO: 4180695 - DNA, 21 bp, Homo sapiens
aaatgtctatagagaaaaact

SEQ ID NO: 4180696 - DNA, 22 bp, Homo sapiens
aaatgttaatgagaaaatggct

SEQ ID NO: 4180697 - DNA, 23 bp, Homo sapiens
aaatgttgatcttccactgcaaa

SEQ ID NO: 4180698 - DNA, 13 bp, Homo sapiens
aaattagagaaat

SEQ ID NO: 4180699 - DNA, 14 bp, Homo sapiens
aaattagtaattgt

SEQ ID NO: 4180700 - DNA, 13 bp, Homo sapiens
aaattatatattt

SEQ ID NO: 4180701 - DNA, 15 bp, Homo sapiens
aaattatatatttat

SEQ ID NO: 4180702 - DNA, 22 bp, Homo sapiens
aaattatatatttattttattc

SEQ ID NO: 4180703 - DNA, 12 bp, Homo sapiens
aaattatttaaa

SEQ ID NO: 4180704 - DNA, 13 bp, Homo sapiens
aaattatttaaac

SEQ ID NO: 4180705 - DNA, 22 bp, Homo sapiens
aaattattttatcacaaactta

SEQ ID NO: 4180706 - DNA, 20 bp, Homo sapiens
aaattcctaataagtttgat

SEQ ID NO: 4180707 - DNA, 14 bp, Homo sapiens
aaattctgatacat

SEQ ID NO: 4180708 - DNA, 15 bp, Homo sapiens
aaattctgatacatt

SEQ ID NO: 4180709 - DNA, 11 bp, Homo sapiens
aaattcttttt

SEQ ID NO: 4180710 - DNA, 17 bp, Homo sapiens
aaattgaatacacaaat

SEQ ID NO: 4180711 - DNA, 22 bp, Homo sapiens
aaattgctcctaagcttcaaat

SEQ ID NO: 4180712 - DNA, 17 bp, Homo sapiens
aaattggtgggaagcaa

SEQ ID NO: 4180713 - DNA, 16 bp, Homo sapiens
aaattgtatttttgta

SEQ ID NO: 4180714 - DNA, 12 bp, Homo sapiens
aaattgtgtttg

SEQ ID NO: 4180715 - DNA, 19 bp, Homo sapiens
aaatttaaactataagcaa

SEQ ID NO: 4180716 - DNA, 14 bp, Homo sapiens
aaatttatataaaa

SEQ ID NO: 4180717 - DNA, 23 bp, Homo sapiens
aaatttccattcccaaaataact

SEQ ID NO: 4180718 - DNA, 14 bp, Homo sapiens
aaattttctagact

SEQ ID NO: 4180719 - DNA, 12 bp, Homo sapiens
aaattttgaatg

SEQ ID NO: 4180720 - DNA, 14 bp, Homo sapiens
aaatttttcctgca

SEQ ID NO: 4180721 - DNA, 13 bp, Homo sapiens
aacaaaacaacaa

SEQ ID NO: 4180722 - DNA, 17 bp, Homo sapiens
aacaaaactgcatttca

SEQ ID NO: 4180723 - DNA, 20 bp, Homo sapiens
aacaaagaaataaaatcctg

SEQ ID NO: 4180724 - DNA, 23 bp, Homo sapiens
aacaaagagttcaagaaataagt

SEQ ID NO: 4180725 - DNA, 22 bp, Homo sapiens
aacaaatacattcataaggaaa

SEQ ID NO: 4180726 - DNA, 13 bp, Homo sapiens
aacaacaaacttg

SEQ ID NO: 4180727 - DNA, 14 bp, Homo sapiens
aacaacaacaacaa

SEQ ID NO: 4180728 - DNA, 16 bp, Homo sapiens
aacaacaacaataaca

SEQ ID NO: 4180729 - DNA, 14 bp, Homo sapiens
aacaacaacaatac

SEQ ID NO: 4180730 - DNA, 15 bp, Homo sapiens
aacaacaataacaac

SEQ ID NO: 4180731 - DNA, 20 bp, Homo sapiens
aacaacaatggtttacatga

SEQ ID NO: 4180732 - DNA, 21 bp, Homo sapiens
aacaagaggtgctagctctta

SEQ ID NO: 4180733 - DNA, 20 bp, Homo sapiens
aacaagaggttagaaatact

SEQ ID NO: 4180734 - DNA, 17 bp, Homo sapiens
aacaagatctttcagga

SEQ ID NO: 4180735 - DNA, 19 bp, Homo sapiens
aacaagatctttcaggaaa

SEQ ID NO: 4180736 - DNA, 12 bp, Homo sapiens
aacaataacaac

SEQ ID NO: 4180737 - DNA, 19 bp, Homo sapiens
aacaataatatttcaagtg

SEQ ID NO: 4180738 - DNA, 13 bp, Homo sapiens
aacaatacaacaa

SEQ ID NO: 4180739 - DNA, 14 bp, Homo sapiens
aacaatacaacaag

SEQ ID NO: 4180740 - DNA, 15 bp, Homo sapiens
aacaatacaacaaga

SEQ ID NO: 4180741 - DNA, 18 bp, Homo sapiens
aacaatacaacaagaaca

SEQ ID NO: 4180742 - DNA, 20 bp, Homo sapiens
aacaatttcctttatattta

SEQ ID NO: 4180743 - DNA, 22 bp, Homo sapiens
aacaatttcctttatatttagt

SEQ ID NO: 4180744 - DNA, 18 bp, Homo sapiens
aacaattttaaataagat

SEQ ID NO: 4180745 - DNA, 16 bp, Homo sapiens
aacacaaagacacagg

SEQ ID NO: 4180746 - DNA, 16 bp, Homo sapiens
aacacaaagacatgga

SEQ ID NO: 4180747 - DNA, 16 bp, Homo sapiens
aacacaagtcctgtga

SEQ ID NO: 4180748 - DNA, 14 bp, Homo sapiens
aacacagctgctga

SEQ ID NO: 4180749 - DNA, 16 bp, Homo sapiens
aacaccaggactttaa

SEQ ID NO: 4180750 - DNA, 12 bp, Homo sapiens
aacaccagtgag

SEQ ID NO: 4180751 - DNA, 18 bp, Homo sapiens
aacacggcagctgtagct

SEQ ID NO: 4180752 - DNA, 19 bp, Homo sapiens
aacactaaacagactattt

SEQ ID NO: 4180753 - DNA, 16 bp, Homo sapiens
aacactcaacaataaa

SEQ ID NO: 4180754 - DNA, 15 bp, Homo sapiens
aacacttaggaagaa

SEQ ID NO: 4180755 - DNA, 23 bp, Homo sapiens
aacagaaaaatatgtaccaagaa

SEQ ID NO: 4180756 - DNA, 16 bp, Homo sapiens
aacagaagaggaggga

SEQ ID NO: 4180757 - DNA, 13 bp, Homo sapiens
aacagagagaacc

SEQ ID NO: 4180758 - DNA, 17 bp, Homo sapiens
aacagatatcagtgtct

SEQ ID NO: 4180759 - DNA, 19 bp, Homo sapiens
aacagcctgggtaggaaaa

SEQ ID NO: 4180760 - DNA, 23 bp, Homo sapiens
aacagctcttcactcagccacac

SEQ ID NO: 4180761 - DNA, 20 bp, Homo sapiens
aacaggaccacaaaaatgaa

SEQ ID NO: 4180762 - DNA, 14 bp, Homo sapiens
aacaggctggttct

SEQ ID NO: 4180763 - DNA, 19 bp, Homo sapiens
aacaggtggcaggaccagg

SEQ ID NO: 4180764 - DNA, 23 bp, Homo sapiens
aacaggtggcaggaccaggacta

SEQ ID NO: 4180765 - DNA, 16 bp, Homo sapiens
aacagtgaagacagaa

SEQ ID NO: 4180766 - DNA, 16 bp, Homo sapiens
aacatagacagaagaa

SEQ ID NO: 4180767 - DNA, 19 bp, Homo sapiens
aacatagacagaagaaaca

SEQ ID NO: 4180768 - DNA, 13 bp, Homo sapiens
aacatatcatttt

SEQ ID NO: 4180769 - DNA, 22 bp, Homo sapiens
aacatctattataaaaccatgt

SEQ ID NO: 4180770 - DNA, 13 bp, Homo sapiens
aacatctcacttt

SEQ ID NO: 4180771 - DNA, 16 bp, Homo sapiens
aacatggaagatattc

SEQ ID NO: 4180772 - DNA, 18 bp, Homo sapiens
aacatggaatttaattta

SEQ ID NO: 4180773 - DNA, 20 bp, Homo sapiens
aacatgtttacttttcaggg

SEQ ID NO: 4180774 - DNA, 19 bp, Homo sapiens
aacattggagctgactgtt

SEQ ID NO: 4180775 - DNA, 19 bp, Homo sapiens
aacatttattttgacataa

SEQ ID NO: 4180776 - DNA, 12 bp, Homo sapiens
aaccaaagccag

SEQ ID NO: 4180777 - DNA, 15 bp, Homo sapiens
aaccacacttcttga

SEQ ID NO: 4180778 - DNA, 17 bp, Homo sapiens
aaccacacttcttgaaa

SEQ ID NO: 4180779 - DNA, 12 bp, Homo sapiens
aaccacagaaca

SEQ ID NO: 4180780 - DNA, 20 bp, Homo sapiens
aaccacagaacagtttgtga

SEQ ID NO: 4180781 - DNA, 19 bp, Homo sapiens
aaccacctaatcaggctga

SEQ ID NO: 4180782 - DNA, 13 bp, Homo sapiens
aaccacctgggtt

SEQ ID NO: 4180783 - DNA, 19 bp, Homo sapiens
aaccactcctcaggaacag

SEQ ID NO: 4180784 - DNA, 20 bp, Homo sapiens
aaccactcctcaggaacaga

SEQ ID NO: 4180785 - DNA, 17 bp, Homo sapiens
aaccagtgaagtgccac

SEQ ID NO: 4180786 - DNA, 17 bp, Homo sapiens
aaccattaaccagatct

SEQ ID NO: 4180787 - DNA, 13 bp, Homo sapiens
aaccattaagaaa

SEQ ID NO: 4180788 - DNA, 22 bp, Homo sapiens
aaccattatttaataagagtaa

SEQ ID NO: 4180789 - DNA, 14 bp, Homo sapiens
aaccatttcaaatg

SEQ ID NO: 4180790 - DNA, 21 bp, Homo sapiens
aaccattttagttcctttatt

SEQ ID NO: 4180791 - DNA, 14 bp, Homo sapiens
aacccagctctcag

SEQ ID NO: 4180792 - DNA, 15 bp, Homo sapiens
aacccccgctccaga

SEQ ID NO: 4180793 - DNA, 10 bp, Homo sapiens
aacccctgtg

SEQ ID NO: 4180794 - DNA, 16 bp, Homo sapiens
aaccctgctttttgac

SEQ ID NO: 4180795 - DNA, 15 bp, Homo sapiens
aaccctgttttatac

SEQ ID NO: 4180796 - DNA, 22 bp, Homo sapiens
aaccctgttttatactgtactt

SEQ ID NO: 4180797 - DNA, 23 bp, Homo sapiens
aaccctgttttatactgtactta

SEQ ID NO: 4180798 - DNA, 21 bp, Homo sapiens
aacctaaatgatgttatagaa

SEQ ID NO: 4180799 - DNA, 16 bp, Homo sapiens
aacctagaacttcaaa

SEQ ID NO: 4180800 - DNA, 18 bp, Homo sapiens
aacctcagtaatttagaa

SEQ ID NO: 4180801 - DNA, 22 bp, Homo sapiens
aacctgaggatgcaacaaatat

SEQ ID NO: 4180802 - DNA, 13 bp, Homo sapiens
aacctgatgagca

SEQ ID NO: 4180803 - DNA, 19 bp, Homo sapiens
aacctgcctgtgcatgacc

SEQ ID NO: 4180804 - DNA, 15 bp, Homo sapiens
aacctggagatgatg

SEQ ID NO: 4180805 - DNA, 16 bp, Homo sapiens
aacctggagatgatga

SEQ ID NO: 4180806 - DNA, 18 bp, Homo sapiens
aacctggagatgatgatg

SEQ ID NO: 4180807 - DNA, 10 bp, Homo sapiens
aacctggctt

SEQ ID NO: 4180808 - DNA, 15 bp, Homo sapiens
aacctggttcatatt

SEQ ID NO: 4180809 - DNA, 20 bp, Homo sapiens
aaccttaagataatggataa

SEQ ID NO: 4180810 - DNA, 16 bp, Homo sapiens
aacctttcttcaccaa

SEQ ID NO: 4180811 - DNA, 17 bp, Homo sapiens
aacgaatgtttcaaatc

SEQ ID NO: 4180812 - DNA, 23 bp, Homo sapiens
aacggtgcatccacgcacacatg

SEQ ID NO: 4180813 - DNA, 18 bp, Homo sapiens
aacgtaatgattatatga

SEQ ID NO: 4180814 - DNA, 19 bp, Homo sapiens
aacgtgggtatttcctgct

SEQ ID NO: 4180815 - DNA, 19 bp, Homo sapiens
aacgttggtatgataatga

SEQ ID NO: 4180816 - DNA, 21 bp, Homo sapiens
aacgttggtatgataatgata

SEQ ID NO: 4180817 - DNA, 16 bp, Homo sapiens
aactagaaatctgcca

SEQ ID NO: 4180818 - DNA, 20 bp, Homo sapiens
aactagagatgactgagtcc

SEQ ID NO: 4180819 - DNA, 21 bp, Homo sapiens
aactagaggtgagaaatttaa

SEQ ID NO: 4180820 - DNA, 13 bp, Homo sapiens
aactaggtttaaa

SEQ ID NO: 4180821 - DNA, 22 bp, Homo sapiens
aactaggtttaaaacagcctgg

SEQ ID NO: 4180822 - DNA, 14 bp, Homo sapiens
aactagtatctctg

SEQ ID NO: 4180823 - DNA, 18 bp, Homo sapiens
aactatttgtctttcagg

SEQ ID NO: 4180824 - DNA, 16 bp, Homo sapiens
aactattttcagatgt

SEQ ID NO: 4180825 - DNA, 22 bp, Homo sapiens
aactcccagcaacacaagctgg

SEQ ID NO: 4180826 - DNA, 17 bp, Homo sapiens
aactccgtgtgcctggg

SEQ ID NO: 4180827 - DNA, 20 bp, Homo sapiens
aactcctcccttttatcttc

SEQ ID NO: 4180828 - DNA, 15 bp, Homo sapiens
aactcgtatagcatg

SEQ ID NO: 4180829 - DNA, 12 bp, Homo sapiens
aactctccactc

SEQ ID NO: 4180830 - DNA, 20 bp, Homo sapiens
aactctgtgttgtgaatgtc

SEQ ID NO: 4180831 - DNA, 16 bp, Homo sapiens
aactcttcaaggtctg

SEQ ID NO: 4180832 - DNA, 15 bp, Homo sapiens
aactcttcactcttc

SEQ ID NO: 4180833 - DNA, 16 bp, Homo sapiens
aactcttccatttatt

SEQ ID NO: 4180834 - DNA, 20 bp, Homo sapiens
aactcttccatttattgcac

SEQ ID NO: 4180835 - DNA, 19 bp, Homo sapiens
aactgaaaatctaatatta

SEQ ID NO: 4180836 - DNA, 13 bp, Homo sapiens
aactgaaaattat

SEQ ID NO: 4180837 - DNA, 17 bp, Homo sapiens
aactgattacctgccaa

SEQ ID NO: 4180838 - DNA, 14 bp, Homo sapiens
aactgccccgggtg

SEQ ID NO: 4180839 - DNA, 13 bp, Homo sapiens
aactgctctgccc

SEQ ID NO: 4180840 - DNA, 18 bp, Homo sapiens
aactgctgatcaatgaaa

SEQ ID NO: 4180841 - DNA, 14 bp, Homo sapiens
aactggcaggcagg

SEQ ID NO: 4180842 - DNA, 20 bp, Homo sapiens
aactggggagttataaaaat

SEQ ID NO: 4180843 - DNA, 15 bp, Homo sapiens
aactgtgaaatacca

SEQ ID NO: 4180844 - DNA, 16 bp, Homo sapiens
aactgtgccctgcctt

SEQ ID NO: 4180845 - DNA, 20 bp, Homo sapiens
aactgttacaacttgtattt

SEQ ID NO: 4180846 - DNA, 13 bp, Homo sapiens
aacttaattttgt

SEQ ID NO: 4180847 - DNA, 20 bp, Homo sapiens
aacttagaattgaggagttg

SEQ ID NO: 4180848 - DNA, 13 bp, Homo sapiens
aacttatttgagt

SEQ ID NO: 4180849 - DNA, 16 bp, Homo sapiens
aacttcttaacgaaat

SEQ ID NO: 4180850 - DNA, 12 bp, Homo sapiens
aacttgaggaca

SEQ ID NO: 4180851 - DNA, 15 bp, Homo sapiens
aacttgaggacacat

SEQ ID NO: 4180852 - DNA, 18 bp, Homo sapiens
aacttgaggacacatgtc

SEQ ID NO: 4180853 - DNA, 19 bp, Homo sapiens
aacttgaggacacatgtcc

SEQ ID NO: 4180854 - DNA, 22 bp, Homo sapiens
aacttgagggtaataaacttag

SEQ ID NO: 4180855 - DNA, 18 bp, Homo sapiens
aacttggctgcaggaatc

SEQ ID NO: 4180856 - DNA, 20 bp, Homo sapiens
aacttggtcagagccactct

SEQ ID NO: 4180857 - DNA, 16 bp, Homo sapiens
aacttggttttgctac

SEQ ID NO: 4180858 - DNA, 21 bp, Homo sapiens
aacttggttttgctacataat

SEQ ID NO: 4180859 - DNA, 19 bp, Homo sapiens
aacttgtattttcttaata

SEQ ID NO: 4180860 - DNA, 19 bp, Homo sapiens
aactttaaagcgtttgcac

SEQ ID NO: 4180861 - DNA, 14 bp, Homo sapiens
aactttataaattc

SEQ ID NO: 4180862 - DNA, 13 bp, Homo sapiens
aactttcattttt

SEQ ID NO: 4180863 - DNA, 18 bp, Homo sapiens
aactttcggagcctgcct

SEQ ID NO: 4180864 - DNA, 18 bp, Homo sapiens
aactttctcactgctgtc

SEQ ID NO: 4180865 - DNA, 18 bp, Homo sapiens
aactttctcttcatactt

SEQ ID NO: 4180866 - DNA, 15 bp, Homo sapiens
aactttctgtaaact

SEQ ID NO: 4180867 - DNA, 15 bp, Homo sapiens
aactttgaagttagc

SEQ ID NO: 4180868 - DNA, 23 bp, Homo sapiens
aacttttttatttaaaaaactaa

SEQ ID NO: 4180869 - DNA, 20 bp, Homo sapiens
aagaaaaacaaactcgtttt

SEQ ID NO: 4180870 - DNA, 12 bp, Homo sapiens
aagaaaaccatt

SEQ ID NO: 4180871 - DNA, 16 bp, Homo sapiens
aagaaagaacggaaga

SEQ ID NO: 4180872 - DNA, 17 bp, Homo sapiens
aagaaagtgcagaatca

SEQ ID NO: 4180873 - DNA, 23 bp, Homo sapiens
aagaactgccccatctcctccca

SEQ ID NO: 4180874 - DNA, 12 bp, Homo sapiens
aagaagaaagca

SEQ ID NO: 4180875 - DNA, 14 bp, Homo sapiens
aagaagaggaggaa

SEQ ID NO: 4180876 - DNA, 15 bp, Homo sapiens
aagaagccctgctgg

SEQ ID NO: 4180877 - DNA, 21 bp, Homo sapiens
aagaagctttaatatttaaat

SEQ ID NO: 4180878 - DNA, 12 bp, Homo sapiens
aagaatacttct

SEQ ID NO: 4180879 - DNA, 15 bp, Homo sapiens
aagaatattcaaatg

SEQ ID NO: 4180880 - DNA, 17 bp, Homo sapiens
aagaatgggctgcagaa

SEQ ID NO: 4180881 - DNA, 22 bp, Homo sapiens
aagacacaaggtgatttcagac

SEQ ID NO: 4180882 - DNA, 18 bp, Homo sapiens
aagacagaagtttgcact

SEQ ID NO: 4180883 - DNA, 20 bp, Homo sapiens
aagacagagcctccacttag

SEQ ID NO: 4180884 - DNA, 21 bp, Homo sapiens
aagacagcactacagatatca

SEQ ID NO: 4180885 - DNA, 23 bp, Homo sapiens
aagacaggacagtgcttcagcct

SEQ ID NO: 4180886 - DNA, 22 bp, Homo sapiens
aagacatggaagattagaggtt

SEQ ID NO: 4180887 - DNA, 22 bp, Homo sapiens
aagacatggaaggttagaggtt

SEQ ID NO: 4180888 - DNA, 11 bp, Homo sapiens
aagacatttct

SEQ ID NO: 4180889 - DNA, 17 bp, Homo sapiens
aagaccaagtcctcaaa

SEQ ID NO: 4180890 - DNA, 21 bp, Homo sapiens
aagaccaataggtgcaaaaat

SEQ ID NO: 4180891 - DNA, 23 bp, Homo sapiens
aagaccaataggtgcaaaaataa

SEQ ID NO: 4180892 - DNA, 16 bp, Homo sapiens
aagaccctgtctcaaa

SEQ ID NO: 4180893 - DNA, 16 bp, Homo sapiens
aagactaatttaaaaa

SEQ ID NO: 4180894 - DNA, 19 bp, Homo sapiens
aagactaatttaaaaaata

SEQ ID NO: 4180895 - DNA, 22 bp, Homo sapiens
aagactatcttactatttcaca

SEQ ID NO: 4180896 - DNA, 15 bp, Homo sapiens
aagactgagcacctg

SEQ ID NO: 4180897 - DNA, 19 bp, Homo sapiens
aagactgagcacctgcttc

SEQ ID NO: 4180898 - DNA, 18 bp, Homo sapiens
aagacttggcaacagaag

SEQ ID NO: 4180899 - DNA, 20 bp, Homo sapiens
aagacttggcaacagaagca

SEQ ID NO: 4180900 - DNA, 18 bp, Homo sapiens
aagagaggcacctgctgg

SEQ ID NO: 4180901 - DNA, 20 bp, Homo sapiens
aagagatagcagaggaaaaa

SEQ ID NO: 4180902 - DNA, 18 bp, Homo sapiens
aagagatgtagcagaata

SEQ ID NO: 4180903 - DNA, 20 bp, Homo sapiens
aagagatgtagcagaataat

SEQ ID NO: 4180904 - DNA, 15 bp, Homo sapiens
aagagatttcaacat

SEQ ID NO: 4180905 - DNA, 14 bp, Homo sapiens
aagagcctggagaa

SEQ ID NO: 4180906 - DNA, 22 bp, Homo sapiens
aagaggagagaggaagctctct

SEQ ID NO: 4180907 - DNA, 15 bp, Homo sapiens
aagaggcaagagaca

SEQ ID NO: 4180908 - DNA, 22 bp, Homo sapiens
aagaggcatagagggagaggaa

SEQ ID NO: 4180909 - DNA, 18 bp, Homo sapiens
aagaggtgctagctctta

SEQ ID NO: 4180910 - DNA, 22 bp, Homo sapiens
aagaggttgggcttccatgcct

SEQ ID NO: 4180911 - DNA, 12 bp, Homo sapiens
aagagtaaaaat

SEQ ID NO: 4180912 - DNA, 23 bp, Homo sapiens
aagagtagcaagttctagagaag

SEQ ID NO: 4180913 - DNA, 16 bp, Homo sapiens
aagagtagttaaaagt

SEQ ID NO: 4180914 - DNA, 16 bp, Homo sapiens
aagagtgaatgtgtac

SEQ ID NO: 4180915 - DNA, 16 bp, Homo sapiens
aagagtgggctgcatc

SEQ ID NO: 4180916 - DNA, 19 bp, Homo sapiens
aagataacccttattccat

SEQ ID NO: 4180917 - DNA, 22 bp, Homo sapiens
aagataatggataatcttcggc

SEQ ID NO: 4180918 - DNA, 17 bp, Homo sapiens
aagataatgttatacat

SEQ ID NO: 4180919 - DNA, 15 bp, Homo sapiens
aagataattttatgt

SEQ ID NO: 4180920 - DNA, 20 bp, Homo sapiens
aagatacatagtaaatggta

SEQ ID NO: 4180921 - DNA, 23 bp, Homo sapiens
aagatacggttgcttcaccttgg

SEQ ID NO: 4180922 - DNA, 14 bp, Homo sapiens
aagatacttaagtg

SEQ ID NO: 4180923 - DNA, 21 bp, Homo sapiens
aagatatatacacaggatcct

SEQ ID NO: 4180924 - DNA, 16 bp, Homo sapiens
aagatcgaatttttca

SEQ ID NO: 4180925 - DNA, 13 bp, Homo sapiens
aagatctgaaagt

SEQ ID NO: 4180926 - DNA, 21 bp, Homo sapiens
aagatggagaataaattattg

SEQ ID NO: 4180927 - DNA, 12 bp, Homo sapiens
aagattaaagga

SEQ ID NO: 4180928 - DNA, 13 bp, Homo sapiens
aagattaaaggaa

SEQ ID NO: 4180929 - DNA, 16 bp, Homo sapiens
aagattaaaggaagga

SEQ ID NO: 4180930 - DNA, 17 bp, Homo sapiens
aagattaaaggaaggaa

SEQ ID NO: 4180931 - DNA, 21 bp, Homo sapiens
aagattaggtactatctgtga

SEQ ID NO: 4180932 - DNA, 14 bp, Homo sapiens
aagattgagaagcc

SEQ ID NO: 4180933 - DNA, 15 bp, Homo sapiens
aagatttagatgttt

SEQ ID NO: 4180934 - DNA, 18 bp, Homo sapiens
aagcaaaaagatgccttt

SEQ ID NO: 4180935 - DNA, 16 bp, Homo sapiens
aagcaaaagcaaggga

SEQ ID NO: 4180936 - DNA, 14 bp, Homo sapiens
aagcaaaaggctga

SEQ ID NO: 4180937 - DNA, 18 bp, Homo sapiens
aagcaaaaggctgagaag

SEQ ID NO: 4180938 - DNA, 21 bp, Homo sapiens
aagcaacaaagattgagaagc

SEQ ID NO: 4180939 - DNA, 19 bp, Homo sapiens
aagcaacataaaacaatga

SEQ ID NO: 4180940 - DNA, 18 bp, Homo sapiens
aagcaacctcagtaattt

SEQ ID NO: 4180941 - DNA, 19 bp, Homo sapiens
aagcaacctcagtaattta

SEQ ID NO: 4180942 - DNA, 21 bp, Homo sapiens
aagcaacctcagtaatttaga

SEQ ID NO: 4180943 - DNA, 20 bp, Homo sapiens
aagcaactccgtgtgcctgg

SEQ ID NO: 4180944 - DNA, 20 bp, Homo sapiens
aagcacactgcagggctgct

SEQ ID NO: 4180945 - DNA, 16 bp, Homo sapiens
aagcacagacattaaa

SEQ ID NO: 4180946 - DNA, 14 bp, Homo sapiens
aagcacctgaacca

SEQ ID NO: 4180947 - DNA, 21 bp, Homo sapiens
aagcacctgaaccactgtggc

SEQ ID NO: 4180948 - DNA, 16 bp, Homo sapiens
aagcaggaaggatggc

SEQ ID NO: 4180949 - DNA, 17 bp, Homo sapiens
aagcagggacacccccc

SEQ ID NO: 4180950 - DNA, 22 bp, Homo sapiens
aagcagggacaccccccgcccc

SEQ ID NO: 4180951 - DNA, 15 bp, Homo sapiens
aagcatggctatttt

SEQ ID NO: 4180952 - DNA, 17 bp, Homo sapiens
aagcatgtctcaatagt

SEQ ID NO: 4180953 - DNA, 12 bp, Homo sapiens
aagcattagcac

SEQ ID NO: 4180954 - DNA, 16 bp, Homo sapiens
aagcattctgagctgg

SEQ ID NO: 4180955 - DNA, 15 bp, Homo sapiens
aagccaaactctgcc

SEQ ID NO: 4180956 - DNA, 16 bp, Homo sapiens
aagccaaactctgcca

SEQ ID NO: 4180957 - DNA, 20 bp, Homo sapiens
aagccaaactctgccagcca

SEQ ID NO: 4180958 - DNA, 15 bp, Homo sapiens
aagccacaagaaatt

SEQ ID NO: 4180959 - DNA, 16 bp, Homo sapiens
aagccacaagaaattt

SEQ ID NO: 4180960 - DNA, 13 bp, Homo sapiens
aagccatgctgga

SEQ ID NO: 4180961 - DNA, 15 bp, Homo sapiens
aagccatgctggaaa

SEQ ID NO: 4180962 - DNA, 21 bp, Homo sapiens
aagccatgtactcaagtacca

SEQ ID NO: 4180963 - DNA, 16 bp, Homo sapiens
aagcccaacctcctga

SEQ ID NO: 4180964 - DNA, 13 bp, Homo sapiens
aagcctccttttt

SEQ ID NO: 4180965 - DNA, 22 bp, Homo sapiens
aagcctgactgctcggtcagga

SEQ ID NO: 4180966 - DNA, 22 bp, Homo sapiens
aagcctgcagcgagctgagatc

SEQ ID NO: 4180967 - DNA, 13 bp, Homo sapiens
aagcctgtataga

SEQ ID NO: 4180968 - DNA, 16 bp, Homo sapiens
aagccttactcacctc

SEQ ID NO: 4180969 - DNA, 18 bp, Homo sapiens
aagccttactcacctctc

SEQ ID NO: 4180970 - DNA, 10 bp, Homo sapiens
aagccttttt

SEQ ID NO: 4180971 - DNA, 13 bp, Homo sapiens
aagcgctcatctg

SEQ ID NO: 4180972 - DNA, 14 bp, Homo sapiens
aagcgggggcgtgg

SEQ ID NO: 4180973 - DNA, 19 bp, Homo sapiens
aagctagaattgagtgttt

SEQ ID NO: 4180974 - DNA, 19 bp, Homo sapiens
aagctatttctctggatct

SEQ ID NO: 4180975 - DNA, 17 bp, Homo sapiens
aagctcagctactgatt

SEQ ID NO: 4180976 - DNA, 23 bp, Homo sapiens
aagctcaggaggcgaataaatgt

SEQ ID NO: 4180977 - DNA, 20 bp, Homo sapiens
aagctcatattttgtatata

SEQ ID NO: 4180978 - DNA, 21 bp, Homo sapiens
aagctcatattttgtatatat

SEQ ID NO: 4180979 - DNA, 22 bp, Homo sapiens
aagctcatattttgtatatatc

SEQ ID NO: 4180980 - DNA, 22 bp, Homo sapiens
aagctgcctgtagttaggaaat

SEQ ID NO: 4180981 - DNA, 17 bp, Homo sapiens
aagctggacaagaagct

SEQ ID NO: 4180982 - DNA, 18 bp, Homo sapiens
aagctggacaagaagctg

SEQ ID NO: 4180983 - DNA, 17 bp, Homo sapiens
aagctggagggaggtgg

SEQ ID NO: 4180984 - DNA, 19 bp, Homo sapiens
aagctgggcatgaacgcac

SEQ ID NO: 4180985 - DNA, 17 bp, Homo sapiens
aagctggtaaactattt

SEQ ID NO: 4180986 - DNA, 16 bp, Homo sapiens
aagctggtttaatgtt

SEQ ID NO: 4180987 - DNA, 22 bp, Homo sapiens
aagctgtagtagccctttctgt

SEQ ID NO: 4180988 - DNA, 14 bp, Homo sapiens
aagcttaaaacttt

SEQ ID NO: 4180989 - DNA, 15 bp, Homo sapiens
aagcttaaaactttg

SEQ ID NO: 4180990 - DNA, 19 bp, Homo sapiens
aagcttaatggctgataat

SEQ ID NO: 4180991 - DNA, 14 bp, Homo sapiens
aagctttctccttt

SEQ ID NO: 4180992 - DNA, 16 bp, Homo sapiens
aagctttctcctttga

SEQ ID NO: 4180993 - DNA, 18 bp, Homo sapiens
aaggaaaactcttggcct

SEQ ID NO: 4180994 - DNA, 21 bp, Homo sapiens
aaggaaacttgaatcaaagca

SEQ ID NO: 4180995 - DNA, 15 bp, Homo sapiens
aaggaacactggaaa

SEQ ID NO: 4180996 - DNA, 21 bp, Homo sapiens
aaggaacactggaaaataaat

SEQ ID NO: 4180997 - DNA, 18 bp, Homo sapiens
aaggacaaagaaggaaat

SEQ ID NO: 4180998 - DNA, 13 bp, Homo sapiens
aaggacagaacat

SEQ ID NO: 4180999 - DNA, 21 bp, Homo sapiens
aaggactatgaaaagctagaa

SEQ ID NO: 4181000 - DNA, 22 bp, Homo sapiens
aaggagagcaagaaggaaagat

SEQ ID NO: 4181001 - DNA, 19 bp, Homo sapiens
aaggaggtgagggatgtga

SEQ ID NO: 4181002 - DNA, 20 bp, Homo sapiens
aaggagttccatgaagacca

SEQ ID NO: 4181003 - DNA, 19 bp, Homo sapiens
aaggatctctgaaacatat

SEQ ID NO: 4181004 - DNA, 13 bp, Homo sapiens
aaggcaaaaatag

SEQ ID NO: 4181005 - DNA, 21 bp, Homo sapiens
aaggcaaaaatagtttggata

SEQ ID NO: 4181006 - DNA, 13 bp, Homo sapiens
aaggcagagggga

SEQ ID NO: 4181007 - DNA, 16 bp, Homo sapiens
aaggcatgttcctctg

SEQ ID NO: 4181008 - DNA, 21 bp, Homo sapiens
aaggccaataaagagttagaa

SEQ ID NO: 4181009 - DNA, 20 bp, Homo sapiens
aaggctttgccatgggcctg

SEQ ID NO: 4181010 - DNA, 22 bp, Homo sapiens
aagggaaagaaattcttttcaa

SEQ ID NO: 4181011 - DNA, 18 bp, Homo sapiens
aagggctataagtagaaa

SEQ ID NO: 4181012 - DNA, 21 bp, Homo sapiens
aagggcttggtggccaagcct

SEQ ID NO: 4181013 - DNA, 14 bp, Homo sapiens
aaggggccctggtc

SEQ ID NO: 4181014 - DNA, 21 bp, Homo sapiens
aaggggccctggtccttccag

SEQ ID NO: 4181015 - DNA, 19 bp, Homo sapiens
aagggggagtttttagttt

SEQ ID NO: 4181016 - DNA, 15 bp, Homo sapiens
aaggtagagatgtgt

SEQ ID NO: 4181017 - DNA, 18 bp, Homo sapiens
aaggtagagatgtgtgtg

SEQ ID NO: 4181018 - DNA, 13 bp, Homo sapiens
aaggtcttcttgt

SEQ ID NO: 4181019 - DNA, 20 bp, Homo sapiens
aaggtcttcttgtgtcctga

SEQ ID NO: 4181020 - DNA, 23 bp, Homo sapiens
aaggtcttcttgtgtcctgatga

SEQ ID NO: 4181021 - DNA, 19 bp, Homo sapiens
aaggtgggctgagccctgg

SEQ ID NO: 4181022 - DNA, 18 bp, Homo sapiens
aaggttagaggtttgtca

SEQ ID NO: 4181023 - DNA, 16 bp, Homo sapiens
aaggttcttctaaaat

SEQ ID NO: 4181024 - DNA, 14 bp, Homo sapiens
aaggtttcaagact

SEQ ID NO: 4181025 - DNA, 19 bp, Homo sapiens
aagtagatcatggcagcat

SEQ ID NO: 4181026 - DNA, 15 bp, Homo sapiens
aagtaggaaggaaaa

SEQ ID NO: 4181027 - DNA, 20 bp, Homo sapiens
aagtagtttgtataacttct

SEQ ID NO: 4181028 - DNA, 17 bp, Homo sapiens
aagtatctaactcttct

SEQ ID NO: 4181029 - DNA, 12 bp, Homo sapiens
aagtatgtaaag

SEQ ID NO: 4181030 - DNA, 20 bp, Homo sapiens
aagtattaggggtaatatat

SEQ ID NO: 4181031 - DNA, 21 bp, Homo sapiens
aagtatttgttaatttagaaa

SEQ ID NO: 4181032 - DNA, 20 bp, Homo sapiens
aagtcagactgctgggactg

SEQ ID NO: 4181033 - DNA, 15 bp, Homo sapiens
aagtctaaagtttac

SEQ ID NO: 4181034 - DNA, 20 bp, Homo sapiens
aagtctaaagtttacagtaa

SEQ ID NO: 4181035 - DNA, 21 bp, Homo sapiens
aagtctaaagtttacagtaaa

SEQ ID NO: 4181036 - DNA, 16 bp, Homo sapiens
aagtctattgtttgtt

SEQ ID NO: 4181037 - DNA, 23 bp, Homo sapiens
aagtctgtgtgatgaactttctc

SEQ ID NO: 4181038 - DNA, 13 bp, Homo sapiens
aagtctgtttact

SEQ ID NO: 4181039 - DNA, 16 bp, Homo sapiens
aagtctgtttactgca

SEQ ID NO: 4181040 - DNA, 22 bp, Homo sapiens
aagtgagaagctgggcatgaac

SEQ ID NO: 4181041 - DNA, 18 bp, Homo sapiens
aagtgcctagactgttac

SEQ ID NO: 4181042 - DNA, 15 bp, Homo sapiens
aagtgggggcgggga

SEQ ID NO: 4181043 - DNA, 16 bp, Homo sapiens
aagtgtaatagattat

SEQ ID NO: 4181044 - DNA, 23 bp, Homo sapiens
aagtgtgtggaaggcagggacag

SEQ ID NO: 4181045 - DNA, 15 bp, Homo sapiens
aagtgttagatagaa

SEQ ID NO: 4181046 - DNA, 23 bp, Homo sapiens
aagtgttttgttctttctggagt

SEQ ID NO: 4181047 - DNA, 17 bp, Homo sapiens
aagttagagaatatatt

SEQ ID NO: 4181048 - DNA, 18 bp, Homo sapiens
aagttagagaatatattt

SEQ ID NO: 4181049 - DNA, 15 bp, Homo sapiens
aagttagctcaggag

SEQ ID NO: 4181050 - DNA, 21 bp, Homo sapiens
aagttatgtacgtatatataa

SEQ ID NO: 4181051 - DNA, 17 bp, Homo sapiens
aagttcctgcactccag

SEQ ID NO: 4181052 - DNA, 15 bp, Homo sapiens
aagttcgaaagaaaa

SEQ ID NO: 4181053 - DNA, 15 bp, Homo sapiens
aagttcttctccaat

SEQ ID NO: 4181054 - DNA, 21 bp, Homo sapiens
aagttggtcttatagaaagca

SEQ ID NO: 4181055 - DNA, 14 bp, Homo sapiens
aagtttaataaatt

SEQ ID NO: 4181056 - DNA, 17 bp, Homo sapiens
aagtttaataaatttat

SEQ ID NO: 4181057 - DNA, 18 bp, Homo sapiens
aagtttacaagtgtatat

SEQ ID NO: 4181058 - DNA, 21 bp, Homo sapiens
aagtttacaagtgtatatcag

SEQ ID NO: 4181059 - DNA, 15 bp, Homo sapiens
aagtttcatcatttt

SEQ ID NO: 4181060 - DNA, 17 bp, Homo sapiens
aagtttctggtgccatt

SEQ ID NO: 4181061 - DNA, 22 bp, Homo sapiens
aagtttctggtgccatttctga

SEQ ID NO: 4181062 - DNA, 15 bp, Homo sapiens
aagtttgatcaaatc

SEQ ID NO: 4181063 - DNA, 20 bp, Homo sapiens
aagtttgcactatctttcag

SEQ ID NO: 4181064 - DNA, 19 bp, Homo sapiens
aagtttggcaatagtttgc

SEQ ID NO: 4181065 - DNA, 11 bp, Homo sapiens
aagttttcagg

SEQ ID NO: 4181066 - DNA, 13 bp, Homo sapiens
aagttttgtacag

SEQ ID NO: 4181067 - DNA, 19 bp, Homo sapiens
aataaaaacttcagaaaaa

SEQ ID NO: 4181068 - DNA, 20 bp, Homo sapiens
aataaaaacttcagaaaaac

SEQ ID NO: 4181069 - DNA, 12 bp, Homo sapiens
aataaaaccttt

SEQ ID NO: 4181070 - DNA, 21 bp, Homo sapiens
aataaaacctttcaaatttca

SEQ ID NO: 4181071 - DNA, 13 bp, Homo sapiens
aataaacctggag

SEQ ID NO: 4181072 - DNA, 15 bp, Homo sapiens
aataaactctaaaca

SEQ ID NO: 4181073 - DNA, 21 bp, Homo sapiens
aataaacttagaataaaattg

SEQ ID NO: 4181074 - DNA, 18 bp, Homo sapiens
aataaagagttagaatga

SEQ ID NO: 4181075 - DNA, 13 bp, Homo sapiens
aataaagcaggga

SEQ ID NO: 4181076 - DNA, 12 bp, Homo sapiens
aataaagctgga

SEQ ID NO: 4181077 - DNA, 21 bp, Homo sapiens
aataaagctggacaagaagct

SEQ ID NO: 4181078 - DNA, 11 bp, Homo sapiens
aataaatgttc

SEQ ID NO: 4181079 - DNA, 13 bp, Homo sapiens
aataaattgtttg

SEQ ID NO: 4181080 - DNA, 20 bp, Homo sapiens
aataaatttattttcttgga

SEQ ID NO: 4181081 - DNA, 22 bp, Homo sapiens
aataactatcaactagcagaaa

SEQ ID NO: 4181082 - DNA, 16 bp, Homo sapiens
aataagagtaaaaata

SEQ ID NO: 4181083 - DNA, 11 bp, Homo sapiens
aataaggaaaa

SEQ ID NO: 4181084 - DNA, 17 bp, Homo sapiens
aataaggatttgttcac

SEQ ID NO: 4181085 - DNA, 14 bp, Homo sapiens
aataatacactaat

SEQ ID NO: 4181086 - DNA, 21 bp, Homo sapiens
aataatatgtgatgattaata

SEQ ID NO: 4181087 - DNA, 12 bp, Homo sapiens
aataatattgta

SEQ ID NO: 4181088 - DNA, 17 bp, Homo sapiens
aataatatttcaagtgc

SEQ ID NO: 4181089 - DNA, 16 bp, Homo sapiens
aataatgccttgtatg

SEQ ID NO: 4181090 - DNA, 12 bp, Homo sapiens
aataattttaaa

SEQ ID NO: 4181091 - DNA, 17 bp, Homo sapiens
aatacaacaagaacaac

SEQ ID NO: 4181092 - DNA, 21 bp, Homo sapiens
aatacataactagtttaatta

SEQ ID NO: 4181093 - DNA, 14 bp, Homo sapiens
aatacatcaaaaat

SEQ ID NO: 4181094 - DNA, 21 bp, Homo sapiens
aatacatgctaagagaagtag

SEQ ID NO: 4181095 - DNA, 22 bp, Homo sapiens
aataccagagccttcaagtgcc

SEQ ID NO: 4181096 - DNA, 16 bp, Homo sapiens
aatacctcatgggaca

SEQ ID NO: 4181097 - DNA, 16 bp, Homo sapiens
aatacgcactacatgt

SEQ ID NO: 4181098 - DNA, 22 bp, Homo sapiens
aatactttttacccaaatatgt

SEQ ID NO: 4181099 - DNA, 23 bp, Homo sapiens
aatactttttacccaaatatgtt

SEQ ID NO: 4181100 - DNA, 17 bp, Homo sapiens
aatagaaaactgaaaat

SEQ ID NO: 4181101 - DNA, 18 bp, Homo sapiens
aatagaaaactgaaaatc

SEQ ID NO: 4181102 - DNA, 23 bp, Homo sapiens
aatagactgaagagaccacagca

SEQ ID NO: 4181103 - DNA, 22 bp, Homo sapiens
aatagatgtttgatagattttc

SEQ ID NO: 4181104 - DNA, 13 bp, Homo sapiens
aatagcaaaagaa

SEQ ID NO: 4181105 - DNA, 19 bp, Homo sapiens
aatagcaaaagaagaagtt

SEQ ID NO: 4181106 - DNA, 20 bp, Homo sapiens
aatagcaaaagaagaagttt

SEQ ID NO: 4181107 - DNA, 15 bp, Homo sapiens
aatagcaaagaattg

SEQ ID NO: 4181108 - DNA, 11 bp, Homo sapiens
aatagcacagg

SEQ ID NO: 4181109 - DNA, 17 bp, Homo sapiens
aatagcgaatcatctca

SEQ ID NO: 4181110 - DNA, 19 bp, Homo sapiens
aatagctctttcagggggg

SEQ ID NO: 4181111 - DNA, 20 bp, Homo sapiens
aatagtatatgcatttttaa

SEQ ID NO: 4181112 - DNA, 19 bp, Homo sapiens
aatagtgcagaatctcata

SEQ ID NO: 4181113 - DNA, 16 bp, Homo sapiens
aatataaaaatgtgaa

SEQ ID NO: 4181114 - DNA, 20 bp, Homo sapiens
aatatatggaagataatttt

SEQ ID NO: 4181115 - DNA, 13 bp, Homo sapiens
aatatatttatga

SEQ ID NO: 4181116 - DNA, 14 bp, Homo sapiens
aatatcctaaacat

SEQ ID NO: 4181117 - DNA, 13 bp, Homo sapiens
aatatcctgcttg

SEQ ID NO: 4181118 - DNA, 10 bp, Homo sapiens
aatatgctta

SEQ ID NO: 4181119 - DNA, 18 bp, Homo sapiens
aatatggaacttctaata

SEQ ID NO: 4181120 - DNA, 21 bp, Homo sapiens
aatatggacttaaatgttaat

SEQ ID NO: 4181121 - DNA, 12 bp, Homo sapiens
aatatgtaccaa

SEQ ID NO: 4181122 - DNA, 14 bp, Homo sapiens
aatatgtagccttt

SEQ ID NO: 4181123 - DNA, 17 bp, Homo sapiens
aatatgtctgccacaga

SEQ ID NO: 4181124 - DNA, 17 bp, Homo sapiens
aatatgtgaaaatgatt

SEQ ID NO: 4181125 - DNA, 18 bp, Homo sapiens
aatatgtgaaaatgatta

SEQ ID NO: 4181126 - DNA, 22 bp, Homo sapiens
aatattaattataataaaggtc

SEQ ID NO: 4181127 - DNA, 22 bp, Homo sapiens
aatattaccaaaaaagtatttt

SEQ ID NO: 4181128 - DNA, 22 bp, Homo sapiens
aatattatgagatgctggcttg

SEQ ID NO: 4181129 - DNA, 14 bp, Homo sapiens
aatattcaataaag

SEQ ID NO: 4181130 - DNA, 16 bp, Homo sapiens
aatattcaataaagct

SEQ ID NO: 4181131 - DNA, 22 bp, Homo sapiens
aatattgaataagtattcttca

SEQ ID NO: 4181132 - DNA, 19 bp, Homo sapiens
aatattgttaccatgaaga

SEQ ID NO: 4181133 - DNA, 23 bp, Homo sapiens
aatatttcaagtgcctagactgt

SEQ ID NO: 4181134 - DNA, 11 bp, Homo sapiens
aatattttaaa

SEQ ID NO: 4181135 - DNA, 15 bp, Homo sapiens
aatattttctgggtt

SEQ ID NO: 4181136 - DNA, 11 bp, Homo sapiens
aatcaaagaaa

SEQ ID NO: 4181137 - DNA, 13 bp, Homo sapiens
aatcaaagaaaac

SEQ ID NO: 4181138 - DNA, 15 bp, Homo sapiens
aatcaacttgcttat

SEQ ID NO: 4181139 - DNA, 17 bp, Homo sapiens
aatcaagaatattcaaa

SEQ ID NO: 4181140 - DNA, 20 bp, Homo sapiens
aatcaagaatattcaaatgt

SEQ ID NO: 4181141 - DNA, 15 bp, Homo sapiens
aatcaagtctgttta

SEQ ID NO: 4181142 - DNA, 17 bp, Homo sapiens
aatcaagtctgtttact

SEQ ID NO: 4181143 - DNA, 16 bp, Homo sapiens
aatcaataaaaatctt

SEQ ID NO: 4181144 - DNA, 17 bp, Homo sapiens
aatcacgctttttgaaa

SEQ ID NO: 4181145 - DNA, 13 bp, Homo sapiens
aatcactatatct

SEQ ID NO: 4181146 - DNA, 13 bp, Homo sapiens
aatcactgctccc

SEQ ID NO: 4181147 - DNA, 15 bp, Homo sapiens
aatcagaaataggaa

SEQ ID NO: 4181148 - DNA, 17 bp, Homo sapiens
aatcagaaataggaaga

SEQ ID NO: 4181149 - DNA, 20 bp, Homo sapiens
aatcagactcttggggaagc

SEQ ID NO: 4181150 - DNA, 14 bp, Homo sapiens
aatcagagagccta

SEQ ID NO: 4181151 - DNA, 16 bp, Homo sapiens
aatcagagagcctaga

SEQ ID NO: 4181152 - DNA, 22 bp, Homo sapiens
aatcagagagcctagaacatcc

SEQ ID NO: 4181153 - DNA, 24 bp, Homo sapiens
aatcagtctcagaatgtcattttg

SEQ ID NO: 4181154 - DNA, 15 bp, Homo sapiens
aatcatctgtgtgaa

SEQ ID NO: 4181155 - DNA, 19 bp, Homo sapiens
aatcatgaatatttcaaaa

SEQ ID NO: 4181156 - DNA, 23 bp, Homo sapiens
aatcatgaatatttcaaaataaa

SEQ ID NO: 4181157 - DNA, 19 bp, Homo sapiens
aatcatgagtacctcaaag

SEQ ID NO: 4181158 - DNA, 20 bp, Homo sapiens
aatcattgtgcttaataata

SEQ ID NO: 4181159 - DNA, 20 bp, Homo sapiens
aatccacaaagccgtgcctt

SEQ ID NO: 4181160 - DNA, 19 bp, Homo sapiens
aatccatgttagtttttac

SEQ ID NO: 4181161 - DNA, 19 bp, Homo sapiens
aatcccaacacttttggga

SEQ ID NO: 4181162 - DNA, 18 bp, Homo sapiens
aatcctgagtctgggcaa

SEQ ID NO: 4181163 - DNA, 12 bp, Homo sapiens
aatcctgctgcc

SEQ ID NO: 4181164 - DNA, 17 bp, Homo sapiens
aatcctgctgccagaga

SEQ ID NO: 4181165 - DNA, 16 bp, Homo sapiens
aatcgagtctacctct

SEQ ID NO: 4181166 - DNA, 16 bp, Homo sapiens
aatctaatattaaaaa

SEQ ID NO: 4181167 - DNA, 19 bp, Homo sapiens
aatctaatattaaaaatat

SEQ ID NO: 4181168 - DNA, 20 bp, Homo sapiens
aatctaatattaaaaatatg

SEQ ID NO: 4181169 - DNA, 19 bp, Homo sapiens
aatctccagggctgcccct

SEQ ID NO: 4181170 - DNA, 21 bp, Homo sapiens
aatctccagggctgcccctgt

SEQ ID NO: 4181171 - DNA, 22 bp, Homo sapiens
aatctgagatctccctccaggg

SEQ ID NO: 4181172 - DNA, 23 bp, Homo sapiens
aatctgcagggagcaactctcca

SEQ ID NO: 4181173 - DNA, 17 bp, Homo sapiens
aatctgcattattggaa

SEQ ID NO: 4181174 - DNA, 21 bp, Homo sapiens
aatctggcttctggccaggaa

SEQ ID NO: 4181175 - DNA, 19 bp, Homo sapiens
aatcttaaggtgtagccac

SEQ ID NO: 4181176 - DNA, 15 bp, Homo sapiens
aatcttcggccaatt

SEQ ID NO: 4181177 - DNA, 19 bp, Homo sapiens
aatcttcggggtgtgatga

SEQ ID NO: 4181178 - DNA, 13 bp, Homo sapiens
aatcttggtttgc

SEQ ID NO: 4181179 - DNA, 21 bp, Homo sapiens
aatctttaaaagatgctttta

SEQ ID NO: 4181180 - DNA, 22 bp, Homo sapiens
aatctttcttttgattcttcct

SEQ ID NO: 4181181 - DNA, 17 bp, Homo sapiens
aatctttgattcagaca

SEQ ID NO: 4181182 - DNA, 16 bp, Homo sapiens
aatcttttataggatt

SEQ ID NO: 4181183 - DNA, 17 bp, Homo sapiens
aatgaaaactttttcac

SEQ ID NO: 4181184 - DNA, 23 bp, Homo sapiens
aatgaaacaaagagttcaagaaa

SEQ ID NO: 4181185 - DNA, 17 bp, Homo sapiens
aatgaaagcatgtctca

SEQ ID NO: 4181186 - DNA, 12 bp, Homo sapiens
aatgaacagaac

SEQ ID NO: 4181187 - DNA, 15 bp, Homo sapiens
aatgaacagaacata

SEQ ID NO: 4181188 - DNA, 17 bp, Homo sapiens
aatgaaggaaaacctca

SEQ ID NO: 4181189 - DNA, 16 bp, Homo sapiens
aatgaagttattcttg

SEQ ID NO: 4181190 - DNA, 15 bp, Homo sapiens
aatgacaacagaagc

SEQ ID NO: 4181191 - DNA, 16 bp, Homo sapiens
aatgacaacagaagct

SEQ ID NO: 4181192 - DNA, 21 bp, Homo sapiens
aatgacagaatgctgttttaa

SEQ ID NO: 4181193 - DNA, 21 bp, Homo sapiens
aatgacagccgctgatgtctg

SEQ ID NO: 4181194 - DNA, 14 bp, Homo sapiens
aatgagaacttcaa

SEQ ID NO: 4181195 - DNA, 17 bp, Homo sapiens
aatgagatcccgcctct

SEQ ID NO: 4181196 - DNA, 20 bp, Homo sapiens
aatgagggactggaaccagg

SEQ ID NO: 4181197 - DNA, 19 bp, Homo sapiens
aatgatcctgtattcagac

SEQ ID NO: 4181198 - DNA, 16 bp, Homo sapiens
aatgattatatgacaa

SEQ ID NO: 4181199 - DNA, 20 bp, Homo sapiens
aatgcaatataaaaatgtga

SEQ ID NO: 4181200 - DNA, 21 bp, Homo sapiens
aatgcaatataaaaatgtgaa

SEQ ID NO: 4181201 - DNA, 17 bp, Homo sapiens
aatgcacactagcctct

SEQ ID NO: 4181202 - DNA, 20 bp, Homo sapiens
aatgcatgtaaggtcttctt

SEQ ID NO: 4181203 - DNA, 14 bp, Homo sapiens
aatgccaagcactt

SEQ ID NO: 4181204 - DNA, 13 bp, Homo sapiens
aatgccagatgtt

SEQ ID NO: 4181205 - DNA, 18 bp, Homo sapiens
aatgcccgtaatgcttag

SEQ ID NO: 4181206 - DNA, 18 bp, Homo sapiens
aatgccggttaaattcca

SEQ ID NO: 4181207 - DNA, 20 bp, Homo sapiens
aatgcctcaatgtgaccagg

SEQ ID NO: 4181208 - DNA, 17 bp, Homo sapiens
aatgccttgggagagat

SEQ ID NO: 4181209 - DNA, 14 bp, Homo sapiens
aatgctttttgaat

SEQ ID NO: 4181210 - DNA, 14 bp, Homo sapiens
aatggactatacat

SEQ ID NO: 4181211 - DNA, 21 bp, Homo sapiens
aatggagtgggagatcagcca

SEQ ID NO: 4181212 - DNA, 10 bp, Homo sapiens
aatggccatg

SEQ ID NO: 4181213 - DNA, 20 bp, Homo sapiens
aatggcctgccttgaagcca

SEQ ID NO: 4181214 - DNA, 16 bp, Homo sapiens
aatggctaattcccag

SEQ ID NO: 4181215 - DNA, 17 bp, Homo sapiens
aatggctgataatttta

SEQ ID NO: 4181216 - DNA, 16 bp, Homo sapiens
aatggggcttgccctg

SEQ ID NO: 4181217 - DNA, 21 bp, Homo sapiens
aatggggcttgccctgggtca

SEQ ID NO: 4181218 - DNA, 21 bp, Homo sapiens
aatggtactctaatcagtcct

SEQ ID NO: 4181219 - DNA, 15 bp, Homo sapiens
aatggtatgagctga

SEQ ID NO: 4181220 - DNA, 18 bp, Homo sapiens
aatggtatgagctgaggg

SEQ ID NO: 4181221 - DNA, 13 bp, Homo sapiens
aatggtccagggt

SEQ ID NO: 4181222 - DNA, 16 bp, Homo sapiens
aatggtccagggttga

SEQ ID NO: 4181223 - DNA, 12 bp, Homo sapiens
aatggtggtttt

SEQ ID NO: 4181224 - DNA, 14 bp, Homo sapiens
aatgtaaagccatg

SEQ ID NO: 4181225 - DNA, 17 bp, Homo sapiens
aatgtaaatacatcaaa

SEQ ID NO: 4181226 - DNA, 20 bp, Homo sapiens
aatgtaataataatgaatgt

SEQ ID NO: 4181227 - DNA, 17 bp, Homo sapiens
aatgtagaatgattttt

SEQ ID NO: 4181228 - DNA, 21 bp, Homo sapiens
aatgtatttatatgttaattt

SEQ ID NO: 4181229 - DNA, 13 bp, Homo sapiens
aatgtcaaaatca

SEQ ID NO: 4181230 - DNA, 14 bp, Homo sapiens
aatgtcatcaaata

SEQ ID NO: 4181231 - DNA, 16 bp, Homo sapiens
aatgtctatagagaaa

SEQ ID NO: 4181232 - DNA, 12 bp, Homo sapiens
aatgtgattttt

SEQ ID NO: 4181233 - DNA, 12 bp, Homo sapiens
aatgttctttat

SEQ ID NO: 4181234 - DNA, 15 bp, Homo sapiens
aatgttgaaatatga

SEQ ID NO: 4181235 - DNA, 19 bp, Homo sapiens
aatgttgattacagtgcag

SEQ ID NO: 4181236 - DNA, 13 bp, Homo sapiens
aatgtttaaaaca

SEQ ID NO: 4181237 - DNA, 20 bp, Homo sapiens
aatgtttccaacctggagta

SEQ ID NO: 4181238 - DNA, 18 bp, Homo sapiens
aatgtttgggcagaaggg

SEQ ID NO: 4181239 - DNA, 14 bp, Homo sapiens
aattaaaaaccact

SEQ ID NO: 4181240 - DNA, 15 bp, Homo sapiens
aattaacatatcttt

SEQ ID NO: 4181241 - DNA, 23 bp, Homo sapiens
aattaagtgttgttcattatact

SEQ ID NO: 4181242 - DNA, 14 bp, Homo sapiens
aattaatgtgtgtc

SEQ ID NO: 4181243 - DNA, 12 bp, Homo sapiens
aattagaagcaa

SEQ ID NO: 4181244 - DNA, 12 bp, Homo sapiens
aattagccaaaa

SEQ ID NO: 4181245 - DNA, 17 bp, Homo sapiens
aattagtaattgtcaat

SEQ ID NO: 4181246 - DNA, 14 bp, Homo sapiens
aattataagatgtc

SEQ ID NO: 4181247 - DNA, 15 bp, Homo sapiens
aattataagatgtca

SEQ ID NO: 4181248 - DNA, 23 bp, Homo sapiens
aattattatgactcaataaaaga

SEQ ID NO: 4181249 - DNA, 22 bp, Homo sapiens
aattatttaaaccgctaaaaga

SEQ ID NO: 4181250 - DNA, 18 bp, Homo sapiens
aattattttaaacaaaat

SEQ ID NO: 4181251 - DNA, 18 bp, Homo sapiens
aattattttattgtctaa

SEQ ID NO: 4181252 - DNA, 13 bp, Homo sapiens
aattcaattcaaa

SEQ ID NO: 4181253 - DNA, 13 bp, Homo sapiens
aattcactcccac

SEQ ID NO: 4181254 - DNA, 12 bp, Homo sapiens
aattcagtaaca

SEQ ID NO: 4181255 - DNA, 16 bp, Homo sapiens
aattccaactcacttt

SEQ ID NO: 4181256 - DNA, 23 bp, Homo sapiens
aattccaaggagttccatgaaga

SEQ ID NO: 4181257 - DNA, 14 bp, Homo sapiens
aattccactggact

SEQ ID NO: 4181258 - DNA, 16 bp, Homo sapiens
aattcctggcatgaca

SEQ ID NO: 4181259 - DNA, 21 bp, Homo sapiens
aattcctggcatgacactcta

SEQ ID NO: 4181260 - DNA, 18 bp, Homo sapiens
aattctacagcatacaga

SEQ ID NO: 4181261 - DNA, 14 bp, Homo sapiens
aattctacaggatg

SEQ ID NO: 4181262 - DNA, 16 bp, Homo sapiens
aattctacaggatggg

SEQ ID NO: 4181263 - DNA, 13 bp, Homo sapiens
aattctagaaaat

SEQ ID NO: 4181264 - DNA, 14 bp, Homo sapiens
aattctgatacatt

SEQ ID NO: 4181265 - DNA, 16 bp, Homo sapiens
aattgaacatgcaatt

SEQ ID NO: 4181266 - DNA, 20 bp, Homo sapiens
aattgaagagatttcaacat

SEQ ID NO: 4181267 - DNA, 18 bp, Homo sapiens
aattgaatgcaaaccata

SEQ ID NO: 4181268 - DNA, 15 bp, Homo sapiens
aattgactcaaatct

SEQ ID NO: 4181269 - DNA, 18 bp, Homo sapiens
aattgagtgtttaaagtt

SEQ ID NO: 4181270 - DNA, 21 bp, Homo sapiens
aattgatcataggtatttcaa

SEQ ID NO: 4181271 - DNA, 22 bp, Homo sapiens
aattgatcataggtatttcaaa

SEQ ID NO: 4181272 - DNA, 22 bp, Homo sapiens
aattgcacgcggagtgagtttt

SEQ ID NO: 4181273 - DNA, 20 bp, Homo sapiens
aattgctcctaagcttcaaa

SEQ ID NO: 4181274 - DNA, 20 bp, Homo sapiens
aattgctttgccaaaatacc

SEQ ID NO: 4181275 - DNA, 18 bp, Homo sapiens
aattggaatttaaaaata

SEQ ID NO: 4181276 - DNA, 22 bp, Homo sapiens
aattggcttattttttaaaata

SEQ ID NO: 4181277 - DNA, 16 bp, Homo sapiens
aattgtagacagcctt

SEQ ID NO: 4181278 - DNA, 18 bp, Homo sapiens
aattgtagatggaaatca

SEQ ID NO: 4181279 - DNA, 15 bp, Homo sapiens
aattgtatagagata

SEQ ID NO: 4181280 - DNA, 18 bp, Homo sapiens
aattgtatcatttgaaca

SEQ ID NO: 4181281 - DNA, 24 bp, Homo sapiens
aattgtatcatttgaacaactagg

SEQ ID NO: 4181282 - DNA, 23 bp, Homo sapiens
aattgtattttttgttgaaagta

SEQ ID NO: 4181283 - DNA, 16 bp, Homo sapiens
aattgtccatgtgctt

SEQ ID NO: 4181284 - DNA, 13 bp, Homo sapiens
aatttaatttatg

SEQ ID NO: 4181285 - DNA, 16 bp, Homo sapiens
aatttagaaaacttta

SEQ ID NO: 4181286 - DNA, 14 bp, Homo sapiens
aatttagtttcata

SEQ ID NO: 4181287 - DNA, 22 bp, Homo sapiens
aatttagtttcatataaagtat

SEQ ID NO: 4181288 - DNA, 16 bp, Homo sapiens
aatttattattgttct

SEQ ID NO: 4181289 - DNA, 20 bp, Homo sapiens
aatttattgtctgtctacat

SEQ ID NO: 4181290 - DNA, 16 bp, Homo sapiens
aatttcctttatattt

SEQ ID NO: 4181291 - DNA, 15 bp, Homo sapiens
aatttctattgtgtt

SEQ ID NO: 4181292 - DNA, 22 bp, Homo sapiens
aatttgatgcccagataatata

SEQ ID NO: 4181293 - DNA, 15 bp, Homo sapiens
aatttgatttctatt

SEQ ID NO: 4181294 - DNA, 15 bp, Homo sapiens
aatttgtaagtttat

SEQ ID NO: 4181295 - DNA, 17 bp, Homo sapiens
aatttgtatctgaagga

SEQ ID NO: 4181296 - DNA, 19 bp, Homo sapiens
aattttatgtgttatagta

SEQ ID NO: 4181297 - DNA, 19 bp, Homo sapiens
aatttttaaacaagtattt

SEQ ID NO: 4181298 - DNA, 15 bp, Homo sapiens
aatttttatttttga

SEQ ID NO: 4181299 - DNA, 20 bp, Homo sapiens
aattttttcatgcacactgt

SEQ ID NO: 4181300 - DNA, 17 bp, Homo sapiens
aatttttttgaaaaaag

SEQ ID NO: 4181301 - DNA, 21 bp, Homo sapiens
aatttttttgtaaaggaaata

SEQ ID NO: 4181302 - DNA, 15 bp, Homo sapiens
acaaaaattgactca

SEQ ID NO: 4181303 - DNA, 18 bp, Homo sapiens
acaaaatagaagctgtag

SEQ ID NO: 4181304 - DNA, 13 bp, Homo sapiens
acaaaatggaagg

SEQ ID NO: 4181305 - DNA, 17 bp, Homo sapiens
acaaacacacacaaaag

SEQ ID NO: 4181306 - DNA, 20 bp, Homo sapiens
acaaactattacttacaaac

SEQ ID NO: 4181307 - DNA, 19 bp, Homo sapiens
acaaactgcggtatacatt

SEQ ID NO: 4181308 - DNA, 16 bp, Homo sapiens
acaaactgtaatacaa

SEQ ID NO: 4181309 - DNA, 12 bp, Homo sapiens
acaaagaacctt

SEQ ID NO: 4181310 - DNA, 12 bp, Homo sapiens
acaaagacatgg

SEQ ID NO: 4181311 - DNA, 16 bp, Homo sapiens
acaaagcccttttata

SEQ ID NO: 4181312 - DNA, 16 bp, Homo sapiens
acaaagggacacacag

SEQ ID NO: 4181313 - DNA, 22 bp, Homo sapiens
acaaatattgttaccatgaaga

SEQ ID NO: 4181314 - DNA, 20 bp, Homo sapiens
acaaatatttatatatttga

SEQ ID NO: 4181315 - DNA, 22 bp, Homo sapiens
acaaattatacataataaagtg

SEQ ID NO: 4181316 - DNA, 10 bp, Homo sapiens
acaacaaaaa

SEQ ID NO: 4181317 - DNA, 12 bp, Homo sapiens
acaacaacaata

SEQ ID NO: 4181318 - DNA, 15 bp, Homo sapiens
acaacaacaataaca

SEQ ID NO: 4181319 - DNA, 14 bp, Homo sapiens
acaacaacaataca

SEQ ID NO: 4181320 - DNA, 16 bp, Homo sapiens
acaacaacaatacaac

SEQ ID NO: 4181321 - DNA, 16 bp, Homo sapiens
acaacaagaacaacaa

SEQ ID NO: 4181322 - DNA, 19 bp, Homo sapiens
acaacaataacaacaatgg

SEQ ID NO: 4181323 - DNA, 21 bp, Homo sapiens
acaacagttgggctgtcaaca

SEQ ID NO: 4181324 - DNA, 13 bp, Homo sapiens
acaacatttattt

SEQ ID NO: 4181325 - DNA, 18 bp, Homo sapiens
acaaccctgttttatact

SEQ ID NO: 4181326 - DNA, 16 bp, Homo sapiens
acaactaggcttcagc

SEQ ID NO: 4181327 - DNA, 14 bp, Homo sapiens
acaactatttttgt

SEQ ID NO: 4181328 - DNA, 15 bp, Homo sapiens
acaacttgtatttcc

SEQ ID NO: 4181329 - DNA, 17 bp, Homo sapiens
acaacttgtatttccaa

SEQ ID NO: 4181330 - DNA, 18 bp, Homo sapiens
acaagaaatttgatttct

SEQ ID NO: 4181331 - DNA, 15 bp, Homo sapiens
acaagaagcattttg

SEQ ID NO: 4181332 - DNA, 17 bp, Homo sapiens
acaagaagcattttgta

SEQ ID NO: 4181333 - DNA, 13 bp, Homo sapiens
acaagagcccagc

SEQ ID NO: 4181334 - DNA, 20 bp, Homo sapiens
acaagagcccagcagggcct

SEQ ID NO: 4181335 - DNA, 20 bp, Homo sapiens
acaagaggtgctagctctta

SEQ ID NO: 4181336 - DNA, 13 bp, Homo sapiens
acaagatctttca

SEQ ID NO: 4181337 - DNA, 16 bp, Homo sapiens
acaagatctttcagga

SEQ ID NO: 4181338 - DNA, 20 bp, Homo sapiens
acaagatctttcaggaaaga

SEQ ID NO: 4181339 - DNA, 17 bp, Homo sapiens
acaagcaacataaaaca

SEQ ID NO: 4181340 - DNA, 14 bp, Homo sapiens
acaagccagaactt

SEQ ID NO: 4181341 - DNA, 16 bp, Homo sapiens
acaagctggaagcaca

SEQ ID NO: 4181342 - DNA, 18 bp, Homo sapiens
acaaggacaatgccttgg

SEQ ID NO: 4181343 - DNA, 19 bp, Homo sapiens
acaagtcctgtgaatttct

SEQ ID NO: 4181344 - DNA, 18 bp, Homo sapiens
acaagtgtatatcagaaa

SEQ ID NO: 4181345 - DNA, 19 bp, Homo sapiens
acaagtgtatatcagaaaa

SEQ ID NO: 4181346 - DNA, 13 bp, Homo sapiens
acaataacaacaa

SEQ ID NO: 4181347 - DNA, 18 bp, Homo sapiens
acaataataaatcctcag

SEQ ID NO: 4181348 - DNA, 20 bp, Homo sapiens
acaataatatttcaagtgcc

SEQ ID NO: 4181349 - DNA, 21 bp, Homo sapiens
acaataatatttcaagtgcct

SEQ ID NO: 4181350 - DNA, 17 bp, Homo sapiens
acaatacaacaagaaca

SEQ ID NO: 4181351 - DNA, 21 bp, Homo sapiens
acaatctaacaataatatttc

SEQ ID NO: 4181352 - DNA, 20 bp, Homo sapiens
acaatctggcttagtgccac

SEQ ID NO: 4181353 - DNA, 22 bp, Homo sapiens
acaatgatcctgtattcagaca

SEQ ID NO: 4181354 - DNA, 19 bp, Homo sapiens
acaatgccttgggagagat

SEQ ID NO: 4181355 - DNA, 17 bp, Homo sapiens
acaatggagtctgcagt

SEQ ID NO: 4181356 - DNA, 21 bp, Homo sapiens
acaatggtttacatgaacaca

SEQ ID NO: 4181357 - DNA, 21 bp, Homo sapiens
acaattattgtacactaacat

SEQ ID NO: 4181358 - DNA, 16 bp, Homo sapiens
acaattttaaataaga

SEQ ID NO: 4181359 - DNA, 17 bp, Homo sapiens
acaattttaaataagat

SEQ ID NO: 4181360 - DNA, 20 bp, Homo sapiens
acacaaagacacaggaagaa

SEQ ID NO: 4181361 - DNA, 13 bp, Homo sapiens
acacaaagacatg

SEQ ID NO: 4181362 - DNA, 15 bp, Homo sapiens
acacaagctggaagc

SEQ ID NO: 4181363 - DNA, 15 bp, Homo sapiens
acacaagtcctgtga

SEQ ID NO: 4181364 - DNA, 15 bp, Homo sapiens
acacacagtgacaaa

SEQ ID NO: 4181365 - DNA, 13 bp, Homo sapiens
acacactcagcag

SEQ ID NO: 4181366 - DNA, 17 bp, Homo sapiens
acacagctaggcatgcc

SEQ ID NO: 4181367 - DNA, 19 bp, Homo sapiens
acacagctaggcatgcctg

SEQ ID NO: 4181368 - DNA, 15 bp, Homo sapiens
acacaggctcagcat

SEQ ID NO: 4181369 - DNA, 19 bp, Homo sapiens
acacagtctcagtccagat

SEQ ID NO: 4181370 - DNA, 10 bp, Homo sapiens
acacagtgtt

SEQ ID NO: 4181371 - DNA, 16 bp, Homo sapiens
acacataactagaaac

SEQ ID NO: 4181372 - DNA, 19 bp, Homo sapiens
acacatactcatttttcat

SEQ ID NO: 4181373 - DNA, 17 bp, Homo sapiens
acacatccctaatgtgt

SEQ ID NO: 4181374 - DNA, 20 bp, Homo sapiens
acacatgcatcatcagccta

SEQ ID NO: 4181375 - DNA, 23 bp, Homo sapiens
acacattagatgttactgtgtga

SEQ ID NO: 4181376 - DNA, 14 bp, Homo sapiens
acaccaatcagaga

SEQ ID NO: 4181377 - DNA, 17 bp, Homo sapiens
acaccaggactttaatc

SEQ ID NO: 4181378 - DNA, 21 bp, Homo sapiens
acacccatgtaaatgtccaaa

SEQ ID NO: 4181379 - DNA, 19 bp, Homo sapiens
acaccccttatccaggact

SEQ ID NO: 4181380 - DNA, 17 bp, Homo sapiens
acacccgactcctcaaa

SEQ ID NO: 4181381 - DNA, 12 bp, Homo sapiens
acaccctctgcc

SEQ ID NO: 4181382 - DNA, 15 bp, Homo sapiens
acacctgacaaatgg

SEQ ID NO: 4181383 - DNA, 18 bp, Homo sapiens
acacctgacaaatggaag

SEQ ID NO: 4181384 - DNA, 18 bp, Homo sapiens
acacctgccctgccctgc

SEQ ID NO: 4181385 - DNA, 17 bp, Homo sapiens
acacctttgttttgcac

SEQ ID NO: 4181386 - DNA, 17 bp, Homo sapiens
acacggcagctgtagct

SEQ ID NO: 4181387 - DNA, 13 bp, Homo sapiens
acacgtatttata

SEQ ID NO: 4181388 - DNA, 20 bp, Homo sapiens
acactccaccccctccagct

SEQ ID NO: 4181389 - DNA, 16 bp, Homo sapiens
acactccagcctgagc

SEQ ID NO: 4181390 - DNA, 20 bp, Homo sapiens
acactctagtgacttcctgg

SEQ ID NO: 4181391 - DNA, 21 bp, Homo sapiens
acactgcctatatatgtaaat

SEQ ID NO: 4181392 - DNA, 12 bp, Homo sapiens
acactgggagaa

SEQ ID NO: 4181393 - DNA, 15 bp, Homo sapiens
acactgggagaagag

SEQ ID NO: 4181394 - DNA, 17 bp, Homo sapiens
acactgggagaagagaa

SEQ ID NO: 4181395 - DNA, 14 bp, Homo sapiens
acactggtgactgc

SEQ ID NO: 4181396 - DNA, 15 bp, Homo sapiens
acacttaagcagagc

SEQ ID NO: 4181397 - DNA, 14 bp, Homo sapiens
acacttatcttctg

SEQ ID NO: 4181398 - DNA, 15 bp, Homo sapiens
acacttatcttctgg

SEQ ID NO: 4181399 - DNA, 19 bp, Homo sapiens
acacttatcttctggatta

SEQ ID NO: 4181400 - DNA, 14 bp, Homo sapiens
acacttgtatgcta

SEQ ID NO: 4181401 - DNA, 20 bp, Homo sapiens
acacttttgggaggtccagg

SEQ ID NO: 4181402 - DNA, 13 bp, Homo sapiens
acagaacactaaa

SEQ ID NO: 4181403 - DNA, 21 bp, Homo sapiens
acagaacacttctaggactgg

SEQ ID NO: 4181404 - DNA, 22 bp, Homo sapiens
acagaagcagttgagtcgtcat

SEQ ID NO: 4181405 - DNA, 14 bp, Homo sapiens
acagaagcttcaga

SEQ ID NO: 4181406 - DNA, 19 bp, Homo sapiens
acagaagtccctaggaggg

SEQ ID NO: 4181407 - DNA, 20 bp, Homo sapiens
acagaagtccctaggaggga

SEQ ID NO: 4181408 - DNA, 17 bp, Homo sapiens
acagaagtttgcactat

SEQ ID NO: 4181409 - DNA, 22 bp, Homo sapiens
acagaattactgtaactgatta

SEQ ID NO: 4181410 - DNA, 18 bp, Homo sapiens
acagaattttatggtgca

SEQ ID NO: 4181411 - DNA, 15 bp, Homo sapiens
acagacatgagccac

SEQ ID NO: 4181412 - DNA, 17 bp, Homo sapiens
acagacattaaacctgg

SEQ ID NO: 4181413 - DNA, 10 bp, Homo sapiens
acagagagaa

SEQ ID NO: 4181414 - DNA, 11 bp, Homo sapiens
acagagagaac

SEQ ID NO: 4181415 - DNA, 22 bp, Homo sapiens
acagagatgcatgcgcaggctc

SEQ ID NO: 4181416 - DNA, 23 bp, Homo sapiens
acagagatgcatgcgcaggctca

SEQ ID NO: 4181417 - DNA, 13 bp, Homo sapiens
acagagcctggct

SEQ ID NO: 4181418 - DNA, 15 bp, Homo sapiens
acagagctggctgtc

SEQ ID NO: 4181419 - DNA, 23 bp, Homo sapiens
acagagggatggcgaatacctca

SEQ ID NO: 4181420 - DNA, 17 bp, Homo sapiens
acagatagacagtgctg

SEQ ID NO: 4181421 - DNA, 21 bp, Homo sapiens
acagatgtgtctgggagagcc

SEQ ID NO: 4181422 - DNA, 22 bp, Homo sapiens
acagatgtgtctgggagagcct

SEQ ID NO: 4181423 - DNA, 23 bp, Homo sapiens
acagatgtgtctgggagagcctg

SEQ ID NO: 4181424 - DNA, 12 bp, Homo sapiens
acagattccatt

SEQ ID NO: 4181425 - DNA, 23 bp, Homo sapiens
acagattccattaagagtgaatg

SEQ ID NO: 4181426 - DNA, 14 bp, Homo sapiens
acagcaaggaaaca

SEQ ID NO: 4181427 - DNA, 23 bp, Homo sapiens
acagccaaatgcatggtgcagtt

SEQ ID NO: 4181428 - DNA, 23 bp, Homo sapiens
acagccaacaggtggcaggacca

SEQ ID NO: 4181429 - DNA, 22 bp, Homo sapiens
acagccaccctgcccagtctgg

SEQ ID NO: 4181430 - DNA, 14 bp, Homo sapiens
acagcccagaacca

SEQ ID NO: 4181431 - DNA, 19 bp, Homo sapiens
acagcccagaaccacagat

SEQ ID NO: 4181432 - DNA, 13 bp, Homo sapiens
acagcccagccta

SEQ ID NO: 4181433 - DNA, 21 bp, Homo sapiens
acagccctgcctatcctctgt

SEQ ID NO: 4181434 - DNA, 13 bp, Homo sapiens
acagccgcagcct

SEQ ID NO: 4181435 - DNA, 22 bp, Homo sapiens
acagccgcagcctccctctgac

SEQ ID NO: 4181436 - DNA, 21 bp, Homo sapiens
acagcctgacaacatttctat

SEQ ID NO: 4181437 - DNA, 16 bp, Homo sapiens
acagcctggttttcac

SEQ ID NO: 4181438 - DNA, 19 bp, Homo sapiens
acagcgagaggcagagaaa

SEQ ID NO: 4181439 - DNA, 14 bp, Homo sapiens
acagcgcgggcgga

SEQ ID NO: 4181440 - DNA, 21 bp, Homo sapiens
acagcgcgggcggaggcggct

SEQ ID NO: 4181441 - DNA, 16 bp, Homo sapiens
acagcggggccccagg

SEQ ID NO: 4181442 - DNA, 15 bp, Homo sapiens
acagctgagagactt

SEQ ID NO: 4181443 - DNA, 14 bp, Homo sapiens
acagctgtttaaga

SEQ ID NO: 4181444 - DNA, 17 bp, Homo sapiens
acaggacagtgcttcag

SEQ ID NO: 4181445 - DNA, 20 bp, Homo sapiens
acaggacagtgcttcagcct

SEQ ID NO: 4181446 - DNA, 22 bp, Homo sapiens
acaggatcctattctcaccagg

SEQ ID NO: 4181447 - DNA, 20 bp, Homo sapiens
acaggatgtgtttgctttct

SEQ ID NO: 4181448 - DNA, 22 bp, Homo sapiens
acaggcagcgatggtctcagaa

SEQ ID NO: 4181449 - DNA, 13 bp, Homo sapiens
acaggctgagctt

SEQ ID NO: 4181450 - DNA, 20 bp, Homo sapiens
acagggaacattggagctga

SEQ ID NO: 4181451 - DNA, 14 bp, Homo sapiens
acagggtccctgga

SEQ ID NO: 4181452 - DNA, 17 bp, Homo sapiens
acagggtccctggatca

SEQ ID NO: 4181453 - DNA, 21 bp, Homo sapiens
acagggtgaataaagcaggga

SEQ ID NO: 4181454 - DNA, 17 bp, Homo sapiens
acaggtaagtggcagga

SEQ ID NO: 4181455 - DNA, 22 bp, Homo sapiens
acaggtgttggaagccaggact

SEQ ID NO: 4181456 - DNA, 14 bp, Homo sapiens
acagtaaataaatt

SEQ ID NO: 4181457 - DNA, 14 bp, Homo sapiens
acagtaacacatct

SEQ ID NO: 4181458 - DNA, 17 bp, Homo sapiens
acagtattctcagtgct

SEQ ID NO: 4181459 - DNA, 13 bp, Homo sapiens
acagtcaagatac

SEQ ID NO: 4181460 - DNA, 19 bp, Homo sapiens
acagtcctcacagcctctc

SEQ ID NO: 4181461 - DNA, 22 bp, Homo sapiens
acagtcctgggagaacctcagg

SEQ ID NO: 4181462 - DNA, 12 bp, Homo sapiens
acagtctaaagc

SEQ ID NO: 4181463 - DNA, 14 bp, Homo sapiens
acagtctaaagctg

SEQ ID NO: 4181464 - DNA, 15 bp, Homo sapiens
acagtctaaagctgg

SEQ ID NO: 4181465 - DNA, 17 bp, Homo sapiens
acagtctcagtccagat

SEQ ID NO: 4181466 - DNA, 19 bp, Homo sapiens
acagtctttctttctgaat

SEQ ID NO: 4181467 - DNA, 14 bp, Homo sapiens
acagtgaagacaga

SEQ ID NO: 4181468 - DNA, 18 bp, Homo sapiens
acagtgaagacagaagtt

SEQ ID NO: 4181469 - DNA, 19 bp, Homo sapiens
acagtgaagacagaagttt

SEQ ID NO: 4181470 - DNA, 15 bp, Homo sapiens
acagtgaatgtgtgt

SEQ ID NO: 4181471 - DNA, 19 bp, Homo sapiens
acagtgaatgtgtgtatgt

SEQ ID NO: 4181472 - DNA, 20 bp, Homo sapiens
acagtgaatgtgtgtatgta

SEQ ID NO: 4181473 - DNA, 12 bp, Homo sapiens
acagtgagccaa

SEQ ID NO: 4181474 - DNA, 14 bp, Homo sapiens
acagtgcagtgcgc

SEQ ID NO: 4181475 - DNA, 17 bp, Homo sapiens
acagtgcccagctaatt

SEQ ID NO: 4181476 - DNA, 18 bp, Homo sapiens
acagtgcccagctaattt

SEQ ID NO: 4181477 - DNA, 24 bp, Homo sapiens
acagtgctgccctgcgaagtggct

SEQ ID NO: 4181478 - DNA, 22 bp, Homo sapiens
acagtgcttcagcctgaggctg

SEQ ID NO: 4181479 - DNA, 22 bp, Homo sapiens
acagtggaggaaaatccatgga

SEQ ID NO: 4181480 - DNA, 15 bp, Homo sapiens
acagtgggtggtgga

SEQ ID NO: 4181481 - DNA, 21 bp, Homo sapiens
acagtgttccagctgcctggg

SEQ ID NO: 4181482 - DNA, 21 bp, Homo sapiens
acagttcagttcctctttgca

SEQ ID NO: 4181483 - DNA, 19 bp, Homo sapiens
acataaaaatgatctaaac

SEQ ID NO: 4181484 - DNA, 14 bp, Homo sapiens
acataaagcctctg

SEQ ID NO: 4181485 - DNA, 16 bp, Homo sapiens
acataactagtttaat

SEQ ID NO: 4181486 - DNA, 22 bp, Homo sapiens
acataatggaaaacatttacat

SEQ ID NO: 4181487 - DNA, 12 bp, Homo sapiens
acatactcattt

SEQ ID NO: 4181488 - DNA, 13 bp, Homo sapiens
acatactcatttt

SEQ ID NO: 4181489 - DNA, 17 bp, Homo sapiens
acatactcatttttcat

SEQ ID NO: 4181490 - DNA, 17 bp, Homo sapiens
acatagacagaagaaac

SEQ ID NO: 4181491 - DNA, 16 bp, Homo sapiens
acatcaactttatgta

SEQ ID NO: 4181492 - DNA, 21 bp, Homo sapiens
acatcattactataagaactt

SEQ ID NO: 4181493 - DNA, 22 bp, Homo sapiens
acatcattctacataatggaaa

SEQ ID NO: 4181494 - DNA, 18 bp, Homo sapiens
acatccatgtttgtaaaa

SEQ ID NO: 4181495 - DNA, 13 bp, Homo sapiens
acatccctgggca

SEQ ID NO: 4181496 - DNA, 18 bp, Homo sapiens
acatctaagcctgttgag

SEQ ID NO: 4181497 - DNA, 14 bp, Homo sapiens
acatctcactttgc

SEQ ID NO: 4181498 - DNA, 13 bp, Homo sapiens
acatctttaagta

SEQ ID NO: 4181499 - DNA, 15 bp, Homo sapiens
acatctttaagtatt

SEQ ID NO: 4181500 - DNA, 22 bp, Homo sapiens
acatgaaaaacacggcagctgt

SEQ ID NO: 4181501 - DNA, 23 bp, Homo sapiens
acatgaacacagctgctgaagag

SEQ ID NO: 4181502 - DNA, 14 bp, Homo sapiens
acatgacgtaaaat

SEQ ID NO: 4181503 - DNA, 16 bp, Homo sapiens
acatgacgtaaaattt

SEQ ID NO: 4181504 - DNA, 20 bp, Homo sapiens
acatgagaggactgatgaat

SEQ ID NO: 4181505 - DNA, 21 bp, Homo sapiens
acatgaggacatgatggagcg

SEQ ID NO: 4181506 - DNA, 19 bp, Homo sapiens
acatgatttagggaagcag

SEQ ID NO: 4181507 - DNA, 22 bp, Homo sapiens
acatgatttagggaagcaggga

SEQ ID NO: 4181508 - DNA, 21 bp, Homo sapiens
acatgcaatttattaaaatga

SEQ ID NO: 4181509 - DNA, 17 bp, Homo sapiens
acatgctaagagaagta

SEQ ID NO: 4181510 - DNA, 24 bp, Homo sapiens
acatgctaagagaagtagaaatca

SEQ ID NO: 4181511 - DNA, 15 bp, Homo sapiens
acatggaagatattc

SEQ ID NO: 4181512 - DNA, 17 bp, Homo sapiens
acatggaagattagagg

SEQ ID NO: 4181513 - DNA, 13 bp, Homo sapiens
acatggacacaga

SEQ ID NO: 4181514 - DNA, 17 bp, Homo sapiens
acatggctttgctttgt

SEQ ID NO: 4181515 - DNA, 22 bp, Homo sapiens
acatgtacatgcatttttctag

SEQ ID NO: 4181516 - DNA, 16 bp, Homo sapiens
acatgtctgtcctcag

SEQ ID NO: 4181517 - DNA, 22 bp, Homo sapiens
acatgtgttagtgtatgtgaat

SEQ ID NO: 4181518 - DNA, 14 bp, Homo sapiens
acatgttatatatt

SEQ ID NO: 4181519 - DNA, 13 bp, Homo sapiens
acattaacatcta

SEQ ID NO: 4181520 - DNA, 15 bp, Homo sapiens
acattagcagctatg

SEQ ID NO: 4181521 - DNA, 14 bp, Homo sapiens
acattcacagccca

SEQ ID NO: 4181522 - DNA, 23 bp, Homo sapiens
acattcacagcccagaaccacag

SEQ ID NO: 4181523 - DNA, 16 bp, Homo sapiens
acattcaggaagatga

SEQ ID NO: 4181524 - DNA, 16 bp, Homo sapiens
acattcataaggaaat

SEQ ID NO: 4181525 - DNA, 15 bp, Homo sapiens
acattccaactcgta

SEQ ID NO: 4181526 - DNA, 22 bp, Homo sapiens
acattgacagtggtgggcgggg

SEQ ID NO: 4181527 - DNA, 15 bp, Homo sapiens
acattggacttcctt

SEQ ID NO: 4181528 - DNA, 20 bp, Homo sapiens
acatttaagcaggaatgcaa

SEQ ID NO: 4181529 - DNA, 16 bp, Homo sapiens
acatttattttgacat

SEQ ID NO: 4181530 - DNA, 12 bp, Homo sapiens
acatttccctgt

SEQ ID NO: 4181531 - DNA, 20 bp, Homo sapiens
acatttctatagccaaaaat

SEQ ID NO: 4181532 - DNA, 14 bp, Homo sapiens
acatttctctaact

SEQ ID NO: 4181533 - DNA, 20 bp, Homo sapiens
acatttctctaactcctgcc

SEQ ID NO: 4181534 - DNA, 23 bp, Homo sapiens
acatttctctaactcctgccatt

SEQ ID NO: 4181535 - DNA, 17 bp, Homo sapiens
acatttgcaaaatggaa

SEQ ID NO: 4181536 - DNA, 22 bp, Homo sapiens
acatttgcaaaatggaaatgta

SEQ ID NO: 4181537 - DNA, 22 bp, Homo sapiens
acattttactgattaacaaata

SEQ ID NO: 4181538 - DNA, 21 bp, Homo sapiens
accaaaatttctttttttaaa

SEQ ID NO: 4181539 - DNA, 22 bp, Homo sapiens
accaaagatatatacacaggat

SEQ ID NO: 4181540 - DNA, 15 bp, Homo sapiens
accaaccaaccaacc

SEQ ID NO: 4181541 - DNA, 12 bp, Homo sapiens
accaactttctg

SEQ ID NO: 4181542 - DNA, 15 bp, Homo sapiens
accaagatacttaag

SEQ ID NO: 4181543 - DNA, 21 bp, Homo sapiens
accaagatacttaagtgctgc

SEQ ID NO: 4181544 - DNA, 15 bp, Homo sapiens
accaatcagagagcc

SEQ ID NO: 4181545 - DNA, 16 bp, Homo sapiens
accaatcagagagcct

SEQ ID NO: 4181546 - DNA, 20 bp, Homo sapiens
accaatgactttttatttta

SEQ ID NO: 4181547 - DNA, 14 bp, Homo sapiens
accacaaaaatgaa

SEQ ID NO: 4181548 - DNA, 20 bp, Homo sapiens
accacaactattttcagatg

SEQ ID NO: 4181549 - DNA, 16 bp, Homo sapiens
accacaagagatcagc

SEQ ID NO: 4181550 - DNA, 14 bp, Homo sapiens
accacacttcttga

SEQ ID NO: 4181551 - DNA, 18 bp, Homo sapiens
accacacttcttgaaaca

SEQ ID NO: 4181552 - DNA, 21 bp, Homo sapiens
accacagatgtgtctgggaga

SEQ ID NO: 4181553 - DNA, 22 bp, Homo sapiens
accacagatgtgtctgggagag

SEQ ID NO: 4181554 - DNA, 16 bp, Homo sapiens
accacatctacaattt

SEQ ID NO: 4181555 - DNA, 23 bp, Homo sapiens
accacctctcaatattcaataaa

SEQ ID NO: 4181556 - DNA, 12 bp, Homo sapiens
accacctgggtt

SEQ ID NO: 4181557 - DNA, 21 bp, Homo sapiens
accacctgggttcagcctctc

SEQ ID NO: 4181558 - DNA, 13 bp, Homo sapiens
accaccttccctc

SEQ ID NO: 4181559 - DNA, 18 bp, Homo sapiens
accaccttccctctttct

SEQ ID NO: 4181560 - DNA, 20 bp, Homo sapiens
accaccttggactcctccca

SEQ ID NO: 4181561 - DNA, 21 bp, Homo sapiens
accaccttggactcctcccac

SEQ ID NO: 4181562 - DNA, 19 bp, Homo sapiens
accactagggtcctggccc

SEQ ID NO: 4181563 - DNA, 12 bp, Homo sapiens
accactggccct

SEQ ID NO: 4181564 - DNA, 22 bp, Homo sapiens
accactgtggccttctcagcct

SEQ ID NO: 4181565 - DNA, 13 bp, Homo sapiens
accacttggctgc

SEQ ID NO: 4181566 - DNA, 13 bp, Homo sapiens
accagaacaaggt

SEQ ID NO: 4181567 - DNA, 21 bp, Homo sapiens
accagacccacctggagcccg

SEQ ID NO: 4181568 - DNA, 13 bp, Homo sapiens
accagagccttca

SEQ ID NO: 4181569 - DNA, 16 bp, Homo sapiens
accagagccttcaagt

SEQ ID NO: 4181570 - DNA, 21 bp, Homo sapiens
accagatagttatattaaatt

SEQ ID NO: 4181571 - DNA, 14 bp, Homo sapiens
accagatgcagctc

SEQ ID NO: 4181572 - DNA, 19 bp, Homo sapiens
accagccgtgagcatgttt

SEQ ID NO: 4181573 - DNA, 20 bp, Homo sapiens
accagcctgaccaacatggt

SEQ ID NO: 4181574 - DNA, 15 bp, Homo sapiens
accagcctgactgca

SEQ ID NO: 4181575 - DNA, 11 bp, Homo sapiens
accagcctggc

SEQ ID NO: 4181576 - DNA, 20 bp, Homo sapiens
accagcctggccaacatggt

SEQ ID NO: 4181577 - DNA, 17 bp, Homo sapiens
accagctgtaacacagc

SEQ ID NO: 4181578 - DNA, 18 bp, Homo sapiens
accagcttctccaggctc

SEQ ID NO: 4181579 - DNA, 21 bp, Homo sapiens
accaggactatagcccaggtc

SEQ ID NO: 4181580 - DNA, 16 bp, Homo sapiens
accaggatagagactg

SEQ ID NO: 4181581 - DNA, 17 bp, Homo sapiens
accaggatagagactgg

SEQ ID NO: 4181582 - DNA, 17 bp, Homo sapiens
accaggcaccaaaagaa

SEQ ID NO: 4181583 - DNA, 19 bp, Homo sapiens
accaggcaccaaaagaagt

SEQ ID NO: 4181584 - DNA, 21 bp, Homo sapiens
accagggcactgtctgcgtga

SEQ ID NO: 4181585 - DNA, 23 bp, Homo sapiens
accagtgcccaaagtctgtgtga

SEQ ID NO: 4181586 - DNA, 16 bp, Homo sapiens
accagtgtagccttgc

SEQ ID NO: 4181587 - DNA, 14 bp, Homo sapiens
accagttaagaatg

SEQ ID NO: 4181588 - DNA, 21 bp, Homo sapiens
accataaactgtacaaatgaa

SEQ ID NO: 4181589 - DNA, 21 bp, Homo sapiens
accatagttatttacttgaaa

SEQ ID NO: 4181590 - DNA, 22 bp, Homo sapiens
accatagttatttacttgaaag

SEQ ID NO: 4181591 - DNA, 13 bp, Homo sapiens
accatcacacatg

SEQ ID NO: 4181592 - DNA, 16 bp, Homo sapiens
accatcgtccagccct

SEQ ID NO: 4181593 - DNA, 18 bp, Homo sapiens
accatcgtccagccctcc

SEQ ID NO: 4181594 - DNA, 14 bp, Homo sapiens
accatgatttaatc

SEQ ID NO: 4181595 - DNA, 20 bp, Homo sapiens
accatgccaggctaattttt

SEQ ID NO: 4181596 - DNA, 21 bp, Homo sapiens
accatgctggcggcgcagagg

SEQ ID NO: 4181597 - DNA, 16 bp, Homo sapiens
accattatttaataag

SEQ ID NO: 4181598 - DNA, 14 bp, Homo sapiens
accatttcaaatgg

SEQ ID NO: 4181599 - DNA, 20 bp, Homo sapiens
accattttagttcctttatt

SEQ ID NO: 4181600 - DNA, 14 bp, Homo sapiens
acccaatttaattc

SEQ ID NO: 4181601 - DNA, 13 bp, Homo sapiens
acccacacatgtt

SEQ ID NO: 4181602 - DNA, 19 bp, Homo sapiens
acccactgtccgcctctgc

SEQ ID NO: 4181603 - DNA, 14 bp, Homo sapiens
acccagatcctcac

SEQ ID NO: 4181604 - DNA, 21 bp, Homo sapiens
acccagatggaaaaataacaa

SEQ ID NO: 4181605 - DNA, 12 bp, Homo sapiens
acccagctctca

SEQ ID NO: 4181606 - DNA, 13 bp, Homo sapiens
acccagctctcag

SEQ ID NO: 4181607 - DNA, 14 bp, Homo sapiens
acccagctctcagg

SEQ ID NO: 4181608 - DNA, 21 bp, Homo sapiens
acccagctctcagggctgtct

SEQ ID NO: 4181609 - DNA, 20 bp, Homo sapiens
acccaggctggagtacagtg

SEQ ID NO: 4181610 - DNA, 22 bp, Homo sapiens
acccagtccgccaaacactcca

SEQ ID NO: 4181611 - DNA, 10 bp, Homo sapiens
acccatctgt

SEQ ID NO: 4181612 - DNA, 20 bp, Homo sapiens
acccatctgtagtaatttat

SEQ ID NO: 4181613 - DNA, 20 bp, Homo sapiens
acccatgaagacaggacagt

SEQ ID NO: 4181614 - DNA, 23 bp, Homo sapiens
acccatgtaaatgtccaaaatgt

SEQ ID NO: 4181615 - DNA, 14 bp, Homo sapiens
accccaaagagcct

SEQ ID NO: 4181616 - DNA, 22 bp, Homo sapiens
accccaaagagcctggagaagc

SEQ ID NO: 4181617 - DNA, 22 bp, Homo sapiens
accccaagtccacctgcctatc

SEQ ID NO: 4181618 - DNA, 19 bp, Homo sapiens
accccacctcatgcctggc

SEQ ID NO: 4181619 - DNA, 14 bp, Homo sapiens
accccagagttggg

SEQ ID NO: 4181620 - DNA, 13 bp, Homo sapiens
accccagcatcct

SEQ ID NO: 4181621 - DNA, 21 bp, Homo sapiens
acccccagtgccacagagaag

SEQ ID NO: 4181622 - DNA, 12 bp, Homo sapiens
accccccacctg

SEQ ID NO: 4181623 - DNA, 14 bp, Homo sapiens
acccccgctccaga

SEQ ID NO: 4181624 - DNA, 11 bp, Homo sapiens
accccctcatt

SEQ ID NO: 4181625 - DNA, 14 bp, Homo sapiens
accccggtggcagt

SEQ ID NO: 4181626 - DNA, 21 bp, Homo sapiens
accccgtgtccccggcctcag

SEQ ID NO: 4181627 - DNA, 17 bp, Homo sapiens
acccctaacctggctta

SEQ ID NO: 4181628 - DNA, 21 bp, Homo sapiens
acccctgttaagcaattcctt

SEQ ID NO: 4181629 - DNA, 11 bp, Homo sapiens
accccttcctt

SEQ ID NO: 4181630 - DNA, 12 bp, Homo sapiens
accccttccttt

SEQ ID NO: 4181631 - DNA, 11 bp, Homo sapiens
acccctttccc

SEQ ID NO: 4181632 - DNA, 16 bp, Homo sapiens
acccctttcccccacc

SEQ ID NO: 4181633 - DNA, 18 bp, Homo sapiens
accctcaataaatgttgc

SEQ ID NO: 4181634 - DNA, 19 bp, Homo sapiens
accctccagtgctggattt

SEQ ID NO: 4181635 - DNA, 22 bp, Homo sapiens
accctccgccttcactccggtg

SEQ ID NO: 4181636 - DNA, 14 bp, Homo sapiens
accctcctccactc

SEQ ID NO: 4181637 - DNA, 22 bp, Homo sapiens
accctcgtggacacctgccctg

SEQ ID NO: 4181638 - DNA, 12 bp, Homo sapiens
accctctcttcc

SEQ ID NO: 4181639 - DNA, 19 bp, Homo sapiens
accctctgaatggtccagg

SEQ ID NO: 4181640 - DNA, 18 bp, Homo sapiens
accctctgccccagaaca

SEQ ID NO: 4181641 - DNA, 22 bp, Homo sapiens
accctgagctgaccagccgtga

SEQ ID NO: 4181642 - DNA, 14 bp, Homo sapiens
accctgcagagcta

SEQ ID NO: 4181643 - DNA, 16 bp, Homo sapiens
accctgcccagtctgg

SEQ ID NO: 4181644 - DNA, 20 bp, Homo sapiens
accctgcgaaggggccctgg

SEQ ID NO: 4181645 - DNA, 14 bp, Homo sapiens
accctgggctctgg

SEQ ID NO: 4181646 - DNA, 15 bp, Homo sapiens
accctggtggaggct

SEQ ID NO: 4181647 - DNA, 12 bp, Homo sapiens
accctgtcagga

SEQ ID NO: 4181648 - DNA, 21 bp, Homo sapiens
accgaccatcgtccagccctc

SEQ ID NO: 4181649 - DNA, 18 bp, Homo sapiens
accgagcgctttctggaa

SEQ ID NO: 4181650 - DNA, 24 bp, Homo sapiens
accgctatttctccttggatggca

SEQ ID NO: 4181651 - DNA, 20 bp, Homo sapiens
accgctcccctctcctccgc

SEQ ID NO: 4181652 - DNA, 21 bp, Homo sapiens
accgctcccctctcctccgcc

SEQ ID NO: 4181653 - DNA, 15 bp, Homo sapiens
accgcttcccagagg

SEQ ID NO: 4181654 - DNA, 16 bp, Homo sapiens
accgcttcccagaggc

SEQ ID NO: 4181655 - DNA, 16 bp, Homo sapiens
accgtctgtttttaaa

SEQ ID NO: 4181656 - DNA, 20 bp, Homo sapiens
accgtgatttggaagagagg

SEQ ID NO: 4181657 - DNA, 19 bp, Homo sapiens
acctaacgccctatttttg

SEQ ID NO: 4181658 - DNA, 16 bp, Homo sapiens
acctaccaccttccct

SEQ ID NO: 4181659 - DNA, 17 bp, Homo sapiens
acctactactcaattgt

SEQ ID NO: 4181660 - DNA, 15 bp, Homo sapiens
acctagaacttcaaa

SEQ ID NO: 4181661 - DNA, 17 bp, Homo sapiens
acctagaacttcaaaat

SEQ ID NO: 4181662 - DNA, 21 bp, Homo sapiens
acctagctggttaatggcagc

SEQ ID NO: 4181663 - DNA, 15 bp, Homo sapiens
acctatagtcccagc

SEQ ID NO: 4181664 - DNA, 22 bp, Homo sapiens
acctatagtcccagctactcag

SEQ ID NO: 4181665 - DNA, 15 bp, Homo sapiens
acctcacgctctgga

SEQ ID NO: 4181666 - DNA, 21 bp, Homo sapiens
acctcagagggataaggcagt

SEQ ID NO: 4181667 - DNA, 22 bp, Homo sapiens
acctcagagggataaggcagtt

SEQ ID NO: 4181668 - DNA, 13 bp, Homo sapiens
acctcaggccagg

SEQ ID NO: 4181669 - DNA, 17 bp, Homo sapiens
acctcagtaatttagaa

SEQ ID NO: 4181670 - DNA, 21 bp, Homo sapiens
acctcagtaatttagaaatca

SEQ ID NO: 4181671 - DNA, 12 bp, Homo sapiens
acctccacccac

SEQ ID NO: 4181672 - DNA, 14 bp, Homo sapiens
acctcgaggctctt

SEQ ID NO: 4181673 - DNA, 20 bp, Homo sapiens
acctcggccgtacatctctg

SEQ ID NO: 4181674 - DNA, 21 bp, Homo sapiens
acctctcaatattcaataaag

SEQ ID NO: 4181675 - DNA, 23 bp, Homo sapiens
acctctcaatattcaataaagct

SEQ ID NO: 4181676 - DNA, 12 bp, Homo sapiens
acctctgagaag

SEQ ID NO: 4181677 - DNA, 14 bp, Homo sapiens
acctcttcagctgg

SEQ ID NO: 4181678 - DNA, 15 bp, Homo sapiens
acctgaaccactgtg

SEQ ID NO: 4181679 - DNA, 16 bp, Homo sapiens
acctgacaagcactgc

SEQ ID NO: 4181680 - DNA, 15 bp, Homo sapiens
acctgaccagaatgc

SEQ ID NO: 4181681 - DNA, 19 bp, Homo sapiens
acctgaggctcctgtgcta

SEQ ID NO: 4181682 - DNA, 14 bp, Homo sapiens
acctgatcacctct

SEQ ID NO: 4181683 - DNA, 15 bp, Homo sapiens
acctgatcacctctg

SEQ ID NO: 4181684 - DNA, 15 bp, Homo sapiens
acctgcaggccaaga

SEQ ID NO: 4181685 - DNA, 15 bp, Homo sapiens
acctgccagcctggc

SEQ ID NO: 4181686 - DNA, 21 bp, Homo sapiens
acctgccagcctggcttctgg

SEQ ID NO: 4181687 - DNA, 18 bp, Homo sapiens
acctgccatttgcaccct

SEQ ID NO: 4181688 - DNA, 16 bp, Homo sapiens
acctgccccgcccagc

SEQ ID NO: 4181689 - DNA, 17 bp, Homo sapiens
acctgccccgcccagct

SEQ ID NO: 4181690 - DNA, 12 bp, Homo sapiens
acctgccctgcc

SEQ ID NO: 4181691 - DNA, 18 bp, Homo sapiens
acctgccctgccctgcca

SEQ ID NO: 4181692 - DNA, 23 bp, Homo sapiens
acctgccctgccctgccacctgt

SEQ ID NO: 4181693 - DNA, 18 bp, Homo sapiens
acctgcctatccatcctg

SEQ ID NO: 4181694 - DNA, 16 bp, Homo sapiens
acctgcggctgctgtg

SEQ ID NO: 4181695 - DNA, 22 bp, Homo sapiens
acctgcggctgctgtgtgcctt

SEQ ID NO: 4181696 - DNA, 17 bp, Homo sapiens
acctgctgggtaaactg

SEQ ID NO: 4181697 - DNA, 19 bp, Homo sapiens
acctgcttcatgctcagcc

SEQ ID NO: 4181698 - DNA, 13 bp, Homo sapiens
acctggagatgat

SEQ ID NO: 4181699 - DNA, 13 bp, Homo sapiens
acctggagcccgc

SEQ ID NO: 4181700 - DNA, 17 bp, Homo sapiens
acctggagcccgcttca

SEQ ID NO: 4181701 - DNA, 15 bp, Homo sapiens
acctggccagaggca

SEQ ID NO: 4181702 - DNA, 16 bp, Homo sapiens
acctgggaagatacca

SEQ ID NO: 4181703 - DNA, 22 bp, Homo sapiens
acctgggagaaatctggcttct

SEQ ID NO: 4181704 - DNA, 19 bp, Homo sapiens
acctgggcccacagagcct

SEQ ID NO: 4181705 - DNA, 18 bp, Homo sapiens
acctgggcgccaactgct

SEQ ID NO: 4181706 - DNA, 18 bp, Homo sapiens
acctgggttgcagacagg

SEQ ID NO: 4181707 - DNA, 20 bp, Homo sapiens
acctgggttgcagacaggaa

SEQ ID NO: 4181708 - DNA, 14 bp, Homo sapiens
acctgtctgtctgt

SEQ ID NO: 4181709 - DNA, 15 bp, Homo sapiens
acctgtggagaagcc

SEQ ID NO: 4181710 - DNA, 21 bp, Homo sapiens
acctgttgagcatcacagaat

SEQ ID NO: 4181711 - DNA, 18 bp, Homo sapiens
accttaccaactttctgt

SEQ ID NO: 4181712 - DNA, 20 bp, Homo sapiens
accttaccaactttctgtaa

SEQ ID NO: 4181713 - DNA, 20 bp, Homo sapiens
accttccccagactcagctc

SEQ ID NO: 4181714 - DNA, 19 bp, Homo sapiens
accttctggcttccttctc

SEQ ID NO: 4181715 - DNA, 21 bp, Homo sapiens
accttcttcgctgctagagaa

SEQ ID NO: 4181716 - DNA, 16 bp, Homo sapiens
accttggactcctccc

SEQ ID NO: 4181717 - DNA, 17 bp, Homo sapiens
acctttatagctctcat

SEQ ID NO: 4181718 - DNA, 15 bp, Homo sapiens
acctttgtgtaaaga

SEQ ID NO: 4181719 - DNA, 18 bp, Homo sapiens
accttttttcaacagtga

SEQ ID NO: 4181720 - DNA, 17 bp, Homo sapiens
acgaacggaagggttgg

SEQ ID NO: 4181721 - DNA, 22 bp, Homo sapiens
acgacaaagccaaactctgcca

SEQ ID NO: 4181722 - DNA, 13 bp, Homo sapiens
acgactcttcctg

SEQ ID NO: 4181723 - DNA, 16 bp, Homo sapiens
acgactcttcctgcaa

SEQ ID NO: 4181724 - DNA, 20 bp, Homo sapiens
acgagaccctacaggagagg

SEQ ID NO: 4181725 - DNA, 22 bp, Homo sapiens
acgcaccaccatgccaggctaa

SEQ ID NO: 4181726 - DNA, 22 bp, Homo sapiens
acgccattgtactccagcctgg

SEQ ID NO: 4181727 - DNA, 16 bp, Homo sapiens
acgcctatgatcccag

SEQ ID NO: 4181728 - DNA, 18 bp, Homo sapiens
acgcctatgatcccagca

SEQ ID NO: 4181729 - DNA, 20 bp, Homo sapiens
acgcctgtaatcccagcact

SEQ ID NO: 4181730 - DNA, 13 bp, Homo sapiens
acgcgcacacaca

SEQ ID NO: 4181731 - DNA, 17 bp, Homo sapiens
acgcgggctgtgcctta

SEQ ID NO: 4181732 - DNA, 18 bp, Homo sapiens
acgcgggctgtgccttac

SEQ ID NO: 4181733 - DNA, 17 bp, Homo sapiens
acgctttttgaaaaagc

SEQ ID NO: 4181734 - DNA, 16 bp, Homo sapiens
acggagagtgcttggg

SEQ ID NO: 4181735 - DNA, 12 bp, Homo sapiens
acggctgctgca

SEQ ID NO: 4181736 - DNA, 14 bp, Homo sapiens
acggctggacctgc

SEQ ID NO: 4181737 - DNA, 16 bp, Homo sapiens
acggctggacctgcac

SEQ ID NO: 4181738 - DNA, 14 bp, Homo sapiens
acgggctgccctgc

SEQ ID NO: 4181739 - DNA, 15 bp, Homo sapiens
acggggtttcaccat

SEQ ID NO: 4181740 - DNA, 21 bp, Homo sapiens
acggtcccacactggtgactg

SEQ ID NO: 4181741 - DNA, 16 bp, Homo sapiens
acggtttcaaaccagg

SEQ ID NO: 4181742 - DNA, 13 bp, Homo sapiens
acgtatttaatag

SEQ ID NO: 4181743 - DNA, 15 bp, Homo sapiens
acgtatttaatagca

SEQ ID NO: 4181744 - DNA, 17 bp, Homo sapiens
acgtatttatatttgga

SEQ ID NO: 4181745 - DNA, 17 bp, Homo sapiens
acgtcaagtctccttcc

SEQ ID NO: 4181746 - DNA, 21 bp, Homo sapiens
acgtgacacaaacacacacaa

SEQ ID NO: 4181747 - DNA, 15 bp, Homo sapiens
acgtgagccaggtaa

SEQ ID NO: 4181748 - DNA, 22 bp, Homo sapiens
acgttgacccctttcccccacc

SEQ ID NO: 4181749 - DNA, 23 bp, Homo sapiens
acgttgacccctttcccccaccc

SEQ ID NO: 4181750 - DNA, 17 bp, Homo sapiens
acgtttaagccaaaaca

SEQ ID NO: 4181751 - DNA, 21 bp, Homo sapiens
acgttttctcttccttgtgat

SEQ ID NO: 4181752 - DNA, 20 bp, Homo sapiens
actaaaagttcttctccaat

SEQ ID NO: 4181753 - DNA, 13 bp, Homo sapiens
actaaagagacat

SEQ ID NO: 4181754 - DNA, 16 bp, Homo sapiens
actaaagccaaacata

SEQ ID NO: 4181755 - DNA, 23 bp, Homo sapiens
actaaagccaaacatatatatac

SEQ ID NO: 4181756 - DNA, 22 bp, Homo sapiens
actaaagggcaggtggttctaa

SEQ ID NO: 4181757 - DNA, 14 bp, Homo sapiens
actaaagtatgtaa

SEQ ID NO: 4181758 - DNA, 13 bp, Homo sapiens
actaaataaaaaa

SEQ ID NO: 4181759 - DNA, 16 bp, Homo sapiens
actaaatctctaatat

SEQ ID NO: 4181760 - DNA, 17 bp, Homo sapiens
actaaatctctaatatg

SEQ ID NO: 4181761 - DNA, 15 bp, Homo sapiens
actaaatcttttata

SEQ ID NO: 4181762 - DNA, 18 bp, Homo sapiens
actaagaggctatttaaa

SEQ ID NO: 4181763 - DNA, 16 bp, Homo sapiens
actaagctttctcctt

SEQ ID NO: 4181764 - DNA, 17 bp, Homo sapiens
actaagctttctccttt

SEQ ID NO: 4181765 - DNA, 23 bp, Homo sapiens
actacacatccctaatgtgtgcc

SEQ ID NO: 4181766 - DNA, 18 bp, Homo sapiens
actacactccagcctgag

SEQ ID NO: 4181767 - DNA, 19 bp, Homo sapiens
actacactccagcctgagc

SEQ ID NO: 4181768 - DNA, 20 bp, Homo sapiens
actacactccagcctgagca

SEQ ID NO: 4181769 - DNA, 16 bp, Homo sapiens
actacagtctaaagct

SEQ ID NO: 4181770 - DNA, 23 bp, Homo sapiens
actacctttatagctctcatcac

SEQ ID NO: 4181771 - DNA, 15 bp, Homo sapiens
actacgttaagggaa

SEQ ID NO: 4181772 - DNA, 20 bp, Homo sapiens
actagaatttgtattttgct

SEQ ID NO: 4181773 - DNA, 12 bp, Homo sapiens
actagacaagcc

SEQ ID NO: 4181774 - DNA, 15 bp, Homo sapiens
actagacaagccaga

SEQ ID NO: 4181775 - DNA, 21 bp, Homo sapiens
actagacaagccagaacttga

SEQ ID NO: 4181776 - DNA, 21 bp, Homo sapiens
actagagcctgtgctaaagaa

SEQ ID NO: 4181777 - DNA, 14 bp, Homo sapiens
actagaggtgagaa

SEQ ID NO: 4181778 - DNA, 11 bp, Homo sapiens
actagcaggca

SEQ ID NO: 4181779 - DNA, 16 bp, Homo sapiens
actaggactctgaggc

SEQ ID NO: 4181780 - DNA, 15 bp, Homo sapiens
actaggaggaaaaga

SEQ ID NO: 4181781 - DNA, 18 bp, Homo sapiens
actaggaggaaaagacag

SEQ ID NO: 4181782 - DNA, 15 bp, Homo sapiens
actagggagccatgt

SEQ ID NO: 4181783 - DNA, 21 bp, Homo sapiens
actaggttctaggtcctggct

SEQ ID NO: 4181784 - DNA, 20 bp, Homo sapiens
actagtcatagaaatacctc

SEQ ID NO: 4181785 - DNA, 18 bp, Homo sapiens
actagtttaattaactat

SEQ ID NO: 4181786 - DNA, 12 bp, Homo sapiens
actatacatact

SEQ ID NO: 4181787 - DNA, 20 bp, Homo sapiens
actatagtttaatactcaga

SEQ ID NO: 4181788 - DNA, 22 bp, Homo sapiens
actatatgataaagagggatgt

SEQ ID NO: 4181789 - DNA, 16 bp, Homo sapiens
actatctgtgaagtta

SEQ ID NO: 4181790 - DNA, 22 bp, Homo sapiens
actatctttttgcttacagttt

SEQ ID NO: 4181791 - DNA, 21 bp, Homo sapiens
actatgaaaagctagaattga

SEQ ID NO: 4181792 - DNA, 15 bp, Homo sapiens
actatgccacagatt

SEQ ID NO: 4181793 - DNA, 16 bp, Homo sapiens
actatgtgatgttaac

SEQ ID NO: 4181794 - DNA, 22 bp, Homo sapiens
actatgttcatgatagtgtgat

SEQ ID NO: 4181795 - DNA, 16 bp, Homo sapiens
actattattaataaat

SEQ ID NO: 4181796 - DNA, 19 bp, Homo sapiens
actatttacatataataaa

SEQ ID NO: 4181797 - DNA, 22 bp, Homo sapiens
actatttcccttgaaattttaa

SEQ ID NO: 4181798 - DNA, 22 bp, Homo sapiens
actattttcagatgtgaaccat

SEQ ID NO: 4181799 - DNA, 15 bp, Homo sapiens
actatttttatattc

SEQ ID NO: 4181800 - DNA, 16 bp, Homo sapiens
actattttttaataaa

SEQ ID NO: 4181801 - DNA, 16 bp, Homo sapiens
actcaacaataaagac

SEQ ID NO: 4181802 - DNA, 18 bp, Homo sapiens
actcaaggcggtgcttga

SEQ ID NO: 4181803 - DNA, 23 bp, Homo sapiens
actcaatctccccttgcactaaa

SEQ ID NO: 4181804 - DNA, 17 bp, Homo sapiens
actcacccatgtgccaa

SEQ ID NO: 4181805 - DNA, 12 bp, Homo sapiens
actcacctctct

SEQ ID NO: 4181806 - DNA, 15 bp, Homo sapiens
actcacgatgaaatt

SEQ ID NO: 4181807 - DNA, 16 bp, Homo sapiens
actcactccattccta

SEQ ID NO: 4181808 - DNA, 19 bp, Homo sapiens
actcagaaaagaaaaccat

SEQ ID NO: 4181809 - DNA, 22 bp, Homo sapiens
actcagaaaatggggcttgccc

SEQ ID NO: 4181810 - DNA, 17 bp, Homo sapiens
actcagaagcctgaggc

SEQ ID NO: 4181811 - DNA, 22 bp, Homo sapiens
actcagataaggtaaaatgcca

SEQ ID NO: 4181812 - DNA, 15 bp, Homo sapiens
actcagccacacccc

SEQ ID NO: 4181813 - DNA, 20 bp, Homo sapiens
actcagtctagtgaagatgt

SEQ ID NO: 4181814 - DNA, 18 bp, Homo sapiens
actcagtctgtgggagct

SEQ ID NO: 4181815 - DNA, 22 bp, Homo sapiens
actcatataaaaggtgagctca

SEQ ID NO: 4181816 - DNA, 13 bp, Homo sapiens
actcattcctgta

SEQ ID NO: 4181817 - DNA, 19 bp, Homo sapiens
actcatttttcatgataat

SEQ ID NO: 4181818 - DNA, 13 bp, Homo sapiens
actccagcctgag

SEQ ID NO: 4181819 - DNA, 13 bp, Homo sapiens
actccagcctggg

SEQ ID NO: 4181820 - DNA, 14 bp, Homo sapiens
actccagcctgggc

SEQ ID NO: 4181821 - DNA, 20 bp, Homo sapiens
actccagtgatgttcttcaa

SEQ ID NO: 4181822 - DNA, 16 bp, Homo sapiens
actcccacacccaaga

SEQ ID NO: 4181823 - DNA, 17 bp, Homo sapiens
actcccacccttggggt

SEQ ID NO: 4181824 - DNA, 16 bp, Homo sapiens
actccccgcctgtcct

SEQ ID NO: 4181825 - DNA, 20 bp, Homo sapiens
actccccgcctgtcctgcct

SEQ ID NO: 4181826 - DNA, 21 bp, Homo sapiens
actccccgcctgtcctgcctc

SEQ ID NO: 4181827 - DNA, 16 bp, Homo sapiens
actccgagaacaacag

SEQ ID NO: 4181828 - DNA, 20 bp, Homo sapiens
actccggtgtgcctgcagcc

SEQ ID NO: 4181829 - DNA, 18 bp, Homo sapiens
actccgtgtgcctggggt

SEQ ID NO: 4181830 - DNA, 17 bp, Homo sapiens
actcctacctcagccta

SEQ ID NO: 4181831 - DNA, 20 bp, Homo sapiens
actcctcaaaagcaaatgag

SEQ ID NO: 4181832 - DNA, 19 bp, Homo sapiens
actcctcaggaacagaaca

SEQ ID NO: 4181833 - DNA, 12 bp, Homo sapiens
actcctcccaca

SEQ ID NO: 4181834 - DNA, 23 bp, Homo sapiens
actcctctaagccactcttccaa

SEQ ID NO: 4181835 - DNA, 16 bp, Homo sapiens
actcctcttatttgct

SEQ ID NO: 4181836 - DNA, 21 bp, Homo sapiens
actcggcctcccaaagtgctg

SEQ ID NO: 4181837 - DNA, 22 bp, Homo sapiens
actcggcctcccaaagtgctgg

SEQ ID NO: 4181838 - DNA, 20 bp, Homo sapiens
actcgggaggctgagacagg

SEQ ID NO: 4181839 - DNA, 19 bp, Homo sapiens
actcgtatagcatgcatct

SEQ ID NO: 4181840 - DNA, 14 bp, Homo sapiens
actctaagctgtgt

SEQ ID NO: 4181841 - DNA, 18 bp, Homo sapiens
actctaagctgtgtgcag

SEQ ID NO: 4181842 - DNA, 21 bp, Homo sapiens
actctgagtgttttatgagaa

SEQ ID NO: 4181843 - DNA, 21 bp, Homo sapiens
actctgccttttttcacagcc

SEQ ID NO: 4181844 - DNA, 22 bp, Homo sapiens
actctgcggtggtgccagaggt

SEQ ID NO: 4181845 - DNA, 14 bp, Homo sapiens
actctggcttccag

SEQ ID NO: 4181846 - DNA, 23 bp, Homo sapiens
actctgtcaatttccctgactcc

SEQ ID NO: 4181847 - DNA, 16 bp, Homo sapiens
actctgtcacactaaa

SEQ ID NO: 4181848 - DNA, 16 bp, Homo sapiens
actctgtcagatggga

SEQ ID NO: 4181849 - DNA, 14 bp, Homo sapiens
actctgtccactct

SEQ ID NO: 4181850 - DNA, 19 bp, Homo sapiens
actcttcaaggtctgcttt

SEQ ID NO: 4181851 - DNA, 11 bp, Homo sapiens
actcttcctgc

SEQ ID NO: 4181852 - DNA, 14 bp, Homo sapiens
actcttggcctctg

SEQ ID NO: 4181853 - DNA, 15 bp, Homo sapiens
actcttggcctctgc

SEQ ID NO: 4181854 - DNA, 15 bp, Homo sapiens
actctttatgcttgc

SEQ ID NO: 4181855 - DNA, 18 bp, Homo sapiens
actgaaaaaaaaaaagaa

SEQ ID NO: 4181856 - DNA, 20 bp, Homo sapiens
actgaagagaccacagcaat

SEQ ID NO: 4181857 - DNA, 22 bp, Homo sapiens
actgaagttatctgtgttattt

SEQ ID NO: 4181858 - DNA, 15 bp, Homo sapiens
actgaataggaaaat

SEQ ID NO: 4181859 - DNA, 17 bp, Homo sapiens
actgaataggaaaatgt

SEQ ID NO: 4181860 - DNA, 21 bp, Homo sapiens
actgaatgcctcaatgtgacc

SEQ ID NO: 4181861 - DNA, 16 bp, Homo sapiens
actgaattagccaaaa

SEQ ID NO: 4181862 - DNA, 20 bp, Homo sapiens
actgaattagccaaaacact

SEQ ID NO: 4181863 - DNA, 18 bp, Homo sapiens
actgaattttgggacttc

SEQ ID NO: 4181864 - DNA, 20 bp, Homo sapiens
actgaattttgggacttcta

SEQ ID NO: 4181865 - DNA, 12 bp, Homo sapiens
actgacaagatg

SEQ ID NO: 4181866 - DNA, 22 bp, Homo sapiens
actgaggccaaaagaggcctga

SEQ ID NO: 4181867 - DNA, 19 bp, Homo sapiens
actgatcaatccttcttat

SEQ ID NO: 4181868 - DNA, 22 bp, Homo sapiens
actgatgttacatcacagtgtt

SEQ ID NO: 4181869 - DNA, 17 bp, Homo sapiens
actgcactccagcctgg

SEQ ID NO: 4181870 - DNA, 13 bp, Homo sapiens
actgcagaaagcc

SEQ ID NO: 4181871 - DNA, 19 bp, Homo sapiens
actgcagaggggaaagact

SEQ ID NO: 4181872 - DNA, 17 bp, Homo sapiens
actgcagggctgctgtg

SEQ ID NO: 4181873 - DNA, 15 bp, Homo sapiens
actgcatactgatcc

SEQ ID NO: 4181874 - DNA, 23 bp, Homo sapiens
actgcccctgcacctgcttctca

SEQ ID NO: 4181875 - DNA, 18 bp, Homo sapiens
actgccgtcagtgctgtg

SEQ ID NO: 4181876 - DNA, 20 bp, Homo sapiens
actgccgtcagtgctgtgct

SEQ ID NO: 4181877 - DNA, 17 bp, Homo sapiens
actgcgggagctctgta

SEQ ID NO: 4181878 - DNA, 21 bp, Homo sapiens
actgctaggcgagtgccagga

SEQ ID NO: 4181879 - DNA, 22 bp, Homo sapiens
actgctaggcgagtgccaggac

SEQ ID NO: 4181880 - DNA, 18 bp, Homo sapiens
actgctgatcaatgaaat

SEQ ID NO: 4181881 - DNA, 18 bp, Homo sapiens
actgctgggactggccag

SEQ ID NO: 4181882 - DNA, 13 bp, Homo sapiens
actgcttggagct

SEQ ID NO: 4181883 - DNA, 16 bp, Homo sapiens
actgcttggagctgag

SEQ ID NO: 4181884 - DNA, 20 bp, Homo sapiens
actggaaaataaattttgaa

SEQ ID NO: 4181885 - DNA, 15 bp, Homo sapiens
actggactgggtttt

SEQ ID NO: 4181886 - DNA, 19 bp, Homo sapiens
actggaggtcacattcagg

SEQ ID NO: 4181887 - DNA, 15 bp, Homo sapiens
actggcagagcacag

SEQ ID NO: 4181888 - DNA, 17 bp, Homo sapiens
actggcagagcacagcc

SEQ ID NO: 4181889 - DNA, 18 bp, Homo sapiens
actggcagagcacagccc

SEQ ID NO: 4181890 - DNA, 20 bp, Homo sapiens
actggcagagcacagcccac

SEQ ID NO: 4181891 - DNA, 13 bp, Homo sapiens
actggccccaccc

SEQ ID NO: 4181892 - DNA, 14 bp, Homo sapiens
actggccctggggc

SEQ ID NO: 4181893 - DNA, 18 bp, Homo sapiens
actggctcctttgcctct

SEQ ID NO: 4181894 - DNA, 12 bp, Homo sapiens
actggtgactgc

SEQ ID NO: 4181895 - DNA, 18 bp, Homo sapiens
actggttcaagagacact

SEQ ID NO: 4181896 - DNA, 16 bp, Homo sapiens
actggttgtgaataat

SEQ ID NO: 4181897 - DNA, 20 bp, Homo sapiens
actggtttatccacccacaa

SEQ ID NO: 4181898 - DNA, 22 bp, Homo sapiens
actggtttatccacccacaaca

SEQ ID NO: 4181899 - DNA, 18 bp, Homo sapiens
actgtacttaataaattc

SEQ ID NO: 4181900 - DNA, 13 bp, Homo sapiens
actgtagtttaat

SEQ ID NO: 4181901 - DNA, 19 bp, Homo sapiens
actgtagtttaatactttt

SEQ ID NO: 4181902 - DNA, 22 bp, Homo sapiens
actgtcccggagctcaggccct

SEQ ID NO: 4181903 - DNA, 20 bp, Homo sapiens
actgtccgcctctgcccgca

SEQ ID NO: 4181904 - DNA, 15 bp, Homo sapiens
actgtctctcctgat

SEQ ID NO: 4181905 - DNA, 18 bp, Homo sapiens
actgtctggttttaacaa

SEQ ID NO: 4181906 - DNA, 14 bp, Homo sapiens
actgtgaaatacca

SEQ ID NO: 4181907 - DNA, 20 bp, Homo sapiens
actgtgaaataccacaagcc

SEQ ID NO: 4181908 - DNA, 21 bp, Homo sapiens
actgtgaaataccacaagcct

SEQ ID NO: 4181909 - DNA, 23 bp, Homo sapiens
actgtgacccaaagaagtttaag

SEQ ID NO: 4181910 - DNA, 11 bp, Homo sapiens
actgtgactga

SEQ ID NO: 4181911 - DNA, 19 bp, Homo sapiens
actgtgataatcagaagct

SEQ ID NO: 4181912 - DNA, 15 bp, Homo sapiens
actgtgccctgcctt

SEQ ID NO: 4181913 - DNA, 18 bp, Homo sapiens
actgtgccctgccttcag

SEQ ID NO: 4181914 - DNA, 14 bp, Homo sapiens
actgtttcttacct

SEQ ID NO: 4181915 - DNA, 15 bp, Homo sapiens
actgtttttgctatt

SEQ ID NO: 4181916 - DNA, 16 bp, Homo sapiens
acttaaatgttaatga

SEQ ID NO: 4181917 - DNA, 20 bp, Homo sapiens
acttaaattttaagcttgaa

SEQ ID NO: 4181918 - DNA, 12 bp, Homo sapiens
acttactttaat

SEQ ID NO: 4181919 - DNA, 15 bp, Homo sapiens
acttagaataaaatt

SEQ ID NO: 4181920 - DNA, 17 bp, Homo sapiens
acttagaataaaattgt

SEQ ID NO: 4181921 - DNA, 18 bp, Homo sapiens
acttagaataaaattgta

SEQ ID NO: 4181922 - DNA, 22 bp, Homo sapiens
acttagaataaaattgtaaaat

SEQ ID NO: 4181923 - DNA, 16 bp, Homo sapiens
acttagctatcagaag

SEQ ID NO: 4181924 - DNA, 12 bp, Homo sapiens
acttatttgagt

SEQ ID NO: 4181925 - DNA, 19 bp, Homo sapiens
acttcataaatgttcagct

SEQ ID NO: 4181926 - DNA, 20 bp, Homo sapiens
acttccatgttgtcttataa

SEQ ID NO: 4181927 - DNA, 20 bp, Homo sapiens
acttcccccgattcagagac

SEQ ID NO: 4181928 - DNA, 15 bp, Homo sapiens
acttctaatatattt

SEQ ID NO: 4181929 - DNA, 18 bp, Homo sapiens
acttctacccagatggaa

SEQ ID NO: 4181930 - DNA, 22 bp, Homo sapiens
acttctacccagatggaaaaat

SEQ ID NO: 4181931 - DNA, 22 bp, Homo sapiens
acttctccagacccaccacacc

SEQ ID NO: 4181932 - DNA, 16 bp, Homo sapiens
acttcttaaaagttgt

SEQ ID NO: 4181933 - DNA, 17 bp, Homo sapiens
acttcttgaaacagcct

SEQ ID NO: 4181934 - DNA, 24 bp, Homo sapiens
acttcttgaaacagcctgggtgac

SEQ ID NO: 4181935 - DNA, 16 bp, Homo sapiens
acttctttgaagttat

SEQ ID NO: 4181936 - DNA, 20 bp, Homo sapiens
acttctttgtggtttcaaat

SEQ ID NO: 4181937 - DNA, 19 bp, Homo sapiens
acttgaaaaatattcatgt

SEQ ID NO: 4181938 - DNA, 18 bp, Homo sapiens
acttgaagccaaactgtt

SEQ ID NO: 4181939 - DNA, 23 bp, Homo sapiens
acttgaaggcccaggtcaacatc

SEQ ID NO: 4181940 - DNA, 16 bp, Homo sapiens
acttgaatcaaagcag

SEQ ID NO: 4181941 - DNA, 15 bp, Homo sapiens
acttgaccctgagct

SEQ ID NO: 4181942 - DNA, 18 bp, Homo sapiens
acttgaccctgagctgac

SEQ ID NO: 4181943 - DNA, 19 bp, Homo sapiens
acttgaggacacatgtcca

SEQ ID NO: 4181944 - DNA, 19 bp, Homo sapiens
acttgagggtaataaactt

SEQ ID NO: 4181945 - DNA, 19 bp, Homo sapiens
acttgcttatcaacttcct

SEQ ID NO: 4181946 - DNA, 14 bp, Homo sapiens
acttggaaaaagaa

SEQ ID NO: 4181947 - DNA, 11 bp, Homo sapiens
acttggctttc

SEQ ID NO: 4181948 - DNA, 16 bp, Homo sapiens
acttgggcccaggagg

SEQ ID NO: 4181949 - DNA, 16 bp, Homo sapiens
acttggtcagagccac

SEQ ID NO: 4181950 - DNA, 20 bp, Homo sapiens
acttgtattttcttaatata

SEQ ID NO: 4181951 - DNA, 23 bp, Homo sapiens
acttgtccttttgtaccatggtg

SEQ ID NO: 4181952 - DNA, 24 bp, Homo sapiens
acttgttttgacttgaataaagta

SEQ ID NO: 4181953 - DNA, 20 bp, Homo sapiens
actttaaccctctcttccct

SEQ ID NO: 4181954 - DNA, 21 bp, Homo sapiens
actttagagtagcatgagaga

SEQ ID NO: 4181955 - DNA, 12 bp, Homo sapiens
actttcattttt

SEQ ID NO: 4181956 - DNA, 16 bp, Homo sapiens
actttcctacaaaatg

SEQ ID NO: 4181957 - DNA, 18 bp, Homo sapiens
actttctgtaaactcaaa

SEQ ID NO: 4181958 - DNA, 19 bp, Homo sapiens
actttctgttgccacaacc

SEQ ID NO: 4181959 - DNA, 13 bp, Homo sapiens
actttctttctca

SEQ ID NO: 4181960 - DNA, 18 bp, Homo sapiens
actttgatctctgcttac

SEQ ID NO: 4181961 - DNA, 18 bp, Homo sapiens
actttggcaatttcctgg

SEQ ID NO: 4181962 - DNA, 19 bp, Homo sapiens
actttggcaatttcctggc

SEQ ID NO: 4181963 - DNA, 15 bp, Homo sapiens
actttgggaggccaa

SEQ ID NO: 4181964 - DNA, 19 bp, Homo sapiens
actttgggaggctgaggcg

SEQ ID NO: 4181965 - DNA, 19 bp, Homo sapiens
actttggtacatggccagt

SEQ ID NO: 4181966 - DNA, 13 bp, Homo sapiens
actttgtcccgct

SEQ ID NO: 4181967 - DNA, 19 bp, Homo sapiens
actttgtggtaacttcttt

SEQ ID NO: 4181968 - DNA, 23 bp, Homo sapiens
actttgtttcctccttgtcactg

SEQ ID NO: 4181969 - DNA, 12 bp, Homo sapiens
acttttcagtga

SEQ ID NO: 4181970 - DNA, 13 bp, Homo sapiens
acttttgggaggt

SEQ ID NO: 4181971 - DNA, 20 bp, Homo sapiens
acttttttacaacctggcca

SEQ ID NO: 4181972 - DNA, 20 bp, Homo sapiens
agaaaaaaaaaaacttacac

SEQ ID NO: 4181973 - DNA, 21 bp, Homo sapiens
agaaaaaatgtagaatgattt

SEQ ID NO: 4181974 - DNA, 23 bp, Homo sapiens
agaaaaacaaactcgttttttac

SEQ ID NO: 4181975 - DNA, 19 bp, Homo sapiens
agaaaatggctttaatcaa

SEQ ID NO: 4181976 - DNA, 18 bp, Homo sapiens
agaaaatggggcttgccc

SEQ ID NO: 4181977 - DNA, 14 bp, Homo sapiens
agaaacaaagggga

SEQ ID NO: 4181978 - DNA, 21 bp, Homo sapiens
agaaacaaaggggatgcccag

SEQ ID NO: 4181979 - DNA, 14 bp, Homo sapiens
agaaacactcaaca

SEQ ID NO: 4181980 - DNA, 23 bp, Homo sapiens
agaaacctactgcccaggcactg

SEQ ID NO: 4181981 - DNA, 17 bp, Homo sapiens
agaaaccttaatatgtg

SEQ ID NO: 4181982 - DNA, 22 bp, Homo sapiens
agaaactagtatctctggcctc

SEQ ID NO: 4181983 - DNA, 24 bp, Homo sapiens
agaaactagtatctctggcctcct

SEQ ID NO: 4181984 - DNA, 19 bp, Homo sapiens
agaaactttctataaccta

SEQ ID NO: 4181985 - DNA, 15 bp, Homo sapiens
agaaactttctttct

SEQ ID NO: 4181986 - DNA, 19 bp, Homo sapiens
agaaactttgatctctgct

SEQ ID NO: 4181987 - DNA, 22 bp, Homo sapiens
agaaagaaaattagtaattgta

SEQ ID NO: 4181988 - DNA, 15 bp, Homo sapiens
agaaagagagagata

SEQ ID NO: 4181989 - DNA, 17 bp, Homo sapiens
agaaagagagagataca

SEQ ID NO: 4181990 - DNA, 22 bp, Homo sapiens
agaaagattaaatatgatcact

SEQ ID NO: 4181991 - DNA, 18 bp, Homo sapiens
agaaagcacctgttttta

SEQ ID NO: 4181992 - DNA, 15 bp, Homo sapiens
agaaagccttctttt

SEQ ID NO: 4181993 - DNA, 16 bp, Homo sapiens
agaaagctggtaaact

SEQ ID NO: 4181994 - DNA, 21 bp, Homo sapiens
agaaagtcgaattaatagctt

SEQ ID NO: 4181995 - DNA, 17 bp, Homo sapiens
agaaagtgcagaatcaa

SEQ ID NO: 4181996 - DNA, 18 bp, Homo sapiens
agaaatagacagtatatt

SEQ ID NO: 4181997 - DNA, 13 bp, Homo sapiens
agaaataggaaga

SEQ ID NO: 4181998 - DNA, 17 bp, Homo sapiens
agaaatctggcttctgg

SEQ ID NO: 4181999 - DNA, 21 bp, Homo sapiens
agaaatgccaagcacttcttt

SEQ ID NO: 4182000 - DNA, 22 bp, Homo sapiens
agaaatgccaagcacttctttt

SEQ ID NO: 4182001 - DNA, 18 bp, Homo sapiens
agaaatgtttaagccaaa

SEQ ID NO: 4182002 - DNA, 14 bp, Homo sapiens
agaaattagccggg

SEQ ID NO: 4182003 - DNA, 15 bp, Homo sapiens
agaaattagccgggc

SEQ ID NO: 4182004 - DNA, 16 bp, Homo sapiens
agaaattatttaataa

SEQ ID NO: 4182005 - DNA, 15 bp, Homo sapiens
agaaattcttttcaa

SEQ ID NO: 4182006 - DNA, 24 bp, Homo sapiens
agaaatttaaactataagcaagaa

SEQ ID NO: 4182007 - DNA, 18 bp, Homo sapiens
agaaatttttatttttga

SEQ ID NO: 4182008 - DNA, 19 bp, Homo sapiens
agaaatttttatttttgaa

SEQ ID NO: 4182009 - DNA, 17 bp, Homo sapiens
agaaattttttcatgca

SEQ ID NO: 4182010 - DNA, 13 bp, Homo sapiens
agaacaacaacaa

SEQ ID NO: 4182011 - DNA, 17 bp, Homo sapiens
agaacaacaacaacaat

SEQ ID NO: 4182012 - DNA, 14 bp, Homo sapiens
agaacactgagata

SEQ ID NO: 4182013 - DNA, 15 bp, Homo sapiens
agaacatccctgggc

SEQ ID NO: 4182014 - DNA, 19 bp, Homo sapiens
agaacatccctgggcaagt

SEQ ID NO: 4182015 - DNA, 18 bp, Homo sapiens
agaacattgccttcctcg

SEQ ID NO: 4182016 - DNA, 17 bp, Homo sapiens
agaaccacttggctgct

SEQ ID NO: 4182017 - DNA, 19 bp, Homo sapiens
agaacctaattcaattcaa

SEQ ID NO: 4182018 - DNA, 12 bp, Homo sapiens
agaaccttctct

SEQ ID NO: 4182019 - DNA, 19 bp, Homo sapiens
agaactaggtttaaaacag

SEQ ID NO: 4182020 - DNA, 19 bp, Homo sapiens
agaactgaattaagttatt

SEQ ID NO: 4182021 - DNA, 19 bp, Homo sapiens
agaactgaattttgggact

SEQ ID NO: 4182022 - DNA, 22 bp, Homo sapiens
agaactgaggtcactgggttct

SEQ ID NO: 4182023 - DNA, 14 bp, Homo sapiens
agaactgccccatc

SEQ ID NO: 4182024 - DNA, 21 bp, Homo sapiens
agaactgccccatctcctccc

SEQ ID NO: 4182025 - DNA, 15 bp, Homo sapiens
agaacttcaaaatgt

SEQ ID NO: 4182026 - DNA, 19 bp, Homo sapiens
agaactttcggagcctgcc

SEQ ID NO: 4182027 - DNA, 20 bp, Homo sapiens
agaactttcggagcctgcct

SEQ ID NO: 4182028 - DNA, 15 bp, Homo sapiens
agaagaaaaagaagc

SEQ ID NO: 4182029 - DNA, 13 bp, Homo sapiens
agaagaaacaagg

SEQ ID NO: 4182030 - DNA, 11 bp, Homo sapiens
agaagaaagca

SEQ ID NO: 4182031 - DNA, 23 bp, Homo sapiens
agaagaaagcaaaagcaagggac

SEQ ID NO: 4182032 - DNA, 18 bp, Homo sapiens
agaagaagaaggagagca

SEQ ID NO: 4182033 - DNA, 13 bp, Homo sapiens
agaagaagatgct

SEQ ID NO: 4182034 - DNA, 19 bp, Homo sapiens
agaagaaggagagcaagaa

SEQ ID NO: 4182035 - DNA, 22 bp, Homo sapiens
agaagaagtttcatcatttttt

SEQ ID NO: 4182036 - DNA, 22 bp, Homo sapiens
agaagacacaaggtgatttcag

SEQ ID NO: 4182037 - DNA, 17 bp, Homo sapiens
agaagagaacctcaaac

SEQ ID NO: 4182038 - DNA, 12 bp, Homo sapiens
agaagagacagg

SEQ ID NO: 4182039 - DNA, 13 bp, Homo sapiens
agaagaggaggaa

SEQ ID NO: 4182040 - DNA, 14 bp, Homo sapiens
agaagaggaggaag

SEQ ID NO: 4182041 - DNA, 20 bp, Homo sapiens
agaagaggaggaagactctg

SEQ ID NO: 4182042 - DNA, 16 bp, Homo sapiens
agaagaggagggacct

SEQ ID NO: 4182043 - DNA, 17 bp, Homo sapiens
agaagaggctggtgctg

SEQ ID NO: 4182044 - DNA, 20 bp, Homo sapiens
agaagaggttgggcttccat

SEQ ID NO: 4182045 - DNA, 14 bp, Homo sapiens
agaagatgctgtga

SEQ ID NO: 4182046 - DNA, 13 bp, Homo sapiens
agaagcaagctgg

SEQ ID NO: 4182047 - DNA, 13 bp, Homo sapiens
agaagcaggcagg

SEQ ID NO: 4182048 - DNA, 14 bp, Homo sapiens
agaagcaggcaggg

SEQ ID NO: 4182049 - DNA, 15 bp, Homo sapiens
agaagcaggcagggc

SEQ ID NO: 4182050 - DNA, 23 bp, Homo sapiens
agaagcaggcagggcaaaggtca

SEQ ID NO: 4182051 - DNA, 17 bp, Homo sapiens
agaagcctgaggctggg

SEQ ID NO: 4182052 - DNA, 16 bp, Homo sapiens
agaagcttcagaagtt

SEQ ID NO: 4182053 - DNA, 11 bp, Homo sapiens
agaaggaaggc

SEQ ID NO: 4182054 - DNA, 15 bp, Homo sapiens
agaaggatagcctca

SEQ ID NO: 4182055 - DNA, 21 bp, Homo sapiens
agaagggttttccaccctgga

SEQ ID NO: 4182056 - DNA, 15 bp, Homo sapiens
agaagtaaaagcaaa

SEQ ID NO: 4182057 - DNA, 13 bp, Homo sapiens
agaagtaggaagg

SEQ ID NO: 4182058 - DNA, 12 bp, Homo sapiens
agaagtgtttta

SEQ ID NO: 4182059 - DNA, 13 bp, Homo sapiens
agaataaaattgt

SEQ ID NO: 4182060 - DNA, 13 bp, Homo sapiens
agaataaacatca

SEQ ID NO: 4182061 - DNA, 20 bp, Homo sapiens
agaataagttggagaaatgt

SEQ ID NO: 4182062 - DNA, 22 bp, Homo sapiens
agaataagttggagaaatgttt

SEQ ID NO: 4182063 - DNA, 17 bp, Homo sapiens
agaataataataaaaag

SEQ ID NO: 4182064 - DNA, 22 bp, Homo sapiens
agaatatcaaggaaaactgtga

SEQ ID NO: 4182065 - DNA, 15 bp, Homo sapiens
agaatatttcaaatg

SEQ ID NO: 4182066 - DNA, 21 bp, Homo sapiens
agaatatttcaaatgaacacg

SEQ ID NO: 4182067 - DNA, 14 bp, Homo sapiens
agaatccctgcagc

SEQ ID NO: 4182068 - DNA, 17 bp, Homo sapiens
agaatctctcctctctc

SEQ ID NO: 4182069 - DNA, 16 bp, Homo sapiens
agaatgaaaactcatt

SEQ ID NO: 4182070 - DNA, 22 bp, Homo sapiens
agaatgaatgagtaggaaagga

SEQ ID NO: 4182071 - DNA, 22 bp, Homo sapiens
agaatgatttttgctatttcta

SEQ ID NO: 4182072 - DNA, 16 bp, Homo sapiens
agaatgccggttaaat

SEQ ID NO: 4182073 - DNA, 14 bp, Homo sapiens
agaatgcttaatca

SEQ ID NO: 4182074 - DNA, 20 bp, Homo sapiens
agaatgcttaatcagataga

SEQ ID NO: 4182075 - DNA, 16 bp, Homo sapiens
agaatgggctgcagaa

SEQ ID NO: 4182076 - DNA, 18 bp, Homo sapiens
agaatgggctgcagaaga

SEQ ID NO: 4182077 - DNA, 17 bp, Homo sapiens
agaatgtgttttctgaa

SEQ ID NO: 4182078 - DNA, 15 bp, Homo sapiens
agaattcacacctta

SEQ ID NO: 4182079 - DNA, 13 bp, Homo sapiens
agaattgggaagc

SEQ ID NO: 4182080 - DNA, 20 bp, Homo sapiens
agaattgtgtcagactgttt

SEQ ID NO: 4182081 - DNA, 19 bp, Homo sapiens
agacacaggctcagcatgc

SEQ ID NO: 4182082 - DNA, 21 bp, Homo sapiens
agacaccatcttttgtgagat

SEQ ID NO: 4182083 - DNA, 23 bp, Homo sapiens
agacactagttcagaggaagcac

SEQ ID NO: 4182084 - DNA, 13 bp, Homo sapiens
agacactgcttgg

SEQ ID NO: 4182085 - DNA, 13 bp, Homo sapiens
agacactgggaga

SEQ ID NO: 4182086 - DNA, 16 bp, Homo sapiens
agacactgggagaaga

SEQ ID NO: 4182087 - DNA, 18 bp, Homo sapiens
agacactgggagaagaga

SEQ ID NO: 4182088 - DNA, 21 bp, Homo sapiens
agacactgggagaagagaacc

SEQ ID NO: 4182089 - DNA, 14 bp, Homo sapiens
agacagaagaaaca

SEQ ID NO: 4182090 - DNA, 15 bp, Homo sapiens
agacagaagaaacaa

SEQ ID NO: 4182091 - DNA, 20 bp, Homo sapiens
agacagaccccttggctttt

SEQ ID NO: 4182092 - DNA, 16 bp, Homo sapiens
agacagagcctccact

SEQ ID NO: 4182093 - DNA, 22 bp, Homo sapiens
agacagccctgcctatcctctg

SEQ ID NO: 4182094 - DNA, 21 bp, Homo sapiens
agacaggacagtgcttcagcc

SEQ ID NO: 4182095 - DNA, 23 bp, Homo sapiens
agacaggagggcaagggccatgc

SEQ ID NO: 4182096 - DNA, 21 bp, Homo sapiens
agacatccatgtttgtaaaac

SEQ ID NO: 4182097 - DNA, 22 bp, Homo sapiens
agacatccatgtttgtaaaact

SEQ ID NO: 4182098 - DNA, 22 bp, Homo sapiens
agacatggaagattagaggttt

SEQ ID NO: 4182099 - DNA, 22 bp, Homo sapiens
agacatggaaggttagaggttt

SEQ ID NO: 4182100 - DNA, 17 bp, Homo sapiens
agacatggaaggttagg

SEQ ID NO: 4182101 - DNA, 12 bp, Homo sapiens
agaccacctctc

SEQ ID NO: 4182102 - DNA, 12 bp, Homo sapiens
agaccagcctgg

SEQ ID NO: 4182103 - DNA, 17 bp, Homo sapiens
agaccagtactgggaag

SEQ ID NO: 4182104 - DNA, 14 bp, Homo sapiens
agacccacacatgt

SEQ ID NO: 4182105 - DNA, 13 bp, Homo sapiens
agacccacctgga

SEQ ID NO: 4182106 - DNA, 23 bp, Homo sapiens
agacccccccccccaacagaaca

SEQ ID NO: 4182107 - DNA, 18 bp, Homo sapiens
agaccccttcctttcctc

SEQ ID NO: 4182108 - DNA, 19 bp, Homo sapiens
agaccccttcctttcctct

SEQ ID NO: 4182109 - DNA, 19 bp, Homo sapiens
agaccctaagcctcctttt

SEQ ID NO: 4182110 - DNA, 14 bp, Homo sapiens
agaccttttttagg

SEQ ID NO: 4182111 - DNA, 14 bp, Homo sapiens
agacggattgcatt

SEQ ID NO: 4182112 - DNA, 17 bp, Homo sapiens
agacggctggacctgca

SEQ ID NO: 4182113 - DNA, 13 bp, Homo sapiens
agacgtgtacata

SEQ ID NO: 4182114 - DNA, 16 bp, Homo sapiens
agactattaagagcaa

SEQ ID NO: 4182115 - DNA, 15 bp, Homo sapiens
agactcagctccaga

SEQ ID NO: 4182116 - DNA, 16 bp, Homo sapiens
agactctggagccaag

SEQ ID NO: 4182117 - DNA, 16 bp, Homo sapiens
agactctgtggggcct

SEQ ID NO: 4182118 - DNA, 14 bp, Homo sapiens
agactgcagagggg

SEQ ID NO: 4182119 - DNA, 22 bp, Homo sapiens
agactgcgggatggtcctgggg

SEQ ID NO: 4182120 - DNA, 20 bp, Homo sapiens
agactgctgggactggccag

SEQ ID NO: 4182121 - DNA, 14 bp, Homo sapiens
agactggctggctg

SEQ ID NO: 4182122 - DNA, 19 bp, Homo sapiens
agacttcaagcatggctat

SEQ ID NO: 4182123 - DNA, 22 bp, Homo sapiens
agacttcaagcatggctatttt

SEQ ID NO: 4182124 - DNA, 14 bp, Homo sapiens
agactttctcagtg

SEQ ID NO: 4182125 - DNA, 17 bp, Homo sapiens
agagaaaataaaccaag

SEQ ID NO: 4182126 - DNA, 14 bp, Homo sapiens
agagaaagaagaga

SEQ ID NO: 4182127 - DNA, 17 bp, Homo sapiens
agagaaagaagagacag

SEQ ID NO: 4182128 - DNA, 20 bp, Homo sapiens
agagaaatttttatttttga

SEQ ID NO: 4182129 - DNA, 16 bp, Homo sapiens
agagaacaagaggtgc

SEQ ID NO: 4182130 - DNA, 14 bp, Homo sapiens
agagaaccaggagg

SEQ ID NO: 4182131 - DNA, 17 bp, Homo sapiens
agagaagaaagaacgga

SEQ ID NO: 4182132 - DNA, 20 bp, Homo sapiens
agagaagggaagcctcttca

SEQ ID NO: 4182133 - DNA, 16 bp, Homo sapiens
agagaagtagaaatca

SEQ ID NO: 4182134 - DNA, 15 bp, Homo sapiens
agagaataaacatca

SEQ ID NO: 4182135 - DNA, 13 bp, Homo sapiens
agagaatatttca

SEQ ID NO: 4182136 - DNA, 23 bp, Homo sapiens
agagacaatttaaggcctgcact

SEQ ID NO: 4182137 - DNA, 16 bp, Homo sapiens
agagacaggaaagaat

SEQ ID NO: 4182138 - DNA, 14 bp, Homo sapiens
agagacaggagggc

SEQ ID NO: 4182139 - DNA, 20 bp, Homo sapiens
agagaccccttcctttcctc

SEQ ID NO: 4182140 - DNA, 21 bp, Homo sapiens
agagaccccttcctttcctct

SEQ ID NO: 4182141 - DNA, 14 bp, Homo sapiens
agagacgtgtacat

SEQ ID NO: 4182142 - DNA, 18 bp, Homo sapiens
agagacttggggaccaga

SEQ ID NO: 4182143 - DNA, 16 bp, Homo sapiens
agagacttttaatcag

SEQ ID NO: 4182144 - DNA, 19 bp, Homo sapiens
agagacttttaatcagaca

SEQ ID NO: 4182145 - DNA, 23 bp, Homo sapiens
agagagaaccaggagggtaacag

SEQ ID NO: 4182146 - DNA, 12 bp, Homo sapiens
agagaggaaaag

SEQ ID NO: 4182147 - DNA, 18 bp, Homo sapiens
agagaggaccccactgga

SEQ ID NO: 4182148 - DNA, 20 bp, Homo sapiens
agagaggcgcgtctgcccca

SEQ ID NO: 4182149 - DNA, 17 bp, Homo sapiens
agagaggtagcgagctg

SEQ ID NO: 4182150 - DNA, 21 bp, Homo sapiens
agagatagcagaggaaaaaga

SEQ ID NO: 4182151 - DNA, 20 bp, Homo sapiens
agagatatgcagaaggaagg

SEQ ID NO: 4182152 - DNA, 14 bp, Homo sapiens
agagatcaggaaga

SEQ ID NO: 4182153 - DNA, 16 bp, Homo sapiens
agagatgcatgcgcag

SEQ ID NO: 4182154 - DNA, 12 bp, Homo sapiens
agagatgtagca

SEQ ID NO: 4182155 - DNA, 18 bp, Homo sapiens
agagcaagactccatttc

SEQ ID NO: 4182156 - DNA, 21 bp, Homo sapiens
agagcaatgcccgtaatgctt

SEQ ID NO: 4182157 - DNA, 14 bp, Homo sapiens
agagcacagcccac

SEQ ID NO: 4182158 - DNA, 18 bp, Homo sapiens
agagcactgccaccagta

SEQ ID NO: 4182159 - DNA, 13 bp, Homo sapiens
agagcagctggct

SEQ ID NO: 4182160 - DNA, 16 bp, Homo sapiens
agagcagctggctctc

SEQ ID NO: 4182161 - DNA, 22 bp, Homo sapiens
agagcattacgtgagccaggta

SEQ ID NO: 4182162 - DNA, 16 bp, Homo sapiens
agagccactacctttg

SEQ ID NO: 4182163 - DNA, 16 bp, Homo sapiens
agagccactctatgag

SEQ ID NO: 4182164 - DNA, 18 bp, Homo sapiens
agagccagctctctctac

SEQ ID NO: 4182165 - DNA, 14 bp, Homo sapiens
agagccaggctctg

SEQ ID NO: 4182166 - DNA, 17 bp, Homo sapiens
agagccaggctctgcct

SEQ ID NO: 4182167 - DNA, 20 bp, Homo sapiens
agagccaggctctgcctgga

SEQ ID NO: 4182168 - DNA, 18 bp, Homo sapiens
agagccccccgtgtggct

SEQ ID NO: 4182169 - DNA, 20 bp, Homo sapiens
agagccggggcactttcaga

SEQ ID NO: 4182170 - DNA, 13 bp, Homo sapiens
agagcctggagaa

SEQ ID NO: 4182171 - DNA, 17 bp, Homo sapiens
agagcctggagaagctg

SEQ ID NO: 4182172 - DNA, 11 bp, Homo sapiens
agagcctggca

SEQ ID NO: 4182173 - DNA, 13 bp, Homo sapiens
agagcctggcaag

SEQ ID NO: 4182174 - DNA, 17 bp, Homo sapiens
agagcgcctcttcctct

SEQ ID NO: 4182175 - DNA, 18 bp, Homo sapiens
agagcgcctcttcctctg

SEQ ID NO: 4182176 - DNA, 22 bp, Homo sapiens
agagcgcctcttcctctgggca

SEQ ID NO: 4182177 - DNA, 11 bp, Homo sapiens
agagctacata

SEQ ID NO: 4182178 - DNA, 16 bp, Homo sapiens
agagctacgtatttaa

SEQ ID NO: 4182179 - DNA, 16 bp, Homo sapiens
agagctgatggagaag

SEQ ID NO: 4182180 - DNA, 17 bp, Homo sapiens
agagctgatggagaagg

SEQ ID NO: 4182181 - DNA, 23 bp, Homo sapiens
agagctgctctggaaaatgtgac

SEQ ID NO: 4182182 - DNA, 18 bp, Homo sapiens
agagctggcaaaggtggc

SEQ ID NO: 4182183 - DNA, 20 bp, Homo sapiens
agagcttggtggctgagctt

SEQ ID NO: 4182184 - DNA, 15 bp, Homo sapiens
agaggaaaaagaaaa

SEQ ID NO: 4182185 - DNA, 21 bp, Homo sapiens
agaggaagcacactgcagggc

SEQ ID NO: 4182186 - DNA, 16 bp, Homo sapiens
agaggacagtctggag

SEQ ID NO: 4182187 - DNA, 12 bp, Homo sapiens
agaggactctgc

SEQ ID NO: 4182188 - DNA, 22 bp, Homo sapiens
agaggaggaagactctggagcc

SEQ ID NO: 4182189 - DNA, 17 bp, Homo sapiens
agaggagggatgctgcc

SEQ ID NO: 4182190 - DNA, 16 bp, Homo sapiens
agaggagttgccaggg

SEQ ID NO: 4182191 - DNA, 13 bp, Homo sapiens
agaggcacctgct

SEQ ID NO: 4182192 - DNA, 16 bp, Homo sapiens
agaggcacctgctgga

SEQ ID NO: 4182193 - DNA, 14 bp, Homo sapiens
agaggcagagaaag

SEQ ID NO: 4182194 - DNA, 22 bp, Homo sapiens
agaggcagagtgaaataaaatg

SEQ ID NO: 4182195 - DNA, 22 bp, Homo sapiens
agaggcagtaggaacccagctc

SEQ ID NO: 4182196 - DNA, 19 bp, Homo sapiens
agaggccaggaatctgcca

SEQ ID NO: 4182197 - DNA, 16 bp, Homo sapiens
agaggctggtgctgtg

SEQ ID NO: 4182198 - DNA, 17 bp, Homo sapiens
agagggaagagtgcatt

SEQ ID NO: 4182199 - DNA, 16 bp, Homo sapiens
agagggagaggaagca

SEQ ID NO: 4182200 - DNA, 15 bp, Homo sapiens
agagggataaggcag

SEQ ID NO: 4182201 - DNA, 19 bp, Homo sapiens
agagggataaggcagttga

SEQ ID NO: 4182202 - DNA, 22 bp, Homo sapiens
agaggggaaaccagtgtagcct

SEQ ID NO: 4182203 - DNA, 18 bp, Homo sapiens
agaggggctttctggaga

SEQ ID NO: 4182204 - DNA, 20 bp, Homo sapiens
agaggtaaaagtgtgagcag

SEQ ID NO: 4182205 - DNA, 23 bp, Homo sapiens
agaggtaaaagtgtgagcagtga

SEQ ID NO: 4182206 - DNA, 19 bp, Homo sapiens
agaggtagcgagctgctct

SEQ ID NO: 4182207 - DNA, 22 bp, Homo sapiens
agaggtgacccaatgctcctgg

SEQ ID NO: 4182208 - DNA, 23 bp, Homo sapiens
agaggtgagaccaaaggatccag

SEQ ID NO: 4182209 - DNA, 19 bp, Homo sapiens
agaggtggattcctgggca

SEQ ID NO: 4182210 - DNA, 16 bp, Homo sapiens
agaggttagaaatact

SEQ ID NO: 4182211 - DNA, 19 bp, Homo sapiens
agaggttttgttgttttat

SEQ ID NO: 4182212 - DNA, 14 bp, Homo sapiens
agagtaccatgctg

SEQ ID NO: 4182213 - DNA, 23 bp, Homo sapiens
agagtagcaagttctagagaaga

SEQ ID NO: 4182214 - DNA, 20 bp, Homo sapiens
agagtcagccattcctgttc

SEQ ID NO: 4182215 - DNA, 13 bp, Homo sapiens
agagtcagccctt

SEQ ID NO: 4182216 - DNA, 18 bp, Homo sapiens
agagtcagccttccccct

SEQ ID NO: 4182217 - DNA, 16 bp, Homo sapiens
agagtgaaataaaatg

SEQ ID NO: 4182218 - DNA, 14 bp, Homo sapiens
agagtgccactgcg

SEQ ID NO: 4182219 - DNA, 15 bp, Homo sapiens
agagttcaagaaata

SEQ ID NO: 4182220 - DNA, 18 bp, Homo sapiens
agagttcaagaaataagt

SEQ ID NO: 4182221 - DNA, 15 bp, Homo sapiens
agagtttaacacaag

SEQ ID NO: 4182222 - DNA, 23 bp, Homo sapiens
agataaacagtttagcccatctc

SEQ ID NO: 4182223 - DNA, 21 bp, Homo sapiens
agataacaagatctttcagga

SEQ ID NO: 4182224 - DNA, 21 bp, Homo sapiens
agataaccagctgtaacacag

SEQ ID NO: 4182225 - DNA, 22 bp, Homo sapiens
agataactgaaaattatttaaa

SEQ ID NO: 4182226 - DNA, 18 bp, Homo sapiens
agataaggtaaaatgcca

SEQ ID NO: 4182227 - DNA, 18 bp, Homo sapiens
agataatggataatcttc

SEQ ID NO: 4182228 - DNA, 15 bp, Homo sapiens
agataattttatgtg

SEQ ID NO: 4182229 - DNA, 14 bp, Homo sapiens
agatacatacagaa

SEQ ID NO: 4182230 - DNA, 15 bp, Homo sapiens
agatacatacagaat

SEQ ID NO: 4182231 - DNA, 22 bp, Homo sapiens
agataccagctttttctctcag

SEQ ID NO: 4182232 - DNA, 15 bp, Homo sapiens
agatacggttgcttc

SEQ ID NO: 4182233 - DNA, 18 bp, Homo sapiens
agatagaaagcaataaaa

SEQ ID NO: 4182234 - DNA, 20 bp, Homo sapiens
agatagaacaggctggttct

SEQ ID NO: 4182235 - DNA, 16 bp, Homo sapiens
agatagaatttccaat

SEQ ID NO: 4182236 - DNA, 22 bp, Homo sapiens
agatatatatttactaaaagaa

SEQ ID NO: 4182237 - DNA, 14 bp, Homo sapiens
agatatatttttca

SEQ ID NO: 4182238 - DNA, 16 bp, Homo sapiens
agatatatttttcaca

SEQ ID NO: 4182239 - DNA, 17 bp, Homo sapiens
agatatcagtgtctccc

SEQ ID NO: 4182240 - DNA, 21 bp, Homo sapiens
agatcagccacggagcctgga

SEQ ID NO: 4182241 - DNA, 17 bp, Homo sapiens
agatcatggcagcatga

SEQ ID NO: 4182242 - DNA, 21 bp, Homo sapiens
agatccatttggacaaaatgg

SEQ ID NO: 4182243 - DNA, 22 bp, Homo sapiens
agatcccgcctcttcttcttca

SEQ ID NO: 4182244 - DNA, 16 bp, Homo sapiens
agatcctgtttcagct

SEQ ID NO: 4182245 - DNA, 20 bp, Homo sapiens
agatcgcgccactgcactcc

SEQ ID NO: 4182246 - DNA, 21 bp, Homo sapiens
agatctttcaggaaagacgga

SEQ ID NO: 4182247 - DNA, 20 bp, Homo sapiens
agatgaaaggagtaagaaat

SEQ ID NO: 4182248 - DNA, 21 bp, Homo sapiens
agatgaaaggagtaagaaatt

SEQ ID NO: 4182249 - DNA, 14 bp, Homo sapiens
agatgactgagtcc

SEQ ID NO: 4182250 - DNA, 15 bp, Homo sapiens
agatgatgatgatga

SEQ ID NO: 4182251 - DNA, 21 bp, Homo sapiens
agatgccttcctgtctttctg

SEQ ID NO: 4182252 - DNA, 21 bp, Homo sapiens
agatgctgtcactggcagagc

SEQ ID NO: 4182253 - DNA, 17 bp, Homo sapiens
agatgctttgtgactta

SEQ ID NO: 4182254 - DNA, 20 bp, Homo sapiens
agatgcttttaacagagtct

SEQ ID NO: 4182255 - DNA, 22 bp, Homo sapiens
agatggcaatgggtactccagc

SEQ ID NO: 4182256 - DNA, 21 bp, Homo sapiens
agatgggtctggctgagctga

SEQ ID NO: 4182257 - DNA, 15 bp, Homo sapiens
agatgtgtctgggag

SEQ ID NO: 4182258 - DNA, 19 bp, Homo sapiens
agatgtgtctgggagagcc

SEQ ID NO: 4182259 - DNA, 21 bp, Homo sapiens
agatgtgtctgggagagcctg

SEQ ID NO: 4182260 - DNA, 17 bp, Homo sapiens
agatgtgtgtgtgtgta

SEQ ID NO: 4182261 - DNA, 17 bp, Homo sapiens
agatgtttgatagattt

SEQ ID NO: 4182262 - DNA, 19 bp, Homo sapiens
agatgtttgatagattttc

SEQ ID NO: 4182263 - DNA, 20 bp, Homo sapiens
agatgttttccatttgggca

SEQ ID NO: 4182264 - DNA, 11 bp, Homo sapiens
agattaaagga

SEQ ID NO: 4182265 - DNA, 12 bp, Homo sapiens
agattaaaggaa

SEQ ID NO: 4182266 - DNA, 14 bp, Homo sapiens
agattaaaggaagg

SEQ ID NO: 4182267 - DNA, 15 bp, Homo sapiens
agattactttgtccc

SEQ ID NO: 4182268 - DNA, 16 bp, Homo sapiens
agattactttgtcccg

SEQ ID NO: 4182269 - DNA, 17 bp, Homo sapiens
agattagaggtttgtca

SEQ ID NO: 4182270 - DNA, 14 bp, Homo sapiens
agattgagaagcca

SEQ ID NO: 4182271 - DNA, 15 bp, Homo sapiens
agattgagaagccat

SEQ ID NO: 4182272 - DNA, 21 bp, Homo sapiens
agatttaacactaaaattcca

SEQ ID NO: 4182273 - DNA, 14 bp, Homo sapiens
agatttcaacatat

SEQ ID NO: 4182274 - DNA, 20 bp, Homo sapiens
agatttcggtcataaagaat

SEQ ID NO: 4182275 - DNA, 19 bp, Homo sapiens
agatttgtgaactggaaga

SEQ ID NO: 4182276 - DNA, 13 bp, Homo sapiens
agattttagttca

SEQ ID NO: 4182277 - DNA, 16 bp, Homo sapiens
agattttttaataatt

SEQ ID NO: 4182278 - DNA, 17 bp, Homo sapiens
agcaaaaagatgccttt

SEQ ID NO: 4182279 - DNA, 14 bp, Homo sapiens
agcaaaagaagaag

SEQ ID NO: 4182280 - DNA, 15 bp, Homo sapiens
agcaaaaggctgaga

SEQ ID NO: 4182281 - DNA, 18 bp, Homo sapiens
agcaaaaggctgagaagg

SEQ ID NO: 4182282 - DNA, 15 bp, Homo sapiens
agcaaacaccagtga

SEQ ID NO: 4182283 - DNA, 22 bp, Homo sapiens
agcaaagcaccagcttctccag

SEQ ID NO: 4182284 - DNA, 17 bp, Homo sapiens
agcaaaggaaaccaaag

SEQ ID NO: 4182285 - DNA, 20 bp, Homo sapiens
agcaaagtctaaagtttaca

SEQ ID NO: 4182286 - DNA, 23 bp, Homo sapiens
agcaaagtctaaagtttacagta

SEQ ID NO: 4182287 - DNA, 11 bp, Homo sapiens
agcaaatcacc

SEQ ID NO: 4182288 - DNA, 17 bp, Homo sapiens
agcaaatcgaatgaaat

SEQ ID NO: 4182289 - DNA, 14 bp, Homo sapiens
agcaacacaagctg

SEQ ID NO: 4182290 - DNA, 17 bp, Homo sapiens
agcaacacaagctggaa

SEQ ID NO: 4182291 - DNA, 18 bp, Homo sapiens
agcaacacaagctggaag

SEQ ID NO: 4182292 - DNA, 16 bp, Homo sapiens
agcaacagataaagtt

SEQ ID NO: 4182293 - DNA, 15 bp, Homo sapiens
agcaactccgtgtgc

SEQ ID NO: 4182294 - DNA, 21 bp, Homo sapiens
agcaactctccactccatatt

SEQ ID NO: 4182295 - DNA, 17 bp, Homo sapiens
agcaagactccatttca

SEQ ID NO: 4182296 - DNA, 13 bp, Homo sapiens
agcaagagctggc

SEQ ID NO: 4182297 - DNA, 21 bp, Homo sapiens
agcaagcattcagaagaaaaa

SEQ ID NO: 4182298 - DNA, 16 bp, Homo sapiens
agcaagtgagcagatg

SEQ ID NO: 4182299 - DNA, 17 bp, Homo sapiens
agcaagttctagagaag

SEQ ID NO: 4182300 - DNA, 23 bp, Homo sapiens
agcaagttctagagaagaggctg

SEQ ID NO: 4182301 - DNA, 15 bp, Homo sapiens
agcaatatgtaaata

SEQ ID NO: 4182302 - DNA, 23 bp, Homo sapiens
agcaatccatgttagtttttact

SEQ ID NO: 4182303 - DNA, 21 bp, Homo sapiens
agcaatgcccgtaatgcttag

SEQ ID NO: 4182304 - DNA, 14 bp, Homo sapiens
agcaattagcagaa

SEQ ID NO: 4182305 - DNA, 15 bp, Homo sapiens
agcaattagcagaag

SEQ ID NO: 4182306 - DNA, 18 bp, Homo sapiens
agcaattagcagaagtga

SEQ ID NO: 4182307 - DNA, 15 bp, Homo sapiens
agcacaaagagggag

SEQ ID NO: 4182308 - DNA, 18 bp, Homo sapiens
agcacaaatttcatctcc

SEQ ID NO: 4182309 - DNA, 17 bp, Homo sapiens
agcacaactcagtctgt

SEQ ID NO: 4182310 - DNA, 22 bp, Homo sapiens
agcacactgcagggctgctgtg

SEQ ID NO: 4182311 - DNA, 15 bp, Homo sapiens
agcacagacattaaa

SEQ ID NO: 4182312 - DNA, 21 bp, Homo sapiens
agcacatgtctgtcctcagag

SEQ ID NO: 4182313 - DNA, 19 bp, Homo sapiens
agcaccagcttctccaggc

SEQ ID NO: 4182314 - DNA, 20 bp, Homo sapiens
agcaccagcttctccaggct

SEQ ID NO: 4182315 - DNA, 21 bp, Homo sapiens
agcaccagcttctccaggctc

SEQ ID NO: 4182316 - DNA, 12 bp, Homo sapiens
agcaccccctca

SEQ ID NO: 4182317 - DNA, 13 bp, Homo sapiens
agcacctgaacca

SEQ ID NO: 4182318 - DNA, 14 bp, Homo sapiens
agcacctgaaccac

SEQ ID NO: 4182319 - DNA, 16 bp, Homo sapiens
agcacctgaaccactg

SEQ ID NO: 4182320 - DNA, 20 bp, Homo sapiens
agcacctgcttcatgctcag

SEQ ID NO: 4182321 - DNA, 16 bp, Homo sapiens
agcactagcattcagg

SEQ ID NO: 4182322 - DNA, 21 bp, Homo sapiens
agcactcctcggtactcccat

SEQ ID NO: 4182323 - DNA, 14 bp, Homo sapiens
agcactgccaccag

SEQ ID NO: 4182324 - DNA, 12 bp, Homo sapiens
agcactttggga

SEQ ID NO: 4182325 - DNA, 19 bp, Homo sapiens
agcagaaaatataaatggt

SEQ ID NO: 4182326 - DNA, 15 bp, Homo sapiens
agcagaaagattaaa

SEQ ID NO: 4182327 - DNA, 13 bp, Homo sapiens
agcagaagtgacc

SEQ ID NO: 4182328 - DNA, 16 bp, Homo sapiens
agcagagcagaacttt

SEQ ID NO: 4182329 - DNA, 22 bp, Homo sapiens
agcagagctgatggagaaggaa

SEQ ID NO: 4182330 - DNA, 22 bp, Homo sapiens
agcagaggaaaaagaaaaacat

SEQ ID NO: 4182331 - DNA, 22 bp, Homo sapiens
agcagaggacagtctggagaag

SEQ ID NO: 4182332 - DNA, 13 bp, Homo sapiens
agcagaggcagcg

SEQ ID NO: 4182333 - DNA, 17 bp, Homo sapiens
agcagcagatctgtagt

SEQ ID NO: 4182334 - DNA, 23 bp, Homo sapiens
agcagcccctctttaacctcatc

SEQ ID NO: 4182335 - DNA, 16 bp, Homo sapiens
agcagcttcagttgtt

SEQ ID NO: 4182336 - DNA, 10 bp, Homo sapiens
agcaggagca

SEQ ID NO: 4182337 - DNA, 12 bp, Homo sapiens
agcaggcaggca

SEQ ID NO: 4182338 - DNA, 22 bp, Homo sapiens
agcaggccttagtacggctgct

SEQ ID NO: 4182339 - DNA, 23 bp, Homo sapiens
agcaggccttagtacggctgctg

SEQ ID NO: 4182340 - DNA, 16 bp, Homo sapiens
agcagggctctgcccc

SEQ ID NO: 4182341 - DNA, 17 bp, Homo sapiens
agcaggtaggggcacag

SEQ ID NO: 4182342 - DNA, 19 bp, Homo sapiens
agcaggtaggggcacagtg

SEQ ID NO: 4182343 - DNA, 13 bp, Homo sapiens
agcaggtggtcct

SEQ ID NO: 4182344 - DNA, 21 bp, Homo sapiens
agcaggtggtcctgagacctg

SEQ ID NO: 4182345 - DNA, 16 bp, Homo sapiens
agcagtaagcaggcct

SEQ ID NO: 4182346 - DNA, 19 bp, Homo sapiens
agcagtgattgtcttaata

SEQ ID NO: 4182347 - DNA, 18 bp, Homo sapiens
agcagttccatgaagaca

SEQ ID NO: 4182348 - DNA, 23 bp, Homo sapiens
agcagttgagtcgtcatcacttt

SEQ ID NO: 4182349 - DNA, 13 bp, Homo sapiens
agcatcacctcag

SEQ ID NO: 4182350 - DNA, 18 bp, Homo sapiens
agcatccccttgaactct

SEQ ID NO: 4182351 - DNA, 19 bp, Homo sapiens
agcatccttttctgcagag

SEQ ID NO: 4182352 - DNA, 15 bp, Homo sapiens
agcatctactctagg

SEQ ID NO: 4182353 - DNA, 15 bp, Homo sapiens
agcatcttgtcaaga

SEQ ID NO: 4182354 - DNA, 15 bp, Homo sapiens
agcatggctatttta

SEQ ID NO: 4182355 - DNA, 17 bp, Homo sapiens
agcatggctattttata

SEQ ID NO: 4182356 - DNA, 18 bp, Homo sapiens
agcatggctattttatat

SEQ ID NO: 4182357 - DNA, 18 bp, Homo sapiens
agcattacgtgagccagg

SEQ ID NO: 4182358 - DNA, 19 bp, Homo sapiens
agcattacgtgagccaggt

SEQ ID NO: 4182359 - DNA, 14 bp, Homo sapiens
agcattcagaagaa

SEQ ID NO: 4182360 - DNA, 17 bp, Homo sapiens
agcattcagaagaaaaa

SEQ ID NO: 4182361 - DNA, 17 bp, Homo sapiens
agcattctgagctgggc

SEQ ID NO: 4182362 - DNA, 18 bp, Homo sapiens
agcattctgagctgggct

SEQ ID NO: 4182363 - DNA, 18 bp, Homo sapiens
agcatttgccattcctgg

SEQ ID NO: 4182364 - DNA, 19 bp, Homo sapiens
agcatttgccattcctgga

SEQ ID NO: 4182365 - DNA, 11 bp, Homo sapiens
agcattttata

SEQ ID NO: 4182366 - DNA, 14 bp, Homo sapiens
agcattttcacatt

SEQ ID NO: 4182367 - DNA, 16 bp, Homo sapiens
agcatttttgatttat

SEQ ID NO: 4182368 - DNA, 12 bp, Homo sapiens
agccaaaacact

SEQ ID NO: 4182369 - DNA, 15 bp, Homo sapiens
agccaaaacacttag

SEQ ID NO: 4182370 - DNA, 17 bp, Homo sapiens
agccaacaggtggcagg

SEQ ID NO: 4182371 - DNA, 20 bp, Homo sapiens
agccaacttggctttcccgg

SEQ ID NO: 4182372 - DNA, 19 bp, Homo sapiens
agccaagatcgcgccactg

SEQ ID NO: 4182373 - DNA, 16 bp, Homo sapiens
agccaaggcagagggg

SEQ ID NO: 4182374 - DNA, 19 bp, Homo sapiens
agccaaggcagaggggagc

SEQ ID NO: 4182375 - DNA, 19 bp, Homo sapiens
agccaagggctaggctctt

SEQ ID NO: 4182376 - DNA, 20 bp, Homo sapiens
agccaaggtgggctgagccc

SEQ ID NO: 4182377 - DNA, 23 bp, Homo sapiens
agccaaggtgggctgagccctgg

SEQ ID NO: 4182378 - DNA, 15 bp, Homo sapiens
agccaccctgcccag

SEQ ID NO: 4182379 - DNA, 19 bp, Homo sapiens
agccactcgggaggctgag

SEQ ID NO: 4182380 - DNA, 21 bp, Homo sapiens
agccagccaggaactggctcc

SEQ ID NO: 4182381 - DNA, 15 bp, Homo sapiens
agccagccggtgcct

SEQ ID NO: 4182382 - DNA, 17 bp, Homo sapiens
agccagccggtgcctgg

SEQ ID NO: 4182383 - DNA, 18 bp, Homo sapiens
agccagccggtgcctggc

SEQ ID NO: 4182384 - DNA, 20 bp, Homo sapiens
agccagctcatttggttcag

SEQ ID NO: 4182385 - DNA, 16 bp, Homo sapiens
agccaggaactggctc

SEQ ID NO: 4182386 - DNA, 19 bp, Homo sapiens
agccaggaactggctcctt

SEQ ID NO: 4182387 - DNA, 21 bp, Homo sapiens
agccaggagttgacgcatcct

SEQ ID NO: 4182388 - DNA, 14 bp, Homo sapiens
agccaggctctgcc

SEQ ID NO: 4182389 - DNA, 17 bp, Homo sapiens
agccagggccaggggtc

SEQ ID NO: 4182390 - DNA, 18 bp, Homo sapiens
agccatcaacaagagttg

SEQ ID NO: 4182391 - DNA, 20 bp, Homo sapiens
agccatcccttccctgtcca

SEQ ID NO: 4182392 - DNA, 20 bp, Homo sapiens
agccattttggggggccccc

SEQ ID NO: 4182393 - DNA, 23 bp, Homo sapiens
agcccaaggtgctgatgtcaaag

SEQ ID NO: 4182394 - DNA, 15 bp, Homo sapiens
agcccacttgtcatc

SEQ ID NO: 4182395 - DNA, 17 bp, Homo sapiens
agcccagaaccacagat

SEQ ID NO: 4182396 - DNA, 21 bp, Homo sapiens
agcccagccattaccatggag

SEQ ID NO: 4182397 - DNA, 23 bp, Homo sapiens
agcccagccattaccatggagac

SEQ ID NO: 4182398 - DNA, 19 bp, Homo sapiens
agcccaggagtttgaggct

SEQ ID NO: 4182399 - DNA, 20 bp, Homo sapiens
agccccttgctctcccctgc

SEQ ID NO: 4182400 - DNA, 17 bp, Homo sapiens
agcccgcttcaagctct

SEQ ID NO: 4182401 - DNA, 20 bp, Homo sapiens
agcccgcttcaagctctctg

SEQ ID NO: 4182402 - DNA, 22 bp, Homo sapiens
agcccgggtgtgcctgccctgg

SEQ ID NO: 4182403 - DNA, 15 bp, Homo sapiens
agccctaaacatcat

SEQ ID NO: 4182404 - DNA, 14 bp, Homo sapiens
agccctcctacgca

SEQ ID NO: 4182405 - DNA, 19 bp, Homo sapiens
agccctgcctatcctctgt

SEQ ID NO: 4182406 - DNA, 20 bp, Homo sapiens
agccctgcctatcctctgta

SEQ ID NO: 4182407 - DNA, 12 bp, Homo sapiens
agccctggcagg

SEQ ID NO: 4182408 - DNA, 17 bp, Homo sapiens
agccctggcaggatgac

SEQ ID NO: 4182409 - DNA, 21 bp, Homo sapiens
agccctggcaggatgaccctg

SEQ ID NO: 4182410 - DNA, 15 bp, Homo sapiens
agcccttggcttctg

SEQ ID NO: 4182411 - DNA, 21 bp, Homo sapiens
agccgacaccttttttcaaca

SEQ ID NO: 4182412 - DNA, 23 bp, Homo sapiens
agccgtgcctttctctggctcca

SEQ ID NO: 4182413 - DNA, 13 bp, Homo sapiens
agcctacagcagt

SEQ ID NO: 4182414 - DNA, 22 bp, Homo sapiens
agcctagaacatccctgggcaa

SEQ ID NO: 4182415 - DNA, 17 bp, Homo sapiens
agcctcccgagtagctg

SEQ ID NO: 4182416 - DNA, 14 bp, Homo sapiens
agcctcctgacctg

SEQ ID NO: 4182417 - DNA, 17 bp, Homo sapiens
agcctcctgacctgagg

SEQ ID NO: 4182418 - DNA, 19 bp, Homo sapiens
agcctcctgacctgaggct

SEQ ID NO: 4182419 - DNA, 22 bp, Homo sapiens
agcctcctgacctgaggctcct

SEQ ID NO: 4182420 - DNA, 12 bp, Homo sapiens
agcctctccagg

SEQ ID NO: 4182421 - DNA, 14 bp, Homo sapiens
agcctctccaggaa

SEQ ID NO: 4182422 - DNA, 17 bp, Homo sapiens
agcctcttccctctgat

SEQ ID NO: 4182423 - DNA, 17 bp, Homo sapiens
agcctgacaacatttct

SEQ ID NO: 4182424 - DNA, 22 bp, Homo sapiens
agcctgcagcgagctgagatca

SEQ ID NO: 4182425 - DNA, 19 bp, Homo sapiens
agcctgccgccgtctctgt

SEQ ID NO: 4182426 - DNA, 23 bp, Homo sapiens
agcctgccgccgtctctgtcccg

SEQ ID NO: 4182427 - DNA, 14 bp, Homo sapiens
agcctggagaagct

SEQ ID NO: 4182428 - DNA, 12 bp, Homo sapiens
agcctggcaagg

SEQ ID NO: 4182429 - DNA, 12 bp, Homo sapiens
agcctggccctt

SEQ ID NO: 4182430 - DNA, 14 bp, Homo sapiens
agcctggcttctgg

SEQ ID NO: 4182431 - DNA, 19 bp, Homo sapiens
agcctggcttctggagccc

SEQ ID NO: 4182432 - DNA, 20 bp, Homo sapiens
agcctgggcgacagagcaag

SEQ ID NO: 4182433 - DNA, 20 bp, Homo sapiens
agcctggggtgatagaacaa

SEQ ID NO: 4182434 - DNA, 17 bp, Homo sapiens
agcctgggtaggaaaat

SEQ ID NO: 4182435 - DNA, 19 bp, Homo sapiens
agcctgtatagacagcact

SEQ ID NO: 4182436 - DNA, 20 bp, Homo sapiens
agcctgttgagacttagata

SEQ ID NO: 4182437 - DNA, 18 bp, Homo sapiens
agcctgttttgttggaag

SEQ ID NO: 4182438 - DNA, 19 bp, Homo sapiens
agccttccccctcccaggg

SEQ ID NO: 4182439 - DNA, 17 bp, Homo sapiens
agccttcttttcaaaac

SEQ ID NO: 4182440 - DNA, 18 bp, Homo sapiens
agcctttggatgaccaga

SEQ ID NO: 4182441 - DNA, 21 bp, Homo sapiens
agcgagttgtggaaagcctct

SEQ ID NO: 4182442 - DNA, 18 bp, Homo sapiens
agcgatgaatttggagac

SEQ ID NO: 4182443 - DNA, 19 bp, Homo sapiens
agcgatgaatttggagact

SEQ ID NO: 4182444 - DNA, 12 bp, Homo sapiens
agcgcacctgcc

SEQ ID NO: 4182445 - DNA, 14 bp, Homo sapiens
agcgcacctgcccc

SEQ ID NO: 4182446 - DNA, 17 bp, Homo sapiens
agcgcacctgccccctg

SEQ ID NO: 4182447 - DNA, 19 bp, Homo sapiens
agcgcacctgccccctggt

SEQ ID NO: 4182448 - DNA, 21 bp, Homo sapiens
agcgcacctgccccctggtgg

SEQ ID NO: 4182449 - DNA, 21 bp, Homo sapiens
agcgccctggagtcccctggg

SEQ ID NO: 4182450 - DNA, 17 bp, Homo sapiens
agcgcctcttcctctgg

SEQ ID NO: 4182451 - DNA, 21 bp, Homo sapiens
agcgcctcttcctctgggcag

SEQ ID NO: 4182452 - DNA, 18 bp, Homo sapiens
agcgcgggcggaggcggc

SEQ ID NO: 4182453 - DNA, 14 bp, Homo sapiens
agcgcgtgcacagc

SEQ ID NO: 4182454 - DNA, 17 bp, Homo sapiens
agcgctttctggaaaag

SEQ ID NO: 4182455 - DNA, 13 bp, Homo sapiens
agcggagcttgcc

SEQ ID NO: 4182456 - DNA, 15 bp, Homo sapiens
agcggagcttgcctg

SEQ ID NO: 4182457 - DNA, 18 bp, Homo sapiens
agcggagcttgcctgcct

SEQ ID NO: 4182458 - DNA, 23 bp, Homo sapiens
agcggaggttgcagggagccgag

SEQ ID NO: 4182459 - DNA, 21 bp, Homo sapiens
agcgtgtgtatccgactctaa

SEQ ID NO: 4182460 - DNA, 20 bp, Homo sapiens
agctaaatgcagggaaactc

SEQ ID NO: 4182461 - DNA, 13 bp, Homo sapiens
agctaagtagaaa

SEQ ID NO: 4182462 - DNA, 14 bp, Homo sapiens
agctaatttttgta

SEQ ID NO: 4182463 - DNA, 17 bp, Homo sapiens
agctacccaggaggctg

SEQ ID NO: 4182464 - DNA, 19 bp, Homo sapiens
agctactcagaagcctgag

SEQ ID NO: 4182465 - DNA, 19 bp, Homo sapiens
agctactctcttgccagca

SEQ ID NO: 4182466 - DNA, 23 bp, Homo sapiens
agctactgccgtcagtgctgtgc

SEQ ID NO: 4182467 - DNA, 19 bp, Homo sapiens
agctaggatggttctgtga

SEQ ID NO: 4182468 - DNA, 21 bp, Homo sapiens
agctaggatggttctgtgacc

SEQ ID NO: 4182469 - DNA, 18 bp, Homo sapiens
agctagttcgtagctttc

SEQ ID NO: 4182470 - DNA, 15 bp, Homo sapiens
agctattactgtctg

SEQ ID NO: 4182471 - DNA, 20 bp, Homo sapiens
agctattactgtctggtttt

SEQ ID NO: 4182472 - DNA, 22 bp, Homo sapiens
agctatttatgtaaaatcaata

SEQ ID NO: 4182473 - DNA, 20 bp, Homo sapiens
agctcagctcgctgcccagg

SEQ ID NO: 4182474 - DNA, 13 bp, Homo sapiens
agctcaggaggcg

SEQ ID NO: 4182475 - DNA, 23 bp, Homo sapiens
agctcaggaggcgaataaatgtt

SEQ ID NO: 4182476 - DNA, 17 bp, Homo sapiens
agctcaggaggcttgga

SEQ ID NO: 4182477 - DNA, 19 bp, Homo sapiens
agctcagggtttcggaaat

SEQ ID NO: 4182478 - DNA, 19 bp, Homo sapiens
agctccagaataccttctt

SEQ ID NO: 4182479 - DNA, 16 bp, Homo sapiens
agctccagtttccaag

SEQ ID NO: 4182480 - DNA, 14 bp, Homo sapiens
agctcctctgctgc

SEQ ID NO: 4182481 - DNA, 18 bp, Homo sapiens
agctcctctgctgctccc

SEQ ID NO: 4182482 - DNA, 13 bp, Homo sapiens
agctctcagggct

SEQ ID NO: 4182483 - DNA, 17 bp, Homo sapiens
agctctctgctgagcag

SEQ ID NO: 4182484 - DNA, 21 bp, Homo sapiens
agctctctgctgagcagccca

SEQ ID NO: 4182485 - DNA, 12 bp, Homo sapiens
agctctggcttc

SEQ ID NO: 4182486 - DNA, 20 bp, Homo sapiens
agctctggcttccagaaaac

SEQ ID NO: 4182487 - DNA, 16 bp, Homo sapiens
agctcttaccaaaaca

SEQ ID NO: 4182488 - DNA, 15 bp, Homo sapiens
agctcttcactcagc

SEQ ID NO: 4182489 - DNA, 17 bp, Homo sapiens
agctcttcactcagcca

SEQ ID NO: 4182490 - DNA, 20 bp, Homo sapiens
agctcttcactcagccacac

SEQ ID NO: 4182491 - DNA, 18 bp, Homo sapiens
agctgaatgagtctgctt

SEQ ID NO: 4182492 - DNA, 19 bp, Homo sapiens
agctgaatgagtctgcttt

SEQ ID NO: 4182493 - DNA, 19 bp, Homo sapiens
agctgactagatctctgga

SEQ ID NO: 4182494 - DNA, 18 bp, Homo sapiens
agctgagcaacctcttca

SEQ ID NO: 4182495 - DNA, 23 bp, Homo sapiens
agctgaggggggccgtgcccagg

SEQ ID NO: 4182496 - DNA, 15 bp, Homo sapiens
agctgatggagaagg

SEQ ID NO: 4182497 - DNA, 22 bp, Homo sapiens
agctgcacctgccagcctggct

SEQ ID NO: 4182498 - DNA, 18 bp, Homo sapiens
agctgcctgtagttagga

SEQ ID NO: 4182499 - DNA, 17 bp, Homo sapiens
agctggaaataaacctg

SEQ ID NO: 4182500 - DNA, 14 bp, Homo sapiens
agctggagggaggt

SEQ ID NO: 4182501 - DNA, 20 bp, Homo sapiens
agctggcgactgcagctgca

SEQ ID NO: 4182502 - DNA, 22 bp, Homo sapiens
agctgggaaggccgcaagaggc

SEQ ID NO: 4182503 - DNA, 20 bp, Homo sapiens
agctggggctgccagcctga

SEQ ID NO: 4182504 - DNA, 14 bp, Homo sapiens
agctggggtacagg

SEQ ID NO: 4182505 - DNA, 13 bp, Homo sapiens
agctggtggctag

SEQ ID NO: 4182506 - DNA, 20 bp, Homo sapiens
agctggtttaatgttttggc

SEQ ID NO: 4182507 - DNA, 22 bp, Homo sapiens
agctgtagtagccctttctgtg

SEQ ID NO: 4182508 - DNA, 23 bp, Homo sapiens
agctgtagtagccctttctgtgt

SEQ ID NO: 4182509 - DNA, 14 bp, Homo sapiens
agctgtcgcatctc

SEQ ID NO: 4182510 - DNA, 22 bp, Homo sapiens
agctgtgcttatggtaccagat

SEQ ID NO: 4182511 - DNA, 22 bp, Homo sapiens
agctgtgtgtttggaagactat

SEQ ID NO: 4182512 - DNA, 16 bp, Homo sapiens
agctgtttaagatggg

SEQ ID NO: 4182513 - DNA, 16 bp, Homo sapiens
agcttaaaactttgaa

SEQ ID NO: 4182514 - DNA, 19 bp, Homo sapiens
agcttaatggctgataatt

SEQ ID NO: 4182515 - DNA, 23 bp, Homo sapiens
agcttctattatagccacatccc

SEQ ID NO: 4182516 - DNA, 14 bp, Homo sapiens
agcttctccaggct

SEQ ID NO: 4182517 - DNA, 12 bp, Homo sapiens
agcttctgtcct

SEQ ID NO: 4182518 - DNA, 15 bp, Homo sapiens
agcttgagcctgaaa

SEQ ID NO: 4182519 - DNA, 15 bp, Homo sapiens
agcttgcctgcctgc

SEQ ID NO: 4182520 - DNA, 16 bp, Homo sapiens
agcttgcctgcctgcc

SEQ ID NO: 4182521 - DNA, 20 bp, Homo sapiens
agcttgctgaggggcaggga

SEQ ID NO: 4182522 - DNA, 16 bp, Homo sapiens
agcttggtggctgagc

SEQ ID NO: 4182523 - DNA, 18 bp, Homo sapiens
agcttgtatagtgtaaaa

SEQ ID NO: 4182524 - DNA, 21 bp, Homo sapiens
agctttacatgcaatttatta

SEQ ID NO: 4182525 - DNA, 12 bp, Homo sapiens
agctttcctggt

SEQ ID NO: 4182526 - DNA, 14 bp, Homo sapiens
agctttcctggtcc

SEQ ID NO: 4182527 - DNA, 22 bp, Homo sapiens
agctttgaaggccgaaggcagt

SEQ ID NO: 4182528 - DNA, 15 bp, Homo sapiens
agcttttattgtata

SEQ ID NO: 4182529 - DNA, 18 bp, Homo sapiens
agcttttcatcaattctt

SEQ ID NO: 4182530 - DNA, 13 bp, Homo sapiens
agcttttgctcat

SEQ ID NO: 4182531 - DNA, 14 bp, Homo sapiens
aggaaaaaataata

SEQ ID NO: 4182532 - DNA, 14 bp, Homo sapiens
aggaaaaagaaaaa

SEQ ID NO: 4182533 - DNA, 16 bp, Homo sapiens
aggaaaaagaaaaaca

SEQ ID NO: 4182534 - DNA, 19 bp, Homo sapiens
aggaaaactcttggcctct

SEQ ID NO: 4182535 - DNA, 21 bp, Homo sapiens
aggaaaactcttggcctctgc

SEQ ID NO: 4182536 - DNA, 23 bp, Homo sapiens
aggaaaactcttggcctctgctt

SEQ ID NO: 4182537 - DNA, 16 bp, Homo sapiens
aggaaaattgaatgca

SEQ ID NO: 4182538 - DNA, 15 bp, Homo sapiens
aggaaagggaagcct

SEQ ID NO: 4182539 - DNA, 14 bp, Homo sapiens
aggaaataaaacct

SEQ ID NO: 4182540 - DNA, 19 bp, Homo sapiens
aggaaataaaacctttcaa

SEQ ID NO: 4182541 - DNA, 21 bp, Homo sapiens
aggaaatcaacttgcttatca

SEQ ID NO: 4182542 - DNA, 23 bp, Homo sapiens
aggaacacccgactcctcaaaag

SEQ ID NO: 4182543 - DNA, 14 bp, Homo sapiens
aggaacccagctct

SEQ ID NO: 4182544 - DNA, 22 bp, Homo sapiens
aggaacccagctctcagggctg

SEQ ID NO: 4182545 - DNA, 18 bp, Homo sapiens
aggaactctggcttccag

SEQ ID NO: 4182546 - DNA, 14 bp, Homo sapiens
aggaactggctcct

SEQ ID NO: 4182547 - DNA, 21 bp, Homo sapiens
aggaactggctcctttgcctc

SEQ ID NO: 4182548 - DNA, 14 bp, Homo sapiens
aggaagactctgga

SEQ ID NO: 4182549 - DNA, 19 bp, Homo sapiens
aggaagactctggagccaa

SEQ ID NO: 4182550 - DNA, 12 bp, Homo sapiens
aggaagagaagg

SEQ ID NO: 4182551 - DNA, 17 bp, Homo sapiens
aggaagagaaggagcag

SEQ ID NO: 4182552 - DNA, 15 bp, Homo sapiens
aggaagatgaaagag

SEQ ID NO: 4182553 - DNA, 20 bp, Homo sapiens
aggaagattaaaaccacaga

SEQ ID NO: 4182554 - DNA, 23 bp, Homo sapiens
aggaagattaaaaccacagaaca

SEQ ID NO: 4182555 - DNA, 16 bp, Homo sapiens
aggaagctctctttcc

SEQ ID NO: 4182556 - DNA, 18 bp, Homo sapiens
aggaaggcagggaggagg

SEQ ID NO: 4182557 - DNA, 22 bp, Homo sapiens
aggaataaggatgttgttatga

SEQ ID NO: 4182558 - DNA, 16 bp, Homo sapiens
aggaatatgactgttt

SEQ ID NO: 4182559 - DNA, 17 bp, Homo sapiens
aggaatcggctggggac

SEQ ID NO: 4182560 - DNA, 17 bp, Homo sapiens
aggacaaagaaggaaat

SEQ ID NO: 4182561 - DNA, 15 bp, Homo sapiens
aggacaatgccttgg

SEQ ID NO: 4182562 - DNA, 14 bp, Homo sapiens
aggacacacagtct

SEQ ID NO: 4182563 - DNA, 16 bp, Homo sapiens
aggacagtctggagaa

SEQ ID NO: 4182564 - DNA, 20 bp, Homo sapiens
aggacagtctggagaaggta

SEQ ID NO: 4182565 - DNA, 16 bp, Homo sapiens
aggacagtgcttcagc

SEQ ID NO: 4182566 - DNA, 17 bp, Homo sapiens
aggacagtgcttcagcc

SEQ ID NO: 4182567 - DNA, 19 bp, Homo sapiens
aggacagtgcttcagcctg

SEQ ID NO: 4182568 - DNA, 22 bp, Homo sapiens
aggacagtgcttcagcctgagg

SEQ ID NO: 4182569 - DNA, 15 bp, Homo sapiens
aggacatgtttttgt

SEQ ID NO: 4182570 - DNA, 13 bp, Homo sapiens
aggaccctgtcag

SEQ ID NO: 4182571 - DNA, 18 bp, Homo sapiens
aggactatagcccaggtc

SEQ ID NO: 4182572 - DNA, 13 bp, Homo sapiens
aggactccccagg

SEQ ID NO: 4182573 - DNA, 17 bp, Homo sapiens
aggactccccaggccag

SEQ ID NO: 4182574 - DNA, 20 bp, Homo sapiens
aggactccccaggccaggcc

SEQ ID NO: 4182575 - DNA, 23 bp, Homo sapiens
aggactgtagtttaatacttttt

SEQ ID NO: 4182576 - DNA, 18 bp, Homo sapiens
aggagacaagaaatccag

SEQ ID NO: 4182577 - DNA, 14 bp, Homo sapiens
aggagattttcctt

SEQ ID NO: 4182578 - DNA, 15 bp, Homo sapiens
aggagattttccttc

SEQ ID NO: 4182579 - DNA, 16 bp, Homo sapiens
aggagctgttggggca

SEQ ID NO: 4182580 - DNA, 18 bp, Homo sapiens
aggagctgttggggcagg

SEQ ID NO: 4182581 - DNA, 15 bp, Homo sapiens
aggaggcgaataaat

SEQ ID NO: 4182582 - DNA, 18 bp, Homo sapiens
aggaggcgaataaatgtt

SEQ ID NO: 4182583 - DNA, 20 bp, Homo sapiens
aggaggcggaggttgcagtg

SEQ ID NO: 4182584 - DNA, 17 bp, Homo sapiens
aggaggctgaggcagga

SEQ ID NO: 4182585 - DNA, 20 bp, Homo sapiens
aggaggctgaggcaggagaa

SEQ ID NO: 4182586 - DNA, 16 bp, Homo sapiens
aggagggcaagggcca

SEQ ID NO: 4182587 - DNA, 14 bp, Homo sapiens
aggaggtgagggat

SEQ ID NO: 4182588 - DNA, 14 bp, Homo sapiens
aggaggtggcagcc

SEQ ID NO: 4182589 - DNA, 18 bp, Homo sapiens
aggaggtggcagccctgt

SEQ ID NO: 4182590 - DNA, 23 bp, Homo sapiens
aggaggtggcagccctgtaggga

SEQ ID NO: 4182591 - DNA, 17 bp, Homo sapiens
aggagttaagagtagca

SEQ ID NO: 4182592 - DNA, 20 bp, Homo sapiens
aggagtttgaggctgcagcg

SEQ ID NO: 4182593 - DNA, 13 bp, Homo sapiens
aggatactctgtc

SEQ ID NO: 4182594 - DNA, 23 bp, Homo sapiens
aggatactgcgggcaccagaatg

SEQ ID NO: 4182595 - DNA, 18 bp, Homo sapiens
aggatcactggagcccag

SEQ ID NO: 4182596 - DNA, 18 bp, Homo sapiens
aggatcacttgggcccag

SEQ ID NO: 4182597 - DNA, 20 bp, Homo sapiens
aggatcacttgggcccagga

SEQ ID NO: 4182598 - DNA, 23 bp, Homo sapiens
aggatcacttgggcccaggaggt

SEQ ID NO: 4182599 - DNA, 12 bp, Homo sapiens
aggatccagaga

SEQ ID NO: 4182600 - DNA, 21 bp, Homo sapiens
aggatcctattctcaccagga

SEQ ID NO: 4182601 - DNA, 20 bp, Homo sapiens
aggatcctggaaccactgat

SEQ ID NO: 4182602 - DNA, 17 bp, Homo sapiens
aggatctctgaaacata

SEQ ID NO: 4182603 - DNA, 20 bp, Homo sapiens
aggatgtaggggttaacttg

SEQ ID NO: 4182604 - DNA, 23 bp, Homo sapiens
aggatgtaggggttaacttggtc

SEQ ID NO: 4182605 - DNA, 13 bp, Homo sapiens
aggattgaagagc

SEQ ID NO: 4182606 - DNA, 14 bp, Homo sapiens
aggattgaagagca

SEQ ID NO: 4182607 - DNA, 19 bp, Homo sapiens
aggattgcaggtgcctggc

SEQ ID NO: 4182608 - DNA, 16 bp, Homo sapiens
aggattggcctgtgtc

SEQ ID NO: 4182609 - DNA, 16 bp, Homo sapiens
aggattttgtgttttt

SEQ ID NO: 4182610 - DNA, 15 bp, Homo sapiens
aggatttttggtata

SEQ ID NO: 4182611 - DNA, 18 bp, Homo sapiens
aggcaccaaaagaagtaa

SEQ ID NO: 4182612 - DNA, 15 bp, Homo sapiens
aggcaccccctggag

SEQ ID NO: 4182613 - DNA, 17 bp, Homo sapiens
aggcaccccctggagag

SEQ ID NO: 4182614 - DNA, 14 bp, Homo sapiens
aggcacctgctgga

SEQ ID NO: 4182615 - DNA, 18 bp, Homo sapiens
aggcactgtggcccttct

SEQ ID NO: 4182616 - DNA, 19 bp, Homo sapiens
aggcagacgtggggagggt

SEQ ID NO: 4182617 - DNA, 20 bp, Homo sapiens
aggcagactctttatgcttg

SEQ ID NO: 4182618 - DNA, 21 bp, Homo sapiens
aggcagactctttatgcttgc

SEQ ID NO: 4182619 - DNA, 22 bp, Homo sapiens
aggcagactctttatgcttgca

SEQ ID NO: 4182620 - DNA, 15 bp, Homo sapiens
aggcagagaaagaag

SEQ ID NO: 4182621 - DNA, 15 bp, Homo sapiens
aggcagagaagaaag

SEQ ID NO: 4182622 - DNA, 15 bp, Homo sapiens
aggcagagtgaaata

SEQ ID NO: 4182623 - DNA, 16 bp, Homo sapiens
aggcagagtgaaataa

SEQ ID NO: 4182624 - DNA, 14 bp, Homo sapiens
aggcagcctgccgc

SEQ ID NO: 4182625 - DNA, 22 bp, Homo sapiens
aggcagggaggaggcagagaag

SEQ ID NO: 4182626 - DNA, 16 bp, Homo sapiens
aggcagggatttgagg

SEQ ID NO: 4182627 - DNA, 15 bp, Homo sapiens
aggcaggggtgggag

SEQ ID NO: 4182628 - DNA, 17 bp, Homo sapiens
aggcaggggtgggagag

SEQ ID NO: 4182629 - DNA, 22 bp, Homo sapiens
aggcaggggtgggagagccagc

SEQ ID NO: 4182630 - DNA, 21 bp, Homo sapiens
aggcagtgaacacactcagca

SEQ ID NO: 4182631 - DNA, 18 bp, Homo sapiens
aggcataaattagagaaa

SEQ ID NO: 4182632 - DNA, 15 bp, Homo sapiens
aggcatttttaccat

SEQ ID NO: 4182633 - DNA, 18 bp, Homo sapiens
aggccaagagcagaggca

SEQ ID NO: 4182634 - DNA, 12 bp, Homo sapiens
aggccaccagga

SEQ ID NO: 4182635 - DNA, 17 bp, Homo sapiens
aggccaggaatctgcca

SEQ ID NO: 4182636 - DNA, 18 bp, Homo sapiens
aggccaggaatctgccat

SEQ ID NO: 4182637 - DNA, 14 bp, Homo sapiens
aggccaggccacca

SEQ ID NO: 4182638 - DNA, 16 bp, Homo sapiens
aggccaggccaccagg

SEQ ID NO: 4182639 - DNA, 17 bp, Homo sapiens
aggccaggccaccagga

SEQ ID NO: 4182640 - DNA, 13 bp, Homo sapiens
aggccagtgggcc

SEQ ID NO: 4182641 - DNA, 20 bp, Homo sapiens
aggccagtgggcctggtagc

SEQ ID NO: 4182642 - DNA, 17 bp, Homo sapiens
aggcccagcctgtcctg

SEQ ID NO: 4182643 - DNA, 19 bp, Homo sapiens
aggcccagcctgtcctggt

SEQ ID NO: 4182644 - DNA, 17 bp, Homo sapiens
aggcccattgctgacga

SEQ ID NO: 4182645 - DNA, 22 bp, Homo sapiens
aggccctaggattcctccccca

SEQ ID NO: 4182646 - DNA, 14 bp, Homo sapiens
aggccctgtctgta

SEQ ID NO: 4182647 - DNA, 12 bp, Homo sapiens
aggccgagccaa

SEQ ID NO: 4182648 - DNA, 16 bp, Homo sapiens
aggccgcaagaggcat

SEQ ID NO: 4182649 - DNA, 19 bp, Homo sapiens
aggcctcgtaccagccagg

SEQ ID NO: 4182650 - DNA, 15 bp, Homo sapiens
aggcctggccaggca

SEQ ID NO: 4182651 - DNA, 20 bp, Homo sapiens
aggccttagtacggctgctg

SEQ ID NO: 4182652 - DNA, 14 bp, Homo sapiens
aggccttccgccag

SEQ ID NO: 4182653 - DNA, 13 bp, Homo sapiens
aggcgaataaatg

SEQ ID NO: 4182654 - DNA, 15 bp, Homo sapiens
aggcgaataaatgtt

SEQ ID NO: 4182655 - DNA, 15 bp, Homo sapiens
aggcgagtgccagga

SEQ ID NO: 4182656 - DNA, 24 bp, Homo sapiens
aggcgagtgccaggactccccagg

SEQ ID NO: 4182657 - DNA, 17 bp, Homo sapiens
aggcggctccaggtccg

SEQ ID NO: 4182658 - DNA, 17 bp, Homo sapiens
aggctagtttattttgt

SEQ ID NO: 4182659 - DNA, 13 bp, Homo sapiens
aggctatttaaaa

SEQ ID NO: 4182660 - DNA, 23 bp, Homo sapiens
aggctcagtctcaggagcatggg

SEQ ID NO: 4182661 - DNA, 17 bp, Homo sapiens
aggctcccactgcccct

SEQ ID NO: 4182662 - DNA, 15 bp, Homo sapiens
aggctcccagggaca

SEQ ID NO: 4182663 - DNA, 14 bp, Homo sapiens
aggctcggaatgtt

SEQ ID NO: 4182664 - DNA, 15 bp, Homo sapiens
aggctcggccgtggg

SEQ ID NO: 4182665 - DNA, 15 bp, Homo sapiens
aggctctattgagcc

SEQ ID NO: 4182666 - DNA, 19 bp, Homo sapiens
aggctctgacccagtgaga

SEQ ID NO: 4182667 - DNA, 23 bp, Homo sapiens
aggctctttggggtcagccaggg

SEQ ID NO: 4182668 - DNA, 15 bp, Homo sapiens
aggctgagctggcat

SEQ ID NO: 4182669 - DNA, 14 bp, Homo sapiens
aggctgaggcagga

SEQ ID NO: 4182670 - DNA, 14 bp, Homo sapiens
aggctgaggtgtct

SEQ ID NO: 4182671 - DNA, 16 bp, Homo sapiens
aggctgcccaatctga

SEQ ID NO: 4182672 - DNA, 14 bp, Homo sapiens
aggctgctgggaga

SEQ ID NO: 4182673 - DNA, 13 bp, Homo sapiens
aggctggtcttga

SEQ ID NO: 4182674 - DNA, 23 bp, Homo sapiens
aggctggtgctgtggccagggtg

SEQ ID NO: 4182675 - DNA, 22 bp, Homo sapiens
aggctgtaagcattctgagctg

SEQ ID NO: 4182676 - DNA, 22 bp, Homo sapiens
aggctgtggggtctggctgtgt

SEQ ID NO: 4182677 - DNA, 21 bp, Homo sapiens
aggctgtgtttggctttcagg

SEQ ID NO: 4182678 - DNA, 18 bp, Homo sapiens
aggcttaggtgccaggct

SEQ ID NO: 4182679 - DNA, 15 bp, Homo sapiens
aggcttatcaaaatc

SEQ ID NO: 4182680 - DNA, 15 bp, Homo sapiens
aggcttcttgcccag

SEQ ID NO: 4182681 - DNA, 14 bp, Homo sapiens
aggcttgttgtgct

SEQ ID NO: 4182682 - DNA, 18 bp, Homo sapiens
aggctttgccatgggcct

SEQ ID NO: 4182683 - DNA, 21 bp, Homo sapiens
aggctttgccatgggcctgct

SEQ ID NO: 4182684 - DNA, 22 bp, Homo sapiens
aggctttgccatgggcctgctg

SEQ ID NO: 4182685 - DNA, 23 bp, Homo sapiens
aggctttgccatgggcctgctgc

SEQ ID NO: 4182686 - DNA, 22 bp, Homo sapiens
agggaacccagctctaatacat

SEQ ID NO: 4182687 - DNA, 15 bp, Homo sapiens
agggaagcctcttca

SEQ ID NO: 4182688 - DNA, 15 bp, Homo sapiens
agggacagagatgga

SEQ ID NO: 4182689 - DNA, 21 bp, Homo sapiens
agggacttcctctttctctcc

SEQ ID NO: 4182690 - DNA, 16 bp, Homo sapiens
agggagaaggatctag

SEQ ID NO: 4182691 - DNA, 13 bp, Homo sapiens
agggagaggaagc

SEQ ID NO: 4182692 - DNA, 17 bp, Homo sapiens
agggagaggaagcacac

SEQ ID NO: 4182693 - DNA, 18 bp, Homo sapiens
agggagccatcccttccc

SEQ ID NO: 4182694 - DNA, 16 bp, Homo sapiens
agggagctgctggctg

SEQ ID NO: 4182695 - DNA, 17 bp, Homo sapiens
agggagctgctggctga

SEQ ID NO: 4182696 - DNA, 20 bp, Homo sapiens
agggagctgctggctgacct

SEQ ID NO: 4182697 - DNA, 20 bp, Homo sapiens
agggaggaggcagagaagaa

SEQ ID NO: 4182698 - DNA, 13 bp, Homo sapiens
agggaggtggggc

SEQ ID NO: 4182699 - DNA, 20 bp, Homo sapiens
agggatctgccattgggacc

SEQ ID NO: 4182700 - DNA, 20 bp, Homo sapiens
agggatcttgcattcccagt

SEQ ID NO: 4182701 - DNA, 18 bp, Homo sapiens
agggatgagagtggctta

SEQ ID NO: 4182702 - DNA, 22 bp, Homo sapiens
agggatgagagtggcttaaaaa

SEQ ID NO: 4182703 - DNA, 16 bp, Homo sapiens
agggatgctgcctgag

SEQ ID NO: 4182704 - DNA, 16 bp, Homo sapiens
agggatgttctagccc

SEQ ID NO: 4182705 - DNA, 17 bp, Homo sapiens
agggcaaggggtttcca

SEQ ID NO: 4182706 - DNA, 18 bp, Homo sapiens
agggcatccttctgcctt

SEQ ID NO: 4182707 - DNA, 17 bp, Homo sapiens
agggcatcttagcttct

SEQ ID NO: 4182708 - DNA, 22 bp, Homo sapiens
agggccaagcgggggcgtggct

SEQ ID NO: 4182709 - DNA, 22 bp, Homo sapiens
agggccagggccctgcagaggg

SEQ ID NO: 4182710 - DNA, 20 bp, Homo sapiens
agggccaggggtctccctgg

SEQ ID NO: 4182711 - DNA, 17 bp, Homo sapiens
agggcccaggcaggcca

SEQ ID NO: 4182712 - DNA, 13 bp, Homo sapiens
agggcccctagaa

SEQ ID NO: 4182713 - DNA, 23 bp, Homo sapiens
agggcccttcccaacctcccctg

SEQ ID NO: 4182714 - DNA, 17 bp, Homo sapiens
agggctactcagcagta

SEQ ID NO: 4182715 - DNA, 14 bp, Homo sapiens
agggctgaaagcca

SEQ ID NO: 4182716 - DNA, 20 bp, Homo sapiens
aggggaagtatgtgtgggta

SEQ ID NO: 4182717 - DNA, 12 bp, Homo sapiens
aggggacccagc

SEQ ID NO: 4182718 - DNA, 17 bp, Homo sapiens
aggggacccagctcctc

SEQ ID NO: 4182719 - DNA, 21 bp, Homo sapiens
aggggacccagctcctctgag

SEQ ID NO: 4182720 - DNA, 17 bp, Homo sapiens
aggggagcttgagggac

SEQ ID NO: 4182721 - DNA, 18 bp, Homo sapiens
aggggagcttgagggaca

SEQ ID NO: 4182722 - DNA, 19 bp, Homo sapiens
aggggaggatcactggagc

SEQ ID NO: 4182723 - DNA, 18 bp, Homo sapiens
aggggcaaagaactgccc

SEQ ID NO: 4182724 - DNA, 14 bp, Homo sapiens
aggggcagggagag

SEQ ID NO: 4182725 - DNA, 17 bp, Homo sapiens
aggggcagggagagcgc

SEQ ID NO: 4182726 - DNA, 19 bp, Homo sapiens
aggggccagtgagggctgg

SEQ ID NO: 4182727 - DNA, 24 bp, Homo sapiens
aggggccagtgagggctgggccca

SEQ ID NO: 4182728 - DNA, 19 bp, Homo sapiens
aggggcccacagggaaccc

SEQ ID NO: 4182729 - DNA, 21 bp, Homo sapiens
aggggcccacagggaaccctg

SEQ ID NO: 4182730 - DNA, 12 bp, Homo sapiens
aggggccctggt

SEQ ID NO: 4182731 - DNA, 18 bp, Homo sapiens
aggggctaggggctggtc

SEQ ID NO: 4182732 - DNA, 23 bp, Homo sapiens
aggggctcctggaaaggctcagt

SEQ ID NO: 4182733 - DNA, 17 bp, Homo sapiens
aggggctggtccttctc

SEQ ID NO: 4182734 - DNA, 12 bp, Homo sapiens
aggggcttcagg

SEQ ID NO: 4182735 - DNA, 20 bp, Homo sapiens
aggggctttctggagaggag

SEQ ID NO: 4182736 - DNA, 22 bp, Homo sapiens
aggggtacatttccctgtgctg

SEQ ID NO: 4182737 - DNA, 19 bp, Homo sapiens
aggggtaggcagagccttt

SEQ ID NO: 4182738 - DNA, 15 bp, Homo sapiens
aggggtctccctgga

SEQ ID NO: 4182739 - DNA, 17 bp, Homo sapiens
agggtatgggaagccat

SEQ ID NO: 4182740 - DNA, 18 bp, Homo sapiens
agggtcctgggggctgct

SEQ ID NO: 4182741 - DNA, 23 bp, Homo sapiens
agggtcctgggggctgctgcact

SEQ ID NO: 4182742 - DNA, 14 bp, Homo sapiens
agggtctaaagaga

SEQ ID NO: 4182743 - DNA, 13 bp, Homo sapiens
agggtcttgctgt

SEQ ID NO: 4182744 - DNA, 19 bp, Homo sapiens
agggtgaataaagcaggga

SEQ ID NO: 4182745 - DNA, 21 bp, Homo sapiens
agggtgataaatcagactctt

SEQ ID NO: 4182746 - DNA, 19 bp, Homo sapiens
agggtgcagtatctcttgc

SEQ ID NO: 4182747 - DNA, 21 bp, Homo sapiens
agggtgcagtatctcttgctg

SEQ ID NO: 4182748 - DNA, 17 bp, Homo sapiens
agggtgggagagcccag

SEQ ID NO: 4182749 - DNA, 18 bp, Homo sapiens
agggtgggagagcccagc

SEQ ID NO: 4182750 - DNA, 19 bp, Homo sapiens
agggtgggagagcccagcc

SEQ ID NO: 4182751 - DNA, 16 bp, Homo sapiens
agggtggtggggacag

SEQ ID NO: 4182752 - DNA, 18 bp, Homo sapiens
agggttatacacagaaaa

SEQ ID NO: 4182753 - DNA, 14 bp, Homo sapiens
agggttgatcacac

SEQ ID NO: 4182754 - DNA, 20 bp, Homo sapiens
agggttggtgggctggccca

SEQ ID NO: 4182755 - DNA, 22 bp, Homo sapiens
agggttggtgggctggcccagc

SEQ ID NO: 4182756 - DNA, 23 bp, Homo sapiens
agggttggtgggctggcccagcc

SEQ ID NO: 4182757 - DNA, 14 bp, Homo sapiens
agggtttcattgtg

SEQ ID NO: 4182758 - DNA, 17 bp, Homo sapiens
aggtaaaagtgtgagca

SEQ ID NO: 4182759 - DNA, 20 bp, Homo sapiens
aggtaactgagagcagatgg

SEQ ID NO: 4182760 - DNA, 16 bp, Homo sapiens
aggtaagggccgccgg

SEQ ID NO: 4182761 - DNA, 17 bp, Homo sapiens
aggtaatgagggactgg

SEQ ID NO: 4182762 - DNA, 16 bp, Homo sapiens
aggtacaagaagcatt

SEQ ID NO: 4182763 - DNA, 16 bp, Homo sapiens
aggtagagatgtgtgt

SEQ ID NO: 4182764 - DNA, 17 bp, Homo sapiens
aggtagagtttgaagga

SEQ ID NO: 4182765 - DNA, 21 bp, Homo sapiens
aggtagagtttgaaggaggtg

SEQ ID NO: 4182766 - DNA, 23 bp, Homo sapiens
aggtagagtttgaaggaggtgag

SEQ ID NO: 4182767 - DNA, 13 bp, Homo sapiens
aggtaggtaaata

SEQ ID NO: 4182768 - DNA, 18 bp, Homo sapiens
aggtagttggtgaacaga

SEQ ID NO: 4182769 - DNA, 13 bp, Homo sapiens
aggtatctccagg

SEQ ID NO: 4182770 - DNA, 18 bp, Homo sapiens
aggtattaaagatgtgtt

SEQ ID NO: 4182771 - DNA, 15 bp, Homo sapiens
aggtattagcaaagc

SEQ ID NO: 4182772 - DNA, 15 bp, Homo sapiens
aggtcacattcagga

SEQ ID NO: 4182773 - DNA, 16 bp, Homo sapiens
aggtcaccagcctgac

SEQ ID NO: 4182774 - DNA, 19 bp, Homo sapiens
aggtcactagatggcgagc

SEQ ID NO: 4182775 - DNA, 13 bp, Homo sapiens
aggtcactgggtt

SEQ ID NO: 4182776 - DNA, 16 bp, Homo sapiens
aggtccaggcaggagg

SEQ ID NO: 4182777 - DNA, 22 bp, Homo sapiens
aggtcctggcttctagatctgg

SEQ ID NO: 4182778 - DNA, 21 bp, Homo sapiens
aggtcctgtcctggctcccag

SEQ ID NO: 4182779 - DNA, 15 bp, Homo sapiens
aggtctagactttct

SEQ ID NO: 4182780 - DNA, 22 bp, Homo sapiens
aggtctccactgaggatgtgag

SEQ ID NO: 4182781 - DNA, 16 bp, Homo sapiens
aggtgagaccacctct

SEQ ID NO: 4182782 - DNA, 13 bp, Homo sapiens
aggtgagctcagc

SEQ ID NO: 4182783 - DNA, 15 bp, Homo sapiens
aggtgcctggcttgc

SEQ ID NO: 4182784 - DNA, 12 bp, Homo sapiens
aggtgctctgtg

SEQ ID NO: 4182785 - DNA, 14 bp, Homo sapiens
aggtgctctgtgtc

SEQ ID NO: 4182786 - DNA, 18 bp, Homo sapiens
aggtgctgatgtcaaagt

SEQ ID NO: 4182787 - DNA, 20 bp, Homo sapiens
aggtgctgatgtcaaagtgt

SEQ ID NO: 4182788 - DNA, 18 bp, Homo sapiens
aggtggattcctgggcaa

SEQ ID NO: 4182789 - DNA, 13 bp, Homo sapiens
aggtggcagccct

SEQ ID NO: 4182790 - DNA, 14 bp, Homo sapiens
aggtggcaggacca

SEQ ID NO: 4182791 - DNA, 14 bp, Homo sapiens
aggtggctctccag

SEQ ID NO: 4182792 - DNA, 15 bp, Homo sapiens
aggtggctctccagt

SEQ ID NO: 4182793 - DNA, 23 bp, Homo sapiens
aggtgggaaatggtatgagctga

SEQ ID NO: 4182794 - DNA, 15 bp, Homo sapiens
aggtgggctgagccc

SEQ ID NO: 4182795 - DNA, 18 bp, Homo sapiens
aggtgggctgagccctgg

SEQ ID NO: 4182796 - DNA, 14 bp, Homo sapiens
aggtgtaataagac

SEQ ID NO: 4182797 - DNA, 17 bp, Homo sapiens
aggtgtctgcacccagg

SEQ ID NO: 4182798 - DNA, 21 bp, Homo sapiens
aggtgtctgcacccaggggtg

SEQ ID NO: 4182799 - DNA, 17 bp, Homo sapiens
aggttagaggtttgtca

SEQ ID NO: 4182800 - DNA, 20 bp, Homo sapiens
aggttagaggtttgtcaaca

SEQ ID NO: 4182801 - DNA, 21 bp, Homo sapiens
aggttaggagttcgagaccag

SEQ ID NO: 4182802 - DNA, 15 bp, Homo sapiens
aggttaggtttgtca

SEQ ID NO: 4182803 - DNA, 20 bp, Homo sapiens
aggttgaggggctcctggaa

SEQ ID NO: 4182804 - DNA, 12 bp, Homo sapiens
aggttgcaggga

SEQ ID NO: 4182805 - DNA, 18 bp, Homo sapiens
aggttgcagggagccgag

SEQ ID NO: 4182806 - DNA, 18 bp, Homo sapiens
aggttgcagtgagctgag

SEQ ID NO: 4182807 - DNA, 18 bp, Homo sapiens
aggttgggcttccatgcc

SEQ ID NO: 4182808 - DNA, 22 bp, Homo sapiens
aggtttggtgtgtggagatgca

SEQ ID NO: 4182809 - DNA, 14 bp, Homo sapiens
aggtttgtcaacac

SEQ ID NO: 4182810 - DNA, 20 bp, Homo sapiens
aggtttgtcaacacaaagac

SEQ ID NO: 4182811 - DNA, 13 bp, Homo sapiens
agtaaaagctaat

SEQ ID NO: 4182812 - DNA, 15 bp, Homo sapiens
agtaaaagctaatta

SEQ ID NO: 4182813 - DNA, 20 bp, Homo sapiens
agtaaatcacgctttttgaa

SEQ ID NO: 4182814 - DNA, 19 bp, Homo sapiens
agtaagtaccactcaggcc

SEQ ID NO: 4182815 - DNA, 13 bp, Homo sapiens
agtaatctgcatt

SEQ ID NO: 4182816 - DNA, 17 bp, Homo sapiens
agtaatgacagattgtt

SEQ ID NO: 4182817 - DNA, 19 bp, Homo sapiens
agtaatttgtaaaaaagat

SEQ ID NO: 4182818 - DNA, 21 bp, Homo sapiens
agtacagagaaattctgtggt

SEQ ID NO: 4182819 - DNA, 21 bp, Homo sapiens
agtaccaaatccacaagccat

SEQ ID NO: 4182820 - DNA, 23 bp, Homo sapiens
agtacctcttttcccatatacaa

SEQ ID NO: 4182821 - DNA, 21 bp, Homo sapiens
agtactctgaaggaataggca

SEQ ID NO: 4182822 - DNA, 12 bp, Homo sapiens
agtagaaatcat

SEQ ID NO: 4182823 - DNA, 22 bp, Homo sapiens
agtagcagtgattgtcttaata

SEQ ID NO: 4182824 - DNA, 15 bp, Homo sapiens
agtagccctttctgt

SEQ ID NO: 4182825 - DNA, 20 bp, Homo sapiens
agtaggaacccagctctcag

SEQ ID NO: 4182826 - DNA, 17 bp, Homo sapiens
agtaggaaggaaaaaat

SEQ ID NO: 4182827 - DNA, 15 bp, Homo sapiens
agtataaaactgctt

SEQ ID NO: 4182828 - DNA, 17 bp, Homo sapiens
agtatattatgtattta

SEQ ID NO: 4182829 - DNA, 19 bp, Homo sapiens
agtatcaatccttgttcag

SEQ ID NO: 4182830 - DNA, 14 bp, Homo sapiens
agtatctaactctt

SEQ ID NO: 4182831 - DNA, 23 bp, Homo sapiens
agtatctcggacctttcagctgt

SEQ ID NO: 4182832 - DNA, 15 bp, Homo sapiens
agtatctctggcctc

SEQ ID NO: 4182833 - DNA, 21 bp, Homo sapiens
agtatgtaaagtatgtaaaca

SEQ ID NO: 4182834 - DNA, 14 bp, Homo sapiens
agtatgtaatcttt

SEQ ID NO: 4182835 - DNA, 12 bp, Homo sapiens
agtatgttacat

SEQ ID NO: 4182836 - DNA, 20 bp, Homo sapiens
agtattcttcatcagcattt

SEQ ID NO: 4182837 - DNA, 23 bp, Homo sapiens
agtatttgaaactgaatgtttat

SEQ ID NO: 4182838 - DNA, 15 bp, Homo sapiens
agtatttgttaattt

SEQ ID NO: 4182839 - DNA, 18 bp, Homo sapiens
agtatttgttaatttaga

SEQ ID NO: 4182840 - DNA, 18 bp, Homo sapiens
agtattttagtgaacttg

SEQ ID NO: 4182841 - DNA, 19 bp, Homo sapiens
agtatttttttaagttaga

SEQ ID NO: 4182842 - DNA, 19 bp, Homo sapiens
agtcaatcatgtgtttaaa

SEQ ID NO: 4182843 - DNA, 16 bp, Homo sapiens
agtcacaagagcccag

SEQ ID NO: 4182844 - DNA, 15 bp, Homo sapiens
agtcagactgctggg

SEQ ID NO: 4182845 - DNA, 20 bp, Homo sapiens
agtcagccattcctgttctc

SEQ ID NO: 4182846 - DNA, 18 bp, Homo sapiens
agtcattgtcgctcagca

SEQ ID NO: 4182847 - DNA, 15 bp, Homo sapiens
agtccagatgccttc

SEQ ID NO: 4182848 - DNA, 17 bp, Homo sapiens
agtccagatgccttcct

SEQ ID NO: 4182849 - DNA, 16 bp, Homo sapiens
agtcccctgggcctgg

SEQ ID NO: 4182850 - DNA, 18 bp, Homo sapiens
agtccctaggagggaagg

SEQ ID NO: 4182851 - DNA, 23 bp, Homo sapiens
agtccctaggagggaaggagctg

SEQ ID NO: 4182852 - DNA, 21 bp, Homo sapiens
agtccctgactctctgtgacc

SEQ ID NO: 4182853 - DNA, 12 bp, Homo sapiens
agtccgtccacc

SEQ ID NO: 4182854 - DNA, 18 bp, Homo sapiens
agtcctatcgactttata

SEQ ID NO: 4182855 - DNA, 13 bp, Homo sapiens
agtcctcaaagca

SEQ ID NO: 4182856 - DNA, 14 bp, Homo sapiens
agtcctcacagcct

SEQ ID NO: 4182857 - DNA, 19 bp, Homo sapiens
agtcctcacagcctctccc

SEQ ID NO: 4182858 - DNA, 20 bp, Homo sapiens
agtcctcacagcctctccct

SEQ ID NO: 4182859 - DNA, 17 bp, Homo sapiens
agtcctgtcagcttccc

SEQ ID NO: 4182860 - DNA, 14 bp, Homo sapiens
agtcctgtgaattt

SEQ ID NO: 4182861 - DNA, 19 bp, Homo sapiens
agtccttattatcccagct

SEQ ID NO: 4182862 - DNA, 22 bp, Homo sapiens
agtcgtcatcacttttcagtga

SEQ ID NO: 4182863 - DNA, 20 bp, Homo sapiens
agtctaaagctggtttaatg

SEQ ID NO: 4182864 - DNA, 17 bp, Homo sapiens
agtctacctcttcagta

SEQ ID NO: 4182865 - DNA, 15 bp, Homo sapiens
agtctagtgaagatg

SEQ ID NO: 4182866 - DNA, 15 bp, Homo sapiens
agtctattgtttgtt

SEQ ID NO: 4182867 - DNA, 19 bp, Homo sapiens
agtctcagaatgtcatttt

SEQ ID NO: 4182868 - DNA, 16 bp, Homo sapiens
agtctcagtccagatg

SEQ ID NO: 4182869 - DNA, 22 bp, Homo sapiens
agtctcagtccagatgccttcc

SEQ ID NO: 4182870 - DNA, 23 bp, Homo sapiens
agtctctcaatgggtaaccatta

SEQ ID NO: 4182871 - DNA, 22 bp, Homo sapiens
agtctgaggccccaggccctag

SEQ ID NO: 4182872 - DNA, 11 bp, Homo sapiens
agtctgcagtg

SEQ ID NO: 4182873 - DNA, 17 bp, Homo sapiens
agtctgctatattttca

SEQ ID NO: 4182874 - DNA, 23 bp, Homo sapiens
agtctgggcaatgaaaccaaagc

SEQ ID NO: 4182875 - DNA, 17 bp, Homo sapiens
agtctgtctcaaaagaa

SEQ ID NO: 4182876 - DNA, 18 bp, Homo sapiens
agtctgtgggagctcagc

SEQ ID NO: 4182877 - DNA, 20 bp, Homo sapiens
agtctgtgggagctcagctc

SEQ ID NO: 4182878 - DNA, 18 bp, Homo sapiens
agtctgtgtgatgaactt

SEQ ID NO: 4182879 - DNA, 19 bp, Homo sapiens
agtctgtgtgatgaacttt

SEQ ID NO: 4182880 - DNA, 20 bp, Homo sapiens
agtgaacacactcagcagcc

SEQ ID NO: 4182881 - DNA, 19 bp, Homo sapiens
agtgaagtgccacatgaca

SEQ ID NO: 4182882 - DNA, 17 bp, Homo sapiens
agtgaatgtgtgtatgt

SEQ ID NO: 4182883 - DNA, 13 bp, Homo sapiens
agtgaatttctga

SEQ ID NO: 4182884 - DNA, 16 bp, Homo sapiens
agtgagaccctgtctc

SEQ ID NO: 4182885 - DNA, 14 bp, Homo sapiens
agtgagggctgggc

SEQ ID NO: 4182886 - DNA, 14 bp, Homo sapiens
agtgagtctgtcag

SEQ ID NO: 4182887 - DNA, 19 bp, Homo sapiens
agtgagttttttagtgcgt

SEQ ID NO: 4182888 - DNA, 16 bp, Homo sapiens
agtgcactcctggtga

SEQ ID NO: 4182889 - DNA, 22 bp, Homo sapiens
agtgcactcctggtgatcctgg

SEQ ID NO: 4182890 - DNA, 15 bp, Homo sapiens
agtgcagcagaggac

SEQ ID NO: 4182891 - DNA, 23 bp, Homo sapiens
agtgcagcagaggacagtctgga

SEQ ID NO: 4182892 - DNA, 21 bp, Homo sapiens
agtgcataaaggttctggggc

SEQ ID NO: 4182893 - DNA, 14 bp, Homo sapiens
agtgcatgaacagg

SEQ ID NO: 4182894 - DNA, 13 bp, Homo sapiens
agtgccacagaga

SEQ ID NO: 4182895 - DNA, 14 bp, Homo sapiens
agtgccacagagaa

SEQ ID NO: 4182896 - DNA, 13 bp, Homo sapiens
agtgccaggactc

SEQ ID NO: 4182897 - DNA, 16 bp, Homo sapiens
agtgccctccacagcc

SEQ ID NO: 4182898 - DNA, 17 bp, Homo sapiens
agtgccctccacagccg

SEQ ID NO: 4182899 - DNA, 17 bp, Homo sapiens
agtgcctagactgttac

SEQ ID NO: 4182900 - DNA, 22 bp, Homo sapiens
agtgcctagactgttactttgg

SEQ ID NO: 4182901 - DNA, 16 bp, Homo sapiens
agtgctgatccggctg

SEQ ID NO: 4182902 - DNA, 19 bp, Homo sapiens
agtgctgatccggctgctc

SEQ ID NO: 4182903 - DNA, 21 bp, Homo sapiens
agtgctgatccggctgctcct

SEQ ID NO: 4182904 - DNA, 17 bp, Homo sapiens
agtgctgtgctgtgcta

SEQ ID NO: 4182905 - DNA, 17 bp, Homo sapiens
agtgctgtggcctgggc

SEQ ID NO: 4182906 - DNA, 15 bp, Homo sapiens
agtgcttcagcctga

SEQ ID NO: 4182907 - DNA, 19 bp, Homo sapiens
agtgcttcagcctgaggct

SEQ ID NO: 4182908 - DNA, 20 bp, Homo sapiens
agtgcttcagcctgaggctg

SEQ ID NO: 4182909 - DNA, 23 bp, Homo sapiens
agtgcttgggtggtgggtgctgg

SEQ ID NO: 4182910 - DNA, 22 bp, Homo sapiens
agtggactggcctcaaagcaag

SEQ ID NO: 4182911 - DNA, 19 bp, Homo sapiens
agtggaggaaaatccatgg

SEQ ID NO: 4182912 - DNA, 23 bp, Homo sapiens
agtggatctccaaggaccaggtt

SEQ ID NO: 4182913 - DNA, 19 bp, Homo sapiens
agtggatggcccagcaggc

SEQ ID NO: 4182914 - DNA, 20 bp, Homo sapiens
agtggatggcccagcaggca

SEQ ID NO: 4182915 - DNA, 23 bp, Homo sapiens
agtggatggcccagcaggcaggc

SEQ ID NO: 4182916 - DNA, 16 bp, Homo sapiens
agtgggctccctggcc

SEQ ID NO: 4182917 - DNA, 19 bp, Homo sapiens
agtgggctccctggcccag

SEQ ID NO: 4182918 - DNA, 21 bp, Homo sapiens
agtgggctccctggcccagcc

SEQ ID NO: 4182919 - DNA, 16 bp, Homo sapiens
agtgggttatcttttt

SEQ ID NO: 4182920 - DNA, 23 bp, Homo sapiens
agtggtcaaaccgcactcaccca

SEQ ID NO: 4182921 - DNA, 20 bp, Homo sapiens
agtggtctttcctatcatgg

SEQ ID NO: 4182922 - DNA, 11 bp, Homo sapiens
agtgtaaaata

SEQ ID NO: 4182923 - DNA, 15 bp, Homo sapiens
agtgtagaacctaat

SEQ ID NO: 4182924 - DNA, 13 bp, Homo sapiens
agtgtagccttgc

SEQ ID NO: 4182925 - DNA, 14 bp, Homo sapiens
agtgtatatcagaa

SEQ ID NO: 4182926 - DNA, 16 bp, Homo sapiens
agtgtcactcaaggcg

SEQ ID NO: 4182927 - DNA, 15 bp, Homo sapiens
agtgtgcgtgtgtgc

SEQ ID NO: 4182928 - DNA, 22 bp, Homo sapiens
agtgtgcttctgttatcaaaca

SEQ ID NO: 4182929 - DNA, 14 bp, Homo sapiens
agtgtggagaagga

SEQ ID NO: 4182930 - DNA, 17 bp, Homo sapiens
agtgttccagctgcctg

SEQ ID NO: 4182931 - DNA, 16 bp, Homo sapiens
agtgttcctatttggg

SEQ ID NO: 4182932 - DNA, 20 bp, Homo sapiens
agtgtttgaaaacgtttcaa

SEQ ID NO: 4182933 - DNA, 18 bp, Homo sapiens
agtgttttatgagaaagc

SEQ ID NO: 4182934 - DNA, 14 bp, Homo sapiens
agttaagtatttac

SEQ ID NO: 4182935 - DNA, 15 bp, Homo sapiens
agttaagtgaatgtc

SEQ ID NO: 4182936 - DNA, 17 bp, Homo sapiens
agttacagcgagaggca

SEQ ID NO: 4182937 - DNA, 17 bp, Homo sapiens
agttactgggtatttga

SEQ ID NO: 4182938 - DNA, 19 bp, Homo sapiens
agttagagaatatattttt

SEQ ID NO: 4182939 - DNA, 15 bp, Homo sapiens
agttaggaaataaaa

SEQ ID NO: 4182940 - DNA, 17 bp, Homo sapiens
agttaggaaataaaacc

SEQ ID NO: 4182941 - DNA, 16 bp, Homo sapiens
agttaggatagcattt

SEQ ID NO: 4182942 - DNA, 15 bp, Homo sapiens
agttataaaaataca

SEQ ID NO: 4182943 - DNA, 13 bp, Homo sapiens
agttatagtttca

SEQ ID NO: 4182944 - DNA, 15 bp, Homo sapiens
agttatattttctat

SEQ ID NO: 4182945 - DNA, 12 bp, Homo sapiens
agttattgattt

SEQ ID NO: 4182946 - DNA, 12 bp, Homo sapiens
agttattgtaca

SEQ ID NO: 4182947 - DNA, 16 bp, Homo sapiens
agttatttacttgaaa

SEQ ID NO: 4182948 - DNA, 16 bp, Homo sapiens
agttatttagaaatat

SEQ ID NO: 4182949 - DNA, 22 bp, Homo sapiens
agttcaatgttcagttttcctt

SEQ ID NO: 4182950 - DNA, 23 bp, Homo sapiens
agttcagttcctctttgcatgga

SEQ ID NO: 4182951 - DNA, 23 bp, Homo sapiens
agttcccgctctgcattgcctga

SEQ ID NO: 4182952 - DNA, 21 bp, Homo sapiens
agttcctctttgcatggaatt

SEQ ID NO: 4182953 - DNA, 14 bp, Homo sapiens
agttcctgcactcc

SEQ ID NO: 4182954 - DNA, 15 bp, Homo sapiens
agttcctgcactcca

SEQ ID NO: 4182955 - DNA, 16 bp, Homo sapiens
agttcctgcactccag

SEQ ID NO: 4182956 - DNA, 14 bp, Homo sapiens
agttcgagaccagc

SEQ ID NO: 4182957 - DNA, 19 bp, Homo sapiens
agttcgagaccagcctggc

SEQ ID NO: 4182958 - DNA, 17 bp, Homo sapiens
agttctcaatcactgct

SEQ ID NO: 4182959 - DNA, 22 bp, Homo sapiens
agttcttgagtagatctgcttc

SEQ ID NO: 4182960 - DNA, 19 bp, Homo sapiens
agttgaatgacaacagaag

SEQ ID NO: 4182961 - DNA, 20 bp, Homo sapiens
agttgaatggcctgccttga

SEQ ID NO: 4182962 - DNA, 22 bp, Homo sapiens
agttgacaaaaagctcttacac

SEQ ID NO: 4182963 - DNA, 15 bp, Homo sapiens
agttgacgcatcctg

SEQ ID NO: 4182964 - DNA, 17 bp, Homo sapiens
agttgacgcatcctgca

SEQ ID NO: 4182965 - DNA, 21 bp, Homo sapiens
agttgataaagattttttaat

SEQ ID NO: 4182966 - DNA, 17 bp, Homo sapiens
agttgatcataattaaa

SEQ ID NO: 4182967 - DNA, 20 bp, Homo sapiens
agttgattctgaatctgaaa

SEQ ID NO: 4182968 - DNA, 16 bp, Homo sapiens
agttgattttctggat

SEQ ID NO: 4182969 - DNA, 14 bp, Homo sapiens
agttggaaatattc

SEQ ID NO: 4182970 - DNA, 22 bp, Homo sapiens
agttgggatgcggggcagagcc

SEQ ID NO: 4182971 - DNA, 20 bp, Homo sapiens
agttggtcttatagaaagca

SEQ ID NO: 4182972 - DNA, 17 bp, Homo sapiens
agttggtgaacagagag

SEQ ID NO: 4182973 - DNA, 16 bp, Homo sapiens
agttgtacgtaatgta

SEQ ID NO: 4182974 - DNA, 20 bp, Homo sapiens
agttgtacgtaatgtattta

SEQ ID NO: 4182975 - DNA, 21 bp, Homo sapiens
agttgtgccttttatagctat

SEQ ID NO: 4182976 - DNA, 21 bp, Homo sapiens
agttgtgtctggcagtttata

SEQ ID NO: 4182977 - DNA, 15 bp, Homo sapiens
agttgttactgaagt

SEQ ID NO: 4182978 - DNA, 22 bp, Homo sapiens
agtttaacacaagtcctgtgaa

SEQ ID NO: 4182979 - DNA, 17 bp, Homo sapiens
agtttaatactttttac

SEQ ID NO: 4182980 - DNA, 16 bp, Homo sapiens
agtttacaagtgtata

SEQ ID NO: 4182981 - DNA, 17 bp, Homo sapiens
agtttacaagtgtatat

SEQ ID NO: 4182982 - DNA, 18 bp, Homo sapiens
agtttacagtaaataaat

SEQ ID NO: 4182983 - DNA, 13 bp, Homo sapiens
agtttaggcagct

SEQ ID NO: 4182984 - DNA, 14 bp, Homo sapiens
agtttattttgtta

SEQ ID NO: 4182985 - DNA, 19 bp, Homo sapiens
agtttcagaagcaggcagg

SEQ ID NO: 4182986 - DNA, 20 bp, Homo sapiens
agtttcagaagcaggcaggg

SEQ ID NO: 4182987 - DNA, 21 bp, Homo sapiens
agtttcagaagcaggcagggc

SEQ ID NO: 4182988 - DNA, 14 bp, Homo sapiens
agtttcagatatat

SEQ ID NO: 4182989 - DNA, 17 bp, Homo sapiens
agtttcagatatatatc

SEQ ID NO: 4182990 - DNA, 16 bp, Homo sapiens
agtttctggccctggc

SEQ ID NO: 4182991 - DNA, 22 bp, Homo sapiens
agtttctggtgccatttctgaa

SEQ ID NO: 4182992 - DNA, 17 bp, Homo sapiens
agtttcttggccactga

SEQ ID NO: 4182993 - DNA, 14 bp, Homo sapiens
agtttgaggctgca

SEQ ID NO: 4182994 - DNA, 16 bp, Homo sapiens
agtttggatatgtaaa

SEQ ID NO: 4182995 - DNA, 16 bp, Homo sapiens
agtttggcaatagttt

SEQ ID NO: 4182996 - DNA, 16 bp, Homo sapiens
agtttgtcctgtagag

SEQ ID NO: 4182997 - DNA, 22 bp, Homo sapiens
agtttgtttaaacacttatctt

SEQ ID NO: 4182998 - DNA, 20 bp, Homo sapiens
agttttccatggcaggaagg

SEQ ID NO: 4182999 - DNA, 16 bp, Homo sapiens
agttttcctatgcttt

SEQ ID NO: 4183000 - DNA, 11 bp, Homo sapiens
agttttcctga

SEQ ID NO: 4183001 - DNA, 22 bp, Homo sapiens
agttttgggaggggatggcaga

SEQ ID NO: 4183002 - DNA, 14 bp, Homo sapiens
agtttttaccttgt

SEQ ID NO: 4183003 - DNA, 16 bp, Homo sapiens
ataaaaagtgaaataa

SEQ ID NO: 4183004 - DNA, 18 bp, Homo sapiens
ataaaaataatatatgct

SEQ ID NO: 4183005 - DNA, 19 bp, Homo sapiens
ataaaaataccttaaatct

SEQ ID NO: 4183006 - DNA, 16 bp, Homo sapiens
ataaaaatgatctaaa

SEQ ID NO: 4183007 - DNA, 13 bp, Homo sapiens
ataaaaatgtgaa

SEQ ID NO: 4183008 - DNA, 13 bp, Homo sapiens
ataaaacctttca

SEQ ID NO: 4183009 - DNA, 21 bp, Homo sapiens
ataaaacctttcaaatttcac

SEQ ID NO: 4183010 - DNA, 18 bp, Homo sapiens
ataaaagtactgaagacc

SEQ ID NO: 4183011 - DNA, 11 bp, Homo sapiens
ataaaatcaaa

SEQ ID NO: 4183012 - DNA, 20 bp, Homo sapiens
ataaacaaatgaattgtatt

SEQ ID NO: 4183013 - DNA, 15 bp, Homo sapiens
ataaactctaaacat

SEQ ID NO: 4183014 - DNA, 23 bp, Homo sapiens
ataaactggggagttataaaaat

SEQ ID NO: 4183015 - DNA, 19 bp, Homo sapiens
ataaactgtacaaatgaaa

SEQ ID NO: 4183016 - DNA, 22 bp, Homo sapiens
ataaactgtacaaatgaaattt

SEQ ID NO: 4183017 - DNA, 22 bp, Homo sapiens
ataaagataacccttattccat

SEQ ID NO: 4183018 - DNA, 21 bp, Homo sapiens
ataaagattttttaataattt

SEQ ID NO: 4183019 - DNA, 21 bp, Homo sapiens
ataaagctggacaagaagctg

SEQ ID NO: 4183020 - DNA, 23 bp, Homo sapiens
ataaagctggacaagaagctgct

SEQ ID NO: 4183021 - DNA, 19 bp, Homo sapiens
ataaaggaagtcaccaaaa

SEQ ID NO: 4183022 - DNA, 15 bp, Homo sapiens
ataaaggttctgggg

SEQ ID NO: 4183023 - DNA, 21 bp, Homo sapiens
ataaagttgataaagattttt

SEQ ID NO: 4183024 - DNA, 11 bp, Homo sapiens
ataaatgttca

SEQ ID NO: 4183025 - DNA, 17 bp, Homo sapiens
ataaatgttcaaactgt

SEQ ID NO: 4183026 - DNA, 23 bp, Homo sapiens
ataaattatattaatttttgaaa

SEQ ID NO: 4183027 - DNA, 15 bp, Homo sapiens
ataaattgtttgacc

SEQ ID NO: 4183028 - DNA, 17 bp, Homo sapiens
ataaattgtttgaccat

SEQ ID NO: 4183029 - DNA, 16 bp, Homo sapiens
ataacaagatctttca

SEQ ID NO: 4183030 - DNA, 18 bp, Homo sapiens
ataacagcaaggaaacat

SEQ ID NO: 4183031 - DNA, 14 bp, Homo sapiens
ataaccagctgtaa

SEQ ID NO: 4183032 - DNA, 15 bp, Homo sapiens
ataactagaaacctg

SEQ ID NO: 4183033 - DNA, 20 bp, Homo sapiens
ataacttgttttgacttgaa

SEQ ID NO: 4183034 - DNA, 20 bp, Homo sapiens
ataagaaacatgatgtgaga

SEQ ID NO: 4183035 - DNA, 14 bp, Homo sapiens
ataagaaacttttt

SEQ ID NO: 4183036 - DNA, 13 bp, Homo sapiens
ataagaagaatgc

SEQ ID NO: 4183037 - DNA, 20 bp, Homo sapiens
ataagaggactgtagtttaa

SEQ ID NO: 4183038 - DNA, 17 bp, Homo sapiens
ataagagttcttgccct

SEQ ID NO: 4183039 - DNA, 19 bp, Homo sapiens
ataagattaaaggaaggaa

SEQ ID NO: 4183040 - DNA, 17 bp, Homo sapiens
ataagcaaattagtaat

SEQ ID NO: 4183041 - DNA, 20 bp, Homo sapiens
ataagcaaattagtaattgt

SEQ ID NO: 4183042 - DNA, 17 bp, Homo sapiens
ataagctatttatgtaa

SEQ ID NO: 4183043 - DNA, 24 bp, Homo sapiens
ataaggaaatcaacttgcttatca

SEQ ID NO: 4183044 - DNA, 20 bp, Homo sapiens
ataaggaaatgtgtgttgta

SEQ ID NO: 4183045 - DNA, 18 bp, Homo sapiens
ataaggatgttgttatga

SEQ ID NO: 4183046 - DNA, 21 bp, Homo sapiens
ataaggcttaggtgccaggct

SEQ ID NO: 4183047 - DNA, 16 bp, Homo sapiens
ataaggtaaaatgcca

SEQ ID NO: 4183048 - DNA, 18 bp, Homo sapiens
ataaggtaaaatgccatg

SEQ ID NO: 4183049 - DNA, 14 bp, Homo sapiens
ataagtaaacaaca

SEQ ID NO: 4183050 - DNA, 16 bp, Homo sapiens
ataagttccatgttaa

SEQ ID NO: 4183051 - DNA, 17 bp, Homo sapiens
ataagttccatgttaaa

SEQ ID NO: 4183052 - DNA, 14 bp, Homo sapiens
ataataaaggtcac

SEQ ID NO: 4183053 - DNA, 20 bp, Homo sapiens
ataataaaggtcacataaac

SEQ ID NO: 4183054 - DNA, 14 bp, Homo sapiens
ataataaagtgttt

SEQ ID NO: 4183055 - DNA, 15 bp, Homo sapiens
ataataatgaatgtc

SEQ ID NO: 4183056 - DNA, 16 bp, Homo sapiens
ataataccaagactaa

SEQ ID NO: 4183057 - DNA, 13 bp, Homo sapiens
ataatcagcctct

SEQ ID NO: 4183058 - DNA, 14 bp, Homo sapiens
ataatcagcctctt

SEQ ID NO: 4183059 - DNA, 15 bp, Homo sapiens
ataatcagcctctta

SEQ ID NO: 4183060 - DNA, 16 bp, Homo sapiens
ataatcagcctcttaa

SEQ ID NO: 4183061 - DNA, 17 bp, Homo sapiens
ataatcagcctcttaaa

SEQ ID NO: 4183062 - DNA, 17 bp, Homo sapiens
ataatcgctcttttcca

SEQ ID NO: 4183063 - DNA, 13 bp, Homo sapiens
ataatgaacagaa

SEQ ID NO: 4183064 - DNA, 16 bp, Homo sapiens
ataatgtcaaaatcat

SEQ ID NO: 4183065 - DNA, 23 bp, Homo sapiens
ataattaaaaaccactgaacatt

SEQ ID NO: 4183066 - DNA, 17 bp, Homo sapiens
ataattaatgtgtgtct

SEQ ID NO: 4183067 - DNA, 17 bp, Homo sapiens
ataatttagtttcatat

SEQ ID NO: 4183068 - DNA, 19 bp, Homo sapiens
ataatttatggtattgtat

SEQ ID NO: 4183069 - DNA, 15 bp, Homo sapiens
ataattttttattca

SEQ ID NO: 4183070 - DNA, 16 bp, Homo sapiens
atacaaacaagcacag

SEQ ID NO: 4183071 - DNA, 23 bp, Homo sapiens
atacaatattaattataataaag

SEQ ID NO: 4183072 - DNA, 14 bp, Homo sapiens
atacacaacattta

SEQ ID NO: 4183073 - DNA, 20 bp, Homo sapiens
atacagaattactgtaactg

SEQ ID NO: 4183074 - DNA, 15 bp, Homo sapiens
atacataataaagtg

SEQ ID NO: 4183075 - DNA, 18 bp, Homo sapiens
atacatgctaagagaagt

SEQ ID NO: 4183076 - DNA, 22 bp, Homo sapiens
atacatgctaagagaagtagaa

SEQ ID NO: 4183077 - DNA, 22 bp, Homo sapiens
atacattggaggctttattttg

SEQ ID NO: 4183078 - DNA, 13 bp, Homo sapiens
atacattttacat

SEQ ID NO: 4183079 - DNA, 16 bp, Homo sapiens
atacattttacatatg

SEQ ID NO: 4183080 - DNA, 22 bp, Homo sapiens
atacattttacatatggaaata

SEQ ID NO: 4183081 - DNA, 23 bp, Homo sapiens
ataccccattaccagcatttact

SEQ ID NO: 4183082 - DNA, 22 bp, Homo sapiens
ataccgaccatcgtccagccct

SEQ ID NO: 4183083 - DNA, 14 bp, Homo sapiens
ataccttcttcgct

SEQ ID NO: 4183084 - DNA, 14 bp, Homo sapiens
atacggttgcttca

SEQ ID NO: 4183085 - DNA, 13 bp, Homo sapiens
atacgtgtgtgaa

SEQ ID NO: 4183086 - DNA, 14 bp, Homo sapiens
atacgtgtgtgaag

SEQ ID NO: 4183087 - DNA, 21 bp, Homo sapiens
atactaagcattgaatggcta

SEQ ID NO: 4183088 - DNA, 21 bp, Homo sapiens
atactattaaaaaggtttaca

SEQ ID NO: 4183089 - DNA, 16 bp, Homo sapiens
atactctctgaaatat

SEQ ID NO: 4183090 - DNA, 16 bp, Homo sapiens
atactgtacttaataa

SEQ ID NO: 4183091 - DNA, 16 bp, Homo sapiens
atacttctcatttttt

SEQ ID NO: 4183092 - DNA, 15 bp, Homo sapiens
atactttaattttta

SEQ ID NO: 4183093 - DNA, 14 bp, Homo sapiens
atagaaagcaataa

SEQ ID NO: 4183094 - DNA, 18 bp, Homo sapiens
atagaaagcactactgca

SEQ ID NO: 4183095 - DNA, 17 bp, Homo sapiens
atagaaatgccaagcac

SEQ ID NO: 4183096 - DNA, 21 bp, Homo sapiens
atagaattatttttgagcagg

SEQ ID NO: 4183097 - DNA, 14 bp, Homo sapiens
atagacagaagaaa

SEQ ID NO: 4183098 - DNA, 16 bp, Homo sapiens
atagacagaagaaaca

SEQ ID NO: 4183099 - DNA, 18 bp, Homo sapiens
atagacagaagaaacaag

SEQ ID NO: 4183100 - DNA, 20 bp, Homo sapiens
atagacagcacttggctcct

SEQ ID NO: 4183101 - DNA, 18 bp, Homo sapiens
atagacagtgctgccctg

SEQ ID NO: 4183102 - DNA, 19 bp, Homo sapiens
atagagaaaaactttcatt

SEQ ID NO: 4183103 - DNA, 21 bp, Homo sapiens
atagagcacctagtccagtga

SEQ ID NO: 4183104 - DNA, 20 bp, Homo sapiens
atagagcagaactgaactta

SEQ ID NO: 4183105 - DNA, 19 bp, Homo sapiens
atagagggagaggaagcac

SEQ ID NO: 4183106 - DNA, 16 bp, Homo sapiens
atagaggtaccagcaa

SEQ ID NO: 4183107 - DNA, 16 bp, Homo sapiens
atagataaattttgac

SEQ ID NO: 4183108 - DNA, 18 bp, Homo sapiens
atagatttgtattttaaa

SEQ ID NO: 4183109 - DNA, 15 bp, Homo sapiens
atagcaaaagaagaa

SEQ ID NO: 4183110 - DNA, 22 bp, Homo sapiens
atagcaatccatgttagttttt

SEQ ID NO: 4183111 - DNA, 14 bp, Homo sapiens
atagcagaggaaaa

SEQ ID NO: 4183112 - DNA, 18 bp, Homo sapiens
atagcagaggaaaaagaa

SEQ ID NO: 4183113 - DNA, 20 bp, Homo sapiens
atagcagaggaaaaagaaaa

SEQ ID NO: 4183114 - DNA, 22 bp, Homo sapiens
atagcagaggaaaaagaaaaac

SEQ ID NO: 4183115 - DNA, 22 bp, Homo sapiens
atagcaggtgtaataagactat

SEQ ID NO: 4183116 - DNA, 21 bp, Homo sapiens
atagcatttttgatttatgca

SEQ ID NO: 4183117 - DNA, 13 bp, Homo sapiens
atagccaaaaata

SEQ ID NO: 4183118 - DNA, 16 bp, Homo sapiens
atagccaaaaatagct

SEQ ID NO: 4183119 - DNA, 14 bp, Homo sapiens
atagcccaggtcct

SEQ ID NO: 4183120 - DNA, 13 bp, Homo sapiens
atagctatattta

SEQ ID NO: 4183121 - DNA, 14 bp, Homo sapiens
atagctattactgt

SEQ ID NO: 4183122 - DNA, 15 bp, Homo sapiens
atagctctttcaggg

SEQ ID NO: 4183123 - DNA, 20 bp, Homo sapiens
atagcttgtatagtgtaaaa

SEQ ID NO: 4183124 - DNA, 14 bp, Homo sapiens
atagcttttattgt

SEQ ID NO: 4183125 - DNA, 15 bp, Homo sapiens
atagcttttattgta

SEQ ID NO: 4183126 - DNA, 18 bp, Homo sapiens
atagcttttattgtataa

SEQ ID NO: 4183127 - DNA, 13 bp, Homo sapiens
ataggaaaatgta

SEQ ID NO: 4183128 - DNA, 17 bp, Homo sapiens
ataggaaaatgtacata

SEQ ID NO: 4183129 - DNA, 20 bp, Homo sapiens
ataggaaaatgtacatacta

SEQ ID NO: 4183130 - DNA, 23 bp, Homo sapiens
ataggatttatttaaaatagcaa

SEQ ID NO: 4183131 - DNA, 19 bp, Homo sapiens
ataggctatgtaatgtaaa

SEQ ID NO: 4183132 - DNA, 18 bp, Homo sapiens
ataggctgcccaatctga

SEQ ID NO: 4183133 - DNA, 18 bp, Homo sapiens
ataggctggagaagctca

SEQ ID NO: 4183134 - DNA, 18 bp, Homo sapiens
ataggcttagagaggaaa

SEQ ID NO: 4183135 - DNA, 19 bp, Homo sapiens
ataggcttagagaggaaaa

SEQ ID NO: 4183136 - DNA, 18 bp, Homo sapiens
ataggctttagaagagat

SEQ ID NO: 4183137 - DNA, 18 bp, Homo sapiens
ataggtgcaaaaataaaa

SEQ ID NO: 4183138 - DNA, 20 bp, Homo sapiens
ataggttgccaataatacac

SEQ ID NO: 4183139 - DNA, 13 bp, Homo sapiens
atagtaaatcacg

SEQ ID NO: 4183140 - DNA, 16 bp, Homo sapiens
atagtgcacacttgta

SEQ ID NO: 4183141 - DNA, 11 bp, Homo sapiens
atagttccagt

SEQ ID NO: 4183142 - DNA, 14 bp, Homo sapiens
atagtttcagatat

SEQ ID NO: 4183143 - DNA, 22 bp, Homo sapiens
atagtttgctttgctttttaat

SEQ ID NO: 4183144 - DNA, 18 bp, Homo sapiens
atagtttggatatgtaaa

SEQ ID NO: 4183145 - DNA, 15 bp, Homo sapiens
atataaaaatgtgaa

SEQ ID NO: 4183146 - DNA, 16 bp, Homo sapiens
atataaaaatgtgaat

SEQ ID NO: 4183147 - DNA, 22 bp, Homo sapiens
atataaaatatatttatgataa

SEQ ID NO: 4183148 - DNA, 21 bp, Homo sapiens
atataataaatagaaattttg

SEQ ID NO: 4183149 - DNA, 16 bp, Homo sapiens
atatactatacaacaa

SEQ ID NO: 4183150 - DNA, 17 bp, Homo sapiens
atatactatacaacaat

SEQ ID NO: 4183151 - DNA, 12 bp, Homo sapiens
atatagatgtgc

SEQ ID NO: 4183152 - DNA, 16 bp, Homo sapiens
atataggttgtgcaaa

SEQ ID NO: 4183153 - DNA, 16 bp, Homo sapiens
atatatcccagaaatt

SEQ ID NO: 4183154 - DNA, 18 bp, Homo sapiens
atatatctgcttcagtgg

SEQ ID NO: 4183155 - DNA, 20 bp, Homo sapiens
atatatcttatgttaaagga

SEQ ID NO: 4183156 - DNA, 21 bp, Homo sapiens
atatatggtctgtgtgtctga

SEQ ID NO: 4183157 - DNA, 16 bp, Homo sapiens
atatattaggcactac

SEQ ID NO: 4183158 - DNA, 12 bp, Homo sapiens
atatatttatga

SEQ ID NO: 4183159 - DNA, 15 bp, Homo sapiens
atatatttattttat

SEQ ID NO: 4183160 - DNA, 21 bp, Homo sapiens
atatatttttcacagtttttc

SEQ ID NO: 4183161 - DNA, 14 bp, Homo sapiens
atatcaaggaaaac

SEQ ID NO: 4183162 - DNA, 15 bp, Homo sapiens
atatcactaagagct

SEQ ID NO: 4183163 - DNA, 14 bp, Homo sapiens
atatcatattggta

SEQ ID NO: 4183164 - DNA, 19 bp, Homo sapiens
atatcatattggtattcac

SEQ ID NO: 4183165 - DNA, 16 bp, Homo sapiens
atatcatcgtatttct

SEQ ID NO: 4183166 - DNA, 13 bp, Homo sapiens
atatcctgcttga

SEQ ID NO: 4183167 - DNA, 23 bp, Homo sapiens
atatctattattataaaaataat

SEQ ID NO: 4183168 - DNA, 21 bp, Homo sapiens
atatgatgttaaaaaaataag

SEQ ID NO: 4183169 - DNA, 21 bp, Homo sapiens
atatgcataatcagcgccctg

SEQ ID NO: 4183170 - DNA, 22 bp, Homo sapiens
atatgctccaggatctttgact

SEQ ID NO: 4183171 - DNA, 12 bp, Homo sapiens
atatgctctcat

SEQ ID NO: 4183172 - DNA, 14 bp, Homo sapiens
atatggaaatatag

SEQ ID NO: 4183173 - DNA, 18 bp, Homo sapiens
atatggaacttctaatat

SEQ ID NO: 4183174 - DNA, 20 bp, Homo sapiens
atatggaacttctaatatat

SEQ ID NO: 4183175 - DNA, 17 bp, Homo sapiens
atatggaagataatttt

SEQ ID NO: 4183176 - DNA, 17 bp, Homo sapiens
atatggacttaaatgtt

SEQ ID NO: 4183177 - DNA, 20 bp, Homo sapiens
atatggacttaaatgttaat

SEQ ID NO: 4183178 - DNA, 17 bp, Homo sapiens
atatggcaagaaagctg

SEQ ID NO: 4183179 - DNA, 16 bp, Homo sapiens
atatggtgcaaaaatg

SEQ ID NO: 4183180 - DNA, 14 bp, Homo sapiens
atatgtaaaacatt

SEQ ID NO: 4183181 - DNA, 15 bp, Homo sapiens
atatgtaaaacattt

SEQ ID NO: 4183182 - DNA, 24 bp, Homo sapiens
atatgtaaaacatttattttgaca

SEQ ID NO: 4183183 - DNA, 22 bp, Homo sapiens
atatgtagccttgccttttaaa

SEQ ID NO: 4183184 - DNA, 17 bp, Homo sapiens
atatgtaggtgtctgca

SEQ ID NO: 4183185 - DNA, 18 bp, Homo sapiens
atatgtctgccacagaga

SEQ ID NO: 4183186 - DNA, 21 bp, Homo sapiens
atattaaatgaaagaatatct

SEQ ID NO: 4183187 - DNA, 18 bp, Homo sapiens
atattaccaaaaaagtat

SEQ ID NO: 4183188 - DNA, 14 bp, Homo sapiens
atattatgagatgc

SEQ ID NO: 4183189 - DNA, 15 bp, Homo sapiens
atattatgagatgct

SEQ ID NO: 4183190 - DNA, 20 bp, Homo sapiens
atattcaataaagctgctga

SEQ ID NO: 4183191 - DNA, 22 bp, Homo sapiens
atattcagtgctgtggcctggg

SEQ ID NO: 4183192 - DNA, 23 bp, Homo sapiens
atattcagtgctgtggcctgggc

SEQ ID NO: 4183193 - DNA, 18 bp, Homo sapiens
atattcatgcttcttcct

SEQ ID NO: 4183194 - DNA, 23 bp, Homo sapiens
atattcctattgtgcaatgtaaa

SEQ ID NO: 4183195 - DNA, 17 bp, Homo sapiens
atattcctttttaactt

SEQ ID NO: 4183196 - DNA, 14 bp, Homo sapiens
atattgaaaagata

SEQ ID NO: 4183197 - DNA, 19 bp, Homo sapiens
atattggacaaagaacctt

SEQ ID NO: 4183198 - DNA, 16 bp, Homo sapiens
atatttaggcaagaga

SEQ ID NO: 4183199 - DNA, 21 bp, Homo sapiens
atatttagttatagtttcaga

SEQ ID NO: 4183200 - DNA, 22 bp, Homo sapiens
atatttagttatagtttcagat

SEQ ID NO: 4183201 - DNA, 12 bp, Homo sapiens
atatttcaagtg

SEQ ID NO: 4183202 - DNA, 13 bp, Homo sapiens
atatttcacatgt

SEQ ID NO: 4183203 - DNA, 19 bp, Homo sapiens
atatttctttttagattgt

SEQ ID NO: 4183204 - DNA, 12 bp, Homo sapiens
atatttgaaatt

SEQ ID NO: 4183205 - DNA, 16 bp, Homo sapiens
atatttgaaattttat

SEQ ID NO: 4183206 - DNA, 21 bp, Homo sapiens
atatttgattgtaaaaacaaa

SEQ ID NO: 4183207 - DNA, 16 bp, Homo sapiens
atatttggaaagagac

SEQ ID NO: 4183208 - DNA, 15 bp, Homo sapiens
atatttttgtaaata

SEQ ID NO: 4183209 - DNA, 21 bp, Homo sapiens
atcaaaatccctatttaattt

SEQ ID NO: 4183210 - DNA, 11 bp, Homo sapiens
atcaaaatctt

SEQ ID NO: 4183211 - DNA, 23 bp, Homo sapiens
atcaaacaccaacataaaaatga

SEQ ID NO: 4183212 - DNA, 13 bp, Homo sapiens
atcaaagaaaaca

SEQ ID NO: 4183213 - DNA, 14 bp, Homo sapiens
atcaaagaaaacat

SEQ ID NO: 4183214 - DNA, 16 bp, Homo sapiens
atcaacttgaagcaag

SEQ ID NO: 4183215 - DNA, 19 bp, Homo sapiens
atcaagacactagttcaga

SEQ ID NO: 4183216 - DNA, 17 bp, Homo sapiens
atcaaggaaaactgtga

SEQ ID NO: 4183217 - DNA, 18 bp, Homo sapiens
atcaaggccttattggaa

SEQ ID NO: 4183218 - DNA, 15 bp, Homo sapiens
atcaagtccagagcc

SEQ ID NO: 4183219 - DNA, 22 bp, Homo sapiens
atcaatcatctgtgtgaaaatg

SEQ ID NO: 4183220 - DNA, 19 bp, Homo sapiens
atcaattcttaaatttctt

SEQ ID NO: 4183221 - DNA, 13 bp, Homo sapiens
atcacaccactgc

SEQ ID NO: 4183222 - DNA, 12 bp, Homo sapiens
atcacagggcag

SEQ ID NO: 4183223 - DNA, 20 bp, Homo sapiens
atcacagggcagagccggga

SEQ ID NO: 4183224 - DNA, 20 bp, Homo sapiens
atcacctctggctttgtctc

SEQ ID NO: 4183225 - DNA, 23 bp, Homo sapiens
atcacgccactgcactccagcct

SEQ ID NO: 4183226 - DNA, 13 bp, Homo sapiens
atcactctgtcct

SEQ ID NO: 4183227 - DNA, 10 bp, Homo sapiens
atcactggag

SEQ ID NO: 4183228 - DNA, 13 bp, Homo sapiens
atcactggagccc

SEQ ID NO: 4183229 - DNA, 15 bp, Homo sapiens
atcactggagcccag

SEQ ID NO: 4183230 - DNA, 18 bp, Homo sapiens
atcactgtagtctaagac

SEQ ID NO: 4183231 - DNA, 20 bp, Homo sapiens
atcacttgggcccaggaggt

SEQ ID NO: 4183232 - DNA, 15 bp, Homo sapiens
atcacttttcagtga

SEQ ID NO: 4183233 - DNA, 12 bp, Homo sapiens
atcagaaatagg

SEQ ID NO: 4183234 - DNA, 14 bp, Homo sapiens
atcagaaataggaa

SEQ ID NO: 4183235 - DNA, 16 bp, Homo sapiens
atcagaagtaggaagg

SEQ ID NO: 4183236 - DNA, 14 bp, Homo sapiens
atcagcagtggcag

SEQ ID NO: 4183237 - DNA, 13 bp, Homo sapiens
atcagcctcttaa

SEQ ID NO: 4183238 - DNA, 15 bp, Homo sapiens
atcagcctcttaaag

SEQ ID NO: 4183239 - DNA, 17 bp, Homo sapiens
atcaggaagagaaggag

SEQ ID NO: 4183240 - DNA, 19 bp, Homo sapiens
atcaggaagagaaggagca

SEQ ID NO: 4183241 - DNA, 19 bp, Homo sapiens
atcaggcagttccctgttg

SEQ ID NO: 4183242 - DNA, 19 bp, Homo sapiens
atcagtagctgagtgcact

SEQ ID NO: 4183243 - DNA, 16 bp, Homo sapiens
atcagtcatgaggaaa

SEQ ID NO: 4183244 - DNA, 16 bp, Homo sapiens
atcagtgtggaaaaaa

SEQ ID NO: 4183245 - DNA, 17 bp, Homo sapiens
atcagttttatccacag

SEQ ID NO: 4183246 - DNA, 21 bp, Homo sapiens
atcatattggtattcactaat

SEQ ID NO: 4183247 - DNA, 13 bp, Homo sapiens
atcatctgtgtga

SEQ ID NO: 4183248 - DNA, 16 bp, Homo sapiens
atcatctgtgtgaaaa

SEQ ID NO: 4183249 - DNA, 18 bp, Homo sapiens
atcatgaatatttcaaaa

SEQ ID NO: 4183250 - DNA, 22 bp, Homo sapiens
atcatgtgtttaaattatttta

SEQ ID NO: 4183251 - DNA, 16 bp, Homo sapiens
atcattatgtaatgtc

SEQ ID NO: 4183252 - DNA, 18 bp, Homo sapiens
atcattgtgcttaataat

SEQ ID NO: 4183253 - DNA, 17 bp, Homo sapiens
atcatttgaacaactag

SEQ ID NO: 4183254 - DNA, 19 bp, Homo sapiens
atcatttggaaatcagcat

SEQ ID NO: 4183255 - DNA, 18 bp, Homo sapiens
atccaaccccccacctgc

SEQ ID NO: 4183256 - DNA, 22 bp, Homo sapiens
atccaatgaatgatcattgaaa

SEQ ID NO: 4183257 - DNA, 18 bp, Homo sapiens
atccacaaagccgtgcct

SEQ ID NO: 4183258 - DNA, 14 bp, Homo sapiens
atccacaagccatt

SEQ ID NO: 4183259 - DNA, 16 bp, Homo sapiens
atccaggattggcctg

SEQ ID NO: 4183260 - DNA, 14 bp, Homo sapiens
atccagtaagcaca

SEQ ID NO: 4183261 - DNA, 21 bp, Homo sapiens
atccagtgatcctcaaacaca

SEQ ID NO: 4183262 - DNA, 19 bp, Homo sapiens
atccagtttcccaccacct

SEQ ID NO: 4183263 - DNA, 16 bp, Homo sapiens
atccatacagtcaaga

SEQ ID NO: 4183264 - DNA, 17 bp, Homo sapiens
atccatacagtcaagat

SEQ ID NO: 4183265 - DNA, 21 bp, Homo sapiens
atccatacagtcaagatacat

SEQ ID NO: 4183266 - DNA, 22 bp, Homo sapiens
atccatacagtcaagatacata

SEQ ID NO: 4183267 - DNA, 13 bp, Homo sapiens
atccatcctgcga

SEQ ID NO: 4183268 - DNA, 18 bp, Homo sapiens
atccatgttagtttttac

SEQ ID NO: 4183269 - DNA, 19 bp, Homo sapiens
atccatgttagtttttact

SEQ ID NO: 4183270 - DNA, 20 bp, Homo sapiens
atcccaagtagaatctcagt

SEQ ID NO: 4183271 - DNA, 19 bp, Homo sapiens
atcccagctacccaggagg

SEQ ID NO: 4183272 - DNA, 23 bp, Homo sapiens
atccccatccctctactttcccc

SEQ ID NO: 4183273 - DNA, 13 bp, Homo sapiens
atcccctttcctc

SEQ ID NO: 4183274 - DNA, 16 bp, Homo sapiens
atcccctttcctcccc

SEQ ID NO: 4183275 - DNA, 18 bp, Homo sapiens
atcccctttcctccccac

SEQ ID NO: 4183276 - DNA, 20 bp, Homo sapiens
atcccctttcctccccacct

SEQ ID NO: 4183277 - DNA, 21 bp, Homo sapiens
atccctatgaagttgaaaaat

SEQ ID NO: 4183278 - DNA, 12 bp, Homo sapiens
atccctccatcc

SEQ ID NO: 4183279 - DNA, 14 bp, Homo sapiens
atccctgggcaagt

SEQ ID NO: 4183280 - DNA, 15 bp, Homo sapiens
atccgactctaagct

SEQ ID NO: 4183281 - DNA, 19 bp, Homo sapiens
atccgactctaagctgtgt

SEQ ID NO: 4183282 - DNA, 23 bp, Homo sapiens
atccgactctaagctgtgtgcag

SEQ ID NO: 4183283 - DNA, 10 bp, Homo sapiens
atccgcctgc

SEQ ID NO: 4183284 - DNA, 17 bp, Homo sapiens
atccgcctgcagaggac

SEQ ID NO: 4183285 - DNA, 14 bp, Homo sapiens
atcctaaacatcat

SEQ ID NO: 4183286 - DNA, 20 bp, Homo sapiens
atcctcaggtagtactggga

SEQ ID NO: 4183287 - DNA, 15 bp, Homo sapiens
atcctctttttccaa

SEQ ID NO: 4183288 - DNA, 16 bp, Homo sapiens
atcctgaaaaaatgat

SEQ ID NO: 4183289 - DNA, 11 bp, Homo sapiens
atcctgctgcc

SEQ ID NO: 4183290 - DNA, 17 bp, Homo sapiens
atcctgctgccagagaa

SEQ ID NO: 4183291 - DNA, 20 bp, Homo sapiens
atcctgctgccagagaacca

SEQ ID NO: 4183292 - DNA, 14 bp, Homo sapiens
atcctgctgctgtg

SEQ ID NO: 4183293 - DNA, 17 bp, Homo sapiens
atcctggccaacatggt

SEQ ID NO: 4183294 - DNA, 21 bp, Homo sapiens
atcctgtattcagacagatga

SEQ ID NO: 4183295 - DNA, 18 bp, Homo sapiens
atccttagatctggcatg

SEQ ID NO: 4183296 - DNA, 18 bp, Homo sapiens
atccttggagagcagctg

SEQ ID NO: 4183297 - DNA, 24 bp, Homo sapiens
atccttggagagcagctggctctc

SEQ ID NO: 4183298 - DNA, 12 bp, Homo sapiens
atcgactttata

SEQ ID NO: 4183299 - DNA, 19 bp, Homo sapiens
atcgactttatacagaact

SEQ ID NO: 4183300 - DNA, 20 bp, Homo sapiens
atcgcagaccttttttagga

SEQ ID NO: 4183301 - DNA, 23 bp, Homo sapiens
atcgcgccactacactccagcct

SEQ ID NO: 4183302 - DNA, 20 bp, Homo sapiens
atcggctggggactgctacc

SEQ ID NO: 4183303 - DNA, 12 bp, Homo sapiens
atcgtccagccc

SEQ ID NO: 4183304 - DNA, 15 bp, Homo sapiens
atctaacaataatat

SEQ ID NO: 4183305 - DNA, 22 bp, Homo sapiens
atctaacaataatatttcaagt

SEQ ID NO: 4183306 - DNA, 21 bp, Homo sapiens
atctagaatgtgttttctgaa

SEQ ID NO: 4183307 - DNA, 16 bp, Homo sapiens
atctagtcacaaagac

SEQ ID NO: 4183308 - DNA, 14 bp, Homo sapiens
atctatctgccttt

SEQ ID NO: 4183309 - DNA, 23 bp, Homo sapiens
atctatcttttccacaaatatga

SEQ ID NO: 4183310 - DNA, 22 bp, Homo sapiens
atctcaaatccactgacagata

SEQ ID NO: 4183311 - DNA, 14 bp, Homo sapiens
atctcaggccagag

SEQ ID NO: 4183312 - DNA, 17 bp, Homo sapiens
atctcagtgaagaatac

SEQ ID NO: 4183313 - DNA, 21 bp, Homo sapiens
atctcagttgattttctggat

SEQ ID NO: 4183314 - DNA, 19 bp, Homo sapiens
atctcataggttgccaata

SEQ ID NO: 4183315 - DNA, 19 bp, Homo sapiens
atctcatctcagtgaagaa

SEQ ID NO: 4183316 - DNA, 13 bp, Homo sapiens
atctcatgctctc

SEQ ID NO: 4183317 - DNA, 19 bp, Homo sapiens
atctccacagtcaaagaag

SEQ ID NO: 4183318 - DNA, 17 bp, Homo sapiens
atctccagggctgcccc

SEQ ID NO: 4183319 - DNA, 14 bp, Homo sapiens
atctccctcccaca

SEQ ID NO: 4183320 - DNA, 17 bp, Homo sapiens
atctcctcccatggcct

SEQ ID NO: 4183321 - DNA, 16 bp, Homo sapiens
atctcctgacctcgtg

SEQ ID NO: 4183322 - DNA, 13 bp, Homo sapiens
atctctaatatgg

SEQ ID NO: 4183323 - DNA, 15 bp, Homo sapiens
atctctccagagagc

SEQ ID NO: 4183324 - DNA, 16 bp, Homo sapiens
atctctgaaacatatt

SEQ ID NO: 4183325 - DNA, 15 bp, Homo sapiens
atctgaaggagattt

SEQ ID NO: 4183326 - DNA, 14 bp, Homo sapiens
atctgaatttttaa

SEQ ID NO: 4183327 - DNA, 18 bp, Homo sapiens
atctgagatctccctcca

SEQ ID NO: 4183328 - DNA, 21 bp, Homo sapiens
atctgagcaaacaccagtgag

SEQ ID NO: 4183329 - DNA, 22 bp, Homo sapiens
atctgagcaagagctggcaaag

SEQ ID NO: 4183330 - DNA, 13 bp, Homo sapiens
atctgagtgtgga

SEQ ID NO: 4183331 - DNA, 18 bp, Homo sapiens
atctggatatatttaaaa

SEQ ID NO: 4183332 - DNA, 22 bp, Homo sapiens
atctggcttctggccaggaagc

SEQ ID NO: 4183333 - DNA, 20 bp, Homo sapiens
atctgggaggtctccactga

SEQ ID NO: 4183334 - DNA, 16 bp, Homo sapiens
atctgggtaagaagaa

SEQ ID NO: 4183335 - DNA, 16 bp, Homo sapiens
atctggtttttaaaag

SEQ ID NO: 4183336 - DNA, 17 bp, Homo sapiens
atctgtgataattttct

SEQ ID NO: 4183337 - DNA, 16 bp, Homo sapiens
atctgtgttatttgga

SEQ ID NO: 4183338 - DNA, 14 bp, Homo sapiens
atctgttttgtttc

SEQ ID NO: 4183339 - DNA, 16 bp, Homo sapiens
atcttactatttcaca

SEQ ID NO: 4183340 - DNA, 15 bp, Homo sapiens
atcttataaactgac

SEQ ID NO: 4183341 - DNA, 20 bp, Homo sapiens
atcttatgcttaaaatgcca

SEQ ID NO: 4183342 - DNA, 11 bp, Homo sapiens
atcttcacaag

SEQ ID NO: 4183343 - DNA, 16 bp, Homo sapiens
atcttcacaagtgtgt

SEQ ID NO: 4183344 - DNA, 22 bp, Homo sapiens
atcttccgtggtcagagtgcca

SEQ ID NO: 4183345 - DNA, 15 bp, Homo sapiens
atcttcgtcctgccc

SEQ ID NO: 4183346 - DNA, 14 bp, Homo sapiens
atcttctagccaca

SEQ ID NO: 4183347 - DNA, 15 bp, Homo sapiens
atcttctagccacag

SEQ ID NO: 4183348 - DNA, 16 bp, Homo sapiens
atcttgactcactgca

SEQ ID NO: 4183349 - DNA, 21 bp, Homo sapiens
atcttgcccctccagagacag

SEQ ID NO: 4183350 - DNA, 20 bp, Homo sapiens
atctttaaaagatgctttta

SEQ ID NO: 4183351 - DNA, 21 bp, Homo sapiens
atctttaaaagatgcttttaa

SEQ ID NO: 4183352 - DNA, 14 bp, Homo sapiens
atctttaagtattg

SEQ ID NO: 4183353 - DNA, 16 bp, Homo sapiens
atctttaagtattgtt

SEQ ID NO: 4183354 - DNA, 12 bp, Homo sapiens
atctttcctgtc

SEQ ID NO: 4183355 - DNA, 13 bp, Homo sapiens
atgaaaccaaagc

SEQ ID NO: 4183356 - DNA, 14 bp, Homo sapiens
atgaaagaatatct

SEQ ID NO: 4183357 - DNA, 20 bp, Homo sapiens
atgaaattgtctagcagagc

SEQ ID NO: 4183358 - DNA, 21 bp, Homo sapiens
atgaaattttctagactttct

SEQ ID NO: 4183359 - DNA, 21 bp, Homo sapiens
atgaagacaggacagtgcttc

SEQ ID NO: 4183360 - DNA, 22 bp, Homo sapiens
atgaagactgttaaatgaaacc

SEQ ID NO: 4183361 - DNA, 18 bp, Homo sapiens
atgaagctttggccctca

SEQ ID NO: 4183362 - DNA, 18 bp, Homo sapiens
atgaagtgttagatagaa

SEQ ID NO: 4183363 - DNA, 20 bp, Homo sapiens
atgaatgatcattgaaagta

SEQ ID NO: 4183364 - DNA, 20 bp, Homo sapiens
atgaattcttgagtttacat

SEQ ID NO: 4183365 - DNA, 20 bp, Homo sapiens
atgaatttggagactctgtg

SEQ ID NO: 4183366 - DNA, 21 bp, Homo sapiens
atgaatttggagactctgtgg

SEQ ID NO: 4183367 - DNA, 15 bp, Homo sapiens
atgacatgttatata

SEQ ID NO: 4183368 - DNA, 23 bp, Homo sapiens
atgacatgttatatattttttgt

SEQ ID NO: 4183369 - DNA, 23 bp, Homo sapiens
atgaccctgcgaaggggccctgg

SEQ ID NO: 4183370 - DNA, 19 bp, Homo sapiens
atgactcactccattccta

SEQ ID NO: 4183371 - DNA, 20 bp, Homo sapiens
atgacttttccatgtatcta

SEQ ID NO: 4183372 - DNA, 20 bp, Homo sapiens
atgacttttctggaagacat

SEQ ID NO: 4183373 - DNA, 23 bp, Homo sapiens
atgagaaaatggctttaatcaat

SEQ ID NO: 4183374 - DNA, 14 bp, Homo sapiens
atgagaaagccttc

SEQ ID NO: 4183375 - DNA, 15 bp, Homo sapiens
atgagaaatacaaaa

SEQ ID NO: 4183376 - DNA, 15 bp, Homo sapiens
atgagatgctggctt

SEQ ID NO: 4183377 - DNA, 15 bp, Homo sapiens
atgaggaaagacaca

SEQ ID NO: 4183378 - DNA, 14 bp, Homo sapiens
atgagtacctcaaa

SEQ ID NO: 4183379 - DNA, 20 bp, Homo sapiens
atgagtcagacatttggtat

SEQ ID NO: 4183380 - DNA, 16 bp, Homo sapiens
atgagtctgctttcac

SEQ ID NO: 4183381 - DNA, 22 bp, Homo sapiens
atgagttaactgtgaaatacca

SEQ ID NO: 4183382 - DNA, 13 bp, Homo sapiens
atgatactttaat

SEQ ID NO: 4183383 - DNA, 13 bp, Homo sapiens
atgatagtgtgat

SEQ ID NO: 4183384 - DNA, 17 bp, Homo sapiens
atgatagtgtgattttt

SEQ ID NO: 4183385 - DNA, 21 bp, Homo sapiens
atgatatccagtaagcacatg

SEQ ID NO: 4183386 - DNA, 13 bp, Homo sapiens
atgatcattgaaa

SEQ ID NO: 4183387 - DNA, 16 bp, Homo sapiens
atgatcctgaaaaaat

SEQ ID NO: 4183388 - DNA, 16 bp, Homo sapiens
atgatgaaaataataa

SEQ ID NO: 4183389 - DNA, 17 bp, Homo sapiens
atgatgaaaataataaa

SEQ ID NO: 4183390 - DNA, 13 bp, Homo sapiens
atgatgatgatga

SEQ ID NO: 4183391 - DNA, 21 bp, Homo sapiens
atgatgattccttgagcattt

SEQ ID NO: 4183392 - DNA, 21 bp, Homo sapiens
atgatgttaaaaaaataagaa

SEQ ID NO: 4183393 - DNA, 17 bp, Homo sapiens
atgatgttatagaatta

SEQ ID NO: 4183394 - DNA, 18 bp, Homo sapiens
atgattccttgagcattt

SEQ ID NO: 4183395 - DNA, 14 bp, Homo sapiens
atgattgtaaaata

SEQ ID NO: 4183396 - DNA, 13 bp, Homo sapiens
atgatttctgtga

SEQ ID NO: 4183397 - DNA, 18 bp, Homo sapiens
atgattttcctccctggt

SEQ ID NO: 4183398 - DNA, 11 bp, Homo sapiens
atgatttttag

SEQ ID NO: 4183399 - DNA, 22 bp, Homo sapiens
atgatttttagatgagattgtt

SEQ ID NO: 4183400 - DNA, 11 bp, Homo sapiens
atgatttttgc

SEQ ID NO: 4183401 - DNA, 14 bp, Homo sapiens
atgcaaaccatagc

SEQ ID NO: 4183402 - DNA, 19 bp, Homo sapiens
atgcaacaaatatttatat

SEQ ID NO: 4183403 - DNA, 13 bp, Homo sapiens
atgcaagcacaaa

SEQ ID NO: 4183404 - DNA, 22 bp, Homo sapiens
atgcaattggggaagaaaaaat

SEQ ID NO: 4183405 - DNA, 19 bp, Homo sapiens
atgcaatttattaaaatga

SEQ ID NO: 4183406 - DNA, 20 bp, Homo sapiens
atgcacactagcctctccag

SEQ ID NO: 4183407 - DNA, 22 bp, Homo sapiens
atgcacactagcctctccagga

SEQ ID NO: 4183408 - DNA, 13 bp, Homo sapiens
atgcacactgttg

SEQ ID NO: 4183409 - DNA, 14 bp, Homo sapiens
atgcacctaaagaa

SEQ ID NO: 4183410 - DNA, 23 bp, Homo sapiens
atgcacctaaagaaaaacaaact

SEQ ID NO: 4183411 - DNA, 12 bp, Homo sapiens
atgcagaatgtt

SEQ ID NO: 4183412 - DNA, 20 bp, Homo sapiens
atgcagtcttaccaatgact

SEQ ID NO: 4183413 - DNA, 22 bp, Homo sapiens
atgcagtcttaccaatgacttt

SEQ ID NO: 4183414 - DNA, 16 bp, Homo sapiens
atgcatcatcagccta

SEQ ID NO: 4183415 - DNA, 12 bp, Homo sapiens
atgcatctgttt

SEQ ID NO: 4183416 - DNA, 16 bp, Homo sapiens
atgcatgcgcaggctc

SEQ ID NO: 4183417 - DNA, 12 bp, Homo sapiens
atgcatggaaac

SEQ ID NO: 4183418 - DNA, 21 bp, Homo sapiens
atgcatgtaaggtcttcttgt

SEQ ID NO: 4183419 - DNA, 21 bp, Homo sapiens
atgcattctaccactacattt

SEQ ID NO: 4183420 - DNA, 17 bp, Homo sapiens
atgccaaaaaaaaatac

SEQ ID NO: 4183421 - DNA, 19 bp, Homo sapiens
atgccaaaaaaaaatacat

SEQ ID NO: 4183422 - DNA, 16 bp, Homo sapiens
atgccaagtggccctc

SEQ ID NO: 4183423 - DNA, 14 bp, Homo sapiens
atgccatgatgcct

SEQ ID NO: 4183424 - DNA, 20 bp, Homo sapiens
atgcccagagggcccaggca

SEQ ID NO: 4183425 - DNA, 16 bp, Homo sapiens
atgccctccctgctgc

SEQ ID NO: 4183426 - DNA, 23 bp, Homo sapiens
atgcccttctgattcccctccac

SEQ ID NO: 4183427 - DNA, 18 bp, Homo sapiens
atgcctaatatttaggca

SEQ ID NO: 4183428 - DNA, 18 bp, Homo sapiens
atgcctcaagaacacctt

SEQ ID NO: 4183429 - DNA, 19 bp, Homo sapiens
atgcctctgtcttctggac

SEQ ID NO: 4183430 - DNA, 18 bp, Homo sapiens
atgcctggcccccctcca

SEQ ID NO: 4183431 - DNA, 22 bp, Homo sapiens
atgcctggcccccctccaggca

SEQ ID NO: 4183432 - DNA, 20 bp, Homo sapiens
atgcctgggaatcctgctgc

SEQ ID NO: 4183433 - DNA, 21 bp, Homo sapiens
atgcctgtagctttcctggtc

SEQ ID NO: 4183434 - DNA, 22 bp, Homo sapiens
atgcctgtagctttcctggtcc

SEQ ID NO: 4183435 - DNA, 14 bp, Homo sapiens
atgcctttagatgt

SEQ ID NO: 4183436 - DNA, 16 bp, Homo sapiens
atgcggggcagagcca

SEQ ID NO: 4183437 - DNA, 17 bp, Homo sapiens
atgctaagagaagtaga

SEQ ID NO: 4183438 - DNA, 15 bp, Homo sapiens
atgctaattgaacat

SEQ ID NO: 4183439 - DNA, 22 bp, Homo sapiens
atgctccaggatctttgactga

SEQ ID NO: 4183440 - DNA, 22 bp, Homo sapiens
atgctggacggcattcctgctt

SEQ ID NO: 4183441 - DNA, 19 bp, Homo sapiens
atgctgtcactggcagagc

SEQ ID NO: 4183442 - DNA, 14 bp, Homo sapiens
atgcttaaaaatgt

SEQ ID NO: 4183443 - DNA, 16 bp, Homo sapiens
atgcttaaagcaaggc

SEQ ID NO: 4183444 - DNA, 22 bp, Homo sapiens
atgctttccttttcttccttct

SEQ ID NO: 4183445 - DNA, 21 bp, Homo sapiens
atgctttgaagtacaattgtg

SEQ ID NO: 4183446 - DNA, 16 bp, Homo sapiens
atgctttttgaatgtt

SEQ ID NO: 4183447 - DNA, 12 bp, Homo sapiens
atggaaatgtaa

SEQ ID NO: 4183448 - DNA, 18 bp, Homo sapiens
atggaacttctaatatat

SEQ ID NO: 4183449 - DNA, 19 bp, Homo sapiens
atggaagataattttatgt

SEQ ID NO: 4183450 - DNA, 15 bp, Homo sapiens
atggaataaaccatt

SEQ ID NO: 4183451 - DNA, 19 bp, Homo sapiens
atggaatttaatttatgtg

SEQ ID NO: 4183452 - DNA, 23 bp, Homo sapiens
atggacaccccttatccaggact

SEQ ID NO: 4183453 - DNA, 17 bp, Homo sapiens
atggactatacatacta

SEQ ID NO: 4183454 - DNA, 12 bp, Homo sapiens
atggacttcaaa

SEQ ID NO: 4183455 - DNA, 16 bp, Homo sapiens
atggagaggtttgtca

SEQ ID NO: 4183456 - DNA, 18 bp, Homo sapiens
atggagaggtttgtcaac

SEQ ID NO: 4183457 - DNA, 13 bp, Homo sapiens
atggagggagcca

SEQ ID NO: 4183458 - DNA, 19 bp, Homo sapiens
atggagtgtgcgtgtgtgc

SEQ ID NO: 4183459 - DNA, 18 bp, Homo sapiens
atggataacctatatgat

SEQ ID NO: 4183460 - DNA, 18 bp, Homo sapiens
atggattctaaaatgcct

SEQ ID NO: 4183461 - DNA, 24 bp, Homo sapiens
atggcaaagcggttgcttctggct

SEQ ID NO: 4183462 - DNA, 23 bp, Homo sapiens
atggcaagaaagctggtaaacta

SEQ ID NO: 4183463 - DNA, 23 bp, Homo sapiens
atggcaccatccaccctgcaggc

SEQ ID NO: 4183464 - DNA, 20 bp, Homo sapiens
atggcagcagttccatgaag

SEQ ID NO: 4183465 - DNA, 17 bp, Homo sapiens
atggcaggaaggcttgt

SEQ ID NO: 4183466 - DNA, 18 bp, Homo sapiens
atggcagtgttcctattt

SEQ ID NO: 4183467 - DNA, 20 bp, Homo sapiens
atggcctgccttgaagccac

SEQ ID NO: 4183468 - DNA, 12 bp, Homo sapiens
atggccttccct

SEQ ID NO: 4183469 - DNA, 18 bp, Homo sapiens
atggccttccctccccac

SEQ ID NO: 4183470 - DNA, 16 bp, Homo sapiens
atggctaattcccaga

SEQ ID NO: 4183471 - DNA, 14 bp, Homo sapiens
atggctatatggca

SEQ ID NO: 4183472 - DNA, 12 bp, Homo sapiens
atgggaccacaa

SEQ ID NO: 4183473 - DNA, 12 bp, Homo sapiens
atgggccctgca

SEQ ID NO: 4183474 - DNA, 14 bp, Homo sapiens
atgggctgcagaag

SEQ ID NO: 4183475 - DNA, 21 bp, Homo sapiens
atggggcatcctctttttcca

SEQ ID NO: 4183476 - DNA, 20 bp, Homo sapiens
atggggcttgccctgggtca

SEQ ID NO: 4183477 - DNA, 19 bp, Homo sapiens
atggggtccaggtcaccag

SEQ ID NO: 4183478 - DNA, 18 bp, Homo sapiens
atgggtaatataaagtgt

SEQ ID NO: 4183479 - DNA, 17 bp, Homo sapiens
atgggtctggctgagct

SEQ ID NO: 4183480 - DNA, 17 bp, Homo sapiens
atggtaagactgtaatt

SEQ ID NO: 4183481 - DNA, 22 bp, Homo sapiens
atggtaagactgtaattaagta

SEQ ID NO: 4183482 - DNA, 17 bp, Homo sapiens
atggtagagagagttgc

SEQ ID NO: 4183483 - DNA, 20 bp, Homo sapiens
atggtatgagctgagggggg

SEQ ID NO: 4183484 - DNA, 12 bp, Homo sapiens
atggtcctgggg

SEQ ID NO: 4183485 - DNA, 14 bp, Homo sapiens
atggtcctggggct

SEQ ID NO: 4183486 - DNA, 17 bp, Homo sapiens
atggtcctttctggaag

SEQ ID NO: 4183487 - DNA, 18 bp, Homo sapiens
atggtctggatctcctga

SEQ ID NO: 4183488 - DNA, 19 bp, Homo sapiens
atggtctggatctcctgac

SEQ ID NO: 4183489 - DNA, 20 bp, Homo sapiens
atggtgcagttgacagcagg

SEQ ID NO: 4183490 - DNA, 20 bp, Homo sapiens
atggtgctcacgactcttcc

SEQ ID NO: 4183491 - DNA, 14 bp, Homo sapiens
atggtgctgacctc

SEQ ID NO: 4183492 - DNA, 22 bp, Homo sapiens
atggtggtaaacattctctcag

SEQ ID NO: 4183493 - DNA, 13 bp, Homo sapiens
atggttctgtgac

SEQ ID NO: 4183494 - DNA, 17 bp, Homo sapiens
atggttttacagtgaat

SEQ ID NO: 4183495 - DNA, 14 bp, Homo sapiens
atggttttctccaa

SEQ ID NO: 4183496 - DNA, 21 bp, Homo sapiens
atggttttctccaagagctac

SEQ ID NO: 4183497 - DNA, 15 bp, Homo sapiens
atgtaaaacatttat

SEQ ID NO: 4183498 - DNA, 21 bp, Homo sapiens
atgtaaaacatttattttgac

SEQ ID NO: 4183499 - DNA, 15 bp, Homo sapiens
atgtaaaataagtat

SEQ ID NO: 4183500 - DNA, 13 bp, Homo sapiens
atgtaaagccatg

SEQ ID NO: 4183501 - DNA, 14 bp, Homo sapiens
atgtaaagccatgc

SEQ ID NO: 4183502 - DNA, 18 bp, Homo sapiens
atgtaaagtatgtaaaca

SEQ ID NO: 4183503 - DNA, 19 bp, Homo sapiens
atgtaaatattttaaagaa

SEQ ID NO: 4183504 - DNA, 20 bp, Homo sapiens
atgtaaatattttaaagaat

SEQ ID NO: 4183505 - DNA, 17 bp, Homo sapiens
atgtaacccaaatgtcc

SEQ ID NO: 4183506 - DNA, 13 bp, Homo sapiens
atgtaataataat

SEQ ID NO: 4183507 - DNA, 19 bp, Homo sapiens
atgtactataatgtgatga

SEQ ID NO: 4183508 - DNA, 15 bp, Homo sapiens
atgtagcagaataat

SEQ ID NO: 4183509 - DNA, 21 bp, Homo sapiens
atgtatatactatacaacaat

SEQ ID NO: 4183510 - DNA, 17 bp, Homo sapiens
atgtatcccattggcta

SEQ ID NO: 4183511 - DNA, 14 bp, Homo sapiens
atgtatttatattt

SEQ ID NO: 4183512 - DNA, 12 bp, Homo sapiens
atgtcaaaatca

SEQ ID NO: 4183513 - DNA, 16 bp, Homo sapiens
atgtcaagtaccaaaa

SEQ ID NO: 4183514 - DNA, 21 bp, Homo sapiens
atgtcagagccaggctctgcc

SEQ ID NO: 4183515 - DNA, 19 bp, Homo sapiens
atgtcagttcataatatat

SEQ ID NO: 4183516 - DNA, 11 bp, Homo sapiens
atgtctaaaga

SEQ ID NO: 4183517 - DNA, 18 bp, Homo sapiens
atgtctgtcctcagagca

SEQ ID NO: 4183518 - DNA, 14 bp, Homo sapiens
atgtctgtggattt

SEQ ID NO: 4183519 - DNA, 22 bp, Homo sapiens
atgtgaaccattaaccagatct

SEQ ID NO: 4183520 - DNA, 15 bp, Homo sapiens
atgtgccaaggtggg

SEQ ID NO: 4183521 - DNA, 22 bp, Homo sapiens
atgtgtctgggagagcctggca

SEQ ID NO: 4183522 - DNA, 23 bp, Homo sapiens
atgtgtctgggagagcctggcaa

SEQ ID NO: 4183523 - DNA, 14 bp, Homo sapiens
atgtgtgctgtgct

SEQ ID NO: 4183524 - DNA, 19 bp, Homo sapiens
atgtgtgtggtgtgtgtgc

SEQ ID NO: 4183525 - DNA, 16 bp, Homo sapiens
atgtgtttgctttctg

SEQ ID NO: 4183526 - DNA, 22 bp, Homo sapiens
atgttaactattattaataaat

SEQ ID NO: 4183527 - DNA, 22 bp, Homo sapiens
atgttaagcaaaggaaaccaaa

SEQ ID NO: 4183528 - DNA, 17 bp, Homo sapiens
atgttacatcacagtgt

SEQ ID NO: 4183529 - DNA, 16 bp, Homo sapiens
atgttactgtgtgaag

SEQ ID NO: 4183530 - DNA, 17 bp, Homo sapiens
atgttatacatcctatt

SEQ ID NO: 4183531 - DNA, 17 bp, Homo sapiens
atgttatatattttttg

SEQ ID NO: 4183532 - DNA, 20 bp, Homo sapiens
atgttatttgttattttcag

SEQ ID NO: 4183533 - DNA, 22 bp, Homo sapiens
atgttatttgttattttcagta

SEQ ID NO: 4183534 - DNA, 14 bp, Homo sapiens
atgttctcagaatc

SEQ ID NO: 4183535 - DNA, 17 bp, Homo sapiens
atgttctcagaatcagg

SEQ ID NO: 4183536 - DNA, 22 bp, Homo sapiens
atgttgaaatatgatgttaaaa

SEQ ID NO: 4183537 - DNA, 22 bp, Homo sapiens
atgttggatgatgaaacattca

SEQ ID NO: 4183538 - DNA, 18 bp, Homo sapiens
atgttgtcttataaacaa

SEQ ID NO: 4183539 - DNA, 14 bp, Homo sapiens
atgtttaaaacatc

SEQ ID NO: 4183540 - DNA, 21 bp, Homo sapiens
atgtttattaagaatcattgt

SEQ ID NO: 4183541 - DNA, 21 bp, Homo sapiens
atgtttatttattctgcattt

SEQ ID NO: 4183542 - DNA, 13 bp, Homo sapiens
atgtttccaacct

SEQ ID NO: 4183543 - DNA, 23 bp, Homo sapiens
atgtttgggcagaagggagaagg

SEQ ID NO: 4183544 - DNA, 13 bp, Homo sapiens
atgtttttaatgt

SEQ ID NO: 4183545 - DNA, 14 bp, Homo sapiens
atgtttttaatgta

SEQ ID NO: 4183546 - DNA, 16 bp, Homo sapiens
atgtttttaatgtata

SEQ ID NO: 4183547 - DNA, 13 bp, Homo sapiens
attaaaaaccact

SEQ ID NO: 4183548 - DNA, 20 bp, Homo sapiens
attaaaaaccactgaacatt

SEQ ID NO: 4183549 - DNA, 22 bp, Homo sapiens
attaaaaatgaaattatttata

SEQ ID NO: 4183550 - DNA, 22 bp, Homo sapiens
attaaaatgtaggaagaaaaat

SEQ ID NO: 4183551 - DNA, 12 bp, Homo sapiens
attaaacctgga

SEQ ID NO: 4183552 - DNA, 14 bp, Homo sapiens
attaaagatgtgtt

SEQ ID NO: 4183553 - DNA, 12 bp, Homo sapiens
attaaaggaagg

SEQ ID NO: 4183554 - DNA, 17 bp, Homo sapiens
attaaattggaattttc

SEQ ID NO: 4183555 - DNA, 14 bp, Homo sapiens
attaagagtgaatg

SEQ ID NO: 4183556 - DNA, 17 bp, Homo sapiens
attaagagtgaatgtgt

SEQ ID NO: 4183557 - DNA, 21 bp, Homo sapiens
attaagtggggtagactgagg

SEQ ID NO: 4183558 - DNA, 13 bp, Homo sapiens
attaagttcttta

SEQ ID NO: 4183559 - DNA, 19 bp, Homo sapiens
attaatagcttttattgta

SEQ ID NO: 4183560 - DNA, 23 bp, Homo sapiens
attaatagcttttattgtataaa

SEQ ID NO: 4183561 - DNA, 16 bp, Homo sapiens
attaatcgtgtcttca

SEQ ID NO: 4183562 - DNA, 20 bp, Homo sapiens
attaatgcttagaattctga

SEQ ID NO: 4183563 - DNA, 21 bp, Homo sapiens
attaatgtgtgtctgaagact

SEQ ID NO: 4183564 - DNA, 22 bp, Homo sapiens
attacaacctggaaaataaatc

SEQ ID NO: 4183565 - DNA, 19 bp, Homo sapiens
attacacttggtaattgta

SEQ ID NO: 4183566 - DNA, 15 bp, Homo sapiens
attaccatggagaca

SEQ ID NO: 4183567 - DNA, 12 bp, Homo sapiens
attacctgccaa

SEQ ID NO: 4183568 - DNA, 20 bp, Homo sapiens
attacctgccaattgctacc

SEQ ID NO: 4183569 - DNA, 16 bp, Homo sapiens
attacgtgagccaggt

SEQ ID NO: 4183570 - DNA, 22 bp, Homo sapiens
attactctgcggtggtgccaga

SEQ ID NO: 4183571 - DNA, 21 bp, Homo sapiens
attagaagacaattgacaaca

SEQ ID NO: 4183572 - DNA, 13 bp, Homo sapiens
attagaagtgttt

SEQ ID NO: 4183573 - DNA, 12 bp, Homo sapiens
attagaatgccg

SEQ ID NO: 4183574 - DNA, 15 bp, Homo sapiens
attagaggtttgtca

SEQ ID NO: 4183575 - DNA, 18 bp, Homo sapiens
attagaggtttgtcaaca

SEQ ID NO: 4183576 - DNA, 21 bp, Homo sapiens
attagatgttactgtgtgaag

SEQ ID NO: 4183577 - DNA, 14 bp, Homo sapiens
attaggcagactct

SEQ ID NO: 4183578 - DNA, 15 bp, Homo sapiens
attagtaattgtaag

SEQ ID NO: 4183579 - DNA, 12 bp, Homo sapiens
attataaaacca

SEQ ID NO: 4183580 - DNA, 16 bp, Homo sapiens
attataataaaggtca

SEQ ID NO: 4183581 - DNA, 16 bp, Homo sapiens
attatacataataaag

SEQ ID NO: 4183582 - DNA, 22 bp, Homo sapiens
attattaacttgtattttctta

SEQ ID NO: 4183583 - DNA, 13 bp, Homo sapiens
attattaataaat

SEQ ID NO: 4183584 - DNA, 21 bp, Homo sapiens
attattactgtttttgctatt

SEQ ID NO: 4183585 - DNA, 23 bp, Homo sapiens
attatttaaaaccattatttaat

SEQ ID NO: 4183586 - DNA, 22 bp, Homo sapiens
attatttaaaccgctaaaagaa

SEQ ID NO: 4183587 - DNA, 20 bp, Homo sapiens
attatttgtgtaatagaaaa

SEQ ID NO: 4183588 - DNA, 22 bp, Homo sapiens
attatttgttatttgtacagtt

SEQ ID NO: 4183589 - DNA, 14 bp, Homo sapiens
attattttaaacaa

SEQ ID NO: 4183590 - DNA, 14 bp, Homo sapiens
attcaaatgtcagt

SEQ ID NO: 4183591 - DNA, 19 bp, Homo sapiens
attcaaatgtcagttcata

SEQ ID NO: 4183592 - DNA, 21 bp, Homo sapiens
attcaaatgtcagttcataat

SEQ ID NO: 4183593 - DNA, 12 bp, Homo sapiens
attcaagtatta

SEQ ID NO: 4183594 - DNA, 16 bp, Homo sapiens
attcaagttattgtac

SEQ ID NO: 4183595 - DNA, 12 bp, Homo sapiens
attcaataaagc

SEQ ID NO: 4183596 - DNA, 13 bp, Homo sapiens
attcaataaagct

SEQ ID NO: 4183597 - DNA, 14 bp, Homo sapiens
attcacagcccaga

SEQ ID NO: 4183598 - DNA, 12 bp, Homo sapiens
attcactcccac

SEQ ID NO: 4183599 - DNA, 13 bp, Homo sapiens
attcactcccaca

SEQ ID NO: 4183600 - DNA, 21 bp, Homo sapiens
attcactcccacacccaagaa

SEQ ID NO: 4183601 - DNA, 16 bp, Homo sapiens
attcagaagaaaaaga

SEQ ID NO: 4183602 - DNA, 13 bp, Homo sapiens
attcagacagatg

SEQ ID NO: 4183603 - DNA, 17 bp, Homo sapiens
attcagcctggccatcc

SEQ ID NO: 4183604 - DNA, 13 bp, Homo sapiens
attcataaggaaa

SEQ ID NO: 4183605 - DNA, 18 bp, Homo sapiens
attcatctcatgctctct

SEQ ID NO: 4183606 - DNA, 13 bp, Homo sapiens
attcatgactatg

SEQ ID NO: 4183607 - DNA, 15 bp, Homo sapiens
attcatgctttctcc

SEQ ID NO: 4183608 - DNA, 16 bp, Homo sapiens
attcatgctttctcct

SEQ ID NO: 4183609 - DNA, 15 bp, Homo sapiens
attccaacagtgagt

SEQ ID NO: 4183610 - DNA, 13 bp, Homo sapiens
attccatgtccct

SEQ ID NO: 4183611 - DNA, 15 bp, Homo sapiens
attcccaactgctct

SEQ ID NO: 4183612 - DNA, 16 bp, Homo sapiens
attcccaactgctctg

SEQ ID NO: 4183613 - DNA, 22 bp, Homo sapiens
attcccaagctctagtgggaag

SEQ ID NO: 4183614 - DNA, 18 bp, Homo sapiens
attccccatctcaggcca

SEQ ID NO: 4183615 - DNA, 19 bp, Homo sapiens
attcctaggtcacttgaag

SEQ ID NO: 4183616 - DNA, 18 bp, Homo sapiens
attcctcatcaccatcgt

SEQ ID NO: 4183617 - DNA, 17 bp, Homo sapiens
attcctcccccagagcc

SEQ ID NO: 4183618 - DNA, 21 bp, Homo sapiens
attcctgggcaagaacctaaa

SEQ ID NO: 4183619 - DNA, 22 bp, Homo sapiens
attccttaccccagctgcggca

SEQ ID NO: 4183620 - DNA, 16 bp, Homo sapiens
attctacataatggaa

SEQ ID NO: 4183621 - DNA, 16 bp, Homo sapiens
attctagccaaactat

SEQ ID NO: 4183622 - DNA, 18 bp, Homo sapiens
attctataagctatttat

SEQ ID NO: 4183623 - DNA, 17 bp, Homo sapiens
attctatatgatcctga

SEQ ID NO: 4183624 - DNA, 21 bp, Homo sapiens
attctatggccattactaaca

SEQ ID NO: 4183625 - DNA, 14 bp, Homo sapiens
attctcaccaggaa

SEQ ID NO: 4183626 - DNA, 21 bp, Homo sapiens
attctccagtttcagaagcag

SEQ ID NO: 4183627 - DNA, 19 bp, Homo sapiens
attctgaaaatagcaggac

SEQ ID NO: 4183628 - DNA, 17 bp, Homo sapiens
attctgaagccattgtc

SEQ ID NO: 4183629 - DNA, 12 bp, Homo sapiens
attctgatacat

SEQ ID NO: 4183630 - DNA, 13 bp, Homo sapiens
attctgcatgccc

SEQ ID NO: 4183631 - DNA, 22 bp, Homo sapiens
attcttcatcagcatttaataa

SEQ ID NO: 4183632 - DNA, 21 bp, Homo sapiens
attcttccagtgcaacaaaat

SEQ ID NO: 4183633 - DNA, 14 bp, Homo sapiens
attcttctgcctca

SEQ ID NO: 4183634 - DNA, 15 bp, Homo sapiens
attctttgccacctt

SEQ ID NO: 4183635 - DNA, 15 bp, Homo sapiens
attgaaaaaaatata

SEQ ID NO: 4183636 - DNA, 15 bp, Homo sapiens
attgaaagtaaaaaa

SEQ ID NO: 4183637 - DNA, 16 bp, Homo sapiens
attgaaagtaaaaaat

SEQ ID NO: 4183638 - DNA, 16 bp, Homo sapiens
attgaatgtttccaac

SEQ ID NO: 4183639 - DNA, 18 bp, Homo sapiens
attgacctataaaacaaa

SEQ ID NO: 4183640 - DNA, 22 bp, Homo sapiens
attgactcaaatctccagtatt

SEQ ID NO: 4183641 - DNA, 17 bp, Homo sapiens
attgacttctcttgaat

SEQ ID NO: 4183642 - DNA, 20 bp, Homo sapiens
attgagaagttttgtacaga

SEQ ID NO: 4183643 - DNA, 17 bp, Homo sapiens
attgcaggtgcctggct

SEQ ID NO: 4183644 - DNA, 18 bp, Homo sapiens
attgcaggtgcctggctt

SEQ ID NO: 4183645 - DNA, 19 bp, Homo sapiens
attgcaggtgcctggcttg

SEQ ID NO: 4183646 - DNA, 14 bp, Homo sapiens
attgcctgcagaga

SEQ ID NO: 4183647 - DNA, 16 bp, Homo sapiens
attgccttcctcgtgc

SEQ ID NO: 4183648 - DNA, 22 bp, Homo sapiens
attgccttcctcgtgcagagct

SEQ ID NO: 4183649 - DNA, 12 bp, Homo sapiens
attgctttgcca

SEQ ID NO: 4183650 - DNA, 20 bp, Homo sapiens
attgctttgccaaaatacca

SEQ ID NO: 4183651 - DNA, 20 bp, Homo sapiens
attggagctgactgttcttg

SEQ ID NO: 4183652 - DNA, 22 bp, Homo sapiens
attggagctgactgttcttggt

SEQ ID NO: 4183653 - DNA, 16 bp, Homo sapiens
attggctactatggca

SEQ ID NO: 4183654 - DNA, 21 bp, Homo sapiens
attggctcacccaagcaaggc

SEQ ID NO: 4183655 - DNA, 22 bp, Homo sapiens
attggctcctccatctagagat

SEQ ID NO: 4183656 - DNA, 17 bp, Homo sapiens
attgggaagctggggga

SEQ ID NO: 4183657 - DNA, 13 bp, Homo sapiens
attggggaagaaa

SEQ ID NO: 4183658 - DNA, 22 bp, Homo sapiens
attggtgggaagcaagcagggg

SEQ ID NO: 4183659 - DNA, 22 bp, Homo sapiens
attggttctcctaaaacatgaa

SEQ ID NO: 4183660 - DNA, 19 bp, Homo sapiens
attgtacactaacatattt

SEQ ID NO: 4183661 - DNA, 15 bp, Homo sapiens
attgtacactatcta

SEQ ID NO: 4183662 - DNA, 16 bp, Homo sapiens
attgtaccagaactat

SEQ ID NO: 4183663 - DNA, 16 bp, Homo sapiens
attgtactccagcctg

SEQ ID NO: 4183664 - DNA, 17 bp, Homo sapiens
attgtagatggaaatca

SEQ ID NO: 4183665 - DNA, 13 bp, Homo sapiens
attgtagtaatct

SEQ ID NO: 4183666 - DNA, 14 bp, Homo sapiens
attgtataatgtga

SEQ ID NO: 4183667 - DNA, 19 bp, Homo sapiens
attgtataatgtgattttt

SEQ ID NO: 4183668 - DNA, 11 bp, Homo sapiens
attgtccatgt

SEQ ID NO: 4183669 - DNA, 15 bp, Homo sapiens
attgtgcaatgtaaa

SEQ ID NO: 4183670 - DNA, 18 bp, Homo sapiens
attgtgcaatgtaaatat

SEQ ID NO: 4183671 - DNA, 14 bp, Homo sapiens
attgtgcttaataa

SEQ ID NO: 4183672 - DNA, 17 bp, Homo sapiens
attgtgtcagactgttt

SEQ ID NO: 4183673 - DNA, 12 bp, Homo sapiens
attgtgtgttag

SEQ ID NO: 4183674 - DNA, 13 bp, Homo sapiens
attgttttatcat

SEQ ID NO: 4183675 - DNA, 16 bp, Homo sapiens
atttaaaaagctcttt

SEQ ID NO: 4183676 - DNA, 21 bp, Homo sapiens
atttaaaatgtgtttcttaca

SEQ ID NO: 4183677 - DNA, 19 bp, Homo sapiens
atttaaaccgctaaaagaa

SEQ ID NO: 4183678 - DNA, 22 bp, Homo sapiens
atttaaaccgctaaaagaaact

SEQ ID NO: 4183679 - DNA, 23 bp, Homo sapiens
atttaaaccgctaaaagaaactt

SEQ ID NO: 4183680 - DNA, 13 bp, Homo sapiens
atttaactctctt

SEQ ID NO: 4183681 - DNA, 20 bp, Homo sapiens
atttaacttgagggtaataa

SEQ ID NO: 4183682 - DNA, 23 bp, Homo sapiens
atttaaggtgtgcaattttctat

SEQ ID NO: 4183683 - DNA, 12 bp, Homo sapiens
atttaataagag

SEQ ID NO: 4183684 - DNA, 17 bp, Homo sapiens
atttaatccagatctgg

SEQ ID NO: 4183685 - DNA, 19 bp, Homo sapiens
atttaatggccaaatggtt

SEQ ID NO: 4183686 - DNA, 15 bp, Homo sapiens
atttaatttatgtga

SEQ ID NO: 4183687 - DNA, 23 bp, Homo sapiens
atttaatttatgtgaaagagttc

SEQ ID NO: 4183688 - DNA, 13 bp, Homo sapiens
atttaatttctat

SEQ ID NO: 4183689 - DNA, 22 bp, Homo sapiens
atttaattttcctggaaagact

SEQ ID NO: 4183690 - DNA, 15 bp, Homo sapiens
atttaccacagcagc

SEQ ID NO: 4183691 - DNA, 17 bp, Homo sapiens
atttaccacagcagctg

SEQ ID NO: 4183692 - DNA, 15 bp, Homo sapiens
atttaccctggtgga

SEQ ID NO: 4183693 - DNA, 21 bp, Homo sapiens
atttactaagccacaagaaat

SEQ ID NO: 4183694 - DNA, 15 bp, Homo sapiens
atttactacttttgc

SEQ ID NO: 4183695 - DNA, 15 bp, Homo sapiens
atttacttgaaagat

SEQ ID NO: 4183696 - DNA, 17 bp, Homo sapiens
atttaggcaagagaaaa

SEQ ID NO: 4183697 - DNA, 14 bp, Homo sapiens
atttagggaagcag

SEQ ID NO: 4183698 - DNA, 17 bp, Homo sapiens
atttagggaagcaggga

SEQ ID NO: 4183699 - DNA, 15 bp, Homo sapiens
atttagtgaactacg

SEQ ID NO: 4183700 - DNA, 20 bp, Homo sapiens
atttagtgatattgtgggta

SEQ ID NO: 4183701 - DNA, 13 bp, Homo sapiens
atttagttatagt

SEQ ID NO: 4183702 - DNA, 22 bp, Homo sapiens
atttatactggtaacttattta

SEQ ID NO: 4183703 - DNA, 13 bp, Homo sapiens
atttatatatttg

SEQ ID NO: 4183704 - DNA, 20 bp, Homo sapiens
atttatatcttatatataat

SEQ ID NO: 4183705 - DNA, 14 bp, Homo sapiens
atttatatgttaat

SEQ ID NO: 4183706 - DNA, 17 bp, Homo sapiens
atttatatttgaaattt

SEQ ID NO: 4183707 - DNA, 12 bp, Homo sapiens
atttatatttgg

SEQ ID NO: 4183708 - DNA, 18 bp, Homo sapiens
atttatcaaacttgtgct

SEQ ID NO: 4183709 - DNA, 16 bp, Homo sapiens
atttatgataactatt

SEQ ID NO: 4183710 - DNA, 19 bp, Homo sapiens
atttattaaaatgattgta

SEQ ID NO: 4183711 - DNA, 23 bp, Homo sapiens
atttattaaaatgattgtaaaat

SEQ ID NO: 4183712 - DNA, 14 bp, Homo sapiens
atttattgtctgtc

SEQ ID NO: 4183713 - DNA, 14 bp, Homo sapiens
atttatttaaaata

SEQ ID NO: 4183714 - DNA, 16 bp, Homo sapiens
atttatttaaaatagc

SEQ ID NO: 4183715 - DNA, 15 bp, Homo sapiens
atttattttattcta

SEQ ID NO: 4183716 - DNA, 18 bp, Homo sapiens
atttattttattctatgt

SEQ ID NO: 4183717 - DNA, 19 bp, Homo sapiens
atttattttattctatgta

SEQ ID NO: 4183718 - DNA, 21 bp, Homo sapiens
atttattttattctatgtatg

SEQ ID NO: 4183719 - DNA, 14 bp, Homo sapiens
atttattttgacat

SEQ ID NO: 4183720 - DNA, 21 bp, Homo sapiens
atttattttgacataaagttg

SEQ ID NO: 4183721 - DNA, 15 bp, Homo sapiens
atttattttgtttaa

SEQ ID NO: 4183722 - DNA, 12 bp, Homo sapiens
atttcaaaataa

SEQ ID NO: 4183723 - DNA, 11 bp, Homo sapiens
atttcaaatgg

SEQ ID NO: 4183724 - DNA, 16 bp, Homo sapiens
atttcaagtgcctaga

SEQ ID NO: 4183725 - DNA, 23 bp, Homo sapiens
atttcaagtgcctagactgttac

SEQ ID NO: 4183726 - DNA, 14 bp, Homo sapiens
atttcaattctcaa

SEQ ID NO: 4183727 - DNA, 18 bp, Homo sapiens
atttccaaataaaatgag

SEQ ID NO: 4183728 - DNA, 14 bp, Homo sapiens
atttccgggtggaa

SEQ ID NO: 4183729 - DNA, 13 bp, Homo sapiens
atttcctggccct

SEQ ID NO: 4183730 - DNA, 16 bp, Homo sapiens
atttctactgtgactg

SEQ ID NO: 4183731 - DNA, 17 bp, Homo sapiens
atttctactgtgactga

SEQ ID NO: 4183732 - DNA, 20 bp, Homo sapiens
atttctagtagaaagaaaat

SEQ ID NO: 4183733 - DNA, 23 bp, Homo sapiens
atttctattcaaggtggccaaat

SEQ ID NO: 4183734 - DNA, 21 bp, Homo sapiens
atttctccaggtttgctgtgt

SEQ ID NO: 4183735 - DNA, 13 bp, Homo sapiens
atttctcctactt

SEQ ID NO: 4183736 - DNA, 17 bp, Homo sapiens
atttctcctactttaca

SEQ ID NO: 4183737 - DNA, 13 bp, Homo sapiens
atttctgatttca

SEQ ID NO: 4183738 - DNA, 21 bp, Homo sapiens
atttctgcagatcttccgtgg

SEQ ID NO: 4183739 - DNA, 18 bp, Homo sapiens
atttcttttttttaataa

SEQ ID NO: 4183740 - DNA, 20 bp, Homo sapiens
atttcttttttttaataagg

SEQ ID NO: 4183741 - DNA, 14 bp, Homo sapiens
atttgaaagaaagt

SEQ ID NO: 4183742 - DNA, 20 bp, Homo sapiens
atttgcaaaatggaaatgta

SEQ ID NO: 4183743 - DNA, 21 bp, Homo sapiens
atttgcaaaatggaaatgtaa

SEQ ID NO: 4183744 - DNA, 18 bp, Homo sapiens
atttgcctaattcctggc

SEQ ID NO: 4183745 - DNA, 16 bp, Homo sapiens
atttgccttctccctg

SEQ ID NO: 4183746 - DNA, 16 bp, Homo sapiens
atttggaagagaggca

SEQ ID NO: 4183747 - DNA, 22 bp, Homo sapiens
atttgtaatagatgtttgatag

SEQ ID NO: 4183748 - DNA, 18 bp, Homo sapiens
atttgtacagttcagttc

SEQ ID NO: 4183749 - DNA, 11 bp, Homo sapiens
atttgtatttt

SEQ ID NO: 4183750 - DNA, 19 bp, Homo sapiens
atttgtcatttaccctggt

SEQ ID NO: 4183751 - DNA, 15 bp, Homo sapiens
atttgtccaattctc

SEQ ID NO: 4183752 - DNA, 21 bp, Homo sapiens
atttgtgtaatagaaaactga

SEQ ID NO: 4183753 - DNA, 23 bp, Homo sapiens
atttgttaatttagaaaacttta

SEQ ID NO: 4183754 - DNA, 18 bp, Homo sapiens
atttgttatttgtacagt

SEQ ID NO: 4183755 - DNA, 16 bp, Homo sapiens
atttgttcacatgcat

SEQ ID NO: 4183756 - DNA, 13 bp, Homo sapiens
attttaaagaatt

SEQ ID NO: 4183757 - DNA, 14 bp, Homo sapiens
attttaaatgtttt

SEQ ID NO: 4183758 - DNA, 13 bp, Homo sapiens
attttaacatttt

SEQ ID NO: 4183759 - DNA, 17 bp, Homo sapiens
attttaacttaaatttt

SEQ ID NO: 4183760 - DNA, 15 bp, Homo sapiens
attttaagcattctt

SEQ ID NO: 4183761 - DNA, 14 bp, Homo sapiens
attttaagcttgaa

SEQ ID NO: 4183762 - DNA, 21 bp, Homo sapiens
attttacatatggaaatatag

SEQ ID NO: 4183763 - DNA, 22 bp, Homo sapiens
attttactgattaacaaataaa

SEQ ID NO: 4183764 - DNA, 20 bp, Homo sapiens
attttacttccatgatactt

SEQ ID NO: 4183765 - DNA, 19 bp, Homo sapiens
attttagacactgggagaa

SEQ ID NO: 4183766 - DNA, 21 bp, Homo sapiens
attttagacactgggagaaga

SEQ ID NO: 4183767 - DNA, 24 bp, Homo sapiens
attttagacactgggagaagagaa

SEQ ID NO: 4183768 - DNA, 17 bp, Homo sapiens
attttaggcagggattt

SEQ ID NO: 4183769 - DNA, 15 bp, Homo sapiens
attttatattacact

SEQ ID NO: 4183770 - DNA, 18 bp, Homo sapiens
attttatattacactaca

SEQ ID NO: 4183771 - DNA, 14 bp, Homo sapiens
attttatggtgcat

SEQ ID NO: 4183772 - DNA, 19 bp, Homo sapiens
attttattactgtaataca

SEQ ID NO: 4183773 - DNA, 21 bp, Homo sapiens
attttcaggatttttggtata

SEQ ID NO: 4183774 - DNA, 14 bp, Homo sapiens
attttcagtatttt

SEQ ID NO: 4183775 - DNA, 19 bp, Homo sapiens
attttcatgacttttccat

SEQ ID NO: 4183776 - DNA, 16 bp, Homo sapiens
attttcattttaattt

SEQ ID NO: 4183777 - DNA, 16 bp, Homo sapiens
attttctagactttct

SEQ ID NO: 4183778 - DNA, 19 bp, Homo sapiens
attttcttatcttctgcaa

SEQ ID NO: 4183779 - DNA, 17 bp, Homo sapiens
attttgacataaagttg

SEQ ID NO: 4183780 - DNA, 13 bp, Homo sapiens
attttgagtgact

SEQ ID NO: 4183781 - DNA, 14 bp, Homo sapiens
attttgagtgactc

SEQ ID NO: 4183782 - DNA, 21 bp, Homo sapiens
attttgcaatcccttaatatc

SEQ ID NO: 4183783 - DNA, 14 bp, Homo sapiens
attttgtatatatc

SEQ ID NO: 4183784 - DNA, 14 bp, Homo sapiens
atttttacaataat

SEQ ID NO: 4183785 - DNA, 23 bp, Homo sapiens
atttttagctctgttctttataa

SEQ ID NO: 4183786 - DNA, 16 bp, Homo sapiens
atttttagtaaagaca

SEQ ID NO: 4183787 - DNA, 16 bp, Homo sapiens
atttttataaatatgt

SEQ ID NO: 4183788 - DNA, 20 bp, Homo sapiens
atttttataaatatgtgaaa

SEQ ID NO: 4183789 - DNA, 16 bp, Homo sapiens
atttttatattctata

SEQ ID NO: 4183790 - DNA, 15 bp, Homo sapiens
atttttatatttagt

SEQ ID NO: 4183791 - DNA, 18 bp, Homo sapiens
atttttcatgataatgaa

SEQ ID NO: 4183792 - DNA, 15 bp, Homo sapiens
atttttgctatttct

SEQ ID NO: 4183793 - DNA, 16 bp, Homo sapiens
atttttggtgtatttg

SEQ ID NO: 4183794 - DNA, 18 bp, Homo sapiens
atttttgtaataaaaggt

SEQ ID NO: 4183795 - DNA, 13 bp, Homo sapiens
attttttattgtt

SEQ ID NO: 4183796 - DNA, 23 bp, Homo sapiens
attttttccttcaaagtttaata

SEQ ID NO: 4183797 - DNA, 19 bp, Homo sapiens
attttttgatgtcagcctt

SEQ ID NO: 4183798 - DNA, 22 bp, Homo sapiens
atttttttaagttagagaatat

SEQ ID NO: 4183799 - DNA, 19 bp, Homo sapiens
atttttttgtaaaggaaat

SEQ ID NO: 4183800 - DNA, 14 bp, Homo sapiens
caaaaaaaaataca

SEQ ID NO: 4183801 - DNA, 15 bp, Homo sapiens
caaaaaagtattttt

SEQ ID NO: 4183802 - DNA, 12 bp, Homo sapiens
caaaaacaaaac

SEQ ID NO: 4183803 - DNA, 15 bp, Homo sapiens
caaaaagacatggaa

SEQ ID NO: 4183804 - DNA, 13 bp, Homo sapiens
caaaaagatgcct

SEQ ID NO: 4183805 - DNA, 14 bp, Homo sapiens
caaaaatagctaaa

SEQ ID NO: 4183806 - DNA, 18 bp, Homo sapiens
caaaaatgggtaattttc

SEQ ID NO: 4183807 - DNA, 15 bp, Homo sapiens
caaaaattagccggg

SEQ ID NO: 4183808 - DNA, 14 bp, Homo sapiens
caaaacaaaacaac

SEQ ID NO: 4183809 - DNA, 16 bp, Homo sapiens
caaaacaacaacaata

SEQ ID NO: 4183810 - DNA, 17 bp, Homo sapiens
caaaacacttaggaaga

SEQ ID NO: 4183811 - DNA, 19 bp, Homo sapiens
caaaacacttaggaagaaa

SEQ ID NO: 4183812 - DNA, 15 bp, Homo sapiens
caaaagaagtaaaag

SEQ ID NO: 4183813 - DNA, 11 bp, Homo sapiens
caaaagacagc

SEQ ID NO: 4183814 - DNA, 20 bp, Homo sapiens
caaaagacagcactacagat

SEQ ID NO: 4183815 - DNA, 18 bp, Homo sapiens
caaaaggctgagaaggaa

SEQ ID NO: 4183816 - DNA, 17 bp, Homo sapiens
caaaagttagctgagcg

SEQ ID NO: 4183817 - DNA, 22 bp, Homo sapiens
caaaatcatgaatatttcaaaa

SEQ ID NO: 4183818 - DNA, 15 bp, Homo sapiens
caaaatgcagtctta

SEQ ID NO: 4183819 - DNA, 12 bp, Homo sapiens
caaaatggaagg

SEQ ID NO: 4183820 - DNA, 17 bp, Homo sapiens
caaaatgttcgtattct

SEQ ID NO: 4183821 - DNA, 18 bp, Homo sapiens
caaaatgttcgtattcta

SEQ ID NO: 4183822 - DNA, 16 bp, Homo sapiens
caaaatgtttattttc

SEQ ID NO: 4183823 - DNA, 21 bp, Homo sapiens
caaaatttctttttttaaatt

SEQ ID NO: 4183824 - DNA, 16 bp, Homo sapiens
caaacacacacaaaag

SEQ ID NO: 4183825 - DNA, 23 bp, Homo sapiens
caaacactccaccccctccagct

SEQ ID NO: 4183826 - DNA, 20 bp, Homo sapiens
caaaccaccctaaaatgaca

SEQ ID NO: 4183827 - DNA, 12 bp, Homo sapiens
caaaccaggatt

SEQ ID NO: 4183828 - DNA, 14 bp, Homo sapiens
caaaccatttcaaa

SEQ ID NO: 4183829 - DNA, 18 bp, Homo sapiens
caaaccccacttcccctc

SEQ ID NO: 4183830 - DNA, 13 bp, Homo sapiens
caaaccctgtggg

SEQ ID NO: 4183831 - DNA, 23 bp, Homo sapiens
caaaccctgtggggcctgatggt

SEQ ID NO: 4183832 - DNA, 22 bp, Homo sapiens
caaacctcagtcatattcttat

SEQ ID NO: 4183833 - DNA, 14 bp, Homo sapiens
caaacctgtaattt

SEQ ID NO: 4183834 - DNA, 14 bp, Homo sapiens
caaactaggaggaa

SEQ ID NO: 4183835 - DNA, 16 bp, Homo sapiens
caaactaggaggaaaa

SEQ ID NO: 4183836 - DNA, 18 bp, Homo sapiens
caaactaggaggaaaaga

SEQ ID NO: 4183837 - DNA, 21 bp, Homo sapiens
caaactaggaggaaaagacag

SEQ ID NO: 4183838 - DNA, 14 bp, Homo sapiens
caaactgtaataca

SEQ ID NO: 4183839 - DNA, 18 bp, Homo sapiens
caaactgtgccctgcctt

SEQ ID NO: 4183840 - DNA, 14 bp, Homo sapiens
caaagaaaacatag

SEQ ID NO: 4183841 - DNA, 18 bp, Homo sapiens
caaagaaccttctctatg

SEQ ID NO: 4183842 - DNA, 18 bp, Homo sapiens
caaagaaggaaatatcat

SEQ ID NO: 4183843 - DNA, 13 bp, Homo sapiens
caaagagcctgga

SEQ ID NO: 4183844 - DNA, 16 bp, Homo sapiens
caaagagcctggagaa

SEQ ID NO: 4183845 - DNA, 23 bp, Homo sapiens
caaagagggagttggctggatct

SEQ ID NO: 4183846 - DNA, 15 bp, Homo sapiens
caaagagttcaagaa

SEQ ID NO: 4183847 - DNA, 21 bp, Homo sapiens
caaagagttcaagaaataagt

SEQ ID NO: 4183848 - DNA, 14 bp, Homo sapiens
caaagattgagaag

SEQ ID NO: 4183849 - DNA, 16 bp, Homo sapiens
caaagcacctgaacca

SEQ ID NO: 4183850 - DNA, 19 bp, Homo sapiens
caaagcacctgaaccactg

SEQ ID NO: 4183851 - DNA, 23 bp, Homo sapiens
caaagcacctgaaccactgtggc

SEQ ID NO: 4183852 - DNA, 18 bp, Homo sapiens
caaagccaaactctgcca

SEQ ID NO: 4183853 - DNA, 23 bp, Homo sapiens
caaagccccttgctctcccctgc

SEQ ID NO: 4183854 - DNA, 17 bp, Homo sapiens
caaagccgtgcctttct

SEQ ID NO: 4183855 - DNA, 15 bp, Homo sapiens
caaagcctccttttt

SEQ ID NO: 4183856 - DNA, 16 bp, Homo sapiens
caaagcggttgcttct

SEQ ID NO: 4183857 - DNA, 22 bp, Homo sapiens
caaaggaaaactcttggcctct

SEQ ID NO: 4183858 - DNA, 14 bp, Homo sapiens
caaaggtggctctc

SEQ ID NO: 4183859 - DNA, 20 bp, Homo sapiens
caaagtctaaagtttacagt

SEQ ID NO: 4183860 - DNA, 23 bp, Homo sapiens
caaagtggggggtggacacagaa

SEQ ID NO: 4183861 - DNA, 16 bp, Homo sapiens
caaagtttaacacaat

SEQ ID NO: 4183862 - DNA, 23 bp, Homo sapiens
caaatattaccaaaaaagtattt

SEQ ID NO: 4183863 - DNA, 14 bp, Homo sapiens
caaatcaccacaaa

SEQ ID NO: 4183864 - DNA, 13 bp, Homo sapiens
caaatccactgac

SEQ ID NO: 4183865 - DNA, 16 bp, Homo sapiens
caaatccttgagcact

SEQ ID NO: 4183866 - DNA, 18 bp, Homo sapiens
caaatgcatggtgcagtt

SEQ ID NO: 4183867 - DNA, 22 bp, Homo sapiens
caaatggcagcagttccatgaa

SEQ ID NO: 4183868 - DNA, 22 bp, Homo sapiens
caaatggggtccaggtcaccag

SEQ ID NO: 4183869 - DNA, 12 bp, Homo sapiens
caaattatttgt

SEQ ID NO: 4183870 - DNA, 14 bp, Homo sapiens
caaattatttgtgt

SEQ ID NO: 4183871 - DNA, 15 bp, Homo sapiens
caaattatttgtgta

SEQ ID NO: 4183872 - DNA, 16 bp, Homo sapiens
caaattatttgtgtaa

SEQ ID NO: 4183873 - DNA, 17 bp, Homo sapiens
caaattatttgtgtaat

SEQ ID NO: 4183874 - DNA, 17 bp, Homo sapiens
caaattggacagaagat

SEQ ID NO: 4183875 - DNA, 19 bp, Homo sapiens
caaatttgaaaataattgt

SEQ ID NO: 4183876 - DNA, 21 bp, Homo sapiens
caaatttgcaaaactgtgctt

SEQ ID NO: 4183877 - DNA, 15 bp, Homo sapiens
caaatttttcctgca

SEQ ID NO: 4183878 - DNA, 9 bp, Homo sapiens
caacaaaaa

SEQ ID NO: 4183879 - DNA, 17 bp, Homo sapiens
caacaaaaagacatgga

SEQ ID NO: 4183880 - DNA, 19 bp, Homo sapiens
caacaaaaagacatggaag

SEQ ID NO: 4183881 - DNA, 19 bp, Homo sapiens
caacaaagattgagaagcc

SEQ ID NO: 4183882 - DNA, 13 bp, Homo sapiens
caacaacaacaat

SEQ ID NO: 4183883 - DNA, 14 bp, Homo sapiens
caacaacaacaata

SEQ ID NO: 4183884 - DNA, 15 bp, Homo sapiens
caacaacaacaataa

SEQ ID NO: 4183885 - DNA, 12 bp, Homo sapiens
caacaacaataa

SEQ ID NO: 4183886 - DNA, 16 bp, Homo sapiens
caacaacaataacaac

SEQ ID NO: 4183887 - DNA, 15 bp, Homo sapiens
caacaacaatacaac

SEQ ID NO: 4183888 - DNA, 15 bp, Homo sapiens
caacaacaattttaa

SEQ ID NO: 4183889 - DNA, 11 bp, Homo sapiens
caacaagaaca

SEQ ID NO: 4183890 - DNA, 12 bp, Homo sapiens
caacaagaacaa

SEQ ID NO: 4183891 - DNA, 14 bp, Homo sapiens
caacaagaacaaca

SEQ ID NO: 4183892 - DNA, 17 bp, Homo sapiens
caacaagagcaaaatga

SEQ ID NO: 4183893 - DNA, 13 bp, Homo sapiens
caacaagtaactt

SEQ ID NO: 4183894 - DNA, 11 bp, Homo sapiens
caacaataaca

SEQ ID NO: 4183895 - DNA, 16 bp, Homo sapiens
caacaatacaacaaga

SEQ ID NO: 4183896 - DNA, 18 bp, Homo sapiens
caacaatacaacaagaac

SEQ ID NO: 4183897 - DNA, 22 bp, Homo sapiens
caacacaaagacacaggaagaa

SEQ ID NO: 4183898 - DNA, 22 bp, Homo sapiens
caacactcttcttgagcagacc

SEQ ID NO: 4183899 - DNA, 16 bp, Homo sapiens
caacacttttgggagg

SEQ ID NO: 4183900 - DNA, 12 bp, Homo sapiens
caacagaagcag

SEQ ID NO: 4183901 - DNA, 16 bp, Homo sapiens
caacagaagcttcaga

SEQ ID NO: 4183902 - DNA, 14 bp, Homo sapiens
caacagataaagtt

SEQ ID NO: 4183903 - DNA, 15 bp, Homo sapiens
caacagtaacacatc

SEQ ID NO: 4183904 - DNA, 11 bp, Homo sapiens
caacagtgagt

SEQ ID NO: 4183905 - DNA, 12 bp, Homo sapiens
caacagtgagtc

SEQ ID NO: 4183906 - DNA, 13 bp, Homo sapiens
caacagttttcct

SEQ ID NO: 4183907 - DNA, 15 bp, Homo sapiens
caacatgttatttgt

SEQ ID NO: 4183908 - DNA, 13 bp, Homo sapiens
caacccacagcct

SEQ ID NO: 4183909 - DNA, 19 bp, Homo sapiens
caaccctgttttatactgt

SEQ ID NO: 4183910 - DNA, 20 bp, Homo sapiens
caacctcccctggtcctgca

SEQ ID NO: 4183911 - DNA, 14 bp, Homo sapiens
caacctgcctgtgc

SEQ ID NO: 4183912 - DNA, 17 bp, Homo sapiens
caacctggccagaggca

SEQ ID NO: 4183913 - DNA, 18 bp, Homo sapiens
caactaaataaaaaattc

SEQ ID NO: 4183914 - DNA, 15 bp, Homo sapiens
caactacagtctaaa

SEQ ID NO: 4183915 - DNA, 19 bp, Homo sapiens
caactacagtctaaagctg

SEQ ID NO: 4183916 - DNA, 22 bp, Homo sapiens
caactcagtctgtgggagctca

SEQ ID NO: 4183917 - DNA, 22 bp, Homo sapiens
caactccagaagtggggctctg

SEQ ID NO: 4183918 - DNA, 16 bp, Homo sapiens
caactcgtatagcatg

SEQ ID NO: 4183919 - DNA, 15 bp, Homo sapiens
caactgccccgggtg

SEQ ID NO: 4183920 - DNA, 15 bp, Homo sapiens
caactgctctgccca

SEQ ID NO: 4183921 - DNA, 20 bp, Homo sapiens
caactgctctgcccactgtg

SEQ ID NO: 4183922 - DNA, 16 bp, Homo sapiens
caactgtgttcattag

SEQ ID NO: 4183923 - DNA, 11 bp, Homo sapiens
caacttattaa

SEQ ID NO: 4183924 - DNA, 19 bp, Homo sapiens
caacttgaagcaagctttc

SEQ ID NO: 4183925 - DNA, 14 bp, Homo sapiens
caacttgcttatca

SEQ ID NO: 4183926 - DNA, 12 bp, Homo sapiens
caacttggcttt

SEQ ID NO: 4183927 - DNA, 16 bp, Homo sapiens
caacttgtgttctatt

SEQ ID NO: 4183928 - DNA, 19 bp, Homo sapiens
caactttctcactgctgtc

SEQ ID NO: 4183929 - DNA, 21 bp, Homo sapiens
caactttctcactgctgtcag

SEQ ID NO: 4183930 - DNA, 16 bp, Homo sapiens
caactttctgtaaact

SEQ ID NO: 4183931 - DNA, 15 bp, Homo sapiens
caagaaacagaagta

SEQ ID NO: 4183932 - DNA, 18 bp, Homo sapiens
caagaaacagaagtagaa

SEQ ID NO: 4183933 - DNA, 22 bp, Homo sapiens
caagaaatccagtttcccacca

SEQ ID NO: 4183934 - DNA, 12 bp, Homo sapiens
caagaacaacaa

SEQ ID NO: 4183935 - DNA, 23 bp, Homo sapiens
caagaacaacaacaacaataaca

SEQ ID NO: 4183936 - DNA, 22 bp, Homo sapiens
caagaagaaatgctttccaaaa

SEQ ID NO: 4183937 - DNA, 23 bp, Homo sapiens
caagaagcattttgtaagttgaa

SEQ ID NO: 4183938 - DNA, 12 bp, Homo sapiens
caagaagctgct

SEQ ID NO: 4183939 - DNA, 16 bp, Homo sapiens
caagaatattcaaatg

SEQ ID NO: 4183940 - DNA, 20 bp, Homo sapiens
caagacactagttcagagga

SEQ ID NO: 4183941 - DNA, 21 bp, Homo sapiens
caagaccaagtcctcaaagca

SEQ ID NO: 4183942 - DNA, 23 bp, Homo sapiens
caagactgtggtattggggtctt

SEQ ID NO: 4183943 - DNA, 15 bp, Homo sapiens
caagacttggcaaca

SEQ ID NO: 4183944 - DNA, 20 bp, Homo sapiens
caagacttggcaacagaagc

SEQ ID NO: 4183945 - DNA, 15 bp, Homo sapiens
caagagatcagcagt

SEQ ID NO: 4183946 - DNA, 14 bp, Homo sapiens
caagagcaaaatga

SEQ ID NO: 4183947 - DNA, 15 bp, Homo sapiens
caagagcagaggcag

SEQ ID NO: 4183948 - DNA, 19 bp, Homo sapiens
caagagctacataatttag

SEQ ID NO: 4183949 - DNA, 22 bp, Homo sapiens
caagagctacgtatttaatagc

SEQ ID NO: 4183950 - DNA, 13 bp, Homo sapiens
caagatctttcag

SEQ ID NO: 4183951 - DNA, 17 bp, Homo sapiens
caagatgtcagactggc

SEQ ID NO: 4183952 - DNA, 17 bp, Homo sapiens
caagattttctactttt

SEQ ID NO: 4183953 - DNA, 18 bp, Homo sapiens
caagcactgctaggcgag

SEQ ID NO: 4183954 - DNA, 16 bp, Homo sapiens
caagcaggaagttcaa

SEQ ID NO: 4183955 - DNA, 21 bp, Homo sapiens
caagcatggctattttatatt

SEQ ID NO: 4183956 - DNA, 22 bp, Homo sapiens
caagcattcagaagaaaaagaa

SEQ ID NO: 4183957 - DNA, 16 bp, Homo sapiens
caagcatttgccctgt

SEQ ID NO: 4183958 - DNA, 19 bp, Homo sapiens
caagccaacgacaaagcca

SEQ ID NO: 4183959 - DNA, 13 bp, Homo sapiens
caagccagaactt

SEQ ID NO: 4183960 - DNA, 20 bp, Homo sapiens
caagccattttttgaggaga

SEQ ID NO: 4183961 - DNA, 14 bp, Homo sapiens
caagcctgagaact

SEQ ID NO: 4183962 - DNA, 13 bp, Homo sapiens
caagcctggccct

SEQ ID NO: 4183963 - DNA, 14 bp, Homo sapiens
caagccttactcac

SEQ ID NO: 4183964 - DNA, 16 bp, Homo sapiens
caagcgggggcgtggc

SEQ ID NO: 4183965 - DNA, 22 bp, Homo sapiens
caagctcaggaggcgaataaat

SEQ ID NO: 4183966 - DNA, 17 bp, Homo sapiens
caagctctagtgggaag

SEQ ID NO: 4183967 - DNA, 15 bp, Homo sapiens
caagctctctgttgc

SEQ ID NO: 4183968 - DNA, 18 bp, Homo sapiens
caagctggaagcacatgt

SEQ ID NO: 4183969 - DNA, 12 bp, Homo sapiens
caagctggatgc

SEQ ID NO: 4183970 - DNA, 23 bp, Homo sapiens
caaggaaaaatgctgcttctcct

SEQ ID NO: 4183971 - DNA, 12 bp, Homo sapiens
caaggaacaaga

SEQ ID NO: 4183972 - DNA, 15 bp, Homo sapiens
caaggaacaagagaa

SEQ ID NO: 4183973 - DNA, 16 bp, Homo sapiens
caaggacaacctgccc

SEQ ID NO: 4183974 - DNA, 17 bp, Homo sapiens
caaggacaacctgcccc

SEQ ID NO: 4183975 - DNA, 18 bp, Homo sapiens
caaggacaacctgcccct

SEQ ID NO: 4183976 - DNA, 21 bp, Homo sapiens
caaggagttccatgaagacca

SEQ ID NO: 4183977 - DNA, 17 bp, Homo sapiens
caaggcatacctgtcct

SEQ ID NO: 4183978 - DNA, 22 bp, Homo sapiens
caagggcaaaccatttcaaatg

SEQ ID NO: 4183979 - DNA, 22 bp, Homo sapiens
caaggggcttcaggtccaggct

SEQ ID NO: 4183980 - DNA, 20 bp, Homo sapiens
caaggtccaggcaaagctgg

SEQ ID NO: 4183981 - DNA, 16 bp, Homo sapiens
caaggtcggtaagttg

SEQ ID NO: 4183982 - DNA, 16 bp, Homo sapiens
caaggtcttcagccat

SEQ ID NO: 4183983 - DNA, 16 bp, Homo sapiens
caaggtgaatagcaca

SEQ ID NO: 4183984 - DNA, 15 bp, Homo sapiens
caaggtgctgatgtc

SEQ ID NO: 4183985 - DNA, 19 bp, Homo sapiens
caaggtggccaaattattt

SEQ ID NO: 4183986 - DNA, 12 bp, Homo sapiens
caaggtgggctg

SEQ ID NO: 4183987 - DNA, 17 bp, Homo sapiens
caaggtgggctgagccc

SEQ ID NO: 4183988 - DNA, 21 bp, Homo sapiens
caaggtgggctgagccctggc

SEQ ID NO: 4183989 - DNA, 18 bp, Homo sapiens
caaggttcaacttattaa

SEQ ID NO: 4183990 - DNA, 15 bp, Homo sapiens
caaggttccctctga

SEQ ID NO: 4183991 - DNA, 16 bp, Homo sapiens
caaggttccctctgag

SEQ ID NO: 4183992 - DNA, 17 bp, Homo sapiens
caaggttccctctgaga

SEQ ID NO: 4183993 - DNA, 18 bp, Homo sapiens
caaggttccctctgagaa

SEQ ID NO: 4183994 - DNA, 16 bp, Homo sapiens
caagtagaatctcagt

SEQ ID NO: 4183995 - DNA, 19 bp, Homo sapiens
caagtatctaactcttctg

SEQ ID NO: 4183996 - DNA, 16 bp, Homo sapiens
caagtatttgttaatt

SEQ ID NO: 4183997 - DNA, 19 bp, Homo sapiens
caagtatttgttaatttag

SEQ ID NO: 4183998 - DNA, 17 bp, Homo sapiens
caagtcaacactcttct

SEQ ID NO: 4183999 - DNA, 16 bp, Homo sapiens
caagtccacctgccta

SEQ ID NO: 4184000 - DNA, 12 bp, Homo sapiens
caagtccagagc

SEQ ID NO: 4184001 - DNA, 20 bp, Homo sapiens
caagtccctgactctctgtg

SEQ ID NO: 4184002 - DNA, 17 bp, Homo sapiens
caagtcctgtgaatttc

SEQ ID NO: 4184003 - DNA, 16 bp, Homo sapiens
caagtctagctttcct

SEQ ID NO: 4184004 - DNA, 15 bp, Homo sapiens
caagtctcagaagag

SEQ ID NO: 4184005 - DNA, 19 bp, Homo sapiens
caagtgagcagatgggaca

SEQ ID NO: 4184006 - DNA, 12 bp, Homo sapiens
caagtgccaaac

SEQ ID NO: 4184007 - DNA, 15 bp, Homo sapiens
caagtgccaaacaga

SEQ ID NO: 4184008 - DNA, 15 bp, Homo sapiens
caagtgcctagactg

SEQ ID NO: 4184009 - DNA, 17 bp, Homo sapiens
caagtgcctagactgtt

SEQ ID NO: 4184010 - DNA, 17 bp, Homo sapiens
caagtggatggcccagc

SEQ ID NO: 4184011 - DNA, 13 bp, Homo sapiens
caagttagctcag

SEQ ID NO: 4184012 - DNA, 14 bp, Homo sapiens
caagttagctcagg

SEQ ID NO: 4184013 - DNA, 20 bp, Homo sapiens
caagttattgtacagctgtt

SEQ ID NO: 4184014 - DNA, 12 bp, Homo sapiens
caagttcaatct

SEQ ID NO: 4184015 - DNA, 19 bp, Homo sapiens
caagttcctgcactccaga

SEQ ID NO: 4184016 - DNA, 19 bp, Homo sapiens
caagttctagagaagaggc

SEQ ID NO: 4184017 - DNA, 15 bp, Homo sapiens
caataaagctgctga

SEQ ID NO: 4184018 - DNA, 22 bp, Homo sapiens
caataaagctgctgagaatcta

SEQ ID NO: 4184019 - DNA, 19 bp, Homo sapiens
caataaagctggacaagaa

SEQ ID NO: 4184020 - DNA, 22 bp, Homo sapiens
caataaagctggacaagaagct

SEQ ID NO: 4184021 - DNA, 23 bp, Homo sapiens
caataaagctggacaagaagctg

SEQ ID NO: 4184022 - DNA, 18 bp, Homo sapiens
caataaatgttgcttgga

SEQ ID NO: 4184023 - DNA, 14 bp, Homo sapiens
caataacaacaatg

SEQ ID NO: 4184024 - DNA, 15 bp, Homo sapiens
caataacaacaatgg

SEQ ID NO: 4184025 - DNA, 18 bp, Homo sapiens
caataatatttcaagtgc

SEQ ID NO: 4184026 - DNA, 19 bp, Homo sapiens
caataatatttcaagtgcc

SEQ ID NO: 4184027 - DNA, 18 bp, Homo sapiens
caatacaacaagaacaac

SEQ ID NO: 4184028 - DNA, 23 bp, Homo sapiens
caataccccaagtccacctgcct

SEQ ID NO: 4184029 - DNA, 22 bp, Homo sapiens
caatagactgaagagaccacag

SEQ ID NO: 4184030 - DNA, 15 bp, Homo sapiens
caataggtgcaaaaa

SEQ ID NO: 4184031 - DNA, 18 bp, Homo sapiens
caatataaaaatgtgaat

SEQ ID NO: 4184032 - DNA, 16 bp, Homo sapiens
caatataaattggctt

SEQ ID NO: 4184033 - DNA, 12 bp, Homo sapiens
caatatgcttac

SEQ ID NO: 4184034 - DNA, 15 bp, Homo sapiens
caatattaattataa

SEQ ID NO: 4184035 - DNA, 17 bp, Homo sapiens
caatattaattataata

SEQ ID NO: 4184036 - DNA, 20 bp, Homo sapiens
caatattaattataataaag

SEQ ID NO: 4184037 - DNA, 15 bp, Homo sapiens
caatcatctgtgtga

SEQ ID NO: 4184038 - DNA, 19 bp, Homo sapiens
caatcatctgtgtgaaaat

SEQ ID NO: 4184039 - DNA, 23 bp, Homo sapiens
caatccatgttagtttttacttt

SEQ ID NO: 4184040 - DNA, 14 bp, Homo sapiens
caatccttgttcag

SEQ ID NO: 4184041 - DNA, 19 bp, Homo sapiens
caatctccagggctgcccc

SEQ ID NO: 4184042 - DNA, 23 bp, Homo sapiens
caatctgagcaaacaccagtgag

SEQ ID NO: 4184043 - DNA, 18 bp, Homo sapiens
caatctggcttagtgcca

SEQ ID NO: 4184044 - DNA, 18 bp, Homo sapiens
caatctgggactttcact

SEQ ID NO: 4184045 - DNA, 14 bp, Homo sapiens
caatctgtaatttc

SEQ ID NO: 4184046 - DNA, 21 bp, Homo sapiens
caatcttcggggtgtgatgaa

SEQ ID NO: 4184047 - DNA, 22 bp, Homo sapiens
caatgaaggaaaacctcacttg

SEQ ID NO: 4184048 - DNA, 17 bp, Homo sapiens
caatggagtctgcagtg

SEQ ID NO: 4184049 - DNA, 16 bp, Homo sapiens
caatggctaattccca

SEQ ID NO: 4184050 - DNA, 18 bp, Homo sapiens
caatggctaattcccaga

SEQ ID NO: 4184051 - DNA, 19 bp, Homo sapiens
caatggctaattcccagag

SEQ ID NO: 4184052 - DNA, 23 bp, Homo sapiens
caatggctaattcccagagtgtg

SEQ ID NO: 4184053 - DNA, 22 bp, Homo sapiens
caatggctatatggcaagaaag

SEQ ID NO: 4184054 - DNA, 18 bp, Homo sapiens
caattattgtacactaac

SEQ ID NO: 4184055 - DNA, 22 bp, Homo sapiens
caattgacaacagttacataat

SEQ ID NO: 4184056 - DNA, 21 bp, Homo sapiens
caattgcacgcggagtgagtt

SEQ ID NO: 4184057 - DNA, 23 bp, Homo sapiens
caattgcacgcggagtgagtttt

SEQ ID NO: 4184058 - DNA, 16 bp, Homo sapiens
caattggggaagaaaa

SEQ ID NO: 4184059 - DNA, 21 bp, Homo sapiens
caatttatatttaataaaatt

SEQ ID NO: 4184060 - DNA, 13 bp, Homo sapiens
caatttatgcaga

SEQ ID NO: 4184061 - DNA, 16 bp, Homo sapiens
caatttcctttatatt

SEQ ID NO: 4184062 - DNA, 14 bp, Homo sapiens
caattttaaataag

SEQ ID NO: 4184063 - DNA, 15 bp, Homo sapiens
caattttaaataaga

SEQ ID NO: 4184064 - DNA, 14 bp, Homo sapiens
cacaaaagccaaaa

SEQ ID NO: 4184065 - DNA, 20 bp, Homo sapiens
cacaaaccaccctaaaatga

SEQ ID NO: 4184066 - DNA, 12 bp, Homo sapiens
cacaaagacaca

SEQ ID NO: 4184067 - DNA, 17 bp, Homo sapiens
cacaaagacacaggaag

SEQ ID NO: 4184068 - DNA, 18 bp, Homo sapiens
cacaaagacacaggaaga

SEQ ID NO: 4184069 - DNA, 20 bp, Homo sapiens
cacaaagacacaggaagaat

SEQ ID NO: 4184070 - DNA, 14 bp, Homo sapiens
cacaaagggacaca

SEQ ID NO: 4184071 - DNA, 20 bp, Homo sapiens
cacaaagggacacacagtga

SEQ ID NO: 4184072 - DNA, 17 bp, Homo sapiens
cacaaccctgttttata

SEQ ID NO: 4184073 - DNA, 22 bp, Homo sapiens
cacaactcagtctgtgggagct

SEQ ID NO: 4184074 - DNA, 15 bp, Homo sapiens
cacaagagatcagca

SEQ ID NO: 4184075 - DNA, 20 bp, Homo sapiens
cacaagagcccagcagggcc

SEQ ID NO: 4184076 - DNA, 23 bp, Homo sapiens
cacaagccattttttgaggagag

SEQ ID NO: 4184077 - DNA, 19 bp, Homo sapiens
cacaagcctgagaactgaa

SEQ ID NO: 4184078 - DNA, 20 bp, Homo sapiens
cacaagccttactcacctct

SEQ ID NO: 4184079 - DNA, 13 bp, Homo sapiens
cacaagctggaag

SEQ ID NO: 4184080 - DNA, 21 bp, Homo sapiens
cacaatggctaattcccagag

SEQ ID NO: 4184081 - DNA, 18 bp, Homo sapiens
cacacagtctcagtccag

SEQ ID NO: 4184082 - DNA, 19 bp, Homo sapiens
cacaccaatcagagagcct

SEQ ID NO: 4184083 - DNA, 20 bp, Homo sapiens
cacaccaatcagagagccta

SEQ ID NO: 4184084 - DNA, 14 bp, Homo sapiens
cacaccaggataga

SEQ ID NO: 4184085 - DNA, 17 bp, Homo sapiens
cacaccggtcaccgaga

SEQ ID NO: 4184086 - DNA, 14 bp, Homo sapiens
cacacctcacgctc

SEQ ID NO: 4184087 - DNA, 15 bp, Homo sapiens
cacacctgacaaatg

SEQ ID NO: 4184088 - DNA, 13 bp, Homo sapiens
cacactcagcagc

SEQ ID NO: 4184089 - DNA, 14 bp, Homo sapiens
cacactgcagggct

SEQ ID NO: 4184090 - DNA, 18 bp, Homo sapiens
cacactgcagggctgctg

SEQ ID NO: 4184091 - DNA, 22 bp, Homo sapiens
cacagaagtccctaggagggaa

SEQ ID NO: 4184092 - DNA, 20 bp, Homo sapiens
cacagagaagacgggatttg

SEQ ID NO: 4184093 - DNA, 12 bp, Homo sapiens
cacagagcctgg

SEQ ID NO: 4184094 - DNA, 22 bp, Homo sapiens
cacagagctggcgactgcagct

SEQ ID NO: 4184095 - DNA, 19 bp, Homo sapiens
cacagataactgaaaatta

SEQ ID NO: 4184096 - DNA, 23 bp, Homo sapiens
cacagatgtgtctgggagagcct

SEQ ID NO: 4184097 - DNA, 22 bp, Homo sapiens
cacagcccacggggatcacagc

SEQ ID NO: 4184098 - DNA, 13 bp, Homo sapiens
cacagcctctccc

SEQ ID NO: 4184099 - DNA, 18 bp, Homo sapiens
cacagcgcgggcggaggc

SEQ ID NO: 4184100 - DNA, 20 bp, Homo sapiens
cacagcggggccccagggct

SEQ ID NO: 4184101 - DNA, 18 bp, Homo sapiens
cacagctgagagactttt

SEQ ID NO: 4184102 - DNA, 19 bp, Homo sapiens
cacagctgagagactttta

SEQ ID NO: 4184103 - DNA, 19 bp, Homo sapiens
cacaggatcctattctcac

SEQ ID NO: 4184104 - DNA, 23 bp, Homo sapiens
cacaggatcctattctcaccagg

SEQ ID NO: 4184105 - DNA, 13 bp, Homo sapiens
cacaggctcagca

SEQ ID NO: 4184106 - DNA, 17 bp, Homo sapiens
cacaggtgttggaagcc

SEQ ID NO: 4184107 - DNA, 19 bp, Homo sapiens
cacaggttagggtgtgtgc

SEQ ID NO: 4184108 - DNA, 14 bp, Homo sapiens
cacaggttccatag

SEQ ID NO: 4184109 - DNA, 14 bp, Homo sapiens
cacagtcctcacag

SEQ ID NO: 4184110 - DNA, 16 bp, Homo sapiens
cacagtcctcacagcc

SEQ ID NO: 4184111 - DNA, 18 bp, Homo sapiens
cacagtggcaagaaacat

SEQ ID NO: 4184112 - DNA, 21 bp, Homo sapiens
cacagtgttccagctgcctgg

SEQ ID NO: 4184113 - DNA, 18 bp, Homo sapiens
cacatactcatttttcat

SEQ ID NO: 4184114 - DNA, 21 bp, Homo sapiens
cacatccacacacgcaggaac

SEQ ID NO: 4184115 - DNA, 15 bp, Homo sapiens
cacatccctctcctc

SEQ ID NO: 4184116 - DNA, 19 bp, Homo sapiens
cacatgcatcatcagccta

SEQ ID NO: 4184117 - DNA, 12 bp, Homo sapiens
cacatgtccagt

SEQ ID NO: 4184118 - DNA, 16 bp, Homo sapiens
cacatgtctgtcctca

SEQ ID NO: 4184119 - DNA, 21 bp, Homo sapiens
cacattatgttagagaggtag

SEQ ID NO: 4184120 - DNA, 21 bp, Homo sapiens
cacattttgcctttctcgtgg

SEQ ID NO: 4184121 - DNA, 15 bp, Homo sapiens
caccaaaagaagtaa

SEQ ID NO: 4184122 - DNA, 21 bp, Homo sapiens
caccaaggtcttcagccatca

SEQ ID NO: 4184123 - DNA, 18 bp, Homo sapiens
caccaccttggactcctc

SEQ ID NO: 4184124 - DNA, 15 bp, Homo sapiens
caccactgcactcca

SEQ ID NO: 4184125 - DNA, 20 bp, Homo sapiens
caccagacccacctggagcc

SEQ ID NO: 4184126 - DNA, 16 bp, Homo sapiens
caccagcctgactgca

SEQ ID NO: 4184127 - DNA, 14 bp, Homo sapiens
caccaggactttaa

SEQ ID NO: 4184128 - DNA, 15 bp, Homo sapiens
caccaggatggccct

SEQ ID NO: 4184129 - DNA, 21 bp, Homo sapiens
caccaggatggcccttcccac

SEQ ID NO: 4184130 - DNA, 18 bp, Homo sapiens
caccagggcactgtctgc

SEQ ID NO: 4184131 - DNA, 22 bp, Homo sapiens
caccaggggtgctatgacatgc

SEQ ID NO: 4184132 - DNA, 16 bp, Homo sapiens
caccatattcagtgct

SEQ ID NO: 4184133 - DNA, 14 bp, Homo sapiens
caccatcacacatg

SEQ ID NO: 4184134 - DNA, 14 bp, Homo sapiens
caccatccaccctg

SEQ ID NO: 4184135 - DNA, 22 bp, Homo sapiens
cacccacctttgccacaaagct

SEQ ID NO: 4184136 - DNA, 21 bp, Homo sapiens
cacccagggctccctcctgga

SEQ ID NO: 4184137 - DNA, 24 bp, Homo sapiens
cacccagggctccctcctggagca

SEQ ID NO: 4184138 - DNA, 19 bp, Homo sapiens
cacccatagtgcacacttg

SEQ ID NO: 4184139 - DNA, 23 bp, Homo sapiens
caccccagagttgggatgcgggg

SEQ ID NO: 4184140 - DNA, 19 bp, Homo sapiens
caccccatgcacctcaggg

SEQ ID NO: 4184141 - DNA, 13 bp, Homo sapiens
caccccctccagc

SEQ ID NO: 4184142 - DNA, 15 bp, Homo sapiens
cacccctaacctggc

SEQ ID NO: 4184143 - DNA, 16 bp, Homo sapiens
caccccttatccagga

SEQ ID NO: 4184144 - DNA, 19 bp, Homo sapiens
caccccttatccaggactc

SEQ ID NO: 4184145 - DNA, 15 bp, Homo sapiens
cacccgactcctcaa

SEQ ID NO: 4184146 - DNA, 16 bp, Homo sapiens
cacccgactcctcaaa

SEQ ID NO: 4184147 - DNA, 21 bp, Homo sapiens
cacccgtcttggggctcgccc

SEQ ID NO: 4184148 - DNA, 15 bp, Homo sapiens
caccctaaaatgaca

SEQ ID NO: 4184149 - DNA, 17 bp, Homo sapiens
caccctcgtggacacct

SEQ ID NO: 4184150 - DNA, 19 bp, Homo sapiens
caccctcgtggacacctgc

SEQ ID NO: 4184151 - DNA, 20 bp, Homo sapiens
caccctcgtggacacctgcc

SEQ ID NO: 4184152 - DNA, 21 bp, Homo sapiens
caccctcgtggacacctgccc

SEQ ID NO: 4184153 - DNA, 23 bp, Homo sapiens
caccctcgtggacacctgccctg

SEQ ID NO: 4184154 - DNA, 12 bp, Homo sapiens
caccctgcagag

SEQ ID NO: 4184155 - DNA, 13 bp, Homo sapiens
cacccttggactt

SEQ ID NO: 4184156 - DNA, 14 bp, Homo sapiens
caccgcagaaggaa

SEQ ID NO: 4184157 - DNA, 24 bp, Homo sapiens
caccgtgcccagccctaaacatca

SEQ ID NO: 4184158 - DNA, 17 bp, Homo sapiens
cacctaaagaaaaacaa

SEQ ID NO: 4184159 - DNA, 16 bp, Homo sapiens
cacctatagtcccagc

SEQ ID NO: 4184160 - DNA, 18 bp, Homo sapiens
cacctcacgctctggaca

SEQ ID NO: 4184161 - DNA, 13 bp, Homo sapiens
cacctcagggcca

SEQ ID NO: 4184162 - DNA, 16 bp, Homo sapiens
cacctcatgcctggcc

SEQ ID NO: 4184163 - DNA, 20 bp, Homo sapiens
cacctccctatactgcttgg

SEQ ID NO: 4184164 - DNA, 15 bp, Homo sapiens
cacctcggcctccta

SEQ ID NO: 4184165 - DNA, 13 bp, Homo sapiens
cacctcttccttc

SEQ ID NO: 4184166 - DNA, 11 bp, Homo sapiens
cacctcttctt

SEQ ID NO: 4184167 - DNA, 16 bp, Homo sapiens
cacctctttaaccact

SEQ ID NO: 4184168 - DNA, 17 bp, Homo sapiens
cacctctttaaccactc

SEQ ID NO: 4184169 - DNA, 16 bp, Homo sapiens
cacctgaaccactgtg

SEQ ID NO: 4184170 - DNA, 17 bp, Homo sapiens
cacctgaaccactgtgg

SEQ ID NO: 4184171 - DNA, 18 bp, Homo sapiens
cacctgaaccactgtggc

SEQ ID NO: 4184172 - DNA, 14 bp, Homo sapiens
cacctgccccctgg

SEQ ID NO: 4184173 - DNA, 21 bp, Homo sapiens
cacctgccccctggtggacag

SEQ ID NO: 4184174 - DNA, 12 bp, Homo sapiens
cacctgccctgc

SEQ ID NO: 4184175 - DNA, 20 bp, Homo sapiens
cacctgcctatccatcctgc

SEQ ID NO: 4184176 - DNA, 10 bp, Homo sapiens
cacctgctgg

SEQ ID NO: 4184177 - DNA, 22 bp, Homo sapiens
cacctgctggaaaccacacttc

SEQ ID NO: 4184178 - DNA, 15 bp, Homo sapiens
cacctgggttcagcc

SEQ ID NO: 4184179 - DNA, 15 bp, Homo sapiens
cacctgtactcagga

SEQ ID NO: 4184180 - DNA, 22 bp, Homo sapiens
cacctgtactcaggaggctgag

SEQ ID NO: 4184181 - DNA, 11 bp, Homo sapiens
cacctgtctgt

SEQ ID NO: 4184182 - DNA, 12 bp, Homo sapiens
cacctgtctgtc

SEQ ID NO: 4184183 - DNA, 22 bp, Homo sapiens
cacctgtctgtctgtctgtccc

SEQ ID NO: 4184184 - DNA, 19 bp, Homo sapiens
caccttcaattcctgggcc

SEQ ID NO: 4184185 - DNA, 11 bp, Homo sapiens
caccttcccca

SEQ ID NO: 4184186 - DNA, 21 bp, Homo sapiens
caccttccccagactcagctc

SEQ ID NO: 4184187 - DNA, 17 bp, Homo sapiens
caccttgccgagagagg

SEQ ID NO: 4184188 - DNA, 21 bp, Homo sapiens
caccttggactcctcccacaa

SEQ ID NO: 4184189 - DNA, 14 bp, Homo sapiens
cacctttgggatca

SEQ ID NO: 4184190 - DNA, 20 bp, Homo sapiens
cacctttgggatcagcctcc

SEQ ID NO: 4184191 - DNA, 23 bp, Homo sapiens
cacctttgggatcagcctccgcc

SEQ ID NO: 4184192 - DNA, 19 bp, Homo sapiens
cacgacctcggctcactgc

SEQ ID NO: 4184193 - DNA, 12 bp, Homo sapiens
cacgactcttcc

SEQ ID NO: 4184194 - DNA, 15 bp, Homo sapiens
cacgatcttgtaaga

SEQ ID NO: 4184195 - DNA, 14 bp, Homo sapiens
cacgccactgcact

SEQ ID NO: 4184196 - DNA, 21 bp, Homo sapiens
cacgcctatgatcccagcact

SEQ ID NO: 4184197 - DNA, 22 bp, Homo sapiens
cacgcctgtaatcccagcactt

SEQ ID NO: 4184198 - DNA, 12 bp, Homo sapiens
cacggcagctgt

SEQ ID NO: 4184199 - DNA, 17 bp, Homo sapiens
cacgtgacacaaacaca

SEQ ID NO: 4184200 - DNA, 19 bp, Homo sapiens
cactaagctttctcctttg

SEQ ID NO: 4184201 - DNA, 18 bp, Homo sapiens
cactacactccagcctga

SEQ ID NO: 4184202 - DNA, 19 bp, Homo sapiens
cactacctttatagctctc

SEQ ID NO: 4184203 - DNA, 22 bp, Homo sapiens
cactacctttatagctctcatc

SEQ ID NO: 4184204 - DNA, 17 bp, Homo sapiens
cactagcctctccagga

SEQ ID NO: 4184205 - DNA, 14 bp, Homo sapiens
cactagttcagagg

SEQ ID NO: 4184206 - DNA, 14 bp, Homo sapiens
cactcaagcctgag

SEQ ID NO: 4184207 - DNA, 22 bp, Homo sapiens
cactcacccatgtgccaaggtg

SEQ ID NO: 4184208 - DNA, 12 bp, Homo sapiens
cactcagcagcc

SEQ ID NO: 4184209 - DNA, 12 bp, Homo sapiens
cactcagccaca

SEQ ID NO: 4184210 - DNA, 16 bp, Homo sapiens
cactccacctccaccc

SEQ ID NO: 4184211 - DNA, 12 bp, Homo sapiens
cactccagcctg

SEQ ID NO: 4184212 - DNA, 14 bp, Homo sapiens
cactccccaccttc

SEQ ID NO: 4184213 - DNA, 21 bp, Homo sapiens
cactccccgcctgtcctgcct

SEQ ID NO: 4184214 - DNA, 20 bp, Homo sapiens
cactccggtgtgcctgcagc

SEQ ID NO: 4184215 - DNA, 21 bp, Homo sapiens
cactccggtgtgcctgcagcc

SEQ ID NO: 4184216 - DNA, 22 bp, Homo sapiens
cactcgggaggctgagacagga

SEQ ID NO: 4184217 - DNA, 20 bp, Homo sapiens
cactctagtgacttcctggt

SEQ ID NO: 4184218 - DNA, 21 bp, Homo sapiens
cactctagtgacttcctggtg

SEQ ID NO: 4184219 - DNA, 18 bp, Homo sapiens
cactctatgagttggact

SEQ ID NO: 4184220 - DNA, 12 bp, Homo sapiens
cactctcccctc

SEQ ID NO: 4184221 - DNA, 14 bp, Homo sapiens
cactctcccctccc

SEQ ID NO: 4184222 - DNA, 17 bp, Homo sapiens
cactctcccctccctct

SEQ ID NO: 4184223 - DNA, 15 bp, Homo sapiens
cactctctgtacaaa

SEQ ID NO: 4184224 - DNA, 20 bp, Homo sapiens
cactctctgtacaaaaacaa

SEQ ID NO: 4184225 - DNA, 17 bp, Homo sapiens
cactcttcctgcaagga

SEQ ID NO: 4184226 - DNA, 20 bp, Homo sapiens
cactcttcttgagcagaccg

SEQ ID NO: 4184227 - DNA, 19 bp, Homo sapiens
cactgaagaaaccttcaga

SEQ ID NO: 4184228 - DNA, 21 bp, Homo sapiens
cactgaatgcctcaatgtgac

SEQ ID NO: 4184229 - DNA, 21 bp, Homo sapiens
cactgcaaaccgccacctccc

SEQ ID NO: 4184230 - DNA, 15 bp, Homo sapiens
cactgcactccagcc

SEQ ID NO: 4184231 - DNA, 13 bp, Homo sapiens
cactgcactccgg

SEQ ID NO: 4184232 - DNA, 17 bp, Homo sapiens
cactgcagggctgctgt

SEQ ID NO: 4184233 - DNA, 18 bp, Homo sapiens
cactgcagggctgctgtg

SEQ ID NO: 4184234 - DNA, 23 bp, Homo sapiens
cactgcagggctgctgtggccca

SEQ ID NO: 4184235 - DNA, 14 bp, Homo sapiens
cactgccctccgcc

SEQ ID NO: 4184236 - DNA, 21 bp, Homo sapiens
cactgcctatatatgtaaata

SEQ ID NO: 4184237 - DNA, 20 bp, Homo sapiens
cactgcgggagctctgtatg

SEQ ID NO: 4184238 - DNA, 22 bp, Homo sapiens
cactgctaggcgagtgccagga

SEQ ID NO: 4184239 - DNA, 13 bp, Homo sapiens
cactgctgtcagc

SEQ ID NO: 4184240 - DNA, 14 bp, Homo sapiens
cactgctgtcagcc

SEQ ID NO: 4184241 - DNA, 14 bp, Homo sapiens
cactggagcccagg

SEQ ID NO: 4184242 - DNA, 19 bp, Homo sapiens
cactggagtcttgtacact

SEQ ID NO: 4184243 - DNA, 21 bp, Homo sapiens
cactggcagagcacagcccac

SEQ ID NO: 4184244 - DNA, 13 bp, Homo sapiens
cactggccctggg

SEQ ID NO: 4184245 - DNA, 21 bp, Homo sapiens
cactgggagaagagaacctca

SEQ ID NO: 4184246 - DNA, 22 bp, Homo sapiens
cactggtgactgcgatcttcag

SEQ ID NO: 4184247 - DNA, 22 bp, Homo sapiens
cactgtaagactcattccctag

SEQ ID NO: 4184248 - DNA, 21 bp, Homo sapiens
cactgtattttcattttaatt

SEQ ID NO: 4184249 - DNA, 18 bp, Homo sapiens
cactgtccgcctctgccc

SEQ ID NO: 4184250 - DNA, 16 bp, Homo sapiens
cactgtctgcgtgact

SEQ ID NO: 4184251 - DNA, 13 bp, Homo sapiens
cactgtctgctgc

SEQ ID NO: 4184252 - DNA, 18 bp, Homo sapiens
cactgtggccttctcagc

SEQ ID NO: 4184253 - DNA, 21 bp, Homo sapiens
cactgttgaaaattattttaa

SEQ ID NO: 4184254 - DNA, 19 bp, Homo sapiens
cacttaaatacctctggct

SEQ ID NO: 4184255 - DNA, 14 bp, Homo sapiens
cacttaggaagaaa

SEQ ID NO: 4184256 - DNA, 14 bp, Homo sapiens
cacttatcttctgg

SEQ ID NO: 4184257 - DNA, 15 bp, Homo sapiens
cacttatcttctgga

SEQ ID NO: 4184258 - DNA, 17 bp, Homo sapiens
cacttatcttctggatt

SEQ ID NO: 4184259 - DNA, 19 bp, Homo sapiens
cacttcttgaaacagcctg

SEQ ID NO: 4184260 - DNA, 12 bp, Homo sapiens
cacttgcaacct

SEQ ID NO: 4184261 - DNA, 20 bp, Homo sapiens
cactttaaccctctcttccc

SEQ ID NO: 4184262 - DNA, 18 bp, Homo sapiens
cactttagaaggttgtat

SEQ ID NO: 4184263 - DNA, 12 bp, Homo sapiens
cactttcagagt

SEQ ID NO: 4184264 - DNA, 18 bp, Homo sapiens
cactttcccttgtgtcaa

SEQ ID NO: 4184265 - DNA, 18 bp, Homo sapiens
cactttcctacaaaatgg

SEQ ID NO: 4184266 - DNA, 13 bp, Homo sapiens
cacttttcagtga

SEQ ID NO: 4184267 - DNA, 18 bp, Homo sapiens
cagaaaaatatgtaccaa

SEQ ID NO: 4184268 - DNA, 21 bp, Homo sapiens
cagaaaacttagaaataagaa

SEQ ID NO: 4184269 - DNA, 16 bp, Homo sapiens
cagaaattagccgggc

SEQ ID NO: 4184270 - DNA, 16 bp, Homo sapiens
cagaacaattctgcag

SEQ ID NO: 4184271 - DNA, 16 bp, Homo sapiens
cagaacattgccttcc

SEQ ID NO: 4184272 - DNA, 15 bp, Homo sapiens
cagaaccacagatgt

SEQ ID NO: 4184273 - DNA, 15 bp, Homo sapiens
cagaactgaggtcac

SEQ ID NO: 4184274 - DNA, 19 bp, Homo sapiens
cagaactgaggtcactggg

SEQ ID NO: 4184275 - DNA, 21 bp, Homo sapiens
cagaactgaggtcactgggtt

SEQ ID NO: 4184276 - DNA, 16 bp, Homo sapiens
cagaagaagatgctgt

SEQ ID NO: 4184277 - DNA, 14 bp, Homo sapiens
cagaagaggaggga

SEQ ID NO: 4184278 - DNA, 11 bp, Homo sapiens
cagaagcacaa

SEQ ID NO: 4184279 - DNA, 14 bp, Homo sapiens
cagaagcaggcagg

SEQ ID NO: 4184280 - DNA, 17 bp, Homo sapiens
cagaagcaggcagggca

SEQ ID NO: 4184281 - DNA, 14 bp, Homo sapiens
cagaagcctgaggc

SEQ ID NO: 4184282 - DNA, 15 bp, Homo sapiens
cagaagcctgaggct

SEQ ID NO: 4184283 - DNA, 14 bp, Homo sapiens
cagaagtaggaagg

SEQ ID NO: 4184284 - DNA, 17 bp, Homo sapiens
cagaagtaggaaggaaa

SEQ ID NO: 4184285 - DNA, 16 bp, Homo sapiens
cagaagtccctaggag

SEQ ID NO: 4184286 - DNA, 20 bp, Homo sapiens
cagaagtccctaggagggaa

SEQ ID NO: 4184287 - DNA, 21 bp, Homo sapiens
cagaagtccctaggagggaag

SEQ ID NO: 4184288 - DNA, 16 bp, Homo sapiens
cagaagtttgcactat

SEQ ID NO: 4184289 - DNA, 15 bp, Homo sapiens
cagaataccttcttc

SEQ ID NO: 4184290 - DNA, 21 bp, Homo sapiens
cagaataccttcttcgctgct

SEQ ID NO: 4184291 - DNA, 20 bp, Homo sapiens
cagaatatcaaggaaaactg

SEQ ID NO: 4184292 - DNA, 21 bp, Homo sapiens
cagaatccacaaagccgtgcc

SEQ ID NO: 4184293 - DNA, 19 bp, Homo sapiens
cagaatcttcgtcctgccc

SEQ ID NO: 4184294 - DNA, 13 bp, Homo sapiens
cagaatgagcagt

SEQ ID NO: 4184295 - DNA, 18 bp, Homo sapiens
cagaatgctgttttaaaa

SEQ ID NO: 4184296 - DNA, 17 bp, Homo sapiens
cagaatgtttttaaaat

SEQ ID NO: 4184297 - DNA, 13 bp, Homo sapiens
cagaattgatcat

SEQ ID NO: 4184298 - DNA, 18 bp, Homo sapiens
cagacagatgaggctttc

SEQ ID NO: 4184299 - DNA, 22 bp, Homo sapiens
cagacatccatgtttgtaaaac

SEQ ID NO: 4184300 - DNA, 17 bp, Homo sapiens
cagacattaaacctgga

SEQ ID NO: 4184301 - DNA, 17 bp, Homo sapiens
cagaccagtactgggaa

SEQ ID NO: 4184302 - DNA, 14 bp, Homo sapiens
cagacccacctgga

SEQ ID NO: 4184303 - DNA, 16 bp, Homo sapiens
cagacccacctggagc

SEQ ID NO: 4184304 - DNA, 17 bp, Homo sapiens
cagaccccttggctttt

SEQ ID NO: 4184305 - DNA, 15 bp, Homo sapiens
cagacgtctcaagac

SEQ ID NO: 4184306 - DNA, 14 bp, Homo sapiens
cagactcagctcca

SEQ ID NO: 4184307 - DNA, 15 bp, Homo sapiens
cagactcagctccag

SEQ ID NO: 4184308 - DNA, 21 bp, Homo sapiens
cagactctgggtccctcggag

SEQ ID NO: 4184309 - DNA, 13 bp, Homo sapiens
cagagaagaaaga

SEQ ID NO: 4184310 - DNA, 18 bp, Homo sapiens
cagagagaaccaggaggg

SEQ ID NO: 4184311 - DNA, 17 bp, Homo sapiens
cagagagcctagaacat

SEQ ID NO: 4184312 - DNA, 22 bp, Homo sapiens
cagagatgcatgcgcaggctca

SEQ ID NO: 4184313 - DNA, 20 bp, Homo sapiens
cagagcaagactccatttca

SEQ ID NO: 4184314 - DNA, 22 bp, Homo sapiens
cagagcagaactttttttgtgg

SEQ ID NO: 4184315 - DNA, 15 bp, Homo sapiens
cagagcagagagcag

SEQ ID NO: 4184316 - DNA, 20 bp, Homo sapiens
cagagcaggccacgctcagg

SEQ ID NO: 4184317 - DNA, 14 bp, Homo sapiens
cagagcaggggcag

SEQ ID NO: 4184318 - DNA, 18 bp, Homo sapiens
cagagcattacgtgagcc

SEQ ID NO: 4184319 - DNA, 21 bp, Homo sapiens
cagagcattacgtgagccagg

SEQ ID NO: 4184320 - DNA, 21 bp, Homo sapiens
cagagccaaggggcttcaggt

SEQ ID NO: 4184321 - DNA, 16 bp, Homo sapiens
cagagccaccagggca

SEQ ID NO: 4184322 - DNA, 19 bp, Homo sapiens
cagagccaggctctgcctg

SEQ ID NO: 4184323 - DNA, 12 bp, Homo sapiens
cagagcctggct

SEQ ID NO: 4184324 - DNA, 11 bp, Homo sapiens
cagagccttca

SEQ ID NO: 4184325 - DNA, 15 bp, Homo sapiens
cagagccttcaagtg

SEQ ID NO: 4184326 - DNA, 19 bp, Homo sapiens
cagagccttcaagtgccaa

SEQ ID NO: 4184327 - DNA, 20 bp, Homo sapiens
cagagccttcaagtgccaaa

SEQ ID NO: 4184328 - DNA, 16 bp, Homo sapiens
cagagcctttggatga

SEQ ID NO: 4184329 - DNA, 18 bp, Homo sapiens
cagagcctttggatgacc

SEQ ID NO: 4184330 - DNA, 20 bp, Homo sapiens
cagagcctttggatgaccag

SEQ ID NO: 4184331 - DNA, 20 bp, Homo sapiens
cagagctgatggagaaggaa

SEQ ID NO: 4184332 - DNA, 21 bp, Homo sapiens
cagagctgatggagaaggaag

SEQ ID NO: 4184333 - DNA, 22 bp, Homo sapiens
cagagctgatggagaaggaagg

SEQ ID NO: 4184334 - DNA, 15 bp, Homo sapiens
cagagctggctgtct

SEQ ID NO: 4184335 - DNA, 22 bp, Homo sapiens
cagagctgtggactttgttcac

SEQ ID NO: 4184336 - DNA, 18 bp, Homo sapiens
cagaggacagtctggaga

SEQ ID NO: 4184337 - DNA, 16 bp, Homo sapiens
cagagggataaggcag

SEQ ID NO: 4184338 - DNA, 22 bp, Homo sapiens
cagagggcccaggcaggccacc

SEQ ID NO: 4184339 - DNA, 23 bp, Homo sapiens
cagaggggaaaccagtgtagcct

SEQ ID NO: 4184340 - DNA, 21 bp, Homo sapiens
cagaggtaaaagtgtgagcag

SEQ ID NO: 4184341 - DNA, 22 bp, Homo sapiens
cagaggttttaggaaacctggc

SEQ ID NO: 4184342 - DNA, 13 bp, Homo sapiens
cagagtatgacga

SEQ ID NO: 4184343 - DNA, 22 bp, Homo sapiens
cagagtcagccattcctgttct

SEQ ID NO: 4184344 - DNA, 17 bp, Homo sapiens
cagagtcaggaagagat

SEQ ID NO: 4184345 - DNA, 14 bp, Homo sapiens
cagagtgaaataaa

SEQ ID NO: 4184346 - DNA, 20 bp, Homo sapiens
cagataaggtaaaatgccat

SEQ ID NO: 4184347 - DNA, 17 bp, Homo sapiens
cagataatcagcctctt

SEQ ID NO: 4184348 - DNA, 18 bp, Homo sapiens
cagatagacagtgctgcc

SEQ ID NO: 4184349 - DNA, 20 bp, Homo sapiens
cagatatatatcatattggt

SEQ ID NO: 4184350 - DNA, 13 bp, Homo sapiens
cagatatattttt

SEQ ID NO: 4184351 - DNA, 18 bp, Homo sapiens
cagatatatttttcacag

SEQ ID NO: 4184352 - DNA, 13 bp, Homo sapiens
cagatctgcactg

SEQ ID NO: 4184353 - DNA, 16 bp, Homo sapiens
cagatctgcactgggt

SEQ ID NO: 4184354 - DNA, 21 bp, Homo sapiens
cagatcttccgtggtcagagt

SEQ ID NO: 4184355 - DNA, 17 bp, Homo sapiens
cagatgaagctttggcc

SEQ ID NO: 4184356 - DNA, 17 bp, Homo sapiens
cagatgattttcctccc

SEQ ID NO: 4184357 - DNA, 15 bp, Homo sapiens
cagatgcccagaggg

SEQ ID NO: 4184358 - DNA, 19 bp, Homo sapiens
cagatgcccagagggccca

SEQ ID NO: 4184359 - DNA, 20 bp, Homo sapiens
cagatgctgtcactggcaga

SEQ ID NO: 4184360 - DNA, 13 bp, Homo sapiens
cagatggaaaaat

SEQ ID NO: 4184361 - DNA, 13 bp, Homo sapiens
cagatgggacaag

SEQ ID NO: 4184362 - DNA, 17 bp, Homo sapiens
cagatgtgaaccattaa

SEQ ID NO: 4184363 - DNA, 23 bp, Homo sapiens
cagatgtgtctgggagagcctgg

SEQ ID NO: 4184364 - DNA, 19 bp, Homo sapiens
cagattgttagagagtata

SEQ ID NO: 4184365 - DNA, 17 bp, Homo sapiens
cagatttttgtaataaa

SEQ ID NO: 4184366 - DNA, 15 bp, Homo sapiens
cagcaactcccacga

SEQ ID NO: 4184367 - DNA, 13 bp, Homo sapiens
cagcaaggaaaca

SEQ ID NO: 4184368 - DNA, 15 bp, Homo sapiens
cagcaattgtagaca

SEQ ID NO: 4184369 - DNA, 23 bp, Homo sapiens
cagcactcagaaaagaaaaccat

SEQ ID NO: 4184370 - DNA, 17 bp, Homo sapiens
cagcactttaaccctct

SEQ ID NO: 4184371 - DNA, 20 bp, Homo sapiens
cagcactttaaccctctctt

SEQ ID NO: 4184372 - DNA, 18 bp, Homo sapiens
cagcactttgggaggctg

SEQ ID NO: 4184373 - DNA, 14 bp, Homo sapiens
cagcagaggacagt

SEQ ID NO: 4184374 - DNA, 22 bp, Homo sapiens
cagcagaggacagtctggagaa

SEQ ID NO: 4184375 - DNA, 18 bp, Homo sapiens
cagcagatggaaagaaag

SEQ ID NO: 4184376 - DNA, 15 bp, Homo sapiens
cagcagcatctactc

SEQ ID NO: 4184377 - DNA, 17 bp, Homo sapiens
cagcagccccctgcccg

SEQ ID NO: 4184378 - DNA, 18 bp, Homo sapiens
cagcagctgaacagccaa

SEQ ID NO: 4184379 - DNA, 20 bp, Homo sapiens
cagcagctgaacagccaaat

SEQ ID NO: 4184380 - DNA, 12 bp, Homo sapiens
cagcaggcaggc

SEQ ID NO: 4184381 - DNA, 13 bp, Homo sapiens
cagcaggcaggca

SEQ ID NO: 4184382 - DNA, 17 bp, Homo sapiens
cagcagttccatgaaga

SEQ ID NO: 4184383 - DNA, 16 bp, Homo sapiens
cagcagttgtaaaatt

SEQ ID NO: 4184384 - DNA, 19 bp, Homo sapiens
cagccaacaggtggcagga

SEQ ID NO: 4184385 - DNA, 23 bp, Homo sapiens
cagccaacaggtggcaggaccag

SEQ ID NO: 4184386 - DNA, 23 bp, Homo sapiens
cagccactcgggaggctgagaca

SEQ ID NO: 4184387 - DNA, 15 bp, Homo sapiens
cagccagccaggaac

SEQ ID NO: 4184388 - DNA, 22 bp, Homo sapiens
cagccagccaggaactggctcc

SEQ ID NO: 4184389 - DNA, 11 bp, Homo sapiens
cagccagggcc

SEQ ID NO: 4184390 - DNA, 12 bp, Homo sapiens
cagccagggcca

SEQ ID NO: 4184391 - DNA, 15 bp, Homo sapiens
cagccagggccaggg

SEQ ID NO: 4184392 - DNA, 22 bp, Homo sapiens
cagccagttttcacaatgccta

SEQ ID NO: 4184393 - DNA, 20 bp, Homo sapiens
cagcccacggggatcacagc

SEQ ID NO: 4184394 - DNA, 15 bp, Homo sapiens
cagcccagcacaacc

SEQ ID NO: 4184395 - DNA, 15 bp, Homo sapiens
cagcccccactttcc

SEQ ID NO: 4184396 - DNA, 19 bp, Homo sapiens
cagccccgacccctgtcca

SEQ ID NO: 4184397 - DNA, 21 bp, Homo sapiens
cagcccgggtgtgcctgccct

SEQ ID NO: 4184398 - DNA, 12 bp, Homo sapiens
cagccctgccta

SEQ ID NO: 4184399 - DNA, 21 bp, Homo sapiens
cagccctgcctatcctctgta

SEQ ID NO: 4184400 - DNA, 22 bp, Homo sapiens
cagcccttcagacgagatcctg

SEQ ID NO: 4184401 - DNA, 18 bp, Homo sapiens
cagccgcagacaagtaat

SEQ ID NO: 4184402 - DNA, 18 bp, Homo sapiens
cagccgccgggcaggcct

SEQ ID NO: 4184403 - DNA, 17 bp, Homo sapiens
cagccgtgagcatgttt

SEQ ID NO: 4184404 - DNA, 17 bp, Homo sapiens
cagcctccgccattcca

SEQ ID NO: 4184405 - DNA, 18 bp, Homo sapiens
cagcctgagcggaggctc

SEQ ID NO: 4184406 - DNA, 20 bp, Homo sapiens
cagcctgagcggaggctcgg

SEQ ID NO: 4184407 - DNA, 19 bp, Homo sapiens
cagcctgaggctgagactg

SEQ ID NO: 4184408 - DNA, 15 bp, Homo sapiens
cagcctggccatccc

SEQ ID NO: 4184409 - DNA, 15 bp, Homo sapiens
cagcctggcttctgg

SEQ ID NO: 4184410 - DNA, 17 bp, Homo sapiens
cagcctggcttctggag

SEQ ID NO: 4184411 - DNA, 19 bp, Homo sapiens
cagcctggcttctggagcc

SEQ ID NO: 4184412 - DNA, 15 bp, Homo sapiens
cagcctgggcgacag

SEQ ID NO: 4184413 - DNA, 19 bp, Homo sapiens
cagcctgggcgacagagca

SEQ ID NO: 4184414 - DNA, 21 bp, Homo sapiens
cagcctgggcgacagagcaag

SEQ ID NO: 4184415 - DNA, 22 bp, Homo sapiens
cagcctggggtgatagaacaag

SEQ ID NO: 4184416 - DNA, 23 bp, Homo sapiens
cagcctgggtaggaaaattagaa

SEQ ID NO: 4184417 - DNA, 16 bp, Homo sapiens
cagcctggttttcaca

SEQ ID NO: 4184418 - DNA, 17 bp, Homo sapiens
cagcctgtcctggtaca

SEQ ID NO: 4184419 - DNA, 18 bp, Homo sapiens
cagcctgtcctggtacag

SEQ ID NO: 4184420 - DNA, 22 bp, Homo sapiens
cagcctgtcctggtacagcagg

SEQ ID NO: 4184421 - DNA, 20 bp, Homo sapiens
cagcgagaggcagagaaaga

SEQ ID NO: 4184422 - DNA, 22 bp, Homo sapiens
cagcgagttgtggaaagcctct

SEQ ID NO: 4184423 - DNA, 23 bp, Homo sapiens
cagcgcagccgccgggcaggcct

SEQ ID NO: 4184424 - DNA, 13 bp, Homo sapiens
cagcgttcatgtt

SEQ ID NO: 4184425 - DNA, 14 bp, Homo sapiens
cagctacccaggag

SEQ ID NO: 4184426 - DNA, 15 bp, Homo sapiens
cagctactcagaagc

SEQ ID NO: 4184427 - DNA, 19 bp, Homo sapiens
cagctactgatttttgtga

SEQ ID NO: 4184428 - DNA, 23 bp, Homo sapiens
cagctagaaataagcccaacaga

SEQ ID NO: 4184429 - DNA, 15 bp, Homo sapiens
cagctaggcatgcct

SEQ ID NO: 4184430 - DNA, 12 bp, Homo sapiens
cagctatgtaaa

SEQ ID NO: 4184431 - DNA, 14 bp, Homo sapiens
cagctctcagggct

SEQ ID NO: 4184432 - DNA, 17 bp, Homo sapiens
cagctctcagggctgtc

SEQ ID NO: 4184433 - DNA, 16 bp, Homo sapiens
cagctctctctacccg

SEQ ID NO: 4184434 - DNA, 23 bp, Homo sapiens
cagctctctctacccggcccaga

SEQ ID NO: 4184435 - DNA, 12 bp, Homo sapiens
cagctctggctt

SEQ ID NO: 4184436 - DNA, 18 bp, Homo sapiens
cagctcttcactcagcca

SEQ ID NO: 4184437 - DNA, 21 bp, Homo sapiens
cagctcttcactcagccacac

SEQ ID NO: 4184438 - DNA, 17 bp, Homo sapiens
cagctgcacctgccagc

SEQ ID NO: 4184439 - DNA, 21 bp, Homo sapiens
cagctgcacctgccagcctgg

SEQ ID NO: 4184440 - DNA, 12 bp, Homo sapiens
cagctgcctggg

SEQ ID NO: 4184441 - DNA, 20 bp, Homo sapiens
cagctgcggcatccctgtgt

SEQ ID NO: 4184442 - DNA, 18 bp, Homo sapiens
cagctggctctccacctt

SEQ ID NO: 4184443 - DNA, 11 bp, Homo sapiens
cagctggtggc

SEQ ID NO: 4184444 - DNA, 18 bp, Homo sapiens
cagctgtaacacagctga

SEQ ID NO: 4184445 - DNA, 20 bp, Homo sapiens
cagctgtaacacagctgaga

SEQ ID NO: 4184446 - DNA, 17 bp, Homo sapiens
cagctgtagctcccgag

SEQ ID NO: 4184447 - DNA, 18 bp, Homo sapiens
cagctgtgaacatggact

SEQ ID NO: 4184448 - DNA, 20 bp, Homo sapiens
cagctgtgaacatggactct

SEQ ID NO: 4184449 - DNA, 21 bp, Homo sapiens
cagctgttttcaaagcccccg

SEQ ID NO: 4184450 - DNA, 23 bp, Homo sapiens
cagcttatggggtattttaagca

SEQ ID NO: 4184451 - DNA, 12 bp, Homo sapiens
cagcttcagttg

SEQ ID NO: 4184452 - DNA, 20 bp, Homo sapiens
cagcttccccaggagctctc

SEQ ID NO: 4184453 - DNA, 23 bp, Homo sapiens
cagcttccccaggagctctctgc

SEQ ID NO: 4184454 - DNA, 14 bp, Homo sapiens
cagcttctccaggc

SEQ ID NO: 4184455 - DNA, 17 bp, Homo sapiens
cagcttttgcagaagca

SEQ ID NO: 4184456 - DNA, 16 bp, Homo sapiens
cagctttttctctcag

SEQ ID NO: 4184457 - DNA, 19 bp, Homo sapiens
caggaaagacaggctgagc

SEQ ID NO: 4184458 - DNA, 18 bp, Homo sapiens
caggaacagaacacttct

SEQ ID NO: 4184459 - DNA, 19 bp, Homo sapiens
caggaacgttgccacacca

SEQ ID NO: 4184460 - DNA, 21 bp, Homo sapiens
caggaagaatgggctgcagaa

SEQ ID NO: 4184461 - DNA, 21 bp, Homo sapiens
caggaagctttggtgagaacc

SEQ ID NO: 4184462 - DNA, 19 bp, Homo sapiens
caggaaggactatgaaaag

SEQ ID NO: 4184463 - DNA, 21 bp, Homo sapiens
caggaagggggtccacccagc

SEQ ID NO: 4184464 - DNA, 17 bp, Homo sapiens
caggaataggcatttgc

SEQ ID NO: 4184465 - DNA, 14 bp, Homo sapiens
caggaatcttaagg

SEQ ID NO: 4184466 - DNA, 20 bp, Homo sapiens
caggaatggggatccagtta

SEQ ID NO: 4184467 - DNA, 17 bp, Homo sapiens
caggacatttacctctt

SEQ ID NO: 4184468 - DNA, 12 bp, Homo sapiens
caggaccacaaa

SEQ ID NO: 4184469 - DNA, 16 bp, Homo sapiens
caggaccacaaaaatg

SEQ ID NO: 4184470 - DNA, 15 bp, Homo sapiens
caggaccccaacccc

SEQ ID NO: 4184471 - DNA, 14 bp, Homo sapiens
caggaccctgtcag

SEQ ID NO: 4184472 - DNA, 16 bp, Homo sapiens
caggactatagcccag

SEQ ID NO: 4184473 - DNA, 18 bp, Homo sapiens
caggactatagcccaggt

SEQ ID NO: 4184474 - DNA, 16 bp, Homo sapiens
caggactccccaggcc

SEQ ID NO: 4184475 - DNA, 18 bp, Homo sapiens
caggactccccaggccag

SEQ ID NO: 4184476 - DNA, 20 bp, Homo sapiens
caggactccccaggccaggc

SEQ ID NO: 4184477 - DNA, 22 bp, Homo sapiens
caggactgtgataatcagaagc

SEQ ID NO: 4184478 - DNA, 23 bp, Homo sapiens
caggactgtgataatcagaagct

SEQ ID NO: 4184479 - DNA, 14 bp, Homo sapiens
caggagacaggaag

SEQ ID NO: 4184480 - DNA, 14 bp, Homo sapiens
caggagcagaaaga

SEQ ID NO: 4184481 - DNA, 17 bp, Homo sapiens
caggagctctctgctga

SEQ ID NO: 4184482 - DNA, 18 bp, Homo sapiens
caggagctctctgctgag

SEQ ID NO: 4184483 - DNA, 21 bp, Homo sapiens
caggagctctctgctgagcag

SEQ ID NO: 4184484 - DNA, 20 bp, Homo sapiens
caggaggatcacttgggccc

SEQ ID NO: 4184485 - DNA, 20 bp, Homo sapiens
caggaggctgaggcaggaga

SEQ ID NO: 4184486 - DNA, 21 bp, Homo sapiens
caggaggctgaggcaggagaa

SEQ ID NO: 4184487 - DNA, 16 bp, Homo sapiens
caggagggtaacagaa

SEQ ID NO: 4184488 - DNA, 19 bp, Homo sapiens
caggagggtaacagaagag

SEQ ID NO: 4184489 - DNA, 18 bp, Homo sapiens
caggagtttgaggctgca

SEQ ID NO: 4184490 - DNA, 23 bp, Homo sapiens
caggatactctgtcagatgggaa

SEQ ID NO: 4184491 - DNA, 16 bp, Homo sapiens
caggatagagactgga

SEQ ID NO: 4184492 - DNA, 19 bp, Homo sapiens
caggatagagactggaaca

SEQ ID NO: 4184493 - DNA, 20 bp, Homo sapiens
caggatcctattctcaccag

SEQ ID NO: 4184494 - DNA, 19 bp, Homo sapiens
caggatgccaagtggccct

SEQ ID NO: 4184495 - DNA, 18 bp, Homo sapiens
caggatgtaggggttaac

SEQ ID NO: 4184496 - DNA, 23 bp, Homo sapiens
caggattgcaggtgcctggcttg

SEQ ID NO: 4184497 - DNA, 21 bp, Homo sapiens
caggattggcctgtgtctggc

SEQ ID NO: 4184498 - DNA, 15 bp, Homo sapiens
caggcaaagctggag

SEQ ID NO: 4184499 - DNA, 16 bp, Homo sapiens
caggcaccccctggag

SEQ ID NO: 4184500 - DNA, 21 bp, Homo sapiens
caggcactgcaaaccgccacc

SEQ ID NO: 4184501 - DNA, 23 bp, Homo sapiens
caggcagagatcaggtgggcaga

SEQ ID NO: 4184502 - DNA, 13 bp, Homo sapiens
caggcaggaggat

SEQ ID NO: 4184503 - DNA, 14 bp, Homo sapiens
caggcaggcactgt

SEQ ID NO: 4184504 - DNA, 15 bp, Homo sapiens
caggcaggcactgtg

SEQ ID NO: 4184505 - DNA, 18 bp, Homo sapiens
caggcagggcaaaggtca

SEQ ID NO: 4184506 - DNA, 23 bp, Homo sapiens
caggcagggcaaaggtcaagact

SEQ ID NO: 4184507 - DNA, 18 bp, Homo sapiens
caggcaggggtgggagag

SEQ ID NO: 4184508 - DNA, 15 bp, Homo sapiens
caggcatgctggcct

SEQ ID NO: 4184509 - DNA, 24 bp, Homo sapiens
caggcattgaatgacaagcatcag

SEQ ID NO: 4184510 - DNA, 15 bp, Homo sapiens
caggccaccaggatg

SEQ ID NO: 4184511 - DNA, 18 bp, Homo sapiens
caggccacgctcaggccc

SEQ ID NO: 4184512 - DNA, 13 bp, Homo sapiens
caggccagagcca

SEQ ID NO: 4184513 - DNA, 17 bp, Homo sapiens
caggccagtgggcctgg

SEQ ID NO: 4184514 - DNA, 18 bp, Homo sapiens
caggccagtgggcctggt

SEQ ID NO: 4184515 - DNA, 19 bp, Homo sapiens
caggccagtgggcctggta

SEQ ID NO: 4184516 - DNA, 21 bp, Homo sapiens
caggcccacagcgtgggaact

SEQ ID NO: 4184517 - DNA, 22 bp, Homo sapiens
caggccggtgtgggctgtgtcg

SEQ ID NO: 4184518 - DNA, 20 bp, Homo sapiens
caggccttagtacggctgct

SEQ ID NO: 4184519 - DNA, 21 bp, Homo sapiens
caggccttagtacggctgctg

SEQ ID NO: 4184520 - DNA, 24 bp, Homo sapiens
caggccttagtacggctgctgcac

SEQ ID NO: 4184521 - DNA, 13 bp, Homo sapiens
caggctaattttt

SEQ ID NO: 4184522 - DNA, 21 bp, Homo sapiens
caggctcccactgcccctgca

SEQ ID NO: 4184523 - DNA, 16 bp, Homo sapiens
caggctcccagggaca

SEQ ID NO: 4184524 - DNA, 20 bp, Homo sapiens
caggctggtctcgaactcct

SEQ ID NO: 4184525 - DNA, 22 bp, Homo sapiens
caggctgtgtttggctttcagg

SEQ ID NO: 4184526 - DNA, 14 bp, Homo sapiens
caggcttccttggc

SEQ ID NO: 4184527 - DNA, 19 bp, Homo sapiens
cagggaacattggagctga

SEQ ID NO: 4184528 - DNA, 19 bp, Homo sapiens
cagggaaccctgcttgcac

SEQ ID NO: 4184529 - DNA, 17 bp, Homo sapiens
cagggacacctgggaga

SEQ ID NO: 4184530 - DNA, 22 bp, Homo sapiens
cagggacacctgggagaaatct

SEQ ID NO: 4184531 - DNA, 16 bp, Homo sapiens
cagggacagagatgga

SEQ ID NO: 4184532 - DNA, 16 bp, Homo sapiens
cagggacggggactgg

SEQ ID NO: 4184533 - DNA, 17 bp, Homo sapiens
cagggacggggactggc

SEQ ID NO: 4184534 - DNA, 22 bp, Homo sapiens
cagggagaccgagcgctttctg

SEQ ID NO: 4184535 - DNA, 21 bp, Homo sapiens
cagggagagcgcctcttcctc

SEQ ID NO: 4184536 - DNA, 15 bp, Homo sapiens
cagggaggaggcaga

SEQ ID NO: 4184537 - DNA, 19 bp, Homo sapiens
cagggaggaggtggcagcc

SEQ ID NO: 4184538 - DNA, 23 bp, Homo sapiens
cagggaggaggtggcagccctgt

SEQ ID NO: 4184539 - DNA, 17 bp, Homo sapiens
cagggaggccctgtgcc

SEQ ID NO: 4184540 - DNA, 17 bp, Homo sapiens
cagggatcttgcattcc

SEQ ID NO: 4184541 - DNA, 19 bp, Homo sapiens
cagggatcttgcattccca

SEQ ID NO: 4184542 - DNA, 14 bp, Homo sapiens
cagggatttgagga

SEQ ID NO: 4184543 - DNA, 22 bp, Homo sapiens
cagggccaagcgggggcgtggc

SEQ ID NO: 4184544 - DNA, 15 bp, Homo sapiens
cagggctaccctccc

SEQ ID NO: 4184545 - DNA, 17 bp, Homo sapiens
cagggctaccctccccc

SEQ ID NO: 4184546 - DNA, 21 bp, Homo sapiens
cagggctccctcctggagcat

SEQ ID NO: 4184547 - DNA, 16 bp, Homo sapiens
cagggctgctgtggcc

SEQ ID NO: 4184548 - DNA, 21 bp, Homo sapiens
caggggccagtgagggctggg

SEQ ID NO: 4184549 - DNA, 19 bp, Homo sapiens
caggggggttgtgaggcct

SEQ ID NO: 4184550 - DNA, 14 bp, Homo sapiens
caggggtcagtgca

SEQ ID NO: 4184551 - DNA, 21 bp, Homo sapiens
caggggtcagtgcagcagagg

SEQ ID NO: 4184552 - DNA, 16 bp, Homo sapiens
caggggtctccctgga

SEQ ID NO: 4184553 - DNA, 17 bp, Homo sapiens
caggggtctccctggag

SEQ ID NO: 4184554 - DNA, 20 bp, Homo sapiens
caggggtgatttcagagagg

SEQ ID NO: 4184555 - DNA, 17 bp, Homo sapiens
caggggtgggagagcca

SEQ ID NO: 4184556 - DNA, 23 bp, Homo sapiens
caggggtgggagagccagctctc

SEQ ID NO: 4184557 - DNA, 16 bp, Homo sapiens
cagggtccctggatca

SEQ ID NO: 4184558 - DNA, 15 bp, Homo sapiens
cagggtctaaagaga

SEQ ID NO: 4184559 - DNA, 14 bp, Homo sapiens
cagggtgagagctg

SEQ ID NO: 4184560 - DNA, 21 bp, Homo sapiens
cagggtgagagctgctctgga

SEQ ID NO: 4184561 - DNA, 18 bp, Homo sapiens
cagggtgggccactctcc

SEQ ID NO: 4184562 - DNA, 19 bp, Homo sapiens
cagggtgggccactctccc

SEQ ID NO: 4184563 - DNA, 20 bp, Homo sapiens
cagggtgggccactctcccc

SEQ ID NO: 4184564 - DNA, 15 bp, Homo sapiens
cagggttctgagtca

SEQ ID NO: 4184565 - DNA, 14 bp, Homo sapiens
caggtaagtggcag

SEQ ID NO: 4184566 - DNA, 18 bp, Homo sapiens
caggtaagtggcaggacc

SEQ ID NO: 4184567 - DNA, 15 bp, Homo sapiens
caggtaatgagggac

SEQ ID NO: 4184568 - DNA, 17 bp, Homo sapiens
caggtaatgagggactg

SEQ ID NO: 4184569 - DNA, 22 bp, Homo sapiens
caggtaatgagggactggaacc

SEQ ID NO: 4184570 - DNA, 13 bp, Homo sapiens
caggtagtactgg

SEQ ID NO: 4184571 - DNA, 15 bp, Homo sapiens
caggtatctccagga

SEQ ID NO: 4184572 - DNA, 13 bp, Homo sapiens
caggtccaggctg

SEQ ID NO: 4184573 - DNA, 13 bp, Homo sapiens
caggtccggaggg

SEQ ID NO: 4184574 - DNA, 13 bp, Homo sapiens
caggtgcctggct

SEQ ID NO: 4184575 - DNA, 16 bp, Homo sapiens
caggtgcctggcttgc

SEQ ID NO: 4184576 - DNA, 17 bp, Homo sapiens
caggtgcctggcttgct

SEQ ID NO: 4184577 - DNA, 21 bp, Homo sapiens
caggtgcctggcttgctgtgg

SEQ ID NO: 4184578 - DNA, 16 bp, Homo sapiens
caggtggcaggaccag

SEQ ID NO: 4184579 - DNA, 21 bp, Homo sapiens
caggtggcaggaccaggacta

SEQ ID NO: 4184580 - DNA, 13 bp, Homo sapiens
caggtgtaataag

SEQ ID NO: 4184581 - DNA, 18 bp, Homo sapiens
caggtgttggaagccagg

SEQ ID NO: 4184582 - DNA, 22 bp, Homo sapiens
caggttagggtgtgtgccacac

SEQ ID NO: 4184583 - DNA, 21 bp, Homo sapiens
caggtttggggagggggaaga

SEQ ID NO: 4184584 - DNA, 17 bp, Homo sapiens
cagtaaataaattgttt

SEQ ID NO: 4184585 - DNA, 19 bp, Homo sapiens
cagtaaataaattgtttga

SEQ ID NO: 4184586 - DNA, 14 bp, Homo sapiens
cagtaacacatctt

SEQ ID NO: 4184587 - DNA, 18 bp, Homo sapiens
cagtaacacatctttaat

SEQ ID NO: 4184588 - DNA, 17 bp, Homo sapiens
cagtaacactggccttc

SEQ ID NO: 4184589 - DNA, 14 bp, Homo sapiens
cagtaatttagaaa

SEQ ID NO: 4184590 - DNA, 23 bp, Homo sapiens
cagtacagagaaattctgtggtg

SEQ ID NO: 4184591 - DNA, 12 bp, Homo sapiens
cagtactgggaa

SEQ ID NO: 4184592 - DNA, 13 bp, Homo sapiens
cagtatatttata

SEQ ID NO: 4184593 - DNA, 18 bp, Homo sapiens
cagtattccatgggatgt

SEQ ID NO: 4184594 - DNA, 23 bp, Homo sapiens
cagtattttggagaaattattta

SEQ ID NO: 4184595 - DNA, 15 bp, Homo sapiens
cagtcaagatacata

SEQ ID NO: 4184596 - DNA, 15 bp, Homo sapiens
cagtcaattttacaa

SEQ ID NO: 4184597 - DNA, 14 bp, Homo sapiens
cagtcagggcccag

SEQ ID NO: 4184598 - DNA, 20 bp, Homo sapiens
cagtcatgaggaaagacaca

SEQ ID NO: 4184599 - DNA, 16 bp, Homo sapiens
cagtccagatgccttc

SEQ ID NO: 4184600 - DNA, 19 bp, Homo sapiens
cagtccagatgccttcctg

SEQ ID NO: 4184601 - DNA, 13 bp, Homo sapiens
cagtccccagcta

SEQ ID NO: 4184602 - DNA, 16 bp, Homo sapiens
cagtcccttgctgaca

SEQ ID NO: 4184603 - DNA, 17 bp, Homo sapiens
cagtccgtccaccacct

SEQ ID NO: 4184604 - DNA, 12 bp, Homo sapiens
cagtcctgggag

SEQ ID NO: 4184605 - DNA, 23 bp, Homo sapiens
cagtcctgggagaacctcaggct

SEQ ID NO: 4184606 - DNA, 18 bp, Homo sapiens
cagtcgtccgctcagcca

SEQ ID NO: 4184607 - DNA, 22 bp, Homo sapiens
cagtctaaagctggtttaatgt

SEQ ID NO: 4184608 - DNA, 19 bp, Homo sapiens
cagtctcagaatgtcattt

SEQ ID NO: 4184609 - DNA, 19 bp, Homo sapiens
cagtctcaggagcatgggg

SEQ ID NO: 4184610 - DNA, 13 bp, Homo sapiens
cagtctcagtcca

SEQ ID NO: 4184611 - DNA, 15 bp, Homo sapiens
cagtctcagtccaga

SEQ ID NO: 4184612 - DNA, 23 bp, Homo sapiens
cagtctcagtccagatgccttcc

SEQ ID NO: 4184613 - DNA, 12 bp, Homo sapiens
cagtctggaaga

SEQ ID NO: 4184614 - DNA, 14 bp, Homo sapiens
cagtctggaagaag

SEQ ID NO: 4184615 - DNA, 17 bp, Homo sapiens
cagtctggaagaagagg

SEQ ID NO: 4184616 - DNA, 14 bp, Homo sapiens
cagtctgtgggagc

SEQ ID NO: 4184617 - DNA, 17 bp, Homo sapiens
cagtctgtgggagctca

SEQ ID NO: 4184618 - DNA, 13 bp, Homo sapiens
cagtgaagacaga

SEQ ID NO: 4184619 - DNA, 15 bp, Homo sapiens
cagtgaatttctgat

SEQ ID NO: 4184620 - DNA, 16 bp, Homo sapiens
cagtgacaagtagggc

SEQ ID NO: 4184621 - DNA, 17 bp, Homo sapiens
cagtgacgtgcacctgt

SEQ ID NO: 4184622 - DNA, 20 bp, Homo sapiens
cagtgagattacagaggaag

SEQ ID NO: 4184623 - DNA, 16 bp, Homo sapiens
cagtgaggggagatgc

SEQ ID NO: 4184624 - DNA, 18 bp, Homo sapiens
cagtgagttacagcgaga

SEQ ID NO: 4184625 - DNA, 22 bp, Homo sapiens
cagtgatcctcaaacacacaaa

SEQ ID NO: 4184626 - DNA, 16 bp, Homo sapiens
cagtgcagcagaggac

SEQ ID NO: 4184627 - DNA, 12 bp, Homo sapiens
cagtgccacaga

SEQ ID NO: 4184628 - DNA, 15 bp, Homo sapiens
cagtgcccagctaat

SEQ ID NO: 4184629 - DNA, 23 bp, Homo sapiens
cagtgctattttgtgcccactgt

SEQ ID NO: 4184630 - DNA, 12 bp, Homo sapiens
cagtgctgtgct

SEQ ID NO: 4184631 - DNA, 15 bp, Homo sapiens
cagtgctgtggcctg

SEQ ID NO: 4184632 - DNA, 15 bp, Homo sapiens
cagtgcttcagcctg

SEQ ID NO: 4184633 - DNA, 16 bp, Homo sapiens
cagtgcttcagcctga

SEQ ID NO: 4184634 - DNA, 18 bp, Homo sapiens
cagtgcttcagcctgagg

SEQ ID NO: 4184635 - DNA, 23 bp, Homo sapiens
cagtggaaaaatcagaagcacaa

SEQ ID NO: 4184636 - DNA, 12 bp, Homo sapiens
cagtggaaattt

SEQ ID NO: 4184637 - DNA, 13 bp, Homo sapiens
cagtggagaatta

SEQ ID NO: 4184638 - DNA, 21 bp, Homo sapiens
cagtggcaggacccttaggaa

SEQ ID NO: 4184639 - DNA, 14 bp, Homo sapiens
cagtggctcatgcc

SEQ ID NO: 4184640 - DNA, 21 bp, Homo sapiens
cagtgggaggtgagaccacct

SEQ ID NO: 4184641 - DNA, 12 bp, Homo sapiens
cagtgggcctgg

SEQ ID NO: 4184642 - DNA, 18 bp, Homo sapiens
cagtgggctccctggccc

SEQ ID NO: 4184643 - DNA, 19 bp, Homo sapiens
cagtgggctccctggccca

SEQ ID NO: 4184644 - DNA, 22 bp, Homo sapiens
cagtgggctccctggcccagcc

SEQ ID NO: 4184645 - DNA, 17 bp, Homo sapiens
cagtggtaagctctggc

SEQ ID NO: 4184646 - DNA, 18 bp, Homo sapiens
cagtggtcaaaccgcact

SEQ ID NO: 4184647 - DNA, 19 bp, Homo sapiens
cagtgtagccttgcccgga

SEQ ID NO: 4184648 - DNA, 11 bp, Homo sapiens
cagtgtgtgtg

SEQ ID NO: 4184649 - DNA, 14 bp, Homo sapiens
cagttacaaaaata

SEQ ID NO: 4184650 - DNA, 22 bp, Homo sapiens
cagttacataattcactctgag

SEQ ID NO: 4184651 - DNA, 15 bp, Homo sapiens
cagttcaaagcagga

SEQ ID NO: 4184652 - DNA, 13 bp, Homo sapiens
cagttcataatat

SEQ ID NO: 4184653 - DNA, 15 bp, Homo sapiens
cagttcataatatat

SEQ ID NO: 4184654 - DNA, 19 bp, Homo sapiens
cagttcccgctctgcattg

SEQ ID NO: 4184655 - DNA, 18 bp, Homo sapiens
cagttgaacctgatgagc

SEQ ID NO: 4184656 - DNA, 16 bp, Homo sapiens
cagttgacagcaggtg

SEQ ID NO: 4184657 - DNA, 17 bp, Homo sapiens
cagttgacttactgttt

SEQ ID NO: 4184658 - DNA, 20 bp, Homo sapiens
cagttgagtcgtcatcactt

SEQ ID NO: 4184659 - DNA, 13 bp, Homo sapiens
cagttgtaaaatt

SEQ ID NO: 4184660 - DNA, 23 bp, Homo sapiens
cagttgtaaaattgttagtaaac

SEQ ID NO: 4184661 - DNA, 15 bp, Homo sapiens
cagttgtgtttggca

SEQ ID NO: 4184662 - DNA, 17 bp, Homo sapiens
cagttgttactgaagtt

SEQ ID NO: 4184663 - DNA, 17 bp, Homo sapiens
cagtttagcccatctct

SEQ ID NO: 4184664 - DNA, 18 bp, Homo sapiens
cagttttatccacagaaa

SEQ ID NO: 4184665 - DNA, 19 bp, Homo sapiens
cagttttcctatgctttga

SEQ ID NO: 4184666 - DNA, 15 bp, Homo sapiens
cataaaaatgatcta

SEQ ID NO: 4184667 - DNA, 17 bp, Homo sapiens
cataaactttataaatt

SEQ ID NO: 4184668 - DNA, 20 bp, Homo sapiens
cataaccattcccattggtt

SEQ ID NO: 4184669 - DNA, 21 bp, Homo sapiens
cataagaccataacagccaac

SEQ ID NO: 4184670 - DNA, 23 bp, Homo sapiens
cataagaccataacagccaacag

SEQ ID NO: 4184671 - DNA, 21 bp, Homo sapiens
cataagattaaaggaaggaaa

SEQ ID NO: 4184672 - DNA, 15 bp, Homo sapiens
cataagtaaacaaca

SEQ ID NO: 4184673 - DNA, 19 bp, Homo sapiens
cataagtaaacaacatatt

SEQ ID NO: 4184674 - DNA, 17 bp, Homo sapiens
cataattcactctgagt

SEQ ID NO: 4184675 - DNA, 23 bp, Homo sapiens
cataattcactctgagtgtttta

SEQ ID NO: 4184676 - DNA, 22 bp, Homo sapiens
cataatttagtttcatataaag

SEQ ID NO: 4184677 - DNA, 17 bp, Homo sapiens
catacactcaaacaatc

SEQ ID NO: 4184678 - DNA, 18 bp, Homo sapiens
catacagtcaagatacat

SEQ ID NO: 4184679 - DNA, 23 bp, Homo sapiens
catacgtgttctatagagcctgg

SEQ ID NO: 4184680 - DNA, 17 bp, Homo sapiens
catactgatccctttcc

SEQ ID NO: 4184681 - DNA, 18 bp, Homo sapiens
catagagggagaggaagc

SEQ ID NO: 4184682 - DNA, 21 bp, Homo sapiens
catagagggagaggaagcaca

SEQ ID NO: 4184683 - DNA, 18 bp, Homo sapiens
catagtattcatgactat

SEQ ID NO: 4184684 - DNA, 20 bp, Homo sapiens
catataaaaggtgagctcag

SEQ ID NO: 4184685 - DNA, 15 bp, Homo sapiens
catataaaatatatt

SEQ ID NO: 4184686 - DNA, 14 bp, Homo sapiens
catatatatactat

SEQ ID NO: 4184687 - DNA, 16 bp, Homo sapiens
catatatcttatgtta

SEQ ID NO: 4184688 - DNA, 23 bp, Homo sapiens
catatcaaaaagtattaaaacta

SEQ ID NO: 4184689 - DNA, 12 bp, Homo sapiens
catatcattttt

SEQ ID NO: 4184690 - DNA, 14 bp, Homo sapiens
catatctttatctt

SEQ ID NO: 4184691 - DNA, 13 bp, Homo sapiens
catatttatactt

SEQ ID NO: 4184692 - DNA, 13 bp, Homo sapiens
catattttgtata

SEQ ID NO: 4184693 - DNA, 20 bp, Homo sapiens
catcacagggcagagccggg

SEQ ID NO: 4184694 - DNA, 22 bp, Homo sapiens
catcaccatcgtgtttgcaaag

SEQ ID NO: 4184695 - DNA, 15 bp, Homo sapiens
catcacctcaggcca

SEQ ID NO: 4184696 - DNA, 12 bp, Homo sapiens
catcagggtggg

SEQ ID NO: 4184697 - DNA, 21 bp, Homo sapiens
catcagtcattcccacgcttg

SEQ ID NO: 4184698 - DNA, 22 bp, Homo sapiens
catccacccatgtttattaaga

SEQ ID NO: 4184699 - DNA, 23 bp, Homo sapiens
catccacccatgtttattaagaa

SEQ ID NO: 4184700 - DNA, 18 bp, Homo sapiens
catccataaagcaagctc

SEQ ID NO: 4184701 - DNA, 21 bp, Homo sapiens
catccataaagcaagctcaac

SEQ ID NO: 4184702 - DNA, 20 bp, Homo sapiens
catccatagtgcactagcat

SEQ ID NO: 4184703 - DNA, 15 bp, Homo sapiens
catccatgtttgtaa

SEQ ID NO: 4184704 - DNA, 19 bp, Homo sapiens
catccccagaggtgaccca

SEQ ID NO: 4184705 - DNA, 21 bp, Homo sapiens
catccccttgtgtcagagaca

SEQ ID NO: 4184706 - DNA, 15 bp, Homo sapiens
catccttctgccttt

SEQ ID NO: 4184707 - DNA, 13 bp, Homo sapiens
catcgtccagccc

SEQ ID NO: 4184708 - DNA, 15 bp, Homo sapiens
catcgtccagccctc

SEQ ID NO: 4184709 - DNA, 16 bp, Homo sapiens
catctacaagcatttg

SEQ ID NO: 4184710 - DNA, 22 bp, Homo sapiens
catctcagtgaagaatacttct

SEQ ID NO: 4184711 - DNA, 20 bp, Homo sapiens
catctcattgtagagcttgg

SEQ ID NO: 4184712 - DNA, 17 bp, Homo sapiens
catctctccagagagca

SEQ ID NO: 4184713 - DNA, 22 bp, Homo sapiens
catctctctactcctacctcag

SEQ ID NO: 4184714 - DNA, 15 bp, Homo sapiens
catctgggattccca

SEQ ID NO: 4184715 - DNA, 16 bp, Homo sapiens
catctgggattcccac

SEQ ID NO: 4184716 - DNA, 20 bp, Homo sapiens
catctgtcaccaattggtta

SEQ ID NO: 4184717 - DNA, 20 bp, Homo sapiens
catcttttaattcacctctt

SEQ ID NO: 4184718 - DNA, 19 bp, Homo sapiens
catgaaaaacacggcagct

SEQ ID NO: 4184719 - DNA, 13 bp, Homo sapiens
catgaacacagct

SEQ ID NO: 4184720 - DNA, 15 bp, Homo sapiens
catgaagacacgctt

SEQ ID NO: 4184721 - DNA, 13 bp, Homo sapiens
catgaagaccaca

SEQ ID NO: 4184722 - DNA, 20 bp, Homo sapiens
catgaatatttcaaaataaa

SEQ ID NO: 4184723 - DNA, 22 bp, Homo sapiens
catgaatatttcaaaataaact

SEQ ID NO: 4184724 - DNA, 12 bp, Homo sapiens
catgacatgtta

SEQ ID NO: 4184725 - DNA, 16 bp, Homo sapiens
catgacatgttatata

SEQ ID NO: 4184726 - DNA, 17 bp, Homo sapiens
catgacatttctaagtg

SEQ ID NO: 4184727 - DNA, 16 bp, Homo sapiens
catgagcaattctcct

SEQ ID NO: 4184728 - DNA, 12 bp, Homo sapiens
catgagccaccg

SEQ ID NO: 4184729 - DNA, 14 bp, Homo sapiens
catgagccaccgcg

SEQ ID NO: 4184730 - DNA, 14 bp, Homo sapiens
catgaggaaagaca

SEQ ID NO: 4184731 - DNA, 20 bp, Homo sapiens
catgaggacatgatggagcg

SEQ ID NO: 4184732 - DNA, 18 bp, Homo sapiens
catgataatgaacagaac

SEQ ID NO: 4184733 - DNA, 14 bp, Homo sapiens
catgatactttaat

SEQ ID NO: 4184734 - DNA, 22 bp, Homo sapiens
catgatagtgtgatttttttca

SEQ ID NO: 4184735 - DNA, 20 bp, Homo sapiens
catgatgcctctgtcttctg

SEQ ID NO: 4184736 - DNA, 22 bp, Homo sapiens
catgatgcctctgtcttctgga

SEQ ID NO: 4184737 - DNA, 18 bp, Homo sapiens
catgatggagcgcacctg

SEQ ID NO: 4184738 - DNA, 14 bp, Homo sapiens
catgatttctgtga

SEQ ID NO: 4184739 - DNA, 18 bp, Homo sapiens
catgatttctgtgaagca

SEQ ID NO: 4184740 - DNA, 17 bp, Homo sapiens
catgcacctcagggcca

SEQ ID NO: 4184741 - DNA, 13 bp, Homo sapiens
catgcatctgttt

SEQ ID NO: 4184742 - DNA, 20 bp, Homo sapiens
catgccgcggtaggtaaggg

SEQ ID NO: 4184743 - DNA, 17 bp, Homo sapiens
catgcctggcccccctc

SEQ ID NO: 4184744 - DNA, 20 bp, Homo sapiens
catgcctgggaatcctgctg

SEQ ID NO: 4184745 - DNA, 21 bp, Homo sapiens
catgcctgggaatcctgctgc

SEQ ID NO: 4184746 - DNA, 22 bp, Homo sapiens
catgcctgggaatcctgctgcc

SEQ ID NO: 4184747 - DNA, 20 bp, Homo sapiens
catgcctgtagctttcctgg

SEQ ID NO: 4184748 - DNA, 22 bp, Homo sapiens
catgcctgtagctttcctggtc

SEQ ID NO: 4184749 - DNA, 19 bp, Homo sapiens
catgctaagagaagtagaa

SEQ ID NO: 4184750 - DNA, 21 bp, Homo sapiens
catgctaagagaagtagaaat

SEQ ID NO: 4184751 - DNA, 20 bp, Homo sapiens
catgctcagccctgactggt

SEQ ID NO: 4184752 - DNA, 13 bp, Homo sapiens
catgctgaaggga

SEQ ID NO: 4184753 - DNA, 18 bp, Homo sapiens
catgctgaagggaccttg

SEQ ID NO: 4184754 - DNA, 23 bp, Homo sapiens
catgctggaaaataatactgctg

SEQ ID NO: 4184755 - DNA, 20 bp, Homo sapiens
catgctggcctcccaataaa

SEQ ID NO: 4184756 - DNA, 16 bp, Homo sapiens
catgctggcggcgcag

SEQ ID NO: 4184757 - DNA, 12 bp, Homo sapiens
catgcttaaata

SEQ ID NO: 4184758 - DNA, 14 bp, Homo sapiens
catgcttcttcctt

SEQ ID NO: 4184759 - DNA, 17 bp, Homo sapiens
catgcttcttctcatgg

SEQ ID NO: 4184760 - DNA, 14 bp, Homo sapiens
catgctttctcctt

SEQ ID NO: 4184761 - DNA, 15 bp, Homo sapiens
catgctttctccttt

SEQ ID NO: 4184762 - DNA, 15 bp, Homo sapiens
catggaaaagttctt

SEQ ID NO: 4184763 - DNA, 20 bp, Homo sapiens
catggaagattagaggtttg

SEQ ID NO: 4184764 - DNA, 19 bp, Homo sapiens
catggaaggttaggtttgt

SEQ ID NO: 4184765 - DNA, 24 bp, Homo sapiens
catggaaggttaggtttgtcaaca

SEQ ID NO: 4184766 - DNA, 19 bp, Homo sapiens
catggacacagacccacac

SEQ ID NO: 4184767 - DNA, 15 bp, Homo sapiens
catggagaggtttgt

SEQ ID NO: 4184768 - DNA, 15 bp, Homo sapiens
catggatgagagtcc

SEQ ID NO: 4184769 - DNA, 19 bp, Homo sapiens
catggccacaaagggacac

SEQ ID NO: 4184770 - DNA, 14 bp, Homo sapiens
catggctattttat

SEQ ID NO: 4184771 - DNA, 15 bp, Homo sapiens
catggctattttata

SEQ ID NO: 4184772 - DNA, 21 bp, Homo sapiens
catggctctgttatgcaagca

SEQ ID NO: 4184773 - DNA, 15 bp, Homo sapiens
catgggactgtgcct

SEQ ID NO: 4184774 - DNA, 15 bp, Homo sapiens
catgggcctgctgcg

SEQ ID NO: 4184775 - DNA, 20 bp, Homo sapiens
catgggtatagttcatgtct

SEQ ID NO: 4184776 - DNA, 18 bp, Homo sapiens
catggtcctttctggaag

SEQ ID NO: 4184777 - DNA, 20 bp, Homo sapiens
catggtgacatttgagatga

SEQ ID NO: 4184778 - DNA, 23 bp, Homo sapiens
catggtgtgaaagtcagatgccc

SEQ ID NO: 4184779 - DNA, 16 bp, Homo sapiens
catggttttacagtga

SEQ ID NO: 4184780 - DNA, 16 bp, Homo sapiens
catgtaaattttgtat

SEQ ID NO: 4184781 - DNA, 18 bp, Homo sapiens
catgtaatgaatggtcag

SEQ ID NO: 4184782 - DNA, 12 bp, Homo sapiens
catgtatgtgtg

SEQ ID NO: 4184783 - DNA, 13 bp, Homo sapiens
catgtatgtgtgt

SEQ ID NO: 4184784 - DNA, 16 bp, Homo sapiens
catgtctgtcctcaga

SEQ ID NO: 4184785 - DNA, 17 bp, Homo sapiens
catgtctgtcctcagag

SEQ ID NO: 4184786 - DNA, 20 bp, Homo sapiens
catgtggtttatagagggcc

SEQ ID NO: 4184787 - DNA, 19 bp, Homo sapiens
catgtgttagtgtatgtga

SEQ ID NO: 4184788 - DNA, 16 bp, Homo sapiens
catgttagcccttcct

SEQ ID NO: 4184789 - DNA, 14 bp, Homo sapiens
catgttatatattt

SEQ ID NO: 4184790 - DNA, 14 bp, Homo sapiens
catgttatttgtaa

SEQ ID NO: 4184791 - DNA, 18 bp, Homo sapiens
catgttgtcttataaaca

SEQ ID NO: 4184792 - DNA, 15 bp, Homo sapiens
catgtttacagaact

SEQ ID NO: 4184793 - DNA, 18 bp, Homo sapiens
catgtttattaagaatca

SEQ ID NO: 4184794 - DNA, 22 bp, Homo sapiens
catgtttggaaggggtctgtag

SEQ ID NO: 4184795 - DNA, 23 bp, Homo sapiens
catgtttgtctgtgtgctgtaac

SEQ ID NO: 4184796 - DNA, 22 bp, Homo sapiens
catgttttctatatgaacttag

SEQ ID NO: 4184797 - DNA, 17 bp, Homo sapiens
cattaagagtgaatgtg

SEQ ID NO: 4184798 - DNA, 18 bp, Homo sapiens
cattaatcaatcatctgt

SEQ ID NO: 4184799 - DNA, 13 bp, Homo sapiens
cattacgtgagcc

SEQ ID NO: 4184800 - DNA, 23 bp, Homo sapiens
cattactataagaactttgagct

SEQ ID NO: 4184801 - DNA, 19 bp, Homo sapiens
cattagagcccatttcaat

SEQ ID NO: 4184802 - DNA, 16 bp, Homo sapiens
cattatgttagagagg

SEQ ID NO: 4184803 - DNA, 18 bp, Homo sapiens
cattattggaatataatt

SEQ ID NO: 4184804 - DNA, 14 bp, Homo sapiens
cattatttaataag

SEQ ID NO: 4184805 - DNA, 19 bp, Homo sapiens
cattatttaataagagtaa

SEQ ID NO: 4184806 - DNA, 14 bp, Homo sapiens
cattcacagcccag

SEQ ID NO: 4184807 - DNA, 19 bp, Homo sapiens
cattcacagcccagaacca

SEQ ID NO: 4184808 - DNA, 13 bp, Homo sapiens
cattcagaagaaa

SEQ ID NO: 4184809 - DNA, 18 bp, Homo sapiens
cattcagaagaaaaagaa

SEQ ID NO: 4184810 - DNA, 13 bp, Homo sapiens
cattcataaggaa

SEQ ID NO: 4184811 - DNA, 15 bp, Homo sapiens
cattcataaggaaat

SEQ ID NO: 4184812 - DNA, 18 bp, Homo sapiens
cattcatctcatgctctc

SEQ ID NO: 4184813 - DNA, 17 bp, Homo sapiens
cattcatttttgttgtt

SEQ ID NO: 4184814 - DNA, 16 bp, Homo sapiens
cattccaacagtgagt

SEQ ID NO: 4184815 - DNA, 23 bp, Homo sapiens
cattccaagggtatgggaagcca

SEQ ID NO: 4184816 - DNA, 11 bp, Homo sapiens
cattcccctcg

SEQ ID NO: 4184817 - DNA, 20 bp, Homo sapiens
cattcccctcgtgtgactct

SEQ ID NO: 4184818 - DNA, 19 bp, Homo sapiens
cattcctaggtcacttgaa

SEQ ID NO: 4184819 - DNA, 23 bp, Homo sapiens
cattcctgttctctttgccttga

SEQ ID NO: 4184820 - DNA, 18 bp, Homo sapiens
cattcgaggtgtcaccct

SEQ ID NO: 4184821 - DNA, 19 bp, Homo sapiens
cattcgcctgtgggaagag

SEQ ID NO: 4184822 - DNA, 13 bp, Homo sapiens
cattctgagctgg

SEQ ID NO: 4184823 - DNA, 22 bp, Homo sapiens
cattggagctgactgttcttgg

SEQ ID NO: 4184824 - DNA, 11 bp, Homo sapiens
cattggcttcc

SEQ ID NO: 4184825 - DNA, 14 bp, Homo sapiens
cattggtctgctga

SEQ ID NO: 4184826 - DNA, 18 bp, Homo sapiens
cattgtcaaagcttgccg

SEQ ID NO: 4184827 - DNA, 20 bp, Homo sapiens
cattgtctttttagatgccc

SEQ ID NO: 4184828 - DNA, 16 bp, Homo sapiens
catttaccctggtgga

SEQ ID NO: 4184829 - DNA, 22 bp, Homo sapiens
catttattgcactcagcttttt

SEQ ID NO: 4184830 - DNA, 15 bp, Homo sapiens
catttcaactccaga

SEQ ID NO: 4184831 - DNA, 23 bp, Homo sapiens
catttctatagccaaaaatagct

SEQ ID NO: 4184832 - DNA, 14 bp, Homo sapiens
catttctcatgctt

SEQ ID NO: 4184833 - DNA, 18 bp, Homo sapiens
catttctgaactgttaca

SEQ ID NO: 4184834 - DNA, 18 bp, Homo sapiens
catttgcaaaatggaaat

SEQ ID NO: 4184835 - DNA, 16 bp, Homo sapiens
catttgccattcctgg

SEQ ID NO: 4184836 - DNA, 19 bp, Homo sapiens
cattttagacactgggaga

SEQ ID NO: 4184837 - DNA, 18 bp, Homo sapiens
cattttggaagttttcag

SEQ ID NO: 4184838 - DNA, 20 bp, Homo sapiens
cattttggaagttttcagga

SEQ ID NO: 4184839 - DNA, 16 bp, Homo sapiens
catttttcatgataat

SEQ ID NO: 4184840 - DNA, 16 bp, Homo sapiens
ccaaaaaagtattttt

SEQ ID NO: 4184841 - DNA, 12 bp, Homo sapiens
ccaaaaatagct

SEQ ID NO: 4184842 - DNA, 17 bp, Homo sapiens
ccaaaacacttaggaag

SEQ ID NO: 4184843 - DNA, 22 bp, Homo sapiens
ccaaaacacttaggaagaaatc

SEQ ID NO: 4184844 - DNA, 17 bp, Homo sapiens
ccaaaatgttgaaatat

SEQ ID NO: 4184845 - DNA, 12 bp, Homo sapiens
ccaaacactcca

SEQ ID NO: 4184846 - DNA, 15 bp, Homo sapiens
ccaaactgttggaag

SEQ ID NO: 4184847 - DNA, 12 bp, Homo sapiens
ccaaagagcctg

SEQ ID NO: 4184848 - DNA, 15 bp, Homo sapiens
ccaaagagcctggag

SEQ ID NO: 4184849 - DNA, 15 bp, Homo sapiens
ccaaagcaaaagaag

SEQ ID NO: 4184850 - DNA, 21 bp, Homo sapiens
ccaaatccttagatctggcat

SEQ ID NO: 4184851 - DNA, 12 bp, Homo sapiens
ccaaattatttg

SEQ ID NO: 4184852 - DNA, 22 bp, Homo sapiens
ccaaattgctcctaagcttcaa

SEQ ID NO: 4184853 - DNA, 14 bp, Homo sapiens
ccaaattgggagat

SEQ ID NO: 4184854 - DNA, 19 bp, Homo sapiens
ccaacaggtggcaggacca

SEQ ID NO: 4184855 - DNA, 16 bp, Homo sapiens
ccaacatctccctccc

SEQ ID NO: 4184856 - DNA, 15 bp, Homo sapiens
ccaacatggtgaaac

SEQ ID NO: 4184857 - DNA, 18 bp, Homo sapiens
ccaaccccccacctgcca

SEQ ID NO: 4184858 - DNA, 13 bp, Homo sapiens
ccaacctcccctg

SEQ ID NO: 4184859 - DNA, 24 bp, Homo sapiens
ccaacctcccctggtcctgcactg

SEQ ID NO: 4184860 - DNA, 18 bp, Homo sapiens
ccaacctgcctgtgcatg

SEQ ID NO: 4184861 - DNA, 19 bp, Homo sapiens
ccaactttctcactgctgt

SEQ ID NO: 4184862 - DNA, 21 bp, Homo sapiens
ccaactttctcactgctgtca

SEQ ID NO: 4184863 - DNA, 18 bp, Homo sapiens
ccaagacttggcaacaga

SEQ ID NO: 4184864 - DNA, 18 bp, Homo sapiens
ccaagatacttaagtgct

SEQ ID NO: 4184865 - DNA, 18 bp, Homo sapiens
ccaagccatggcatgctc

SEQ ID NO: 4184866 - DNA, 13 bp, Homo sapiens
ccaagcctggccc

SEQ ID NO: 4184867 - DNA, 14 bp, Homo sapiens
ccaagcctggccct

SEQ ID NO: 4184868 - DNA, 16 bp, Homo sapiens
ccaagcctggccctta

SEQ ID NO: 4184869 - DNA, 15 bp, Homo sapiens
ccaagctggcagctg

SEQ ID NO: 4184870 - DNA, 22 bp, Homo sapiens
ccaagctggcagctgtcattca

SEQ ID NO: 4184871 - DNA, 13 bp, Homo sapiens
ccaagggctaggc

SEQ ID NO: 4184872 - DNA, 19 bp, Homo sapiens
ccaagggtatgggaagcca

SEQ ID NO: 4184873 - DNA, 19 bp, Homo sapiens
ccaaggtgaatagcacagg

SEQ ID NO: 4184874 - DNA, 14 bp, Homo sapiens
ccaaggtgctctgt

SEQ ID NO: 4184875 - DNA, 14 bp, Homo sapiens
ccaaggtgctgatg

SEQ ID NO: 4184876 - DNA, 20 bp, Homo sapiens
ccaaggtgggctgagccctg

SEQ ID NO: 4184877 - DNA, 23 bp, Homo sapiens
ccaaggtgggctgagccctggca

SEQ ID NO: 4184878 - DNA, 18 bp, Homo sapiens
ccaagtcaacactcttct

SEQ ID NO: 4184879 - DNA, 19 bp, Homo sapiens
ccaagtcaacactcttctt

SEQ ID NO: 4184880 - DNA, 19 bp, Homo sapiens
ccaagttcctgcactccag

SEQ ID NO: 4184881 - DNA, 14 bp, Homo sapiens
ccaataaagctgga

SEQ ID NO: 4184882 - DNA, 15 bp, Homo sapiens
ccaataggtgcaaaa

SEQ ID NO: 4184883 - DNA, 20 bp, Homo sapiens
ccaataggtgcaaaaataaa

SEQ ID NO: 4184884 - DNA, 18 bp, Homo sapiens
ccaatcagagagcctaga

SEQ ID NO: 4184885 - DNA, 13 bp, Homo sapiens
ccaattgctaccg

SEQ ID NO: 4184886 - DNA, 22 bp, Homo sapiens
ccacaaagctaggatggttctg

SEQ ID NO: 4184887 - DNA, 21 bp, Homo sapiens
ccacaaagggacacacagtga

SEQ ID NO: 4184888 - DNA, 15 bp, Homo sapiens
ccacaactattttca

SEQ ID NO: 4184889 - DNA, 17 bp, Homo sapiens
ccacaactattttcaga

SEQ ID NO: 4184890 - DNA, 21 bp, Homo sapiens
ccacaagaaatttgatttcta

SEQ ID NO: 4184891 - DNA, 20 bp, Homo sapiens
ccacaagagatcagcagtgg

SEQ ID NO: 4184892 - DNA, 23 bp, Homo sapiens
ccacaagccattttttgaggaga

SEQ ID NO: 4184893 - DNA, 17 bp, Homo sapiens
ccacaagcctgagaact

SEQ ID NO: 4184894 - DNA, 21 bp, Homo sapiens
ccacaagccttactcacctct

SEQ ID NO: 4184895 - DNA, 19 bp, Homo sapiens
ccacaatggagtgggagat

SEQ ID NO: 4184896 - DNA, 15 bp, Homo sapiens
ccacacacgcaggaa

SEQ ID NO: 4184897 - DNA, 23 bp, Homo sapiens
ccacacacgcaggaactcccagc

SEQ ID NO: 4184898 - DNA, 18 bp, Homo sapiens
ccacaccaatcagagagc

SEQ ID NO: 4184899 - DNA, 19 bp, Homo sapiens
ccacactccccgcctgtcc

SEQ ID NO: 4184900 - DNA, 12 bp, Homo sapiens
ccacacttcttg

SEQ ID NO: 4184901 - DNA, 13 bp, Homo sapiens
ccacacttcttga

SEQ ID NO: 4184902 - DNA, 18 bp, Homo sapiens
ccacagataactgaaaat

SEQ ID NO: 4184903 - DNA, 16 bp, Homo sapiens
ccacagtcaaagaagg

SEQ ID NO: 4184904 - DNA, 19 bp, Homo sapiens
ccacagtgcccagctaatt

SEQ ID NO: 4184905 - DNA, 21 bp, Homo sapiens
ccacagttctaagacccaaag

SEQ ID NO: 4184906 - DNA, 15 bp, Homo sapiens
ccacatccacacacg

SEQ ID NO: 4184907 - DNA, 20 bp, Homo sapiens
ccacatccacacacgcagga

SEQ ID NO: 4184908 - DNA, 15 bp, Homo sapiens
ccaccaagggatctg

SEQ ID NO: 4184909 - DNA, 22 bp, Homo sapiens
ccaccaccttggactcctccca

SEQ ID NO: 4184910 - DNA, 12 bp, Homo sapiens
ccaccagaccca

SEQ ID NO: 4184911 - DNA, 22 bp, Homo sapiens
ccaccagacccacctggagccc

SEQ ID NO: 4184912 - DNA, 15 bp, Homo sapiens
ccacccactgtccgc

SEQ ID NO: 4184913 - DNA, 21 bp, Homo sapiens
ccacccagggctccctcctgg

SEQ ID NO: 4184914 - DNA, 12 bp, Homo sapiens
ccaccccaacat

SEQ ID NO: 4184915 - DNA, 22 bp, Homo sapiens
ccaccccagagttgggatgcgg

SEQ ID NO: 4184916 - DNA, 17 bp, Homo sapiens
ccacctaatcaggctga

SEQ ID NO: 4184917 - DNA, 21 bp, Homo sapiens
ccacctgcctatccatcctgc

SEQ ID NO: 4184918 - DNA, 16 bp, Homo sapiens
ccacctgggttcagcc

SEQ ID NO: 4184919 - DNA, 19 bp, Homo sapiens
ccaccttcaattcctgggc

SEQ ID NO: 4184920 - DNA, 22 bp, Homo sapiens
ccaccttccccagactcagctc

SEQ ID NO: 4184921 - DNA, 15 bp, Homo sapiens
ccaccttccctcttt

SEQ ID NO: 4184922 - DNA, 16 bp, Homo sapiens
ccaccttggactcctc

SEQ ID NO: 4184923 - DNA, 17 bp, Homo sapiens
ccaccttggactcctcc

SEQ ID NO: 4184924 - DNA, 18 bp, Homo sapiens
ccaccttggactcctccc

SEQ ID NO: 4184925 - DNA, 23 bp, Homo sapiens
ccaccttggactcctcccacaat

SEQ ID NO: 4184926 - DNA, 19 bp, Homo sapiens
ccacctttgggatcagcct

SEQ ID NO: 4184927 - DNA, 21 bp, Homo sapiens
ccacctttgggatcagcctcc

SEQ ID NO: 4184928 - DNA, 22 bp, Homo sapiens
ccacctttgggatcagcctccg

SEQ ID NO: 4184929 - DNA, 18 bp, Homo sapiens
ccacgactgttgtacaag

SEQ ID NO: 4184930 - DNA, 17 bp, Homo sapiens
ccacgcacacatggaca

SEQ ID NO: 4184931 - DNA, 20 bp, Homo sapiens
ccacgcccgactagcaggca

SEQ ID NO: 4184932 - DNA, 16 bp, Homo sapiens
ccacgctcaggcccgg

SEQ ID NO: 4184933 - DNA, 20 bp, Homo sapiens
ccacggggatcacagcgttt

SEQ ID NO: 4184934 - DNA, 18 bp, Homo sapiens
ccactacactccagcctg

SEQ ID NO: 4184935 - DNA, 21 bp, Homo sapiens
ccactacactccagcctgagc

SEQ ID NO: 4184936 - DNA, 22 bp, Homo sapiens
ccactacctttgtccaggcctg

SEQ ID NO: 4184937 - DNA, 16 bp, Homo sapiens
ccactaggactctgag

SEQ ID NO: 4184938 - DNA, 18 bp, Homo sapiens
ccactaggactctgaggc

SEQ ID NO: 4184939 - DNA, 19 bp, Homo sapiens
ccactaggactctgaggct

SEQ ID NO: 4184940 - DNA, 20 bp, Homo sapiens
ccactaggactctgaggctc

SEQ ID NO: 4184941 - DNA, 20 bp, Homo sapiens
ccactagggtcctggccctc

SEQ ID NO: 4184942 - DNA, 20 bp, Homo sapiens
ccactccacctccacccact

SEQ ID NO: 4184943 - DNA, 16 bp, Homo sapiens
ccactgaagctgggat

SEQ ID NO: 4184944 - DNA, 13 bp, Homo sapiens
ccactgacagata

SEQ ID NO: 4184945 - DNA, 20 bp, Homo sapiens
ccactgcactccagcctggg

SEQ ID NO: 4184946 - DNA, 21 bp, Homo sapiens
ccactgcgggagctctgtatg

SEQ ID NO: 4184947 - DNA, 23 bp, Homo sapiens
ccactggactgggttttgtctct

SEQ ID NO: 4184948 - DNA, 16 bp, Homo sapiens
ccactggacttgagct

SEQ ID NO: 4184949 - DNA, 11 bp, Homo sapiens
ccactggaggt

SEQ ID NO: 4184950 - DNA, 13 bp, Homo sapiens
ccactgtccgcct

SEQ ID NO: 4184951 - DNA, 22 bp, Homo sapiens
ccactgtccgcctctgcccgca

SEQ ID NO: 4184952 - DNA, 23 bp, Homo sapiens
ccactgtccgcctctgcccgcag

SEQ ID NO: 4184953 - DNA, 17 bp, Homo sapiens
ccactgtggccttctca

SEQ ID NO: 4184954 - DNA, 14 bp, Homo sapiens
ccactgtttgtcct

SEQ ID NO: 4184955 - DNA, 14 bp, Homo sapiens
ccacttgtcatcca

SEQ ID NO: 4184956 - DNA, 13 bp, Homo sapiens
ccagaaaacaaaa

SEQ ID NO: 4184957 - DNA, 22 bp, Homo sapiens
ccagaaagaaggacacttgtat

SEQ ID NO: 4184958 - DNA, 19 bp, Homo sapiens
ccagaacaattctgcagag

SEQ ID NO: 4184959 - DNA, 23 bp, Homo sapiens
ccagaactgaggtcactgggttc

SEQ ID NO: 4184960 - DNA, 17 bp, Homo sapiens
ccagaagtggggctctg

SEQ ID NO: 4184961 - DNA, 19 bp, Homo sapiens
ccagaagtggggctctggg

SEQ ID NO: 4184962 - DNA, 19 bp, Homo sapiens
ccagaatcttcgtcctgcc

SEQ ID NO: 4184963 - DNA, 21 bp, Homo sapiens
ccagaatcttcgtcctgcccc

SEQ ID NO: 4184964 - DNA, 20 bp, Homo sapiens
ccagacccacctggagcccg

SEQ ID NO: 4184965 - DNA, 13 bp, Homo sapiens
ccagactcagctc

SEQ ID NO: 4184966 - DNA, 18 bp, Homo sapiens
ccagagacaggaaagaat

SEQ ID NO: 4184967 - DNA, 22 bp, Homo sapiens
ccagagaccccttcctttcctc

SEQ ID NO: 4184968 - DNA, 22 bp, Homo sapiens
ccagagagcaaacataggaata

SEQ ID NO: 4184969 - DNA, 22 bp, Homo sapiens
ccagagcattacgtgagccagg

SEQ ID NO: 4184970 - DNA, 13 bp, Homo sapiens
ccagagccaaggg

SEQ ID NO: 4184971 - DNA, 13 bp, Homo sapiens
ccagagccactac

SEQ ID NO: 4184972 - DNA, 17 bp, Homo sapiens
ccagagccactaccttt

SEQ ID NO: 4184973 - DNA, 22 bp, Homo sapiens
ccagagccggggcactttcaga

SEQ ID NO: 4184974 - DNA, 22 bp, Homo sapiens
ccagagccttcaagtgccaaac

SEQ ID NO: 4184975 - DNA, 13 bp, Homo sapiens
ccagagggcccag

SEQ ID NO: 4184976 - DNA, 17 bp, Homo sapiens
ccagagggcccaggcag

SEQ ID NO: 4184977 - DNA, 22 bp, Homo sapiens
ccagaggtgacccaatgctcct

SEQ ID NO: 4184978 - DNA, 15 bp, Homo sapiens
ccagagtcaggaaga

SEQ ID NO: 4184979 - DNA, 23 bp, Homo sapiens
ccagagttgggatgcggggcaga

SEQ ID NO: 4184980 - DNA, 15 bp, Homo sapiens
ccagataatatatta

SEQ ID NO: 4184981 - DNA, 21 bp, Homo sapiens
ccagatgccttcctgtctttc

SEQ ID NO: 4184982 - DNA, 15 bp, Homo sapiens
ccagcaacacaagct

SEQ ID NO: 4184983 - DNA, 15 bp, Homo sapiens
ccagcaacacagagc

SEQ ID NO: 4184984 - DNA, 17 bp, Homo sapiens
ccagcaagtttcacctt

SEQ ID NO: 4184985 - DNA, 14 bp, Homo sapiens
ccagcactttggga

SEQ ID NO: 4184986 - DNA, 19 bp, Homo sapiens
ccagcactttgggaggcca

SEQ ID NO: 4184987 - DNA, 20 bp, Homo sapiens
ccagcaggcaggcactgtgg

SEQ ID NO: 4184988 - DNA, 23 bp, Homo sapiens
ccagcaggcaggcactgtggccc

SEQ ID NO: 4184989 - DNA, 22 bp, Homo sapiens
ccagcagttgaatgacaacaga

SEQ ID NO: 4184990 - DNA, 22 bp, Homo sapiens
ccagcatttgccattcctggaa

SEQ ID NO: 4184991 - DNA, 20 bp, Homo sapiens
ccagccactcgggaggctga

SEQ ID NO: 4184992 - DNA, 18 bp, Homo sapiens
ccagccaggatcccaagc

SEQ ID NO: 4184993 - DNA, 19 bp, Homo sapiens
ccagccattaccatggaga

SEQ ID NO: 4184994 - DNA, 17 bp, Homo sapiens
ccagcccttcagacgag

SEQ ID NO: 4184995 - DNA, 23 bp, Homo sapiens
ccagccctttgcaggcccagcag

SEQ ID NO: 4184996 - DNA, 16 bp, Homo sapiens
ccagcctgactgcaca

SEQ ID NO: 4184997 - DNA, 10 bp, Homo sapiens
ccagcctggc

SEQ ID NO: 4184998 - DNA, 12 bp, Homo sapiens
ccagcctggcca

SEQ ID NO: 4184999 - DNA, 13 bp, Homo sapiens
ccagcctggcttc

SEQ ID NO: 4185000 - DNA, 19 bp, Homo sapiens
ccagcctggcttctggagc

SEQ ID NO: 4185001 - DNA, 16 bp, Homo sapiens
ccagcctgggcgacag

SEQ ID NO: 4185002 - DNA, 20 bp, Homo sapiens
ccagctaatttttgtatttt

SEQ ID NO: 4185003 - DNA, 14 bp, Homo sapiens
ccagctactcagaa

SEQ ID NO: 4185004 - DNA, 16 bp, Homo sapiens
ccagctactcagaagc

SEQ ID NO: 4185005 - DNA, 20 bp, Homo sapiens
ccagctactcagaagcctga

SEQ ID NO: 4185006 - DNA, 12 bp, Homo sapiens
ccagctcctctg

SEQ ID NO: 4185007 - DNA, 15 bp, Homo sapiens
ccagctcctctgagc

SEQ ID NO: 4185008 - DNA, 20 bp, Homo sapiens
ccagctctttgttcagttga

SEQ ID NO: 4185009 - DNA, 19 bp, Homo sapiens
ccagctgcacctgccagcc

SEQ ID NO: 4185010 - DNA, 12 bp, Homo sapiens
ccagctgcctgg

SEQ ID NO: 4185011 - DNA, 22 bp, Homo sapiens
ccagcttgctgaggggcaggga

SEQ ID NO: 4185012 - DNA, 22 bp, Homo sapiens
ccaggaactggctcctttgcct

SEQ ID NO: 4185013 - DNA, 14 bp, Homo sapiens
ccaggaatctgcca

SEQ ID NO: 4185014 - DNA, 15 bp, Homo sapiens
ccaggactccccagg

SEQ ID NO: 4185015 - DNA, 21 bp, Homo sapiens
ccaggactccccaggccaggc

SEQ ID NO: 4185016 - DNA, 22 bp, Homo sapiens
ccaggactccccaggccaggcc

SEQ ID NO: 4185017 - DNA, 13 bp, Homo sapiens
ccaggagctctct

SEQ ID NO: 4185018 - DNA, 15 bp, Homo sapiens
ccaggagctctctgc

SEQ ID NO: 4185019 - DNA, 18 bp, Homo sapiens
ccaggagctctctgctga

SEQ ID NO: 4185020 - DNA, 22 bp, Homo sapiens
ccaggaggctgaggcaggagaa

SEQ ID NO: 4185021 - DNA, 23 bp, Homo sapiens
ccaggaggctgaggcaggagaat

SEQ ID NO: 4185022 - DNA, 21 bp, Homo sapiens
ccaggagggtaacagaagagg

SEQ ID NO: 4185023 - DNA, 17 bp, Homo sapiens
ccaggagtttgaggctg

SEQ ID NO: 4185024 - DNA, 20 bp, Homo sapiens
ccaggagtttgaggctgcag

SEQ ID NO: 4185025 - DNA, 24 bp, Homo sapiens
ccaggatcccaagcgtcccgtccc

SEQ ID NO: 4185026 - DNA, 16 bp, Homo sapiens
ccaggatctttgactg

SEQ ID NO: 4185027 - DNA, 18 bp, Homo sapiens
ccaggattggcctgtgtc

SEQ ID NO: 4185028 - DNA, 16 bp, Homo sapiens
ccaggcaaagctggag

SEQ ID NO: 4185029 - DNA, 13 bp, Homo sapiens
ccaggcactgcaa

SEQ ID NO: 4185030 - DNA, 16 bp, Homo sapiens
ccaggcatgctggcct

SEQ ID NO: 4185031 - DNA, 18 bp, Homo sapiens
ccaggccagtgggcctgg

SEQ ID NO: 4185032 - DNA, 15 bp, Homo sapiens
ccaggcgggcggcac

SEQ ID NO: 4185033 - DNA, 24 bp, Homo sapiens
ccaggctaatttttttgtatttta

SEQ ID NO: 4185034 - DNA, 22 bp, Homo sapiens
ccaggctctgcctggaggatcc

SEQ ID NO: 4185035 - DNA, 22 bp, Homo sapiens
ccaggctctttggggtcagcca

SEQ ID NO: 4185036 - DNA, 22 bp, Homo sapiens
ccaggctgtaagcattctgagc

SEQ ID NO: 4185037 - DNA, 23 bp, Homo sapiens
ccaggctgtgtttggctttcagg

SEQ ID NO: 4185038 - DNA, 23 bp, Homo sapiens
ccagggaagaaggtttgaaagat

SEQ ID NO: 4185039 - DNA, 20 bp, Homo sapiens
ccagggacacctgggagaaa

SEQ ID NO: 4185040 - DNA, 18 bp, Homo sapiens
ccagggctcaaaaagttt

SEQ ID NO: 4185041 - DNA, 17 bp, Homo sapiens
ccagggctccctcctgg

SEQ ID NO: 4185042 - DNA, 21 bp, Homo sapiens
ccagggctccctcctggagca

SEQ ID NO: 4185043 - DNA, 19 bp, Homo sapiens
ccagggctgcccctgtagg

SEQ ID NO: 4185044 - DNA, 19 bp, Homo sapiens
ccaggggtctccctggagt

SEQ ID NO: 4185045 - DNA, 19 bp, Homo sapiens
ccaggggtgatttcagaga

SEQ ID NO: 4185046 - DNA, 17 bp, Homo sapiens
ccagggtctaaagagaa

SEQ ID NO: 4185047 - DNA, 19 bp, Homo sapiens
ccagggtctaaagagaaca

SEQ ID NO: 4185048 - DNA, 22 bp, Homo sapiens
ccagggttgatcacactctggg

SEQ ID NO: 4185049 - DNA, 18 bp, Homo sapiens
ccaggtaatgagggactg

SEQ ID NO: 4185050 - DNA, 13 bp, Homo sapiens
ccaggtcctctga

SEQ ID NO: 4185051 - DNA, 22 bp, Homo sapiens
ccaggtgcagtggctcacgcct

SEQ ID NO: 4185052 - DNA, 13 bp, Homo sapiens
ccaggtggcagga

SEQ ID NO: 4185053 - DNA, 21 bp, Homo sapiens
ccagtaagcacatgtttattc

SEQ ID NO: 4185054 - DNA, 22 bp, Homo sapiens
ccagtacagagaaattctgtgg

SEQ ID NO: 4185055 - DNA, 13 bp, Homo sapiens
ccagtactgggaa

SEQ ID NO: 4185056 - DNA, 17 bp, Homo sapiens
ccagtactgggaaggag

SEQ ID NO: 4185057 - DNA, 12 bp, Homo sapiens
ccagtattcttg

SEQ ID NO: 4185058 - DNA, 18 bp, Homo sapiens
ccagtcgtccgctcagcc

SEQ ID NO: 4185059 - DNA, 20 bp, Homo sapiens
ccagtgacctgctgggtaaa

SEQ ID NO: 4185060 - DNA, 13 bp, Homo sapiens
ccagtgccacaga

SEQ ID NO: 4185061 - DNA, 18 bp, Homo sapiens
ccagtgccacagagaaga

SEQ ID NO: 4185062 - DNA, 20 bp, Homo sapiens
ccagtgggaggtgagaccac

SEQ ID NO: 4185063 - DNA, 16 bp, Homo sapiens
ccagttaagaatggaa

SEQ ID NO: 4185064 - DNA, 14 bp, Homo sapiens
ccagttagcaacaa

SEQ ID NO: 4185065 - DNA, 18 bp, Homo sapiens
ccagttgttactgaagtt

SEQ ID NO: 4185066 - DNA, 22 bp, Homo sapiens
ccagtttccaagttcctgcact

SEQ ID NO: 4185067 - DNA, 14 bp, Homo sapiens
ccagtttcccacca

SEQ ID NO: 4185068 - DNA, 15 bp, Homo sapiens
ccataaactgtacaa

SEQ ID NO: 4185069 - DNA, 15 bp, Homo sapiens
ccataaagcaagctc

SEQ ID NO: 4185070 - DNA, 17 bp, Homo sapiens
ccataaagcaagctcaa

SEQ ID NO: 4185071 - DNA, 21 bp, Homo sapiens
ccataaagcaagctcaacctt

SEQ ID NO: 4185072 - DNA, 15 bp, Homo sapiens
ccataacagccaaca

SEQ ID NO: 4185073 - DNA, 17 bp, Homo sapiens
ccataccgaccatcgtc

SEQ ID NO: 4185074 - DNA, 16 bp, Homo sapiens
ccatagagtttaacac

SEQ ID NO: 4185075 - DNA, 22 bp, Homo sapiens
ccatagttatttacttgaaaga

SEQ ID NO: 4185076 - DNA, 22 bp, Homo sapiens
ccatatgctccaggatctttga

SEQ ID NO: 4185077 - DNA, 16 bp, Homo sapiens
ccatattcacacctca

SEQ ID NO: 4185078 - DNA, 18 bp, Homo sapiens
ccatcactgagttttcca

SEQ ID NO: 4185079 - DNA, 22 bp, Homo sapiens
ccatcagggtgggccactctcc

SEQ ID NO: 4185080 - DNA, 21 bp, Homo sapiens
ccatcccctttcctccccacc

SEQ ID NO: 4185081 - DNA, 13 bp, Homo sapiens
ccatcgtccagcc

SEQ ID NO: 4185082 - DNA, 15 bp, Homo sapiens
ccatcgtccagccct

SEQ ID NO: 4185083 - DNA, 17 bp, Homo sapiens
ccatcgtccagccctcc

SEQ ID NO: 4185084 - DNA, 12 bp, Homo sapiens
ccatctagagat

SEQ ID NO: 4185085 - DNA, 11 bp, Homo sapiens
ccatctcaggc

SEQ ID NO: 4185086 - DNA, 14 bp, Homo sapiens
ccatctcaggccag

SEQ ID NO: 4185087 - DNA, 13 bp, Homo sapiens
ccatctcctccca

SEQ ID NO: 4185088 - DNA, 16 bp, Homo sapiens
ccatctcctttcaggg

SEQ ID NO: 4185089 - DNA, 15 bp, Homo sapiens
ccatctctccagaga

SEQ ID NO: 4185090 - DNA, 18 bp, Homo sapiens
ccatctgaaccactttgc

SEQ ID NO: 4185091 - DNA, 16 bp, Homo sapiens
ccatgaagacaggaca

SEQ ID NO: 4185092 - DNA, 19 bp, Homo sapiens
ccatgaagacaggacagtg

SEQ ID NO: 4185093 - DNA, 14 bp, Homo sapiens
ccatgaattcttga

SEQ ID NO: 4185094 - DNA, 11 bp, Homo sapiens
ccatgcagcct

SEQ ID NO: 4185095 - DNA, 11 bp, Homo sapiens
ccatgccctcc

SEQ ID NO: 4185096 - DNA, 22 bp, Homo sapiens
ccatgcctgtagctttcctggt

SEQ ID NO: 4185097 - DNA, 23 bp, Homo sapiens
ccatgcctgtagctttcctggtc

SEQ ID NO: 4185098 - DNA, 19 bp, Homo sapiens
ccatgctggcggcgcagag

SEQ ID NO: 4185099 - DNA, 18 bp, Homo sapiens
ccatgctttccttttctt

SEQ ID NO: 4185100 - DNA, 22 bp, Homo sapiens
ccatgctttccttttcttcctt

SEQ ID NO: 4185101 - DNA, 14 bp, Homo sapiens
ccatggcaggaagg

SEQ ID NO: 4185102 - DNA, 14 bp, Homo sapiens
ccatggccccaggc

SEQ ID NO: 4185103 - DNA, 12 bp, Homo sapiens
ccatggccttcc

SEQ ID NO: 4185104 - DNA, 15 bp, Homo sapiens
ccatggccttccctc

SEQ ID NO: 4185105 - DNA, 19 bp, Homo sapiens
ccatggcgtgtccctctcg

SEQ ID NO: 4185106 - DNA, 21 bp, Homo sapiens
ccatggcgtgtccctctcgga

SEQ ID NO: 4185107 - DNA, 13 bp, Homo sapiens
ccatggctctgtt

SEQ ID NO: 4185108 - DNA, 22 bp, Homo sapiens
ccatgggatgttaagcaaagga

SEQ ID NO: 4185109 - DNA, 13 bp, Homo sapiens
ccatgggcctgct

SEQ ID NO: 4185110 - DNA, 20 bp, Homo sapiens
ccatgggcctgctgcgtcag

SEQ ID NO: 4185111 - DNA, 15 bp, Homo sapiens
ccatgtatctacctc

SEQ ID NO: 4185112 - DNA, 22 bp, Homo sapiens
ccatgtgcttattatatttctt

SEQ ID NO: 4185113 - DNA, 16 bp, Homo sapiens
ccattagagtcagcct

SEQ ID NO: 4185114 - DNA, 17 bp, Homo sapiens
ccattggctcccatctg

SEQ ID NO: 4185115 - DNA, 17 bp, Homo sapiens
ccattgtactccagcct

SEQ ID NO: 4185116 - DNA, 19 bp, Homo sapiens
ccattgtactccagcctgg

SEQ ID NO: 4185117 - DNA, 15 bp, Homo sapiens
ccatttaatttctat

SEQ ID NO: 4185118 - DNA, 14 bp, Homo sapiens
ccatttcaactcca

SEQ ID NO: 4185119 - DNA, 17 bp, Homo sapiens
ccatttcaattctcaaa

SEQ ID NO: 4185120 - DNA, 19 bp, Homo sapiens
ccatttctcagtggcttct

SEQ ID NO: 4185121 - DNA, 15 bp, Homo sapiens
ccatttgggcacatt

SEQ ID NO: 4185122 - DNA, 20 bp, Homo sapiens
cccaaactgtgccctgcctt

SEQ ID NO: 4185123 - DNA, 18 bp, Homo sapiens
cccaaagagcctggagaa

SEQ ID NO: 4185124 - DNA, 21 bp, Homo sapiens
cccaaagcccagctctttgtt

SEQ ID NO: 4185125 - DNA, 14 bp, Homo sapiens
cccaataaagctgg

SEQ ID NO: 4185126 - DNA, 16 bp, Homo sapiens
cccaatgctcctggag

SEQ ID NO: 4185127 - DNA, 23 bp, Homo sapiens
cccacaatctggcttagtgccac

SEQ ID NO: 4185128 - DNA, 20 bp, Homo sapiens
cccacacatgtttacagaac

SEQ ID NO: 4185129 - DNA, 14 bp, Homo sapiens
cccacagcctctgg

SEQ ID NO: 4185130 - DNA, 21 bp, Homo sapiens
cccacagtcctcacagcctct

SEQ ID NO: 4185131 - DNA, 19 bp, Homo sapiens
cccacattggacttccttg

SEQ ID NO: 4185132 - DNA, 19 bp, Homo sapiens
cccacatttacctcgaggc

SEQ ID NO: 4185133 - DNA, 20 bp, Homo sapiens
cccaccaccttggactcctc

SEQ ID NO: 4185134 - DNA, 12 bp, Homo sapiens
cccacccagtcc

SEQ ID NO: 4185135 - DNA, 15 bp, Homo sapiens
cccaccccagagttg

SEQ ID NO: 4185136 - DNA, 23 bp, Homo sapiens
cccacctcatgcctggcccccct

SEQ ID NO: 4185137 - DNA, 21 bp, Homo sapiens
cccaccttcaattcctgggcc

SEQ ID NO: 4185138 - DNA, 19 bp, Homo sapiens
cccacctttgggatcagcc

SEQ ID NO: 4185139 - DNA, 22 bp, Homo sapiens
cccacctttgggatcagcctcc

SEQ ID NO: 4185140 - DNA, 16 bp, Homo sapiens
cccacggggatcacag

SEQ ID NO: 4185141 - DNA, 17 bp, Homo sapiens
cccacggggatcacagc

SEQ ID NO: 4185142 - DNA, 16 bp, Homo sapiens
cccactaagctttctc

SEQ ID NO: 4185143 - DNA, 20 bp, Homo sapiens
cccactaagctttctccttt

SEQ ID NO: 4185144 - DNA, 20 bp, Homo sapiens
cccagaaaaaaaaaaactta

SEQ ID NO: 4185145 - DNA, 14 bp, Homo sapiens
cccagaaccacaga

SEQ ID NO: 4185146 - DNA, 17 bp, Homo sapiens
cccagagaccccttcct

SEQ ID NO: 4185147 - DNA, 23 bp, Homo sapiens
cccagagaccccttcctttcctc

SEQ ID NO: 4185148 - DNA, 21 bp, Homo sapiens
cccagagcattacgtgagcca

SEQ ID NO: 4185149 - DNA, 13 bp, Homo sapiens
cccagaggccagg

SEQ ID NO: 4185150 - DNA, 13 bp, Homo sapiens
cccagagggccca

SEQ ID NO: 4185151 - DNA, 22 bp, Homo sapiens
cccagagggcccaggcaggcca

SEQ ID NO: 4185152 - DNA, 22 bp, Homo sapiens
cccagcaacacaagctggaagc

SEQ ID NO: 4185153 - DNA, 22 bp, Homo sapiens
cccagcactttgggaggccaag

SEQ ID NO: 4185154 - DNA, 14 bp, Homo sapiens
cccagcaggcaggc

SEQ ID NO: 4185155 - DNA, 24 bp, Homo sapiens
cccagcaggcaggcactgtggccc

SEQ ID NO: 4185156 - DNA, 15 bp, Homo sapiens
cccagccagccagga

SEQ ID NO: 4185157 - DNA, 10 bp, Homo sapiens
cccagccatt

SEQ ID NO: 4185158 - DNA, 19 bp, Homo sapiens
cccagccattaccatggag

SEQ ID NO: 4185159 - DNA, 20 bp, Homo sapiens
cccagcgtgtgtatccgact

SEQ ID NO: 4185160 - DNA, 19 bp, Homo sapiens
cccagctacccaggaggct

SEQ ID NO: 4185161 - DNA, 21 bp, Homo sapiens
cccagctactcagaagcctga

SEQ ID NO: 4185162 - DNA, 16 bp, Homo sapiens
cccagctcctctgagc

SEQ ID NO: 4185163 - DNA, 18 bp, Homo sapiens
cccagctcctctgagcca

SEQ ID NO: 4185164 - DNA, 15 bp, Homo sapiens
cccagctctcagggc

SEQ ID NO: 4185165 - DNA, 22 bp, Homo sapiens
cccagctgtgcttatggtacca

SEQ ID NO: 4185166 - DNA, 13 bp, Homo sapiens
cccaggagctctc

SEQ ID NO: 4185167 - DNA, 22 bp, Homo sapiens
cccaggaggctgaggcaggaga

SEQ ID NO: 4185168 - DNA, 23 bp, Homo sapiens
cccaggaggtcaagcctgcagcg

SEQ ID NO: 4185169 - DNA, 22 bp, Homo sapiens
cccaggccaggccaccaggatg

SEQ ID NO: 4185170 - DNA, 19 bp, Homo sapiens
cccagggacacctgggaga

SEQ ID NO: 4185171 - DNA, 17 bp, Homo sapiens
cccagggccagggccct

SEQ ID NO: 4185172 - DNA, 21 bp, Homo sapiens
cccagggccagggccctgcag

SEQ ID NO: 4185173 - DNA, 20 bp, Homo sapiens
cccaggtcctctgataccca

SEQ ID NO: 4185174 - DNA, 13 bp, Homo sapiens
cccagtccgccaa

SEQ ID NO: 4185175 - DNA, 20 bp, Homo sapiens
cccagtcgtccgctcagcca

SEQ ID NO: 4185176 - DNA, 17 bp, Homo sapiens
cccagtctggaagaaga

SEQ ID NO: 4185177 - DNA, 19 bp, Homo sapiens
cccagtctggaagaagagg

SEQ ID NO: 4185178 - DNA, 22 bp, Homo sapiens
cccagtctggaagaagaggagg

SEQ ID NO: 4185179 - DNA, 23 bp, Homo sapiens
cccagtctggaagaagaggagga

SEQ ID NO: 4185180 - DNA, 17 bp, Homo sapiens
cccagtgccacagagaa

SEQ ID NO: 4185181 - DNA, 21 bp, Homo sapiens
cccataattgctttgccaaaa

SEQ ID NO: 4185182 - DNA, 12 bp, Homo sapiens
cccatccccttt

SEQ ID NO: 4185183 - DNA, 14 bp, Homo sapiens
cccatcccctttcc

SEQ ID NO: 4185184 - DNA, 19 bp, Homo sapiens
cccatctctccagagagca

SEQ ID NO: 4185185 - DNA, 13 bp, Homo sapiens
cccatgatccaga

SEQ ID NO: 4185186 - DNA, 13 bp, Homo sapiens
cccatgccctccc

SEQ ID NO: 4185187 - DNA, 17 bp, Homo sapiens
cccatggccccaggccc

SEQ ID NO: 4185188 - DNA, 18 bp, Homo sapiens
cccattctgcatgccctc

SEQ ID NO: 4185189 - DNA, 17 bp, Homo sapiens
cccattttgagtgactc

SEQ ID NO: 4185190 - DNA, 18 bp, Homo sapiens
cccattttgagtgactcg

SEQ ID NO: 4185191 - DNA, 23 bp, Homo sapiens
ccccaaaactctacaccctctgc

SEQ ID NO: 4185192 - DNA, 19 bp, Homo sapiens
ccccaaacgggctgccctg

SEQ ID NO: 4185193 - DNA, 20 bp, Homo sapiens
ccccaaagagcctggagaag

SEQ ID NO: 4185194 - DNA, 22 bp, Homo sapiens
ccccaactcttctccaagtcta

SEQ ID NO: 4185195 - DNA, 22 bp, Homo sapiens
ccccaagtccacctgcctatcc

SEQ ID NO: 4185196 - DNA, 13 bp, Homo sapiens
ccccacaatctgg

SEQ ID NO: 4185197 - DNA, 12 bp, Homo sapiens
ccccacctgcca

SEQ ID NO: 4185198 - DNA, 14 bp, Homo sapiens
ccccactgtatcta

SEQ ID NO: 4185199 - DNA, 21 bp, Homo sapiens
ccccactttcctacaaaatgg

SEQ ID NO: 4185200 - DNA, 17 bp, Homo sapiens
ccccagactcagctcca

SEQ ID NO: 4185201 - DNA, 12 bp, Homo sapiens
ccccagcactga

SEQ ID NO: 4185202 - DNA, 15 bp, Homo sapiens
ccccagcctgacaaa

SEQ ID NO: 4185203 - DNA, 16 bp, Homo sapiens
ccccagtgctacctct

SEQ ID NO: 4185204 - DNA, 20 bp, Homo sapiens
ccccatctcctcccatggcc

SEQ ID NO: 4185205 - DNA, 21 bp, Homo sapiens
ccccatctcctcccatggcct

SEQ ID NO: 4185206 - DNA, 20 bp, Homo sapiens
ccccatgcacctcagggcca

SEQ ID NO: 4185207 - DNA, 21 bp, Homo sapiens
ccccatgccctccctgctgcc

SEQ ID NO: 4185208 - DNA, 21 bp, Homo sapiens
cccccagtgccacagagaaga

SEQ ID NO: 4185209 - DNA, 12 bp, Homo sapiens
cccccatgccct

SEQ ID NO: 4185210 - DNA, 22 bp, Homo sapiens
cccccatgccctccctgctgcc

SEQ ID NO: 4185211 - DNA, 13 bp, Homo sapiens
ccccccatgccct

SEQ ID NO: 4185212 - DNA, 12 bp, Homo sapiens
ccccctccaggc

SEQ ID NO: 4185213 - DNA, 19 bp, Homo sapiens
ccccctggtggacagtcct

SEQ ID NO: 4185214 - DNA, 20 bp, Homo sapiens
ccccctggtggacagtcctg

SEQ ID NO: 4185215 - DNA, 18 bp, Homo sapiens
cccccttgaatctgcagg

SEQ ID NO: 4185216 - DNA, 20 bp, Homo sapiens
cccccttgaatctgcaggga

SEQ ID NO: 4185217 - DNA, 23 bp, Homo sapiens
cccccttgaatctgcagggagca

SEQ ID NO: 4185218 - DNA, 22 bp, Homo sapiens
ccccgcctgtcctgcctctctg

SEQ ID NO: 4185219 - DNA, 16 bp, Homo sapiens
ccccggtggcagtgga

SEQ ID NO: 4185220 - DNA, 20 bp, Homo sapiens
cccctagaaaccacctgggt

SEQ ID NO: 4185221 - DNA, 17 bp, Homo sapiens
cccctagcaaggtccag

SEQ ID NO: 4185222 - DNA, 16 bp, Homo sapiens
cccctccaggcatgct

SEQ ID NO: 4185223 - DNA, 22 bp, Homo sapiens
cccctccaggcatgctggcctc

SEQ ID NO: 4185224 - DNA, 14 bp, Homo sapiens
cccctccctcttcc

SEQ ID NO: 4185225 - DNA, 14 bp, Homo sapiens
cccctccttgctct

SEQ ID NO: 4185226 - DNA, 22 bp, Homo sapiens
cccctgcccgaccccatctcat

SEQ ID NO: 4185227 - DNA, 14 bp, Homo sapiens
cccctgggcctgga

SEQ ID NO: 4185228 - DNA, 13 bp, Homo sapiens
cccctggtcctgc

SEQ ID NO: 4185229 - DNA, 17 bp, Homo sapiens
cccctggtcctgcactg

SEQ ID NO: 4185230 - DNA, 15 bp, Homo sapiens
cccctggtggacagt

SEQ ID NO: 4185231 - DNA, 16 bp, Homo sapiens
ccccttatccaggact

SEQ ID NO: 4185232 - DNA, 15 bp, Homo sapiens
ccccttcctttcctc

SEQ ID NO: 4185233 - DNA, 18 bp, Homo sapiens
ccccttgaatctgcaggg

SEQ ID NO: 4185234 - DNA, 23 bp, Homo sapiens
ccccttgacaactggcaggcagg

SEQ ID NO: 4185235 - DNA, 14 bp, Homo sapiens
cccctttcctcccc

SEQ ID NO: 4185236 - DNA, 15 bp, Homo sapiens
cccgactagcaggca

SEQ ID NO: 4185237 - DNA, 18 bp, Homo sapiens
cccgagggagctgctggc

SEQ ID NO: 4185238 - DNA, 15 bp, Homo sapiens
cccgattcagagact

SEQ ID NO: 4185239 - DNA, 13 bp, Homo sapiens
cccgcctgtcctg

SEQ ID NO: 4185240 - DNA, 15 bp, Homo sapiens
cccgcgcctccttcc

SEQ ID NO: 4185241 - DNA, 11 bp, Homo sapiens
cccgctctgca

SEQ ID NO: 4185242 - DNA, 17 bp, Homo sapiens
cccgcttattctcctcc

SEQ ID NO: 4185243 - DNA, 14 bp, Homo sapiens
cccggcccagagac

SEQ ID NO: 4185244 - DNA, 18 bp, Homo sapiens
cccggcctcagcacccct

SEQ ID NO: 4185245 - DNA, 18 bp, Homo sapiens
cccgggtgtgcctgccct

SEQ ID NO: 4185246 - DNA, 20 bp, Homo sapiens
cccgggtgtgcctgccctgg

SEQ ID NO: 4185247 - DNA, 22 bp, Homo sapiens
cccgggtgtgcctgccctggag

SEQ ID NO: 4185248 - DNA, 15 bp, Homo sapiens
cccggtggcagtgga

SEQ ID NO: 4185249 - DNA, 17 bp, Homo sapiens
cccggttcaccttgccg

SEQ ID NO: 4185250 - DNA, 20 bp, Homo sapiens
cccgtgtcctctccctgcca

SEQ ID NO: 4185251 - DNA, 14 bp, Homo sapiens
ccctaggctgagct

SEQ ID NO: 4185252 - DNA, 15 bp, Homo sapiens
ccctcaaaccctgtg

SEQ ID NO: 4185253 - DNA, 17 bp, Homo sapiens
ccctcacccccatggcc

SEQ ID NO: 4185254 - DNA, 18 bp, Homo sapiens
ccctcactgaatgcctca

SEQ ID NO: 4185255 - DNA, 12 bp, Homo sapiens
ccctcagggatc

SEQ ID NO: 4185256 - DNA, 17 bp, Homo sapiens
ccctcataagtttgttt

SEQ ID NO: 4185257 - DNA, 18 bp, Homo sapiens
ccctccactcctcatccc

SEQ ID NO: 4185258 - DNA, 21 bp, Homo sapiens
ccctccagagacaggaaagaa

SEQ ID NO: 4185259 - DNA, 15 bp, Homo sapiens
ccctccagctccagt

SEQ ID NO: 4185260 - DNA, 14 bp, Homo sapiens
ccctccaggcatgc

SEQ ID NO: 4185261 - DNA, 15 bp, Homo sapiens
ccctccaggcatgct

SEQ ID NO: 4185262 - DNA, 16 bp, Homo sapiens
ccctccccacagtcct

SEQ ID NO: 4185263 - DNA, 16 bp, Homo sapiens
ccctcctccactccac

SEQ ID NO: 4185264 - DNA, 19 bp, Homo sapiens
ccctccttgctctgcaggc

SEQ ID NO: 4185265 - DNA, 20 bp, Homo sapiens
ccctccttgctctgcaggca

SEQ ID NO: 4185266 - DNA, 22 bp, Homo sapiens
ccctcgtggacacctgccctgc

SEQ ID NO: 4185267 - DNA, 23 bp, Homo sapiens
ccctctaacccccagtgccacag

SEQ ID NO: 4185268 - DNA, 13 bp, Homo sapiens
ccctctacctgga

SEQ ID NO: 4185269 - DNA, 17 bp, Homo sapiens
ccctctcttccctatta

SEQ ID NO: 4185270 - DNA, 20 bp, Homo sapiens
ccctctgagaattccaagga

SEQ ID NO: 4185271 - DNA, 12 bp, Homo sapiens
ccctcttccttc

SEQ ID NO: 4185272 - DNA, 14 bp, Homo sapiens
ccctcttccttccc

SEQ ID NO: 4185273 - DNA, 18 bp, Homo sapiens
ccctctttccccacctct

SEQ ID NO: 4185274 - DNA, 14 bp, Homo sapiens
ccctgagctgacca

SEQ ID NO: 4185275 - DNA, 19 bp, Homo sapiens
ccctgagtggatctccaag

SEQ ID NO: 4185276 - DNA, 21 bp, Homo sapiens
ccctgcaagacacaggctcag

SEQ ID NO: 4185277 - DNA, 13 bp, Homo sapiens
ccctgcagagcta

SEQ ID NO: 4185278 - DNA, 15 bp, Homo sapiens
ccctgccacctgtct

SEQ ID NO: 4185279 - DNA, 19 bp, Homo sapiens
ccctgcccgaccccatctc

SEQ ID NO: 4185280 - DNA, 15 bp, Homo sapiens
ccctgccctgccacc

SEQ ID NO: 4185281 - DNA, 18 bp, Homo sapiens
ccctgccctgccacctgt

SEQ ID NO: 4185282 - DNA, 19 bp, Homo sapiens
ccctgcgaaggggccctgg

SEQ ID NO: 4185283 - DNA, 20 bp, Homo sapiens
ccctgcgaaggggccctggt

SEQ ID NO: 4185284 - DNA, 14 bp, Homo sapiens
ccctgctgccaggc

SEQ ID NO: 4185285 - DNA, 23 bp, Homo sapiens
ccctgctgccgcctcccagcctg

SEQ ID NO: 4185286 - DNA, 15 bp, Homo sapiens
ccctggagtgcagtt

SEQ ID NO: 4185287 - DNA, 22 bp, Homo sapiens
ccctggatcagggttgttctgg

SEQ ID NO: 4185288 - DNA, 22 bp, Homo sapiens
ccctggcaggatgaccctgcga

SEQ ID NO: 4185289 - DNA, 16 bp, Homo sapiens
ccctggcatgtcagag

SEQ ID NO: 4185290 - DNA, 11 bp, Homo sapiens
ccctggcccag

SEQ ID NO: 4185291 - DNA, 17 bp, Homo sapiens
ccctgggctctggtctg

SEQ ID NO: 4185292 - DNA, 17 bp, Homo sapiens
ccctggggccatgggtg

SEQ ID NO: 4185293 - DNA, 12 bp, Homo sapiens
ccctggtcctgc

SEQ ID NO: 4185294 - DNA, 14 bp, Homo sapiens
ccctggtcctgcac

SEQ ID NO: 4185295 - DNA, 23 bp, Homo sapiens
ccctggtggaggcttcttgccca

SEQ ID NO: 4185296 - DNA, 13 bp, Homo sapiens
ccctgtcttgtcc

SEQ ID NO: 4185297 - DNA, 21 bp, Homo sapiens
ccctgtggattccagcatttg

SEQ ID NO: 4185298 - DNA, 18 bp, Homo sapiens
ccctgtggggcctgatgg

SEQ ID NO: 4185299 - DNA, 15 bp, Homo sapiens
cccttatccaggact

SEQ ID NO: 4185300 - DNA, 16 bp, Homo sapiens
cccttcctttcctctg

SEQ ID NO: 4185301 - DNA, 19 bp, Homo sapiens
cccttcctttcctctgcag

SEQ ID NO: 4185302 - DNA, 20 bp, Homo sapiens
cccttcctttcctctgcagc

SEQ ID NO: 4185303 - DNA, 23 bp, Homo sapiens
cccttctcattccaacagtgagt

SEQ ID NO: 4185304 - DNA, 13 bp, Homo sapiens
cccttctctcctt

SEQ ID NO: 4185305 - DNA, 17 bp, Homo sapiens
cccttctctccttccct

SEQ ID NO: 4185306 - DNA, 17 bp, Homo sapiens
cccttgaaattttaaac

SEQ ID NO: 4185307 - DNA, 12 bp, Homo sapiens
cccttgaactct

SEQ ID NO: 4185308 - DNA, 19 bp, Homo sapiens
cccttgaatctgcagggag

SEQ ID NO: 4185309 - DNA, 19 bp, Homo sapiens
cccttgacaactggcaggc

SEQ ID NO: 4185310 - DNA, 23 bp, Homo sapiens
cccttgacgtcaagtctccttcc

SEQ ID NO: 4185311 - DNA, 21 bp, Homo sapiens
cccttgccgccccgtgcctgt

SEQ ID NO: 4185312 - DNA, 15 bp, Homo sapiens
cccttggcttctgct

SEQ ID NO: 4185313 - DNA, 14 bp, Homo sapiens
cccttgtgtcagag

SEQ ID NO: 4185314 - DNA, 21 bp, Homo sapiens
ccctttcccatgatccagaac

SEQ ID NO: 4185315 - DNA, 20 bp, Homo sapiens
ccctttcccccaccccagag

SEQ ID NO: 4185316 - DNA, 14 bp, Homo sapiens
cccttttatcttct

SEQ ID NO: 4185317 - DNA, 13 bp, Homo sapiens
ccgacagcccagc

SEQ ID NO: 4185318 - DNA, 15 bp, Homo sapiens
ccgactctaagctgt

SEQ ID NO: 4185319 - DNA, 16 bp, Homo sapiens
ccgactctaagctgtg

SEQ ID NO: 4185320 - DNA, 17 bp, Homo sapiens
ccgactctaagctgtgt

SEQ ID NO: 4185321 - DNA, 19 bp, Homo sapiens
ccgactctaagctgtgtgc

SEQ ID NO: 4185322 - DNA, 18 bp, Homo sapiens
ccgagcgctttctggaaa

SEQ ID NO: 4185323 - DNA, 21 bp, Homo sapiens
ccgagctactctcttgccagc

SEQ ID NO: 4185324 - DNA, 22 bp, Homo sapiens
ccgagctactctcttgccagca

SEQ ID NO: 4185325 - DNA, 20 bp, Homo sapiens
ccgagggagctgctggctga

SEQ ID NO: 4185326 - DNA, 15 bp, Homo sapiens
ccgcagagcccacgc

SEQ ID NO: 4185327 - DNA, 14 bp, Homo sapiens
ccgcagcctccctc

SEQ ID NO: 4185328 - DNA, 22 bp, Homo sapiens
ccgcagggacggggactggccc

SEQ ID NO: 4185329 - DNA, 19 bp, Homo sapiens
ccgcagtgcccccacccag

SEQ ID NO: 4185330 - DNA, 22 bp, Homo sapiens
ccgcccagctgcacctgccagc

SEQ ID NO: 4185331 - DNA, 14 bp, Homo sapiens
ccgcctctgcccgc

SEQ ID NO: 4185332 - DNA, 21 bp, Homo sapiens
ccgcctgcagaggacagagct

SEQ ID NO: 4185333 - DNA, 19 bp, Homo sapiens
ccgcgagggctactcagca

SEQ ID NO: 4185334 - DNA, 20 bp, Homo sapiens
ccgcgagggctactcagcag

SEQ ID NO: 4185335 - DNA, 16 bp, Homo sapiens
ccgcgcctccttcctt

SEQ ID NO: 4185336 - DNA, 18 bp, Homo sapiens
ccgctaaaagaaactttc

SEQ ID NO: 4185337 - DNA, 17 bp, Homo sapiens
ccgcttcaagctctctg

SEQ ID NO: 4185338 - DNA, 13 bp, Homo sapiens
ccgcttcccagag

SEQ ID NO: 4185339 - DNA, 15 bp, Homo sapiens
ccgcttcccagaggc

SEQ ID NO: 4185340 - DNA, 21 bp, Homo sapiens
ccggaggggttgcgggggagc

SEQ ID NO: 4185341 - DNA, 18 bp, Homo sapiens
ccggcccagagacccctt

SEQ ID NO: 4185342 - DNA, 21 bp, Homo sapiens
ccggcctgatgacagagcgag

SEQ ID NO: 4185343 - DNA, 19 bp, Homo sapiens
ccggctgctcctccagccc

SEQ ID NO: 4185344 - DNA, 20 bp, Homo sapiens
ccggctgctcctccagccct

SEQ ID NO: 4185345 - DNA, 15 bp, Homo sapiens
ccgggggaggaaggg

SEQ ID NO: 4185346 - DNA, 21 bp, Homo sapiens
ccgggtgccccccatgccctc

SEQ ID NO: 4185347 - DNA, 20 bp, Homo sapiens
ccgggtgcctcagagcaggc

SEQ ID NO: 4185348 - DNA, 21 bp, Homo sapiens
ccgggtgcctcagagcaggct

SEQ ID NO: 4185349 - DNA, 13 bp, Homo sapiens
ccggtggcagtgg

SEQ ID NO: 4185350 - DNA, 14 bp, Homo sapiens
ccggtggcagtgga

SEQ ID NO: 4185351 - DNA, 18 bp, Homo sapiens
ccgtctaggattgggcct

SEQ ID NO: 4185352 - DNA, 19 bp, Homo sapiens
ccgtctaggattgggcctc

SEQ ID NO: 4185353 - DNA, 15 bp, Homo sapiens
ccgtgagcatgtttg

SEQ ID NO: 4185354 - DNA, 22 bp, Homo sapiens
ccgtgatttggaagagaggcac

SEQ ID NO: 4185355 - DNA, 22 bp, Homo sapiens
ccgtgcctttctctggctccag

SEQ ID NO: 4185356 - DNA, 17 bp, Homo sapiens
ccgtggtcagagtgcca

SEQ ID NO: 4185357 - DNA, 19 bp, Homo sapiens
ccgtggtcagagtgccact

SEQ ID NO: 4185358 - DNA, 16 bp, Homo sapiens
cctaaagaaaaacaaa

SEQ ID NO: 4185359 - DNA, 15 bp, Homo sapiens
cctaacctggcttat

SEQ ID NO: 4185360 - DNA, 12 bp, Homo sapiens
cctaagcctgtt

SEQ ID NO: 4185361 - DNA, 20 bp, Homo sapiens
cctaccccacctcatgcctg

SEQ ID NO: 4185362 - DNA, 16 bp, Homo sapiens
cctactactcaattgt

SEQ ID NO: 4185363 - DNA, 16 bp, Homo sapiens
cctagaacatccctgg

SEQ ID NO: 4185364 - DNA, 18 bp, Homo sapiens
cctagaacatccctgggc

SEQ ID NO: 4185365 - DNA, 20 bp, Homo sapiens
cctagaacatccctgggcaa

SEQ ID NO: 4185366 - DNA, 14 bp, Homo sapiens
cctagactgttact

SEQ ID NO: 4185367 - DNA, 17 bp, Homo sapiens
cctagcaggatctgccc

SEQ ID NO: 4185368 - DNA, 13 bp, Homo sapiens
cctagcccacttg

SEQ ID NO: 4185369 - DNA, 15 bp, Homo sapiens
cctaggagggaagga

SEQ ID NO: 4185370 - DNA, 18 bp, Homo sapiens
cctaggagggaaggagct

SEQ ID NO: 4185371 - DNA, 23 bp, Homo sapiens
cctatactgcttggagctgagca

SEQ ID NO: 4185372 - DNA, 14 bp, Homo sapiens
cctatagtcccagc

SEQ ID NO: 4185373 - DNA, 18 bp, Homo sapiens
cctatatgatttatagtt

SEQ ID NO: 4185374 - DNA, 13 bp, Homo sapiens
cctatccatcctg

SEQ ID NO: 4185375 - DNA, 18 bp, Homo sapiens
cctatccttggagagcag

SEQ ID NO: 4185376 - DNA, 20 bp, Homo sapiens
cctatccttggagagcagct

SEQ ID NO: 4185377 - DNA, 15 bp, Homo sapiens
cctatgatcccagca

SEQ ID NO: 4185378 - DNA, 12 bp, Homo sapiens
cctatgctttga

SEQ ID NO: 4185379 - DNA, 11 bp, Homo sapiens
cctattctcac

SEQ ID NO: 4185380 - DNA, 19 bp, Homo sapiens
cctattgtgcaatgtaaat

SEQ ID NO: 4185381 - DNA, 16 bp, Homo sapiens
cctattttggagtggt

SEQ ID NO: 4185382 - DNA, 19 bp, Homo sapiens
cctcaaagcacctgaacca

SEQ ID NO: 4185383 - DNA, 21 bp, Homo sapiens
cctcaaagcacctgaaccact

SEQ ID NO: 4185384 - DNA, 15 bp, Homo sapiens
cctcaagaacacctt

SEQ ID NO: 4185385 - DNA, 16 bp, Homo sapiens
cctcaagaacaccttt

SEQ ID NO: 4185386 - DNA, 15 bp, Homo sapiens
cctcacagcctctcc

SEQ ID NO: 4185387 - DNA, 17 bp, Homo sapiens
cctcacagcctctccct

SEQ ID NO: 4185388 - DNA, 19 bp, Homo sapiens
cctcacagcctctccctta

SEQ ID NO: 4185389 - DNA, 14 bp, Homo sapiens
cctcacgctctgga

SEQ ID NO: 4185390 - DNA, 15 bp, Homo sapiens
cctcacgctctggac

SEQ ID NO: 4185391 - DNA, 15 bp, Homo sapiens
cctcagagcaggctc

SEQ ID NO: 4185392 - DNA, 19 bp, Homo sapiens
cctcagagcaggggccaga

SEQ ID NO: 4185393 - DNA, 23 bp, Homo sapiens
cctcagagggataaggcagttga

SEQ ID NO: 4185394 - DNA, 19 bp, Homo sapiens
cctcagcacccctgtctct

SEQ ID NO: 4185395 - DNA, 21 bp, Homo sapiens
cctcagccacaaaactctgtc

SEQ ID NO: 4185396 - DNA, 20 bp, Homo sapiens
cctcagcctagaccctcctc

SEQ ID NO: 4185397 - DNA, 21 bp, Homo sapiens
cctcaggccaggtgcagtggc

SEQ ID NO: 4185398 - DNA, 20 bp, Homo sapiens
cctcagggccaagcgggggc

SEQ ID NO: 4185399 - DNA, 19 bp, Homo sapiens
cctcaggtagtactgggaa

SEQ ID NO: 4185400 - DNA, 21 bp, Homo sapiens
cctcagtgggctccctggccc

SEQ ID NO: 4185401 - DNA, 22 bp, Homo sapiens
cctcagtgggctccctggccca

SEQ ID NO: 4185402 - DNA, 18 bp, Homo sapiens
cctcatcaccatcgtgtt

SEQ ID NO: 4185403 - DNA, 14 bp, Homo sapiens
cctcattcccctcg

SEQ ID NO: 4185404 - DNA, 19 bp, Homo sapiens
cctcattcgcctgtgggaa

SEQ ID NO: 4185405 - DNA, 16 bp, Homo sapiens
cctccaacccacagcc

SEQ ID NO: 4185406 - DNA, 19 bp, Homo sapiens
cctccaacccacagccttt

SEQ ID NO: 4185407 - DNA, 16 bp, Homo sapiens
cctccacagccgcagc

SEQ ID NO: 4185408 - DNA, 23 bp, Homo sapiens
cctccacagttcgacctgcggct

SEQ ID NO: 4185409 - DNA, 18 bp, Homo sapiens
cctccaccaaaccccact

SEQ ID NO: 4185410 - DNA, 18 bp, Homo sapiens
cctccaccgcagaaggaa

SEQ ID NO: 4185411 - DNA, 14 bp, Homo sapiens
cctccactccacct

SEQ ID NO: 4185412 - DNA, 20 bp, Homo sapiens
cctccagagacaggaaagaa

SEQ ID NO: 4185413 - DNA, 13 bp, Homo sapiens
cctccagcccttc

SEQ ID NO: 4185414 - DNA, 16 bp, Homo sapiens
cctccaggcatgctgg

SEQ ID NO: 4185415 - DNA, 19 bp, Homo sapiens
cctccagggaatccgcctg

SEQ ID NO: 4185416 - DNA, 20 bp, Homo sapiens
cctccagggaatccgcctgc

SEQ ID NO: 4185417 - DNA, 16 bp, Homo sapiens
cctccagtgctggatt

SEQ ID NO: 4185418 - DNA, 17 bp, Homo sapiens
cctccatttcaactcca

SEQ ID NO: 4185419 - DNA, 20 bp, Homo sapiens
cctccatttcaactccagaa

SEQ ID NO: 4185420 - DNA, 22 bp, Homo sapiens
cctcccacaatctgggactttc

SEQ ID NO: 4185421 - DNA, 12 bp, Homo sapiens
cctcccagcctg

SEQ ID NO: 4185422 - DNA, 17 bp, Homo sapiens
cctcccagcgtgtgtat

SEQ ID NO: 4185423 - DNA, 22 bp, Homo sapiens
cctcccataattgctttgccaa

SEQ ID NO: 4185424 - DNA, 18 bp, Homo sapiens
cctcccatggccttccct

SEQ ID NO: 4185425 - DNA, 13 bp, Homo sapiens
cctccccacagtc

SEQ ID NO: 4185426 - DNA, 14 bp, Homo sapiens
cctccccaccttcc

SEQ ID NO: 4185427 - DNA, 15 bp, Homo sapiens
cctccccaccttccc

SEQ ID NO: 4185428 - DNA, 19 bp, Homo sapiens
cctccccaccttccccaga

SEQ ID NO: 4185429 - DNA, 19 bp, Homo sapiens
cctcccctggtcctgcact

SEQ ID NO: 4185430 - DNA, 22 bp, Homo sapiens
cctcccctggtcctgcactgtc

SEQ ID NO: 4185431 - DNA, 17 bp, Homo sapiens
cctcccgggagcacaga

SEQ ID NO: 4185432 - DNA, 14 bp, Homo sapiens
cctccctctgacct

SEQ ID NO: 4185433 - DNA, 18 bp, Homo sapiens
cctccctcttccttcccc

SEQ ID NO: 4185434 - DNA, 21 bp, Homo sapiens
cctcccttttatcttctagcc

SEQ ID NO: 4185435 - DNA, 13 bp, Homo sapiens
cctccgcccttcc

SEQ ID NO: 4185436 - DNA, 14 bp, Homo sapiens
cctccgcccttccc

SEQ ID NO: 4185437 - DNA, 12 bp, Homo sapiens
cctcctctgtgc

SEQ ID NO: 4185438 - DNA, 13 bp, Homo sapiens
cctcctctgtgct

SEQ ID NO: 4185439 - DNA, 18 bp, Homo sapiens
cctcctgacctgaggctc

SEQ ID NO: 4185440 - DNA, 11 bp, Homo sapiens
cctccttccct

SEQ ID NO: 4185441 - DNA, 22 bp, Homo sapiens
cctccttcccttctctccttcc

SEQ ID NO: 4185442 - DNA, 15 bp, Homo sapiens
cctccttgctctgca

SEQ ID NO: 4185443 - DNA, 17 bp, Homo sapiens
cctcggagctgccagcc

SEQ ID NO: 4185444 - DNA, 18 bp, Homo sapiens
cctcggccgtacatctct

SEQ ID NO: 4185445 - DNA, 16 bp, Homo sapiens
cctcgtaccagccagg

SEQ ID NO: 4185446 - DNA, 19 bp, Homo sapiens
cctcgtgcagagctggggc

SEQ ID NO: 4185447 - DNA, 21 bp, Homo sapiens
cctctaacccccagtgccaca

SEQ ID NO: 4185448 - DNA, 22 bp, Homo sapiens
cctctaacccccagtgccacag

SEQ ID NO: 4185449 - DNA, 19 bp, Homo sapiens
cctctaagccactcttcca

SEQ ID NO: 4185450 - DNA, 12 bp, Homo sapiens
cctctaattgaa

SEQ ID NO: 4185451 - DNA, 13 bp, Homo sapiens
cctctacctggat

SEQ ID NO: 4185452 - DNA, 15 bp, Homo sapiens
cctctagtgccctcc

SEQ ID NO: 4185453 - DNA, 12 bp, Homo sapiens
cctctctctccg

SEQ ID NO: 4185454 - DNA, 16 bp, Homo sapiens
cctctctgctccagag

SEQ ID NO: 4185455 - DNA, 17 bp, Homo sapiens
cctctgacctgcaggcc

SEQ ID NO: 4185456 - DNA, 19 bp, Homo sapiens
cctctgacctgcaggccaa

SEQ ID NO: 4185457 - DNA, 20 bp, Homo sapiens
cctctgacctgcaggccaag

SEQ ID NO: 4185458 - DNA, 11 bp, Homo sapiens
cctctgagaag

SEQ ID NO: 4185459 - DNA, 19 bp, Homo sapiens
cctctgatacccagagcat

SEQ ID NO: 4185460 - DNA, 14 bp, Homo sapiens
cctctgcagcactt

SEQ ID NO: 4185461 - DNA, 16 bp, Homo sapiens
cctctgcagcacttta

SEQ ID NO: 4185462 - DNA, 15 bp, Homo sapiens
cctctgcccgcagag

SEQ ID NO: 4185463 - DNA, 16 bp, Homo sapiens
cctctgcccgcagagc

SEQ ID NO: 4185464 - DNA, 17 bp, Homo sapiens
cctctgcccgcagagcc

SEQ ID NO: 4185465 - DNA, 22 bp, Homo sapiens
cctctgctactgaggcagggga

SEQ ID NO: 4185466 - DNA, 14 bp, Homo sapiens
cctctgctgccatg

SEQ ID NO: 4185467 - DNA, 15 bp, Homo sapiens
cctctgctgccatgg

SEQ ID NO: 4185468 - DNA, 19 bp, Homo sapiens
cctctgggccaagactcct

SEQ ID NO: 4185469 - DNA, 15 bp, Homo sapiens
cctctgtcttctgga

SEQ ID NO: 4185470 - DNA, 21 bp, Homo sapiens
cctcttaaagctgcctgtagt

SEQ ID NO: 4185471 - DNA, 23 bp, Homo sapiens
cctcttaaattatatatttattt

SEQ ID NO: 4185472 - DNA, 19 bp, Homo sapiens
cctcttataacttctgaag

SEQ ID NO: 4185473 - DNA, 14 bp, Homo sapiens
cctcttccctctga

SEQ ID NO: 4185474 - DNA, 15 bp, Homo sapiens
cctcttccctctgat

SEQ ID NO: 4185475 - DNA, 15 bp, Homo sapiens
cctcttcctctgggc

SEQ ID NO: 4185476 - DNA, 21 bp, Homo sapiens
cctctttccccacctcttcct

SEQ ID NO: 4185477 - DNA, 15 bp, Homo sapiens
cctctttgcatggaa

SEQ ID NO: 4185478 - DNA, 22 bp, Homo sapiens
cctgaagtcaaaccttaagata

SEQ ID NO: 4185479 - DNA, 17 bp, Homo sapiens
cctgaatgacctgcagt

SEQ ID NO: 4185480 - DNA, 21 bp, Homo sapiens
cctgaatgacctgcagtcagg

SEQ ID NO: 4185481 - DNA, 20 bp, Homo sapiens
cctgacaagcactgctaggc

SEQ ID NO: 4185482 - DNA, 13 bp, Homo sapiens
cctgacctgaggc

SEQ ID NO: 4185483 - DNA, 15 bp, Homo sapiens
cctgacctgaggctc

SEQ ID NO: 4185484 - DNA, 16 bp, Homo sapiens
cctgactctctgtgac

SEQ ID NO: 4185485 - DNA, 21 bp, Homo sapiens
cctgactgcacacagctaggc

SEQ ID NO: 4185486 - DNA, 21 bp, Homo sapiens
cctgactggtgctataggctg

SEQ ID NO: 4185487 - DNA, 22 bp, Homo sapiens
cctgagaataagaaagtttcac

SEQ ID NO: 4185488 - DNA, 17 bp, Homo sapiens
cctgagcctaactccct

SEQ ID NO: 4185489 - DNA, 17 bp, Homo sapiens
cctgaggctcctgtgct

SEQ ID NO: 4185490 - DNA, 14 bp, Homo sapiens
cctgaggctgagac

SEQ ID NO: 4185491 - DNA, 18 bp, Homo sapiens
cctgagtcacccatgaag

SEQ ID NO: 4185492 - DNA, 23 bp, Homo sapiens
cctgagtctgctatattttcatg

SEQ ID NO: 4185493 - DNA, 19 bp, Homo sapiens
cctgagtggatctccaagg

SEQ ID NO: 4185494 - DNA, 20 bp, Homo sapiens
cctgagtggatctccaagga

SEQ ID NO: 4185495 - DNA, 22 bp, Homo sapiens
cctgatgaaaaatatgtgcttg

SEQ ID NO: 4185496 - DNA, 16 bp, Homo sapiens
cctgatgacagagcga

SEQ ID NO: 4185497 - DNA, 21 bp, Homo sapiens
cctgatggcacttagctatca

SEQ ID NO: 4185498 - DNA, 18 bp, Homo sapiens
cctgatggtacaggaaag

SEQ ID NO: 4185499 - DNA, 13 bp, Homo sapiens
cctgatttggagc

SEQ ID NO: 4185500 - DNA, 20 bp, Homo sapiens
cctgcaagacacaggctcag

SEQ ID NO: 4185501 - DNA, 12 bp, Homo sapiens
cctgcaaggact

SEQ ID NO: 4185502 - DNA, 17 bp, Homo sapiens
cctgcaatctccagggc

SEQ ID NO: 4185503 - DNA, 17 bp, Homo sapiens
cctgcacctgcttctca

SEQ ID NO: 4185504 - DNA, 20 bp, Homo sapiens
cctgcactgtcccggagctc

SEQ ID NO: 4185505 - DNA, 13 bp, Homo sapiens
cctgcagagagaa

SEQ ID NO: 4185506 - DNA, 15 bp, Homo sapiens
cctgcagagagaagc

SEQ ID NO: 4185507 - DNA, 15 bp, Homo sapiens
cctgcagagctatgg

SEQ ID NO: 4185508 - DNA, 20 bp, Homo sapiens
cctgcagcgagctgagatca

SEQ ID NO: 4185509 - DNA, 21 bp, Homo sapiens
cctgcaggccaagagcagagg

SEQ ID NO: 4185510 - DNA, 13 bp, Homo sapiens
cctgccacctgtc

SEQ ID NO: 4185511 - DNA, 23 bp, Homo sapiens
cctgccactttggtacatggcca

SEQ ID NO: 4185512 - DNA, 21 bp, Homo sapiens
cctgccattcttctggtgcta

SEQ ID NO: 4185513 - DNA, 23 bp, Homo sapiens
cctgccattcttctggtgctact

SEQ ID NO: 4185514 - DNA, 23 bp, Homo sapiens
cctgccatttgcaccctccgcct

SEQ ID NO: 4185515 - DNA, 16 bp, Homo sapiens
cctgcccagtctggaa

SEQ ID NO: 4185516 - DNA, 22 bp, Homo sapiens
cctgcccccgacagcccagcct

SEQ ID NO: 4185517 - DNA, 16 bp, Homo sapiens
cctgccccctggtgga

SEQ ID NO: 4185518 - DNA, 14 bp, Homo sapiens
cctgccctcaggga

SEQ ID NO: 4185519 - DNA, 11 bp, Homo sapiens
cctgccctgcc

SEQ ID NO: 4185520 - DNA, 20 bp, Homo sapiens
cctgccctgctgccgcctcc

SEQ ID NO: 4185521 - DNA, 12 bp, Homo sapiens
cctgccctggag

SEQ ID NO: 4185522 - DNA, 18 bp, Homo sapiens
cctgcctatccatcctgc

SEQ ID NO: 4185523 - DNA, 15 bp, Homo sapiens
cctgcctgcctgtgg

SEQ ID NO: 4185524 - DNA, 16 bp, Homo sapiens
cctgcctgtggagaca

SEQ ID NO: 4185525 - DNA, 23 bp, Homo sapiens
cctgcctgtggagacagccctgc

SEQ ID NO: 4185526 - DNA, 22 bp, Homo sapiens
cctgccttgaagccactgaagc

SEQ ID NO: 4185527 - DNA, 15 bp, Homo sapiens
cctgcgaaggggccc

SEQ ID NO: 4185528 - DNA, 18 bp, Homo sapiens
cctgcgattttgcctgtg

SEQ ID NO: 4185529 - DNA, 21 bp, Homo sapiens
cctgcggctgctgtgtgcctt

SEQ ID NO: 4185530 - DNA, 22 bp, Homo sapiens
cctgcgtgccgggagaggactc

SEQ ID NO: 4185531 - DNA, 16 bp, Homo sapiens
cctgctacacaaaagc

SEQ ID NO: 4185532 - DNA, 20 bp, Homo sapiens
cctgctgccaggctcccact

SEQ ID NO: 4185533 - DNA, 14 bp, Homo sapiens
cctgctgccgcctc

SEQ ID NO: 4185534 - DNA, 23 bp, Homo sapiens
cctgctgccgcctcccagcctgg

SEQ ID NO: 4185535 - DNA, 17 bp, Homo sapiens
cctgctgggtaaactgt

SEQ ID NO: 4185536 - DNA, 17 bp, Homo sapiens
cctgcttcatgctcagc

SEQ ID NO: 4185537 - DNA, 13 bp, Homo sapiens
cctgcttctcagc

SEQ ID NO: 4185538 - DNA, 15 bp, Homo sapiens
cctggaaaataaatc

SEQ ID NO: 4185539 - DNA, 17 bp, Homo sapiens
cctggaaaggctcagtc

SEQ ID NO: 4185540 - DNA, 21 bp, Homo sapiens
cctggaaaggctcagtctcag

SEQ ID NO: 4185541 - DNA, 22 bp, Homo sapiens
cctggaaaggctcagtctcagg

SEQ ID NO: 4185542 - DNA, 18 bp, Homo sapiens
cctggaccgcttcccaga

SEQ ID NO: 4185543 - DNA, 21 bp, Homo sapiens
cctggaccgcttcccagaggc

SEQ ID NO: 4185544 - DNA, 11 bp, Homo sapiens
cctggagaagc

SEQ ID NO: 4185545 - DNA, 16 bp, Homo sapiens
cctggagatgatgatg

SEQ ID NO: 4185546 - DNA, 17 bp, Homo sapiens
cctggagcatcccaggc

SEQ ID NO: 4185547 - DNA, 12 bp, Homo sapiens
cctggagcccgc

SEQ ID NO: 4185548 - DNA, 18 bp, Homo sapiens
cctggagcggagcttgcc

SEQ ID NO: 4185549 - DNA, 19 bp, Homo sapiens
cctggaggatccctccatc

SEQ ID NO: 4185550 - DNA, 17 bp, Homo sapiens
cctggagtctcttggtg

SEQ ID NO: 4185551 - DNA, 17 bp, Homo sapiens
cctggcatgtcagagcc

SEQ ID NO: 4185552 - DNA, 13 bp, Homo sapiens
cctggccagaggc

SEQ ID NO: 4185553 - DNA, 15 bp, Homo sapiens
cctggcccagccagc

SEQ ID NO: 4185554 - DNA, 15 bp, Homo sapiens
cctggccctcttctt

SEQ ID NO: 4185555 - DNA, 16 bp, Homo sapiens
cctggctcccagggtc

SEQ ID NO: 4185556 - DNA, 22 bp, Homo sapiens
cctggcttctggagcccttggg

SEQ ID NO: 4185557 - DNA, 15 bp, Homo sapiens
cctggcttgctgtgg

SEQ ID NO: 4185558 - DNA, 16 bp, Homo sapiens
cctggcttgctgtggc

SEQ ID NO: 4185559 - DNA, 22 bp, Homo sapiens
cctggctttggtccccagcatt

SEQ ID NO: 4185560 - DNA, 17 bp, Homo sapiens
cctgggaatcctgctgc

SEQ ID NO: 4185561 - DNA, 20 bp, Homo sapiens
cctgggaatcctgctgccag

SEQ ID NO: 4185562 - DNA, 14 bp, Homo sapiens
cctgggaggcggag

SEQ ID NO: 4185563 - DNA, 22 bp, Homo sapiens
cctgggcatgtttgtctgtgtg

SEQ ID NO: 4185564 - DNA, 20 bp, Homo sapiens
cctgggcccacagagcctgg

SEQ ID NO: 4185565 - DNA, 14 bp, Homo sapiens
cctgggctctgccc

SEQ ID NO: 4185566 - DNA, 22 bp, Homo sapiens
cctgggctctgccccagctctg

SEQ ID NO: 4185567 - DNA, 13 bp, Homo sapiens
cctgggctctggt

SEQ ID NO: 4185568 - DNA, 19 bp, Homo sapiens
cctgggggctgctgcactg

SEQ ID NO: 4185569 - DNA, 19 bp, Homo sapiens
cctggggtgatagaacaag

SEQ ID NO: 4185570 - DNA, 16 bp, Homo sapiens
cctgggttgcagacag

SEQ ID NO: 4185571 - DNA, 15 bp, Homo sapiens
cctggtccctcaccc

SEQ ID NO: 4185572 - DNA, 19 bp, Homo sapiens
cctggtcgtctatcccagt

SEQ ID NO: 4185573 - DNA, 22 bp, Homo sapiens
cctggtcgtctatcccagtgtg

SEQ ID NO: 4185574 - DNA, 16 bp, Homo sapiens
cctggtctttcctctg

SEQ ID NO: 4185575 - DNA, 17 bp, Homo sapiens
cctggtgaggcccagcc

SEQ ID NO: 4185576 - DNA, 18 bp, Homo sapiens
cctggtggacagtcctgg

SEQ ID NO: 4185577 - DNA, 19 bp, Homo sapiens
cctggtggacagtcctggg

SEQ ID NO: 4185578 - DNA, 16 bp, Homo sapiens
cctggttcatatttat

SEQ ID NO: 4185579 - DNA, 23 bp, Homo sapiens
cctggttttctcttactgcagta

SEQ ID NO: 4185580 - DNA, 16 bp, Homo sapiens
cctgtagtgccccctc

SEQ ID NO: 4185581 - DNA, 23 bp, Homo sapiens
cctgtagtgccccctctaacccc

SEQ ID NO: 4185582 - DNA, 16 bp, Homo sapiens
cctgtagttaggaaat

SEQ ID NO: 4185583 - DNA, 17 bp, Homo sapiens
cctgtatagacagcact

SEQ ID NO: 4185584 - DNA, 12 bp, Homo sapiens
cctgtatagtta

SEQ ID NO: 4185585 - DNA, 16 bp, Homo sapiens
cctgtattcagacaga

SEQ ID NO: 4185586 - DNA, 23 bp, Homo sapiens
cctgtcagcttccccaggagctc

SEQ ID NO: 4185587 - DNA, 17 bp, Homo sapiens
cctgtccacctcaccag

SEQ ID NO: 4185588 - DNA, 16 bp, Homo sapiens
cctgtcctggtacagc

SEQ ID NO: 4185589 - DNA, 15 bp, Homo sapiens
cctgtgactatggct

SEQ ID NO: 4185590 - DNA, 17 bp, Homo sapiens
cctgtggggcctgatgg

SEQ ID NO: 4185591 - DNA, 21 bp, Homo sapiens
cctgtggggcctgatggtgct

SEQ ID NO: 4185592 - DNA, 18 bp, Homo sapiens
cctgtggtgaggtcctgt

SEQ ID NO: 4185593 - DNA, 13 bp, Homo sapiens
cctgtgtctggcc

SEQ ID NO: 4185594 - DNA, 20 bp, Homo sapiens
cctgttgaaagttgtctggc

SEQ ID NO: 4185595 - DNA, 17 bp, Homo sapiens
cctgttgagcatcacag

SEQ ID NO: 4185596 - DNA, 22 bp, Homo sapiens
ccttaaaggcaccatctaatag

SEQ ID NO: 4185597 - DNA, 15 bp, Homo sapiens
ccttaccaactttct

SEQ ID NO: 4185598 - DNA, 12 bp, Homo sapiens
ccttactcacct

SEQ ID NO: 4185599 - DNA, 14 bp, Homo sapiens
ccttactcacctct

SEQ ID NO: 4185600 - DNA, 15 bp, Homo sapiens
ccttagtttttacct

SEQ ID NO: 4185601 - DNA, 13 bp, Homo sapiens
ccttatccaggac

SEQ ID NO: 4185602 - DNA, 17 bp, Homo sapiens
ccttatccaggactctg

SEQ ID NO: 4185603 - DNA, 13 bp, Homo sapiens
ccttcaagtgcca

SEQ ID NO: 4185604 - DNA, 17 bp, Homo sapiens
ccttcaagttagctcag

SEQ ID NO: 4185605 - DNA, 14 bp, Homo sapiens
ccttcaattcctgg

SEQ ID NO: 4185606 - DNA, 23 bp, Homo sapiens
ccttcactccggtgtgcctgcag

SEQ ID NO: 4185607 - DNA, 23 bp, Homo sapiens
ccttccccagactcagctccaga

SEQ ID NO: 4185608 - DNA, 20 bp, Homo sapiens
ccttcccccatcccctttcc

SEQ ID NO: 4185609 - DNA, 23 bp, Homo sapiens
ccttcccccatcccctttcctcc

SEQ ID NO: 4185610 - DNA, 16 bp, Homo sapiens
ccttccccctcccagg

SEQ ID NO: 4185611 - DNA, 18 bp, Homo sapiens
ccttccctccccacagtc

SEQ ID NO: 4185612 - DNA, 14 bp, Homo sapiens
ccttccctctttcc

SEQ ID NO: 4185613 - DNA, 20 bp, Homo sapiens
ccttccctctttccccacct

SEQ ID NO: 4185614 - DNA, 15 bp, Homo sapiens
ccttccctctttcta

SEQ ID NO: 4185615 - DNA, 17 bp, Homo sapiens
ccttccctgacactgtc

SEQ ID NO: 4185616 - DNA, 21 bp, Homo sapiens
ccttccctgacactgtctgct

SEQ ID NO: 4185617 - DNA, 17 bp, Homo sapiens
ccttccgctcctttacc

SEQ ID NO: 4185618 - DNA, 18 bp, Homo sapiens
ccttccgctcctttacct

SEQ ID NO: 4185619 - DNA, 21 bp, Homo sapiens
ccttcctcgtgcagagctggg

SEQ ID NO: 4185620 - DNA, 17 bp, Homo sapiens
ccttcctttcctctgca

SEQ ID NO: 4185621 - DNA, 22 bp, Homo sapiens
ccttcctttcctctgcagcact

SEQ ID NO: 4185622 - DNA, 17 bp, Homo sapiens
ccttcgcggtggaaggc

SEQ ID NO: 4185623 - DNA, 20 bp, Homo sapiens
ccttcgcggtggaaggcccg

SEQ ID NO: 4185624 - DNA, 19 bp, Homo sapiens
ccttcgtccccagttgccg

SEQ ID NO: 4185625 - DNA, 22 bp, Homo sapiens
ccttctcagcctacagcagtgt

SEQ ID NO: 4185626 - DNA, 20 bp, Homo sapiens
ccttctgtccaccagaccca

SEQ ID NO: 4185627 - DNA, 16 bp, Homo sapiens
ccttcttccctgtttt

SEQ ID NO: 4185628 - DNA, 22 bp, Homo sapiens
ccttgaagccactgaagctggg

SEQ ID NO: 4185629 - DNA, 19 bp, Homo sapiens
ccttgaatctgcagggagc

SEQ ID NO: 4185630 - DNA, 21 bp, Homo sapiens
ccttgcaggtcggtttggttt

SEQ ID NO: 4185631 - DNA, 18 bp, Homo sapiens
ccttgcccggattctggg

SEQ ID NO: 4185632 - DNA, 18 bp, Homo sapiens
ccttgccttttaaaagaa

SEQ ID NO: 4185633 - DNA, 19 bp, Homo sapiens
ccttgccttttaaaagaaa

SEQ ID NO: 4185634 - DNA, 16 bp, Homo sapiens
ccttgctgtcctaggc

SEQ ID NO: 4185635 - DNA, 19 bp, Homo sapiens
ccttggaaagttcagccag

SEQ ID NO: 4185636 - DNA, 20 bp, Homo sapiens
ccttggaaagttcagccaga

SEQ ID NO: 4185637 - DNA, 15 bp, Homo sapiens
ccttggaagtttcat

SEQ ID NO: 4185638 - DNA, 16 bp, Homo sapiens
ccttggactcctccca

SEQ ID NO: 4185639 - DNA, 15 bp, Homo sapiens
ccttggagagcagct

SEQ ID NO: 4185640 - DNA, 19 bp, Homo sapiens
ccttggagagcagctggct

SEQ ID NO: 4185641 - DNA, 15 bp, Homo sapiens
ccttggcttctgctt

SEQ ID NO: 4185642 - DNA, 16 bp, Homo sapiens
ccttggcttctgcttc

SEQ ID NO: 4185643 - DNA, 17 bp, Homo sapiens
ccttggtaattatatct

SEQ ID NO: 4185644 - DNA, 21 bp, Homo sapiens
ccttggtaattatatctgttt

SEQ ID NO: 4185645 - DNA, 14 bp, Homo sapiens
ccttgtcactgaag

SEQ ID NO: 4185646 - DNA, 15 bp, Homo sapiens
ccttgtcactgaaga

SEQ ID NO: 4185647 - DNA, 20 bp, Homo sapiens
ccttgtgtcaagacatttct

SEQ ID NO: 4185648 - DNA, 17 bp, Homo sapiens
cctttaggcagcctgcc

SEQ ID NO: 4185649 - DNA, 18 bp, Homo sapiens
cctttaggcagcctgccg

SEQ ID NO: 4185650 - DNA, 17 bp, Homo sapiens
cctttatagctcatcac

SEQ ID NO: 4185651 - DNA, 18 bp, Homo sapiens
cctttatagctctcatca

SEQ ID NO: 4185652 - DNA, 12 bp, Homo sapiens
cctttcagctgt

SEQ ID NO: 4185653 - DNA, 15 bp, Homo sapiens
cctttcagctgtgaa

SEQ ID NO: 4185654 - DNA, 20 bp, Homo sapiens
cctttcccatgatccagaac

SEQ ID NO: 4185655 - DNA, 14 bp, Homo sapiens
cctttcctctgcag

SEQ ID NO: 4185656 - DNA, 21 bp, Homo sapiens
cctttcctctgcagcacttta

SEQ ID NO: 4185657 - DNA, 19 bp, Homo sapiens
cctttctagagcactgcca

SEQ ID NO: 4185658 - DNA, 17 bp, Homo sapiens
cctttctctggctccag

SEQ ID NO: 4185659 - DNA, 13 bp, Homo sapiens
cctttctggaagt

SEQ ID NO: 4185660 - DNA, 22 bp, Homo sapiens
cctttggaacaattattttatt

SEQ ID NO: 4185661 - DNA, 18 bp, Homo sapiens
cctttgggatcagcctcc

SEQ ID NO: 4185662 - DNA, 16 bp, Homo sapiens
ccttttatagctatta

SEQ ID NO: 4185663 - DNA, 12 bp, Homo sapiens
ccttttcttcct

SEQ ID NO: 4185664 - DNA, 13 bp, Homo sapiens
ccttttgctgctg

SEQ ID NO: 4185665 - DNA, 16 bp, Homo sapiens
cctttttctttataaa

SEQ ID NO: 4185666 - DNA, 20 bp, Homo sapiens
cctttttctttataaacttt

SEQ ID NO: 4185667 - DNA, 22 bp, Homo sapiens
ccttttttatttttttaagctg

SEQ ID NO: 4185668 - DNA, 21 bp, Homo sapiens
cgaaaacgttgacccctttcc

SEQ ID NO: 4185669 - DNA, 10 bp, Homo sapiens
cgaaagctga

SEQ ID NO: 4185670 - DNA, 13 bp, Homo sapiens
cgaaggggccctg

SEQ ID NO: 4185671 - DNA, 22 bp, Homo sapiens
cgaattaatagcttttattgta

SEQ ID NO: 4185672 - DNA, 17 bp, Homo sapiens
cgaatttttcagatgat

SEQ ID NO: 4185673 - DNA, 11 bp, Homo sapiens
cgacagagcaa

SEQ ID NO: 4185674 - DNA, 17 bp, Homo sapiens
cgaccatcgtccagccc

SEQ ID NO: 4185675 - DNA, 16 bp, Homo sapiens
cgacgtccccaaacct

SEQ ID NO: 4185676 - DNA, 15 bp, Homo sapiens
cgactctaagctgtg

SEQ ID NO: 4185677 - DNA, 17 bp, Homo sapiens
cgactctaagctgtgtg

SEQ ID NO: 4185678 - DNA, 13 bp, Homo sapiens
cgactcttcctgc

SEQ ID NO: 4185679 - DNA, 15 bp, Homo sapiens
cgactcttcctgcaa

SEQ ID NO: 4185680 - DNA, 18 bp, Homo sapiens
cgactcttcctgcaaagg

SEQ ID NO: 4185681 - DNA, 21 bp, Homo sapiens
cgactgttgtacaagctcagg

SEQ ID NO: 4185682 - DNA, 17 bp, Homo sapiens
cgactttatacagaact

SEQ ID NO: 4185683 - DNA, 16 bp, Homo sapiens
cgagaccagcctggcc

SEQ ID NO: 4185684 - DNA, 17 bp, Homo sapiens
cgagaccagcctggcca

SEQ ID NO: 4185685 - DNA, 16 bp, Homo sapiens
cgagacggctggacct

SEQ ID NO: 4185686 - DNA, 14 bp, Homo sapiens
cgagagtctgtctc

SEQ ID NO: 4185687 - DNA, 16 bp, Homo sapiens
cgagctactctcttgc

SEQ ID NO: 4185688 - DNA, 21 bp, Homo sapiens
cgagctactctcttgccagca

SEQ ID NO: 4185689 - DNA, 14 bp, Homo sapiens
cgaggtagagtttg

SEQ ID NO: 4185690 - DNA, 20 bp, Homo sapiens
cgaggtgtcaccctgcagag

SEQ ID NO: 4185691 - DNA, 21 bp, Homo sapiens
cgaggtgtcaccctgcagagc

SEQ ID NO: 4185692 - DNA, 19 bp, Homo sapiens
cgataatcgctcttttcca

SEQ ID NO: 4185693 - DNA, 14 bp, Homo sapiens
cgatcaagtccaga

SEQ ID NO: 4185694 - DNA, 16 bp, Homo sapiens
cgatcaagtccagagc

SEQ ID NO: 4185695 - DNA, 21 bp, Homo sapiens
cgatgaatttggagactctgt

SEQ ID NO: 4185696 - DNA, 23 bp, Homo sapiens
cgatgaatttggagactctgtgg

SEQ ID NO: 4185697 - DNA, 10 bp, Homo sapiens
cgcacacaca

SEQ ID NO: 4185698 - DNA, 12 bp, Homo sapiens
cgcacacacacc

SEQ ID NO: 4185699 - DNA, 13 bp, Homo sapiens
cgcacatgttatc

SEQ ID NO: 4185700 - DNA, 16 bp, Homo sapiens
cgcacctgccccctgg

SEQ ID NO: 4185701 - DNA, 12 bp, Homo sapiens
cgcagagcccac

SEQ ID NO: 4185702 - DNA, 21 bp, Homo sapiens
cgcatttctcatgcttcttct

SEQ ID NO: 4185703 - DNA, 10 bp, Homo sapiens
cgccaccccc

SEQ ID NO: 4185704 - DNA, 16 bp, Homo sapiens
cgccacggggaggggg

SEQ ID NO: 4185705 - DNA, 21 bp, Homo sapiens
cgccactacactccagcctga

SEQ ID NO: 4185706 - DNA, 21 bp, Homo sapiens
cgccactgcactccagcctgg

SEQ ID NO: 4185707 - DNA, 23 bp, Homo sapiens
cgccactgcactccagcctgggc

SEQ ID NO: 4185708 - DNA, 20 bp, Homo sapiens
cgccactgcactccggcctg

SEQ ID NO: 4185709 - DNA, 13 bp, Homo sapiens
cgccccccacctt

SEQ ID NO: 4185710 - DNA, 20 bp, Homo sapiens
cgcccttccctgacactgtc

SEQ ID NO: 4185711 - DNA, 23 bp, Homo sapiens
cgcccttccctgacactgtctgc

SEQ ID NO: 4185712 - DNA, 14 bp, Homo sapiens
cgccgagggcagcc

SEQ ID NO: 4185713 - DNA, 16 bp, Homo sapiens
cgccgggcaggcctgc

SEQ ID NO: 4185714 - DNA, 20 bp, Homo sapiens
cgcctctgcccgcagagccc

SEQ ID NO: 4185715 - DNA, 16 bp, Homo sapiens
cgcctcttcctctggg

SEQ ID NO: 4185716 - DNA, 15 bp, Homo sapiens
cgcctgtagtcccag

SEQ ID NO: 4185717 - DNA, 23 bp, Homo sapiens
cgcgccactacactccagcctga

SEQ ID NO: 4185718 - DNA, 13 bp, Homo sapiens
cgcgtctgcccca

SEQ ID NO: 4185719 - DNA, 15 bp, Homo sapiens
cgcgtctgccccacc

SEQ ID NO: 4185720 - DNA, 13 bp, Homo sapiens
cgctaaaagaaac

SEQ ID NO: 4185721 - DNA, 11 bp, Homo sapiens
cgctcatctgg

SEQ ID NO: 4185722 - DNA, 24 bp, Homo sapiens
cgctcatctggcttttcgcttgct

SEQ ID NO: 4185723 - DNA, 20 bp, Homo sapiens
cgctcccgcatttctcatgc

SEQ ID NO: 4185724 - DNA, 16 bp, Homo sapiens
cgctgtcctttctaga

SEQ ID NO: 4185725 - DNA, 19 bp, Homo sapiens
cgcttgaaccggggaggtg

SEQ ID NO: 4185726 - DNA, 16 bp, Homo sapiens
cgcttgcttctgcagc

SEQ ID NO: 4185727 - DNA, 23 bp, Homo sapiens
cgcttgcttctgcagcaactccc

SEQ ID NO: 4185728 - DNA, 21 bp, Homo sapiens
cggaagaagagatcaggaaga

SEQ ID NO: 4185729 - DNA, 18 bp, Homo sapiens
cggaccgcgtagagagcc

SEQ ID NO: 4185730 - DNA, 19 bp, Homo sapiens
cggagagtacagtgagcca

SEQ ID NO: 4185731 - DNA, 21 bp, Homo sapiens
cggagagtacagtgagccaag

SEQ ID NO: 4185732 - DNA, 22 bp, Homo sapiens
cggagcctgcctccttcagtga

SEQ ID NO: 4185733 - DNA, 16 bp, Homo sapiens
cggagcttgcctgcct

SEQ ID NO: 4185734 - DNA, 18 bp, Homo sapiens
cggagcttgcctgcctgc

SEQ ID NO: 4185735 - DNA, 23 bp, Homo sapiens
cggagcttgcctgcctgcctgtg

SEQ ID NO: 4185736 - DNA, 16 bp, Homo sapiens
cggaggcggctccagg

SEQ ID NO: 4185737 - DNA, 19 bp, Homo sapiens
cggaggctcggccgtgggc

SEQ ID NO: 4185738 - DNA, 22 bp, Homo sapiens
cggaggctcggccgtgggccgg

SEQ ID NO: 4185739 - DNA, 14 bp, Homo sapiens
cggaggggacccag

SEQ ID NO: 4185740 - DNA, 19 bp, Homo sapiens
cggcccagagaccccttcc

SEQ ID NO: 4185741 - DNA, 20 bp, Homo sapiens
cggcccagagaccccttcct

SEQ ID NO: 4185742 - DNA, 14 bp, Homo sapiens
cggcctcagcaccc

SEQ ID NO: 4185743 - DNA, 20 bp, Homo sapiens
cggcctcctaaagtgctggg

SEQ ID NO: 4185744 - DNA, 14 bp, Homo sapiens
cggctgctcctcca

SEQ ID NO: 4185745 - DNA, 12 bp, Homo sapiens
cgggaaattatt

SEQ ID NO: 4185746 - DNA, 12 bp, Homo sapiens
cgggaagcggag

SEQ ID NO: 4185747 - DNA, 15 bp, Homo sapiens
cgggagaggactctg

SEQ ID NO: 4185748 - DNA, 14 bp, Homo sapiens
cgggaggcagtgct

SEQ ID NO: 4185749 - DNA, 13 bp, Homo sapiens
cgggaggctgaga

SEQ ID NO: 4185750 - DNA, 18 bp, Homo sapiens
cgggatggtcctggggct

SEQ ID NO: 4185751 - DNA, 19 bp, Homo sapiens
cggggaagggtgcatagct

SEQ ID NO: 4185752 - DNA, 20 bp, Homo sapiens
cggggagaagatagggaaca

SEQ ID NO: 4185753 - DNA, 15 bp, Homo sapiens
cggggcactgcaggg

SEQ ID NO: 4185754 - DNA, 17 bp, Homo sapiens
cggggcatgctggggca

SEQ ID NO: 4185755 - DNA, 15 bp, Homo sapiens
cggggccccagggct

SEQ ID NO: 4185756 - DNA, 13 bp, Homo sapiens
cgggggagctgga

SEQ ID NO: 4185757 - DNA, 22 bp, Homo sapiens
cgggggcccgaaagctgagacc

SEQ ID NO: 4185758 - DNA, 19 bp, Homo sapiens
cgggggtggcaagggggcg

SEQ ID NO: 4185759 - DNA, 23 bp, Homo sapiens
cgggggtggcaagggggcggggc

SEQ ID NO: 4185760 - DNA, 20 bp, Homo sapiens
cgggtgcctcagagcaggct

SEQ ID NO: 4185761 - DNA, 16 bp, Homo sapiens
cggtaataagccaagg

SEQ ID NO: 4185762 - DNA, 22 bp, Homo sapiens
cggtcaaaatattttttaaagt

SEQ ID NO: 4185763 - DNA, 23 bp, Homo sapiens
cggtcaggagggtgcagtatctc

SEQ ID NO: 4185764 - DNA, 21 bp, Homo sapiens
cggtcctttaggcagcctgcc

SEQ ID NO: 4185765 - DNA, 19 bp, Homo sapiens
cggtctaggtgggagagag

SEQ ID NO: 4185766 - DNA, 22 bp, Homo sapiens
cggtgcatccacgcacacatgg

SEQ ID NO: 4185767 - DNA, 11 bp, Homo sapiens
cggtgcctggc

SEQ ID NO: 4185768 - DNA, 13 bp, Homo sapiens
cggtggcagtgga

SEQ ID NO: 4185769 - DNA, 16 bp, Homo sapiens
cggtgtgggctgtgtc

SEQ ID NO: 4185770 - DNA, 14 bp, Homo sapiens
cggttaaattccat

SEQ ID NO: 4185771 - DNA, 19 bp, Homo sapiens
cggtttcaaaccaggattt

SEQ ID NO: 4185772 - DNA, 13 bp, Homo sapiens
cgtaatgcttaga

SEQ ID NO: 4185773 - DNA, 22 bp, Homo sapiens
cgtagatattggacaaagaacc

SEQ ID NO: 4185774 - DNA, 20 bp, Homo sapiens
cgtagccaaggtgggctgag

SEQ ID NO: 4185775 - DNA, 14 bp, Homo sapiens
cgtatctgcagaat

SEQ ID NO: 4185776 - DNA, 23 bp, Homo sapiens
cgtatttaatagcaaagaattga

SEQ ID NO: 4185777 - DNA, 12 bp, Homo sapiens
cgtccagccctc

SEQ ID NO: 4185778 - DNA, 21 bp, Homo sapiens
cgtccccagttgccgtctagg

SEQ ID NO: 4185779 - DNA, 19 bp, Homo sapiens
cgtccctgagggcccttcc

SEQ ID NO: 4185780 - DNA, 21 bp, Homo sapiens
cgtccctgagggcccttccca

SEQ ID NO: 4185781 - DNA, 22 bp, Homo sapiens
cgtccctgagggcccttcccaa

SEQ ID NO: 4185782 - DNA, 23 bp, Homo sapiens
cgtccctgagggcccttcccaac

SEQ ID NO: 4185783 - DNA, 22 bp, Homo sapiens
cgtcccttggaaagttcagcca

SEQ ID NO: 4185784 - DNA, 13 bp, Homo sapiens
cgtccgctcagcc

SEQ ID NO: 4185785 - DNA, 14 bp, Homo sapiens
cgtccgctcagcca

SEQ ID NO: 4185786 - DNA, 22 bp, Homo sapiens
cgtcctgcccccgacagcccag

SEQ ID NO: 4185787 - DNA, 17 bp, Homo sapiens
cgtctcggcccttgccg

SEQ ID NO: 4185788 - DNA, 20 bp, Homo sapiens
cgtgagcatgtttggaaggg

SEQ ID NO: 4185789 - DNA, 16 bp, Homo sapiens
cgtgataaatatatgg

SEQ ID NO: 4185790 - DNA, 21 bp, Homo sapiens
cgtgatttggaagagaggcac

SEQ ID NO: 4185791 - DNA, 23 bp, Homo sapiens
cgtgatttggaagagaggcacct

SEQ ID NO: 4185792 - DNA, 14 bp, Homo sapiens
cgtgcacagcgcgg

SEQ ID NO: 4185793 - DNA, 15 bp, Homo sapiens
cgtgcacctgtactc

SEQ ID NO: 4185794 - DNA, 19 bp, Homo sapiens
cgtgcccaggggcccacag

SEQ ID NO: 4185795 - DNA, 22 bp, Homo sapiens
cgtgcctttctctggctccaga

SEQ ID NO: 4185796 - DNA, 18 bp, Homo sapiens
cgtgcttagcctcctgac

SEQ ID NO: 4185797 - DNA, 22 bp, Homo sapiens
cgtggcagataatcagcctctt

SEQ ID NO: 4185798 - DNA, 14 bp, Homo sapiens
cgtgggcattgtct

SEQ ID NO: 4185799 - DNA, 17 bp, Homo sapiens
cgtgggccgggaggcag

SEQ ID NO: 4185800 - DNA, 14 bp, Homo sapiens
cgtggtagaagcca

SEQ ID NO: 4185801 - DNA, 16 bp, Homo sapiens
cgtgtccccggcctca

SEQ ID NO: 4185802 - DNA, 17 bp, Homo sapiens
cgtgtccccggcctcag

SEQ ID NO: 4185803 - DNA, 20 bp, Homo sapiens
cgtgtcctctccctgccaag

SEQ ID NO: 4185804 - DNA, 21 bp, Homo sapiens
cgtgtgtatccgactctaagc

SEQ ID NO: 4185805 - DNA, 17 bp, Homo sapiens
cgttgacccctttcccc

SEQ ID NO: 4185806 - DNA, 15 bp, Homo sapiens
cgttggttctgcact

SEQ ID NO: 4185807 - DNA, 17 bp, Homo sapiens
cgtttaagccaaaacaa

SEQ ID NO: 4185808 - DNA, 18 bp, Homo sapiens
cgtttaagccaaaacaat

SEQ ID NO: 4185809 - DNA, 22 bp, Homo sapiens
cgttttctcttccttgtgattg

SEQ ID NO: 4185810 - DNA, 14 bp, Homo sapiens
ctaaaagaaacttt

SEQ ID NO: 4185811 - DNA, 24 bp, Homo sapiens
ctaaaatttttctagaagatatca

SEQ ID NO: 4185812 - DNA, 16 bp, Homo sapiens
ctaaacagactattta

SEQ ID NO: 4185813 - DNA, 13 bp, Homo sapiens
ctaaacatcattc

SEQ ID NO: 4185814 - DNA, 18 bp, Homo sapiens
ctaaacattgtgatgatt

SEQ ID NO: 4185815 - DNA, 22 bp, Homo sapiens
ctaaacgactccgagaacaaca

SEQ ID NO: 4185816 - DNA, 20 bp, Homo sapiens
ctaaagaaaaacaaactcgt

SEQ ID NO: 4185817 - DNA, 18 bp, Homo sapiens
ctaaagccaaacatatat

SEQ ID NO: 4185818 - DNA, 17 bp, Homo sapiens
ctaaataaaaaattcaa

SEQ ID NO: 4185819 - DNA, 20 bp, Homo sapiens
ctaaatcttttataggattt

SEQ ID NO: 4185820 - DNA, 16 bp, Homo sapiens
ctaaattgaatacaca

SEQ ID NO: 4185821 - DNA, 21 bp, Homo sapiens
ctaacatttgcaaaatggaaa

SEQ ID NO: 4185822 - DNA, 22 bp, Homo sapiens
ctaacatttgcaaaatggaaat

SEQ ID NO: 4185823 - DNA, 19 bp, Homo sapiens
ctaacccccagtgccacag

SEQ ID NO: 4185824 - DNA, 13 bp, Homo sapiens
ctaacctggctta

SEQ ID NO: 4185825 - DNA, 22 bp, Homo sapiens
ctaactcctgccattcttctgg

SEQ ID NO: 4185826 - DNA, 15 bp, Homo sapiens
ctaagagaagtagaa

SEQ ID NO: 4185827 - DNA, 17 bp, Homo sapiens
ctaagagaagtagaaat

SEQ ID NO: 4185828 - DNA, 20 bp, Homo sapiens
ctaagaggctatttaaaagt

SEQ ID NO: 4185829 - DNA, 20 bp, Homo sapiens
ctaagccactcttccaaagg

SEQ ID NO: 4185830 - DNA, 13 bp, Homo sapiens
ctaagcctgttgc

SEQ ID NO: 4185831 - DNA, 19 bp, Homo sapiens
ctaaggtcccataataaaa

SEQ ID NO: 4185832 - DNA, 22 bp, Homo sapiens
ctaagtcaagatcaacattcca

SEQ ID NO: 4185833 - DNA, 11 bp, Homo sapiens
ctaatatattt

SEQ ID NO: 4185834 - DNA, 12 bp, Homo sapiens
ctaatatatttt

SEQ ID NO: 4185835 - DNA, 13 bp, Homo sapiens
ctaatatggcaaa

SEQ ID NO: 4185836 - DNA, 14 bp, Homo sapiens
ctaatattaaaaat

SEQ ID NO: 4185837 - DNA, 13 bp, Homo sapiens
ctaattcatttat

SEQ ID NO: 4185838 - DNA, 20 bp, Homo sapiens
ctaattccttaccccagctg

SEQ ID NO: 4185839 - DNA, 22 bp, Homo sapiens
ctaattgatagcaggtgtaata

SEQ ID NO: 4185840 - DNA, 12 bp, Homo sapiens
ctaatttaaaaa

SEQ ID NO: 4185841 - DNA, 14 bp, Homo sapiens
ctaattttttgttg

SEQ ID NO: 4185842 - DNA, 16 bp, Homo sapiens
ctaattttttgttgtt

SEQ ID NO: 4185843 - DNA, 11 bp, Homo sapiens
ctacaaaatgg

SEQ ID NO: 4185844 - DNA, 16 bp, Homo sapiens
ctacaacaagagttta

SEQ ID NO: 4185845 - DNA, 22 bp, Homo sapiens
ctacaagcatttgccctgtgga

SEQ ID NO: 4185846 - DNA, 12 bp, Homo sapiens
ctacaccctctg

SEQ ID NO: 4185847 - DNA, 16 bp, Homo sapiens
ctacacccttggactt

SEQ ID NO: 4185848 - DNA, 16 bp, Homo sapiens
ctacactccagcctga

SEQ ID NO: 4185849 - DNA, 17 bp, Homo sapiens
ctacactccagcctgag

SEQ ID NO: 4185850 - DNA, 14 bp, Homo sapiens
ctacagcagtgtgg

SEQ ID NO: 4185851 - DNA, 18 bp, Homo sapiens
ctacaggagagggaagag

SEQ ID NO: 4185852 - DNA, 21 bp, Homo sapiens
ctacaggagagggaagagtgc

SEQ ID NO: 4185853 - DNA, 22 bp, Homo sapiens
ctacatcagtgtggaaaaaaat

SEQ ID NO: 4185854 - DNA, 14 bp, Homo sapiens
ctaccaccttccct

SEQ ID NO: 4185855 - DNA, 20 bp, Homo sapiens
ctacccaggaggctgaggca

SEQ ID NO: 4185856 - DNA, 17 bp, Homo sapiens
ctacccccagctgtgct

SEQ ID NO: 4185857 - DNA, 17 bp, Homo sapiens
ctacccgcatcttctgt

SEQ ID NO: 4185858 - DNA, 15 bp, Homo sapiens
ctacccggcccagag

SEQ ID NO: 4185859 - DNA, 16 bp, Homo sapiens
ctacccggcccagaga

SEQ ID NO: 4185860 - DNA, 19 bp, Homo sapiens
ctaccctgggctctggtct

SEQ ID NO: 4185861 - DNA, 21 bp, Homo sapiens
ctaccgctcccctctcctccg

SEQ ID NO: 4185862 - DNA, 14 bp, Homo sapiens
ctacctcagcctag

SEQ ID NO: 4185863 - DNA, 15 bp, Homo sapiens
ctacctcagcctaga

SEQ ID NO: 4185864 - DNA, 15 bp, Homo sapiens
ctacctctgagaaga

SEQ ID NO: 4185865 - DNA, 21 bp, Homo sapiens
ctacctgttgagcatcacaga

SEQ ID NO: 4185866 - DNA, 22 bp, Homo sapiens
ctacctgttgagcatcacagaa

SEQ ID NO: 4185867 - DNA, 15 bp, Homo sapiens
ctacgcagatgctgt

SEQ ID NO: 4185868 - DNA, 16 bp, Homo sapiens
ctacgttaagggaagg

SEQ ID NO: 4185869 - DNA, 15 bp, Homo sapiens
ctactactcaattgt

SEQ ID NO: 4185870 - DNA, 13 bp, Homo sapiens
ctactcagaagcc

SEQ ID NO: 4185871 - DNA, 15 bp, Homo sapiens
ctactcctacctcag

SEQ ID NO: 4185872 - DNA, 17 bp, Homo sapiens
ctactcctacctcagcc

SEQ ID NO: 4185873 - DNA, 21 bp, Homo sapiens
ctactcctacctcagcctaga

SEQ ID NO: 4185874 - DNA, 17 bp, Homo sapiens
ctactctcttgccagca

SEQ ID NO: 4185875 - DNA, 18 bp, Homo sapiens
ctactgaacccagagtca

SEQ ID NO: 4185876 - DNA, 21 bp, Homo sapiens
ctactgcccaggcactgcaaa

SEQ ID NO: 4185877 - DNA, 18 bp, Homo sapiens
ctacttttgcatgaaaat

SEQ ID NO: 4185878 - DNA, 14 bp, Homo sapiens
ctagaacttcaaaa

SEQ ID NO: 4185879 - DNA, 15 bp, Homo sapiens
ctagaactttgtgcc

SEQ ID NO: 4185880 - DNA, 16 bp, Homo sapiens
ctagaattgagtgttt

SEQ ID NO: 4185881 - DNA, 19 bp, Homo sapiens
ctagaattgagtgtttaaa

SEQ ID NO: 4185882 - DNA, 18 bp, Homo sapiens
ctagaatttgtattttgc

SEQ ID NO: 4185883 - DNA, 16 bp, Homo sapiens
ctagacaagccagaac

SEQ ID NO: 4185884 - DNA, 17 bp, Homo sapiens
ctagacaagccagaact

SEQ ID NO: 4185885 - DNA, 16 bp, Homo sapiens
ctagactgttactttg

SEQ ID NO: 4185886 - DNA, 13 bp, Homo sapiens
ctagactttctgt

SEQ ID NO: 4185887 - DNA, 12 bp, Homo sapiens
ctagagaagagg

SEQ ID NO: 4185888 - DNA, 15 bp, Homo sapiens
ctagagaagaggctg

SEQ ID NO: 4185889 - DNA, 15 bp, Homo sapiens
ctagaggtgagaaat

SEQ ID NO: 4185890 - DNA, 17 bp, Homo sapiens
ctagaggtgagaaattt

SEQ ID NO: 4185891 - DNA, 17 bp, Homo sapiens
ctagattagaagtgttt

SEQ ID NO: 4185892 - DNA, 14 bp, Homo sapiens
ctagcagaaaatat

SEQ ID NO: 4185893 - DNA, 19 bp, Homo sapiens
ctagcagagcaggggcagg

SEQ ID NO: 4185894 - DNA, 15 bp, Homo sapiens
ctagcaggcatgccg

SEQ ID NO: 4185895 - DNA, 18 bp, Homo sapiens
ctagcattttcttgaacc

SEQ ID NO: 4185896 - DNA, 10 bp, Homo sapiens
ctagctctta

SEQ ID NO: 4185897 - DNA, 19 bp, Homo sapiens
ctagctggttaatggcagc

SEQ ID NO: 4185898 - DNA, 14 bp, Homo sapiens
ctaggaaacccaag

SEQ ID NO: 4185899 - DNA, 14 bp, Homo sapiens
ctaggactctgagg

SEQ ID NO: 4185900 - DNA, 14 bp, Homo sapiens
ctaggatggttctg

SEQ ID NO: 4185901 - DNA, 14 bp, Homo sapiens
ctaggattcctccc

SEQ ID NO: 4185902 - DNA, 18 bp, Homo sapiens
ctaggattgggcctccca

SEQ ID NO: 4185903 - DNA, 13 bp, Homo sapiens
ctaggcaacatag

SEQ ID NO: 4185904 - DNA, 23 bp, Homo sapiens
ctaggcttcagcatatttatagc

SEQ ID NO: 4185905 - DNA, 20 bp, Homo sapiens
ctaggtttaaaacagcctgg

SEQ ID NO: 4185906 - DNA, 22 bp, Homo sapiens
ctaggtttaaaacagcctgggt

SEQ ID NO: 4185907 - DNA, 16 bp, Homo sapiens
ctagtatctctggcct

SEQ ID NO: 4185908 - DNA, 20 bp, Homo sapiens
ctagtcaatcaagtctgttt

SEQ ID NO: 4185909 - DNA, 14 bp, Homo sapiens
ctagtcacaaagac

SEQ ID NO: 4185910 - DNA, 23 bp, Homo sapiens
ctagtcatagaaatacctcattc

SEQ ID NO: 4185911 - DNA, 19 bp, Homo sapiens
ctagtgccctccacagccg

SEQ ID NO: 4185912 - DNA, 23 bp, Homo sapiens
ctagtgccctccacagccgcagc

SEQ ID NO: 4185913 - DNA, 18 bp, Homo sapiens
ctagttcagaggaagcac

SEQ ID NO: 4185914 - DNA, 20 bp, Homo sapiens
ctagttcagaggaagcacat

SEQ ID NO: 4185915 - DNA, 21 bp, Homo sapiens
ctataaaatcaaagaaaacat

SEQ ID NO: 4185916 - DNA, 15 bp, Homo sapiens
ctataacctaaatga

SEQ ID NO: 4185917 - DNA, 22 bp, Homo sapiens
ctataagcaagaaggcaaaaat

SEQ ID NO: 4185918 - DNA, 15 bp, Homo sapiens
ctataagtagaaact

SEQ ID NO: 4185919 - DNA, 18 bp, Homo sapiens
ctatactaccctgggctc

SEQ ID NO: 4185920 - DNA, 19 bp, Homo sapiens
ctatactaccctgggctct

SEQ ID NO: 4185921 - DNA, 23 bp, Homo sapiens
ctatactgcttggagctgagcaa

SEQ ID NO: 4185922 - DNA, 15 bp, Homo sapiens
ctataggctggagaa

SEQ ID NO: 4185923 - DNA, 18 bp, Homo sapiens
ctatatgatcctgaaaaa

SEQ ID NO: 4185924 - DNA, 17 bp, Homo sapiens
ctatatgatttatagtt

SEQ ID NO: 4185925 - DNA, 19 bp, Homo sapiens
ctatatgatttatagtttg

SEQ ID NO: 4185926 - DNA, 19 bp, Homo sapiens
ctatatggcaagaaagctg

SEQ ID NO: 4185927 - DNA, 21 bp, Homo sapiens
ctatccagtgatcctcaaaca

SEQ ID NO: 4185928 - DNA, 13 bp, Homo sapiens
ctatccatcctgc

SEQ ID NO: 4185929 - DNA, 19 bp, Homo sapiens
ctatctgtgaagttacact

SEQ ID NO: 4185930 - DNA, 21 bp, Homo sapiens
ctatgatcccagcactttggg

SEQ ID NO: 4185931 - DNA, 22 bp, Homo sapiens
ctatgatcccagcactttggga

SEQ ID NO: 4185932 - DNA, 15 bp, Homo sapiens
ctatgctttgaaaca

SEQ ID NO: 4185933 - DNA, 17 bp, Homo sapiens
ctatgctttgaaacaga

SEQ ID NO: 4185934 - DNA, 17 bp, Homo sapiens
ctatgtaatgtaaatac

SEQ ID NO: 4185935 - DNA, 16 bp, Homo sapiens
ctatgtttatctttgt

SEQ ID NO: 4185936 - DNA, 15 bp, Homo sapiens
ctatgtttttaatgt

SEQ ID NO: 4185937 - DNA, 23 bp, Homo sapiens
ctattactgtctggttttaacaa

SEQ ID NO: 4185938 - DNA, 22 bp, Homo sapiens
ctattcaaggtggccaaattat

SEQ ID NO: 4185939 - DNA, 15 bp, Homo sapiens
ctatttaacttgagg

SEQ ID NO: 4185940 - DNA, 16 bp, Homo sapiens
ctatttcttaaacact

SEQ ID NO: 4185941 - DNA, 17 bp, Homo sapiens
ctatttgtctttcagga

SEQ ID NO: 4185942 - DNA, 15 bp, Homo sapiens
ctattttggagtggt

SEQ ID NO: 4185943 - DNA, 13 bp, Homo sapiens
ctattttttaata

SEQ ID NO: 4185944 - DNA, 17 bp, Homo sapiens
ctcaaaagattgtttta

SEQ ID NO: 4185945 - DNA, 20 bp, Homo sapiens
ctcaaaagcacccttgacgt

SEQ ID NO: 4185946 - DNA, 19 bp, Homo sapiens
ctcaaagtttaacacaatt

SEQ ID NO: 4185947 - DNA, 13 bp, Homo sapiens
ctcaaatccactg

SEQ ID NO: 4185948 - DNA, 16 bp, Homo sapiens
ctcaacaacaatttta

SEQ ID NO: 4185949 - DNA, 15 bp, Homo sapiens
ctcaagagatcccaa

SEQ ID NO: 4185950 - DNA, 19 bp, Homo sapiens
ctcaagagatcccaagtag

SEQ ID NO: 4185951 - DNA, 18 bp, Homo sapiens
ctcaatattcaataaagc

SEQ ID NO: 4185952 - DNA, 19 bp, Homo sapiens
ctcaatattcaataaagct

SEQ ID NO: 4185953 - DNA, 23 bp, Homo sapiens
ctcaatcactgctcccccgtgtg

SEQ ID NO: 4185954 - DNA, 16 bp, Homo sapiens
ctcaatcagtctcaga

SEQ ID NO: 4185955 - DNA, 17 bp, Homo sapiens
ctcaatggacttcaaat

SEQ ID NO: 4185956 - DNA, 16 bp, Homo sapiens
ctcaatgtgaccaggg

SEQ ID NO: 4185957 - DNA, 13 bp, Homo sapiens
ctcacagcctctc

SEQ ID NO: 4185958 - DNA, 15 bp, Homo sapiens
ctcacagcctctccc

SEQ ID NO: 4185959 - DNA, 17 bp, Homo sapiens
ctcacagcctctccctt

SEQ ID NO: 4185960 - DNA, 16 bp, Homo sapiens
ctcacctctctctaag

SEQ ID NO: 4185961 - DNA, 14 bp, Homo sapiens
ctcacgactcttcc

SEQ ID NO: 4185962 - DNA, 17 bp, Homo sapiens
ctcacgactcttcctgc

SEQ ID NO: 4185963 - DNA, 19 bp, Homo sapiens
ctcacgactcttcctgcaa

SEQ ID NO: 4185964 - DNA, 20 bp, Homo sapiens
ctcacgcctatgatcccagc

SEQ ID NO: 4185965 - DNA, 13 bp, Homo sapiens
ctcacgctctgga

SEQ ID NO: 4185966 - DNA, 15 bp, Homo sapiens
ctcactcaagcctga

SEQ ID NO: 4185967 - DNA, 21 bp, Homo sapiens
ctcactcaagcctgagagaag

SEQ ID NO: 4185968 - DNA, 17 bp, Homo sapiens
ctcactgctgtcagcca

SEQ ID NO: 4185969 - DNA, 18 bp, Homo sapiens
ctcactgctgtcagccaa

SEQ ID NO: 4185970 - DNA, 21 bp, Homo sapiens
ctcagaaaatggggcttgccc

SEQ ID NO: 4185971 - DNA, 18 bp, Homo sapiens
ctcagaagcctgaggctg

SEQ ID NO: 4185972 - DNA, 14 bp, Homo sapiens
ctcagacattccaa

SEQ ID NO: 4185973 - DNA, 14 bp, Homo sapiens
ctcagagcaggctc

SEQ ID NO: 4185974 - DNA, 18 bp, Homo sapiens
ctcagagggataaggcag

SEQ ID NO: 4185975 - DNA, 21 bp, Homo sapiens
ctcagataaggtaaaatgcca

SEQ ID NO: 4185976 - DNA, 14 bp, Homo sapiens
ctcagattccacag

SEQ ID NO: 4185977 - DNA, 23 bp, Homo sapiens
ctcagattgacctataaaacaaa

SEQ ID NO: 4185978 - DNA, 14 bp, Homo sapiens
ctcagcagccccct

SEQ ID NO: 4185979 - DNA, 16 bp, Homo sapiens
ctcagccgcagacaag

SEQ ID NO: 4185980 - DNA, 18 bp, Homo sapiens
ctcagcctacagcagtgt

SEQ ID NO: 4185981 - DNA, 12 bp, Homo sapiens
ctcaggaacaga

SEQ ID NO: 4185982 - DNA, 13 bp, Homo sapiens
ctcaggaggcgaa

SEQ ID NO: 4185983 - DNA, 21 bp, Homo sapiens
ctcaggaggcgaataaatgtt

SEQ ID NO: 4185984 - DNA, 22 bp, Homo sapiens
ctcaggaggcgaataaatgttc

SEQ ID NO: 4185985 - DNA, 16 bp, Homo sapiens
ctcaggaggctgaggg

SEQ ID NO: 4185986 - DNA, 19 bp, Homo sapiens
ctcaggccaacaagccaac

SEQ ID NO: 4185987 - DNA, 17 bp, Homo sapiens
ctcagggacaacatttt

SEQ ID NO: 4185988 - DNA, 23 bp, Homo sapiens
ctcaggggccagtgagggctggg

SEQ ID NO: 4185989 - DNA, 15 bp, Homo sapiens
ctcaggtacttgtaa

SEQ ID NO: 4185990 - DNA, 14 bp, Homo sapiens
ctcagtccagatgc

SEQ ID NO: 4185991 - DNA, 19 bp, Homo sapiens
ctcagtccagatgccttcc

SEQ ID NO: 4185992 - DNA, 13 bp, Homo sapiens
ctcagtctcagga

SEQ ID NO: 4185993 - DNA, 14 bp, Homo sapiens
ctcagtggcttctc

SEQ ID NO: 4185994 - DNA, 20 bp, Homo sapiens
ctcagtgggacaaaccagag

SEQ ID NO: 4185995 - DNA, 22 bp, Homo sapiens
ctcagtgggacaaaccagagca

SEQ ID NO: 4185996 - DNA, 20 bp, Homo sapiens
ctcagtgggctccctggccc

SEQ ID NO: 4185997 - DNA, 21 bp, Homo sapiens
ctcagtgggctccctggccca

SEQ ID NO: 4185998 - DNA, 18 bp, Homo sapiens
ctcagttgattttctgga

SEQ ID NO: 4185999 - DNA, 22 bp, Homo sapiens
ctcatatgcgtcccaagcagcc

SEQ ID NO: 4186000 - DNA, 15 bp, Homo sapiens
ctcatcactgtgcct

SEQ ID NO: 4186001 - DNA, 11 bp, Homo sapiens
ctcatctcagt

SEQ ID NO: 4186002 - DNA, 17 bp, Homo sapiens
ctcattccaacagtgag

SEQ ID NO: 4186003 - DNA, 14 bp, Homo sapiens
ctcattcccctcgt

SEQ ID NO: 4186004 - DNA, 12 bp, Homo sapiens
ctcattgtctca

SEQ ID NO: 4186005 - DNA, 19 bp, Homo sapiens
ctcattgtctcagtgctgg

SEQ ID NO: 4186006 - DNA, 18 bp, Homo sapiens
ctcatttgcaaacctcag

SEQ ID NO: 4186007 - DNA, 13 bp, Homo sapiens
ctcattttttaaa

SEQ ID NO: 4186008 - DNA, 16 bp, Homo sapiens
ctccaaacaccggcag

SEQ ID NO: 4186009 - DNA, 15 bp, Homo sapiens
ctccaagatgccctc

SEQ ID NO: 4186010 - DNA, 15 bp, Homo sapiens
ctccaaggtgctctg

SEQ ID NO: 4186011 - DNA, 15 bp, Homo sapiens
ctccacagccgcagc

SEQ ID NO: 4186012 - DNA, 22 bp, Homo sapiens
ctccacagttcgacctgcggct

SEQ ID NO: 4186013 - DNA, 17 bp, Homo sapiens
ctccaccgcagaaggaa

SEQ ID NO: 4186014 - DNA, 20 bp, Homo sapiens
ctccaccttgttacacatta

SEQ ID NO: 4186015 - DNA, 15 bp, Homo sapiens
ctccactccacctcc

SEQ ID NO: 4186016 - DNA, 18 bp, Homo sapiens
ctccagaataccttcttc

SEQ ID NO: 4186017 - DNA, 21 bp, Homo sapiens
ctccagaataccttcttcgct

SEQ ID NO: 4186018 - DNA, 18 bp, Homo sapiens
ctccagagacaggaaaga

SEQ ID NO: 4186019 - DNA, 20 bp, Homo sapiens
ctccagagacaggaaagaat

SEQ ID NO: 4186020 - DNA, 23 bp, Homo sapiens
ctccagcaggtaggggcacagtg

SEQ ID NO: 4186021 - DNA, 19 bp, Homo sapiens
ctccagcccttcagacgag

SEQ ID NO: 4186022 - DNA, 22 bp, Homo sapiens
ctccagcctgggcgacagagca

SEQ ID NO: 4186023 - DNA, 15 bp, Homo sapiens
ctccaggcatgctgg

SEQ ID NO: 4186024 - DNA, 16 bp, Homo sapiens
ctccaggcatgctggc

SEQ ID NO: 4186025 - DNA, 19 bp, Homo sapiens
ctccaggcatgctggcctc

SEQ ID NO: 4186026 - DNA, 13 bp, Homo sapiens
ctccagggctgcc

SEQ ID NO: 4186027 - DNA, 18 bp, Homo sapiens
ctccagggctgcccctgt

SEQ ID NO: 4186028 - DNA, 19 bp, Homo sapiens
ctccagggtctaaagagaa

SEQ ID NO: 4186029 - DNA, 17 bp, Homo sapiens
ctccaggtttgctgtgt

SEQ ID NO: 4186030 - DNA, 23 bp, Homo sapiens
ctccagtgtgaatatatggtctg

SEQ ID NO: 4186031 - DNA, 13 bp, Homo sapiens
ctccagtttcaga

SEQ ID NO: 4186032 - DNA, 16 bp, Homo sapiens
ctccagtttcagaagc

SEQ ID NO: 4186033 - DNA, 17 bp, Homo sapiens
ctccagtttcagaagca

SEQ ID NO: 4186034 - DNA, 18 bp, Homo sapiens
ctccagtttcagaagcag

SEQ ID NO: 4186035 - DNA, 23 bp, Homo sapiens
ctccagtttcagaagcaggcagg

SEQ ID NO: 4186036 - DNA, 22 bp, Homo sapiens
ctccagtttccaagttcctgca

SEQ ID NO: 4186037 - DNA, 21 bp, Homo sapiens
ctccattcctaggtcacttga

SEQ ID NO: 4186038 - DNA, 14 bp, Homo sapiens
ctccattggcttcc

SEQ ID NO: 4186039 - DNA, 21 bp, Homo sapiens
ctccatttcaactccagaagt

SEQ ID NO: 4186040 - DNA, 15 bp, Homo sapiens
ctcccaataaagctg

SEQ ID NO: 4186041 - DNA, 14 bp, Homo sapiens
ctcccacaatctgg

SEQ ID NO: 4186042 - DNA, 17 bp, Homo sapiens
ctcccactgcccctgca

SEQ ID NO: 4186043 - DNA, 21 bp, Homo sapiens
ctcccagcaacacaagctgga

SEQ ID NO: 4186044 - DNA, 19 bp, Homo sapiens
ctcccagcaagtttcacct

SEQ ID NO: 4186045 - DNA, 12 bp, Homo sapiens
ctcccagcgtgt

SEQ ID NO: 4186046 - DNA, 17 bp, Homo sapiens
ctcccagcgtgtgtatc

SEQ ID NO: 4186047 - DNA, 16 bp, Homo sapiens
ctcccagggccagggc

SEQ ID NO: 4186048 - DNA, 16 bp, Homo sapiens
ctccccaccttcccca

SEQ ID NO: 4186049 - DNA, 17 bp, Homo sapiens
ctccccaccttccccag

SEQ ID NO: 4186050 - DNA, 14 bp, Homo sapiens
ctccccagcccttt

SEQ ID NO: 4186051 - DNA, 20 bp, Homo sapiens
ctccccagtgctacctctct

SEQ ID NO: 4186052 - DNA, 14 bp, Homo sapiens
ctcccccagagcca

SEQ ID NO: 4186053 - DNA, 11 bp, Homo sapiens
ctccccctggg

SEQ ID NO: 4186054 - DNA, 23 bp, Homo sapiens
ctccccctgggctctgccccagc

SEQ ID NO: 4186055 - DNA, 13 bp, Homo sapiens
ctcccctgccctg

SEQ ID NO: 4186056 - DNA, 15 bp, Homo sapiens
ctcccctggtcctgc

SEQ ID NO: 4186057 - DNA, 22 bp, Homo sapiens
ctcccgcatttctcatgcttct

SEQ ID NO: 4186058 - DNA, 18 bp, Homo sapiens
ctcccgggagcacagagg

SEQ ID NO: 4186059 - DNA, 20 bp, Homo sapiens
ctccctccccctagcaaggt

SEQ ID NO: 4186060 - DNA, 13 bp, Homo sapiens
ctccctctgacct

SEQ ID NO: 4186061 - DNA, 17 bp, Homo sapiens
ctccctctgacctgcag

SEQ ID NO: 4186062 - DNA, 21 bp, Homo sapiens
ctccctctgacctgcaggcca

SEQ ID NO: 4186063 - DNA, 17 bp, Homo sapiens
ctccctcttccttcccc

SEQ ID NO: 4186064 - DNA, 22 bp, Homo sapiens
ctccctgccaagtctcagaaga

SEQ ID NO: 4186065 - DNA, 13 bp, Homo sapiens
ctccctgctgcca

SEQ ID NO: 4186066 - DNA, 22 bp, Homo sapiens
ctccctgctgccaggctcccac

SEQ ID NO: 4186067 - DNA, 22 bp, Homo sapiens
ctccctggagtgcagtttccaa

SEQ ID NO: 4186068 - DNA, 16 bp, Homo sapiens
ctccctggctctcaga

SEQ ID NO: 4186069 - DNA, 20 bp, Homo sapiens
ctccctggctctcagaaggt

SEQ ID NO: 4186070 - DNA, 15 bp, Homo sapiens
ctccgagaacaacag

SEQ ID NO: 4186071 - DNA, 18 bp, Homo sapiens
ctccgccttcactccggt

SEQ ID NO: 4186072 - DNA, 17 bp, Homo sapiens
ctccgcgagggctactc

SEQ ID NO: 4186073 - DNA, 24 bp, Homo sapiens
ctccggaggggacccagctcctct

SEQ ID NO: 4186074 - DNA, 22 bp, Homo sapiens
ctccggcctgatgacagagcga

SEQ ID NO: 4186075 - DNA, 23 bp, Homo sapiens
ctccggtgtgcctgcagccccgc

SEQ ID NO: 4186076 - DNA, 20 bp, Homo sapiens
ctccgtcatgaatgccttcc

SEQ ID NO: 4186077 - DNA, 21 bp, Homo sapiens
ctcctaaacccccgctccaga

SEQ ID NO: 4186078 - DNA, 15 bp, Homo sapiens
ctcctacctcagcct

SEQ ID NO: 4186079 - DNA, 16 bp, Homo sapiens
ctcctacctcagccta

SEQ ID NO: 4186080 - DNA, 19 bp, Homo sapiens
ctcctacgcagatgctgtc

SEQ ID NO: 4186081 - DNA, 16 bp, Homo sapiens
ctcctactttacactc

SEQ ID NO: 4186082 - DNA, 17 bp, Homo sapiens
ctcctccactccacctc

SEQ ID NO: 4186083 - DNA, 12 bp, Homo sapiens
ctcctccagccc

SEQ ID NO: 4186084 - DNA, 15 bp, Homo sapiens
ctcctccagcccttc

SEQ ID NO: 4186085 - DNA, 21 bp, Homo sapiens
ctcctccagcccttcagacga

SEQ ID NO: 4186086 - DNA, 13 bp, Homo sapiens
ctcctcccacaat

SEQ ID NO: 4186087 - DNA, 19 bp, Homo sapiens
ctcctcccagcgtgtgtat

SEQ ID NO: 4186088 - DNA, 21 bp, Homo sapiens
ctcctcccagcgtgtgtatcc

SEQ ID NO: 4186089 - DNA, 15 bp, Homo sapiens
ctcctcccatggcct

SEQ ID NO: 4186090 - DNA, 14 bp, Homo sapiens
ctcctcctccccca

SEQ ID NO: 4186091 - DNA, 16 bp, Homo sapiens
ctcctctcctcctctg

SEQ ID NO: 4186092 - DNA, 13 bp, Homo sapiens
ctcctctgctgct

SEQ ID NO: 4186093 - DNA, 12 bp, Homo sapiens
ctcctctgtgct

SEQ ID NO: 4186094 - DNA, 15 bp, Homo sapiens
ctcctgacctgaggc

SEQ ID NO: 4186095 - DNA, 16 bp, Homo sapiens
ctcctgacctgaggct

SEQ ID NO: 4186096 - DNA, 16 bp, Homo sapiens
ctcctgacctgtcacc

SEQ ID NO: 4186097 - DNA, 14 bp, Homo sapiens
ctcctgccattctt

SEQ ID NO: 4186098 - DNA, 20 bp, Homo sapiens
ctcctggaaaggctcagtct

SEQ ID NO: 4186099 - DNA, 24 bp, Homo sapiens
ctcctggaaaggctcagtctcagg

SEQ ID NO: 4186100 - DNA, 16 bp, Homo sapiens
ctcctggagcatccca

SEQ ID NO: 4186101 - DNA, 15 bp, Homo sapiens
ctcctgtagcacaaa

SEQ ID NO: 4186102 - DNA, 13 bp, Homo sapiens
ctcctgtgtacag

SEQ ID NO: 4186103 - DNA, 14 bp, Homo sapiens
ctccttacctgtgg

SEQ ID NO: 4186104 - DNA, 16 bp, Homo sapiens
ctccttcccctgtggt

SEQ ID NO: 4186105 - DNA, 23 bp, Homo sapiens
ctccttccctctttccccacctc

SEQ ID NO: 4186106 - DNA, 16 bp, Homo sapiens
ctccttcccttctctc

SEQ ID NO: 4186107 - DNA, 18 bp, Homo sapiens
ctccttcccttctctcct

SEQ ID NO: 4186108 - DNA, 23 bp, Homo sapiens
ctccttcccttctctccttccct

SEQ ID NO: 4186109 - DNA, 16 bp, Homo sapiens
ctccttcttccctgtt

SEQ ID NO: 4186110 - DNA, 13 bp, Homo sapiens
ctccttcttgctt

SEQ ID NO: 4186111 - DNA, 14 bp, Homo sapiens
ctccttgctctgca

SEQ ID NO: 4186112 - DNA, 16 bp, Homo sapiens
ctcctttacctaccac

SEQ ID NO: 4186113 - DNA, 14 bp, Homo sapiens
ctcctttgcctctg

SEQ ID NO: 4186114 - DNA, 17 bp, Homo sapiens
ctcctttttctaccttt

SEQ ID NO: 4186115 - DNA, 16 bp, Homo sapiens
ctcgccacggggaggg

SEQ ID NO: 4186116 - DNA, 12 bp, Homo sapiens
ctcgccccaccc

SEQ ID NO: 4186117 - DNA, 18 bp, Homo sapiens
ctcgctgtcctttctaga

SEQ ID NO: 4186118 - DNA, 21 bp, Homo sapiens
ctcggcacctccccggcctct

SEQ ID NO: 4186119 - DNA, 21 bp, Homo sapiens
ctcgggaggctgagacaggag

SEQ ID NO: 4186120 - DNA, 12 bp, Homo sapiens
ctcgtaccagcc

SEQ ID NO: 4186121 - DNA, 14 bp, Homo sapiens
ctcgtaccagccag

SEQ ID NO: 4186122 - DNA, 15 bp, Homo sapiens
ctcgtaccagccagg

SEQ ID NO: 4186123 - DNA, 16 bp, Homo sapiens
ctcgtaccagccagga

SEQ ID NO: 4186124 - DNA, 17 bp, Homo sapiens
ctcgtggacacctgccc

SEQ ID NO: 4186125 - DNA, 19 bp, Homo sapiens
ctcgtggacacctgccctg

SEQ ID NO: 4186126 - DNA, 22 bp, Homo sapiens
ctcgtttgctctagtcttgctt

SEQ ID NO: 4186127 - DNA, 22 bp, Homo sapiens
ctctaacccccagtgccacaga

SEQ ID NO: 4186128 - DNA, 16 bp, Homo sapiens
ctctaactcctgccat

SEQ ID NO: 4186129 - DNA, 19 bp, Homo sapiens
ctctaagccactcttccaa

SEQ ID NO: 4186130 - DNA, 12 bp, Homo sapiens
ctctaagctgtg

SEQ ID NO: 4186131 - DNA, 15 bp, Homo sapiens
ctctaagctgtgtgc

SEQ ID NO: 4186132 - DNA, 17 bp, Homo sapiens
ctctaagctgtgtgcag

SEQ ID NO: 4186133 - DNA, 20 bp, Homo sapiens
ctctaagttatgtacgtata

SEQ ID NO: 4186134 - DNA, 18 bp, Homo sapiens
ctctaagttcaagaagac

SEQ ID NO: 4186135 - DNA, 18 bp, Homo sapiens
ctctacccggcccagaga

SEQ ID NO: 4186136 - DNA, 17 bp, Homo sapiens
ctctacctggatggatg

SEQ ID NO: 4186137 - DNA, 14 bp, Homo sapiens
ctctagtcttgctt

SEQ ID NO: 4186138 - DNA, 19 bp, Homo sapiens
ctctatggggcatcctctt

SEQ ID NO: 4186139 - DNA, 14 bp, Homo sapiens
ctctatttcacaat

SEQ ID NO: 4186140 - DNA, 10 bp, Homo sapiens
ctctcaatat

SEQ ID NO: 4186141 - DNA, 16 bp, Homo sapiens
ctctcaatatgcttac

SEQ ID NO: 4186142 - DNA, 18 bp, Homo sapiens
ctctcaatattcaataaa

SEQ ID NO: 4186143 - DNA, 19 bp, Homo sapiens
ctctcaatattcaataaag

SEQ ID NO: 4186144 - DNA, 21 bp, Homo sapiens
ctctcaatattcaataaagct

SEQ ID NO: 4186145 - DNA, 18 bp, Homo sapiens
ctctcaggggccagtgag

SEQ ID NO: 4186146 - DNA, 15 bp, Homo sapiens
ctctcccctccctct

SEQ ID NO: 4186147 - DNA, 15 bp, Homo sapiens
ctctcccctgccctg

SEQ ID NO: 4186148 - DNA, 21 bp, Homo sapiens
ctctcctaccccacctcatgc

SEQ ID NO: 4186149 - DNA, 16 bp, Homo sapiens
ctctcctcctctgtgc

SEQ ID NO: 4186150 - DNA, 20 bp, Homo sapiens
ctctcctcctctgtgctcct

SEQ ID NO: 4186151 - DNA, 13 bp, Homo sapiens
ctctccttccctc

SEQ ID NO: 4186152 - DNA, 16 bp, Homo sapiens
ctctcggaaggctggc

SEQ ID NO: 4186153 - DNA, 22 bp, Homo sapiens
ctctcggaaggctggctgggca

SEQ ID NO: 4186154 - DNA, 16 bp, Homo sapiens
ctctcgtaactggttt

SEQ ID NO: 4186155 - DNA, 19 bp, Homo sapiens
ctctctactcctacctcag

SEQ ID NO: 4186156 - DNA, 22 bp, Homo sapiens
ctctctctacccggcccagaga

SEQ ID NO: 4186157 - DNA, 13 bp, Homo sapiens
ctctctgctccag

SEQ ID NO: 4186158 - DNA, 14 bp, Homo sapiens
ctctctgctccaga

SEQ ID NO: 4186159 - DNA, 15 bp, Homo sapiens
ctctctgctccagag

SEQ ID NO: 4186160 - DNA, 16 bp, Homo sapiens
ctctctgctccagaga

SEQ ID NO: 4186161 - DNA, 12 bp, Homo sapiens
ctctctgctgag

SEQ ID NO: 4186162 - DNA, 19 bp, Homo sapiens
ctctctgtacaaaaacaaa

SEQ ID NO: 4186163 - DNA, 16 bp, Homo sapiens
ctctgactcaaactcc

SEQ ID NO: 4186164 - DNA, 19 bp, Homo sapiens
ctctgaggctctttctggg

SEQ ID NO: 4186165 - DNA, 17 bp, Homo sapiens
ctctgagtgttttatga

SEQ ID NO: 4186166 - DNA, 17 bp, Homo sapiens
ctctgatacccagagca

SEQ ID NO: 4186167 - DNA, 17 bp, Homo sapiens
ctctgatccttcttcct

SEQ ID NO: 4186168 - DNA, 14 bp, Homo sapiens
ctctgcaggcacct

SEQ ID NO: 4186169 - DNA, 15 bp, Homo sapiens
ctctgccccagaggc

SEQ ID NO: 4186170 - DNA, 20 bp, Homo sapiens
ctctgccccagaggcctctc

SEQ ID NO: 4186171 - DNA, 22 bp, Homo sapiens
ctctgccccagaggcctctctc

SEQ ID NO: 4186172 - DNA, 12 bp, Homo sapiens
ctctgccccagc

SEQ ID NO: 4186173 - DNA, 16 bp, Homo sapiens
ctctgccccagctctg

SEQ ID NO: 4186174 - DNA, 23 bp, Homo sapiens
ctctgcctggaggatccctccat

SEQ ID NO: 4186175 - DNA, 19 bp, Homo sapiens
ctctgcggtggtgccagag

SEQ ID NO: 4186176 - DNA, 23 bp, Homo sapiens
ctctgctatatgccttaagccaa

SEQ ID NO: 4186177 - DNA, 13 bp, Homo sapiens
ctctgctccagag

SEQ ID NO: 4186178 - DNA, 15 bp, Homo sapiens
ctctgctgccatggc

SEQ ID NO: 4186179 - DNA, 13 bp, Homo sapiens
ctctgctgctccc

SEQ ID NO: 4186180 - DNA, 17 bp, Homo sapiens
ctctgctttctcctgta

SEQ ID NO: 4186181 - DNA, 20 bp, Homo sapiens
ctctgctttctcctgtagca

SEQ ID NO: 4186182 - DNA, 19 bp, Homo sapiens
ctctggaaaatgtgaccca

SEQ ID NO: 4186183 - DNA, 15 bp, Homo sapiens
ctctggcttagaaat

SEQ ID NO: 4186184 - DNA, 16 bp, Homo sapiens
ctctggcttagaaatt

SEQ ID NO: 4186185 - DNA, 17 bp, Homo sapiens
ctctgggccaagactcc

SEQ ID NO: 4186186 - DNA, 15 bp, Homo sapiens
ctctgtcaatgaaaa

SEQ ID NO: 4186187 - DNA, 13 bp, Homo sapiens
ctctgtccactct

SEQ ID NO: 4186188 - DNA, 23 bp, Homo sapiens
ctctgtgacctgccccgcccagc

SEQ ID NO: 4186189 - DNA, 10 bp, Homo sapiens
ctctgtgctc

SEQ ID NO: 4186190 - DNA, 15 bp, Homo sapiens
ctctgtgtccgtctg

SEQ ID NO: 4186191 - DNA, 16 bp, Homo sapiens
ctctgtttctccttct

SEQ ID NO: 4186192 - DNA, 20 bp, Homo sapiens
ctcttaaagctgcctgtagt

SEQ ID NO: 4186193 - DNA, 20 bp, Homo sapiens
ctcttaaattatatatttat

SEQ ID NO: 4186194 - DNA, 15 bp, Homo sapiens
ctcttcaaatgcctg

SEQ ID NO: 4186195 - DNA, 13 bp, Homo sapiens
ctcttcactcagc

SEQ ID NO: 4186196 - DNA, 17 bp, Homo sapiens
ctcttcactcagccaca

SEQ ID NO: 4186197 - DNA, 18 bp, Homo sapiens
ctcttcactcagccacac

SEQ ID NO: 4186198 - DNA, 20 bp, Homo sapiens
ctcttcactcagccacaccc

SEQ ID NO: 4186199 - DNA, 21 bp, Homo sapiens
ctcttcagcagcatctactct

SEQ ID NO: 4186200 - DNA, 18 bp, Homo sapiens
ctcttcagggtgagtgaa

SEQ ID NO: 4186201 - DNA, 13 bp, Homo sapiens
ctcttcatacttt

SEQ ID NO: 4186202 - DNA, 19 bp, Homo sapiens
ctcttcatactttttttca

SEQ ID NO: 4186203 - DNA, 14 bp, Homo sapiens
ctcttccctctgat

SEQ ID NO: 4186204 - DNA, 16 bp, Homo sapiens
ctcttccctctgattt

SEQ ID NO: 4186205 - DNA, 13 bp, Homo sapiens
ctcttccttcccc

SEQ ID NO: 4186206 - DNA, 16 bp, Homo sapiens
ctcttgaattattttg

SEQ ID NO: 4186207 - DNA, 13 bp, Homo sapiens
ctcttggcctctg

SEQ ID NO: 4186208 - DNA, 21 bp, Homo sapiens
ctctttatgcttgcaaaaact

SEQ ID NO: 4186209 - DNA, 19 bp, Homo sapiens
ctctttgccttgatgttgt

SEQ ID NO: 4186210 - DNA, 17 bp, Homo sapiens
ctctttggggtcagcca

SEQ ID NO: 4186211 - DNA, 19 bp, Homo sapiens
ctctttggggtcagccagg

SEQ ID NO: 4186212 - DNA, 20 bp, Homo sapiens
ctctttggggtcagccaggg

SEQ ID NO: 4186213 - DNA, 14 bp, Homo sapiens
ctcttttccactcc

SEQ ID NO: 4186214 - DNA, 19 bp, Homo sapiens
ctcttttccactccaagat

SEQ ID NO: 4186215 - DNA, 20 bp, Homo sapiens
ctgaaaaaaaaaaagaagaa

SEQ ID NO: 4186216 - DNA, 15 bp, Homo sapiens
ctgaaaaaaagttta

SEQ ID NO: 4186217 - DNA, 15 bp, Homo sapiens
ctgaaaatagcagga

SEQ ID NO: 4186218 - DNA, 15 bp, Homo sapiens
ctgaaaatctaatat

SEQ ID NO: 4186219 - DNA, 17 bp, Homo sapiens
ctgaaaattatttaaac

SEQ ID NO: 4186220 - DNA, 19 bp, Homo sapiens
ctgaaattggtgggaagca

SEQ ID NO: 4186221 - DNA, 21 bp, Homo sapiens
ctgaacatttgctttgttttc

SEQ ID NO: 4186222 - DNA, 13 bp, Homo sapiens
ctgaactgttaca

SEQ ID NO: 4186223 - DNA, 18 bp, Homo sapiens
ctgaacttattacctaat

SEQ ID NO: 4186224 - DNA, 16 bp, Homo sapiens
ctgaagaggcaagaga

SEQ ID NO: 4186225 - DNA, 22 bp, Homo sapiens
ctgaaggaataggcaaaatgtt

SEQ ID NO: 4186226 - DNA, 16 bp, Homo sapiens
ctgaaggagattttcc

SEQ ID NO: 4186227 - DNA, 21 bp, Homo sapiens
ctgaagtcaaaccttaagata

SEQ ID NO: 4186228 - DNA, 17 bp, Homo sapiens
ctgaataggaaaatgta

SEQ ID NO: 4186229 - DNA, 21 bp, Homo sapiens
ctgaataggaaaatgtacata

SEQ ID NO: 4186230 - DNA, 18 bp, Homo sapiens
ctgaatgacctgcagtca

SEQ ID NO: 4186231 - DNA, 21 bp, Homo sapiens
ctgaatgacctgcagtcaggg

SEQ ID NO: 4186232 - DNA, 15 bp, Homo sapiens
ctgaatggtccaggg

SEQ ID NO: 4186233 - DNA, 16 bp, Homo sapiens
ctgaatggtccagggt

SEQ ID NO: 4186234 - DNA, 18 bp, Homo sapiens
ctgaatggtccagggttg

SEQ ID NO: 4186235 - DNA, 16 bp, Homo sapiens
ctgaatgtttattcct

SEQ ID NO: 4186236 - DNA, 18 bp, Homo sapiens
ctgaatgtttattccttg

SEQ ID NO: 4186237 - DNA, 19 bp, Homo sapiens
ctgaatgtttattccttga

SEQ ID NO: 4186238 - DNA, 14 bp, Homo sapiens
ctgaattaagttat

SEQ ID NO: 4186239 - DNA, 21 bp, Homo sapiens
ctgaatttttaaacaagtatt

SEQ ID NO: 4186240 - DNA, 22 bp, Homo sapiens
ctgaatttttaaacaagtattt

SEQ ID NO: 4186241 - DNA, 17 bp, Homo sapiens
ctgacaagataaaggaa

SEQ ID NO: 4186242 - DNA, 13 bp, Homo sapiens
ctgacatggcttt

SEQ ID NO: 4186243 - DNA, 13 bp, Homo sapiens
ctgacccagtgag

SEQ ID NO: 4186244 - DNA, 14 bp, Homo sapiens
ctgacccagtgaga

SEQ ID NO: 4186245 - DNA, 20 bp, Homo sapiens
ctgaccccaaagagcctgga

SEQ ID NO: 4186246 - DNA, 18 bp, Homo sapiens
ctgaccctccaccgcaga

SEQ ID NO: 4186247 - DNA, 19 bp, Homo sapiens
ctgacctgtttttgtgttt

SEQ ID NO: 4186248 - DNA, 21 bp, Homo sapiens
ctgacgacactgaagaatcaa

SEQ ID NO: 4186249 - DNA, 21 bp, Homo sapiens
ctgacggaagccaacttggct

SEQ ID NO: 4186250 - DNA, 19 bp, Homo sapiens
ctgactcctctaagccact

SEQ ID NO: 4186251 - DNA, 13 bp, Homo sapiens
ctgactctctgtg

SEQ ID NO: 4186252 - DNA, 22 bp, Homo sapiens
ctgactggtgctataggctgga

SEQ ID NO: 4186253 - DNA, 23 bp, Homo sapiens
ctgacttctttgtggtttcaaat

SEQ ID NO: 4186254 - DNA, 20 bp, Homo sapiens
ctgagacctgacaagcactg

SEQ ID NO: 4186255 - DNA, 21 bp, Homo sapiens
ctgagactttcagtgcactgt

SEQ ID NO: 4186256 - DNA, 18 bp, Homo sapiens
ctgagagacttttaatca

SEQ ID NO: 4186257 - DNA, 18 bp, Homo sapiens
ctgagatcacaccactgc

SEQ ID NO: 4186258 - DNA, 19 bp, Homo sapiens
ctgagatctccctccaggg

SEQ ID NO: 4186259 - DNA, 17 bp, Homo sapiens
ctgagcaacctcttcag

SEQ ID NO: 4186260 - DNA, 20 bp, Homo sapiens
ctgagcaacctcttcagctg

SEQ ID NO: 4186261 - DNA, 23 bp, Homo sapiens
ctgagcaacctcttcagctggga

SEQ ID NO: 4186262 - DNA, 14 bp, Homo sapiens
ctgagcaagagctg

SEQ ID NO: 4186263 - DNA, 16 bp, Homo sapiens
ctgagcaagagctggc

SEQ ID NO: 4186264 - DNA, 16 bp, Homo sapiens
ctgagcacctgcttca

SEQ ID NO: 4186265 - DNA, 17 bp, Homo sapiens
ctgagcacctgcttcat

SEQ ID NO: 4186266 - DNA, 14 bp, Homo sapiens
ctgagcagcccagc

SEQ ID NO: 4186267 - DNA, 18 bp, Homo sapiens
ctgagcagcccagcacaa

SEQ ID NO: 4186268 - DNA, 15 bp, Homo sapiens
ctgagccctggcagg

SEQ ID NO: 4186269 - DNA, 16 bp, Homo sapiens
ctgagcggaggctcgg

SEQ ID NO: 4186270 - DNA, 12 bp, Homo sapiens
ctgagctgggct

SEQ ID NO: 4186271 - DNA, 14 bp, Homo sapiens
ctgagcttggccct

SEQ ID NO: 4186272 - DNA, 17 bp, Homo sapiens
ctgagcttggccctatt

SEQ ID NO: 4186273 - DNA, 14 bp, Homo sapiens
ctgaggcaggagaa

SEQ ID NO: 4186274 - DNA, 17 bp, Homo sapiens
ctgaggctcctgtgcta

SEQ ID NO: 4186275 - DNA, 20 bp, Homo sapiens
ctgaggctcctgtgctactt

SEQ ID NO: 4186276 - DNA, 22 bp, Homo sapiens
ctgaggggaggatcactggagc

SEQ ID NO: 4186277 - DNA, 15 bp, Homo sapiens
ctgaggggcagggag

SEQ ID NO: 4186278 - DNA, 18 bp, Homo sapiens
ctgaggggcagggagagc

SEQ ID NO: 4186279 - DNA, 16 bp, Homo sapiens
ctgaggggggccgtgc

SEQ ID NO: 4186280 - DNA, 21 bp, Homo sapiens
ctgaggggggccgtgcccagg

SEQ ID NO: 4186281 - DNA, 14 bp, Homo sapiens
ctgagtgcactcct

SEQ ID NO: 4186282 - DNA, 16 bp, Homo sapiens
ctgagtgcactcctgg

SEQ ID NO: 4186283 - DNA, 18 bp, Homo sapiens
ctgagtgtgggcttctga

SEQ ID NO: 4186284 - DNA, 11 bp, Homo sapiens
ctgagttttcc

SEQ ID NO: 4186285 - DNA, 14 bp, Homo sapiens
ctgatagagtgatt

SEQ ID NO: 4186286 - DNA, 15 bp, Homo sapiens
ctgatcaaggcctta

SEQ ID NO: 4186287 - DNA, 22 bp, Homo sapiens
ctgatcattacatggctgtggt

SEQ ID NO: 4186288 - DNA, 19 bp, Homo sapiens
ctgatcattctgttttttc

SEQ ID NO: 4186289 - DNA, 19 bp, Homo sapiens
ctgatccggctgctcctcc

SEQ ID NO: 4186290 - DNA, 14 bp, Homo sapiens
ctgatgaaaatgaa

SEQ ID NO: 4186291 - DNA, 15 bp, Homo sapiens
ctgatgacagagcga

SEQ ID NO: 4186292 - DNA, 17 bp, Homo sapiens
ctgatgacagagcgaga

SEQ ID NO: 4186293 - DNA, 13 bp, Homo sapiens
ctgatgagcaaga

SEQ ID NO: 4186294 - DNA, 14 bp, Homo sapiens
ctgatgagcaagaa

SEQ ID NO: 4186295 - DNA, 20 bp, Homo sapiens
ctgatgggtcccaaaagctt

SEQ ID NO: 4186296 - DNA, 16 bp, Homo sapiens
ctgattacctgccaat

SEQ ID NO: 4186297 - DNA, 23 bp, Homo sapiens
ctgattcagcctggccatcccca

SEQ ID NO: 4186298 - DNA, 14 bp, Homo sapiens
ctgcaagcagggct

SEQ ID NO: 4186299 - DNA, 18 bp, Homo sapiens
ctgcaagcagggctctgc

SEQ ID NO: 4186300 - DNA, 17 bp, Homo sapiens
ctgcaatctccagggct

SEQ ID NO: 4186301 - DNA, 16 bp, Homo sapiens
ctgcacacagctaggc

SEQ ID NO: 4186302 - DNA, 16 bp, Homo sapiens
ctgcacctgccagcct

SEQ ID NO: 4186303 - DNA, 18 bp, Homo sapiens
ctgcacctgccagcctgg

SEQ ID NO: 4186304 - DNA, 14 bp, Homo sapiens
ctgcacctgcttct

SEQ ID NO: 4186305 - DNA, 15 bp, Homo sapiens
ctgcacctgcttctc

SEQ ID NO: 4186306 - DNA, 18 bp, Homo sapiens
ctgcacctgcttctcagc

SEQ ID NO: 4186307 - DNA, 13 bp, Homo sapiens
ctgcactccagaa

SEQ ID NO: 4186308 - DNA, 14 bp, Homo sapiens
ctgcactccagaat

SEQ ID NO: 4186309 - DNA, 15 bp, Homo sapiens
ctgcactccagcctg

SEQ ID NO: 4186310 - DNA, 16 bp, Homo sapiens
ctgcactccagcctgg

SEQ ID NO: 4186311 - DNA, 19 bp, Homo sapiens
ctgcactccagcctgggcg

SEQ ID NO: 4186312 - DNA, 18 bp, Homo sapiens
ctgcactccagcctgggg

SEQ ID NO: 4186313 - DNA, 14 bp, Homo sapiens
ctgcactgccctcc

SEQ ID NO: 4186314 - DNA, 22 bp, Homo sapiens
ctgcagaaagcccttcaacttc

SEQ ID NO: 4186315 - DNA, 13 bp, Homo sapiens
ctgcagaggacag

SEQ ID NO: 4186316 - DNA, 19 bp, Homo sapiens
ctgcagaggacagagctgg

SEQ ID NO: 4186317 - DNA, 23 bp, Homo sapiens
ctgcagaggacagagctggctgt

SEQ ID NO: 4186318 - DNA, 22 bp, Homo sapiens
ctgcagaggggaaagacttcca

SEQ ID NO: 4186319 - DNA, 19 bp, Homo sapiens
ctgcagaggggctttctgg

SEQ ID NO: 4186320 - DNA, 20 bp, Homo sapiens
ctgcagaggggctttctgga

SEQ ID NO: 4186321 - DNA, 14 bp, Homo sapiens
ctgcagagtggtga

SEQ ID NO: 4186322 - DNA, 16 bp, Homo sapiens
ctgcagatcttccgtg

SEQ ID NO: 4186323 - DNA, 18 bp, Homo sapiens
ctgcagatcttccgtggt

SEQ ID NO: 4186324 - DNA, 12 bp, Homo sapiens
ctgcagcaactc

SEQ ID NO: 4186325 - DNA, 14 bp, Homo sapiens
ctgcagcaactccc

SEQ ID NO: 4186326 - DNA, 12 bp, Homo sapiens
ctgcagcacttt

SEQ ID NO: 4186327 - DNA, 20 bp, Homo sapiens
ctgcagcctggtagaattgg

SEQ ID NO: 4186328 - DNA, 20 bp, Homo sapiens
ctgcaggcaccttagtggct

SEQ ID NO: 4186329 - DNA, 15 bp, Homo sapiens
ctgcaggccaagagc

SEQ ID NO: 4186330 - DNA, 19 bp, Homo sapiens
ctgcaggccaagagcagag

SEQ ID NO: 4186331 - DNA, 21 bp, Homo sapiens
ctgcaggccaagagcagaggc

SEQ ID NO: 4186332 - DNA, 23 bp, Homo sapiens
ctgcaggccaagagcagaggcag

SEQ ID NO: 4186333 - DNA, 14 bp, Homo sapiens
ctgcagggctgctg

SEQ ID NO: 4186334 - DNA, 15 bp, Homo sapiens
ctgcagggctgctgt

SEQ ID NO: 4186335 - DNA, 16 bp, Homo sapiens
ctgcagtaacactggc

SEQ ID NO: 4186336 - DNA, 17 bp, Homo sapiens
ctgcagtaacactggcc

SEQ ID NO: 4186337 - DNA, 23 bp, Homo sapiens
ctgcagtaacactggccttccct

SEQ ID NO: 4186338 - DNA, 15 bp, Homo sapiens
ctgcagtgaggggag

SEQ ID NO: 4186339 - DNA, 16 bp, Homo sapiens
ctgcagtgaggggaga

SEQ ID NO: 4186340 - DNA, 13 bp, Homo sapiens
ctgcattgcctga

SEQ ID NO: 4186341 - DNA, 19 bp, Homo sapiens
ctgccaagtctcagaagag

SEQ ID NO: 4186342 - DNA, 17 bp, Homo sapiens
ctgccaccatcctgctg

SEQ ID NO: 4186343 - DNA, 19 bp, Homo sapiens
ctgccaccatcctgctgct

SEQ ID NO: 4186344 - DNA, 14 bp, Homo sapiens
ctgccagcctgagc

SEQ ID NO: 4186345 - DNA, 20 bp, Homo sapiens
ctgccagcctgagcggaggc

SEQ ID NO: 4186346 - DNA, 12 bp, Homo sapiens
ctgccagcctgg

SEQ ID NO: 4186347 - DNA, 13 bp, Homo sapiens
ctgccagcctggc

SEQ ID NO: 4186348 - DNA, 16 bp, Homo sapiens
ctgccagcctggcttc

SEQ ID NO: 4186349 - DNA, 14 bp, Homo sapiens
ctgccatggcgtgt

SEQ ID NO: 4186350 - DNA, 19 bp, Homo sapiens
ctgccattgggaccctcca

SEQ ID NO: 4186351 - DNA, 21 bp, Homo sapiens
ctgccattgggaccctccagt

SEQ ID NO: 4186352 - DNA, 21 bp, Homo sapiens
ctgccatttgcaccctccgcc

SEQ ID NO: 4186353 - DNA, 14 bp, Homo sapiens
ctgcccaggcactg

SEQ ID NO: 4186354 - DNA, 12 bp, Homo sapiens
ctgccccaccct

SEQ ID NO: 4186355 - DNA, 16 bp, Homo sapiens
ctgccccagctctggc

SEQ ID NO: 4186356 - DNA, 19 bp, Homo sapiens
ctgccccagctctggcttc

SEQ ID NO: 4186357 - DNA, 11 bp, Homo sapiens
ctgccccccgc

SEQ ID NO: 4186358 - DNA, 12 bp, Homo sapiens
ctgccccctggt

SEQ ID NO: 4186359 - DNA, 17 bp, Homo sapiens
ctgccccgggtgcctca

SEQ ID NO: 4186360 - DNA, 13 bp, Homo sapiens
ctgcccctgcacc

SEQ ID NO: 4186361 - DNA, 14 bp, Homo sapiens
ctgcccgcagagcc

SEQ ID NO: 4186362 - DNA, 12 bp, Homo sapiens
ctgccctcaggg

SEQ ID NO: 4186363 - DNA, 13 bp, Homo sapiens
ctgccctcaggga

SEQ ID NO: 4186364 - DNA, 16 bp, Homo sapiens
ctgccctccgcccttc

SEQ ID NO: 4186365 - DNA, 14 bp, Homo sapiens
ctgccctgccacct

SEQ ID NO: 4186366 - DNA, 13 bp, Homo sapiens
ctgccctgccact

SEQ ID NO: 4186367 - DNA, 21 bp, Homo sapiens
ctgccctgctgccgcctccca

SEQ ID NO: 4186368 - DNA, 14 bp, Homo sapiens
ctgccgcctcccag

SEQ ID NO: 4186369 - DNA, 15 bp, Homo sapiens
ctgccgcctcccagc

SEQ ID NO: 4186370 - DNA, 19 bp, Homo sapiens
ctgcctatatatgtaaata

SEQ ID NO: 4186371 - DNA, 15 bp, Homo sapiens
ctgcctatccatcct

SEQ ID NO: 4186372 - DNA, 17 bp, Homo sapiens
ctgcctatccatcctgc

SEQ ID NO: 4186373 - DNA, 15 bp, Homo sapiens
ctgcctatcctctgt

SEQ ID NO: 4186374 - DNA, 16 bp, Homo sapiens
ctgcctatcctctgta

SEQ ID NO: 4186375 - DNA, 21 bp, Homo sapiens
ctgcctatcctctgtatatag

SEQ ID NO: 4186376 - DNA, 16 bp, Homo sapiens
ctgcctcagcctctca

SEQ ID NO: 4186377 - DNA, 17 bp, Homo sapiens
ctgcctctctgctccag

SEQ ID NO: 4186378 - DNA, 18 bp, Homo sapiens
ctgcctctctgctccaga

SEQ ID NO: 4186379 - DNA, 19 bp, Homo sapiens
ctgcctctctgctccagag

SEQ ID NO: 4186380 - DNA, 13 bp, Homo sapiens
ctgcctgtagtta

SEQ ID NO: 4186381 - DNA, 18 bp, Homo sapiens
ctgcctgtagttaggaaa

SEQ ID NO: 4186382 - DNA, 21 bp, Homo sapiens
ctgcctgtagttaggaaataa

SEQ ID NO: 4186383 - DNA, 18 bp, Homo sapiens
ctgcctgtgcatgacctg

SEQ ID NO: 4186384 - DNA, 16 bp, Homo sapiens
ctgcctgtggagacag

SEQ ID NO: 4186385 - DNA, 20 bp, Homo sapiens
ctgcctgtggagacagccct

SEQ ID NO: 4186386 - DNA, 20 bp, Homo sapiens
ctgccttgaagccactgaag

SEQ ID NO: 4186387 - DNA, 16 bp, Homo sapiens
ctgccttttgctgctg

SEQ ID NO: 4186388 - DNA, 17 bp, Homo sapiens
ctgcgaaggggccctgg

SEQ ID NO: 4186389 - DNA, 19 bp, Homo sapiens
ctgcgatcttcagagcagg

SEQ ID NO: 4186390 - DNA, 17 bp, Homo sapiens
ctgcgattttgcctgtg

SEQ ID NO: 4186391 - DNA, 13 bp, Homo sapiens
ctgcggcatccct

SEQ ID NO: 4186392 - DNA, 16 bp, Homo sapiens
ctgcggcatccctgtg

SEQ ID NO: 4186393 - DNA, 17 bp, Homo sapiens
ctgcgggatggtcctgg

SEQ ID NO: 4186394 - DNA, 20 bp, Homo sapiens
ctgcggtggtgccagaggtt

SEQ ID NO: 4186395 - DNA, 20 bp, Homo sapiens
ctgcgtcagaccagtactgg

SEQ ID NO: 4186396 - DNA, 15 bp, Homo sapiens
ctgctactgaggcag

SEQ ID NO: 4186397 - DNA, 15 bp, Homo sapiens
ctgctagagaagggg

SEQ ID NO: 4186398 - DNA, 19 bp, Homo sapiens
ctgctaggcgagtgccagg

SEQ ID NO: 4186399 - DNA, 23 bp, Homo sapiens
ctgctatattttcatgacttttc

SEQ ID NO: 4186400 - DNA, 18 bp, Homo sapiens
ctgctcccatctgcacta

SEQ ID NO: 4186401 - DNA, 23 bp, Homo sapiens
ctgctcctaaacccccgctccag

SEQ ID NO: 4186402 - DNA, 15 bp, Homo sapiens
ctgctcctccagccc

SEQ ID NO: 4186403 - DNA, 22 bp, Homo sapiens
ctgctgaagaggcaagagacag

SEQ ID NO: 4186404 - DNA, 20 bp, Homo sapiens
ctgctgagatacatacagaa

SEQ ID NO: 4186405 - DNA, 12 bp, Homo sapiens
ctgctgcactgc

SEQ ID NO: 4186406 - DNA, 16 bp, Homo sapiens
ctgctgcactgccctc

SEQ ID NO: 4186407 - DNA, 14 bp, Homo sapiens
ctgctgccagagaa

SEQ ID NO: 4186408 - DNA, 12 bp, Homo sapiens
ctgctgccaggc

SEQ ID NO: 4186409 - DNA, 19 bp, Homo sapiens
ctgctgccgcctcccagcc

SEQ ID NO: 4186410 - DNA, 22 bp, Homo sapiens
ctgctgcggccagcctgactag

SEQ ID NO: 4186411 - DNA, 20 bp, Homo sapiens
ctgctgcgtcagaccagtac

SEQ ID NO: 4186412 - DNA, 11 bp, Homo sapiens
ctgctgctccc

SEQ ID NO: 4186413 - DNA, 13 bp, Homo sapiens
ctgctgctgtgtt

SEQ ID NO: 4186414 - DNA, 16 bp, Homo sapiens
ctgctggctgacctgg

SEQ ID NO: 4186415 - DNA, 20 bp, Homo sapiens
ctgctggctgacctgggccc

SEQ ID NO: 4186416 - DNA, 12 bp, Homo sapiens
ctgctgtcagcc

SEQ ID NO: 4186417 - DNA, 14 bp, Homo sapiens
ctgctgtcagccaa

SEQ ID NO: 4186418 - DNA, 14 bp, Homo sapiens
ctgctgtggcccag

SEQ ID NO: 4186419 - DNA, 15 bp, Homo sapiens
ctgctgtggcccagt

SEQ ID NO: 4186420 - DNA, 18 bp, Homo sapiens
ctgcttctcctcccagcg

SEQ ID NO: 4186421 - DNA, 19 bp, Homo sapiens
ctgcttcttcatcttgaca

SEQ ID NO: 4186422 - DNA, 21 bp, Homo sapiens
ctgcttgatgggattctggac

SEQ ID NO: 4186423 - DNA, 17 bp, Homo sapiens
ctgcttggagctgagca

SEQ ID NO: 4186424 - DNA, 23 bp, Homo sapiens
ctgcttgggttcctttttcaact

SEQ ID NO: 4186425 - DNA, 17 bp, Homo sapiens
ctggaaaactcaggatt

SEQ ID NO: 4186426 - DNA, 14 bp, Homo sapiens
ctggaaaggctcag

SEQ ID NO: 4186427 - DNA, 17 bp, Homo sapiens
ctggaaaggctcagtct

SEQ ID NO: 4186428 - DNA, 10 bp, Homo sapiens
ctggaaataa

SEQ ID NO: 4186429 - DNA, 21 bp, Homo sapiens
ctggaacactagacaagccag

SEQ ID NO: 4186430 - DNA, 14 bp, Homo sapiens
ctggaagaaagcaa

SEQ ID NO: 4186431 - DNA, 12 bp, Homo sapiens
ctggaagaagag

SEQ ID NO: 4186432 - DNA, 13 bp, Homo sapiens
ctggaagaagagg

SEQ ID NO: 4186433 - DNA, 17 bp, Homo sapiens
ctggaagaagaggagga

SEQ ID NO: 4186434 - DNA, 23 bp, Homo sapiens
ctggaagtttctggtgccatttc

SEQ ID NO: 4186435 - DNA, 21 bp, Homo sapiens
ctggaatggaattcagtaaca

SEQ ID NO: 4186436 - DNA, 17 bp, Homo sapiens
ctggacaagaagctgct

SEQ ID NO: 4186437 - DNA, 17 bp, Homo sapiens
ctggaccgcttcccaga

SEQ ID NO: 4186438 - DNA, 20 bp, Homo sapiens
ctggaccgcttcccagaggc

SEQ ID NO: 4186439 - DNA, 18 bp, Homo sapiens
ctggacgccgagggcagc

SEQ ID NO: 4186440 - DNA, 20 bp, Homo sapiens
ctggacggcattcctgctta

SEQ ID NO: 4186441 - DNA, 19 bp, Homo sapiens
ctggagaagctcacccaat

SEQ ID NO: 4186442 - DNA, 17 bp, Homo sapiens
ctggagagaagtttctg

SEQ ID NO: 4186443 - DNA, 13 bp, Homo sapiens
ctggagatgatga

SEQ ID NO: 4186444 - DNA, 15 bp, Homo sapiens
ctggagatgatgatg

SEQ ID NO: 4186445 - DNA, 15 bp, Homo sapiens
ctggagcatcccagg

SEQ ID NO: 4186446 - DNA, 17 bp, Homo sapiens
ctggagcatcccaggcg

SEQ ID NO: 4186447 - DNA, 14 bp, Homo sapiens
ctggagcccgcttc

SEQ ID NO: 4186448 - DNA, 21 bp, Homo sapiens
ctggagcggagcttgcctgcc

SEQ ID NO: 4186449 - DNA, 15 bp, Homo sapiens
ctggagggatgccac

SEQ ID NO: 4186450 - DNA, 22 bp, Homo sapiens
ctggaggtcacattcaggaaga

SEQ ID NO: 4186451 - DNA, 14 bp, Homo sapiens
ctggagtcccctgg

SEQ ID NO: 4186452 - DNA, 14 bp, Homo sapiens
ctggagtcttgtac

SEQ ID NO: 4186453 - DNA, 18 bp, Homo sapiens
ctggatcttttggtggag

SEQ ID NO: 4186454 - DNA, 13 bp, Homo sapiens
ctggatgcagtgg

SEQ ID NO: 4186455 - DNA, 15 bp, Homo sapiens
ctggatgcagtggct

SEQ ID NO: 4186456 - DNA, 22 bp, Homo sapiens
ctggatgcagtggctcatgcct

SEQ ID NO: 4186457 - DNA, 16 bp, Homo sapiens
ctggattcaagtgatt

SEQ ID NO: 4186458 - DNA, 18 bp, Homo sapiens
ctggcaaaggtggctctc

SEQ ID NO: 4186459 - DNA, 22 bp, Homo sapiens
ctggcaaaggtggctctccagt

SEQ ID NO: 4186460 - DNA, 15 bp, Homo sapiens
ctggcagagcacagc

SEQ ID NO: 4186461 - DNA, 17 bp, Homo sapiens
ctggcagagcacagccc

SEQ ID NO: 4186462 - DNA, 18 bp, Homo sapiens
ctggcagagcacagccca

SEQ ID NO: 4186463 - DNA, 20 bp, Homo sapiens
ctggcagtttatatttaact

SEQ ID NO: 4186464 - DNA, 17 bp, Homo sapiens
ctggcatgtcagagcca

SEQ ID NO: 4186465 - DNA, 20 bp, Homo sapiens
ctggcccagccaactgcccc

SEQ ID NO: 4186466 - DNA, 21 bp, Homo sapiens
ctggcccagccaactgccccg

SEQ ID NO: 4186467 - DNA, 22 bp, Homo sapiens
ctggcccagccaactgccccgg

SEQ ID NO: 4186468 - DNA, 15 bp, Homo sapiens
ctggcccagccagcc

SEQ ID NO: 4186469 - DNA, 16 bp, Homo sapiens
ctggcccagccagcca

SEQ ID NO: 4186470 - DNA, 12 bp, Homo sapiens
ctggccccaccc

SEQ ID NO: 4186471 - DNA, 13 bp, Homo sapiens
ctggcccccctcc

SEQ ID NO: 4186472 - DNA, 16 bp, Homo sapiens
ctggcccccctccagg

SEQ ID NO: 4186473 - DNA, 17 bp, Homo sapiens
ctggcccccctccaggc

SEQ ID NO: 4186474 - DNA, 21 bp, Homo sapiens
ctggcccgtcatgttcctcaa

SEQ ID NO: 4186475 - DNA, 17 bp, Homo sapiens
ctggccctggggccatg

SEQ ID NO: 4186476 - DNA, 22 bp, Homo sapiens
ctggcccttaaacaactgcaga

SEQ ID NO: 4186477 - DNA, 23 bp, Homo sapiens
ctggcccttaaacaactgcagaa

SEQ ID NO: 4186478 - DNA, 18 bp, Homo sapiens
ctggccctttctggacca

SEQ ID NO: 4186479 - DNA, 21 bp, Homo sapiens
ctggcctcaaagcaagcattc

SEQ ID NO: 4186480 - DNA, 22 bp, Homo sapiens
ctggcctcccaataaagctgga

SEQ ID NO: 4186481 - DNA, 23 bp, Homo sapiens
ctggcctcccaataaagctggac

SEQ ID NO: 4186482 - DNA, 21 bp, Homo sapiens
ctggcctttcaggtccaggcc

SEQ ID NO: 4186483 - DNA, 22 bp, Homo sapiens
ctggcctttcaggtccaggcca

SEQ ID NO: 4186484 - DNA, 16 bp, Homo sapiens
ctggcggcgcagaggg

SEQ ID NO: 4186485 - DNA, 15 bp, Homo sapiens
ctggctcccagggtc

SEQ ID NO: 4186486 - DNA, 20 bp, Homo sapiens
ctggctcctttgcctctgct

SEQ ID NO: 4186487 - DNA, 19 bp, Homo sapiens
ctggctgaccccaaagagc

SEQ ID NO: 4186488 - DNA, 22 bp, Homo sapiens
ctggctgaccccaaagagcctg

SEQ ID NO: 4186489 - DNA, 13 bp, Homo sapiens
ctggctgagctga

SEQ ID NO: 4186490 - DNA, 14 bp, Homo sapiens
ctggctgtgtggcc

SEQ ID NO: 4186491 - DNA, 15 bp, Homo sapiens
ctggctgtgtggcca

SEQ ID NO: 4186492 - DNA, 22 bp, Homo sapiens
ctggcttattcccaactgctct

SEQ ID NO: 4186493 - DNA, 12 bp, Homo sapiens
ctggcttctggc

SEQ ID NO: 4186494 - DNA, 13 bp, Homo sapiens
ctggcttctggcc

SEQ ID NO: 4186495 - DNA, 17 bp, Homo sapiens
ctggcttctggccagga

SEQ ID NO: 4186496 - DNA, 22 bp, Homo sapiens
ctggctttctccgactgctagg

SEQ ID NO: 4186497 - DNA, 17 bp, Homo sapiens
ctggctttggtccccag

SEQ ID NO: 4186498 - DNA, 19 bp, Homo sapiens
ctggctttggtccccagca

SEQ ID NO: 4186499 - DNA, 18 bp, Homo sapiens
ctggctttgtctctagcc

SEQ ID NO: 4186500 - DNA, 15 bp, Homo sapiens
ctggcttttcgcttg

SEQ ID NO: 4186501 - DNA, 13 bp, Homo sapiens
ctgggaaggagga

SEQ ID NO: 4186502 - DNA, 18 bp, Homo sapiens
ctgggagaaatctggctt

SEQ ID NO: 4186503 - DNA, 12 bp, Homo sapiens
ctgggagaacct

SEQ ID NO: 4186504 - DNA, 16 bp, Homo sapiens
ctgggagaacctcagg

SEQ ID NO: 4186505 - DNA, 21 bp, Homo sapiens
ctgggagagcctggcaaggca

SEQ ID NO: 4186506 - DNA, 21 bp, Homo sapiens
ctgggaggaagcaggttgagg

SEQ ID NO: 4186507 - DNA, 22 bp, Homo sapiens
ctgggaggcggagagtacagtg

SEQ ID NO: 4186508 - DNA, 12 bp, Homo sapiens
ctgggagtcctg

SEQ ID NO: 4186509 - DNA, 18 bp, Homo sapiens
ctgggccaagttcctcta

SEQ ID NO: 4186510 - DNA, 20 bp, Homo sapiens
ctgggccaagttcctctagt

SEQ ID NO: 4186511 - DNA, 14 bp, Homo sapiens
ctgggcccacagag

SEQ ID NO: 4186512 - DNA, 17 bp, Homo sapiens
ctgggcccacagagcct

SEQ ID NO: 4186513 - DNA, 18 bp, Homo sapiens
ctgggcccacagagcctg

SEQ ID NO: 4186514 - DNA, 21 bp, Homo sapiens
ctgggcccacagagcctggct

SEQ ID NO: 4186515 - DNA, 24 bp, Homo sapiens
ctgggccccaaacgggctgccctg

SEQ ID NO: 4186516 - DNA, 15 bp, Homo sapiens
ctgggcctgagccta

SEQ ID NO: 4186517 - DNA, 13 bp, Homo sapiens
ctgggctctgccc

SEQ ID NO: 4186518 - DNA, 18 bp, Homo sapiens
ctgggctctgccccagct

SEQ ID NO: 4186519 - DNA, 11 bp, Homo sapiens
ctgggctctgg

SEQ ID NO: 4186520 - DNA, 12 bp, Homo sapiens
ctgggctctggt

SEQ ID NO: 4186521 - DNA, 20 bp, Homo sapiens
ctggggactgctacctctga

SEQ ID NO: 4186522 - DNA, 19 bp, Homo sapiens
ctggggctctgtgcaggga

SEQ ID NO: 4186523 - DNA, 18 bp, Homo sapiens
ctggggctgccagcctga

SEQ ID NO: 4186524 - DNA, 19 bp, Homo sapiens
ctggggctgccagcctgag

SEQ ID NO: 4186525 - DNA, 20 bp, Homo sapiens
ctggggctgggcctgagcct

SEQ ID NO: 4186526 - DNA, 16 bp, Homo sapiens
ctgggggaagggtggt

SEQ ID NO: 4186527 - DNA, 12 bp, Homo sapiens
ctgggggctgct

SEQ ID NO: 4186528 - DNA, 16 bp, Homo sapiens
ctgggggctgctgcac

SEQ ID NO: 4186529 - DNA, 21 bp, Homo sapiens
ctgggggtcttttagctccat

SEQ ID NO: 4186530 - DNA, 16 bp, Homo sapiens
ctggggtacaggtttg

SEQ ID NO: 4186531 - DNA, 15 bp, Homo sapiens
ctgggtaagaagaaa

SEQ ID NO: 4186532 - DNA, 17 bp, Homo sapiens
ctgggtcacctagctgg

SEQ ID NO: 4186533 - DNA, 14 bp, Homo sapiens
ctgggtccctcgga

SEQ ID NO: 4186534 - DNA, 20 bp, Homo sapiens
ctgggtccctcggagctgcc

SEQ ID NO: 4186535 - DNA, 21 bp, Homo sapiens
ctgggtccctcggagctgcca

SEQ ID NO: 4186536 - DNA, 22 bp, Homo sapiens
ctgggtgtggccccgcagtgcc

SEQ ID NO: 4186537 - DNA, 15 bp, Homo sapiens
ctgggttgcagacag

SEQ ID NO: 4186538 - DNA, 18 bp, Homo sapiens
ctgggttgcagacaggaa

SEQ ID NO: 4186539 - DNA, 23 bp, Homo sapiens
ctgggttttgtctctgcatctca

SEQ ID NO: 4186540 - DNA, 19 bp, Homo sapiens
ctggtaaactatttgtctt

SEQ ID NO: 4186541 - DNA, 22 bp, Homo sapiens
ctggtaatttgtatctgaagga

SEQ ID NO: 4186542 - DNA, 20 bp, Homo sapiens
ctggtagcacatgtctgtcc

SEQ ID NO: 4186543 - DNA, 21 bp, Homo sapiens
ctggtagcacatgtctgtcct

SEQ ID NO: 4186544 - DNA, 18 bp, Homo sapiens
ctggtatgaacttgagga

SEQ ID NO: 4186545 - DNA, 18 bp, Homo sapiens
ctggtcaagtagatcatg

SEQ ID NO: 4186546 - DNA, 14 bp, Homo sapiens
ctggtcctgcactg

SEQ ID NO: 4186547 - DNA, 15 bp, Homo sapiens
ctggtcctgcactgt

SEQ ID NO: 4186548 - DNA, 16 bp, Homo sapiens
ctggtccttccaggcc

SEQ ID NO: 4186549 - DNA, 15 bp, Homo sapiens
ctggtctttcctctg

SEQ ID NO: 4186550 - DNA, 14 bp, Homo sapiens
ctggtgaggcccag

SEQ ID NO: 4186551 - DNA, 19 bp, Homo sapiens
ctggtgaggcccagcctgt

SEQ ID NO: 4186552 - DNA, 16 bp, Homo sapiens
ctggtgcactggcccc

SEQ ID NO: 4186553 - DNA, 15 bp, Homo sapiens
ctggtgctactccat

SEQ ID NO: 4186554 - DNA, 17 bp, Homo sapiens
ctggtgctactccatgc

SEQ ID NO: 4186555 - DNA, 20 bp, Homo sapiens
ctggtgctataggctggaga

SEQ ID NO: 4186556 - DNA, 21 bp, Homo sapiens
ctggtgctataggctggagaa

SEQ ID NO: 4186557 - DNA, 16 bp, Homo sapiens
ctggtgctgtggccag

SEQ ID NO: 4186558 - DNA, 18 bp, Homo sapiens
ctggtgctgtggccaggg

SEQ ID NO: 4186559 - DNA, 19 bp, Homo sapiens
ctggtgctgtggccagggt

SEQ ID NO: 4186560 - DNA, 17 bp, Homo sapiens
ctggtggacagtcctgg

SEQ ID NO: 4186561 - DNA, 20 bp, Homo sapiens
ctggtgtagctcctctgctg

SEQ ID NO: 4186562 - DNA, 16 bp, Homo sapiens
ctggtttgcagctgtt

SEQ ID NO: 4186563 - DNA, 21 bp, Homo sapiens
ctgtaaaaagagagaaaactt

SEQ ID NO: 4186564 - DNA, 19 bp, Homo sapiens
ctgtaaactcaaaacttaa

SEQ ID NO: 4186565 - DNA, 13 bp, Homo sapiens
ctgtaagaaacct

SEQ ID NO: 4186566 - DNA, 14 bp, Homo sapiens
ctgtacaaaaacaa

SEQ ID NO: 4186567 - DNA, 20 bp, Homo sapiens
ctgtacccaatttaattcca

SEQ ID NO: 4186568 - DNA, 15 bp, Homo sapiens
ctgtagctttcctgg

SEQ ID NO: 4186569 - DNA, 22 bp, Homo sapiens
ctgtaggtttgtagtagccacc

SEQ ID NO: 4186570 - DNA, 14 bp, Homo sapiens
ctgtagtcccagcc

SEQ ID NO: 4186571 - DNA, 15 bp, Homo sapiens
ctgtagtcccagcca

SEQ ID NO: 4186572 - DNA, 20 bp, Homo sapiens
ctgtagtgtcactcaaggcg

SEQ ID NO: 4186573 - DNA, 13 bp, Homo sapiens
ctgtagttaggaa

SEQ ID NO: 4186574 - DNA, 12 bp, Homo sapiens
ctgtatgtcaga

SEQ ID NO: 4186575 - DNA, 15 bp, Homo sapiens
ctgtattcagacaga

SEQ ID NO: 4186576 - DNA, 13 bp, Homo sapiens
ctgtcacactaaa

SEQ ID NO: 4186577 - DNA, 16 bp, Homo sapiens
ctgtcacactaaactt

SEQ ID NO: 4186578 - DNA, 17 bp, Homo sapiens
ctgtcactggcagagca

SEQ ID NO: 4186579 - DNA, 18 bp, Homo sapiens
ctgtcactggcagagcac

SEQ ID NO: 4186580 - DNA, 21 bp, Homo sapiens
ctgtcactggcagagcacagc

SEQ ID NO: 4186581 - DNA, 18 bp, Homo sapiens
ctgtcatggtcctttctg

SEQ ID NO: 4186582 - DNA, 22 bp, Homo sapiens
ctgtcattcaggaccccaaccc

SEQ ID NO: 4186583 - DNA, 18 bp, Homo sapiens
ctgtccaatcagagaata

SEQ ID NO: 4186584 - DNA, 15 bp, Homo sapiens
ctgtccaccagaccc

SEQ ID NO: 4186585 - DNA, 16 bp, Homo sapiens
ctgtccaccagaccca

SEQ ID NO: 4186586 - DNA, 19 bp, Homo sapiens
ctgtccactcttgttcaag

SEQ ID NO: 4186587 - DNA, 19 bp, Homo sapiens
ctgtccagcgcggctcccg

SEQ ID NO: 4186588 - DNA, 19 bp, Homo sapiens
ctgtcccggttcaccttgc

SEQ ID NO: 4186589 - DNA, 18 bp, Homo sapiens
ctgtccgcctctgcccgc

SEQ ID NO: 4186590 - DNA, 19 bp, Homo sapiens
ctgtccgcctctgcccgca

SEQ ID NO: 4186591 - DNA, 20 bp, Homo sapiens
ctgtccgcctctgcccgcag

SEQ ID NO: 4186592 - DNA, 21 bp, Homo sapiens
ctgtccgcctctgcccgcaga

SEQ ID NO: 4186593 - DNA, 14 bp, Homo sapiens
ctgtcctggtacag

SEQ ID NO: 4186594 - DNA, 19 bp, Homo sapiens
ctgtcctggtacagcaggg

SEQ ID NO: 4186595 - DNA, 13 bp, Homo sapiens
ctgtcctttctag

SEQ ID NO: 4186596 - DNA, 23 bp, Homo sapiens
ctgtcctttctagagcactgcca

SEQ ID NO: 4186597 - DNA, 16 bp, Homo sapiens
ctgtctggttttaaca

SEQ ID NO: 4186598 - DNA, 14 bp, Homo sapiens
ctgtctgtctgtct

SEQ ID NO: 4186599 - DNA, 14 bp, Homo sapiens
ctgtcttctggact

SEQ ID NO: 4186600 - DNA, 15 bp, Homo sapiens
ctgtcttctggactg

SEQ ID NO: 4186601 - DNA, 20 bp, Homo sapiens
ctgtgaaataccacaagcct

SEQ ID NO: 4186602 - DNA, 14 bp, Homo sapiens
ctgtgaagcaaaaa

SEQ ID NO: 4186603 - DNA, 18 bp, Homo sapiens
ctgtgacccatctgtagt

SEQ ID NO: 4186604 - DNA, 15 bp, Homo sapiens
ctgtgcagggaggag

SEQ ID NO: 4186605 - DNA, 14 bp, Homo sapiens
ctgtgccctgcctt

SEQ ID NO: 4186606 - DNA, 10 bp, Homo sapiens
ctgtgcctta

SEQ ID NO: 4186607 - DNA, 24 bp, Homo sapiens
ctgtgctaaagaagccctgctggg

SEQ ID NO: 4186608 - DNA, 19 bp, Homo sapiens
ctgtgctatggtgctctgt

SEQ ID NO: 4186609 - DNA, 16 bp, Homo sapiens
ctgtgctcctgtccct

SEQ ID NO: 4186610 - DNA, 22 bp, Homo sapiens
ctgtggagacagccctgcctat

SEQ ID NO: 4186611 - DNA, 23 bp, Homo sapiens
ctgtggattttttccttcaaagt

SEQ ID NO: 4186612 - DNA, 20 bp, Homo sapiens
ctgtggcccttctgtccacc

SEQ ID NO: 4186613 - DNA, 14 bp, Homo sapiens
ctgtggcctgggca

SEQ ID NO: 4186614 - DNA, 15 bp, Homo sapiens
ctgtggccttctcag

SEQ ID NO: 4186615 - DNA, 18 bp, Homo sapiens
ctgtggccttctcagcct

SEQ ID NO: 4186616 - DNA, 16 bp, Homo sapiens
ctgtgggagctcagct

SEQ ID NO: 4186617 - DNA, 13 bp, Homo sapiens
ctgtggggcctga

SEQ ID NO: 4186618 - DNA, 17 bp, Homo sapiens
ctgtggggtctggctgt

SEQ ID NO: 4186619 - DNA, 15 bp, Homo sapiens
ctgtgtactgcagtt

SEQ ID NO: 4186620 - DNA, 14 bp, Homo sapiens
ctgtgtctggcccc

SEQ ID NO: 4186621 - DNA, 15 bp, Homo sapiens
ctgtgtctggcccct

SEQ ID NO: 4186622 - DNA, 17 bp, Homo sapiens
ctgtgtgcagtgaaggt

SEQ ID NO: 4186623 - DNA, 13 bp, Homo sapiens
ctgtgtgtacatg

SEQ ID NO: 4186624 - DNA, 16 bp, Homo sapiens
ctgtgttaactcagga

SEQ ID NO: 4186625 - DNA, 22 bp, Homo sapiens
ctgtgttatttggaccactcca

SEQ ID NO: 4186626 - DNA, 18 bp, Homo sapiens
ctgtgttgcgtgtcgtgg

SEQ ID NO: 4186627 - DNA, 20 bp, Homo sapiens
ctgtgttgcgtgtcgtgggt

SEQ ID NO: 4186628 - DNA, 18 bp, Homo sapiens
ctgttaagcaattccttt

SEQ ID NO: 4186629 - DNA, 23 bp, Homo sapiens
ctgttatcaaacaccaacataaa

SEQ ID NO: 4186630 - DNA, 17 bp, Homo sapiens
ctgttcccaatatgtag

SEQ ID NO: 4186631 - DNA, 22 bp, Homo sapiens
ctgttcttggtaactgattacc

SEQ ID NO: 4186632 - DNA, 14 bp, Homo sapiens
ctgttgaaaattat

SEQ ID NO: 4186633 - DNA, 13 bp, Homo sapiens
ctgttgccacaac

SEQ ID NO: 4186634 - DNA, 15 bp, Homo sapiens
ctgttggggcagggg

SEQ ID NO: 4186635 - DNA, 14 bp, Homo sapiens
ctgttgtacaagct

SEQ ID NO: 4186636 - DNA, 17 bp, Homo sapiens
ctgttgttcccatctgc

SEQ ID NO: 4186637 - DNA, 20 bp, Homo sapiens
ctgttgttttgttttaaata

SEQ ID NO: 4186638 - DNA, 17 bp, Homo sapiens
ctgtttactgcaaggtt

SEQ ID NO: 4186639 - DNA, 20 bp, Homo sapiens
ctgtttagtagcagtgattg

SEQ ID NO: 4186640 - DNA, 13 bp, Homo sapiens
ctgttttcaaagc

SEQ ID NO: 4186641 - DNA, 10 bp, Homo sapiens
ctgttttcca

SEQ ID NO: 4186642 - DNA, 14 bp, Homo sapiens
ctgttttgtttctt

SEQ ID NO: 4186643 - DNA, 15 bp, Homo sapiens
ctgttttgtttcttg

SEQ ID NO: 4186644 - DNA, 18 bp, Homo sapiens
ctgttttttctgtacaca

SEQ ID NO: 4186645 - DNA, 16 bp, Homo sapiens
cttaaacaactgcaga

SEQ ID NO: 4186646 - DNA, 22 bp, Homo sapiens
cttaaagaaagtcgaattaata

SEQ ID NO: 4186647 - DNA, 18 bp, Homo sapiens
cttaaatgttaatgagaa

SEQ ID NO: 4186648 - DNA, 15 bp, Homo sapiens
cttaacatatttact

SEQ ID NO: 4186649 - DNA, 18 bp, Homo sapiens
cttaacatggaagatatt

SEQ ID NO: 4186650 - DNA, 21 bp, Homo sapiens
cttaagcagagcagaactttt

SEQ ID NO: 4186651 - DNA, 20 bp, Homo sapiens
cttaagccttttgctcacaa

SEQ ID NO: 4186652 - DNA, 21 bp, Homo sapiens
cttaaggtgtagccacaccag

SEQ ID NO: 4186653 - DNA, 11 bp, Homo sapiens
cttaataatac

SEQ ID NO: 4186654 - DNA, 22 bp, Homo sapiens
cttaatggctgataattttaaa

SEQ ID NO: 4186655 - DNA, 15 bp, Homo sapiens
cttaattttaatcca

SEQ ID NO: 4186656 - DNA, 15 bp, Homo sapiens
cttaccaactttctg

SEQ ID NO: 4186657 - DNA, 17 bp, Homo sapiens
cttaccaactttctgta

SEQ ID NO: 4186658 - DNA, 19 bp, Homo sapiens
cttaccaggcaccaaaaga

SEQ ID NO: 4186659 - DNA, 17 bp, Homo sapiens
cttactaatgtgcccca

SEQ ID NO: 4186660 - DNA, 13 bp, Homo sapiens
cttactcacctct

SEQ ID NO: 4186661 - DNA, 17 bp, Homo sapiens
cttactctttcactcag

SEQ ID NO: 4186662 - DNA, 17 bp, Homo sapiens
cttagaataaaattgta

SEQ ID NO: 4186663 - DNA, 18 bp, Homo sapiens
cttagaattgaggagttg

SEQ ID NO: 4186664 - DNA, 20 bp, Homo sapiens
cttagagaatgttctcctaa

SEQ ID NO: 4186665 - DNA, 17 bp, Homo sapiens
cttagcctcctgacctg

SEQ ID NO: 4186666 - DNA, 21 bp, Homo sapiens
cttagcctcctgacctgaggc

SEQ ID NO: 4186667 - DNA, 15 bp, Homo sapiens
cttaggaacagctct

SEQ ID NO: 4186668 - DNA, 13 bp, Homo sapiens
cttaggaagaaat

SEQ ID NO: 4186669 - DNA, 18 bp, Homo sapiens
cttaggctgctgggagat

SEQ ID NO: 4186670 - DNA, 16 bp, Homo sapiens
cttagtacggctgctg

SEQ ID NO: 4186671 - DNA, 17 bp, Homo sapiens
cttagtacggctgctgc

SEQ ID NO: 4186672 - DNA, 18 bp, Homo sapiens
cttagtacggctgctgca

SEQ ID NO: 4186673 - DNA, 22 bp, Homo sapiens
cttagtggcttttttcctcctg

SEQ ID NO: 4186674 - DNA, 13 bp, Homo sapiens
cttataacttctg

SEQ ID NO: 4186675 - DNA, 12 bp, Homo sapiens
cttatcatcagc

SEQ ID NO: 4186676 - DNA, 12 bp, Homo sapiens
cttatccaggac

SEQ ID NO: 4186677 - DNA, 13 bp, Homo sapiens
cttatccaggact

SEQ ID NO: 4186678 - DNA, 14 bp, Homo sapiens
cttattatcccagc

SEQ ID NO: 4186679 - DNA, 21 bp, Homo sapiens
cttattcatgctttctccttt

SEQ ID NO: 4186680 - DNA, 23 bp, Homo sapiens
cttattcatgctttctccttttt

SEQ ID NO: 4186681 - DNA, 15 bp, Homo sapiens
cttattctcctccct

SEQ ID NO: 4186682 - DNA, 16 bp, Homo sapiens
cttattgtttgtaaac

SEQ ID NO: 4186683 - DNA, 17 bp, Homo sapiens
cttattgtttgtaaaca

SEQ ID NO: 4186684 - DNA, 18 bp, Homo sapiens
cttattttttaaaataat

SEQ ID NO: 4186685 - DNA, 20 bp, Homo sapiens
cttcaacaattctaaaatga

SEQ ID NO: 4186686 - DNA, 12 bp, Homo sapiens
cttcaagtgcca

SEQ ID NO: 4186687 - DNA, 17 bp, Homo sapiens
cttcaagttagctcagg

SEQ ID NO: 4186688 - DNA, 16 bp, Homo sapiens
cttcaattcctgggcc

SEQ ID NO: 4186689 - DNA, 15 bp, Homo sapiens
cttcactcagccaca

SEQ ID NO: 4186690 - DNA, 24 bp, Homo sapiens
cttcactccggtgtgcctgcagcc

SEQ ID NO: 4186691 - DNA, 16 bp, Homo sapiens
cttcagaaggcctcac

SEQ ID NO: 4186692 - DNA, 20 bp, Homo sapiens
cttcagaaggcctcactcaa

SEQ ID NO: 4186693 - DNA, 17 bp, Homo sapiens
cttcagacgagatcctg

SEQ ID NO: 4186694 - DNA, 19 bp, Homo sapiens
cttcagacttttatcaaaa

SEQ ID NO: 4186695 - DNA, 18 bp, Homo sapiens
cttcagatttgtgttata

SEQ ID NO: 4186696 - DNA, 22 bp, Homo sapiens
cttcagcctgaggctgagactg

SEQ ID NO: 4186697 - DNA, 19 bp, Homo sapiens
cttcagtgacaagtagggc

SEQ ID NO: 4186698 - DNA, 17 bp, Homo sapiens
cttcagtggagaattat

SEQ ID NO: 4186699 - DNA, 17 bp, Homo sapiens
cttcagttgttttcccg

SEQ ID NO: 4186700 - DNA, 12 bp, Homo sapiens
cttcatcttgac

SEQ ID NO: 4186701 - DNA, 14 bp, Homo sapiens
cttcatggtgacat

SEQ ID NO: 4186702 - DNA, 20 bp, Homo sapiens
cttccaggtatctccaggat

SEQ ID NO: 4186703 - DNA, 16 bp, Homo sapiens
cttccaggtggcagga

SEQ ID NO: 4186704 - DNA, 16 bp, Homo sapiens
cttccatgatacttta

SEQ ID NO: 4186705 - DNA, 18 bp, Homo sapiens
cttccatgatactttaat

SEQ ID NO: 4186706 - DNA, 11 bp, Homo sapiens
cttccatgcct

SEQ ID NO: 4186707 - DNA, 14 bp, Homo sapiens
cttccatgcctgta

SEQ ID NO: 4186708 - DNA, 21 bp, Homo sapiens
cttccatgcctgtagctttcc

SEQ ID NO: 4186709 - DNA, 10 bp, Homo sapiens
cttcccagag

SEQ ID NO: 4186710 - DNA, 17 bp, Homo sapiens
cttccccagactcagct

SEQ ID NO: 4186711 - DNA, 18 bp, Homo sapiens
cttccccagactcagctc

SEQ ID NO: 4186712 - DNA, 16 bp, Homo sapiens
cttccccaggagctct

SEQ ID NO: 4186713 - DNA, 21 bp, Homo sapiens
cttcccccatcccctttcctc

SEQ ID NO: 4186714 - DNA, 23 bp, Homo sapiens
cttcccccatcccctttcctccc

SEQ ID NO: 4186715 - DNA, 23 bp, Homo sapiens
cttccccctccaacccacagcct

SEQ ID NO: 4186716 - DNA, 13 bp, Homo sapiens
cttccctctttcc

SEQ ID NO: 4186717 - DNA, 23 bp, Homo sapiens
cttccctctttccccacctcttc

SEQ ID NO: 4186718 - DNA, 14 bp, Homo sapiens
cttcccttctctcc

SEQ ID NO: 4186719 - DNA, 17 bp, Homo sapiens
cttcccttctctccttc

SEQ ID NO: 4186720 - DNA, 14 bp, Homo sapiens
cttccgctccttta

SEQ ID NO: 4186721 - DNA, 21 bp, Homo sapiens
cttccgtggtcagagtgccac

SEQ ID NO: 4186722 - DNA, 22 bp, Homo sapiens
cttccgtggtcagagtgccact

SEQ ID NO: 4186723 - DNA, 23 bp, Homo sapiens
cttcctacacccttggacttgag

SEQ ID NO: 4186724 - DNA, 14 bp, Homo sapiens
cttcctccctggag

SEQ ID NO: 4186725 - DNA, 16 bp, Homo sapiens
cttcctcgtgcagagc

SEQ ID NO: 4186726 - DNA, 13 bp, Homo sapiens
cttcctctgggca

SEQ ID NO: 4186727 - DNA, 18 bp, Homo sapiens
cttcctggtgaggcccag

SEQ ID NO: 4186728 - DNA, 19 bp, Homo sapiens
cttccttaattcactccca

SEQ ID NO: 4186729 - DNA, 15 bp, Homo sapiens
cttccttctttctct

SEQ ID NO: 4186730 - DNA, 18 bp, Homo sapiens
cttccttctttctcttcc

SEQ ID NO: 4186731 - DNA, 19 bp, Homo sapiens
cttccttctttctcttccc

SEQ ID NO: 4186732 - DNA, 14 bp, Homo sapiens
cttccttgtgattg

SEQ ID NO: 4186733 - DNA, 11 bp, Homo sapiens
cttcctttcct

SEQ ID NO: 4186734 - DNA, 12 bp, Homo sapiens
cttctacccaga

SEQ ID NO: 4186735 - DNA, 17 bp, Homo sapiens
cttctagccacagttct

SEQ ID NO: 4186736 - DNA, 21 bp, Homo sapiens
cttctcaaaagattgttttat

SEQ ID NO: 4186737 - DNA, 21 bp, Homo sapiens
cttctcagcctacagcagtgt

SEQ ID NO: 4186738 - DNA, 21 bp, Homo sapiens
cttctcattccaacagtgagt

SEQ ID NO: 4186739 - DNA, 10 bp, Homo sapiens
cttctccatc

SEQ ID NO: 4186740 - DNA, 16 bp, Homo sapiens
cttctcgtttgctcta

SEQ ID NO: 4186741 - DNA, 15 bp, Homo sapiens
cttctctacagactt

SEQ ID NO: 4186742 - DNA, 21 bp, Homo sapiens
cttctctccttccctctttcc

SEQ ID NO: 4186743 - DNA, 13 bp, Homo sapiens
cttctcttgaatt

SEQ ID NO: 4186744 - DNA, 18 bp, Homo sapiens
cttctgattcccctccac

SEQ ID NO: 4186745 - DNA, 15 bp, Homo sapiens
cttctgcagcaactc

SEQ ID NO: 4186746 - DNA, 17 bp, Homo sapiens
cttctgcagcaactccc

SEQ ID NO: 4186747 - DNA, 21 bp, Homo sapiens
cttctgcagcaactcccacga

SEQ ID NO: 4186748 - DNA, 22 bp, Homo sapiens
cttctgcagcaactcccacgac

SEQ ID NO: 4186749 - DNA, 11 bp, Homo sapiens
cttctggagcc

SEQ ID NO: 4186750 - DNA, 13 bp, Homo sapiens
cttctggagccct

SEQ ID NO: 4186751 - DNA, 14 bp, Homo sapiens
cttctggagccctt

SEQ ID NO: 4186752 - DNA, 15 bp, Homo sapiens
cttctggccaggaag

SEQ ID NO: 4186753 - DNA, 22 bp, Homo sapiens
cttctggccaggaagctttggt

SEQ ID NO: 4186754 - DNA, 22 bp, Homo sapiens
cttctggctccaaggtgctctg

SEQ ID NO: 4186755 - DNA, 22 bp, Homo sapiens
cttctggctcctccttcccctg

SEQ ID NO: 4186756 - DNA, 19 bp, Homo sapiens
cttctggtgctactccatg

SEQ ID NO: 4186757 - DNA, 14 bp, Homo sapiens
cttcttaacgaaat

SEQ ID NO: 4186758 - DNA, 12 bp, Homo sapiens
cttcttccctgt

SEQ ID NO: 4186759 - DNA, 13 bp, Homo sapiens
cttcttgcccaga

SEQ ID NO: 4186760 - DNA, 17 bp, Homo sapiens
cttctttctcttccctc

SEQ ID NO: 4186761 - DNA, 19 bp, Homo sapiens
cttctttctcttccctcct

SEQ ID NO: 4186762 - DNA, 16 bp, Homo sapiens
cttctttgaagttatt

SEQ ID NO: 4186763 - DNA, 14 bp, Homo sapiens
cttcttttcacctc

SEQ ID NO: 4186764 - DNA, 14 bp, Homo sapiens
cttgaaacagcctg

SEQ ID NO: 4186765 - DNA, 16 bp, Homo sapiens
cttgaaacagcctggg

SEQ ID NO: 4186766 - DNA, 18 bp, Homo sapiens
cttgaacatgttttgtat

SEQ ID NO: 4186767 - DNA, 20 bp, Homo sapiens
cttgaagaatctctcctctc

SEQ ID NO: 4186768 - DNA, 18 bp, Homo sapiens
cttgaagccactgaagct

SEQ ID NO: 4186769 - DNA, 21 bp, Homo sapiens
cttgaagccactgaagctggg

SEQ ID NO: 4186770 - DNA, 16 bp, Homo sapiens
cttgaagggtaaagaa

SEQ ID NO: 4186771 - DNA, 14 bp, Homo sapiens
cttgaattattttg

SEQ ID NO: 4186772 - DNA, 16 bp, Homo sapiens
cttgacccatctcccc

SEQ ID NO: 4186773 - DNA, 14 bp, Homo sapiens
cttgaccctgagct

SEQ ID NO: 4186774 - DNA, 12 bp, Homo sapiens
cttgagcttggc

SEQ ID NO: 4186775 - DNA, 13 bp, Homo sapiens
cttgaggacacat

SEQ ID NO: 4186776 - DNA, 15 bp, Homo sapiens
cttgaggacacatgt

SEQ ID NO: 4186777 - DNA, 22 bp, Homo sapiens
cttgatactaaaagttcttctc

SEQ ID NO: 4186778 - DNA, 21 bp, Homo sapiens
cttgcactaaagtatgtaaag

SEQ ID NO: 4186779 - DNA, 23 bp, Homo sapiens
cttgcaggaaggactatgaaaag

SEQ ID NO: 4186780 - DNA, 11 bp, Homo sapiens
cttgcctgcct

SEQ ID NO: 4186781 - DNA, 12 bp, Homo sapiens
cttgcctgcctg

SEQ ID NO: 4186782 - DNA, 17 bp, Homo sapiens
cttgccttttaaaagaa

SEQ ID NO: 4186783 - DNA, 20 bp, Homo sapiens
cttgcggaatcactctgtcc

SEQ ID NO: 4186784 - DNA, 18 bp, Homo sapiens
cttgctgacatggctttg

SEQ ID NO: 4186785 - DNA, 15 bp, Homo sapiens
cttgctgtcctaggc

SEQ ID NO: 4186786 - DNA, 16 bp, Homo sapiens
cttgctgtcctaggcc

SEQ ID NO: 4186787 - DNA, 12 bp, Homo sapiens
cttgcttctgca

SEQ ID NO: 4186788 - DNA, 21 bp, Homo sapiens
cttgcttctgcagcaactccc

SEQ ID NO: 4186789 - DNA, 22 bp, Homo sapiens
cttgcttctgcagcaactccca

SEQ ID NO: 4186790 - DNA, 22 bp, Homo sapiens
cttggaaagcatcacctcaggc

SEQ ID NO: 4186791 - DNA, 17 bp, Homo sapiens
cttggaagtgtgtggaa

SEQ ID NO: 4186792 - DNA, 16 bp, Homo sapiens
cttggactcctcccac

SEQ ID NO: 4186793 - DNA, 18 bp, Homo sapiens
cttggactcctcccacaa

SEQ ID NO: 4186794 - DNA, 15 bp, Homo sapiens
cttggagagcagctg

SEQ ID NO: 4186795 - DNA, 16 bp, Homo sapiens
cttggagcctgaacat

SEQ ID NO: 4186796 - DNA, 18 bp, Homo sapiens
cttggagcctgaacatga

SEQ ID NO: 4186797 - DNA, 14 bp, Homo sapiens
cttggagctgagca

SEQ ID NO: 4186798 - DNA, 16 bp, Homo sapiens
cttggcagagaggacc

SEQ ID NO: 4186799 - DNA, 15 bp, Homo sapiens
cttggcagctgaact

SEQ ID NO: 4186800 - DNA, 18 bp, Homo sapiens
cttggcagtattccatgg

SEQ ID NO: 4186801 - DNA, 22 bp, Homo sapiens
cttggcatcacagggcagagcc

SEQ ID NO: 4186802 - DNA, 17 bp, Homo sapiens
cttggcttttgcttggc

SEQ ID NO: 4186803 - DNA, 18 bp, Homo sapiens
cttggcttttgcttggca

SEQ ID NO: 4186804 - DNA, 21 bp, Homo sapiens
cttggcttttgcttggcagag

SEQ ID NO: 4186805 - DNA, 15 bp, Homo sapiens
cttgggcccaggagg

SEQ ID NO: 4186806 - DNA, 16 bp, Homo sapiens
cttgggcccaggaggt

SEQ ID NO: 4186807 - DNA, 15 bp, Homo sapiens
cttggggctcgcccc

SEQ ID NO: 4186808 - DNA, 19 bp, Homo sapiens
cttggggctcgccccaccc

SEQ ID NO: 4186809 - DNA, 20 bp, Homo sapiens
cttggggttttcagtatgaa

SEQ ID NO: 4186810 - DNA, 15 bp, Homo sapiens
cttggtcagagccac

SEQ ID NO: 4186811 - DNA, 20 bp, Homo sapiens
cttggtctgatttcaggata

SEQ ID NO: 4186812 - DNA, 18 bp, Homo sapiens
cttggtggccaagcctgg

SEQ ID NO: 4186813 - DNA, 19 bp, Homo sapiens
cttggtggccaagcctggc

SEQ ID NO: 4186814 - DNA, 20 bp, Homo sapiens
cttggtggccaagcctggcc

SEQ ID NO: 4186815 - DNA, 21 bp, Homo sapiens
cttggtggccaagcctggccc

SEQ ID NO: 4186816 - DNA, 19 bp, Homo sapiens
cttggtgtgaccctctgaa

SEQ ID NO: 4186817 - DNA, 21 bp, Homo sapiens
cttggttttgctacataatta

SEQ ID NO: 4186818 - DNA, 14 bp, Homo sapiens
cttgtatctttcta

SEQ ID NO: 4186819 - DNA, 14 bp, Homo sapiens
cttgtattttctta

SEQ ID NO: 4186820 - DNA, 23 bp, Homo sapiens
cttgtccttttgtaccatggtgt

SEQ ID NO: 4186821 - DNA, 18 bp, Homo sapiens
cttgtgtcaagacatttc

SEQ ID NO: 4186822 - DNA, 21 bp, Homo sapiens
cttgtgtcaagacatttctct

SEQ ID NO: 4186823 - DNA, 18 bp, Homo sapiens
cttgtgtcagagacagac

SEQ ID NO: 4186824 - DNA, 19 bp, Homo sapiens
cttgtgtgttttgagagta

SEQ ID NO: 4186825 - DNA, 21 bp, Homo sapiens
cttgttgtttttaagtcctgt

SEQ ID NO: 4186826 - DNA, 19 bp, Homo sapiens
ctttaaaatgtaaagccat

SEQ ID NO: 4186827 - DNA, 21 bp, Homo sapiens
ctttaaaatgtaaagccatgc

SEQ ID NO: 4186828 - DNA, 22 bp, Homo sapiens
ctttaaccactcctcaggaaca

SEQ ID NO: 4186829 - DNA, 19 bp, Homo sapiens
ctttaaccctctcttccct

SEQ ID NO: 4186830 - DNA, 15 bp, Homo sapiens
ctttaacttaaatag

SEQ ID NO: 4186831 - DNA, 23 bp, Homo sapiens
ctttaatttttataaatatgtga

SEQ ID NO: 4186832 - DNA, 21 bp, Homo sapiens
ctttacatttgataaactaaa

SEQ ID NO: 4186833 - DNA, 14 bp, Homo sapiens
ctttaggcagcctg

SEQ ID NO: 4186834 - DNA, 19 bp, Homo sapiens
ctttaggcagcctgccgcc

SEQ ID NO: 4186835 - DNA, 20 bp, Homo sapiens
ctttaggcagcctgccgccg

SEQ ID NO: 4186836 - DNA, 13 bp, Homo sapiens
ctttataaacttt

SEQ ID NO: 4186837 - DNA, 14 bp, Homo sapiens
ctttatacagaact

SEQ ID NO: 4186838 - DNA, 20 bp, Homo sapiens
ctttataggcagtagactca

SEQ ID NO: 4186839 - DNA, 20 bp, Homo sapiens
ctttatcaccaggatgtcac

SEQ ID NO: 4186840 - DNA, 19 bp, Homo sapiens
ctttatctttatctttata

SEQ ID NO: 4186841 - DNA, 17 bp, Homo sapiens
ctttcagcactcagaaa

SEQ ID NO: 4186842 - DNA, 13 bp, Homo sapiens
ctttcagctgtga

SEQ ID NO: 4186843 - DNA, 20 bp, Homo sapiens
ctttcccatgatccagaact

SEQ ID NO: 4186844 - DNA, 19 bp, Homo sapiens
ctttcccccaccccagagt

SEQ ID NO: 4186845 - DNA, 18 bp, Homo sapiens
ctttccccgggggaggaa

SEQ ID NO: 4186846 - DNA, 15 bp, Homo sapiens
ctttcctacaaaatg

SEQ ID NO: 4186847 - DNA, 18 bp, Homo sapiens
ctttcctatcatggagtg

SEQ ID NO: 4186848 - DNA, 20 bp, Homo sapiens
ctttcctccccaccttcccc

SEQ ID NO: 4186849 - DNA, 16 bp, Homo sapiens
ctttccttttcttcct

SEQ ID NO: 4186850 - DNA, 18 bp, Homo sapiens
ctttccttttcttccttc

SEQ ID NO: 4186851 - DNA, 20 bp, Homo sapiens
ctttccttttcttccttctt

SEQ ID NO: 4186852 - DNA, 13 bp, Homo sapiens
ctttctcactgct

SEQ ID NO: 4186853 - DNA, 14 bp, Homo sapiens
ctttctctccttct

SEQ ID NO: 4186854 - DNA, 21 bp, Homo sapiens
ctttctctccttcttccctgt

SEQ ID NO: 4186855 - DNA, 19 bp, Homo sapiens
ctttctctggctccagaat

SEQ ID NO: 4186856 - DNA, 21 bp, Homo sapiens
ctttctcttccctccttccct

SEQ ID NO: 4186857 - DNA, 15 bp, Homo sapiens
ctttctgatcaaggc

SEQ ID NO: 4186858 - DNA, 17 bp, Homo sapiens
ctttctggaccagatcc

SEQ ID NO: 4186859 - DNA, 15 bp, Homo sapiens
ctttctgtgtgcacc

SEQ ID NO: 4186860 - DNA, 16 bp, Homo sapiens
ctttctgttgccacaa

SEQ ID NO: 4186861 - DNA, 11 bp, Homo sapiens
ctttgaagtta

SEQ ID NO: 4186862 - DNA, 15 bp, Homo sapiens
ctttgaagttattta

SEQ ID NO: 4186863 - DNA, 16 bp, Homo sapiens
ctttgaatgctttttg

SEQ ID NO: 4186864 - DNA, 13 bp, Homo sapiens
ctttgagtaccaa

SEQ ID NO: 4186865 - DNA, 13 bp, Homo sapiens
ctttgagttatag

SEQ ID NO: 4186866 - DNA, 21 bp, Homo sapiens
ctttgcatggaatttgtaagt

SEQ ID NO: 4186867 - DNA, 16 bp, Homo sapiens
ctttgccccagttaca

SEQ ID NO: 4186868 - DNA, 13 bp, Homo sapiens
ctttgcctctgct

SEQ ID NO: 4186869 - DNA, 15 bp, Homo sapiens
ctttgcctctgctac

SEQ ID NO: 4186870 - DNA, 11 bp, Homo sapiens
ctttgcctggt

SEQ ID NO: 4186871 - DNA, 21 bp, Homo sapiens
ctttgccttgatgttgtgttg

SEQ ID NO: 4186872 - DNA, 17 bp, Homo sapiens
ctttggaaacaggacca

SEQ ID NO: 4186873 - DNA, 11 bp, Homo sapiens
ctttggaagga

SEQ ID NO: 4186874 - DNA, 15 bp, Homo sapiens
ctttggaaggagtga

SEQ ID NO: 4186875 - DNA, 18 bp, Homo sapiens
ctttggcaatttcctggc

SEQ ID NO: 4186876 - DNA, 18 bp, Homo sapiens
ctttggggttgcccagcc

SEQ ID NO: 4186877 - DNA, 19 bp, Homo sapiens
ctttggtgagaacctgggt

SEQ ID NO: 4186878 - DNA, 15 bp, Homo sapiens
ctttgtataatccca

SEQ ID NO: 4186879 - DNA, 22 bp, Homo sapiens
ctttgtttcctccttgtcactg

SEQ ID NO: 4186880 - DNA, 14 bp, Homo sapiens
ctttgttttctaaa

SEQ ID NO: 4186881 - DNA, 15 bp, Homo sapiens
ctttgttttgcactg

SEQ ID NO: 4186882 - DNA, 11 bp, Homo sapiens
cttttaaaatg

SEQ ID NO: 4186883 - DNA, 22 bp, Homo sapiens
cttttaacagagtctgaaccta

SEQ ID NO: 4186884 - DNA, 21 bp, Homo sapiens
cttttaagcaaagttgggtgt

SEQ ID NO: 4186885 - DNA, 14 bp, Homo sapiens
cttttaatcagaca

SEQ ID NO: 4186886 - DNA, 19 bp, Homo sapiens
cttttaccatgaattcttg

SEQ ID NO: 4186887 - DNA, 17 bp, Homo sapiens
cttttatagctattact

SEQ ID NO: 4186888 - DNA, 20 bp, Homo sapiens
cttttatcttctagccacag

SEQ ID NO: 4186889 - DNA, 13 bp, Homo sapiens
cttttattgtata

SEQ ID NO: 4186890 - DNA, 19 bp, Homo sapiens
cttttattgtataaactat

SEQ ID NO: 4186891 - DNA, 21 bp, Homo sapiens
cttttattgtataaactatca

SEQ ID NO: 4186892 - DNA, 13 bp, Homo sapiens
cttttcacctctt

SEQ ID NO: 4186893 - DNA, 16 bp, Homo sapiens
cttttcagttagacaa

SEQ ID NO: 4186894 - DNA, 21 bp, Homo sapiens
cttttcatctccagtgtgaat

SEQ ID NO: 4186895 - DNA, 18 bp, Homo sapiens
cttttcgcttgcttctgc

SEQ ID NO: 4186896 - DNA, 20 bp, Homo sapiens
cttttcgcttgcttctgcag

SEQ ID NO: 4186897 - DNA, 24 bp, Homo sapiens
cttttcgcttgcttctgcagcaac

SEQ ID NO: 4186898 - DNA, 12 bp, Homo sapiens
cttttctgcaga

SEQ ID NO: 4186899 - DNA, 15 bp, Homo sapiens
cttttctgcagaggg

SEQ ID NO: 4186900 - DNA, 14 bp, Homo sapiens
cttttcttccttct

SEQ ID NO: 4186901 - DNA, 14 bp, Homo sapiens
cttttctttttctc

SEQ ID NO: 4186902 - DNA, 14 bp, Homo sapiens
cttttgctgctgct

SEQ ID NO: 4186903 - DNA, 11 bp, Homo sapiens
cttttgggagg

SEQ ID NO: 4186904 - DNA, 23 bp, Homo sapiens
cttttgggtgtggtgtcaccagc

SEQ ID NO: 4186905 - DNA, 15 bp, Homo sapiens
cttttggtggagtca

SEQ ID NO: 4186906 - DNA, 23 bp, Homo sapiens
cttttgtgtacagtgtgtaaagt

SEQ ID NO: 4186907 - DNA, 23 bp, Homo sapiens
ctttttcaacttggaaaaagaaa

SEQ ID NO: 4186908 - DNA, 13 bp, Homo sapiens
cttttttcctcct

SEQ ID NO: 4186909 - DNA, 14 bp, Homo sapiens
ctttttttctctcc

SEQ ID NO: 4186910 - DNA, 16 bp, Homo sapiens
cttttttttaataagg

SEQ ID NO: 4186911 - DNA, 17 bp, Homo sapiens
cttttttttaataagga

SEQ ID NO: 4186912 - DNA, 22 bp, Homo sapiens
gaaaaaagttcaatgttcagtt

SEQ ID NO: 4186913 - DNA, 23 bp, Homo sapiens
gaaaaacaaactcgttttttaca

SEQ ID NO: 4186914 - DNA, 23 bp, Homo sapiens
gaaaaacacggcagctgtagctc

SEQ ID NO: 4186915 - DNA, 12 bp, Homo sapiens
gaaaaatgctgc

SEQ ID NO: 4186916 - DNA, 13 bp, Homo sapiens
gaaaacaaaactg

SEQ ID NO: 4186917 - DNA, 22 bp, Homo sapiens
gaaaacgttgacccctttcccc

SEQ ID NO: 4186918 - DNA, 23 bp, Homo sapiens
gaaaacgttgacccctttccccc

SEQ ID NO: 4186919 - DNA, 20 bp, Homo sapiens
gaaaactcttggcctctgct

SEQ ID NO: 4186920 - DNA, 18 bp, Homo sapiens
gaaaactgaaaatctaat

SEQ ID NO: 4186921 - DNA, 20 bp, Homo sapiens
gaaaactgaaaatctaatat

SEQ ID NO: 4186922 - DNA, 12 bp, Homo sapiens
gaaaagaggagt

SEQ ID NO: 4186923 - DNA, 21 bp, Homo sapiens
gaaaagaggtggattcctggg

SEQ ID NO: 4186924 - DNA, 15 bp, Homo sapiens
gaaaagctgcctctg

SEQ ID NO: 4186925 - DNA, 23 bp, Homo sapiens
gaaaaggtttatgaaaaagaaga

SEQ ID NO: 4186926 - DNA, 15 bp, Homo sapiens
gaaaagtgttattat

SEQ ID NO: 4186927 - DNA, 21 bp, Homo sapiens
gaaaatctaatattaaaaata

SEQ ID NO: 4186928 - DNA, 12 bp, Homo sapiens
gaaaattagtaa

SEQ ID NO: 4186929 - DNA, 22 bp, Homo sapiens
gaaaattattccttgctttcat

SEQ ID NO: 4186930 - DNA, 13 bp, Homo sapiens
gaaacaaagggga

SEQ ID NO: 4186931 - DNA, 15 bp, Homo sapiens
gaaacacaaatgggg

SEQ ID NO: 4186932 - DNA, 15 bp, Homo sapiens
gaaaccaaagccagg

SEQ ID NO: 4186933 - DNA, 21 bp, Homo sapiens
gaaaccacacttcttgaaaca

SEQ ID NO: 4186934 - DNA, 14 bp, Homo sapiens
gaaacccaaggaac

SEQ ID NO: 4186935 - DNA, 18 bp, Homo sapiens
gaaacctgaaaaaaagtt

SEQ ID NO: 4186936 - DNA, 19 bp, Homo sapiens
gaaacgaatgtttcaaatc

SEQ ID NO: 4186937 - DNA, 19 bp, Homo sapiens
gaaactttgatctctgctt

SEQ ID NO: 4186938 - DNA, 17 bp, Homo sapiens
gaaacttttttatttaa

SEQ ID NO: 4186939 - DNA, 18 bp, Homo sapiens
gaaagaaaatgtctgttt

SEQ ID NO: 4186940 - DNA, 17 bp, Homo sapiens
gaaagacaggctgagct

SEQ ID NO: 4186941 - DNA, 21 bp, Homo sapiens
gaaagacatcacatccctctc

SEQ ID NO: 4186942 - DNA, 10 bp, Homo sapiens
gaaagagacc

SEQ ID NO: 4186943 - DNA, 13 bp, Homo sapiens
gaaagagagtacc

SEQ ID NO: 4186944 - DNA, 23 bp, Homo sapiens
gaaagatttgtgaactggaagaa

SEQ ID NO: 4186945 - DNA, 18 bp, Homo sapiens
gaaagcatcacctcaggc

SEQ ID NO: 4186946 - DNA, 19 bp, Homo sapiens
gaaagcatcacctcaggcc

SEQ ID NO: 4186947 - DNA, 15 bp, Homo sapiens
gaaagcctctgctgc

SEQ ID NO: 4186948 - DNA, 15 bp, Homo sapiens
gaaagcctctggaaa

SEQ ID NO: 4186949 - DNA, 14 bp, Homo sapiens
gaaagccttctttt

SEQ ID NO: 4186950 - DNA, 21 bp, Homo sapiens
gaaagctgagaccctcgccac

SEQ ID NO: 4186951 - DNA, 19 bp, Homo sapiens
gaaaggctcagtctcagga

SEQ ID NO: 4186952 - DNA, 22 bp, Homo sapiens
gaaaggctcagtctcaggagca

SEQ ID NO: 4186953 - DNA, 17 bp, Homo sapiens
gaaagggaagcctgact

SEQ ID NO: 4186954 - DNA, 19 bp, Homo sapiens
gaaagggagggcccctcat

SEQ ID NO: 4186955 - DNA, 13 bp, Homo sapiens
gaaaggtttcaag

SEQ ID NO: 4186956 - DNA, 14 bp, Homo sapiens
gaaaggtttcaaga

SEQ ID NO: 4186957 - DNA, 21 bp, Homo sapiens
gaaaggtttcaagacttgata

SEQ ID NO: 4186958 - DNA, 22 bp, Homo sapiens
gaaagtgcagaatcaacttgaa

SEQ ID NO: 4186959 - DNA, 14 bp, Homo sapiens
gaaagttcagccag

SEQ ID NO: 4186960 - DNA, 19 bp, Homo sapiens
gaaataaacctggagatga

SEQ ID NO: 4186961 - DNA, 20 bp, Homo sapiens
gaaataaacctggagatgat

SEQ ID NO: 4186962 - DNA, 22 bp, Homo sapiens
gaaataaacctggagatgatga

SEQ ID NO: 4186963 - DNA, 23 bp, Homo sapiens
gaaataaacctggagatgatgat

SEQ ID NO: 4186964 - DNA, 18 bp, Homo sapiens
gaaatagacagtatattt

SEQ ID NO: 4186965 - DNA, 16 bp, Homo sapiens
gaaatatagttctgat

SEQ ID NO: 4186966 - DNA, 24 bp, Homo sapiens
gaaatatcctttggaacaattatt

SEQ ID NO: 4186967 - DNA, 15 bp, Homo sapiens
gaaatcaacttgctt

SEQ ID NO: 4186968 - DNA, 23 bp, Homo sapiens
gaaatctggcttctggccaggaa

SEQ ID NO: 4186969 - DNA, 17 bp, Homo sapiens
gaaatggtatgagctga

SEQ ID NO: 4186970 - DNA, 23 bp, Homo sapiens
gaaatgtgtgttgtaacaaatat

SEQ ID NO: 4186971 - DNA, 13 bp, Homo sapiens
gaaatttaaacta

SEQ ID NO: 4186972 - DNA, 21 bp, Homo sapiens
gaaatttattagttaatatat

SEQ ID NO: 4186973 - DNA, 14 bp, Homo sapiens
gaaatttgatttct

SEQ ID NO: 4186974 - DNA, 13 bp, Homo sapiens
gaaattttgttaa

SEQ ID NO: 4186975 - DNA, 15 bp, Homo sapiens
gaacaacaacaacaa

SEQ ID NO: 4186976 - DNA, 20 bp, Homo sapiens
gaacaacaacaacaataaca

SEQ ID NO: 4186977 - DNA, 16 bp, Homo sapiens
gaacaagcattctcct

SEQ ID NO: 4186978 - DNA, 18 bp, Homo sapiens
gaacactagacaagccag

SEQ ID NO: 4186979 - DNA, 23 bp, Homo sapiens
gaacagaacatagacagaagaaa

SEQ ID NO: 4186980 - DNA, 23 bp, Homo sapiens
gaacagctcttcactcagccaca

SEQ ID NO: 4186981 - DNA, 21 bp, Homo sapiens
gaacatctcactttgccccag

SEQ ID NO: 4186982 - DNA, 19 bp, Homo sapiens
gaaccacaagagatcagca

SEQ ID NO: 4186983 - DNA, 23 bp, Homo sapiens
gaaccacagatgtgtctgggaga

SEQ ID NO: 4186984 - DNA, 12 bp, Homo sapiens
gaaccactgtgg

SEQ ID NO: 4186985 - DNA, 14 bp, Homo sapiens
gaaccactgtggcc

SEQ ID NO: 4186986 - DNA, 11 bp, Homo sapiens
gaaccaggagg

SEQ ID NO: 4186987 - DNA, 20 bp, Homo sapiens
gaaccattcccaagccatgg

SEQ ID NO: 4186988 - DNA, 16 bp, Homo sapiens
gaacccagagtcagga

SEQ ID NO: 4186989 - DNA, 14 bp, Homo sapiens
gaacccagctctca

SEQ ID NO: 4186990 - DNA, 18 bp, Homo sapiens
gaacccagctctcagggc

SEQ ID NO: 4186991 - DNA, 19 bp, Homo sapiens
gaacccctgtgtccctttt

SEQ ID NO: 4186992 - DNA, 19 bp, Homo sapiens
gaacctaattcaattcaaa

SEQ ID NO: 4186993 - DNA, 11 bp, Homo sapiens
gaacctcaggc

SEQ ID NO: 4186994 - DNA, 15 bp, Homo sapiens
gaacctgatgagcaa

SEQ ID NO: 4186995 - DNA, 20 bp, Homo sapiens
gaacgcaacttaggatggct

SEQ ID NO: 4186996 - DNA, 15 bp, Homo sapiens
gaacgttgccacacc

SEQ ID NO: 4186997 - DNA, 23 bp, Homo sapiens
gaactaggtttaaaacagcctgg

SEQ ID NO: 4186998 - DNA, 19 bp, Homo sapiens
gaactggctcctttgcctc

SEQ ID NO: 4186999 - DNA, 22 bp, Homo sapiens
gaactggctcctttgcctctgc

SEQ ID NO: 4187000 - DNA, 20 bp, Homo sapiens
gaactggttcaagagacact

SEQ ID NO: 4187001 - DNA, 13 bp, Homo sapiens
gaacttctaatat

SEQ ID NO: 4187002 - DNA, 14 bp, Homo sapiens
gaacttgaggacac

SEQ ID NO: 4187003 - DNA, 15 bp, Homo sapiens
gaacttgaggacaca

SEQ ID NO: 4187004 - DNA, 21 bp, Homo sapiens
gaactttctcttcatactttt

SEQ ID NO: 4187005 - DNA, 13 bp, Homo sapiens
gaagaaaaagaag

SEQ ID NO: 4187006 - DNA, 13 bp, Homo sapiens
gaagaaaagcact

SEQ ID NO: 4187007 - DNA, 19 bp, Homo sapiens
gaagaaagaacggaagaag

SEQ ID NO: 4187008 - DNA, 23 bp, Homo sapiens
gaagaagaggaggaagactctgg

SEQ ID NO: 4187009 - DNA, 19 bp, Homo sapiens
gaagaagtttcatcatttt

SEQ ID NO: 4187010 - DNA, 18 bp, Homo sapiens
gaagaatgggctgcagaa

SEQ ID NO: 4187011 - DNA, 17 bp, Homo sapiens
gaagacagaagtttgca

SEQ ID NO: 4187012 - DNA, 14 bp, Homo sapiens
gaagaccacatcca

SEQ ID NO: 4187013 - DNA, 20 bp, Homo sapiens
gaagaccacatccacacacg

SEQ ID NO: 4187014 - DNA, 21 bp, Homo sapiens
gaagaccacatccacacacgc

SEQ ID NO: 4187015 - DNA, 15 bp, Homo sapiens
gaagactctggagcc

SEQ ID NO: 4187016 - DNA, 16 bp, Homo sapiens
gaagactctggagcca

SEQ ID NO: 4187017 - DNA, 23 bp, Homo sapiens
gaagactctggagccaaggcaga

SEQ ID NO: 4187018 - DNA, 12 bp, Homo sapiens
gaagagaaattt

SEQ ID NO: 4187019 - DNA, 14 bp, Homo sapiens
gaagagaaggagca

SEQ ID NO: 4187020 - DNA, 18 bp, Homo sapiens
gaagagacaggagggcaa

SEQ ID NO: 4187021 - DNA, 15 bp, Homo sapiens
gaagagaccacagca

SEQ ID NO: 4187022 - DNA, 15 bp, Homo sapiens
gaagaggagggacct

SEQ ID NO: 4187023 - DNA, 16 bp, Homo sapiens
gaagataattttatgt

SEQ ID NO: 4187024 - DNA, 13 bp, Homo sapiens
gaagatgaaagag

SEQ ID NO: 4187025 - DNA, 17 bp, Homo sapiens
gaagatgaaagaggagg

SEQ ID NO: 4187026 - DNA, 11 bp, Homo sapiens
gaagattaaaa

SEQ ID NO: 4187027 - DNA, 21 bp, Homo sapiens
gaagattaaaaccacagaaca

SEQ ID NO: 4187028 - DNA, 20 bp, Homo sapiens
gaagcaacctcagtaattta

SEQ ID NO: 4187029 - DNA, 22 bp, Homo sapiens
gaagcaactccgtgtgcctggg

SEQ ID NO: 4187030 - DNA, 14 bp, Homo sapiens
gaagcaagcagggg

SEQ ID NO: 4187031 - DNA, 15 bp, Homo sapiens
gaagcaagcaggggt

SEQ ID NO: 4187032 - DNA, 22 bp, Homo sapiens
gaagcacactgcagggctgctg

SEQ ID NO: 4187033 - DNA, 23 bp, Homo sapiens
gaagcacactgcagggctgctgt

SEQ ID NO: 4187034 - DNA, 23 bp, Homo sapiens
gaagcaggttgaggggctcctgg

SEQ ID NO: 4187035 - DNA, 15 bp, Homo sapiens
gaagccactgaagct

SEQ ID NO: 4187036 - DNA, 12 bp, Homo sapiens
gaagcctgaggc

SEQ ID NO: 4187037 - DNA, 20 bp, Homo sapiens
gaagcctgttttgttggaag

SEQ ID NO: 4187038 - DNA, 15 bp, Homo sapiens
gaagcgggtggtggc

SEQ ID NO: 4187039 - DNA, 15 bp, Homo sapiens
gaagctttgaaggcc

SEQ ID NO: 4187040 - DNA, 14 bp, Homo sapiens
gaagctttggccct

SEQ ID NO: 4187041 - DNA, 14 bp, Homo sapiens
gaagctttggtgag

SEQ ID NO: 4187042 - DNA, 20 bp, Homo sapiens
gaagctttggtgagaacctg

SEQ ID NO: 4187043 - DNA, 15 bp, Homo sapiens
gaaggaactctggct

SEQ ID NO: 4187044 - DNA, 23 bp, Homo sapiens
gaaggaactctggcttccaggta

SEQ ID NO: 4187045 - DNA, 18 bp, Homo sapiens
gaaggaaggcagggagga

SEQ ID NO: 4187046 - DNA, 20 bp, Homo sapiens
gaaggaaggcagggaggagg

SEQ ID NO: 4187047 - DNA, 22 bp, Homo sapiens
gaaggaaggctccatctccagt

SEQ ID NO: 4187048 - DNA, 15 bp, Homo sapiens
gaaggaggtgaggga

SEQ ID NO: 4187049 - DNA, 15 bp, Homo sapiens
gaaggatagcctcag

SEQ ID NO: 4187050 - DNA, 19 bp, Homo sapiens
gaaggatagcctcagccac

SEQ ID NO: 4187051 - DNA, 16 bp, Homo sapiens
gaaggctggctgggca

SEQ ID NO: 4187052 - DNA, 19 bp, Homo sapiens
gaaggcttgttgtgctttt

SEQ ID NO: 4187053 - DNA, 17 bp, Homo sapiens
gaagggaccttgaaggg

SEQ ID NO: 4187054 - DNA, 19 bp, Homo sapiens
gaagggcatccttctgcct

SEQ ID NO: 4187055 - DNA, 19 bp, Homo sapiens
gaaggggacgcgggctgtg

SEQ ID NO: 4187056 - DNA, 20 bp, Homo sapiens
gaaggggacgcgggctgtgc

SEQ ID NO: 4187057 - DNA, 18 bp, Homo sapiens
gaagggggtccacccagc

SEQ ID NO: 4187058 - DNA, 22 bp, Homo sapiens
gaagggtggtctgagcaccccc

SEQ ID NO: 4187059 - DNA, 18 bp, Homo sapiens
gaagggttggtgggctgg

SEQ ID NO: 4187060 - DNA, 21 bp, Homo sapiens
gaagggttggtgggctggccc

SEQ ID NO: 4187061 - DNA, 22 bp, Homo sapiens
gaagggttggtgggctggccca

SEQ ID NO: 4187062 - DNA, 23 bp, Homo sapiens
gaagggttggtgggctggcccag

SEQ ID NO: 4187063 - DNA, 19 bp, Homo sapiens
gaaggtatacctgggaaga

SEQ ID NO: 4187064 - DNA, 21 bp, Homo sapiens
gaaggtcactcttcctgcaag

SEQ ID NO: 4187065 - DNA, 20 bp, Homo sapiens
gaaggtttggtgtgtggaga

SEQ ID NO: 4187066 - DNA, 18 bp, Homo sapiens
gaagtaggaaggaaaaaa

SEQ ID NO: 4187067 - DNA, 19 bp, Homo sapiens
gaagtagtttgtataactt

SEQ ID NO: 4187068 - DNA, 13 bp, Homo sapiens
gaagtatgtgtgg

SEQ ID NO: 4187069 - DNA, 11 bp, Homo sapiens
gaagtatttta

SEQ ID NO: 4187070 - DNA, 19 bp, Homo sapiens
gaagtcaaaccttaagata

SEQ ID NO: 4187071 - DNA, 17 bp, Homo sapiens
gaagtccctaggaggga

SEQ ID NO: 4187072 - DNA, 21 bp, Homo sapiens
gaagtgaccaaattgggagat

SEQ ID NO: 4187073 - DNA, 19 bp, Homo sapiens
gaagttagctttaacttaa

SEQ ID NO: 4187074 - DNA, 13 bp, Homo sapiens
gaagttttcagga

SEQ ID NO: 4187075 - DNA, 13 bp, Homo sapiens
gaataaagcaggg

SEQ ID NO: 4187076 - DNA, 12 bp, Homo sapiens
gaataaatgttc

SEQ ID NO: 4187077 - DNA, 13 bp, Homo sapiens
gaataaatgttca

SEQ ID NO: 4187078 - DNA, 17 bp, Homo sapiens
gaataagaaagtttcac

SEQ ID NO: 4187079 - DNA, 19 bp, Homo sapiens
gaataaggtacaagaagca

SEQ ID NO: 4187080 - DNA, 13 bp, Homo sapiens
gaataagtattct

SEQ ID NO: 4187081 - DNA, 17 bp, Homo sapiens
gaataagtattcttcat

SEQ ID NO: 4187082 - DNA, 21 bp, Homo sapiens
gaataatgccttgtatggtgt

SEQ ID NO: 4187083 - DNA, 19 bp, Homo sapiens
gaatagcgaatcatctcaa

SEQ ID NO: 4187084 - DNA, 17 bp, Homo sapiens
gaatatgactgttttta

SEQ ID NO: 4187085 - DNA, 19 bp, Homo sapiens
gaatatttcaaatgaacac

SEQ ID NO: 4187086 - DNA, 23 bp, Homo sapiens
gaatcaagagggcagcccccact

SEQ ID NO: 4187087 - DNA, 22 bp, Homo sapiens
gaatcaaggaatcctgagtctg

SEQ ID NO: 4187088 - DNA, 23 bp, Homo sapiens
gaatcactgtattttcattttaa

SEQ ID NO: 4187089 - DNA, 12 bp, Homo sapiens
gaatccctgcag

SEQ ID NO: 4187090 - DNA, 16 bp, Homo sapiens
gaatcctgctgccaga

SEQ ID NO: 4187091 - DNA, 17 bp, Homo sapiens
gaatcctgctgccagag

SEQ ID NO: 4187092 - DNA, 18 bp, Homo sapiens
gaatcctgctgccagaga

SEQ ID NO: 4187093 - DNA, 23 bp, Homo sapiens
gaatctcagttgattttctggat

SEQ ID NO: 4187094 - DNA, 22 bp, Homo sapiens
gaatcttaaggtgtagccacac

SEQ ID NO: 4187095 - DNA, 15 bp, Homo sapiens
gaatgaaaactcatt

SEQ ID NO: 4187096 - DNA, 15 bp, Homo sapiens
gaatgacctgcagtc

SEQ ID NO: 4187097 - DNA, 16 bp, Homo sapiens
gaatgatttttgctat

SEQ ID NO: 4187098 - DNA, 20 bp, Homo sapiens
gaatgccttccgggccgggc

SEQ ID NO: 4187099 - DNA, 17 bp, Homo sapiens
gaatggggatccagtta

SEQ ID NO: 4187100 - DNA, 15 bp, Homo sapiens
gaatggtcagttgta

SEQ ID NO: 4187101 - DNA, 13 bp, Homo sapiens
gaatggtccaggg

SEQ ID NO: 4187102 - DNA, 19 bp, Homo sapiens
gaatgtgataaggaaatca

SEQ ID NO: 4187103 - DNA, 15 bp, Homo sapiens
gaattaatgacagaa

SEQ ID NO: 4187104 - DNA, 21 bp, Homo sapiens
gaattatttttgagcaggagc

SEQ ID NO: 4187105 - DNA, 22 bp, Homo sapiens
gaattatttttgagcaggagca

SEQ ID NO: 4187106 - DNA, 19 bp, Homo sapiens
gaattgagtgtttaaagtt

SEQ ID NO: 4187107 - DNA, 16 bp, Homo sapiens
gaattgggaagctggg

SEQ ID NO: 4187108 - DNA, 14 bp, Homo sapiens
gaattgtatcattt

SEQ ID NO: 4187109 - DNA, 17 bp, Homo sapiens
gaattgtccatgtgctt

SEQ ID NO: 4187110 - DNA, 17 bp, Homo sapiens
gaatttattattgttct

SEQ ID NO: 4187111 - DNA, 11 bp, Homo sapiens
gaatttctgat

SEQ ID NO: 4187112 - DNA, 22 bp, Homo sapiens
gaatttgtaagtttatgtctaa

SEQ ID NO: 4187113 - DNA, 18 bp, Homo sapiens
gaatttttaaacaagtat

SEQ ID NO: 4187114 - DNA, 12 bp, Homo sapiens
gacaactggcag

SEQ ID NO: 4187115 - DNA, 15 bp, Homo sapiens
gacaactggcaggca

SEQ ID NO: 4187116 - DNA, 18 bp, Homo sapiens
gacaactggcaggcaggc

SEQ ID NO: 4187117 - DNA, 12 bp, Homo sapiens
gacaagaagctg

SEQ ID NO: 4187118 - DNA, 14 bp, Homo sapiens
gacaagtaatcact

SEQ ID NO: 4187119 - DNA, 23 bp, Homo sapiens
gacaagtaatcactaacccgttt

SEQ ID NO: 4187120 - DNA, 15 bp, Homo sapiens
gacacaaacacacac

SEQ ID NO: 4187121 - DNA, 22 bp, Homo sapiens
gacacaaggtgatttcagactg

SEQ ID NO: 4187122 - DNA, 22 bp, Homo sapiens
gacacacgtatttatatttgga

SEQ ID NO: 4187123 - DNA, 20 bp, Homo sapiens
gacacagacccacacatgtt

SEQ ID NO: 4187124 - DNA, 15 bp, Homo sapiens
gacacaggctcagca

SEQ ID NO: 4187125 - DNA, 18 bp, Homo sapiens
gacacaggctcagcatgc

SEQ ID NO: 4187126 - DNA, 21 bp, Homo sapiens
gacaccccccgccccccacct

SEQ ID NO: 4187127 - DNA, 19 bp, Homo sapiens
gacaccccttatccaggac

SEQ ID NO: 4187128 - DNA, 21 bp, Homo sapiens
gacaccccttatccaggactc

SEQ ID NO: 4187129 - DNA, 14 bp, Homo sapiens
gacacctgccctgc

SEQ ID NO: 4187130 - DNA, 18 bp, Homo sapiens
gacactagttcagaggaa

SEQ ID NO: 4187131 - DNA, 22 bp, Homo sapiens
gacactagttcagaggaagcac

SEQ ID NO: 4187132 - DNA, 12 bp, Homo sapiens
gacactgggaga

SEQ ID NO: 4187133 - DNA, 15 bp, Homo sapiens
gacagaagtttgcac

SEQ ID NO: 4187134 - DNA, 19 bp, Homo sapiens
gacagaccccttggctttt

SEQ ID NO: 4187135 - DNA, 16 bp, Homo sapiens
gacagatgaggctttc

SEQ ID NO: 4187136 - DNA, 12 bp, Homo sapiens
gacagcaggtgg

SEQ ID NO: 4187137 - DNA, 10 bp, Homo sapiens
gacagcccag

SEQ ID NO: 4187138 - DNA, 12 bp, Homo sapiens
gacagccctgcc

SEQ ID NO: 4187139 - DNA, 15 bp, Homo sapiens
gacagccctgcctat

SEQ ID NO: 4187140 - DNA, 17 bp, Homo sapiens
gacagccctgcctatcc

SEQ ID NO: 4187141 - DNA, 21 bp, Homo sapiens
gacagccctgcctatcctctg

SEQ ID NO: 4187142 - DNA, 23 bp, Homo sapiens
gacaggacagtgcttcagcctga

SEQ ID NO: 4187143 - DNA, 21 bp, Homo sapiens
gacaggaggggcccacaatgg

SEQ ID NO: 4187144 - DNA, 18 bp, Homo sapiens
gacaggatgtgtttgctt

SEQ ID NO: 4187145 - DNA, 18 bp, Homo sapiens
gacaggtaagtggcagga

SEQ ID NO: 4187146 - DNA, 13 bp, Homo sapiens
gacagtcctggga

SEQ ID NO: 4187147 - DNA, 23 bp, Homo sapiens
gacagtcctgggagaacctcagg

SEQ ID NO: 4187148 - DNA, 17 bp, Homo sapiens
gacagtgctgccctgcg

SEQ ID NO: 4187149 - DNA, 18 bp, Homo sapiens
gacatggaagattagagg

SEQ ID NO: 4187150 - DNA, 20 bp, Homo sapiens
gacatggaagattagaggtt

SEQ ID NO: 4187151 - DNA, 13 bp, Homo sapiens
gacatggaaggtt

SEQ ID NO: 4187152 - DNA, 18 bp, Homo sapiens
gacatgtttttgttttct

SEQ ID NO: 4187153 - DNA, 22 bp, Homo sapiens
gacatttctctaactcctgcca

SEQ ID NO: 4187154 - DNA, 14 bp, Homo sapiens
gaccactggccctg

SEQ ID NO: 4187155 - DNA, 14 bp, Homo sapiens
gaccaggactatag

SEQ ID NO: 4187156 - DNA, 22 bp, Homo sapiens
gaccaggggtgatttcagagag

SEQ ID NO: 4187157 - DNA, 16 bp, Homo sapiens
gaccataacagccaac

SEQ ID NO: 4187158 - DNA, 19 bp, Homo sapiens
gaccataacagccaacagg

SEQ ID NO: 4187159 - DNA, 17 bp, Homo sapiens
gaccatcgtccagccct

SEQ ID NO: 4187160 - DNA, 18 bp, Homo sapiens
gaccatcgtccagccctc

SEQ ID NO: 4187161 - DNA, 19 bp, Homo sapiens
gaccatcgtccagccctcc

SEQ ID NO: 4187162 - DNA, 20 bp, Homo sapiens
gaccatcgtccagccctcct

SEQ ID NO: 4187163 - DNA, 18 bp, Homo sapiens
gacccacctggagcccgc

SEQ ID NO: 4187164 - DNA, 15 bp, Homo sapiens
gacccagctcctctg

SEQ ID NO: 4187165 - DNA, 22 bp, Homo sapiens
gacccagtgagattacagagga

SEQ ID NO: 4187166 - DNA, 20 bp, Homo sapiens
gacccatttaatttctattg

SEQ ID NO: 4187167 - DNA, 18 bp, Homo sapiens
gaccccaaagagcctgga

SEQ ID NO: 4187168 - DNA, 20 bp, Homo sapiens
gaccccaaagagcctggaga

SEQ ID NO: 4187169 - DNA, 23 bp, Homo sapiens
gaccccaaagagcctggagaagc

SEQ ID NO: 4187170 - DNA, 14 bp, Homo sapiens
gaccccatctcatt

SEQ ID NO: 4187171 - DNA, 17 bp, Homo sapiens
gaccccttcctttcctc

SEQ ID NO: 4187172 - DNA, 18 bp, Homo sapiens
gaccccttcctttcctct

SEQ ID NO: 4187173 - DNA, 12 bp, Homo sapiens
gaccccttggct

SEQ ID NO: 4187174 - DNA, 12 bp, Homo sapiens
gacccctttccc

SEQ ID NO: 4187175 - DNA, 18 bp, Homo sapiens
gaccctaagaccggcggc

SEQ ID NO: 4187176 - DNA, 22 bp, Homo sapiens
gaccctccaccgcagaaggaag

SEQ ID NO: 4187177 - DNA, 21 bp, Homo sapiens
gaccctcctccactccacctc

SEQ ID NO: 4187178 - DNA, 20 bp, Homo sapiens
gaccctgcgaaggggccctg

SEQ ID NO: 4187179 - DNA, 20 bp, Homo sapiens
gaccgcgtagagagccgggc

SEQ ID NO: 4187180 - DNA, 17 bp, Homo sapiens
gaccgcttcccagaggc

SEQ ID NO: 4187181 - DNA, 15 bp, Homo sapiens
gacctactgaaccca

SEQ ID NO: 4187182 - DNA, 22 bp, Homo sapiens
gacctataaaacaaagtctggg

SEQ ID NO: 4187183 - DNA, 20 bp, Homo sapiens
gacctgaatgacctgcagtc

SEQ ID NO: 4187184 - DNA, 18 bp, Homo sapiens
gacctgaggctcctgtgc

SEQ ID NO: 4187185 - DNA, 16 bp, Homo sapiens
gacctgcagtcagggc

SEQ ID NO: 4187186 - DNA, 17 bp, Homo sapiens
gacctgggcccacagag

SEQ ID NO: 4187187 - DNA, 18 bp, Homo sapiens
gacctgggcccacagagc

SEQ ID NO: 4187188 - DNA, 21 bp, Homo sapiens
gacctgggcccacagagcctg

SEQ ID NO: 4187189 - DNA, 22 bp, Homo sapiens
gacctgggcccacagagcctgg

SEQ ID NO: 4187190 - DNA, 23 bp, Homo sapiens
gacctgggcccacagagcctggc

SEQ ID NO: 4187191 - DNA, 17 bp, Homo sapiens
gacctttcagctgtgaa

SEQ ID NO: 4187192 - DNA, 15 bp, Homo sapiens
gacgaacggaagggt

SEQ ID NO: 4187193 - DNA, 23 bp, Homo sapiens
gacgatgccgtgtgtctcgtctc

SEQ ID NO: 4187194 - DNA, 14 bp, Homo sapiens
gacgccgagggcag

SEQ ID NO: 4187195 - DNA, 17 bp, Homo sapiens
gacggctggacctgcac

SEQ ID NO: 4187196 - DNA, 14 bp, Homo sapiens
gacgtcaagtctcc

SEQ ID NO: 4187197 - DNA, 17 bp, Homo sapiens
gacgttggttctgcact

SEQ ID NO: 4187198 - DNA, 20 bp, Homo sapiens
gactaatggcatgagaaata

SEQ ID NO: 4187199 - DNA, 16 bp, Homo sapiens
gactattttttaataa

SEQ ID NO: 4187200 - DNA, 18 bp, Homo sapiens
gactattttttaataaaa

SEQ ID NO: 4187201 - DNA, 15 bp, Homo sapiens
gactcaggagcctcc

SEQ ID NO: 4187202 - DNA, 15 bp, Homo sapiens
gactcatcttttgaa

SEQ ID NO: 4187203 - DNA, 13 bp, Homo sapiens
gactctaagctgt

SEQ ID NO: 4187204 - DNA, 19 bp, Homo sapiens
gactctaagctgtgtgcag

SEQ ID NO: 4187205 - DNA, 21 bp, Homo sapiens
gactctatactaccctgggct

SEQ ID NO: 4187206 - DNA, 12 bp, Homo sapiens
gactctctgtga

SEQ ID NO: 4187207 - DNA, 22 bp, Homo sapiens
gactctgaggctctttctgggc

SEQ ID NO: 4187208 - DNA, 21 bp, Homo sapiens
gactctgccttttttcacagc

SEQ ID NO: 4187209 - DNA, 14 bp, Homo sapiens
gactctggagccaa

SEQ ID NO: 4187210 - DNA, 20 bp, Homo sapiens
gactctgggtccctcggagc

SEQ ID NO: 4187211 - DNA, 22 bp, Homo sapiens
gactctgtcaatttccctgact

SEQ ID NO: 4187212 - DNA, 12 bp, Homo sapiens
gactcttcctgc

SEQ ID NO: 4187213 - DNA, 14 bp, Homo sapiens
gactgagcacctgc

SEQ ID NO: 4187214 - DNA, 22 bp, Homo sapiens
gactgagtcctcgtagccatct

SEQ ID NO: 4187215 - DNA, 24 bp, Homo sapiens
gactgcacacagctaggcatgcct

SEQ ID NO: 4187216 - DNA, 20 bp, Homo sapiens
gactgcgatcttcagagcag

SEQ ID NO: 4187217 - DNA, 21 bp, Homo sapiens
gactgcgggatggtcctgggg

SEQ ID NO: 4187218 - DNA, 14 bp, Homo sapiens
gactgctacctctg

SEQ ID NO: 4187219 - DNA, 21 bp, Homo sapiens
gactgctacctctgagaagac

SEQ ID NO: 4187220 - DNA, 12 bp, Homo sapiens
gactgctgggac

SEQ ID NO: 4187221 - DNA, 14 bp, Homo sapiens
gactgctgggactg

SEQ ID NO: 4187222 - DNA, 16 bp, Homo sapiens
gactggctggctgcag

SEQ ID NO: 4187223 - DNA, 22 bp, Homo sapiens
gactgggggcacctgaccagaa

SEQ ID NO: 4187224 - DNA, 22 bp, Homo sapiens
gactggtgctataggctggaga

SEQ ID NO: 4187225 - DNA, 21 bp, Homo sapiens
gactgttcttggtaactgatt

SEQ ID NO: 4187226 - DNA, 19 bp, Homo sapiens
gactgtttttatatgcaca

SEQ ID NO: 4187227 - DNA, 15 bp, Homo sapiens
gacttactgtttctt

SEQ ID NO: 4187228 - DNA, 22 bp, Homo sapiens
gacttactgtttcttaccttaa

SEQ ID NO: 4187229 - DNA, 22 bp, Homo sapiens
gacttcctggtgaggcccagcc

SEQ ID NO: 4187230 - DNA, 23 bp, Homo sapiens
gacttcctggtgaggcccagcct

SEQ ID NO: 4187231 - DNA, 14 bp, Homo sapiens
gacttgaataaagt

SEQ ID NO: 4187232 - DNA, 17 bp, Homo sapiens
gacttggcaacagaagc

SEQ ID NO: 4187233 - DNA, 17 bp, Homo sapiens
gagaaaaactttcattt

SEQ ID NO: 4187234 - DNA, 13 bp, Homo sapiens
gagaaatgtttaa

SEQ ID NO: 4187235 - DNA, 14 bp, Homo sapiens
gagaaattctgtgg

SEQ ID NO: 4187236 - DNA, 13 bp, Homo sapiens
gagaaatttttat

SEQ ID NO: 4187237 - DNA, 19 bp, Homo sapiens
gagaaatttttatttttga

SEQ ID NO: 4187238 - DNA, 14 bp, Homo sapiens
gagaacctcaggct

SEQ ID NO: 4187239 - DNA, 21 bp, Homo sapiens
gagaacctgggttgcagacag

SEQ ID NO: 4187240 - DNA, 21 bp, Homo sapiens
gagaagaaagaacggaagaag

SEQ ID NO: 4187241 - DNA, 17 bp, Homo sapiens
gagaagagaacctcaaa

SEQ ID NO: 4187242 - DNA, 21 bp, Homo sapiens
gagaagaggctggtgctgtgg

SEQ ID NO: 4187243 - DNA, 13 bp, Homo sapiens
gagaaggaacagg

SEQ ID NO: 4187244 - DNA, 19 bp, Homo sapiens
gagaagggggattggaggg

SEQ ID NO: 4187245 - DNA, 21 bp, Homo sapiens
gagaagggggattggagggaa

SEQ ID NO: 4187246 - DNA, 19 bp, Homo sapiens
gagaaggtattagcaaagc

SEQ ID NO: 4187247 - DNA, 17 bp, Homo sapiens
gagaaggttggaggtgg

SEQ ID NO: 4187248 - DNA, 21 bp, Homo sapiens
gagaagtttctggccctggct

SEQ ID NO: 4187249 - DNA, 16 bp, Homo sapiens
gagaagttttgttttt

SEQ ID NO: 4187250 - DNA, 21 bp, Homo sapiens
gagaattgtatcatttgaaca

SEQ ID NO: 4187251 - DNA, 9 bp, Homo sapiens
gagacagag

SEQ ID NO: 4187252 - DNA, 17 bp, Homo sapiens
gagacagccctgcctat

SEQ ID NO: 4187253 - DNA, 12 bp, Homo sapiens
gagacaggaagg

SEQ ID NO: 4187254 - DNA, 15 bp, Homo sapiens
gagacaggagggcaa

SEQ ID NO: 4187255 - DNA, 23 bp, Homo sapiens
gagaccacagcaattggctcctc

SEQ ID NO: 4187256 - DNA, 12 bp, Homo sapiens
gagaccacctct

SEQ ID NO: 4187257 - DNA, 11 bp, Homo sapiens
gagaccagcac

SEQ ID NO: 4187258 - DNA, 14 bp, Homo sapiens
gagaccagcctggc

SEQ ID NO: 4187259 - DNA, 14 bp, Homo sapiens
gagaccccttcctt

SEQ ID NO: 4187260 - DNA, 20 bp, Homo sapiens
gagaccccttcctttcctct

SEQ ID NO: 4187261 - DNA, 22 bp, Homo sapiens
gagacggagaccccggtggcag

SEQ ID NO: 4187262 - DNA, 14 bp, Homo sapiens
gagacggctggacc

SEQ ID NO: 4187263 - DNA, 16 bp, Homo sapiens
gagacggctggacctg

SEQ ID NO: 4187264 - DNA, 12 bp, Homo sapiens
gagactctggcc

SEQ ID NO: 4187265 - DNA, 13 bp, Homo sapiens
gagactctggcct

SEQ ID NO: 4187266 - DNA, 16 bp, Homo sapiens
gagactggtcctgtgt

SEQ ID NO: 4187267 - DNA, 23 bp, Homo sapiens
gagactggtcctgtgtgcagtga

SEQ ID NO: 4187268 - DNA, 22 bp, Homo sapiens
gagacttttaatcagacaaagt

SEQ ID NO: 4187269 - DNA, 15 bp, Homo sapiens
gagagaaccaggagg

SEQ ID NO: 4187270 - DNA, 16 bp, Homo sapiens
gagagacgtgtacata

SEQ ID NO: 4187271 - DNA, 20 bp, Homo sapiens
gagagacgtgtacatagtgt

SEQ ID NO: 4187272 - DNA, 19 bp, Homo sapiens
gagagagttgctggctatt

SEQ ID NO: 4187273 - DNA, 18 bp, Homo sapiens
gagagcaaacataggaat

SEQ ID NO: 4187274 - DNA, 10 bp, Homo sapiens
gagagcagct

SEQ ID NO: 4187275 - DNA, 11 bp, Homo sapiens
gagagcagctg

SEQ ID NO: 4187276 - DNA, 12 bp, Homo sapiens
gagagcctggca

SEQ ID NO: 4187277 - DNA, 16 bp, Homo sapiens
gagagcctggcaaggc

SEQ ID NO: 4187278 - DNA, 18 bp, Homo sapiens
gagagcgcctcttcctct

SEQ ID NO: 4187279 - DNA, 21 bp, Homo sapiens
gagagcgggtgggtgggtgtg

SEQ ID NO: 4187280 - DNA, 17 bp, Homo sapiens
gagaggaaaagctgcct

SEQ ID NO: 4187281 - DNA, 20 bp, Homo sapiens
gagaggaaaagctgcctctg

SEQ ID NO: 4187282 - DNA, 16 bp, Homo sapiens
gagaggatgcagaggg

SEQ ID NO: 4187283 - DNA, 16 bp, Homo sapiens
gagaggcacctgctgg

SEQ ID NO: 4187284 - DNA, 14 bp, Homo sapiens
gagagggcagaggg

SEQ ID NO: 4187285 - DNA, 22 bp, Homo sapiens
gagaggtttgtcaacacaaaga

SEQ ID NO: 4187286 - DNA, 19 bp, Homo sapiens
gagagtacagtgagccaag

SEQ ID NO: 4187287 - DNA, 21 bp, Homo sapiens
gagagtcctttgggattctag

SEQ ID NO: 4187288 - DNA, 16 bp, Homo sapiens
gagatacatacagaat

SEQ ID NO: 4187289 - DNA, 16 bp, Homo sapiens
gagatagcagaggaaa

SEQ ID NO: 4187290 - DNA, 16 bp, Homo sapiens
gagatatgcagaagga

SEQ ID NO: 4187291 - DNA, 13 bp, Homo sapiens
gagatccagcaca

SEQ ID NO: 4187292 - DNA, 17 bp, Homo sapiens
gagatctccctccaggg

SEQ ID NO: 4187293 - DNA, 15 bp, Homo sapiens
gagatgatgatgatg

SEQ ID NO: 4187294 - DNA, 14 bp, Homo sapiens
gagatgcagaggta

SEQ ID NO: 4187295 - DNA, 17 bp, Homo sapiens
gagatgcatgcgcaggc

SEQ ID NO: 4187296 - DNA, 19 bp, Homo sapiens
gagatgctggcttgggcag

SEQ ID NO: 4187297 - DNA, 14 bp, Homo sapiens
gagatgtaattgtt

SEQ ID NO: 4187298 - DNA, 15 bp, Homo sapiens
gagattaattttaac

SEQ ID NO: 4187299 - DNA, 22 bp, Homo sapiens
gagatttaacactaaaattcca

SEQ ID NO: 4187300 - DNA, 21 bp, Homo sapiens
gagcaaacaccagtgaggctc

SEQ ID NO: 4187301 - DNA, 16 bp, Homo sapiens
gagcaaacataggaat

SEQ ID NO: 4187302 - DNA, 19 bp, Homo sapiens
gagcaaagtctaaagttta

SEQ ID NO: 4187303 - DNA, 20 bp, Homo sapiens
gagcaacagagtgagaccct

SEQ ID NO: 4187304 - DNA, 14 bp, Homo sapiens
gagcaacctcttca

SEQ ID NO: 4187305 - DNA, 12 bp, Homo sapiens
gagcaagagctg

SEQ ID NO: 4187306 - DNA, 20 bp, Homo sapiens
gagcaaggacaacctgcccc

SEQ ID NO: 4187307 - DNA, 20 bp, Homo sapiens
gagcacagaggggctagggg

SEQ ID NO: 4187308 - DNA, 13 bp, Homo sapiens
gagcactgctcca

SEQ ID NO: 4187309 - DNA, 20 bp, Homo sapiens
gagcagagctgatggagaag

SEQ ID NO: 4187310 - DNA, 15 bp, Homo sapiens
gagcagctggctctc

SEQ ID NO: 4187311 - DNA, 16 bp, Homo sapiens
gagcagctggctctcc

SEQ ID NO: 4187312 - DNA, 15 bp, Homo sapiens
gagcaggagcagaaa

SEQ ID NO: 4187313 - DNA, 15 bp, Homo sapiens
gagcaggccacgctc

SEQ ID NO: 4187314 - DNA, 18 bp, Homo sapiens
gagcaggctcagactctg

SEQ ID NO: 4187315 - DNA, 13 bp, Homo sapiens
gagcatcacagaa

SEQ ID NO: 4187316 - DNA, 17 bp, Homo sapiens
gagcattacgtgagcca

SEQ ID NO: 4187317 - DNA, 21 bp, Homo sapiens
gagccaagatcgcgccactgc

SEQ ID NO: 4187318 - DNA, 15 bp, Homo sapiens
gagccaatagactga

SEQ ID NO: 4187319 - DNA, 20 bp, Homo sapiens
gagccaccagggcactgtct

SEQ ID NO: 4187320 - DNA, 19 bp, Homo sapiens
gagccaccgcgcccagccc

SEQ ID NO: 4187321 - DNA, 15 bp, Homo sapiens
gagccactacctttg

SEQ ID NO: 4187322 - DNA, 15 bp, Homo sapiens
gagccaggctctgcc

SEQ ID NO: 4187323 - DNA, 12 bp, Homo sapiens
gagccatgtttc

SEQ ID NO: 4187324 - DNA, 21 bp, Homo sapiens
gagccattttggggggccccc

SEQ ID NO: 4187325 - DNA, 23 bp, Homo sapiens
gagccattttggggggcccccct

SEQ ID NO: 4187326 - DNA, 17 bp, Homo sapiens
gagccccccgtgtggct

SEQ ID NO: 4187327 - DNA, 13 bp, Homo sapiens
gagccctggcagg

SEQ ID NO: 4187328 - DNA, 23 bp, Homo sapiens
gagccctggcaggatgaccctgc

SEQ ID NO: 4187329 - DNA, 20 bp, Homo sapiens
gagccgagatcacgccactg

SEQ ID NO: 4187330 - DNA, 21 bp, Homo sapiens
gagcctagaacatccctgggc

SEQ ID NO: 4187331 - DNA, 22 bp, Homo sapiens
gagcctagaacatccctgggca

SEQ ID NO: 4187332 - DNA, 23 bp, Homo sapiens
gagcctagaacatccctgggcaa

SEQ ID NO: 4187333 - DNA, 14 bp, Homo sapiens
gagcctccacttag

SEQ ID NO: 4187334 - DNA, 16 bp, Homo sapiens
gagcctcctagggctt

SEQ ID NO: 4187335 - DNA, 13 bp, Homo sapiens
gagcctgcctcct

SEQ ID NO: 4187336 - DNA, 12 bp, Homo sapiens
gagcctggagaa

SEQ ID NO: 4187337 - DNA, 13 bp, Homo sapiens
gagcctggagaag

SEQ ID NO: 4187338 - DNA, 14 bp, Homo sapiens
gagcctggagaagc

SEQ ID NO: 4187339 - DNA, 12 bp, Homo sapiens
gagcctggcaag

SEQ ID NO: 4187340 - DNA, 11 bp, Homo sapiens
gagcctggctt

SEQ ID NO: 4187341 - DNA, 13 bp, Homo sapiens
gagccttcaagtg

SEQ ID NO: 4187342 - DNA, 17 bp, Homo sapiens
gagcctttggatgacca

SEQ ID NO: 4187343 - DNA, 18 bp, Homo sapiens
gagcgcacctgccccctg

SEQ ID NO: 4187344 - DNA, 20 bp, Homo sapiens
gagcgcacctgccccctggt

SEQ ID NO: 4187345 - DNA, 13 bp, Homo sapiens
gagcgcctcttcc

SEQ ID NO: 4187346 - DNA, 17 bp, Homo sapiens
gagcgcctcttcctctg

SEQ ID NO: 4187347 - DNA, 15 bp, Homo sapiens
gagcggagcttgcct

SEQ ID NO: 4187348 - DNA, 19 bp, Homo sapiens
gagcggagcttgcctgcct

SEQ ID NO: 4187349 - DNA, 15 bp, Homo sapiens
gagctactctcttgc

SEQ ID NO: 4187350 - DNA, 20 bp, Homo sapiens
gagctactctcttgccagca

SEQ ID NO: 4187351 - DNA, 14 bp, Homo sapiens
gagctgaccagccg

SEQ ID NO: 4187352 - DNA, 14 bp, Homo sapiens
gagctgctctgcta

SEQ ID NO: 4187353 - DNA, 23 bp, Homo sapiens
gagctgctggctgacctgggccc

SEQ ID NO: 4187354 - DNA, 17 bp, Homo sapiens
gagctggaaataaacct

SEQ ID NO: 4187355 - DNA, 20 bp, Homo sapiens
gagctggcaaaggtggctct

SEQ ID NO: 4187356 - DNA, 20 bp, Homo sapiens
gagctggcattggtctgctg

SEQ ID NO: 4187357 - DNA, 16 bp, Homo sapiens
gagctggctgtcttcc

SEQ ID NO: 4187358 - DNA, 19 bp, Homo sapiens
gagctggggctgccagcct

SEQ ID NO: 4187359 - DNA, 19 bp, Homo sapiens
gagctgttggggcaggggt

SEQ ID NO: 4187360 - DNA, 16 bp, Homo sapiens
gagcttgcctgcctgc

SEQ ID NO: 4187361 - DNA, 16 bp, Homo sapiens
gagcttggtggctgag

SEQ ID NO: 4187362 - DNA, 14 bp, Homo sapiens
gaggaaagacacag

SEQ ID NO: 4187363 - DNA, 15 bp, Homo sapiens
gaggaaagacacaga

SEQ ID NO: 4187364 - DNA, 13 bp, Homo sapiens
gaggaagactctg

SEQ ID NO: 4187365 - DNA, 18 bp, Homo sapiens
gaggaatatgactgtttt

SEQ ID NO: 4187366 - DNA, 19 bp, Homo sapiens
gaggaatatgactgttttt

SEQ ID NO: 4187367 - DNA, 23 bp, Homo sapiens
gaggactgatgaatgacaacatt

SEQ ID NO: 4187368 - DNA, 20 bp, Homo sapiens
gaggaggcagagaagaaaga

SEQ ID NO: 4187369 - DNA, 15 bp, Homo sapiens
gaggaggtggcagcc

SEQ ID NO: 4187370 - DNA, 20 bp, Homo sapiens
gaggaggtggcagccctgta

SEQ ID NO: 4187371 - DNA, 22 bp, Homo sapiens
gaggaggtggcagccctgtagg

SEQ ID NO: 4187372 - DNA, 17 bp, Homo sapiens
gaggatcactggagccc

SEQ ID NO: 4187373 - DNA, 22 bp, Homo sapiens
gaggatcacttgggcccaggag

SEQ ID NO: 4187374 - DNA, 23 bp, Homo sapiens
gaggatcacttgggcccaggagg

SEQ ID NO: 4187375 - DNA, 14 bp, Homo sapiens
gaggatgcagaggg

SEQ ID NO: 4187376 - DNA, 18 bp, Homo sapiens
gaggatttaactgtgaac

SEQ ID NO: 4187377 - DNA, 22 bp, Homo sapiens
gaggattttccagttctgacac

SEQ ID NO: 4187378 - DNA, 13 bp, Homo sapiens
gaggattttgagt

SEQ ID NO: 4187379 - DNA, 17 bp, Homo sapiens
gaggcaagagacagaat

SEQ ID NO: 4187380 - DNA, 18 bp, Homo sapiens
gaggcagagaagaaagaa

SEQ ID NO: 4187381 - DNA, 23 bp, Homo sapiens
gaggcagcgtgaaagcagatgag

SEQ ID NO: 4187382 - DNA, 13 bp, Homo sapiens
gaggcagtaggaa

SEQ ID NO: 4187383 - DNA, 21 bp, Homo sapiens
gaggcagtgctgatccggctg

SEQ ID NO: 4187384 - DNA, 14 bp, Homo sapiens
gaggcatagaggga

SEQ ID NO: 4187385 - DNA, 20 bp, Homo sapiens
gaggcatagagggagaggaa

SEQ ID NO: 4187386 - DNA, 23 bp, Homo sapiens
gaggcatagagggagaggaagca

SEQ ID NO: 4187387 - DNA, 18 bp, Homo sapiens
gaggccaggaatctgcca

SEQ ID NO: 4187388 - DNA, 14 bp, Homo sapiens
gaggcccagcctgt

SEQ ID NO: 4187389 - DNA, 19 bp, Homo sapiens
gaggcctcgtaccagccag

SEQ ID NO: 4187390 - DNA, 20 bp, Homo sapiens
gaggcctcgtaccagccagg

SEQ ID NO: 4187391 - DNA, 14 bp, Homo sapiens
gaggcgaataaatg

SEQ ID NO: 4187392 - DNA, 14 bp, Homo sapiens
gaggcgcgtctgcc

SEQ ID NO: 4187393 - DNA, 16 bp, Homo sapiens
gaggcggctccaggtc

SEQ ID NO: 4187394 - DNA, 18 bp, Homo sapiens
gaggcggctccaggtccg

SEQ ID NO: 4187395 - DNA, 14 bp, Homo sapiens
gaggctctattgag

SEQ ID NO: 4187396 - DNA, 18 bp, Homo sapiens
gaggctcttccatcccca

SEQ ID NO: 4187397 - DNA, 16 bp, Homo sapiens
gaggctgcagcgagct

SEQ ID NO: 4187398 - DNA, 17 bp, Homo sapiens
gaggcttcttgcccaga

SEQ ID NO: 4187399 - DNA, 14 bp, Homo sapiens
gaggctttccatgg

SEQ ID NO: 4187400 - DNA, 15 bp, Homo sapiens
gagggagaggaagca

SEQ ID NO: 4187401 - DNA, 16 bp, Homo sapiens
gagggagaggaagcac

SEQ ID NO: 4187402 - DNA, 19 bp, Homo sapiens
gagggagccatcccttccc

SEQ ID NO: 4187403 - DNA, 15 bp, Homo sapiens
gagggagctgctggc

SEQ ID NO: 4187404 - DNA, 15 bp, Homo sapiens
gagggatgagagtgg

SEQ ID NO: 4187405 - DNA, 17 bp, Homo sapiens
gagggatgctgcctgag

SEQ ID NO: 4187406 - DNA, 21 bp, Homo sapiens
gagggatgtaactattgaatt

SEQ ID NO: 4187407 - DNA, 22 bp, Homo sapiens
gagggattttagcctcttccct

SEQ ID NO: 4187408 - DNA, 22 bp, Homo sapiens
gagggcaagggccatgctgaag

SEQ ID NO: 4187409 - DNA, 21 bp, Homo sapiens
gagggcaggtgccctctgctc

SEQ ID NO: 4187410 - DNA, 18 bp, Homo sapiens
gagggccaagacttggca

SEQ ID NO: 4187411 - DNA, 16 bp, Homo sapiens
gagggcccaggcaggc

SEQ ID NO: 4187412 - DNA, 15 bp, Homo sapiens
gaggggacccagctc

SEQ ID NO: 4187413 - DNA, 18 bp, Homo sapiens
gaggggatggcagacagt

SEQ ID NO: 4187414 - DNA, 14 bp, Homo sapiens
gaggggcagggaga

SEQ ID NO: 4187415 - DNA, 13 bp, Homo sapiens
gaggggctcctgg

SEQ ID NO: 4187416 - DNA, 14 bp, Homo sapiens
gaggggtaggcaga

SEQ ID NO: 4187417 - DNA, 20 bp, Homo sapiens
gaggggtgacagtggaggaa

SEQ ID NO: 4187418 - DNA, 22 bp, Homo sapiens
gagggtaacagaagaggaggga

SEQ ID NO: 4187419 - DNA, 19 bp, Homo sapiens
gagggtgggagagcccagc

SEQ ID NO: 4187420 - DNA, 22 bp, Homo sapiens
gaggtaaaagtgtgagcagtga

SEQ ID NO: 4187421 - DNA, 21 bp, Homo sapiens
gaggtagcgagctgctctgct

SEQ ID NO: 4187422 - DNA, 15 bp, Homo sapiens
gaggtggcagccctg

SEQ ID NO: 4187423 - DNA, 16 bp, Homo sapiens
gaggtggcagccctgt

SEQ ID NO: 4187424 - DNA, 19 bp, Homo sapiens
gaggttgcagggagccgag

SEQ ID NO: 4187425 - DNA, 15 bp, Homo sapiens
gaggttgcagtgagc

SEQ ID NO: 4187426 - DNA, 16 bp, Homo sapiens
gaggtttgtcaacaca

SEQ ID NO: 4187427 - DNA, 19 bp, Homo sapiens
gaggtttgtcaacacaaag

SEQ ID NO: 4187428 - DNA, 19 bp, Homo sapiens
gagtacagacgtctcaaga

SEQ ID NO: 4187429 - DNA, 18 bp, Homo sapiens
gagtagatggtgaaattt

SEQ ID NO: 4187430 - DNA, 22 bp, Homo sapiens
gagtagcaagttctagagaaga

SEQ ID NO: 4187431 - DNA, 23 bp, Homo sapiens
gagtatctcggacctttcagctg

SEQ ID NO: 4187432 - DNA, 12 bp, Homo sapiens
gagtcagccctt

SEQ ID NO: 4187433 - DNA, 13 bp, Homo sapiens
gagtcaggaagag

SEQ ID NO: 4187434 - DNA, 18 bp, Homo sapiens
gagtctacctcttcagta

SEQ ID NO: 4187435 - DNA, 22 bp, Homo sapiens
gagtggatctccaaggaccagg

SEQ ID NO: 4187436 - DNA, 20 bp, Homo sapiens
gagtgtgcgtgtgtgcatgt

SEQ ID NO: 4187437 - DNA, 18 bp, Homo sapiens
gagttacagcgagaggca

SEQ ID NO: 4187438 - DNA, 19 bp, Homo sapiens
gagttacagcgagaggcag

SEQ ID NO: 4187439 - DNA, 16 bp, Homo sapiens
gagttataaaaataca

SEQ ID NO: 4187440 - DNA, 15 bp, Homo sapiens
gagttccatgaagac

SEQ ID NO: 4187441 - DNA, 17 bp, Homo sapiens
gagttcgagaccagcct

SEQ ID NO: 4187442 - DNA, 15 bp, Homo sapiens
gagtttcgaggtaga

SEQ ID NO: 4187443 - DNA, 23 bp, Homo sapiens
gagttttcacctggtatccatta

SEQ ID NO: 4187444 - DNA, 18 bp, Homo sapiens
gagttttccatggcagga

SEQ ID NO: 4187445 - DNA, 17 bp, Homo sapiens
gataaagattttttaat

SEQ ID NO: 4187446 - DNA, 15 bp, Homo sapiens
gataacaagatcttt

SEQ ID NO: 4187447 - DNA, 17 bp, Homo sapiens
gataacccttattccat

SEQ ID NO: 4187448 - DNA, 23 bp, Homo sapiens
gataacctatatgatttatagtt

SEQ ID NO: 4187449 - DNA, 21 bp, Homo sapiens
gataactatttacatataata

SEQ ID NO: 4187450 - DNA, 13 bp, Homo sapiens
gataaggaaatca

SEQ ID NO: 4187451 - DNA, 19 bp, Homo sapiens
gataaggcagttgaacctg

SEQ ID NO: 4187452 - DNA, 17 bp, Homo sapiens
gataaggtaaaatgcca

SEQ ID NO: 4187453 - DNA, 18 bp, Homo sapiens
gataatcttcggccaatt

SEQ ID NO: 4187454 - DNA, 16 bp, Homo sapiens
gataatgataacttgt

SEQ ID NO: 4187455 - DNA, 16 bp, Homo sapiens
gataatgtcaaaatca

SEQ ID NO: 4187456 - DNA, 12 bp, Homo sapiens
gataattttaaa

SEQ ID NO: 4187457 - DNA, 15 bp, Homo sapiens
gatacgctggtctgg

SEQ ID NO: 4187458 - DNA, 20 bp, Homo sapiens
gatactaaaagttcttctcc

SEQ ID NO: 4187459 - DNA, 20 bp, Homo sapiens
gatacttaagtgctgcaatt

SEQ ID NO: 4187460 - DNA, 17 bp, Homo sapiens
gatactttaatttttat

SEQ ID NO: 4187461 - DNA, 22 bp, Homo sapiens
gatactttaatttttataaata

SEQ ID NO: 4187462 - DNA, 13 bp, Homo sapiens
gatagaaatgcca

SEQ ID NO: 4187463 - DNA, 19 bp, Homo sapiens
gatagaaatgccaagcact

SEQ ID NO: 4187464 - DNA, 19 bp, Homo sapiens
gatagacagtgctgccctg

SEQ ID NO: 4187465 - DNA, 12 bp, Homo sapiens
gatagagtgatt

SEQ ID NO: 4187466 - DNA, 17 bp, Homo sapiens
gatagcatttttgattt

SEQ ID NO: 4187467 - DNA, 23 bp, Homo sapiens
gatagcatttttgatttatgcat

SEQ ID NO: 4187468 - DNA, 15 bp, Homo sapiens
gatagcctcagccac

SEQ ID NO: 4187469 - DNA, 15 bp, Homo sapiens
gatagtatcttttaa

SEQ ID NO: 4187470 - DNA, 13 bp, Homo sapiens
gatatatatcata

SEQ ID NO: 4187471 - DNA, 22 bp, Homo sapiens
gatatatatttactaaaagaat

SEQ ID NO: 4187472 - DNA, 19 bp, Homo sapiens
gatatcaccatgatttaat

SEQ ID NO: 4187473 - DNA, 22 bp, Homo sapiens
gatatcaccatgatttaatcca

SEQ ID NO: 4187474 - DNA, 19 bp, Homo sapiens
gatatgtaaaacatttatt

SEQ ID NO: 4187475 - DNA, 13 bp, Homo sapiens
gatcaagtccaga

SEQ ID NO: 4187476 - DNA, 19 bp, Homo sapiens
gatcacagcgtttcaggaa

SEQ ID NO: 4187477 - DNA, 14 bp, Homo sapiens
gatcacctgaggtt

SEQ ID NO: 4187478 - DNA, 23 bp, Homo sapiens
gatcacgccactgcactccagcc

SEQ ID NO: 4187479 - DNA, 14 bp, Homo sapiens
gatcactggagccc

SEQ ID NO: 4187480 - DNA, 17 bp, Homo sapiens
gatcactggagcccagg

SEQ ID NO: 4187481 - DNA, 16 bp, Homo sapiens
gatcacttgggcccag

SEQ ID NO: 4187482 - DNA, 17 bp, Homo sapiens
gatcagcagtggcagga

SEQ ID NO: 4187483 - DNA, 11 bp, Homo sapiens
gatcagcctcc

SEQ ID NO: 4187484 - DNA, 21 bp, Homo sapiens
gatcagcctccgccattccaa

SEQ ID NO: 4187485 - DNA, 16 bp, Homo sapiens
gatcaggaagagaagg

SEQ ID NO: 4187486 - DNA, 17 bp, Homo sapiens
gatcaggaagagaagga

SEQ ID NO: 4187487 - DNA, 19 bp, Homo sapiens
gatcattacatggctgtgg

SEQ ID NO: 4187488 - DNA, 22 bp, Homo sapiens
gatcattacatggctgtggttc

SEQ ID NO: 4187489 - DNA, 19 bp, Homo sapiens
gatcattttagacactggg

SEQ ID NO: 4187490 - DNA, 17 bp, Homo sapiens
gatccaggattggcctg

SEQ ID NO: 4187491 - DNA, 20 bp, Homo sapiens
gatccatttggacaaaatgg

SEQ ID NO: 4187492 - DNA, 13 bp, Homo sapiens
gatccggctgctc

SEQ ID NO: 4187493 - DNA, 21 bp, Homo sapiens
gatccggctgctcctccagcc

SEQ ID NO: 4187494 - DNA, 17 bp, Homo sapiens
gatcctcaaacacacaa

SEQ ID NO: 4187495 - DNA, 23 bp, Homo sapiens
gatcgcgccactacactccagcc

SEQ ID NO: 4187496 - DNA, 16 bp, Homo sapiens
gatctccaaggaccag

SEQ ID NO: 4187497 - DNA, 12 bp, Homo sapiens
gatctctgctta

SEQ ID NO: 4187498 - DNA, 22 bp, Homo sapiens
gatctgaaattggtgggaagca

SEQ ID NO: 4187499 - DNA, 21 bp, Homo sapiens
gatctgggaggtctccactga

SEQ ID NO: 4187500 - DNA, 14 bp, Homo sapiens
gatcttcagagcag

SEQ ID NO: 4187501 - DNA, 17 bp, Homo sapiens
gatcttccgtggtcaga

SEQ ID NO: 4187502 - DNA, 15 bp, Homo sapiens
gatctttcaggaaag

SEQ ID NO: 4187503 - DNA, 15 bp, Homo sapiens
gatctttgactgaaa

SEQ ID NO: 4187504 - DNA, 16 bp, Homo sapiens
gatctttgactgaaaa

SEQ ID NO: 4187505 - DNA, 23 bp, Homo sapiens
gatgaaattttctagactttctg

SEQ ID NO: 4187506 - DNA, 18 bp, Homo sapiens
gatgaccagaacaaggtt

SEQ ID NO: 4187507 - DNA, 20 bp, Homo sapiens
gatgactcactccattccta

SEQ ID NO: 4187508 - DNA, 12 bp, Homo sapiens
gatgactgagtc

SEQ ID NO: 4187509 - DNA, 17 bp, Homo sapiens
gatgactgagtcctcgt

SEQ ID NO: 4187510 - DNA, 18 bp, Homo sapiens
gatgagagtggcttaaaa

SEQ ID NO: 4187511 - DNA, 18 bp, Homo sapiens
gatgagttaactgtgaaa

SEQ ID NO: 4187512 - DNA, 11 bp, Homo sapiens
gatgcagaggg

SEQ ID NO: 4187513 - DNA, 12 bp, Homo sapiens
gatgcagagggg

SEQ ID NO: 4187514 - DNA, 23 bp, Homo sapiens
gatgcagaggtaaaagtgtgagc

SEQ ID NO: 4187515 - DNA, 13 bp, Homo sapiens
gatgcatgcgcag

SEQ ID NO: 4187516 - DNA, 22 bp, Homo sapiens
gatgcccagagggcccaggcag

SEQ ID NO: 4187517 - DNA, 17 bp, Homo sapiens
gatgcggggcagagcca

SEQ ID NO: 4187518 - DNA, 14 bp, Homo sapiens
gatgctgcctgagt

SEQ ID NO: 4187519 - DNA, 15 bp, Homo sapiens
gatggaaagaaagca

SEQ ID NO: 4187520 - DNA, 14 bp, Homo sapiens
gatggagaaggaag

SEQ ID NO: 4187521 - DNA, 16 bp, Homo sapiens
gatggagaaggaaggc

SEQ ID NO: 4187522 - DNA, 17 bp, Homo sapiens
gatggaggccgagccaa

SEQ ID NO: 4187523 - DNA, 21 bp, Homo sapiens
gatggcaccatccaccctgca

SEQ ID NO: 4187524 - DNA, 19 bp, Homo sapiens
gatggcccagcaggcaggc

SEQ ID NO: 4187525 - DNA, 13 bp, Homo sapiens
gatgggattctgg

SEQ ID NO: 4187526 - DNA, 21 bp, Homo sapiens
gatgggtctggctgagctgaa

SEQ ID NO: 4187527 - DNA, 22 bp, Homo sapiens
gatggtatctgggtaagaagaa

SEQ ID NO: 4187528 - DNA, 16 bp, Homo sapiens
gatgtaactattgaat

SEQ ID NO: 4187529 - DNA, 23 bp, Homo sapiens
gatgtaaggtaatttctgtgtat

SEQ ID NO: 4187530 - DNA, 21 bp, Homo sapiens
gatgtcaaagtgtaacagata

SEQ ID NO: 4187531 - DNA, 12 bp, Homo sapiens
gatgtcagcctt

SEQ ID NO: 4187532 - DNA, 14 bp, Homo sapiens
gatgtgtctgggag

SEQ ID NO: 4187533 - DNA, 15 bp, Homo sapiens
gatgtgtctgggaga

SEQ ID NO: 4187534 - DNA, 22 bp, Homo sapiens
gatgtgtctgggagagcctggc

SEQ ID NO: 4187535 - DNA, 14 bp, Homo sapiens
gatgtgtttgcttt

SEQ ID NO: 4187536 - DNA, 19 bp, Homo sapiens
gatgttgttactgattctc

SEQ ID NO: 4187537 - DNA, 10 bp, Homo sapiens
gatgtttgtt

SEQ ID NO: 4187538 - DNA, 14 bp, Homo sapiens
gattaaaggaagga

SEQ ID NO: 4187539 - DNA, 15 bp, Homo sapiens
gattaaaggaaggaa

SEQ ID NO: 4187540 - DNA, 13 bp, Homo sapiens
gattaacaaataa

SEQ ID NO: 4187541 - DNA, 14 bp, Homo sapiens
gattaacaaataaa

SEQ ID NO: 4187542 - DNA, 17 bp, Homo sapiens
gattaatacaatattaa

SEQ ID NO: 4187543 - DNA, 20 bp, Homo sapiens
gattacagacatgagccacc

SEQ ID NO: 4187544 - DNA, 23 bp, Homo sapiens
gattactactttgcctcttcagc

SEQ ID NO: 4187545 - DNA, 23 bp, Homo sapiens
gattatttgttatttgtacagtt

SEQ ID NO: 4187546 - DNA, 17 bp, Homo sapiens
gattcagagacttagaa

SEQ ID NO: 4187547 - DNA, 22 bp, Homo sapiens
gattcccaccaaggtcttcagc

SEQ ID NO: 4187548 - DNA, 13 bp, Homo sapiens
gattcccctccac

SEQ ID NO: 4187549 - DNA, 16 bp, Homo sapiens
gattcctgggcaagaa

SEQ ID NO: 4187550 - DNA, 16 bp, Homo sapiens
gattctcctgtcagag

SEQ ID NO: 4187551 - DNA, 22 bp, Homo sapiens
gattctgggaggaagcaggttg

SEQ ID NO: 4187552 - DNA, 13 bp, Homo sapiens
gattgaggcctgc

SEQ ID NO: 4187553 - DNA, 22 bp, Homo sapiens
gattgaggcctgccctcaggga

SEQ ID NO: 4187554 - DNA, 19 bp, Homo sapiens
gattgtataatgtgatttt

SEQ ID NO: 4187555 - DNA, 13 bp, Homo sapiens
gatttaacaaata

SEQ ID NO: 4187556 - DNA, 16 bp, Homo sapiens
gatttaacaaatacat

SEQ ID NO: 4187557 - DNA, 17 bp, Homo sapiens
gatttaacaaatacatt

SEQ ID NO: 4187558 - DNA, 20 bp, Homo sapiens
gatttatagtttgtacatgc

SEQ ID NO: 4187559 - DNA, 12 bp, Homo sapiens
gatttatttaaa

SEQ ID NO: 4187560 - DNA, 14 bp, Homo sapiens
gatttcaacatatc

SEQ ID NO: 4187561 - DNA, 17 bp, Homo sapiens
gatttcaacatatcatt

SEQ ID NO: 4187562 - DNA, 22 bp, Homo sapiens
gatttctccaggtttgctgtgt

SEQ ID NO: 4187563 - DNA, 18 bp, Homo sapiens
gatttgaagctgtaccca

SEQ ID NO: 4187564 - DNA, 13 bp, Homo sapiens
gatttggaagaga

SEQ ID NO: 4187565 - DNA, 14 bp, Homo sapiens
gatttgtgaactgg

SEQ ID NO: 4187566 - DNA, 17 bp, Homo sapiens
gattttagcctcttccc

SEQ ID NO: 4187567 - DNA, 20 bp, Homo sapiens
gattttctgctactttgctg

SEQ ID NO: 4187568 - DNA, 14 bp, Homo sapiens
gattttgagtatct

SEQ ID NO: 4187569 - DNA, 13 bp, Homo sapiens
gattttgcctgtg

SEQ ID NO: 4187570 - DNA, 12 bp, Homo sapiens
gatttttccttt

SEQ ID NO: 4187571 - DNA, 23 bp, Homo sapiens
gattttttttttttggtaattat

SEQ ID NO: 4187572 - DNA, 14 bp, Homo sapiens
gcaaaactgtgctt

SEQ ID NO: 4187573 - DNA, 16 bp, Homo sapiens
gcaaaagaagtaaaag

SEQ ID NO: 4187574 - DNA, 20 bp, Homo sapiens
gcaaaagcaagggaccttca

SEQ ID NO: 4187575 - DNA, 17 bp, Homo sapiens
gcaaaccatttcaaatg

SEQ ID NO: 4187576 - DNA, 16 bp, Homo sapiens
gcaaagaactgcccca

SEQ ID NO: 4187577 - DNA, 21 bp, Homo sapiens
gcaaagcaccagcttctccag

SEQ ID NO: 4187578 - DNA, 12 bp, Homo sapiens
gcaaagcctcct

SEQ ID NO: 4187579 - DNA, 16 bp, Homo sapiens
gcaaaggaaaccaaag

SEQ ID NO: 4187580 - DNA, 17 bp, Homo sapiens
gcaaaggaaaccaaagg

SEQ ID NO: 4187581 - DNA, 12 bp, Homo sapiens
gcaaattagtaa

SEQ ID NO: 4187582 - DNA, 13 bp, Homo sapiens
gcaaattagtaat

SEQ ID NO: 4187583 - DNA, 16 bp, Homo sapiens
gcaacaaatatttata

SEQ ID NO: 4187584 - DNA, 23 bp, Homo sapiens
gcaacaaatccatggacctatga

SEQ ID NO: 4187585 - DNA, 14 bp, Homo sapiens
gcaacagagtgaga

SEQ ID NO: 4187586 - DNA, 19 bp, Homo sapiens
gcaacctcagtaatttaga

SEQ ID NO: 4187587 - DNA, 18 bp, Homo sapiens
gcaacctcttcagctggg

SEQ ID NO: 4187588 - DNA, 18 bp, Homo sapiens
gcaagaacctaaagtagc

SEQ ID NO: 4187589 - DNA, 21 bp, Homo sapiens
gcaagaaggcaaaaatagttt

SEQ ID NO: 4187590 - DNA, 24 bp, Homo sapiens
gcaagaattataacagcaaggaaa

SEQ ID NO: 4187591 - DNA, 17 bp, Homo sapiens
gcaagacacaggctcag

SEQ ID NO: 4187592 - DNA, 15 bp, Homo sapiens
gcaagagaaaataaa

SEQ ID NO: 4187593 - DNA, 22 bp, Homo sapiens
gcaaggactacgttaagggaag

SEQ ID NO: 4187594 - DNA, 18 bp, Homo sapiens
gcaaggcatacctgtcct

SEQ ID NO: 4187595 - DNA, 13 bp, Homo sapiens
gcaagggaccttc

SEQ ID NO: 4187596 - DNA, 13 bp, Homo sapiens
gcaagggggcggg

SEQ ID NO: 4187597 - DNA, 18 bp, Homo sapiens
gcaagtggatggcccagc

SEQ ID NO: 4187598 - DNA, 20 bp, Homo sapiens
gcaagtggatggcccagcag

SEQ ID NO: 4187599 - DNA, 17 bp, Homo sapiens
gcaagttctagagaaga

SEQ ID NO: 4187600 - DNA, 20 bp, Homo sapiens
gcaagttctagagaagaggc

SEQ ID NO: 4187601 - DNA, 20 bp, Homo sapiens
gcaataagttccatgttaaa

SEQ ID NO: 4187602 - DNA, 18 bp, Homo sapiens
gcaatataaaaatgtgaa

SEQ ID NO: 4187603 - DNA, 13 bp, Homo sapiens
gcaatccatgtta

SEQ ID NO: 4187604 - DNA, 14 bp, Homo sapiens
gcaatgaaaccaaa

SEQ ID NO: 4187605 - DNA, 16 bp, Homo sapiens
gcaatgaaaccaaagc

SEQ ID NO: 4187606 - DNA, 19 bp, Homo sapiens
gcacaactcagtctgtggg

SEQ ID NO: 4187607 - DNA, 19 bp, Homo sapiens
gcacactgcagggctgctg

SEQ ID NO: 4187608 - DNA, 16 bp, Homo sapiens
gcacagatttcaacag

SEQ ID NO: 4187609 - DNA, 18 bp, Homo sapiens
gcacagcgcgggcggagg

SEQ ID NO: 4187610 - DNA, 16 bp, Homo sapiens
gcacaggctaattttt

SEQ ID NO: 4187611 - DNA, 14 bp, Homo sapiens
gcacagtgaatgtg

SEQ ID NO: 4187612 - DNA, 21 bp, Homo sapiens
gcacatgtctgtcctcagagc

SEQ ID NO: 4187613 - DNA, 18 bp, Homo sapiens
gcaccagcttctccaggc

SEQ ID NO: 4187614 - DNA, 16 bp, Homo sapiens
gcaccatcacacatgc

SEQ ID NO: 4187615 - DNA, 17 bp, Homo sapiens
gcaccccctcattcccc

SEQ ID NO: 4187616 - DNA, 21 bp, Homo sapiens
gcacctaaaccaccagtgccc

SEQ ID NO: 4187617 - DNA, 14 bp, Homo sapiens
gcacctgccagcct

SEQ ID NO: 4187618 - DNA, 22 bp, Homo sapiens
gcacctgccagcctggcttctg

SEQ ID NO: 4187619 - DNA, 15 bp, Homo sapiens
gcacctgccccctgg

SEQ ID NO: 4187620 - DNA, 16 bp, Homo sapiens
gcacctgccccctggt

SEQ ID NO: 4187621 - DNA, 23 bp, Homo sapiens
gcacctgctggaaaccacacttc

SEQ ID NO: 4187622 - DNA, 13 bp, Homo sapiens
gcaccttagtggc

SEQ ID NO: 4187623 - DNA, 16 bp, Homo sapiens
gcaccttagtggcttt

SEQ ID NO: 4187624 - DNA, 19 bp, Homo sapiens
gcactaaagtatgtaaagt

SEQ ID NO: 4187625 - DNA, 19 bp, Homo sapiens
gcactcacccatgtgccaa

SEQ ID NO: 4187626 - DNA, 16 bp, Homo sapiens
gcactccagcctgggc

SEQ ID NO: 4187627 - DNA, 19 bp, Homo sapiens
gcactcctcggtactccca

SEQ ID NO: 4187628 - DNA, 17 bp, Homo sapiens
gcactgatcaatccttc

SEQ ID NO: 4187629 - DNA, 15 bp, Homo sapiens
gcactgccctccgcc

SEQ ID NO: 4187630 - DNA, 22 bp, Homo sapiens
gcactgctaggcgagtgccagg

SEQ ID NO: 4187631 - DNA, 14 bp, Homo sapiens
gcactggccccacc

SEQ ID NO: 4187632 - DNA, 16 bp, Homo sapiens
gcactgtatgctggac

SEQ ID NO: 4187633 - DNA, 15 bp, Homo sapiens
gcactgtctgcgtga

SEQ ID NO: 4187634 - DNA, 23 bp, Homo sapiens
gcacttctttttctcgctgtcct

SEQ ID NO: 4187635 - DNA, 16 bp, Homo sapiens
gcactttaaccctctc

SEQ ID NO: 4187636 - DNA, 20 bp, Homo sapiens
gcactttaaccctctcttcc

SEQ ID NO: 4187637 - DNA, 21 bp, Homo sapiens
gcactttgggaggctgaggcg

SEQ ID NO: 4187638 - DNA, 22 bp, Homo sapiens
gcagaaaatcttttactagtgt

SEQ ID NO: 4187639 - DNA, 14 bp, Homo sapiens
gcagaaagattaaa

SEQ ID NO: 4187640 - DNA, 17 bp, Homo sapiens
gcagaactttttttgtg

SEQ ID NO: 4187641 - DNA, 22 bp, Homo sapiens
gcagaaggaagggcatccttct

SEQ ID NO: 4187642 - DNA, 17 bp, Homo sapiens
gcagacagtcaaggaga

SEQ ID NO: 4187643 - DNA, 17 bp, Homo sapiens
gcagaccgtgatttgga

SEQ ID NO: 4187644 - DNA, 17 bp, Homo sapiens
gcagaccttttttagga

SEQ ID NO: 4187645 - DNA, 22 bp, Homo sapiens
gcagacttgagtctgaggcccc

SEQ ID NO: 4187646 - DNA, 16 bp, Homo sapiens
gcagagagaagcctgt

SEQ ID NO: 4187647 - DNA, 22 bp, Homo sapiens
gcagagagcaggacaggagaca

SEQ ID NO: 4187648 - DNA, 14 bp, Homo sapiens
gcagagcaggggca

SEQ ID NO: 4187649 - DNA, 13 bp, Homo sapiens
gcagagctggggc

SEQ ID NO: 4187650 - DNA, 20 bp, Homo sapiens
gcagagctggggctgccagc

SEQ ID NO: 4187651 - DNA, 22 bp, Homo sapiens
gcagagctggggctgccagcct

SEQ ID NO: 4187652 - DNA, 12 bp, Homo sapiens
gcagaggaaaaa

SEQ ID NO: 4187653 - DNA, 19 bp, Homo sapiens
gcagaggacagtctggaga

SEQ ID NO: 4187654 - DNA, 22 bp, Homo sapiens
gcagaggacagtctggagaagg

SEQ ID NO: 4187655 - DNA, 12 bp, Homo sapiens
gcagaggcagcg

SEQ ID NO: 4187656 - DNA, 20 bp, Homo sapiens
gcagaggggctttctggaga

SEQ ID NO: 4187657 - DNA, 13 bp, Homo sapiens
gcagaggtaaaag

SEQ ID NO: 4187658 - DNA, 23 bp, Homo sapiens
gcagatcttccgtggtcagagtg

SEQ ID NO: 4187659 - DNA, 22 bp, Homo sapiens
gcagatgctgtcactggcagag

SEQ ID NO: 4187660 - DNA, 18 bp, Homo sapiens
gcagcactttaaccctct

SEQ ID NO: 4187661 - DNA, 18 bp, Homo sapiens
gcagcagttccatgaaga

SEQ ID NO: 4187662 - DNA, 20 bp, Homo sapiens
gcagccagcagttgtaaaat

SEQ ID NO: 4187663 - DNA, 23 bp, Homo sapiens
gcagccccgacccctgtccagcg

SEQ ID NO: 4187664 - DNA, 23 bp, Homo sapiens
gcagcctccctctgacctgcagg

SEQ ID NO: 4187665 - DNA, 22 bp, Homo sapiens
gcagcctggtagaattgggaag

SEQ ID NO: 4187666 - DNA, 22 bp, Homo sapiens
gcagcgagctatgatcgcgcca

SEQ ID NO: 4187667 - DNA, 24 bp, Homo sapiens
gcagcgagttgtggaaagcctctg

SEQ ID NO: 4187668 - DNA, 18 bp, Homo sapiens
gcagcgcagccgccgggc

SEQ ID NO: 4187669 - DNA, 16 bp, Homo sapiens
gcagctcaagagatcc

SEQ ID NO: 4187670 - DNA, 18 bp, Homo sapiens
gcagctggctctccacct

SEQ ID NO: 4187671 - DNA, 18 bp, Homo sapiens
gcagctgtagctcccgag

SEQ ID NO: 4187672 - DNA, 16 bp, Homo sapiens
gcaggaactcccagca

SEQ ID NO: 4187673 - DNA, 17 bp, Homo sapiens
gcaggaaggatggcaag

SEQ ID NO: 4187674 - DNA, 13 bp, Homo sapiens
gcaggaccaggac

SEQ ID NO: 4187675 - DNA, 14 bp, Homo sapiens
gcaggaccaggact

SEQ ID NO: 4187676 - DNA, 15 bp, Homo sapiens
gcaggaccctgtcag

SEQ ID NO: 4187677 - DNA, 18 bp, Homo sapiens
gcaggacccttaggaatc

SEQ ID NO: 4187678 - DNA, 15 bp, Homo sapiens
gcaggagcagaaaga

SEQ ID NO: 4187679 - DNA, 15 bp, Homo sapiens
gcaggcactgtggcc

SEQ ID NO: 4187680 - DNA, 17 bp, Homo sapiens
gcaggcaggctcccagg

SEQ ID NO: 4187681 - DNA, 12 bp, Homo sapiens
gcaggcatgccg

SEQ ID NO: 4187682 - DNA, 23 bp, Homo sapiens
gcaggctcccagggacacctggg

SEQ ID NO: 4187683 - DNA, 18 bp, Homo sapiens
gcagggaattaatgacag

SEQ ID NO: 4187684 - DNA, 15 bp, Homo sapiens
gcagggacacccccc

SEQ ID NO: 4187685 - DNA, 22 bp, Homo sapiens
gcagggacaccccccgcccccc

SEQ ID NO: 4187686 - DNA, 17 bp, Homo sapiens
gcagggacggggactgg

SEQ ID NO: 4187687 - DNA, 19 bp, Homo sapiens
gcagggagagcgcctcttc

SEQ ID NO: 4187688 - DNA, 14 bp, Homo sapiens
gcagggatttgagg

SEQ ID NO: 4187689 - DNA, 15 bp, Homo sapiens
gcagggatttgagga

SEQ ID NO: 4187690 - DNA, 12 bp, Homo sapiens
gcagggctgctg

SEQ ID NO: 4187691 - DNA, 13 bp, Homo sapiens
gcagggctgctgt

SEQ ID NO: 4187692 - DNA, 15 bp, Homo sapiens
gcagggctgctgtgg

SEQ ID NO: 4187693 - DNA, 22 bp, Homo sapiens
gcaggtagttggtgaacagaga

SEQ ID NO: 4187694 - DNA, 21 bp, Homo sapiens
gcaggtattttaactgtgtga

SEQ ID NO: 4187695 - DNA, 20 bp, Homo sapiens
gcaggtgcctggcttgctgt

SEQ ID NO: 4187696 - DNA, 16 bp, Homo sapiens
gcaggtggtcctgaga

SEQ ID NO: 4187697 - DNA, 16 bp, Homo sapiens
gcaggttgaggggctc

SEQ ID NO: 4187698 - DNA, 20 bp, Homo sapiens
gcaggttgaggggctcctgg

SEQ ID NO: 4187699 - DNA, 13 bp, Homo sapiens
gcagtaagcaggc

SEQ ID NO: 4187700 - DNA, 18 bp, Homo sapiens
gcagtaagtcttttttga

SEQ ID NO: 4187701 - DNA, 18 bp, Homo sapiens
gcagtagactcatctttt

SEQ ID NO: 4187702 - DNA, 21 bp, Homo sapiens
gcagtgaacacactcagcagc

SEQ ID NO: 4187703 - DNA, 18 bp, Homo sapiens
gcagtgacgtgcacctgt

SEQ ID NO: 4187704 - DNA, 14 bp, Homo sapiens
gcagtgagctgaga

SEQ ID NO: 4187705 - DNA, 15 bp, Homo sapiens
gcagtgagctgagat

SEQ ID NO: 4187706 - DNA, 16 bp, Homo sapiens
gcagtgagcttctatt

SEQ ID NO: 4187707 - DNA, 23 bp, Homo sapiens
gcagtgcaagagactctggcctc

SEQ ID NO: 4187708 - DNA, 21 bp, Homo sapiens
gcagtgctgatccggctgctc

SEQ ID NO: 4187709 - DNA, 22 bp, Homo sapiens
gcagtggaaaaatcagaagcac

SEQ ID NO: 4187710 - DNA, 16 bp, Homo sapiens
gcagtggctcacgcct

SEQ ID NO: 4187711 - DNA, 22 bp, Homo sapiens
gcagtgtggtctcttacatggc

SEQ ID NO: 4187712 - DNA, 21 bp, Homo sapiens
gcagtgttcctatttggggct

SEQ ID NO: 4187713 - DNA, 15 bp, Homo sapiens
gcagttgggagtgag

SEQ ID NO: 4187714 - DNA, 16 bp, Homo sapiens
gcataagattaaagga

SEQ ID NO: 4187715 - DNA, 23 bp, Homo sapiens
gcataagattaaaggaaggaaaa

SEQ ID NO: 4187716 - DNA, 19 bp, Homo sapiens
gcatacctgtcctagcagg

SEQ ID NO: 4187717 - DNA, 22 bp, Homo sapiens
gcatagaggtaccagcaatatg

SEQ ID NO: 4187718 - DNA, 23 bp, Homo sapiens
gcatagctgttttagctgaggga

SEQ ID NO: 4187719 - DNA, 23 bp, Homo sapiens
gcatatttatagcaatccatgtt

SEQ ID NO: 4187720 - DNA, 17 bp, Homo sapiens
gcatcacctcaggccag

SEQ ID NO: 4187721 - DNA, 14 bp, Homo sapiens
gcatccacgcacac

SEQ ID NO: 4187722 - DNA, 19 bp, Homo sapiens
gcatcccccagcactgatg

SEQ ID NO: 4187723 - DNA, 20 bp, Homo sapiens
gcatccttttctgcagaggg

SEQ ID NO: 4187724 - DNA, 13 bp, Homo sapiens
gcatctcattgta

SEQ ID NO: 4187725 - DNA, 14 bp, Homo sapiens
gcatgacactctag

SEQ ID NO: 4187726 - DNA, 14 bp, Homo sapiens
gcatgagaaataca

SEQ ID NO: 4187727 - DNA, 23 bp, Homo sapiens
gcatgcctgggaatcctgctgcc

SEQ ID NO: 4187728 - DNA, 14 bp, Homo sapiens
gcatgcgcaggctc

SEQ ID NO: 4187729 - DNA, 24 bp, Homo sapiens
gcatgctggcctcccaataaagct

SEQ ID NO: 4187730 - DNA, 15 bp, Homo sapiens
gcatgctggggcaag

SEQ ID NO: 4187731 - DNA, 17 bp, Homo sapiens
gcatggaatttgtaagt

SEQ ID NO: 4187732 - DNA, 18 bp, Homo sapiens
gcatgtttgtctgtgtgc

SEQ ID NO: 4187733 - DNA, 17 bp, Homo sapiens
gcattacgtgagccagg

SEQ ID NO: 4187734 - DNA, 18 bp, Homo sapiens
gcattcagggttatacac

SEQ ID NO: 4187735 - DNA, 23 bp, Homo sapiens
gcattcagggttatacacagaaa

SEQ ID NO: 4187736 - DNA, 16 bp, Homo sapiens
gcattctgagctgggc

SEQ ID NO: 4187737 - DNA, 15 bp, Homo sapiens
gcattgaatgacaag

SEQ ID NO: 4187738 - DNA, 21 bp, Homo sapiens
gcattgaatgacaagcatcag

SEQ ID NO: 4187739 - DNA, 22 bp, Homo sapiens
gcatttcactttcccggtgttc

SEQ ID NO: 4187740 - DNA, 22 bp, Homo sapiens
gcattttcacattttgcctttc

SEQ ID NO: 4187741 - DNA, 23 bp, Homo sapiens
gccaaaacaatgtttaaaccttt

SEQ ID NO: 4187742 - DNA, 23 bp, Homo sapiens
gccaaactgttggaagttcactg

SEQ ID NO: 4187743 - DNA, 16 bp, Homo sapiens
gccaaagcaaaagaag

SEQ ID NO: 4187744 - DNA, 21 bp, Homo sapiens
gccaaagcaaaagaagtaaaa

SEQ ID NO: 4187745 - DNA, 22 bp, Homo sapiens
gccaaataaaacctcagggaca

SEQ ID NO: 4187746 - DNA, 18 bp, Homo sapiens
gccaaattatttgtgtaa

SEQ ID NO: 4187747 - DNA, 22 bp, Homo sapiens
gccaacaggtggcaggaccagg

SEQ ID NO: 4187748 - DNA, 14 bp, Homo sapiens
gccaacatggtgaa

SEQ ID NO: 4187749 - DNA, 23 bp, Homo sapiens
gccaacgacaaagccaaactctg

SEQ ID NO: 4187750 - DNA, 11 bp, Homo sapiens
gccaagcctgg

SEQ ID NO: 4187751 - DNA, 23 bp, Homo sapiens
gccaagcgggggcgtggctggcc

SEQ ID NO: 4187752 - DNA, 19 bp, Homo sapiens
gccaagggctaggctcttg

SEQ ID NO: 4187753 - DNA, 18 bp, Homo sapiens
gccaaggtgggctgagcc

SEQ ID NO: 4187754 - DNA, 17 bp, Homo sapiens
gccaagtctcagaagag

SEQ ID NO: 4187755 - DNA, 20 bp, Homo sapiens
gccacaaaactctgtcaggc

SEQ ID NO: 4187756 - DNA, 14 bp, Homo sapiens
gccacaaagggaca

SEQ ID NO: 4187757 - DNA, 14 bp, Homo sapiens
gccacaagaaattt

SEQ ID NO: 4187758 - DNA, 16 bp, Homo sapiens
gccacaagaaatttga

SEQ ID NO: 4187759 - DNA, 17 bp, Homo sapiens
gccacaccaatcagaga

SEQ ID NO: 4187760 - DNA, 20 bp, Homo sapiens
gccacaccaatcagagagcc

SEQ ID NO: 4187761 - DNA, 13 bp, Homo sapiens
gccacaccaggat

SEQ ID NO: 4187762 - DNA, 19 bp, Homo sapiens
gccacaccatctcctttca

SEQ ID NO: 4187763 - DNA, 12 bp, Homo sapiens
gccacagagaag

SEQ ID NO: 4187764 - DNA, 13 bp, Homo sapiens
gccacagagaaga

SEQ ID NO: 4187765 - DNA, 17 bp, Homo sapiens
gccacagttctaagacc

SEQ ID NO: 4187766 - DNA, 12 bp, Homo sapiens
gccaccaggatg

SEQ ID NO: 4187767 - DNA, 19 bp, Homo sapiens
gccaccagggcactgtctg

SEQ ID NO: 4187768 - DNA, 13 bp, Homo sapiens
gccacctgtctgt

SEQ ID NO: 4187769 - DNA, 17 bp, Homo sapiens
gccacggggagggggac

SEQ ID NO: 4187770 - DNA, 20 bp, Homo sapiens
gccactacactccagcctga

SEQ ID NO: 4187771 - DNA, 22 bp, Homo sapiens
gccactacctttgtccaggcct

SEQ ID NO: 4187772 - DNA, 22 bp, Homo sapiens
gccactctcccctccctcttcc

SEQ ID NO: 4187773 - DNA, 14 bp, Homo sapiens
gccactgaagctgg

SEQ ID NO: 4187774 - DNA, 15 bp, Homo sapiens
gccactgcactccgg

SEQ ID NO: 4187775 - DNA, 21 bp, Homo sapiens
gccactgcgggagctctgtat

SEQ ID NO: 4187776 - DNA, 22 bp, Homo sapiens
gccagaatcttcgtcctgcccc

SEQ ID NO: 4187777 - DNA, 16 bp, Homo sapiens
gccagcagttgtaaaa

SEQ ID NO: 4187778 - DNA, 17 bp, Homo sapiens
gccagccggtgcctggc

SEQ ID NO: 4187779 - DNA, 12 bp, Homo sapiens
gccagcctgagc

SEQ ID NO: 4187780 - DNA, 17 bp, Homo sapiens
gccagcctggcttctgg

SEQ ID NO: 4187781 - DNA, 21 bp, Homo sapiens
gccagcctggcttctggagcc

SEQ ID NO: 4187782 - DNA, 22 bp, Homo sapiens
gccagcctggcttctggagccc

SEQ ID NO: 4187783 - DNA, 10 bp, Homo sapiens
gccagctctc

SEQ ID NO: 4187784 - DNA, 18 bp, Homo sapiens
gccaggaactggctcctt

SEQ ID NO: 4187785 - DNA, 17 bp, Homo sapiens
gccaggatcccaagcgt

SEQ ID NO: 4187786 - DNA, 14 bp, Homo sapiens
gccaggcaggggtg

SEQ ID NO: 4187787 - DNA, 16 bp, Homo sapiens
gccaggccaccaggat

SEQ ID NO: 4187788 - DNA, 13 bp, Homo sapiens
gccaggctctgcc

SEQ ID NO: 4187789 - DNA, 16 bp, Homo sapiens
gccaggctctgcctgg

SEQ ID NO: 4187790 - DNA, 13 bp, Homo sapiens
gccagggccaggg

SEQ ID NO: 4187791 - DNA, 19 bp, Homo sapiens
gccagggccctgcagaggg

SEQ ID NO: 4187792 - DNA, 17 bp, Homo sapiens
gccagggtgagagctgc

SEQ ID NO: 4187793 - DNA, 16 bp, Homo sapiens
gccaggtaatgaggga

SEQ ID NO: 4187794 - DNA, 12 bp, Homo sapiens
gccagtatttct

SEQ ID NO: 4187795 - DNA, 13 bp, Homo sapiens
gccagtcttgtgt

SEQ ID NO: 4187796 - DNA, 13 bp, Homo sapiens
gccagtgggcctg

SEQ ID NO: 4187797 - DNA, 16 bp, Homo sapiens
gccatattcacacctc

SEQ ID NO: 4187798 - DNA, 13 bp, Homo sapiens
gccatcagggtgg

SEQ ID NO: 4187799 - DNA, 24 bp, Homo sapiens
gccatcagggtgggccactctccc

SEQ ID NO: 4187800 - DNA, 19 bp, Homo sapiens
gccatgatgcctctgtctt

SEQ ID NO: 4187801 - DNA, 22 bp, Homo sapiens
gccatgatggtgctgacctctg

SEQ ID NO: 4187802 - DNA, 14 bp, Homo sapiens
gccatgccaccctg

SEQ ID NO: 4187803 - DNA, 14 bp, Homo sapiens
gccatggcatgctc

SEQ ID NO: 4187804 - DNA, 16 bp, Homo sapiens
gccatggcgtgtccct

SEQ ID NO: 4187805 - DNA, 18 bp, Homo sapiens
gccattaccatggagaca

SEQ ID NO: 4187806 - DNA, 20 bp, Homo sapiens
gccattcttctggtgctact

SEQ ID NO: 4187807 - DNA, 22 bp, Homo sapiens
gccattgggaccctccagtgct

SEQ ID NO: 4187808 - DNA, 18 bp, Homo sapiens
gccattgtactccagcct

SEQ ID NO: 4187809 - DNA, 19 bp, Homo sapiens
gccattgtactccagcctg

SEQ ID NO: 4187810 - DNA, 20 bp, Homo sapiens
gccattgtactccagcctgg

SEQ ID NO: 4187811 - DNA, 20 bp, Homo sapiens
gccatttgcaccctccgcct

SEQ ID NO: 4187812 - DNA, 14 bp, Homo sapiens
gcccaacctcctga

SEQ ID NO: 4187813 - DNA, 22 bp, Homo sapiens
gcccacaagccttactcacctc

SEQ ID NO: 4187814 - DNA, 18 bp, Homo sapiens
gcccacagagatgcatgc

SEQ ID NO: 4187815 - DNA, 18 bp, Homo sapiens
gcccacagagcctggctt

SEQ ID NO: 4187816 - DNA, 16 bp, Homo sapiens
gcccacattggaccca

SEQ ID NO: 4187817 - DNA, 21 bp, Homo sapiens
gcccacgcccgactagcaggc

SEQ ID NO: 4187818 - DNA, 16 bp, Homo sapiens
gcccagagggcccagg

SEQ ID NO: 4187819 - DNA, 20 bp, Homo sapiens
gcccagagggcccaggcagg

SEQ ID NO: 4187820 - DNA, 14 bp, Homo sapiens
gcccagcacaaccc

SEQ ID NO: 4187821 - DNA, 21 bp, Homo sapiens
gcccagcaggcaggcactgtg

SEQ ID NO: 4187822 - DNA, 13 bp, Homo sapiens
gcccagccagcca

SEQ ID NO: 4187823 - DNA, 11 bp, Homo sapiens
gcccagcctgt

SEQ ID NO: 4187824 - DNA, 23 bp, Homo sapiens
gcccagctgcacctgccagcctg

SEQ ID NO: 4187825 - DNA, 15 bp, Homo sapiens
gcccaggcactgcaa

SEQ ID NO: 4187826 - DNA, 22 bp, Homo sapiens
gcccagtcgtccgctcagccaa

SEQ ID NO: 4187827 - DNA, 15 bp, Homo sapiens
gcccagtctggaaga

SEQ ID NO: 4187828 - DNA, 18 bp, Homo sapiens
gcccatctctccagagag

SEQ ID NO: 4187829 - DNA, 19 bp, Homo sapiens
gcccatctctccagagagc

SEQ ID NO: 4187830 - DNA, 15 bp, Homo sapiens
gcccattctgcatgc

SEQ ID NO: 4187831 - DNA, 18 bp, Homo sapiens
gcccattctgcatgccct

SEQ ID NO: 4187832 - DNA, 23 bp, Homo sapiens
gccccacccagggctccctcctg

SEQ ID NO: 4187833 - DNA, 17 bp, Homo sapiens
gccccacccccatgcag

SEQ ID NO: 4187834 - DNA, 21 bp, Homo sapiens
gccccaccctcaaaccctgtg

SEQ ID NO: 4187835 - DNA, 20 bp, Homo sapiens
gccccaccctcgtggacacc

SEQ ID NO: 4187836 - DNA, 23 bp, Homo sapiens
gccccaccctcgtggacacctgc

SEQ ID NO: 4187837 - DNA, 12 bp, Homo sapiens
gccccagaggcc

SEQ ID NO: 4187838 - DNA, 15 bp, Homo sapiens
gccccagaggcctct

SEQ ID NO: 4187839 - DNA, 13 bp, Homo sapiens
gccccagctctgg

SEQ ID NO: 4187840 - DNA, 13 bp, Homo sapiens
gccccatctcctc

SEQ ID NO: 4187841 - DNA, 16 bp, Homo sapiens
gccccatctcctccca

SEQ ID NO: 4187842 - DNA, 21 bp, Homo sapiens
gcccccactttcctacaaaat

SEQ ID NO: 4187843 - DNA, 14 bp, Homo sapiens
gccccccatgccct

SEQ ID NO: 4187844 - DNA, 14 bp, Homo sapiens
gcccccctccaggc

SEQ ID NO: 4187845 - DNA, 16 bp, Homo sapiens
gcccccgacagcccag

SEQ ID NO: 4187846 - DNA, 16 bp, Homo sapiens
gccccgacccctgtcc

SEQ ID NO: 4187847 - DNA, 18 bp, Homo sapiens
gccccgggtgcctcagag

SEQ ID NO: 4187848 - DNA, 19 bp, Homo sapiens
gccccgggtgcctcagagc

SEQ ID NO: 4187849 - DNA, 19 bp, Homo sapiens
gcccctgcacctgcttctc

SEQ ID NO: 4187850 - DNA, 10 bp, Homo sapiens
gccccttcca

SEQ ID NO: 4187851 - DNA, 19 bp, Homo sapiens
gccccttgacaactggcag

SEQ ID NO: 4187852 - DNA, 14 bp, Homo sapiens
gcccgactagcagg

SEQ ID NO: 4187853 - DNA, 15 bp, Homo sapiens
gcccgactagcaggc

SEQ ID NO: 4187854 - DNA, 12 bp, Homo sapiens
gcccgcagagcc

SEQ ID NO: 4187855 - DNA, 13 bp, Homo sapiens
gcccgcagagccc

SEQ ID NO: 4187856 - DNA, 14 bp, Homo sapiens
gcccgcctctgtcc

SEQ ID NO: 4187857 - DNA, 13 bp, Homo sapiens
gcccgcttcaagc

SEQ ID NO: 4187858 - DNA, 17 bp, Homo sapiens
gcccgcttcaagctctc

SEQ ID NO: 4187859 - DNA, 16 bp, Homo sapiens
gcccggattctgggag

SEQ ID NO: 4187860 - DNA, 18 bp, Homo sapiens
gcccggtttggggctgcg

SEQ ID NO: 4187861 - DNA, 22 bp, Homo sapiens
gcccgtggtgaggttgtgctgc

SEQ ID NO: 4187862 - DNA, 23 bp, Homo sapiens
gccctaggattcctcccccagag

SEQ ID NO: 4187863 - DNA, 22 bp, Homo sapiens
gccctcataaaccaatgtggca

SEQ ID NO: 4187864 - DNA, 23 bp, Homo sapiens
gccctccacagccgcagcctccc

SEQ ID NO: 4187865 - DNA, 24 bp, Homo sapiens
gccctcccagcaagtttcaccttg

SEQ ID NO: 4187866 - DNA, 13 bp, Homo sapiens
gccctccctgctg

SEQ ID NO: 4187867 - DNA, 16 bp, Homo sapiens
gccctccctgctgcca

SEQ ID NO: 4187868 - DNA, 18 bp, Homo sapiens
gccctccctgctgccagg

SEQ ID NO: 4187869 - DNA, 18 bp, Homo sapiens
gccctccgcccttccctg

SEQ ID NO: 4187870 - DNA, 21 bp, Homo sapiens
gccctgagtggatctccaagg

SEQ ID NO: 4187871 - DNA, 13 bp, Homo sapiens
gccctgcagaggg

SEQ ID NO: 4187872 - DNA, 13 bp, Homo sapiens
gccctgccacctg

SEQ ID NO: 4187873 - DNA, 14 bp, Homo sapiens
gccctgccacctgt

SEQ ID NO: 4187874 - DNA, 15 bp, Homo sapiens
gccctgccacctgtc

SEQ ID NO: 4187875 - DNA, 18 bp, Homo sapiens
gccctgcctatcctctgt

SEQ ID NO: 4187876 - DNA, 19 bp, Homo sapiens
gccctgccttcagctttgg

SEQ ID NO: 4187877 - DNA, 23 bp, Homo sapiens
gccctgctgccgcctcccagcct

SEQ ID NO: 4187878 - DNA, 14 bp, Homo sapiens
gccctggagggagg

SEQ ID NO: 4187879 - DNA, 20 bp, Homo sapiens
gccctgggtcacctagctgg

SEQ ID NO: 4187880 - DNA, 20 bp, Homo sapiens
gccctgtgccccttgacaac

SEQ ID NO: 4187881 - DNA, 22 bp, Homo sapiens
gccctgtgccccttgacaactg

SEQ ID NO: 4187882 - DNA, 22 bp, Homo sapiens
gcccttcagacgagatcctgtt

SEQ ID NO: 4187883 - DNA, 14 bp, Homo sapiens
gcccttcccaacct

SEQ ID NO: 4187884 - DNA, 15 bp, Homo sapiens
gccctttgcaggccc

SEQ ID NO: 4187885 - DNA, 23 bp, Homo sapiens
gccctttgcaggcccagcagact

SEQ ID NO: 4187886 - DNA, 22 bp, Homo sapiens
gccgagatcacgccactgcact

SEQ ID NO: 4187887 - DNA, 12 bp, Homo sapiens
gccgagggcagc

SEQ ID NO: 4187888 - DNA, 17 bp, Homo sapiens
gccgcagggacggggac

SEQ ID NO: 4187889 - DNA, 12 bp, Homo sapiens
gccgcctcccag

SEQ ID NO: 4187890 - DNA, 13 bp, Homo sapiens
gccgcctcccagc

SEQ ID NO: 4187891 - DNA, 19 bp, Homo sapiens
gccgcctcccagcctgggg

SEQ ID NO: 4187892 - DNA, 15 bp, Homo sapiens
gccgggagaggactc

SEQ ID NO: 4187893 - DNA, 15 bp, Homo sapiens
gccgggaggcagtgc

SEQ ID NO: 4187894 - DNA, 16 bp, Homo sapiens
gccgggaggcagtgct

SEQ ID NO: 4187895 - DNA, 15 bp, Homo sapiens
gccgggcaggcctgc

SEQ ID NO: 4187896 - DNA, 19 bp, Homo sapiens
gccgggcgtggtggcgggc

SEQ ID NO: 4187897 - DNA, 13 bp, Homo sapiens
gccgtacatctct

SEQ ID NO: 4187898 - DNA, 21 bp, Homo sapiens
gccgtctaggattgggcctcc

SEQ ID NO: 4187899 - DNA, 14 bp, Homo sapiens
gccgtgcccagggg

SEQ ID NO: 4187900 - DNA, 15 bp, Homo sapiens
gccgtgggccgggag

SEQ ID NO: 4187901 - DNA, 17 bp, Homo sapiens
gccgtgggccgggaggc

SEQ ID NO: 4187902 - DNA, 22 bp, Homo sapiens
gccgtgtgtctcgtctcctgac

SEQ ID NO: 4187903 - DNA, 18 bp, Homo sapiens
gcctaatatttaggcaag

SEQ ID NO: 4187904 - DNA, 15 bp, Homo sapiens
gcctaattcctggca

SEQ ID NO: 4187905 - DNA, 13 bp, Homo sapiens
gcctagactgtgt

SEQ ID NO: 4187906 - DNA, 20 bp, Homo sapiens
gcctagactgttactttggc

SEQ ID NO: 4187907 - DNA, 16 bp, Homo sapiens
gcctcactcaagcctg

SEQ ID NO: 4187908 - DNA, 18 bp, Homo sapiens
gcctcactcaagcctgag

SEQ ID NO: 4187909 - DNA, 15 bp, Homo sapiens
gcctcagagcaggct

SEQ ID NO: 4187910 - DNA, 17 bp, Homo sapiens
gcctccaaatgccaact

SEQ ID NO: 4187911 - DNA, 22 bp, Homo sapiens
gcctccaaatgccaacttgtcc

SEQ ID NO: 4187912 - DNA, 15 bp, Homo sapiens
gcctcccaataaagc

SEQ ID NO: 4187913 - DNA, 20 bp, Homo sapiens
gcctcccaataaagctggac

SEQ ID NO: 4187914 - DNA, 21 bp, Homo sapiens
gcctcccataattgctttgcc

SEQ ID NO: 4187915 - DNA, 14 bp, Homo sapiens
gcctccctctgacc

SEQ ID NO: 4187916 - DNA, 17 bp, Homo sapiens
gcctcgtaccagccagg

SEQ ID NO: 4187917 - DNA, 12 bp, Homo sapiens
gcctctccctta

SEQ ID NO: 4187918 - DNA, 13 bp, Homo sapiens
gcctctctgctcc

SEQ ID NO: 4187919 - DNA, 14 bp, Homo sapiens
gcctctctgctcca

SEQ ID NO: 4187920 - DNA, 15 bp, Homo sapiens
gcctctctgctccag

SEQ ID NO: 4187921 - DNA, 16 bp, Homo sapiens
gcctctctgctccaga

SEQ ID NO: 4187922 - DNA, 17 bp, Homo sapiens
gcctctgactcaaactc

SEQ ID NO: 4187923 - DNA, 16 bp, Homo sapiens
gcctctgcccgcagag

SEQ ID NO: 4187924 - DNA, 17 bp, Homo sapiens
gcctctgcccgcagagc

SEQ ID NO: 4187925 - DNA, 11 bp, Homo sapiens
gcctctgctgc

SEQ ID NO: 4187926 - DNA, 23 bp, Homo sapiens
gcctcttaaagctgcctgtagtt

SEQ ID NO: 4187927 - DNA, 16 bp, Homo sapiens
gcctcttcagcagcat

SEQ ID NO: 4187928 - DNA, 15 bp, Homo sapiens
gcctcttccctctga

SEQ ID NO: 4187929 - DNA, 14 bp, Homo sapiens
gcctcttcctctgg

SEQ ID NO: 4187930 - DNA, 16 bp, Homo sapiens
gcctcttcctctgggc

SEQ ID NO: 4187931 - DNA, 17 bp, Homo sapiens
gcctcttcctctgggca

SEQ ID NO: 4187932 - DNA, 21 bp, Homo sapiens
gcctcttcctctgggcagcgc

SEQ ID NO: 4187933 - DNA, 23 bp, Homo sapiens
gcctcttcctctgggcagcgcta

SEQ ID NO: 4187934 - DNA, 15 bp, Homo sapiens
gcctcttcttcttca

SEQ ID NO: 4187935 - DNA, 16 bp, Homo sapiens
gcctcttcttcttcag

SEQ ID NO: 4187936 - DNA, 20 bp, Homo sapiens
gcctcttcttcttcagaaga

SEQ ID NO: 4187937 - DNA, 21 bp, Homo sapiens
gcctcttcttcttcagaagac

SEQ ID NO: 4187938 - DNA, 20 bp, Homo sapiens
gcctgactagggagccatgt

SEQ ID NO: 4187939 - DNA, 18 bp, Homo sapiens
gcctgactgcacacagct

SEQ ID NO: 4187940 - DNA, 22 bp, Homo sapiens
gcctgagcaacagagtgagacc

SEQ ID NO: 4187941 - DNA, 18 bp, Homo sapiens
gcctgagcggaggctcgg

SEQ ID NO: 4187942 - DNA, 15 bp, Homo sapiens
gcctgaggctgagac

SEQ ID NO: 4187943 - DNA, 12 bp, Homo sapiens
gcctgatgacag

SEQ ID NO: 4187944 - DNA, 17 bp, Homo sapiens
gcctgatgacagagcga

SEQ ID NO: 4187945 - DNA, 11 bp, Homo sapiens
gcctgcagaga

SEQ ID NO: 4187946 - DNA, 16 bp, Homo sapiens
gcctgcagagagaagc

SEQ ID NO: 4187947 - DNA, 17 bp, Homo sapiens
gcctgcagagagaagcc

SEQ ID NO: 4187948 - DNA, 18 bp, Homo sapiens
gcctgcagagagaagcct

SEQ ID NO: 4187949 - DNA, 13 bp, Homo sapiens
gcctgcagcgagc

SEQ ID NO: 4187950 - DNA, 18 bp, Homo sapiens
gcctgccctggagggagg

SEQ ID NO: 4187951 - DNA, 20 bp, Homo sapiens
gcctgccgccgtctctgtcc

SEQ ID NO: 4187952 - DNA, 21 bp, Homo sapiens
gcctgccgccgtctctgtccc

SEQ ID NO: 4187953 - DNA, 17 bp, Homo sapiens
gcctgcctccttcagtg

SEQ ID NO: 4187954 - DNA, 19 bp, Homo sapiens
gcctgcctgtggagacagc

SEQ ID NO: 4187955 - DNA, 20 bp, Homo sapiens
gcctgcctgtggagacagcc

SEQ ID NO: 4187956 - DNA, 17 bp, Homo sapiens
gcctgctgcgtcagacc

SEQ ID NO: 4187957 - DNA, 18 bp, Homo sapiens
gcctggaccgcttcccag

SEQ ID NO: 4187958 - DNA, 23 bp, Homo sapiens
gcctggaccgcttcccagaggcc

SEQ ID NO: 4187959 - DNA, 15 bp, Homo sapiens
gcctggagaagctga

SEQ ID NO: 4187960 - DNA, 17 bp, Homo sapiens
gcctggagggatgccac

SEQ ID NO: 4187961 - DNA, 12 bp, Homo sapiens
gcctggcaaggc

SEQ ID NO: 4187962 - DNA, 12 bp, Homo sapiens
gcctggccaggc

SEQ ID NO: 4187963 - DNA, 15 bp, Homo sapiens
gcctggccatcccca

SEQ ID NO: 4187964 - DNA, 16 bp, Homo sapiens
gcctggcttctggagc

SEQ ID NO: 4187965 - DNA, 16 bp, Homo sapiens
gcctggcttgctgtgg

SEQ ID NO: 4187966 - DNA, 17 bp, Homo sapiens
gcctggcttgctgtggc

SEQ ID NO: 4187967 - DNA, 19 bp, Homo sapiens
gcctgggaatcctgctgcc

SEQ ID NO: 4187968 - DNA, 20 bp, Homo sapiens
gcctgggaatcctgctgcca

SEQ ID NO: 4187969 - DNA, 19 bp, Homo sapiens
gcctggggttcccgaggga

SEQ ID NO: 4187970 - DNA, 23 bp, Homo sapiens
gcctggggttcccgagggagctg

SEQ ID NO: 4187971 - DNA, 20 bp, Homo sapiens
gcctgggtggcagagtgaga

SEQ ID NO: 4187972 - DNA, 23 bp, Homo sapiens
gcctgggtggcagagtgagactc

SEQ ID NO: 4187973 - DNA, 22 bp, Homo sapiens
gcctgtaatcccagctacccag

SEQ ID NO: 4187974 - DNA, 14 bp, Homo sapiens
gcctgtagttagga

SEQ ID NO: 4187975 - DNA, 16 bp, Homo sapiens
gcctgtagttaggaaa

SEQ ID NO: 4187976 - DNA, 18 bp, Homo sapiens
gcctgtagttaggaaata

SEQ ID NO: 4187977 - DNA, 22 bp, Homo sapiens
gcctgtagttaggaaataaaac

SEQ ID NO: 4187978 - DNA, 23 bp, Homo sapiens
gcctgtagttaggaaataaaacc

SEQ ID NO: 4187979 - DNA, 18 bp, Homo sapiens
gcctgtatagacagcact

SEQ ID NO: 4187980 - DNA, 12 bp, Homo sapiens
gcctgtcctgcc

SEQ ID NO: 4187981 - DNA, 14 bp, Homo sapiens
gcctgtcctgcctc

SEQ ID NO: 4187982 - DNA, 21 bp, Homo sapiens
gcctgtcctggtacagcaggg

SEQ ID NO: 4187983 - DNA, 21 bp, Homo sapiens
gcctgtggagacagccctgcc

SEQ ID NO: 4187984 - DNA, 22 bp, Homo sapiens
gcctgtggagacagccctgcct

SEQ ID NO: 4187985 - DNA, 15 bp, Homo sapiens
gcctgtgtctggccc

SEQ ID NO: 4187986 - DNA, 19 bp, Homo sapiens
gcctgttgctgaagtcatt

SEQ ID NO: 4187987 - DNA, 16 bp, Homo sapiens
gccttaggctgctggg

SEQ ID NO: 4187988 - DNA, 18 bp, Homo sapiens
gccttagtacggctgctg

SEQ ID NO: 4187989 - DNA, 19 bp, Homo sapiens
gccttagtacggctgctgc

SEQ ID NO: 4187990 - DNA, 20 bp, Homo sapiens
gccttagtacggctgctgca

SEQ ID NO: 4187991 - DNA, 20 bp, Homo sapiens
gccttcactccggtgtgcct

SEQ ID NO: 4187992 - DNA, 19 bp, Homo sapiens
gccttccctccccacagtc

SEQ ID NO: 4187993 - DNA, 15 bp, Homo sapiens
gccttcctcgtgcag

SEQ ID NO: 4187994 - DNA, 22 bp, Homo sapiens
gccttcctcgtgcagagctggg

SEQ ID NO: 4187995 - DNA, 22 bp, Homo sapiens
gccttcctgtctttctggccct

SEQ ID NO: 4187996 - DNA, 23 bp, Homo sapiens
gccttcttttgggggtcaacagt

SEQ ID NO: 4187997 - DNA, 14 bp, Homo sapiens
gccttgaagccact

SEQ ID NO: 4187998 - DNA, 17 bp, Homo sapiens
gcctttctctggctcca

SEQ ID NO: 4187999 - DNA, 19 bp, Homo sapiens
gcctttgggaggcagcatc

SEQ ID NO: 4188000 - DNA, 16 bp, Homo sapiens
gccttttgctgctgct

SEQ ID NO: 4188001 - DNA, 19 bp, Homo sapiens
gcgaaaacgttgacccctt

SEQ ID NO: 4188002 - DNA, 22 bp, Homo sapiens
gcgaaacaacttgtgttctatt

SEQ ID NO: 4188003 - DNA, 15 bp, Homo sapiens
gcgaaggggccctgg

SEQ ID NO: 4188004 - DNA, 15 bp, Homo sapiens
gcgaagtggctctca

SEQ ID NO: 4188005 - DNA, 16 bp, Homo sapiens
gcgagagtctgtctca

SEQ ID NO: 4188006 - DNA, 22 bp, Homo sapiens
gcgagggctactcagcagtaag

SEQ ID NO: 4188007 - DNA, 17 bp, Homo sapiens
gcgatcaagtccagagc

SEQ ID NO: 4188008 - DNA, 15 bp, Homo sapiens
gcgatggtctcagaa

SEQ ID NO: 4188009 - DNA, 17 bp, Homo sapiens
gcgcacctgccccctgg

SEQ ID NO: 4188010 - DNA, 22 bp, Homo sapiens
gcgcagtgcttctctacagact

SEQ ID NO: 4188011 - DNA, 20 bp, Homo sapiens
gcgcatttgatttctccagg

SEQ ID NO: 4188012 - DNA, 12 bp, Homo sapiens
gcgcctcttcct

SEQ ID NO: 4188013 - DNA, 16 bp, Homo sapiens
gcgcctgtagtcccag

SEQ ID NO: 4188014 - DNA, 14 bp, Homo sapiens
gcgcgggcggaggc

SEQ ID NO: 4188015 - DNA, 15 bp, Homo sapiens
gcgctttctggaaaa

SEQ ID NO: 4188016 - DNA, 22 bp, Homo sapiens
gcggagagtacagtgagccaag

SEQ ID NO: 4188017 - DNA, 17 bp, Homo sapiens
gcggagcttgcctgcct

SEQ ID NO: 4188018 - DNA, 17 bp, Homo sapiens
gcggaggcggctccagg

SEQ ID NO: 4188019 - DNA, 15 bp, Homo sapiens
gcggaggttgcaggg

SEQ ID NO: 4188020 - DNA, 13 bp, Homo sapiens
gcggatctcactc

SEQ ID NO: 4188021 - DNA, 20 bp, Homo sapiens
gcggcacgccaacagccccc

SEQ ID NO: 4188022 - DNA, 13 bp, Homo sapiens
gcggcgcagaggg

SEQ ID NO: 4188023 - DNA, 17 bp, Homo sapiens
gcggctgctgtgtgcct

SEQ ID NO: 4188024 - DNA, 20 bp, Homo sapiens
gcgggcacctatagtcccag

SEQ ID NO: 4188025 - DNA, 15 bp, Homo sapiens
gcgggcggaggcggc

SEQ ID NO: 4188026 - DNA, 14 bp, Homo sapiens
gcggggcagagcca

SEQ ID NO: 4188027 - DNA, 17 bp, Homo sapiens
gcggtgcttgatagaaa

SEQ ID NO: 4188028 - DNA, 14 bp, Homo sapiens
gcggtggaaggccc

SEQ ID NO: 4188029 - DNA, 18 bp, Homo sapiens
gcggtggaaggcccgagg

SEQ ID NO: 4188030 - DNA, 15 bp, Homo sapiens
gcggtggtgccagag

SEQ ID NO: 4188031 - DNA, 12 bp, Homo sapiens
gcggttcaggaa

SEQ ID NO: 4188032 - DNA, 14 bp, Homo sapiens
gcgtagagagccgg

SEQ ID NO: 4188033 - DNA, 20 bp, Homo sapiens
gcgtccctgagggcccttcc

SEQ ID NO: 4188034 - DNA, 23 bp, Homo sapiens
gcgtgcacagcgcgggcggaggc

SEQ ID NO: 4188035 - DNA, 19 bp, Homo sapiens
gcgtgtcgtgggtgtgtgt

SEQ ID NO: 4188036 - DNA, 11 bp, Homo sapiens
gcgtgtgtatc

SEQ ID NO: 4188037 - DNA, 12 bp, Homo sapiens
gctaaaagaaac

SEQ ID NO: 4188038 - DNA, 20 bp, Homo sapiens
gctaaacgactccgagaaca

SEQ ID NO: 4188039 - DNA, 19 bp, Homo sapiens
gctaaattgaatacacaaa

SEQ ID NO: 4188040 - DNA, 13 bp, Homo sapiens
gctaagagaagta

SEQ ID NO: 4188041 - DNA, 19 bp, Homo sapiens
gctactcagaagcctgagg

SEQ ID NO: 4188042 - DNA, 21 bp, Homo sapiens
gctactcagcagtaagcaggc

SEQ ID NO: 4188043 - DNA, 14 bp, Homo sapiens
gctactctcttgcc

SEQ ID NO: 4188044 - DNA, 17 bp, Homo sapiens
gctactgatttttgtga

SEQ ID NO: 4188045 - DNA, 16 bp, Homo sapiens
gctactttgctgctat

SEQ ID NO: 4188046 - DNA, 23 bp, Homo sapiens
gctactttgctgctatggttttc

SEQ ID NO: 4188047 - DNA, 17 bp, Homo sapiens
gctaggaaagggaagcc

SEQ ID NO: 4188048 - DNA, 20 bp, Homo sapiens
gctaggaaagggaagcctga

SEQ ID NO: 4188049 - DNA, 14 bp, Homo sapiens
gctaggcatgcctg

SEQ ID NO: 4188050 - DNA, 18 bp, Homo sapiens
gctaggggctggtccttc

SEQ ID NO: 4188051 - DNA, 12 bp, Homo sapiens
gctatatgcatt

SEQ ID NO: 4188052 - DNA, 19 bp, Homo sapiens
gctatatgccttaagccaa

SEQ ID NO: 4188053 - DNA, 14 bp, Homo sapiens
gctatattttcatg

SEQ ID NO: 4188054 - DNA, 23 bp, Homo sapiens
gctatattttcatgacttttcca

SEQ ID NO: 4188055 - DNA, 17 bp, Homo sapiens
gctatgatcgcgccact

SEQ ID NO: 4188056 - DNA, 15 bp, Homo sapiens
gctattactgtctgg

SEQ ID NO: 4188057 - DNA, 13 bp, Homo sapiens
gctcaaaaagttt

SEQ ID NO: 4188058 - DNA, 16 bp, Homo sapiens
gctcacgactcttcct

SEQ ID NO: 4188059 - DNA, 22 bp, Homo sapiens
gctcacgcctatgatcccagca

SEQ ID NO: 4188060 - DNA, 16 bp, Homo sapiens
gctcagccctgactgg

SEQ ID NO: 4188061 - DNA, 16 bp, Homo sapiens
gctcagggtttcggaa

SEQ ID NO: 4188062 - DNA, 18 bp, Homo sapiens
gctcatattttgtatata

SEQ ID NO: 4188063 - DNA, 15 bp, Homo sapiens
gctcattttttctta

SEQ ID NO: 4188064 - DNA, 9 bp, Homo sapiens
gctccaagg

SEQ ID NO: 4188065 - DNA, 19 bp, Homo sapiens
gctccaaggtgctctgtgt

SEQ ID NO: 4188066 - DNA, 14 bp, Homo sapiens
gctccaggtccgga

SEQ ID NO: 4188067 - DNA, 16 bp, Homo sapiens
gctccaggtccggagg

SEQ ID NO: 4188068 - DNA, 18 bp, Homo sapiens
gctcccactgcccctgca

SEQ ID NO: 4188069 - DNA, 23 bp, Homo sapiens
gctcccagggtcctgggggctgc

SEQ ID NO: 4188070 - DNA, 15 bp, Homo sapiens
gctcccctctcctcc

SEQ ID NO: 4188071 - DNA, 19 bp, Homo sapiens
gctcccctctcctccgcca

SEQ ID NO: 4188072 - DNA, 14 bp, Homo sapiens
gctcccgagctact

SEQ ID NO: 4188073 - DNA, 17 bp, Homo sapiens
gctcccgagctactctc

SEQ ID NO: 4188074 - DNA, 19 bp, Homo sapiens
gctcccgagctactctctt

SEQ ID NO: 4188075 - DNA, 15 bp, Homo sapiens
gctccctcctggagc

SEQ ID NO: 4188076 - DNA, 19 bp, Homo sapiens
gctccctcctggagcatcc

SEQ ID NO: 4188077 - DNA, 16 bp, Homo sapiens
gctccctggcccagcc

SEQ ID NO: 4188078 - DNA, 19 bp, Homo sapiens
gctccctggcccagccagc

SEQ ID NO: 4188079 - DNA, 22 bp, Homo sapiens
gctccggaggggacccagctcc

SEQ ID NO: 4188080 - DNA, 23 bp, Homo sapiens
gctcctaaacccccgctccagat

SEQ ID NO: 4188081 - DNA, 15 bp, Homo sapiens
gctcctaagcttcaa

SEQ ID NO: 4188082 - DNA, 15 bp, Homo sapiens
gctcctccttcccct

SEQ ID NO: 4188083 - DNA, 15 bp, Homo sapiens
gctcctctgctgctc

SEQ ID NO: 4188084 - DNA, 17 bp, Homo sapiens
gctcctctgctgctccc

SEQ ID NO: 4188085 - DNA, 18 bp, Homo sapiens
gctcctggaaaggctcag

SEQ ID NO: 4188086 - DNA, 23 bp, Homo sapiens
gctcctggaaaggctcagtctca

SEQ ID NO: 4188087 - DNA, 21 bp, Homo sapiens
gctcctggagggggcaagcct

SEQ ID NO: 4188088 - DNA, 18 bp, Homo sapiens
gctccttgggtcctgcaa

SEQ ID NO: 4188089 - DNA, 15 bp, Homo sapiens
gctcggccgtgggcc

SEQ ID NO: 4188090 - DNA, 22 bp, Homo sapiens
gctcgtaaatattccctgacga

SEQ ID NO: 4188091 - DNA, 12 bp, Homo sapiens
gctctaatacat

SEQ ID NO: 4188092 - DNA, 19 bp, Homo sapiens
gctctcaggggccagtgag

SEQ ID NO: 4188093 - DNA, 21 bp, Homo sapiens
gctctcaggggccagtgaggg

SEQ ID NO: 4188094 - DNA, 16 bp, Homo sapiens
gctctgcaggcacctt

SEQ ID NO: 4188095 - DNA, 16 bp, Homo sapiens
gctctgcccactgtga

SEQ ID NO: 4188096 - DNA, 12 bp, Homo sapiens
gctctgccccag

SEQ ID NO: 4188097 - DNA, 21 bp, Homo sapiens
gctctgccccagaggcctctc

SEQ ID NO: 4188098 - DNA, 22 bp, Homo sapiens
gctctggaaaatgtgacccaga

SEQ ID NO: 4188099 - DNA, 22 bp, Homo sapiens
gctctgtgtccgtctgtgtatg

SEQ ID NO: 4188100 - DNA, 21 bp, Homo sapiens
gctctgttatgcaagcacaaa

SEQ ID NO: 4188101 - DNA, 19 bp, Homo sapiens
gctcttcactcagccacac

SEQ ID NO: 4188102 - DNA, 13 bp, Homo sapiens
gctcttgcctgta

SEQ ID NO: 4188103 - DNA, 13 bp, Homo sapiens
gctctttcagggg

SEQ ID NO: 4188104 - DNA, 13 bp, Homo sapiens
gctctttctgggc

SEQ ID NO: 4188105 - DNA, 14 bp, Homo sapiens
gctctttctgggcc

SEQ ID NO: 4188106 - DNA, 18 bp, Homo sapiens
gctctttggggtcagcca

SEQ ID NO: 4188107 - DNA, 20 bp, Homo sapiens
gctctttggggtcagccagg

SEQ ID NO: 4188108 - DNA, 20 bp, Homo sapiens
gctcttttccactccaagat

SEQ ID NO: 4188109 - DNA, 13 bp, Homo sapiens
gctgaaagccatt

SEQ ID NO: 4188110 - DNA, 15 bp, Homo sapiens
gctgacatggctttg

SEQ ID NO: 4188111 - DNA, 21 bp, Homo sapiens
gctgaccagccgtgagcatgt

SEQ ID NO: 4188112 - DNA, 16 bp, Homo sapiens
gctgacctctggtggc

SEQ ID NO: 4188113 - DNA, 14 bp, Homo sapiens
gctgacctgggccc

SEQ ID NO: 4188114 - DNA, 16 bp, Homo sapiens
gctgagaaggaacagg

SEQ ID NO: 4188115 - DNA, 18 bp, Homo sapiens
gctgagcaaatcaccaca

SEQ ID NO: 4188116 - DNA, 17 bp, Homo sapiens
gctgagcaacctcttca

SEQ ID NO: 4188117 - DNA, 13 bp, Homo sapiens
gctgagccctggc

SEQ ID NO: 4188118 - DNA, 16 bp, Homo sapiens
gctgagccctggcagg

SEQ ID NO: 4188119 - DNA, 13 bp, Homo sapiens
gctgaggggcagg

SEQ ID NO: 4188120 - DNA, 19 bp, Homo sapiens
gctgataattttaaattct

SEQ ID NO: 4188121 - DNA, 16 bp, Homo sapiens
gctgatcaatgaaatg

SEQ ID NO: 4188122 - DNA, 20 bp, Homo sapiens
gctgatccggctgctcctcc

SEQ ID NO: 4188123 - DNA, 17 bp, Homo sapiens
gctgatggagaaggaag

SEQ ID NO: 4188124 - DNA, 18 bp, Homo sapiens
gctgcacctgccagcctg

SEQ ID NO: 4188125 - DNA, 19 bp, Homo sapiens
gctgcacctgccagcctgg

SEQ ID NO: 4188126 - DNA, 17 bp, Homo sapiens
gctgcatatgagtcttt

SEQ ID NO: 4188127 - DNA, 18 bp, Homo sapiens
gctgcatgcctggtcttt

SEQ ID NO: 4188128 - DNA, 20 bp, Homo sapiens
gctgcatgcctggtctttcc

SEQ ID NO: 4188129 - DNA, 14 bp, Homo sapiens
gctgccagccgggc

SEQ ID NO: 4188130 - DNA, 15 bp, Homo sapiens
gctgccagcctgagc

SEQ ID NO: 4188131 - DNA, 18 bp, Homo sapiens
gctgccaggctcccactg

SEQ ID NO: 4188132 - DNA, 15 bp, Homo sapiens
gctgccgcctcccag

SEQ ID NO: 4188133 - DNA, 18 bp, Homo sapiens
gctgccgcctcccagcct

SEQ ID NO: 4188134 - DNA, 16 bp, Homo sapiens
gctgcctctggtcaag

SEQ ID NO: 4188135 - DNA, 13 bp, Homo sapiens
gctgcctgtagtt

SEQ ID NO: 4188136 - DNA, 15 bp, Homo sapiens
gctgcctgtagttag

SEQ ID NO: 4188137 - DNA, 16 bp, Homo sapiens
gctgcctgtagttagg

SEQ ID NO: 4188138 - DNA, 19 bp, Homo sapiens
gctgccttttgctgctgct

SEQ ID NO: 4188139 - DNA, 21 bp, Homo sapiens
gctgcgaaaacgttgacccct

SEQ ID NO: 4188140 - DNA, 17 bp, Homo sapiens
gctgcggcatccctgtg

SEQ ID NO: 4188141 - DNA, 14 bp, Homo sapiens
gctgctagagaagg

SEQ ID NO: 4188142 - DNA, 13 bp, Homo sapiens
gctgctcctccag

SEQ ID NO: 4188143 - DNA, 12 bp, Homo sapiens
gctgctctggaa

SEQ ID NO: 4188144 - DNA, 14 bp, Homo sapiens
gctgctctggaaaa

SEQ ID NO: 4188145 - DNA, 11 bp, Homo sapiens
gctggaaataa

SEQ ID NO: 4188146 - DNA, 16 bp, Homo sapiens
gctggacaagaagctg

SEQ ID NO: 4188147 - DNA, 17 bp, Homo sapiens
gctggacaagaagctgc

SEQ ID NO: 4188148 - DNA, 17 bp, Homo sapiens
gctggatttgatgagtt

SEQ ID NO: 4188149 - DNA, 20 bp, Homo sapiens
gctggcctcccaataaagct

SEQ ID NO: 4188150 - DNA, 23 bp, Homo sapiens
gctggcctcccaataaagctgga

SEQ ID NO: 4188151 - DNA, 23 bp, Homo sapiens
gctggctatttaaaaagctcttt

SEQ ID NO: 4188152 - DNA, 13 bp, Homo sapiens
gctggctgcagtg

SEQ ID NO: 4188153 - DNA, 15 bp, Homo sapiens
gctggctgggcatgg

SEQ ID NO: 4188154 - DNA, 10 bp, Homo sapiens
gctggctgtc

SEQ ID NO: 4188155 - DNA, 14 bp, Homo sapiens
gctgggactacagg

SEQ ID NO: 4188156 - DNA, 14 bp, Homo sapiens
gctgggactggcca

SEQ ID NO: 4188157 - DNA, 15 bp, Homo sapiens
gctgggcctgagcct

SEQ ID NO: 4188158 - DNA, 15 bp, Homo sapiens
gctggggctgccagc

SEQ ID NO: 4188159 - DNA, 16 bp, Homo sapiens
gctggggctgccagcc

SEQ ID NO: 4188160 - DNA, 18 bp, Homo sapiens
gctggggctgccagcctg

SEQ ID NO: 4188161 - DNA, 15 bp, Homo sapiens
gctggggtacaggtt

SEQ ID NO: 4188162 - DNA, 17 bp, Homo sapiens
gctgggtcccgggtgcc

SEQ ID NO: 4188163 - DNA, 14 bp, Homo sapiens
gctggtaaactatt

SEQ ID NO: 4188164 - DNA, 19 bp, Homo sapiens
gctggtgctgtggccaggg

SEQ ID NO: 4188165 - DNA, 17 bp, Homo sapiens
gctgtcactggcagagc

SEQ ID NO: 4188166 - DNA, 18 bp, Homo sapiens
gctgtcactggcagagca

SEQ ID NO: 4188167 - DNA, 19 bp, Homo sapiens
gctgtcactggcagagcac

SEQ ID NO: 4188168 - DNA, 20 bp, Homo sapiens
gctgtcactggcagagcaca

SEQ ID NO: 4188169 - DNA, 21 bp, Homo sapiens
gctgtcactggcagagcacag

SEQ ID NO: 4188170 - DNA, 21 bp, Homo sapiens
gctgtcatggtcctttctgga

SEQ ID NO: 4188171 - DNA, 14 bp, Homo sapiens
gctgtcctaggcca

SEQ ID NO: 4188172 - DNA, 14 bp, Homo sapiens
gctgtggccagggt

SEQ ID NO: 4188173 - DNA, 21 bp, Homo sapiens
gctgtggccagggtgagagct

SEQ ID NO: 4188174 - DNA, 22 bp, Homo sapiens
gctgtggccagggtgagagctg

SEQ ID NO: 4188175 - DNA, 14 bp, Homo sapiens
gctgtggcccagtc

SEQ ID NO: 4188176 - DNA, 14 bp, Homo sapiens
gctgtggcctgggc

SEQ ID NO: 4188177 - DNA, 15 bp, Homo sapiens
gctgtggcctgggca

SEQ ID NO: 4188178 - DNA, 14 bp, Homo sapiens
gctgtggggtctgg

SEQ ID NO: 4188179 - DNA, 16 bp, Homo sapiens
gctgtggggtctggct

SEQ ID NO: 4188180 - DNA, 12 bp, Homo sapiens
gctgttggggca

SEQ ID NO: 4188181 - DNA, 18 bp, Homo sapiens
gctgttttagctgaggga

SEQ ID NO: 4188182 - DNA, 12 bp, Homo sapiens
gcttaaaacttt

SEQ ID NO: 4188183 - DNA, 17 bp, Homo sapiens
gcttaatcagatagata

SEQ ID NO: 4188184 - DNA, 18 bp, Homo sapiens
gcttagagaatgttctcc

SEQ ID NO: 4188185 - DNA, 15 bp, Homo sapiens
gcttagagaggaaaa

SEQ ID NO: 4188186 - DNA, 18 bp, Homo sapiens
gcttaggtgccaggctgt

SEQ ID NO: 4188187 - DNA, 19 bp, Homo sapiens
gcttcaccttggagcctga

SEQ ID NO: 4188188 - DNA, 14 bp, Homo sapiens
gcttcagcctgagg

SEQ ID NO: 4188189 - DNA, 21 bp, Homo sapiens
gcttcaggtccaggctgtgtt

SEQ ID NO: 4188190 - DNA, 17 bp, Homo sapiens
gcttccaggtggcagga

SEQ ID NO: 4188191 - DNA, 13 bp, Homo sapiens
gcttcccagaggc

SEQ ID NO: 4188192 - DNA, 18 bp, Homo sapiens
gcttctagatctggaacc

SEQ ID NO: 4188193 - DNA, 12 bp, Homo sapiens
gcttctccaggc

SEQ ID NO: 4188194 - DNA, 15 bp, Homo sapiens
gcttctcctcccagc

SEQ ID NO: 4188195 - DNA, 14 bp, Homo sapiens
gcttctctacagac

SEQ ID NO: 4188196 - DNA, 17 bp, Homo sapiens
gcttctgcagcaactcc

SEQ ID NO: 4188197 - DNA, 19 bp, Homo sapiens
gcttctgcagcaactccca

SEQ ID NO: 4188198 - DNA, 13 bp, Homo sapiens
gcttctggagccc

SEQ ID NO: 4188199 - DNA, 17 bp, Homo sapiens
gcttctggccaggaagc

SEQ ID NO: 4188200 - DNA, 19 bp, Homo sapiens
gcttcttcatcttgacatg

SEQ ID NO: 4188201 - DNA, 13 bp, Homo sapiens
gcttgagggacaa

SEQ ID NO: 4188202 - DNA, 15 bp, Homo sapiens
gcttgcctgcctgcc

SEQ ID NO: 4188203 - DNA, 12 bp, Homo sapiens
gcttgcttctgc

SEQ ID NO: 4188204 - DNA, 14 bp, Homo sapiens
gcttgcttctgcag

SEQ ID NO: 4188205 - DNA, 15 bp, Homo sapiens
gcttgcttctgcagc

SEQ ID NO: 4188206 - DNA, 21 bp, Homo sapiens
gcttggaaagcatcacctcag

SEQ ID NO: 4188207 - DNA, 15 bp, Homo sapiens
gcttggagctgagca

SEQ ID NO: 4188208 - DNA, 13 bp, Homo sapiens
gcttggcagctga

SEQ ID NO: 4188209 - DNA, 18 bp, Homo sapiens
gcttggtggccaagcctg

SEQ ID NO: 4188210 - DNA, 16 bp, Homo sapiens
gcttgttgtgctttta

SEQ ID NO: 4188211 - DNA, 17 bp, Homo sapiens
gctttaatcaattctag

SEQ ID NO: 4188212 - DNA, 12 bp, Homo sapiens
gctttacatgca

SEQ ID NO: 4188213 - DNA, 15 bp, Homo sapiens
gctttccatgggacc

SEQ ID NO: 4188214 - DNA, 16 bp, Homo sapiens
gctttcctggtccctc

SEQ ID NO: 4188215 - DNA, 12 bp, Homo sapiens
gctttctccttt

SEQ ID NO: 4188216 - DNA, 15 bp, Homo sapiens
gctttgaaacagaaa

SEQ ID NO: 4188217 - DNA, 12 bp, Homo sapiens
gctttgccaaaa

SEQ ID NO: 4188218 - DNA, 21 bp, Homo sapiens
gctttgccaaaataccagagc

SEQ ID NO: 4188219 - DNA, 23 bp, Homo sapiens
gctttgccaaaataccagagcct

SEQ ID NO: 4188220 - DNA, 19 bp, Homo sapiens
gctttgccatgggcctgct

SEQ ID NO: 4188221 - DNA, 21 bp, Homo sapiens
gctttgccatgggcctgctgc

SEQ ID NO: 4188222 - DNA, 14 bp, Homo sapiens
gctttggtccccag

SEQ ID NO: 4188223 - DNA, 17 bp, Homo sapiens
gctttggtgagaacctg

SEQ ID NO: 4188224 - DNA, 18 bp, Homo sapiens
gctttgtctctagccggg

SEQ ID NO: 4188225 - DNA, 15 bp, Homo sapiens
gcttttattgtataa

SEQ ID NO: 4188226 - DNA, 22 bp, Homo sapiens
gcttttcagttcccgctctgca

SEQ ID NO: 4188227 - DNA, 23 bp, Homo sapiens
gcttttgcggttcaggaaaattg

SEQ ID NO: 4188228 - DNA, 21 bp, Homo sapiens
gcttttggtggtccccacagc

SEQ ID NO: 4188229 - DNA, 13 bp, Homo sapiens
ggaaaaagaaaga

SEQ ID NO: 4188230 - DNA, 22 bp, Homo sapiens
ggaaaagaatccctgcagcctg

SEQ ID NO: 4188231 - DNA, 23 bp, Homo sapiens
ggaaaagaatccctgcagcctgg

SEQ ID NO: 4188232 - DNA, 12 bp, Homo sapiens
ggaaaagacaga

SEQ ID NO: 4188233 - DNA, 13 bp, Homo sapiens
ggaaaagacagag

SEQ ID NO: 4188234 - DNA, 15 bp, Homo sapiens
ggaaaagtgttatta

SEQ ID NO: 4188235 - DNA, 23 bp, Homo sapiens
ggaaaagttctttactggtgatt

SEQ ID NO: 4188236 - DNA, 15 bp, Homo sapiens
ggaaaattagaagca

SEQ ID NO: 4188237 - DNA, 16 bp, Homo sapiens
ggaaacccaaggaaca

SEQ ID NO: 4188238 - DNA, 20 bp, Homo sapiens
ggaaaggccagaggcagagt

SEQ ID NO: 4188239 - DNA, 20 bp, Homo sapiens
ggaaaggctcagtctcagga

SEQ ID NO: 4188240 - DNA, 23 bp, Homo sapiens
ggaaaggctcagtctcaggagca

SEQ ID NO: 4188241 - DNA, 15 bp, Homo sapiens
ggaaagggaagcctg

SEQ ID NO: 4188242 - DNA, 16 bp, Homo sapiens
ggaaagggaagcctga

SEQ ID NO: 4188243 - DNA, 16 bp, Homo sapiens
ggaaataaaacctttc

SEQ ID NO: 4188244 - DNA, 13 bp, Homo sapiens
ggaaataaatgat

SEQ ID NO: 4188245 - DNA, 23 bp, Homo sapiens
ggaaatgtgtgttgtaacaaata

SEQ ID NO: 4188246 - DNA, 11 bp, Homo sapiens
ggaacattttc

SEQ ID NO: 4188247 - DNA, 13 bp, Homo sapiens
ggaaccagggaga

SEQ ID NO: 4188248 - DNA, 17 bp, Homo sapiens
ggaaccagggagaccga

SEQ ID NO: 4188249 - DNA, 11 bp, Homo sapiens
ggaactcccag

SEQ ID NO: 4188250 - DNA, 22 bp, Homo sapiens
ggaactcccagcaacacaagct

SEQ ID NO: 4188251 - DNA, 15 bp, Homo sapiens
ggaactggttcaaga

SEQ ID NO: 4188252 - DNA, 20 bp, Homo sapiens
ggaagaagagatcaggaaga

SEQ ID NO: 4188253 - DNA, 16 bp, Homo sapiens
ggaagagaagggaagc

SEQ ID NO: 4188254 - DNA, 12 bp, Homo sapiens
ggaagagaggca

SEQ ID NO: 4188255 - DNA, 14 bp, Homo sapiens
ggaagagaggcacc

SEQ ID NO: 4188256 - DNA, 15 bp, Homo sapiens
ggaagagaggcacct

SEQ ID NO: 4188257 - DNA, 18 bp, Homo sapiens
ggaagccaacttggcttt

SEQ ID NO: 4188258 - DNA, 20 bp, Homo sapiens
ggaagcggaggttgcaggga

SEQ ID NO: 4188259 - DNA, 13 bp, Homo sapiens
ggaaggagtgaga

SEQ ID NO: 4188260 - DNA, 14 bp, Homo sapiens
ggaaggctggctgg

SEQ ID NO: 4188261 - DNA, 21 bp, Homo sapiens
ggaaggcttgttgtgctttta

SEQ ID NO: 4188262 - DNA, 18 bp, Homo sapiens
ggaagggttggtgggctg

SEQ ID NO: 4188263 - DNA, 19 bp, Homo sapiens
ggaaggtcccttgtttcca

SEQ ID NO: 4188264 - DNA, 18 bp, Homo sapiens
ggaaggttagaggtttgt

SEQ ID NO: 4188265 - DNA, 19 bp, Homo sapiens
ggaataaggtacaagaagc

SEQ ID NO: 4188266 - DNA, 15 bp, Homo sapiens
ggaatataattgttt

SEQ ID NO: 4188267 - DNA, 16 bp, Homo sapiens
ggaatatgactgtttt

SEQ ID NO: 4188268 - DNA, 19 bp, Homo sapiens
ggaatcagctggtggctag

SEQ ID NO: 4188269 - DNA, 21 bp, Homo sapiens
ggaatcagctggtggctaggt

SEQ ID NO: 4188270 - DNA, 17 bp, Homo sapiens
ggaatccgcctgcagag

SEQ ID NO: 4188271 - DNA, 19 bp, Homo sapiens
ggaatggaaggctttgcca

SEQ ID NO: 4188272 - DNA, 21 bp, Homo sapiens
ggaatggaaggctttgccatg

SEQ ID NO: 4188273 - DNA, 21 bp, Homo sapiens
ggaatgtttgggcagaaggga

SEQ ID NO: 4188274 - DNA, 12 bp, Homo sapiens
ggacaacatttt

SEQ ID NO: 4188275 - DNA, 15 bp, Homo sapiens
ggacacacagtgaca

SEQ ID NO: 4188276 - DNA, 12 bp, Homo sapiens
ggacacatgtcc

SEQ ID NO: 4188277 - DNA, 13 bp, Homo sapiens
ggacacatgtcca

SEQ ID NO: 4188278 - DNA, 21 bp, Homo sapiens
ggacaccccccgccccccacc

SEQ ID NO: 4188279 - DNA, 20 bp, Homo sapiens
ggacaccccttatccaggac

SEQ ID NO: 4188280 - DNA, 13 bp, Homo sapiens
ggacacctgccct

SEQ ID NO: 4188281 - DNA, 19 bp, Homo sapiens
ggacagatagacagtgctg

SEQ ID NO: 4188282 - DNA, 17 bp, Homo sapiens
ggacaggatgtgtttgc

SEQ ID NO: 4188283 - DNA, 17 bp, Homo sapiens
ggacaggtaagtggcag

SEQ ID NO: 4188284 - DNA, 17 bp, Homo sapiens
ggacagtattctcagtg

SEQ ID NO: 4188285 - DNA, 16 bp, Homo sapiens
ggacagtgcttcagcc

SEQ ID NO: 4188286 - DNA, 21 bp, Homo sapiens
ggacagtgcttcagcctgagg

SEQ ID NO: 4188287 - DNA, 23 bp, Homo sapiens
ggacagtgcttcagcctgaggct

SEQ ID NO: 4188288 - DNA, 21 bp, Homo sapiens
ggacatgatttagggaagcag

SEQ ID NO: 4188289 - DNA, 14 bp, Homo sapiens
ggacccagctcctc

SEQ ID NO: 4188290 - DNA, 17 bp, Homo sapiens
ggacccagctcctctga

SEQ ID NO: 4188291 - DNA, 21 bp, Homo sapiens
ggacccagctcctctgagcca

SEQ ID NO: 4188292 - DNA, 18 bp, Homo sapiens
ggaccgcttcccagaggc

SEQ ID NO: 4188293 - DNA, 22 bp, Homo sapiens
ggacctatgacaggctgaaagc

SEQ ID NO: 4188294 - DNA, 17 bp, Homo sapiens
ggacctgaatgacctgc

SEQ ID NO: 4188295 - DNA, 21 bp, Homo sapiens
ggacctgcacgccaccgctgc

SEQ ID NO: 4188296 - DNA, 15 bp, Homo sapiens
ggacctttcagctgt

SEQ ID NO: 4188297 - DNA, 14 bp, Homo sapiens
ggactccccaggcc

SEQ ID NO: 4188298 - DNA, 15 bp, Homo sapiens
ggactcctcccacaa

SEQ ID NO: 4188299 - DNA, 18 bp, Homo sapiens
ggactcgtaaagctgcta

SEQ ID NO: 4188300 - DNA, 13 bp, Homo sapiens
ggactctgaggct

SEQ ID NO: 4188301 - DNA, 21 bp, Homo sapiens
ggactctgaggctctttctgg

SEQ ID NO: 4188302 - DNA, 22 bp, Homo sapiens
ggactgcaagcagggctctgcc

SEQ ID NO: 4188303 - DNA, 14 bp, Homo sapiens
ggactggaaccagg

SEQ ID NO: 4188304 - DNA, 15 bp, Homo sapiens
ggactggaaccaggg

SEQ ID NO: 4188305 - DNA, 18 bp, Homo sapiens
ggactgggttttgtctct

SEQ ID NO: 4188306 - DNA, 19 bp, Homo sapiens
ggactgtgataatcagaag

SEQ ID NO: 4188307 - DNA, 18 bp, Homo sapiens
ggacttgaggattttgag

SEQ ID NO: 4188308 - DNA, 20 bp, Homo sapiens
ggagaactaggtttaaaaca

SEQ ID NO: 4188309 - DNA, 13 bp, Homo sapiens
ggagaagagaacc

SEQ ID NO: 4188310 - DNA, 13 bp, Homo sapiens
ggagaagctgatg

SEQ ID NO: 4188311 - DNA, 12 bp, Homo sapiens
ggagaaggaagg

SEQ ID NO: 4188312 - DNA, 16 bp, Homo sapiens
ggagacagccctgcct

SEQ ID NO: 4188313 - DNA, 18 bp, Homo sapiens
ggagacagccctgcctat

SEQ ID NO: 4188314 - DNA, 20 bp, Homo sapiens
ggagaccccggtggcagtgg

SEQ ID NO: 4188315 - DNA, 20 bp, Homo sapiens
ggagagatcatagctcactg

SEQ ID NO: 4188316 - DNA, 17 bp, Homo sapiens
ggagagcaagaaggaaa

SEQ ID NO: 4188317 - DNA, 13 bp, Homo sapiens
ggagagcagctgg

SEQ ID NO: 4188318 - DNA, 15 bp, Homo sapiens
ggagagccagctctc

SEQ ID NO: 4188319 - DNA, 17 bp, Homo sapiens
ggagagccagctctctc

SEQ ID NO: 4188320 - DNA, 19 bp, Homo sapiens
ggagagcgcctcttcctct

SEQ ID NO: 4188321 - DNA, 20 bp, Homo sapiens
ggagagcgcctcttcctctg

SEQ ID NO: 4188322 - DNA, 23 bp, Homo sapiens
ggagagcgcctcttcctctgggc

SEQ ID NO: 4188323 - DNA, 22 bp, Homo sapiens
ggagaggaagcacactgcaggg

SEQ ID NO: 4188324 - DNA, 14 bp, Homo sapiens
ggagaggactctgc

SEQ ID NO: 4188325 - DNA, 16 bp, Homo sapiens
ggagaggactctgcct

SEQ ID NO: 4188326 - DNA, 22 bp, Homo sapiens
ggagaggtttgtcaacacaaag

SEQ ID NO: 4188327 - DNA, 17 bp, Homo sapiens
ggagagtacagtgagcc

SEQ ID NO: 4188328 - DNA, 15 bp, Homo sapiens
ggagcatcccaggcg

SEQ ID NO: 4188329 - DNA, 15 bp, Homo sapiens
ggagccaaggcagag

SEQ ID NO: 4188330 - DNA, 21 bp, Homo sapiens
ggagcccgcttcaagctctct

SEQ ID NO: 4188331 - DNA, 23 bp, Homo sapiens
ggagcgcacctgccccctggtgg

SEQ ID NO: 4188332 - DNA, 20 bp, Homo sapiens
ggagcggagcttgcctgcct

SEQ ID NO: 4188333 - DNA, 16 bp, Homo sapiens
ggagctctctgctgag

SEQ ID NO: 4188334 - DNA, 13 bp, Homo sapiens
ggagctggaaata

SEQ ID NO: 4188335 - DNA, 14 bp, Homo sapiens
ggagcttgagggac

SEQ ID NO: 4188336 - DNA, 21 bp, Homo sapiens
ggagcttgagggacaatgcca

SEQ ID NO: 4188337 - DNA, 23 bp, Homo sapiens
ggagcttgagggacaatgccact

SEQ ID NO: 4188338 - DNA, 13 bp, Homo sapiens
ggagcttgcctgc

SEQ ID NO: 4188339 - DNA, 14 bp, Homo sapiens
ggagcttgcctgcc

SEQ ID NO: 4188340 - DNA, 15 bp, Homo sapiens
ggagcttgcctgcct

SEQ ID NO: 4188341 - DNA, 20 bp, Homo sapiens
ggaggaagactctggagcca

SEQ ID NO: 4188342 - DNA, 17 bp, Homo sapiens
ggaggaggcagagaaga

SEQ ID NO: 4188343 - DNA, 17 bp, Homo sapiens
ggaggatcactggagcc

SEQ ID NO: 4188344 - DNA, 19 bp, Homo sapiens
ggaggatcactggagccca

SEQ ID NO: 4188345 - DNA, 15 bp, Homo sapiens
ggaggcagagaagaa

SEQ ID NO: 4188346 - DNA, 20 bp, Homo sapiens
ggaggcctcgtaccagccag

SEQ ID NO: 4188347 - DNA, 17 bp, Homo sapiens
ggaggcgaataaatgtt

SEQ ID NO: 4188348 - DNA, 12 bp, Homo sapiens
ggaggcggagag

SEQ ID NO: 4188349 - DNA, 14 bp, Homo sapiens
ggaggcggctccag

SEQ ID NO: 4188350 - DNA, 15 bp, Homo sapiens
ggaggcggctccagg

SEQ ID NO: 4188351 - DNA, 17 bp, Homo sapiens
ggaggcggctccaggtc

SEQ ID NO: 4188352 - DNA, 20 bp, Homo sapiens
ggaggctcggccgtgggccg

SEQ ID NO: 4188353 - DNA, 15 bp, Homo sapiens
ggaggctgagacagg

SEQ ID NO: 4188354 - DNA, 19 bp, Homo sapiens
ggaggctgagacaggagaa

SEQ ID NO: 4188355 - DNA, 15 bp, Homo sapiens
ggaggctgaggcagg

SEQ ID NO: 4188356 - DNA, 17 bp, Homo sapiens
ggaggctgaggcaggag

SEQ ID NO: 4188357 - DNA, 20 bp, Homo sapiens
ggaggggacccagctcctct

SEQ ID NO: 4188358 - DNA, 19 bp, Homo sapiens
ggaggggatggcagacagt

SEQ ID NO: 4188359 - DNA, 23 bp, Homo sapiens
ggaggggttgcgggggagctgga

SEQ ID NO: 4188360 - DNA, 20 bp, Homo sapiens
ggaggtcaagcctgcagcga

SEQ ID NO: 4188361 - DNA, 15 bp, Homo sapiens
ggaggtccaggcagg

SEQ ID NO: 4188362 - DNA, 22 bp, Homo sapiens
ggaggtcgaccccaaagcccct

SEQ ID NO: 4188363 - DNA, 18 bp, Homo sapiens
ggaggtctccactgagga

SEQ ID NO: 4188364 - DNA, 17 bp, Homo sapiens
ggaggtgagaccacctc

SEQ ID NO: 4188365 - DNA, 19 bp, Homo sapiens
ggaggtggaggttgcagtg

SEQ ID NO: 4188366 - DNA, 17 bp, Homo sapiens
ggaggtggcagccctgt

SEQ ID NO: 4188367 - DNA, 14 bp, Homo sapiens
ggaggttgcagtga

SEQ ID NO: 4188368 - DNA, 21 bp, Homo sapiens
ggaggttgcagtgagctgaga

SEQ ID NO: 4188369 - DNA, 15 bp, Homo sapiens
ggagttccatgaaga

SEQ ID NO: 4188370 - DNA, 20 bp, Homo sapiens
ggagttcgagaccagcctgg

SEQ ID NO: 4188371 - DNA, 19 bp, Homo sapiens
ggagttgacgcatcctgca

SEQ ID NO: 4188372 - DNA, 14 bp, Homo sapiens
ggataacctatatg

SEQ ID NO: 4188373 - DNA, 13 bp, Homo sapiens
ggatagcattttt

SEQ ID NO: 4188374 - DNA, 17 bp, Homo sapiens
ggatatggtgcaaaaat

SEQ ID NO: 4188375 - DNA, 14 bp, Homo sapiens
ggatcactggagcc

SEQ ID NO: 4188376 - DNA, 18 bp, Homo sapiens
ggatcactggagcccagg

SEQ ID NO: 4188377 - DNA, 19 bp, Homo sapiens
ggatcactggagcccagga

SEQ ID NO: 4188378 - DNA, 12 bp, Homo sapiens
ggatcagcctcc

SEQ ID NO: 4188379 - DNA, 19 bp, Homo sapiens
ggatccagagacttgggga

SEQ ID NO: 4188380 - DNA, 20 bp, Homo sapiens
ggatccagagacttggggac

SEQ ID NO: 4188381 - DNA, 14 bp, Homo sapiens
ggatctccaaggac

SEQ ID NO: 4188382 - DNA, 17 bp, Homo sapiens
ggatcttgcattcccag

SEQ ID NO: 4188383 - DNA, 14 bp, Homo sapiens
ggatgagagtggct

SEQ ID NO: 4188384 - DNA, 20 bp, Homo sapiens
ggatggcccagcaggcaggc

SEQ ID NO: 4188385 - DNA, 22 bp, Homo sapiens
ggatggcccttcccactggagg

SEQ ID NO: 4188386 - DNA, 14 bp, Homo sapiens
ggatgggccctgca

SEQ ID NO: 4188387 - DNA, 22 bp, Homo sapiens
ggatggtcctggggctctgtgc

SEQ ID NO: 4188388 - DNA, 15 bp, Homo sapiens
ggattaatttattta

SEQ ID NO: 4188389 - DNA, 18 bp, Homo sapiens
ggattccagcatttgcca

SEQ ID NO: 4188390 - DNA, 23 bp, Homo sapiens
ggattcccaccaaggtcttcagc

SEQ ID NO: 4188391 - DNA, 12 bp, Homo sapiens
ggattggcctgt

SEQ ID NO: 4188392 - DNA, 16 bp, Homo sapiens
ggattggcctgtgtct

SEQ ID NO: 4188393 - DNA, 14 bp, Homo sapiens
ggatttatttaaaa

SEQ ID NO: 4188394 - DNA, 23 bp, Homo sapiens
ggatttgatgagttaactgtgaa

SEQ ID NO: 4188395 - DNA, 13 bp, Homo sapiens
ggatttgttcaca

SEQ ID NO: 4188396 - DNA, 18 bp, Homo sapiens
ggcaaagaactgccccat

SEQ ID NO: 4188397 - DNA, 23 bp, Homo sapiens
ggcaaagaactgccccatctcct

SEQ ID NO: 4188398 - DNA, 12 bp, Homo sapiens
ggcaaagctgga

SEQ ID NO: 4188399 - DNA, 17 bp, Homo sapiens
ggcaacgacggtttcaa

SEQ ID NO: 4188400 - DNA, 17 bp, Homo sapiens
ggcaaggcattcctcat

SEQ ID NO: 4188401 - DNA, 21 bp, Homo sapiens
ggcaagggccatgctgaaggg

SEQ ID NO: 4188402 - DNA, 22 bp, Homo sapiens
ggcaagtccctgactctctgtg

SEQ ID NO: 4188403 - DNA, 19 bp, Homo sapiens
ggcaagtggatggcccagc

SEQ ID NO: 4188404 - DNA, 14 bp, Homo sapiens
ggcaccccctggag

SEQ ID NO: 4188405 - DNA, 18 bp, Homo sapiens
ggcaccccctggagagaa

SEQ ID NO: 4188406 - DNA, 18 bp, Homo sapiens
ggcacctatagtcccagc

SEQ ID NO: 4188407 - DNA, 18 bp, Homo sapiens
ggcacctgaccagaatgc

SEQ ID NO: 4188408 - DNA, 18 bp, Homo sapiens
ggcacgccaacagccccc

SEQ ID NO: 4188409 - DNA, 16 bp, Homo sapiens
ggcactgtggcccttc

SEQ ID NO: 4188410 - DNA, 23 bp, Homo sapiens
ggcagaaaacggagagtgcttgg

SEQ ID NO: 4188411 - DNA, 15 bp, Homo sapiens
ggcagaagggagaag

SEQ ID NO: 4188412 - DNA, 16 bp, Homo sapiens
ggcagaaggggaagat

SEQ ID NO: 4188413 - DNA, 19 bp, Homo sapiens
ggcagactctttatgcttg

SEQ ID NO: 4188414 - DNA, 20 bp, Homo sapiens
ggcagactctttatgcttgc

SEQ ID NO: 4188415 - DNA, 20 bp, Homo sapiens
ggcagagcacagcccacggg

SEQ ID NO: 4188416 - DNA, 20 bp, Homo sapiens
ggcagagccaccagggcact

SEQ ID NO: 4188417 - DNA, 13 bp, Homo sapiens
ggcagccctgtag

SEQ ID NO: 4188418 - DNA, 15 bp, Homo sapiens
ggcagccctgtaggg

SEQ ID NO: 4188419 - DNA, 14 bp, Homo sapiens
ggcagcctgccgcc

SEQ ID NO: 4188420 - DNA, 15 bp, Homo sapiens
ggcaggaccaggact

SEQ ID NO: 4188421 - DNA, 16 bp, Homo sapiens
ggcaggaccctgtcag

SEQ ID NO: 4188422 - DNA, 17 bp, Homo sapiens
ggcaggaccctgtcagg

SEQ ID NO: 4188423 - DNA, 24 bp, Homo sapiens
ggcaggtgccctctgctccccagt

SEQ ID NO: 4188424 - DNA, 24 bp, Homo sapiens
ggcagtgaacacactcagcagccc

SEQ ID NO: 4188425 - DNA, 23 bp, Homo sapiens
ggcagtgctgatccggctgctcc

SEQ ID NO: 4188426 - DNA, 22 bp, Homo sapiens
ggcagtggaaaaatcagaagca

SEQ ID NO: 4188427 - DNA, 14 bp, Homo sapiens
ggcagttgggagtg

SEQ ID NO: 4188428 - DNA, 21 bp, Homo sapiens
ggcatagagggagaggaagca

SEQ ID NO: 4188429 - DNA, 14 bp, Homo sapiens
ggcatcacagggca

SEQ ID NO: 4188430 - DNA, 22 bp, Homo sapiens
ggcatcacagggcagagccggg

SEQ ID NO: 4188431 - DNA, 16 bp, Homo sapiens
ggcatccttctgcctt

SEQ ID NO: 4188432 - DNA, 13 bp, Homo sapiens
ggcatgctggcct

SEQ ID NO: 4188433 - DNA, 16 bp, Homo sapiens
ggcatgctggggcaag

SEQ ID NO: 4188434 - DNA, 14 bp, Homo sapiens
ggcatgtcagagcc

SEQ ID NO: 4188435 - DNA, 19 bp, Homo sapiens
ggcatgtcagagccaggct

SEQ ID NO: 4188436 - DNA, 23 bp, Homo sapiens
ggcatgttagcccttcctccaat

SEQ ID NO: 4188437 - DNA, 23 bp, Homo sapiens
ggcatgtttgtctgtgtgctgta

SEQ ID NO: 4188438 - DNA, 21 bp, Homo sapiens
ggccaaattatttgtgtaata

SEQ ID NO: 4188439 - DNA, 22 bp, Homo sapiens
ggccaatgcacctaaagaaaaa

SEQ ID NO: 4188440 - DNA, 20 bp, Homo sapiens
ggccactctcccctccctct

SEQ ID NO: 4188441 - DNA, 21 bp, Homo sapiens
ggccactctcccctccctctt

SEQ ID NO: 4188442 - DNA, 14 bp, Homo sapiens
ggccagagccaagg

SEQ ID NO: 4188443 - DNA, 21 bp, Homo sapiens
ggccagctgtcgcatctcagc

SEQ ID NO: 4188444 - DNA, 16 bp, Homo sapiens
ggccagggccctgcag

SEQ ID NO: 4188445 - DNA, 17 bp, Homo sapiens
ggccagggccctgcaga

SEQ ID NO: 4188446 - DNA, 17 bp, Homo sapiens
ggccaggggtctccctg

SEQ ID NO: 4188447 - DNA, 17 bp, Homo sapiens
ggccaggtttctgccca

SEQ ID NO: 4188448 - DNA, 13 bp, Homo sapiens
ggccagtgagggc

SEQ ID NO: 4188449 - DNA, 15 bp, Homo sapiens
ggccagtgagggctg

SEQ ID NO: 4188450 - DNA, 16 bp, Homo sapiens
ggccagtgagggctgg

SEQ ID NO: 4188451 - DNA, 14 bp, Homo sapiens
ggccagtgggcctg

SEQ ID NO: 4188452 - DNA, 15 bp, Homo sapiens
ggccagtgggcctgg

SEQ ID NO: 4188453 - DNA, 16 bp, Homo sapiens
ggccatgctgaaggga

SEQ ID NO: 4188454 - DNA, 17 bp, Homo sapiens
ggccatgctgaagggac

SEQ ID NO: 4188455 - DNA, 20 bp, Homo sapiens
ggccatgctttccttttctt

SEQ ID NO: 4188456 - DNA, 13 bp, Homo sapiens
ggcccacagagcc

SEQ ID NO: 4188457 - DNA, 12 bp, Homo sapiens
ggcccagcctgt

SEQ ID NO: 4188458 - DNA, 16 bp, Homo sapiens
ggcccagcctgtcctg

SEQ ID NO: 4188459 - DNA, 17 bp, Homo sapiens
ggcccagcctgtcctgg

SEQ ID NO: 4188460 - DNA, 18 bp, Homo sapiens
ggcccaggaggtcaagcc

SEQ ID NO: 4188461 - DNA, 18 bp, Homo sapiens
ggcccccctccaggcatg

SEQ ID NO: 4188462 - DNA, 19 bp, Homo sapiens
ggcccccctccaggcatgc

SEQ ID NO: 4188463 - DNA, 23 bp, Homo sapiens
ggcccctagaaaccacctgggtt

SEQ ID NO: 4188464 - DNA, 14 bp, Homo sapiens
ggcccgaaagctga

SEQ ID NO: 4188465 - DNA, 20 bp, Homo sapiens
ggcccttcccaacctcccct

SEQ ID NO: 4188466 - DNA, 15 bp, Homo sapiens
ggccgggaggcagtg

SEQ ID NO: 4188467 - DNA, 15 bp, Homo sapiens
ggccggtgtgggctg

SEQ ID NO: 4188468 - DNA, 13 bp, Homo sapiens
ggccgtgcccagg

SEQ ID NO: 4188469 - DNA, 22 bp, Homo sapiens
ggccgtggccatcagggtgggc

SEQ ID NO: 4188470 - DNA, 17 bp, Homo sapiens
ggcctcagcacccctgt

SEQ ID NO: 4188471 - DNA, 22 bp, Homo sapiens
ggcctccgtcatgaatgccttc

SEQ ID NO: 4188472 - DNA, 14 bp, Homo sapiens
ggcctctaattgaa

SEQ ID NO: 4188473 - DNA, 18 bp, Homo sapiens
ggcctctctcttcccagc

SEQ ID NO: 4188474 - DNA, 18 bp, Homo sapiens
ggcctgatgacagagcga

SEQ ID NO: 4188475 - DNA, 17 bp, Homo sapiens
ggcctgccctcagggat

SEQ ID NO: 4188476 - DNA, 18 bp, Homo sapiens
ggcctgccttgaagccac

SEQ ID NO: 4188477 - DNA, 21 bp, Homo sapiens
ggcctggaccgcttcccagag

SEQ ID NO: 4188478 - DNA, 23 bp, Homo sapiens
ggcctggaccgcttcccagaggc

SEQ ID NO: 4188479 - DNA, 14 bp, Homo sapiens
ggcctggccaggca

SEQ ID NO: 4188480 - DNA, 13 bp, Homo sapiens
ggccttctcagcc

SEQ ID NO: 4188481 - DNA, 22 bp, Homo sapiens
ggccttctcagcctacagcagt

SEQ ID NO: 4188482 - DNA, 17 bp, Homo sapiens
ggcgacagagcaagact

SEQ ID NO: 4188483 - DNA, 23 bp, Homo sapiens
ggcgacagagcgagagtctgtct

SEQ ID NO: 4188484 - DNA, 15 bp, Homo sapiens
ggcgatcaagtccag

SEQ ID NO: 4188485 - DNA, 14 bp, Homo sapiens
ggcgcgtctgcccc

SEQ ID NO: 4188486 - DNA, 17 bp, Homo sapiens
ggcgcgtctgccccacc

SEQ ID NO: 4188487 - DNA, 19 bp, Homo sapiens
ggcggagagtacagtgagc

SEQ ID NO: 4188488 - DNA, 20 bp, Homo sapiens
ggcggagagtacagtgagcc

SEQ ID NO: 4188489 - DNA, 13 bp, Homo sapiens
ggcggaggcggct

SEQ ID NO: 4188490 - DNA, 19 bp, Homo sapiens
ggcggaggttgcagtgagc

SEQ ID NO: 4188491 - DNA, 20 bp, Homo sapiens
ggcgggggcccgaaagctga

SEQ ID NO: 4188492 - DNA, 13 bp, Homo sapiens
ggctactcagcag

SEQ ID NO: 4188493 - DNA, 20 bp, Homo sapiens
ggctagagtgcggtggcgcg

SEQ ID NO: 4188494 - DNA, 12 bp, Homo sapiens
ggctaggctctt

SEQ ID NO: 4188495 - DNA, 20 bp, Homo sapiens
ggctatgggaatcagctggt

SEQ ID NO: 4188496 - DNA, 23 bp, Homo sapiens
ggctatgggaatcagctggtggc

SEQ ID NO: 4188497 - DNA, 21 bp, Homo sapiens
ggctcacgcctatgatcccag

SEQ ID NO: 4188498 - DNA, 17 bp, Homo sapiens
ggctcagtctcaggagc

SEQ ID NO: 4188499 - DNA, 15 bp, Homo sapiens
ggctccaaggtgctc

SEQ ID NO: 4188500 - DNA, 13 bp, Homo sapiens
ggctccaggtccg

SEQ ID NO: 4188501 - DNA, 20 bp, Homo sapiens
ggctccaggtccggaggggt

SEQ ID NO: 4188502 - DNA, 19 bp, Homo sapiens
ggctcccactgcccctgca

SEQ ID NO: 4188503 - DNA, 17 bp, Homo sapiens
ggctcccagggacacct

SEQ ID NO: 4188504 - DNA, 23 bp, Homo sapiens
ggctcccgccaccctcaataaat

SEQ ID NO: 4188505 - DNA, 15 bp, Homo sapiens
ggctccctcctggag

SEQ ID NO: 4188506 - DNA, 20 bp, Homo sapiens
ggctcctgtgctactttgcc

SEQ ID NO: 4188507 - DNA, 20 bp, Homo sapiens
ggctcctttgcctctgctac

SEQ ID NO: 4188508 - DNA, 14 bp, Homo sapiens
ggctcgccccaccc

SEQ ID NO: 4188509 - DNA, 20 bp, Homo sapiens
ggctcgccccacccagggct

SEQ ID NO: 4188510 - DNA, 21 bp, Homo sapiens
ggctctattgagccaagacca

SEQ ID NO: 4188511 - DNA, 16 bp, Homo sapiens
ggctctgccccagagg

SEQ ID NO: 4188512 - DNA, 18 bp, Homo sapiens
ggctctgccccagaggcc

SEQ ID NO: 4188513 - DNA, 14 bp, Homo sapiens
ggctctgccccagc

SEQ ID NO: 4188514 - DNA, 21 bp, Homo sapiens
ggctctgccccagctctggct

SEQ ID NO: 4188515 - DNA, 14 bp, Homo sapiens
ggctctgcctggag

SEQ ID NO: 4188516 - DNA, 20 bp, Homo sapiens
ggctgaccccaaagagcctg

SEQ ID NO: 4188517 - DNA, 22 bp, Homo sapiens
ggctgaccccaaagagcctgga

SEQ ID NO: 4188518 - DNA, 14 bp, Homo sapiens
ggctgacctgggcc

SEQ ID NO: 4188519 - DNA, 13 bp, Homo sapiens
ggctgagaaggaa

SEQ ID NO: 4188520 - DNA, 14 bp, Homo sapiens
ggctgagaaggaac

SEQ ID NO: 4188521 - DNA, 19 bp, Homo sapiens
ggctgagaaggaacaggga

SEQ ID NO: 4188522 - DNA, 21 bp, Homo sapiens
ggctgagactgcgggatggtc

SEQ ID NO: 4188523 - DNA, 16 bp, Homo sapiens
ggctgagccctggcag

SEQ ID NO: 4188524 - DNA, 15 bp, Homo sapiens
ggctgagcttggccc

SEQ ID NO: 4188525 - DNA, 22 bp, Homo sapiens
ggctgcagtgacgtgcacctgt

SEQ ID NO: 4188526 - DNA, 23 bp, Homo sapiens
ggctgcatctgggattcccacca

SEQ ID NO: 4188527 - DNA, 12 bp, Homo sapiens
ggctgccagcct

SEQ ID NO: 4188528 - DNA, 15 bp, Homo sapiens
ggctgcccaatctga

SEQ ID NO: 4188529 - DNA, 24 bp, Homo sapiens
ggctgctcattccttctggaggac

SEQ ID NO: 4188530 - DNA, 13 bp, Homo sapiens
ggctgctcctcca

SEQ ID NO: 4188531 - DNA, 16 bp, Homo sapiens
ggctgctgtggcccag

SEQ ID NO: 4188532 - DNA, 15 bp, Homo sapiens
ggctgctgtgtgcct

SEQ ID NO: 4188533 - DNA, 19 bp, Homo sapiens
ggctggagtgcagtggcat

SEQ ID NO: 4188534 - DNA, 15 bp, Homo sapiens
ggctgggcctgagcc

SEQ ID NO: 4188535 - DNA, 23 bp, Homo sapiens
ggctgtcttggtggatgggccct

SEQ ID NO: 4188536 - DNA, 18 bp, Homo sapiens
ggcttatcatcagccctc

SEQ ID NO: 4188537 - DNA, 23 bp, Homo sapiens
ggcttattcccaactgctctgcc

SEQ ID NO: 4188538 - DNA, 13 bp, Homo sapiens
ggcttcaggtcca

SEQ ID NO: 4188539 - DNA, 16 bp, Homo sapiens
ggcttcaggtccaggc

SEQ ID NO: 4188540 - DNA, 14 bp, Homo sapiens
ggcttcttgcccag

SEQ ID NO: 4188541 - DNA, 15 bp, Homo sapiens
ggcttgccctgggtc

SEQ ID NO: 4188542 - DNA, 17 bp, Homo sapiens
ggcttggtggccaagcc

SEQ ID NO: 4188543 - DNA, 21 bp, Homo sapiens
ggcttttcgcttgcttctgca

SEQ ID NO: 4188544 - DNA, 19 bp, Homo sapiens
gggaaaagggcaatcagca

SEQ ID NO: 4188545 - DNA, 13 bp, Homo sapiens
gggaaattctata

SEQ ID NO: 4188546 - DNA, 17 bp, Homo sapiens
gggaacactcatccctg

SEQ ID NO: 4188547 - DNA, 23 bp, Homo sapiens
gggaagcggaggttgcagggagc

SEQ ID NO: 4188548 - DNA, 14 bp, Homo sapiens
gggaagctggggga

SEQ ID NO: 4188549 - DNA, 12 bp, Homo sapiens
gggaatccgcct

SEQ ID NO: 4188550 - DNA, 18 bp, Homo sapiens
gggaatccgcctgcagag

SEQ ID NO: 4188551 - DNA, 13 bp, Homo sapiens
gggaatcctgctg

SEQ ID NO: 4188552 - DNA, 15 bp, Homo sapiens
gggaatcctgctgcc

SEQ ID NO: 4188553 - DNA, 23 bp, Homo sapiens
gggaatgtttgggcagaagggag

SEQ ID NO: 4188554 - DNA, 16 bp, Homo sapiens
gggacaccccccgccc

SEQ ID NO: 4188555 - DNA, 14 bp, Homo sapiens
gggacccagctcct

SEQ ID NO: 4188556 - DNA, 17 bp, Homo sapiens
gggacctactgaaccca

SEQ ID NO: 4188557 - DNA, 21 bp, Homo sapiens
gggacctactgaacccagagt

SEQ ID NO: 4188558 - DNA, 21 bp, Homo sapiens
gggactgctacctctgagaag

SEQ ID NO: 4188559 - DNA, 19 bp, Homo sapiens
gggactggaaccagggaga

SEQ ID NO: 4188560 - DNA, 15 bp, Homo sapiens
gggagaacctcaggc

SEQ ID NO: 4188561 - DNA, 14 bp, Homo sapiens
gggagagccagctc

SEQ ID NO: 4188562 - DNA, 13 bp, Homo sapiens
gggagagcgcctc

SEQ ID NO: 4188563 - DNA, 12 bp, Homo sapiens
gggagaggaagc

SEQ ID NO: 4188564 - DNA, 14 bp, Homo sapiens
gggagaggactctg

SEQ ID NO: 4188565 - DNA, 15 bp, Homo sapiens
gggagcaactctcca

SEQ ID NO: 4188566 - DNA, 13 bp, Homo sapiens
gggagctcagctc

SEQ ID NO: 4188567 - DNA, 23 bp, Homo sapiens
gggagctcagctcgctgcccagg

SEQ ID NO: 4188568 - DNA, 13 bp, Homo sapiens
gggagctctgtat

SEQ ID NO: 4188569 - DNA, 15 bp, Homo sapiens
gggagctggaaataa

SEQ ID NO: 4188570 - DNA, 23 bp, Homo sapiens
gggaggaagcaggttgaggggct

SEQ ID NO: 4188571 - DNA, 23 bp, Homo sapiens
gggaggatcactggagcccagga

SEQ ID NO: 4188572 - DNA, 23 bp, Homo sapiens
gggaggcctcgtaccagccagga

SEQ ID NO: 4188573 - DNA, 15 bp, Homo sapiens
gggaggctgagacag

SEQ ID NO: 4188574 - DNA, 16 bp, Homo sapiens
gggaggtccaggcagg

SEQ ID NO: 4188575 - DNA, 18 bp, Homo sapiens
gggaggtgagaccacctc

SEQ ID NO: 4188576 - DNA, 13 bp, Homo sapiens
gggatcacaaggt

SEQ ID NO: 4188577 - DNA, 22 bp, Homo sapiens
gggcaagtggatggcccagcag

SEQ ID NO: 4188578 - DNA, 19 bp, Homo sapiens
gggcacctatagtcccagc

SEQ ID NO: 4188579 - DNA, 18 bp, Homo sapiens
gggcagggagagcgcctc

SEQ ID NO: 4188580 - DNA, 15 bp, Homo sapiens
gggcagtggggagca

SEQ ID NO: 4188581 - DNA, 21 bp, Homo sapiens
gggcagtggtaagctctggct

SEQ ID NO: 4188582 - DNA, 17 bp, Homo sapiens
gggcataggctgcccaa

SEQ ID NO: 4188583 - DNA, 17 bp, Homo sapiens
gggccaagacttggcaa

SEQ ID NO: 4188584 - DNA, 24 bp, Homo sapiens
gggcccacaatggagtgggagatc

SEQ ID NO: 4188585 - DNA, 12 bp, Homo sapiens
gggcccaggagg

SEQ ID NO: 4188586 - DNA, 13 bp, Homo sapiens
gggcccaggcagg

SEQ ID NO: 4188587 - DNA, 15 bp, Homo sapiens
gggcccgaaagctga

SEQ ID NO: 4188588 - DNA, 18 bp, Homo sapiens
gggcctcccataattgct

SEQ ID NO: 4188589 - DNA, 23 bp, Homo sapiens
gggcctcccataattgctttgcc

SEQ ID NO: 4188590 - DNA, 11 bp, Homo sapiens
gggcctgctgc

SEQ ID NO: 4188591 - DNA, 23 bp, Homo sapiens
gggcgcacatgttatccacaagc

SEQ ID NO: 4188592 - DNA, 13 bp, Homo sapiens
gggcggaggcggc

SEQ ID NO: 4188593 - DNA, 15 bp, Homo sapiens
gggcgtggctggcct

SEQ ID NO: 4188594 - DNA, 15 bp, Homo sapiens
gggcgtggtggcacg

SEQ ID NO: 4188595 - DNA, 14 bp, Homo sapiens
gggcgtgttgtttt

SEQ ID NO: 4188596 - DNA, 20 bp, Homo sapiens
gggctactgcagctttacat

SEQ ID NO: 4188597 - DNA, 22 bp, Homo sapiens
gggctcagcataagtaaacaac

SEQ ID NO: 4188598 - DNA, 23 bp, Homo sapiens
gggctccggaggggacccagctc

SEQ ID NO: 4188599 - DNA, 23 bp, Homo sapiens
gggctctgccccagaggcctctc

SEQ ID NO: 4188600 - DNA, 21 bp, Homo sapiens
gggctctgccccagctctggc

SEQ ID NO: 4188601 - DNA, 13 bp, Homo sapiens
gggctgagccctg

SEQ ID NO: 4188602 - DNA, 14 bp, Homo sapiens
gggctgcagaagat

SEQ ID NO: 4188603 - DNA, 14 bp, Homo sapiens
gggctgctgcactg

SEQ ID NO: 4188604 - DNA, 13 bp, Homo sapiens
gggctggcccagc

SEQ ID NO: 4188605 - DNA, 22 bp, Homo sapiens
gggctgggcccacagagatgca

SEQ ID NO: 4188606 - DNA, 17 bp, Homo sapiens
gggcttcaggtccaggc

SEQ ID NO: 4188607 - DNA, 18 bp, Homo sapiens
gggcttccatgcctgtag

SEQ ID NO: 4188608 - DNA, 17 bp, Homo sapiens
gggcttgccctgggtca

SEQ ID NO: 4188609 - DNA, 24 bp, Homo sapiens
gggcttgttgtttttaagtcctgt

SEQ ID NO: 4188610 - DNA, 14 bp, Homo sapiens
gggctttctggaga

SEQ ID NO: 4188611 - DNA, 15 bp, Homo sapiens
gggctttctggagag

SEQ ID NO: 4188612 - DNA, 14 bp, Homo sapiens
ggggagctggaaat

SEQ ID NO: 4188613 - DNA, 11 bp, Homo sapiens
ggggaggggga

SEQ ID NO: 4188614 - DNA, 12 bp, Homo sapiens
ggggagggggac

SEQ ID NO: 4188615 - DNA, 14 bp, Homo sapiens
ggggagtagtggag

SEQ ID NO: 4188616 - DNA, 17 bp, Homo sapiens
ggggatcacagcgtttc

SEQ ID NO: 4188617 - DNA, 18 bp, Homo sapiens
ggggattggagggaagac

SEQ ID NO: 4188618 - DNA, 20 bp, Homo sapiens
ggggattggagggaagacag

SEQ ID NO: 4188619 - DNA, 17 bp, Homo sapiens
ggggcactgcaggggcc

SEQ ID NO: 4188620 - DNA, 13 bp, Homo sapiens
ggggcagggagag

SEQ ID NO: 4188621 - DNA, 18 bp, Homo sapiens
ggggccagtgagggctgg

SEQ ID NO: 4188622 - DNA, 19 bp, Homo sapiens
ggggcccattctgcatgcc

SEQ ID NO: 4188623 - DNA, 21 bp, Homo sapiens
ggggccctggtccttccaggc

SEQ ID NO: 4188624 - DNA, 19 bp, Homo sapiens
ggggcgatcaagtccagag

SEQ ID NO: 4188625 - DNA, 12 bp, Homo sapiens
ggggctcctgga

SEQ ID NO: 4188626 - DNA, 15 bp, Homo sapiens
ggggctcgccccacc

SEQ ID NO: 4188627 - DNA, 17 bp, Homo sapiens
ggggctcgccccaccca

SEQ ID NO: 4188628 - DNA, 24 bp, Homo sapiens
gggggtttttactccagtggtgaa

SEQ ID NO: 4188629 - DNA, 17 bp, Homo sapiens
ggggtaggcagagcctt

SEQ ID NO: 4188630 - DNA, 16 bp, Homo sapiens
ggggtcatataaaata

SEQ ID NO: 4188631 - DNA, 21 bp, Homo sapiens
ggggtccaggtcaccagcctg

SEQ ID NO: 4188632 - DNA, 22 bp, Homo sapiens
ggggtccttcaagttagctcag

SEQ ID NO: 4188633 - DNA, 17 bp, Homo sapiens
ggggtcttttggctctg

SEQ ID NO: 4188634 - DNA, 17 bp, Homo sapiens
ggggtgatttcagagag

SEQ ID NO: 4188635 - DNA, 22 bp, Homo sapiens
ggggttaacttggtcagagcca

SEQ ID NO: 4188636 - DNA, 17 bp, Homo sapiens
ggggttgtgaggcctgg

SEQ ID NO: 4188637 - DNA, 21 bp, Homo sapiens
gggtaataaacttagaataaa

SEQ ID NO: 4188638 - DNA, 15 bp, Homo sapiens
gggtagactgaggga

SEQ ID NO: 4188639 - DNA, 12 bp, Homo sapiens
gggtcagccagg

SEQ ID NO: 4188640 - DNA, 13 bp, Homo sapiens
gggtcagccaggg

SEQ ID NO: 4188641 - DNA, 19 bp, Homo sapiens
gggtcagccagggccaggg

SEQ ID NO: 4188642 - DNA, 19 bp, Homo sapiens
gggtcagtgcagcagagga

SEQ ID NO: 4188643 - DNA, 18 bp, Homo sapiens
gggtgaataaagcaggga

SEQ ID NO: 4188644 - DNA, 14 bp, Homo sapiens
gggtgatagaacaa

SEQ ID NO: 4188645 - DNA, 22 bp, Homo sapiens
gggtgcctcagagcaggctcag

SEQ ID NO: 4188646 - DNA, 16 bp, Homo sapiens
gggtgggagagccagc

SEQ ID NO: 4188647 - DNA, 15 bp, Homo sapiens
gggtgggccactctc

SEQ ID NO: 4188648 - DNA, 17 bp, Homo sapiens
gggttaacttggtcaga

SEQ ID NO: 4188649 - DNA, 16 bp, Homo sapiens
gggttcagcctctccc

SEQ ID NO: 4188650 - DNA, 17 bp, Homo sapiens
gggttcccgagggagct

SEQ ID NO: 4188651 - DNA, 17 bp, Homo sapiens
gggttctgagtcagagg

SEQ ID NO: 4188652 - DNA, 19 bp, Homo sapiens
gggttctttggaaggagtg

SEQ ID NO: 4188653 - DNA, 12 bp, Homo sapiens
gggttgcccagc

SEQ ID NO: 4188654 - DNA, 15 bp, Homo sapiens
gggttgcgggggagc

SEQ ID NO: 4188655 - DNA, 22 bp, Homo sapiens
gggttgcgggggagctggaaat

SEQ ID NO: 4188656 - DNA, 20 bp, Homo sapiens
gggtttcaccatgttggcca

SEQ ID NO: 4188657 - DNA, 16 bp, Homo sapiens
gggttttccaccctgg

SEQ ID NO: 4188658 - DNA, 13 bp, Homo sapiens
ggtaaaatgccat

SEQ ID NO: 4188659 - DNA, 13 bp, Homo sapiens
ggtaagaagaaag

SEQ ID NO: 4188660 - DNA, 15 bp, Homo sapiens
ggtaagaagaaagca

SEQ ID NO: 4188661 - DNA, 17 bp, Homo sapiens
ggtaagaagaaagcaaa

SEQ ID NO: 4188662 - DNA, 15 bp, Homo sapiens
ggtaataaacttaga

SEQ ID NO: 4188663 - DNA, 16 bp, Homo sapiens
ggtaattatatctgtt

SEQ ID NO: 4188664 - DNA, 16 bp, Homo sapiens
ggtagaattgggaagc

SEQ ID NO: 4188665 - DNA, 18 bp, Homo sapiens
ggtagaattgggaagctg

SEQ ID NO: 4188666 - DNA, 15 bp, Homo sapiens
ggtagactgagggat

SEQ ID NO: 4188667 - DNA, 14 bp, Homo sapiens
ggtagagatgtgtg

SEQ ID NO: 4188668 - DNA, 14 bp, Homo sapiens
ggtagtactgggaa

SEQ ID NO: 4188669 - DNA, 13 bp, Homo sapiens
ggtatacatttta

SEQ ID NO: 4188670 - DNA, 22 bp, Homo sapiens
ggtatgaacttgaggacacatg

SEQ ID NO: 4188671 - DNA, 14 bp, Homo sapiens
ggtatgagctgagg

SEQ ID NO: 4188672 - DNA, 13 bp, Homo sapiens
ggtatgggaagcc

SEQ ID NO: 4188673 - DNA, 15 bp, Homo sapiens
ggtattaaagatgtg

SEQ ID NO: 4188674 - DNA, 19 bp, Homo sapiens
ggtattccttttgtgtaca

SEQ ID NO: 4188675 - DNA, 14 bp, Homo sapiens
ggtatttcctgcta

SEQ ID NO: 4188676 - DNA, 18 bp, Homo sapiens
ggtcaccagcctgactgc

SEQ ID NO: 4188677 - DNA, 19 bp, Homo sapiens
ggtcaccagcctgactgca

SEQ ID NO: 4188678 - DNA, 13 bp, Homo sapiens
ggtcagagccact

SEQ ID NO: 4188679 - DNA, 24 bp, Homo sapiens
ggtcagatgcaccacccatggaga

SEQ ID NO: 4188680 - DNA, 13 bp, Homo sapiens
ggtcagccagggc

SEQ ID NO: 4188681 - DNA, 18 bp, Homo sapiens
ggtcagccagggccaggg

SEQ ID NO: 4188682 - DNA, 21 bp, Homo sapiens
ggtcagcccattggctcccat

SEQ ID NO: 4188683 - DNA, 14 bp, Homo sapiens
ggtccaggcaggag

SEQ ID NO: 4188684 - DNA, 16 bp, Homo sapiens
ggtccaggcaggagga

SEQ ID NO: 4188685 - DNA, 19 bp, Homo sapiens
ggtccaggccagtgggcct

SEQ ID NO: 4188686 - DNA, 13 bp, Homo sapiens
ggtccaggctgtg

SEQ ID NO: 4188687 - DNA, 13 bp, Homo sapiens
ggtccagggttga

SEQ ID NO: 4188688 - DNA, 18 bp, Homo sapiens
ggtccaggtcaccagcct

SEQ ID NO: 4188689 - DNA, 19 bp, Homo sapiens
ggtccagtttctagagggc

SEQ ID NO: 4188690 - DNA, 17 bp, Homo sapiens
ggtccctcggagctgcc

SEQ ID NO: 4188691 - DNA, 14 bp, Homo sapiens
ggtccctggatcag

SEQ ID NO: 4188692 - DNA, 15 bp, Homo sapiens
ggtcctggggctctg

SEQ ID NO: 4188693 - DNA, 22 bp, Homo sapiens
ggtcctgggggctgctgcactg

SEQ ID NO: 4188694 - DNA, 21 bp, Homo sapiens
ggtccttcaagttagctcagg

SEQ ID NO: 4188695 - DNA, 16 bp, Homo sapiens
ggtccttccaggcccc

SEQ ID NO: 4188696 - DNA, 23 bp, Homo sapiens
ggtcggtttggtttgttgtaaat

SEQ ID NO: 4188697 - DNA, 15 bp, Homo sapiens
ggtctaaagagaaca

SEQ ID NO: 4188698 - DNA, 17 bp, Homo sapiens
ggtctcttacatggcca

SEQ ID NO: 4188699 - DNA, 16 bp, Homo sapiens
ggtctgagcaccccct

SEQ ID NO: 4188700 - DNA, 12 bp, Homo sapiens
ggtctgccacca

SEQ ID NO: 4188701 - DNA, 16 bp, Homo sapiens
ggtcttcttgtgtcct

SEQ ID NO: 4188702 - DNA, 18 bp, Homo sapiens
ggtgaaaccctgtctcta

SEQ ID NO: 4188703 - DNA, 15 bp, Homo sapiens
ggtgacagtggagga

SEQ ID NO: 4188704 - DNA, 23 bp, Homo sapiens
ggtgacggtcctttaggcagcct

SEQ ID NO: 4188705 - DNA, 21 bp, Homo sapiens
ggtgagaacctgggttgcaga

SEQ ID NO: 4188706 - DNA, 12 bp, Homo sapiens
ggtgagagctgc

SEQ ID NO: 4188707 - DNA, 12 bp, Homo sapiens
ggtgagctcagc

SEQ ID NO: 4188708 - DNA, 13 bp, Homo sapiens
ggtgaggcccagc

SEQ ID NO: 4188709 - DNA, 14 bp, Homo sapiens
ggtgaggcccagcc

SEQ ID NO: 4188710 - DNA, 23 bp, Homo sapiens
ggtgatttcagactgcagagggg

SEQ ID NO: 4188711 - DNA, 15 bp, Homo sapiens
ggtgatttcagagag

SEQ ID NO: 4188712 - DNA, 16 bp, Homo sapiens
ggtgccatttctgaac

SEQ ID NO: 4188713 - DNA, 20 bp, Homo sapiens
ggtgcctcagagcaggctca

SEQ ID NO: 4188714 - DNA, 22 bp, Homo sapiens
ggtgcctggcttgctgtggcta

SEQ ID NO: 4188715 - DNA, 17 bp, Homo sapiens
ggtgctataggctggag

SEQ ID NO: 4188716 - DNA, 12 bp, Homo sapiens
ggtgctggagga

SEQ ID NO: 4188717 - DNA, 19 bp, Homo sapiens
ggtgctgtggccagggtga

SEQ ID NO: 4188718 - DNA, 19 bp, Homo sapiens
ggtggaaggcccgaggggc

SEQ ID NO: 4188719 - DNA, 16 bp, Homo sapiens
ggtggacacagaagtc

SEQ ID NO: 4188720 - DNA, 17 bp, Homo sapiens
ggtggaggttgcagtga

SEQ ID NO: 4188721 - DNA, 16 bp, Homo sapiens
ggtggatgggccctgc

SEQ ID NO: 4188722 - DNA, 22 bp, Homo sapiens
ggtggattcctgggcaagaacc

SEQ ID NO: 4188723 - DNA, 20 bp, Homo sapiens
ggtggcaagggggcggggcg

SEQ ID NO: 4188724 - DNA, 14 bp, Homo sapiens
ggtggcaggaccag

SEQ ID NO: 4188725 - DNA, 15 bp, Homo sapiens
ggtggcaggaccagg

SEQ ID NO: 4188726 - DNA, 17 bp, Homo sapiens
ggtggcaggaccaggac

SEQ ID NO: 4188727 - DNA, 19 bp, Homo sapiens
ggtggcgggcacctatagt

SEQ ID NO: 4188728 - DNA, 13 bp, Homo sapiens
ggtggctgagctt

SEQ ID NO: 4188729 - DNA, 22 bp, Homo sapiens
ggtgggaaatggtatgagctga

SEQ ID NO: 4188730 - DNA, 15 bp, Homo sapiens
ggtgggagagcccag

SEQ ID NO: 4188731 - DNA, 18 bp, Homo sapiens
ggtgggctgagccctggc

SEQ ID NO: 4188732 - DNA, 17 bp, Homo sapiens
ggtgggctggcccagcc

SEQ ID NO: 4188733 - DNA, 19 bp, Homo sapiens
ggtgggttctttggaagga

SEQ ID NO: 4188734 - DNA, 13 bp, Homo sapiens
ggtggtgccagag

SEQ ID NO: 4188735 - DNA, 21 bp, Homo sapiens
ggtggtttttggttacatgga

SEQ ID NO: 4188736 - DNA, 18 bp, Homo sapiens
ggtgtagctcctctgctg

SEQ ID NO: 4188737 - DNA, 23 bp, Homo sapiens
ggtgtagctcctctgctgctccc

SEQ ID NO: 4188738 - DNA, 13 bp, Homo sapiens
ggtgtcaccctgc

SEQ ID NO: 4188739 - DNA, 14 bp, Homo sapiens
ggtgtgcctgcagc

SEQ ID NO: 4188740 - DNA, 15 bp, Homo sapiens
ggtgtgcctgcagcc

SEQ ID NO: 4188741 - DNA, 15 bp, Homo sapiens
ggtgtgcctgccctg

SEQ ID NO: 4188742 - DNA, 17 bp, Homo sapiens
ggtgtggataaggctta

SEQ ID NO: 4188743 - DNA, 17 bp, Homo sapiens
ggttaagatctgaaagt

SEQ ID NO: 4188744 - DNA, 14 bp, Homo sapiens
ggttcaacttatta

SEQ ID NO: 4188745 - DNA, 19 bp, Homo sapiens
ggttcaagagacactgctt

SEQ ID NO: 4188746 - DNA, 23 bp, Homo sapiens
ggttcccattttcgctttcctct

SEQ ID NO: 4188747 - DNA, 13 bp, Homo sapiens
ggttccctctgag

SEQ ID NO: 4188748 - DNA, 16 bp, Homo sapiens
ggttccctctgagaat

SEQ ID NO: 4188749 - DNA, 16 bp, Homo sapiens
ggttcttgggagggaa

SEQ ID NO: 4188750 - DNA, 13 bp, Homo sapiens
ggttgcagggagc

SEQ ID NO: 4188751 - DNA, 11 bp, Homo sapiens
ggttgcagtga

SEQ ID NO: 4188752 - DNA, 11 bp, Homo sapiens
ggttgcccagc

SEQ ID NO: 4188753 - DNA, 19 bp, Homo sapiens
ggttgcttcaccttggagc

SEQ ID NO: 4188754 - DNA, 14 bp, Homo sapiens
ggttggggcaaagc

SEQ ID NO: 4188755 - DNA, 19 bp, Homo sapiens
ggttggggcaaagcctcct

SEQ ID NO: 4188756 - DNA, 14 bp, Homo sapiens
ggttggtgggctgg

SEQ ID NO: 4188757 - DNA, 14 bp, Homo sapiens
ggttgtgaggcctg

SEQ ID NO: 4188758 - DNA, 17 bp, Homo sapiens
ggtttaaaacagcctgg

SEQ ID NO: 4188759 - DNA, 13 bp, Homo sapiens
ggtttgtcaacac

SEQ ID NO: 4188760 - DNA, 13 bp, Homo sapiens
gtaaaaacaaaaa

SEQ ID NO: 4188761 - DNA, 21 bp, Homo sapiens
gtaaaactacacatccctaat

SEQ ID NO: 4188762 - DNA, 13 bp, Homo sapiens
gtaaaagctaatt

SEQ ID NO: 4188763 - DNA, 21 bp, Homo sapiens
gtaaagtatgtaaacaggaga

SEQ ID NO: 4188764 - DNA, 18 bp, Homo sapiens
gtaaataaattgtttgac

SEQ ID NO: 4188765 - DNA, 13 bp, Homo sapiens
gtaaatattttaa

SEQ ID NO: 4188766 - DNA, 15 bp, Homo sapiens
gtaaatcctttttct

SEQ ID NO: 4188767 - DNA, 16 bp, Homo sapiens
gtaaatcctttttctt

SEQ ID NO: 4188768 - DNA, 21 bp, Homo sapiens
gtaaatctaactacaaggaca

SEQ ID NO: 4188769 - DNA, 22 bp, Homo sapiens
gtaaatctaactacaaggacaa

SEQ ID NO: 4188770 - DNA, 12 bp, Homo sapiens
gtaaatggtatc

SEQ ID NO: 4188771 - DNA, 17 bp, Homo sapiens
gtaaatgtccaaaatgt

SEQ ID NO: 4188772 - DNA, 22 bp, Homo sapiens
gtaaattattaatttatgcaga

SEQ ID NO: 4188773 - DNA, 18 bp, Homo sapiens
gtaaattttgtatgaaaa

SEQ ID NO: 4188774 - DNA, 15 bp, Homo sapiens
gtaacagaagaggag

SEQ ID NO: 4188775 - DNA, 20 bp, Homo sapiens
gtaacagatatcagtgtctc

SEQ ID NO: 4188776 - DNA, 20 bp, Homo sapiens
gtaacatttggagtgtgtat

SEQ ID NO: 4188777 - DNA, 15 bp, Homo sapiens
gtaagaagaaagcaa

SEQ ID NO: 4188778 - DNA, 19 bp, Homo sapiens
gtaagcattctgagctggg

SEQ ID NO: 4188779 - DNA, 21 bp, Homo sapiens
gtaagcattctgagctgggct

SEQ ID NO: 4188780 - DNA, 16 bp, Homo sapiens
gtaagtaccacatcta

SEQ ID NO: 4188781 - DNA, 22 bp, Homo sapiens
gtaagtggcaggaccctgtcag

SEQ ID NO: 4188782 - DNA, 23 bp, Homo sapiens
gtaagttgaatggcctgccttga

SEQ ID NO: 4188783 - DNA, 19 bp, Homo sapiens
gtaagtttatgtctaaaga

SEQ ID NO: 4188784 - DNA, 19 bp, Homo sapiens
gtaatagaaaactgaaaat

SEQ ID NO: 4188785 - DNA, 17 bp, Homo sapiens
gtaatagattatagttg

SEQ ID NO: 4188786 - DNA, 15 bp, Homo sapiens
gtaatatattgctgc

SEQ ID NO: 4188787 - DNA, 14 bp, Homo sapiens
gtaatgagggactg

SEQ ID NO: 4188788 - DNA, 15 bp, Homo sapiens
gtaattatatctgtt

SEQ ID NO: 4188789 - DNA, 21 bp, Homo sapiens
gtaatttctgtgtattttgag

SEQ ID NO: 4188790 - DNA, 13 bp, Homo sapiens
gtaatttgtatct

SEQ ID NO: 4188791 - DNA, 14 bp, Homo sapiens
gtaatttgtatctg

SEQ ID NO: 4188792 - DNA, 20 bp, Homo sapiens
gtaatttttttgaaaaaagt

SEQ ID NO: 4188793 - DNA, 23 bp, Homo sapiens
gtacaaattatacataataaagt

SEQ ID NO: 4188794 - DNA, 15 bp, Homo sapiens
gtacaagctcaggag

SEQ ID NO: 4188795 - DNA, 17 bp, Homo sapiens
gtacaatcctttgagtt

SEQ ID NO: 4188796 - DNA, 19 bp, Homo sapiens
gtacatacgtgttctatag

SEQ ID NO: 4188797 - DNA, 19 bp, Homo sapiens
gtaccaaatccacaagcca

SEQ ID NO: 4188798 - DNA, 18 bp, Homo sapiens
gtacctatgtgacagaca

SEQ ID NO: 4188799 - DNA, 12 bp, Homo sapiens
gtacggctgctg

SEQ ID NO: 4188800 - DNA, 15 bp, Homo sapiens
gtacggctgctgcac

SEQ ID NO: 4188801 - DNA, 12 bp, Homo sapiens
gtacgtaatgta

SEQ ID NO: 4188802 - DNA, 23 bp, Homo sapiens
gtactcaggaggctgaggggagg

SEQ ID NO: 4188803 - DNA, 14 bp, Homo sapiens
gtactccagcaggt

SEQ ID NO: 4188804 - DNA, 14 bp, Homo sapiens
gtagaataataata

SEQ ID NO: 4188805 - DNA, 18 bp, Homo sapiens
gtagaattgggaagctgg

SEQ ID NO: 4188806 - DNA, 18 bp, Homo sapiens
gtagacacgctcttctat

SEQ ID NO: 4188807 - DNA, 13 bp, Homo sapiens
gtagagatgtgtg

SEQ ID NO: 4188808 - DNA, 17 bp, Homo sapiens
gtagatagaaagcaata

SEQ ID NO: 4188809 - DNA, 19 bp, Homo sapiens
gtagatcatggcagcatga

SEQ ID NO: 4188810 - DNA, 16 bp, Homo sapiens
gtagcacaaagaggga

SEQ ID NO: 4188811 - DNA, 12 bp, Homo sapiens
gtagcatgagag

SEQ ID NO: 4188812 - DNA, 14 bp, Homo sapiens
gtagccaaaggttc

SEQ ID NO: 4188813 - DNA, 14 bp, Homo sapiens
gtagccctttctgt

SEQ ID NO: 4188814 - DNA, 13 bp, Homo sapiens
gtagcgagctgct

SEQ ID NO: 4188815 - DNA, 17 bp, Homo sapiens
gtagctttcccaaataa

SEQ ID NO: 4188816 - DNA, 16 bp, Homo sapiens
gtaggaaatcaggcag

SEQ ID NO: 4188817 - DNA, 23 bp, Homo sapiens
gtaggaacccagctctcagggct

SEQ ID NO: 4188818 - DNA, 16 bp, Homo sapiens
gtaggattaatttatt

SEQ ID NO: 4188819 - DNA, 15 bp, Homo sapiens
gtaggtattaaagat

SEQ ID NO: 4188820 - DNA, 19 bp, Homo sapiens
gtaggtattaaagatgtgt

SEQ ID NO: 4188821 - DNA, 14 bp, Homo sapiens
gtaggtttgtagta

SEQ ID NO: 4188822 - DNA, 22 bp, Homo sapiens
gtagttaggaaataaaaccttt

SEQ ID NO: 4188823 - DNA, 14 bp, Homo sapiens
gtataaaagacaaa

SEQ ID NO: 4188824 - DNA, 18 bp, Homo sapiens
gtatagcatgcatctgtt

SEQ ID NO: 4188825 - DNA, 20 bp, Homo sapiens
gtatatactatacaacaatg

SEQ ID NO: 4188826 - DNA, 19 bp, Homo sapiens
gtatatcagaaaagggaag

SEQ ID NO: 4188827 - DNA, 14 bp, Homo sapiens
gtatatgtcattta

SEQ ID NO: 4188828 - DNA, 16 bp, Homo sapiens
gtatccgactctaagc

SEQ ID NO: 4188829 - DNA, 24 bp, Homo sapiens
gtatccgactctaagctgtgtgca

SEQ ID NO: 4188830 - DNA, 13 bp, Homo sapiens
gtatctctggcct

SEQ ID NO: 4188831 - DNA, 14 bp, Homo sapiens
gtatctgaaggaga

SEQ ID NO: 4188832 - DNA, 19 bp, Homo sapiens
gtatctgggtaagaagaaa

SEQ ID NO: 4188833 - DNA, 17 bp, Homo sapiens
gtatcttactctgtcca

SEQ ID NO: 4188834 - DNA, 16 bp, Homo sapiens
gtatgaacttgaggac

SEQ ID NO: 4188835 - DNA, 19 bp, Homo sapiens
gtatgaacttgaggacaca

SEQ ID NO: 4188836 - DNA, 22 bp, Homo sapiens
gtatgaacttgaggacacatgt

SEQ ID NO: 4188837 - DNA, 14 bp, Homo sapiens
gtatgggaagccat

SEQ ID NO: 4188838 - DNA, 11 bp, Homo sapiens
gtatgtgtgtg

SEQ ID NO: 4188839 - DNA, 13 bp, Homo sapiens
gtatgtgtgtggt

SEQ ID NO: 4188840 - DNA, 14 bp, Homo sapiens
gtattaaagatgtg

SEQ ID NO: 4188841 - DNA, 16 bp, Homo sapiens
gtattaaagatgtgtt

SEQ ID NO: 4188842 - DNA, 19 bp, Homo sapiens
gtattaggggtaatatatt

SEQ ID NO: 4188843 - DNA, 20 bp, Homo sapiens
gtattccttttgtgtacagt

SEQ ID NO: 4188844 - DNA, 23 bp, Homo sapiens
gtattgcgaaacaacttgtgttc

SEQ ID NO: 4188845 - DNA, 22 bp, Homo sapiens
gtattggggtcttttggctctg

SEQ ID NO: 4188846 - DNA, 18 bp, Homo sapiens
gtatttatatttggaaag

SEQ ID NO: 4188847 - DNA, 20 bp, Homo sapiens
gtatttatatttggaaagag

SEQ ID NO: 4188848 - DNA, 23 bp, Homo sapiens
gtatttgttaatttagaaaactt

SEQ ID NO: 4188849 - DNA, 16 bp, Homo sapiens
gtattttaaatgtttt

SEQ ID NO: 4188850 - DNA, 14 bp, Homo sapiens
gtattttggagaaa

SEQ ID NO: 4188851 - DNA, 18 bp, Homo sapiens
gtatttttgtatgtggca

SEQ ID NO: 4188852 - DNA, 15 bp, Homo sapiens
gtcaaaagctggatt

SEQ ID NO: 4188853 - DNA, 17 bp, Homo sapiens
gtcaacacaaagacatg

SEQ ID NO: 4188854 - DNA, 22 bp, Homo sapiens
gtcaacacaaagacatggaaga

SEQ ID NO: 4188855 - DNA, 14 bp, Homo sapiens
gtcaacactcttct

SEQ ID NO: 4188856 - DNA, 22 bp, Homo sapiens
gtcaacagttttcctatgcttt

SEQ ID NO: 4188857 - DNA, 21 bp, Homo sapiens
gtcaagatcaacattccaggg

SEQ ID NO: 4188858 - DNA, 22 bp, Homo sapiens
gtcaagcctgcagcgagctgag

SEQ ID NO: 4188859 - DNA, 24 bp, Homo sapiens
gtcaatccaatctgtaatttcact

SEQ ID NO: 4188860 - DNA, 18 bp, Homo sapiens
gtcacacctgacaaatgg

SEQ ID NO: 4188861 - DNA, 14 bp, Homo sapiens
gtcacattcaggaa

SEQ ID NO: 4188862 - DNA, 16 bp, Homo sapiens
gtcacattcaggaaga

SEQ ID NO: 4188863 - DNA, 20 bp, Homo sapiens
gtcacccaggctggagtaca

SEQ ID NO: 4188864 - DNA, 13 bp, Homo sapiens
gtcaccctgcaga

SEQ ID NO: 4188865 - DNA, 16 bp, Homo sapiens
gtcaccctgcagagct

SEQ ID NO: 4188866 - DNA, 19 bp, Homo sapiens
gtcactcttcctgcaagga

SEQ ID NO: 4188867 - DNA, 20 bp, Homo sapiens
gtcactcttcctgcaaggac

SEQ ID NO: 4188868 - DNA, 16 bp, Homo sapiens
gtcactggcagagcac

SEQ ID NO: 4188869 - DNA, 13 bp, Homo sapiens
gtcactgggttct

SEQ ID NO: 4188870 - DNA, 18 bp, Homo sapiens
gtcagaccagtactggga

SEQ ID NO: 4188871 - DNA, 17 bp, Homo sapiens
gtcagaccctaggaagc

SEQ ID NO: 4188872 - DNA, 21 bp, Homo sapiens
gtcagaccctaggaagctgga

SEQ ID NO: 4188873 - DNA, 14 bp, Homo sapiens
gtcagactgctggg

SEQ ID NO: 4188874 - DNA, 15 bp, Homo sapiens
gtcagactgctggga

SEQ ID NO: 4188875 - DNA, 18 bp, Homo sapiens
gtcagactggctggctgc

SEQ ID NO: 4188876 - DNA, 22 bp, Homo sapiens
gtcagactggctggctgcagtg

SEQ ID NO: 4188877 - DNA, 12 bp, Homo sapiens
gtcagagacaga

SEQ ID NO: 4188878 - DNA, 23 bp, Homo sapiens
gtcagcttccccaggagctctct

SEQ ID NO: 4188879 - DNA, 19 bp, Homo sapiens
gtcagctttgcttttcctg

SEQ ID NO: 4188880 - DNA, 14 bp, Homo sapiens
gtcatatcagcttt

SEQ ID NO: 4188881 - DNA, 21 bp, Homo sapiens
gtcatatcagctttatccctt

SEQ ID NO: 4188882 - DNA, 18 bp, Homo sapiens
gtcatatgtaggtgtctg

SEQ ID NO: 4188883 - DNA, 17 bp, Homo sapiens
gtcatcacttttcagtg

SEQ ID NO: 4188884 - DNA, 14 bp, Homo sapiens
gtcatcccctacac

SEQ ID NO: 4188885 - DNA, 17 bp, Homo sapiens
gtcatctcatgatacag

SEQ ID NO: 4188886 - DNA, 22 bp, Homo sapiens
gtcatgatttctgtgaagcaaa

SEQ ID NO: 4188887 - DNA, 21 bp, Homo sapiens
gtcatggtcctttctggaagt

SEQ ID NO: 4188888 - DNA, 15 bp, Homo sapiens
gtcattactaaccat

SEQ ID NO: 4188889 - DNA, 17 bp, Homo sapiens
gtcatttaccctggtgg

SEQ ID NO: 4188890 - DNA, 20 bp, Homo sapiens
gtcatttaccctggtggagg

SEQ ID NO: 4188891 - DNA, 20 bp, Homo sapiens
gtccagatgccttcctgtct

SEQ ID NO: 4188892 - DNA, 24 bp, Homo sapiens
gtccagtgggaggtgagaccacct

SEQ ID NO: 4188893 - DNA, 17 bp, Homo sapiens
gtcccacactggtgact

SEQ ID NO: 4188894 - DNA, 14 bp, Homo sapiens
gtccccagttgccg

SEQ ID NO: 4188895 - DNA, 17 bp, Homo sapiens
gtcccggttcaccttgc

SEQ ID NO: 4188896 - DNA, 20 bp, Homo sapiens
gtccctgagggcccttccca

SEQ ID NO: 4188897 - DNA, 20 bp, Homo sapiens
gtcccttggaaagttcagcc

SEQ ID NO: 4188898 - DNA, 23 bp, Homo sapiens
gtcccttggaaagttcagccaga

SEQ ID NO: 4188899 - DNA, 20 bp, Homo sapiens
gtcccttgtttccagctaga

SEQ ID NO: 4188900 - DNA, 17 bp, Homo sapiens
gtccgccaaacactcca

SEQ ID NO: 4188901 - DNA, 21 bp, Homo sapiens
gtccgcctctgcccgcagagc

SEQ ID NO: 4188902 - DNA, 22 bp, Homo sapiens
gtccgcctctgcccgcagagcc

SEQ ID NO: 4188903 - DNA, 13 bp, Homo sapiens
gtccgctcagcca

SEQ ID NO: 4188904 - DNA, 18 bp, Homo sapiens
gtcctagcaggatctgcc

SEQ ID NO: 4188905 - DNA, 22 bp, Homo sapiens
gtcctaggccacaccatctcct

SEQ ID NO: 4188906 - DNA, 21 bp, Homo sapiens
gtcctgcccccgacagcccag

SEQ ID NO: 4188907 - DNA, 23 bp, Homo sapiens
gtcctgcccccgacagcccagcc

SEQ ID NO: 4188908 - DNA, 18 bp, Homo sapiens
gtcctgcctctctgctcc

SEQ ID NO: 4188909 - DNA, 19 bp, Homo sapiens
gtcctgcctctctgctcca

SEQ ID NO: 4188910 - DNA, 20 bp, Homo sapiens
gtcctggcttctagatctgg

SEQ ID NO: 4188911 - DNA, 20 bp, Homo sapiens
gtcctgggagaacctcaggc

SEQ ID NO: 4188912 - DNA, 21 bp, Homo sapiens
gtcctgggagaacctcaggct

SEQ ID NO: 4188913 - DNA, 17 bp, Homo sapiens
gtcctggggctctgtgc

SEQ ID NO: 4188914 - DNA, 20 bp, Homo sapiens
gtcctgggggctgctgcact

SEQ ID NO: 4188915 - DNA, 16 bp, Homo sapiens
gtcctggtacagcagg

SEQ ID NO: 4188916 - DNA, 18 bp, Homo sapiens
gtcctggtacagcagggt

SEQ ID NO: 4188917 - DNA, 19 bp, Homo sapiens
gtcctgtcagcttccccag

SEQ ID NO: 4188918 - DNA, 17 bp, Homo sapiens
gtcctgtcctggctccc

SEQ ID NO: 4188919 - DNA, 15 bp, Homo sapiens
gtcctgtgaatttct

SEQ ID NO: 4188920 - DNA, 19 bp, Homo sapiens
gtccttattatcccagctt

SEQ ID NO: 4188921 - DNA, 18 bp, Homo sapiens
gtccttctcgtttgctct

SEQ ID NO: 4188922 - DNA, 22 bp, Homo sapiens
gtccttggtgtgaccctctgaa

SEQ ID NO: 4188923 - DNA, 16 bp, Homo sapiens
gtcctttaggcagcct

SEQ ID NO: 4188924 - DNA, 17 bp, Homo sapiens
gtcctttaggcagcctg

SEQ ID NO: 4188925 - DNA, 17 bp, Homo sapiens
gtccttttaaagttgga

SEQ ID NO: 4188926 - DNA, 22 bp, Homo sapiens
gtccttttgtaccatggtgtga

SEQ ID NO: 4188927 - DNA, 23 bp, Homo sapiens
gtcgcgcgcagcgcgtgcacagc

SEQ ID NO: 4188928 - DNA, 16 bp, Homo sapiens
gtctaaagagaacaag

SEQ ID NO: 4188929 - DNA, 18 bp, Homo sapiens
gtctaaagagaacaagag

SEQ ID NO: 4188930 - DNA, 17 bp, Homo sapiens
gtctaggattgggcctc

SEQ ID NO: 4188931 - DNA, 18 bp, Homo sapiens
gtctatagagaaaaactt

SEQ ID NO: 4188932 - DNA, 15 bp, Homo sapiens
gtctcaagactgaaa

SEQ ID NO: 4188933 - DNA, 11 bp, Homo sapiens
gtctcagaaga

SEQ ID NO: 4188934 - DNA, 13 bp, Homo sapiens
gtctcagaagagg

SEQ ID NO: 4188935 - DNA, 14 bp, Homo sapiens
gtctcagaagaggt

SEQ ID NO: 4188936 - DNA, 12 bp, Homo sapiens
gtctcaggagca

SEQ ID NO: 4188937 - DNA, 16 bp, Homo sapiens
gtctcaggagcatggg

SEQ ID NO: 4188938 - DNA, 16 bp, Homo sapiens
gtctcagtccagatgc

SEQ ID NO: 4188939 - DNA, 19 bp, Homo sapiens
gtctccactgaggatgtga

SEQ ID NO: 4188940 - DNA, 16 bp, Homo sapiens
gtctccttacctgtgg

SEQ ID NO: 4188941 - DNA, 21 bp, Homo sapiens
gtctcctttctcagccacaaa

SEQ ID NO: 4188942 - DNA, 14 bp, Homo sapiens
gtctctagccactt

SEQ ID NO: 4188943 - DNA, 14 bp, Homo sapiens
gtctctagccgggc

SEQ ID NO: 4188944 - DNA, 19 bp, Homo sapiens
gtctgaggccccaggccct

SEQ ID NO: 4188945 - DNA, 14 bp, Homo sapiens
gtctgatgtttgtt

SEQ ID NO: 4188946 - DNA, 20 bp, Homo sapiens
gtctgattggctcacccaag

SEQ ID NO: 4188947 - DNA, 22 bp, Homo sapiens
gtctgatttcaggatactctgt

SEQ ID NO: 4188948 - DNA, 17 bp, Homo sapiens
gtctgcacccaggggtg

SEQ ID NO: 4188949 - DNA, 18 bp, Homo sapiens
gtctgccttaggctgctg

SEQ ID NO: 4188950 - DNA, 19 bp, Homo sapiens
gtctgccttaggctgctgg

SEQ ID NO: 4188951 - DNA, 20 bp, Homo sapiens
gtctgccttaggctgctggg

SEQ ID NO: 4188952 - DNA, 17 bp, Homo sapiens
gtctgctatattttcat

SEQ ID NO: 4188953 - DNA, 16 bp, Homo sapiens
gtctgctatcattatt

SEQ ID NO: 4188954 - DNA, 13 bp, Homo sapiens
gtctggaagaaga

SEQ ID NO: 4188955 - DNA, 16 bp, Homo sapiens
gtctggaagaagagga

SEQ ID NO: 4188956 - DNA, 19 bp, Homo sapiens
gtctggaagaagaggagga

SEQ ID NO: 4188957 - DNA, 15 bp, Homo sapiens
gtctggcccctccgc

SEQ ID NO: 4188958 - DNA, 15 bp, Homo sapiens
gtctggctgagctga

SEQ ID NO: 4188959 - DNA, 14 bp, Homo sapiens
gtctgggagagcct

SEQ ID NO: 4188960 - DNA, 17 bp, Homo sapiens
gtctgggagagcctggc

SEQ ID NO: 4188961 - DNA, 20 bp, Homo sapiens
gtctgggagagcctggcaag

SEQ ID NO: 4188962 - DNA, 11 bp, Homo sapiens
gtctggtgtag

SEQ ID NO: 4188963 - DNA, 13 bp, Homo sapiens
gtctgtcctcaga

SEQ ID NO: 4188964 - DNA, 16 bp, Homo sapiens
gtctgtggattttttc

SEQ ID NO: 4188965 - DNA, 22 bp, Homo sapiens
gtctgtgttgcgtgtcgtgggt

SEQ ID NO: 4188966 - DNA, 12 bp, Homo sapiens
gtctgtttactg

SEQ ID NO: 4188967 - DNA, 13 bp, Homo sapiens
gtctgtttactgc

SEQ ID NO: 4188968 - DNA, 23 bp, Homo sapiens
gtcttaagccttttgctcacaaa

SEQ ID NO: 4188969 - DNA, 17 bp, Homo sapiens
gtcttcactgccatgcc

SEQ ID NO: 4188970 - DNA, 16 bp, Homo sapiens
gtcttcttgtgtcctg

SEQ ID NO: 4188971 - DNA, 19 bp, Homo sapiens
gtcttcttgtgtcctgatg

SEQ ID NO: 4188972 - DNA, 16 bp, Homo sapiens
gtctttgggcagggaa

SEQ ID NO: 4188973 - DNA, 18 bp, Homo sapiens
gtgaaacaattattgtac

SEQ ID NO: 4188974 - DNA, 17 bp, Homo sapiens
gtgaaaccctgtctcta

SEQ ID NO: 4188975 - DNA, 23 bp, Homo sapiens
gtgaaataccacaagcctgagaa

SEQ ID NO: 4188976 - DNA, 18 bp, Homo sapiens
gtgaacagagagaaccag

SEQ ID NO: 4188977 - DNA, 20 bp, Homo sapiens
gtgaacagagagaaccagga

SEQ ID NO: 4188978 - DNA, 15 bp, Homo sapiens
gtgaactggaagaaa

SEQ ID NO: 4188979 - DNA, 14 bp, Homo sapiens
gtgaagaatacttc

SEQ ID NO: 4188980 - DNA, 22 bp, Homo sapiens
gtgaattgcctgcagagagaag

SEQ ID NO: 4188981 - DNA, 20 bp, Homo sapiens
gtgaatttaatgcttaaaaa

SEQ ID NO: 4188982 - DNA, 13 bp, Homo sapiens
gtgaatttctgat

SEQ ID NO: 4188983 - DNA, 19 bp, Homo sapiens
gtgaatttcttcactgttg

SEQ ID NO: 4188984 - DNA, 19 bp, Homo sapiens
gtgacaaaaggctcggaat

SEQ ID NO: 4188985 - DNA, 14 bp, Homo sapiens
gtgacacaaacaca

SEQ ID NO: 4188986 - DNA, 13 bp, Homo sapiens
gtgaccctctgaa

SEQ ID NO: 4188987 - DNA, 20 bp, Homo sapiens
gtgacggtcctttaggcagc

SEQ ID NO: 4188988 - DNA, 13 bp, Homo sapiens
gtgagaccacctc

SEQ ID NO: 4188989 - DNA, 20 bp, Homo sapiens
gtgagaccacctctcaatat

SEQ ID NO: 4188990 - DNA, 16 bp, Homo sapiens
gtgagaccctgtctct

SEQ ID NO: 4188991 - DNA, 15 bp, Homo sapiens
gtgagatgtaattgt

SEQ ID NO: 4188992 - DNA, 19 bp, Homo sapiens
gtgagctgagatcacgcca

SEQ ID NO: 4188993 - DNA, 14 bp, Homo sapiens
gtgaggcctggcca

SEQ ID NO: 4188994 - DNA, 16 bp, Homo sapiens
gtgaggttgtgctgcc

SEQ ID NO: 4188995 - DNA, 17 bp, Homo sapiens
gtgagtgaatggcaaag

SEQ ID NO: 4188996 - DNA, 17 bp, Homo sapiens
gtgagttacagcgagag

SEQ ID NO: 4188997 - DNA, 19 bp, Homo sapiens
gtgagtttaggcagcttct

SEQ ID NO: 4188998 - DNA, 21 bp, Homo sapiens
gtgataaatctagaaaattga

SEQ ID NO: 4188999 - DNA, 18 bp, Homo sapiens
gtgatttagaactgtatg

SEQ ID NO: 4189000 - DNA, 19 bp, Homo sapiens
gtgatttcagactgcagag

SEQ ID NO: 4189001 - DNA, 12 bp, Homo sapiens
gtgatttctgag

SEQ ID NO: 4189002 - DNA, 23 bp, Homo sapiens
gtgcaaaaataaaaggaaaacca

SEQ ID NO: 4189003 - DNA, 20 bp, Homo sapiens
gtgcaacaagagcaaaatga

SEQ ID NO: 4189004 - DNA, 20 bp, Homo sapiens
gtgcaagagactctggcctc

SEQ ID NO: 4189005 - DNA, 22 bp, Homo sapiens
gtgcaagagactctggcctcca

SEQ ID NO: 4189006 - DNA, 21 bp, Homo sapiens
gtgcacctgtactcaggaggc

SEQ ID NO: 4189007 - DNA, 16 bp, Homo sapiens
gtgcactggccccacc

SEQ ID NO: 4189008 - DNA, 13 bp, Homo sapiens
gtgcagagctggg

SEQ ID NO: 4189009 - DNA, 17 bp, Homo sapiens
gtgcagagctggggctg

SEQ ID NO: 4189010 - DNA, 20 bp, Homo sapiens
gtgcatccacgcacacatgg

SEQ ID NO: 4189011 - DNA, 14 bp, Homo sapiens
gtgcatgtatgtgt

SEQ ID NO: 4189012 - DNA, 22 bp, Homo sapiens
gtgcatgtatgtgtgtgtgtat

SEQ ID NO: 4189013 - DNA, 15 bp, Homo sapiens
gtgccacagagaaga

SEQ ID NO: 4189014 - DNA, 11 bp, Homo sapiens
gtgccagaggt

SEQ ID NO: 4189015 - DNA, 13 bp, Homo sapiens
gtgccagcgctgg

SEQ ID NO: 4189016 - DNA, 17 bp, Homo sapiens
gtgccaggactccccag

SEQ ID NO: 4189017 - DNA, 13 bp, Homo sapiens
gtgccccatgtcc

SEQ ID NO: 4189018 - DNA, 20 bp, Homo sapiens
gtgccctccacagccgcagc

SEQ ID NO: 4189019 - DNA, 21 bp, Homo sapiens
gtgccctttggggttgcccag

SEQ ID NO: 4189020 - DNA, 17 bp, Homo sapiens
gtgccgggagaggactc

SEQ ID NO: 4189021 - DNA, 16 bp, Homo sapiens
gtgcctagactgttac

SEQ ID NO: 4189022 - DNA, 18 bp, Homo sapiens
gtgcctagactgttactt

SEQ ID NO: 4189023 - DNA, 21 bp, Homo sapiens
gtgcctttctctggctccaga

SEQ ID NO: 4189024 - DNA, 14 bp, Homo sapiens
gtgccttttatagc

SEQ ID NO: 4189025 - DNA, 15 bp, Homo sapiens
gtgcggtggctcacg

SEQ ID NO: 4189026 - DNA, 20 bp, Homo sapiens
gtgctactccatgcaggggt

SEQ ID NO: 4189027 - DNA, 16 bp, Homo sapiens
gtgctatggtgctctg

SEQ ID NO: 4189028 - DNA, 16 bp, Homo sapiens
gtgctcctgtccctcc

SEQ ID NO: 4189029 - DNA, 14 bp, Homo sapiens
gtgctgacctctgg

SEQ ID NO: 4189030 - DNA, 14 bp, Homo sapiens
gtgctgatccggct

SEQ ID NO: 4189031 - DNA, 15 bp, Homo sapiens
gtgctgatccggctg

SEQ ID NO: 4189032 - DNA, 17 bp, Homo sapiens
gtgctgtggccagggtg

SEQ ID NO: 4189033 - DNA, 23 bp, Homo sapiens
gtgctgtggccagggtgagagct

SEQ ID NO: 4189034 - DNA, 13 bp, Homo sapiens
gtgcttcagcctg

SEQ ID NO: 4189035 - DNA, 20 bp, Homo sapiens
gtgcttccctaggctgagct

SEQ ID NO: 4189036 - DNA, 18 bp, Homo sapiens
gtgcttgatagaaatgcc

SEQ ID NO: 4189037 - DNA, 20 bp, Homo sapiens
gtgctttcaggtctggggct

SEQ ID NO: 4189038 - DNA, 19 bp, Homo sapiens
gtggaaaaatcagaagcac

SEQ ID NO: 4189039 - DNA, 20 bp, Homo sapiens
gtggaaaagaatccctgcag

SEQ ID NO: 4189040 - DNA, 13 bp, Homo sapiens
gtggacacctgcc

SEQ ID NO: 4189041 - DNA, 13 bp, Homo sapiens
gtggacagtcctg

SEQ ID NO: 4189042 - DNA, 16 bp, Homo sapiens
gtggacagtcctggga

SEQ ID NO: 4189043 - DNA, 14 bp, Homo sapiens
gtggagacagccct

SEQ ID NO: 4189044 - DNA, 15 bp, Homo sapiens
gtggatcacctgagg

SEQ ID NO: 4189045 - DNA, 23 bp, Homo sapiens
gtggatctccaaggaccaggtta

SEQ ID NO: 4189046 - DNA, 17 bp, Homo sapiens
gtggatctgtccaagga

SEQ ID NO: 4189047 - DNA, 16 bp, Homo sapiens
gtggatgggccctgca

SEQ ID NO: 4189048 - DNA, 19 bp, Homo sapiens
gtggattcctgggcaagaa

SEQ ID NO: 4189049 - DNA, 13 bp, Homo sapiens
gtggcaagggggc

SEQ ID NO: 4189050 - DNA, 15 bp, Homo sapiens
gtggcaagggggcgg

SEQ ID NO: 4189051 - DNA, 21 bp, Homo sapiens
gtggcagataatcagcctctt

SEQ ID NO: 4189052 - DNA, 20 bp, Homo sapiens
gtggcatggcagaatgaaaa

SEQ ID NO: 4189053 - DNA, 13 bp, Homo sapiens
gtggccaagcctg

SEQ ID NO: 4189054 - DNA, 18 bp, Homo sapiens
gtggccatcagggtgggc

SEQ ID NO: 4189055 - DNA, 23 bp, Homo sapiens
gtggcccagtcgtccgctcagcc

SEQ ID NO: 4189056 - DNA, 12 bp, Homo sapiens
gtggcctgggca

SEQ ID NO: 4189057 - DNA, 14 bp, Homo sapiens
gtggctctggacag

SEQ ID NO: 4189058 - DNA, 16 bp, Homo sapiens
gtggctgagcttggcc

SEQ ID NO: 4189059 - DNA, 21 bp, Homo sapiens
gtggctggcctttcaggtcca

SEQ ID NO: 4189060 - DNA, 15 bp, Homo sapiens
gtggcttacaaattc

SEQ ID NO: 4189061 - DNA, 20 bp, Homo sapiens
gtggcttttttcctcctgtg

SEQ ID NO: 4189062 - DNA, 17 bp, Homo sapiens
gtgggaactcactttcc

SEQ ID NO: 4189063 - DNA, 14 bp, Homo sapiens
gtgggaagcaagca

SEQ ID NO: 4189064 - DNA, 21 bp, Homo sapiens
gtgggacaaaccagagcagag

SEQ ID NO: 4189065 - DNA, 18 bp, Homo sapiens
gtgggagctcagctcgct

SEQ ID NO: 4189066 - DNA, 17 bp, Homo sapiens
gtgggaggtgagaccac

SEQ ID NO: 4189067 - DNA, 15 bp, Homo sapiens
gtgggcggggagaag

SEQ ID NO: 4189068 - DNA, 15 bp, Homo sapiens
gtgggctccctggcc

SEQ ID NO: 4189069 - DNA, 14 bp, Homo sapiens
gtgggctgagccct

SEQ ID NO: 4189070 - DNA, 18 bp, Homo sapiens
gtgggctgagccctggca

SEQ ID NO: 4189071 - DNA, 15 bp, Homo sapiens
gtgggctgcatctgg

SEQ ID NO: 4189072 - DNA, 13 bp, Homo sapiens
gtggggccttggt

SEQ ID NO: 4189073 - DNA, 17 bp, Homo sapiens
gtggggggtggacacag

SEQ ID NO: 4189074 - DNA, 19 bp, Homo sapiens
gtgggtatttcctgctaca

SEQ ID NO: 4189075 - DNA, 16 bp, Homo sapiens
gtgggtggtggatctg

SEQ ID NO: 4189076 - DNA, 15 bp, Homo sapiens
gtggtgaagaaaact

SEQ ID NO: 4189077 - DNA, 22 bp, Homo sapiens
gtggtgaggtcctgtcctggct

SEQ ID NO: 4189078 - DNA, 21 bp, Homo sapiens
gtggtgaggttgtgctgcctg

SEQ ID NO: 4189079 - DNA, 20 bp, Homo sapiens
gtggtggatctgtccaagga

SEQ ID NO: 4189080 - DNA, 14 bp, Homo sapiens
gtggtgtgtgtgct

SEQ ID NO: 4189081 - DNA, 21 bp, Homo sapiens
gtggtgtttgtaggctgtggg

SEQ ID NO: 4189082 - DNA, 12 bp, Homo sapiens
gtgtacagtgtg

SEQ ID NO: 4189083 - DNA, 16 bp, Homo sapiens
gtgtagcaactacagt

SEQ ID NO: 4189084 - DNA, 14 bp, Homo sapiens
gtgtagccaaggtc

SEQ ID NO: 4189085 - DNA, 17 bp, Homo sapiens
gtgtagccacaccagga

SEQ ID NO: 4189086 - DNA, 16 bp, Homo sapiens
gtgtagccttgcccgg

SEQ ID NO: 4189087 - DNA, 16 bp, Homo sapiens
gtgtcaagacatttct

SEQ ID NO: 4189088 - DNA, 15 bp, Homo sapiens
gtgtcaccctgcaga

SEQ ID NO: 4189089 - DNA, 15 bp, Homo sapiens
gtgtcactcaaggcg

SEQ ID NO: 4189090 - DNA, 21 bp, Homo sapiens
gtgtcactcaaggcggtgctt

SEQ ID NO: 4189091 - DNA, 15 bp, Homo sapiens
gtgtcctctccctgc

SEQ ID NO: 4189092 - DNA, 22 bp, Homo sapiens
gtgtctccccgtgtcctctccc

SEQ ID NO: 4189093 - DNA, 15 bp, Homo sapiens
gtgtctgatgtttgt

SEQ ID NO: 4189094 - DNA, 14 bp, Homo sapiens
gtgtctgcacccag

SEQ ID NO: 4189095 - DNA, 17 bp, Homo sapiens
gtgtctgggagagcctg

SEQ ID NO: 4189096 - DNA, 19 bp, Homo sapiens
gtgtctgggagagcctggc

SEQ ID NO: 4189097 - DNA, 21 bp, Homo sapiens
gtgtctgggagagcctggcaa

SEQ ID NO: 4189098 - DNA, 22 bp, Homo sapiens
gtgtctgggagagcctggcaag

SEQ ID NO: 4189099 - DNA, 18 bp, Homo sapiens
gtgtgaaagtcagatgcc

SEQ ID NO: 4189100 - DNA, 23 bp, Homo sapiens
gtgtgactctcttggattattta

SEQ ID NO: 4189101 - DNA, 17 bp, Homo sapiens
gtgtgatcccaagtgcc

SEQ ID NO: 4189102 - DNA, 17 bp, Homo sapiens
gtgtgatgaactttctc

SEQ ID NO: 4189103 - DNA, 15 bp, Homo sapiens
gtgtgcctgcagccc

SEQ ID NO: 4189104 - DNA, 14 bp, Homo sapiens
gtgtgggctgtgtc

SEQ ID NO: 4189105 - DNA, 22 bp, Homo sapiens
gtgtggtgtcaccagcctgttt

SEQ ID NO: 4189106 - DNA, 19 bp, Homo sapiens
gtgtgtctgtgcgtctgtg

SEQ ID NO: 4189107 - DNA, 21 bp, Homo sapiens
gtgtgttttgagagtatatta

SEQ ID NO: 4189108 - DNA, 12 bp, Homo sapiens
gtgttaattttt

SEQ ID NO: 4189109 - DNA, 20 bp, Homo sapiens
gtgttataatgggtaatata

SEQ ID NO: 4189110 - DNA, 15 bp, Homo sapiens
gtgttattatttggc

SEQ ID NO: 4189111 - DNA, 17 bp, Homo sapiens
gtgttccagctgcctgg

SEQ ID NO: 4189112 - DNA, 21 bp, Homo sapiens
gtgttcctataaaatcaaaga

SEQ ID NO: 4189113 - DNA, 14 bp, Homo sapiens
gtgtttaacattca

SEQ ID NO: 4189114 - DNA, 13 bp, Homo sapiens
gtgtttgctttct

SEQ ID NO: 4189115 - DNA, 18 bp, Homo sapiens
gtgttttctgaataacat

SEQ ID NO: 4189116 - DNA, 19 bp, Homo sapiens
gtgttttctgaataacatt

SEQ ID NO: 4189117 - DNA, 18 bp, Homo sapiens
gttaaattccatatgctc

SEQ ID NO: 4189118 - DNA, 15 bp, Homo sapiens
gttaacattaacatc

SEQ ID NO: 4189119 - DNA, 17 bp, Homo sapiens
gttaactttaagactga

SEQ ID NO: 4189120 - DNA, 19 bp, Homo sapiens
gttaagatctgaaagtttt

SEQ ID NO: 4189121 - DNA, 13 bp, Homo sapiens
gttaagggaagga

SEQ ID NO: 4189122 - DNA, 12 bp, Homo sapiens
gttaatttttga

SEQ ID NO: 4189123 - DNA, 17 bp, Homo sapiens
gttacaacttgtatttc

SEQ ID NO: 4189124 - DNA, 21 bp, Homo sapiens
gttacagcgagaggcagagaa

SEQ ID NO: 4189125 - DNA, 14 bp, Homo sapiens
gttactgattctcc

SEQ ID NO: 4189126 - DNA, 18 bp, Homo sapiens
gttagagaggtagcgagc

SEQ ID NO: 4189127 - DNA, 21 bp, Homo sapiens
gttagagaggtagcgagctgc

SEQ ID NO: 4189128 - DNA, 20 bp, Homo sapiens
gttagctcaggaggcttgga

SEQ ID NO: 4189129 - DNA, 14 bp, Homo sapiens
gttaggaaataaaa

SEQ ID NO: 4189130 - DNA, 22 bp, Homo sapiens
gttaggaaataaaacctttcaa

SEQ ID NO: 4189131 - DNA, 14 bp, Homo sapiens
gttagtttttactt

SEQ ID NO: 4189132 - DNA, 17 bp, Homo sapiens
gttatatattttttgta

SEQ ID NO: 4189133 - DNA, 19 bp, Homo sapiens
gttatattttctattacac

SEQ ID NO: 4189134 - DNA, 14 bp, Homo sapiens
gttatctttttgtg

SEQ ID NO: 4189135 - DNA, 15 bp, Homo sapiens
gttatttacttgaaa

SEQ ID NO: 4189136 - DNA, 20 bp, Homo sapiens
gttatttgtacagttcagtt

SEQ ID NO: 4189137 - DNA, 14 bp, Homo sapiens
gttattttcagtat

SEQ ID NO: 4189138 - DNA, 15 bp, Homo sapiens
gttattttcagtatt

SEQ ID NO: 4189139 - DNA, 16 bp, Homo sapiens
gttcaagaaataagtt

SEQ ID NO: 4189140 - DNA, 13 bp, Homo sapiens
gttcaagaagact

SEQ ID NO: 4189141 - DNA, 18 bp, Homo sapiens
gttcaaggaccacatgtg

SEQ ID NO: 4189142 - DNA, 19 bp, Homo sapiens
gttcatatttatactttgc

SEQ ID NO: 4189143 - DNA, 23 bp, Homo sapiens
gttccaaataaggatttgttcac

SEQ ID NO: 4189144 - DNA, 16 bp, Homo sapiens
gttccagctgcctggg

SEQ ID NO: 4189145 - DNA, 18 bp, Homo sapiens
gttccagctgcctgggag

SEQ ID NO: 4189146 - DNA, 23 bp, Homo sapiens
gttccatgaagaccacatccaca

SEQ ID NO: 4189147 - DNA, 13 bp, Homo sapiens
gttccatgttaaa

SEQ ID NO: 4189148 - DNA, 18 bp, Homo sapiens
gttcccaatatgtagcct

SEQ ID NO: 4189149 - DNA, 14 bp, Homo sapiens
gttcccgagggagc

SEQ ID NO: 4189150 - DNA, 19 bp, Homo sapiens
gttcccgagggagctgctg

SEQ ID NO: 4189151 - DNA, 22 bp, Homo sapiens
gttcccgagggagctgctggct

SEQ ID NO: 4189152 - DNA, 14 bp, Homo sapiens
gttcctgcactcca

SEQ ID NO: 4189153 - DNA, 21 bp, Homo sapiens
gttcctttttcaacttggaaa

SEQ ID NO: 4189154 - DNA, 16 bp, Homo sapiens
gttcgagaccagcctg

SEQ ID NO: 4189155 - DNA, 19 bp, Homo sapiens
gttcgagaccagcctggcc

SEQ ID NO: 4189156 - DNA, 14 bp, Homo sapiens
gttctaatattttt

SEQ ID NO: 4189157 - DNA, 18 bp, Homo sapiens
gttctatagagcctggcg

SEQ ID NO: 4189158 - DNA, 14 bp, Homo sapiens
gttctgcgttacaa

SEQ ID NO: 4189159 - DNA, 12 bp, Homo sapiens
gttctgtatttt

SEQ ID NO: 4189160 - DNA, 18 bp, Homo sapiens
gttctgtgacccatctgt

SEQ ID NO: 4189161 - DNA, 13 bp, Homo sapiens
gttcttgatgaca

SEQ ID NO: 4189162 - DNA, 16 bp, Homo sapiens
gttcttggtaactgat

SEQ ID NO: 4189163 - DNA, 23 bp, Homo sapiens
gttctttactggtgatttctgag

SEQ ID NO: 4189164 - DNA, 19 bp, Homo sapiens
gttctttataaaaagtgaa

SEQ ID NO: 4189165 - DNA, 21 bp, Homo sapiens
gttcttttttgttacagctat

SEQ ID NO: 4189166 - DNA, 19 bp, Homo sapiens
gttgaacatctcactttgc

SEQ ID NO: 4189167 - DNA, 15 bp, Homo sapiens
gttgaatgacaacag

SEQ ID NO: 4189168 - DNA, 19 bp, Homo sapiens
gttgaatgacaacagaagc

SEQ ID NO: 4189169 - DNA, 16 bp, Homo sapiens
gttgaatggcctgcct

SEQ ID NO: 4189170 - DNA, 19 bp, Homo sapiens
gttgacccctttcccccac

SEQ ID NO: 4189171 - DNA, 23 bp, Homo sapiens
gttgacccctttcccccacccca

SEQ ID NO: 4189172 - DNA, 18 bp, Homo sapiens
gttgaggggctcctggaa

SEQ ID NO: 4189173 - DNA, 16 bp, Homo sapiens
gttgatcataattaaa

SEQ ID NO: 4189174 - DNA, 19 bp, Homo sapiens
gttgattctgaatctgaaa

SEQ ID NO: 4189175 - DNA, 21 bp, Homo sapiens
gttgccacaccaatcagagag

SEQ ID NO: 4189176 - DNA, 12 bp, Homo sapiens
gttgcccagcct

SEQ ID NO: 4189177 - DNA, 14 bp, Homo sapiens
gttgcccagcctgg

SEQ ID NO: 4189178 - DNA, 18 bp, Homo sapiens
gttgcgggggagctggaa

SEQ ID NO: 4189179 - DNA, 14 bp, Homo sapiens
gttgcttctggctc

SEQ ID NO: 4189180 - DNA, 17 bp, Homo sapiens
gttgcttctggctcctc

SEQ ID NO: 4189181 - DNA, 14 bp, Homo sapiens
gttggacttcagtc

SEQ ID NO: 4189182 - DNA, 17 bp, Homo sapiens
gttggggcaaagcctcc

SEQ ID NO: 4189183 - DNA, 15 bp, Homo sapiens
gttgggttcatctga

SEQ ID NO: 4189184 - DNA, 20 bp, Homo sapiens
gttggtgaacagagagaacc

SEQ ID NO: 4189185 - DNA, 18 bp, Homo sapiens
gttggtgggctggcccag

SEQ ID NO: 4189186 - DNA, 19 bp, Homo sapiens
gttggtttccaaaaaggaa

SEQ ID NO: 4189187 - DNA, 16 bp, Homo sapiens
gttgtaaataaaagta

SEQ ID NO: 4189188 - DNA, 14 bp, Homo sapiens
gttgtacaagctca

SEQ ID NO: 4189189 - DNA, 22 bp, Homo sapiens
gttgtgaggcctggccaggcac

SEQ ID NO: 4189190 - DNA, 22 bp, Homo sapiens
gttgtgcttgctggtactaaga

SEQ ID NO: 4189191 - DNA, 15 bp, Homo sapiens
gttgttactgattct

SEQ ID NO: 4189192 - DNA, 16 bp, Homo sapiens
gttgttactgattctc

SEQ ID NO: 4189193 - DNA, 13 bp, Homo sapiens
gttgttgttgttt

SEQ ID NO: 4189194 - DNA, 18 bp, Homo sapiens
gtttaaattattttatca

SEQ ID NO: 4189195 - DNA, 16 bp, Homo sapiens
gtttaacattcacagc

SEQ ID NO: 4189196 - DNA, 19 bp, Homo sapiens
gtttaacattcacagccca

SEQ ID NO: 4189197 - DNA, 14 bp, Homo sapiens
gtttaatactcaga

SEQ ID NO: 4189198 - DNA, 11 bp, Homo sapiens
gtttacagaat

SEQ ID NO: 4189199 - DNA, 15 bp, Homo sapiens
gtttacagtaaataa

SEQ ID NO: 4189200 - DNA, 19 bp, Homo sapiens
gtttacatgaacacagctg

SEQ ID NO: 4189201 - DNA, 13 bp, Homo sapiens
gtttacatgcaga

SEQ ID NO: 4189202 - DNA, 16 bp, Homo sapiens
gtttactaaagagaca

SEQ ID NO: 4189203 - DNA, 14 bp, Homo sapiens
gtttacttcatgag

SEQ ID NO: 4189204 - DNA, 17 bp, Homo sapiens
gtttacttttcagggca

SEQ ID NO: 4189205 - DNA, 15 bp, Homo sapiens
gtttagaagcgctca

SEQ ID NO: 4189206 - DNA, 19 bp, Homo sapiens
gtttagcccttccctgcct

SEQ ID NO: 4189207 - DNA, 21 bp, Homo sapiens
gtttatagagggccaagactt

SEQ ID NO: 4189208 - DNA, 17 bp, Homo sapiens
gtttcaaaaataaaaga

SEQ ID NO: 4189209 - DNA, 19 bp, Homo sapiens
gtttcacaaggtctttaaa

SEQ ID NO: 4189210 - DNA, 23 bp, Homo sapiens
gtttcacagcctataaccagaca

SEQ ID NO: 4189211 - DNA, 13 bp, Homo sapiens
gtttcagaagcag

SEQ ID NO: 4189212 - DNA, 19 bp, Homo sapiens
gtttcagaagcaggcaggg

SEQ ID NO: 4189213 - DNA, 16 bp, Homo sapiens
gtttcagatatatatc

SEQ ID NO: 4189214 - DNA, 17 bp, Homo sapiens
gtttcagatatatatca

SEQ ID NO: 4189215 - DNA, 23 bp, Homo sapiens
gtttccaagttcctgcactccag

SEQ ID NO: 4189216 - DNA, 15 bp, Homo sapiens
gtttctagagggcac

SEQ ID NO: 4189217 - DNA, 22 bp, Homo sapiens
gtttctccccctgggctctgcc

SEQ ID NO: 4189218 - DNA, 19 bp, Homo sapiens
gtttgcactgtatgctgga

SEQ ID NO: 4189219 - DNA, 22 bp, Homo sapiens
gtttgcactgtatgctggacgg

SEQ ID NO: 4189220 - DNA, 19 bp, Homo sapiens
gtttgctctagtcttgctt

SEQ ID NO: 4189221 - DNA, 22 bp, Homo sapiens
gtttggaaaagctaagtagaaa

SEQ ID NO: 4189222 - DNA, 20 bp, Homo sapiens
gtttggatatgtaaaacatt

SEQ ID NO: 4189223 - DNA, 21 bp, Homo sapiens
gtttggatatgtaaaacattt

SEQ ID NO: 4189224 - DNA, 19 bp, Homo sapiens
gtttggcaatagtttgcat

SEQ ID NO: 4189225 - DNA, 16 bp, Homo sapiens
gtttgtaggctgtggg

SEQ ID NO: 4189226 - DNA, 14 bp, Homo sapiens
gtttgtattttaaa

SEQ ID NO: 4189227 - DNA, 21 bp, Homo sapiens
gtttgtcaacaaaaagacatg

SEQ ID NO: 4189228 - DNA, 22 bp, Homo sapiens
gtttgtttaaacacttatcttc

SEQ ID NO: 4189229 - DNA, 19 bp, Homo sapiens
gtttgtttctccccctggg

SEQ ID NO: 4189230 - DNA, 20 bp, Homo sapiens
gtttgtttctccccctgggc

SEQ ID NO: 4189231 - DNA, 22 bp, Homo sapiens
gttttaaatacgcactacatgt

SEQ ID NO: 4189232 - DNA, 14 bp, Homo sapiens
gttttatcatgaca

SEQ ID NO: 4189233 - DNA, 18 bp, Homo sapiens
gttttccaaagataatgt

SEQ ID NO: 4189234 - DNA, 20 bp, Homo sapiens
gttttctcttccttgtgatt

SEQ ID NO: 4189235 - DNA, 13 bp, Homo sapiens
gtttttaatgtat

SEQ ID NO: 4189236 - DNA, 17 bp, Homo sapiens
gtttttactttctgttg

SEQ ID NO: 4189237 - DNA, 17 bp, Homo sapiens
gtttttattttcctctg

SEQ ID NO: 4189238 - DNA, 14 bp, Homo sapiens
gtttttgctataga

SEQ ID NO: 4189239 - DNA, 14 bp, Homo sapiens
gttttttgtaccaa

SEQ ID NO: 4189240 - DNA, 17 bp, Homo sapiens
taaaaaactaaaaacta

SEQ ID NO: 4189241 - DNA, 21 bp, Homo sapiens
taaaaaactatctttttgctt

SEQ ID NO: 4189242 - DNA, 16 bp, Homo sapiens
taaaaaagatttgtag

SEQ ID NO: 4189243 - DNA, 23 bp, Homo sapiens
taaaaagactattaagagcaata

SEQ ID NO: 4189244 - DNA, 21 bp, Homo sapiens
taaaaagctctttcatctttt

SEQ ID NO: 4189245 - DNA, 23 bp, Homo sapiens
taaaaatatggaacttctaatat

SEQ ID NO: 4189246 - DNA, 21 bp, Homo sapiens
taaaaatatgtgaatctggat

SEQ ID NO: 4189247 - DNA, 16 bp, Homo sapiens
taaaaatattttctga

SEQ ID NO: 4189248 - DNA, 17 bp, Homo sapiens
taaaaatctttgattca

SEQ ID NO: 4189249 - DNA, 14 bp, Homo sapiens
taaaaatgaaatta

SEQ ID NO: 4189250 - DNA, 15 bp, Homo sapiens
taaaaccacagaaca

SEQ ID NO: 4189251 - DNA, 23 bp, Homo sapiens
taaaacctcagggacaacatttt

SEQ ID NO: 4189252 - DNA, 10 bp, Homo sapiens
taaaaccttt

SEQ ID NO: 4189253 - DNA, 11 bp, Homo sapiens
taaaacctttc

SEQ ID NO: 4189254 - DNA, 20 bp, Homo sapiens
taaaacctttcaaatttcac

SEQ ID NO: 4189255 - DNA, 21 bp, Homo sapiens
taaaactttgaagttagcttt

SEQ ID NO: 4189256 - DNA, 14 bp, Homo sapiens
taaaagataaacag

SEQ ID NO: 4189257 - DNA, 23 bp, Homo sapiens
taaaagataacaagatctttcag

SEQ ID NO: 4189258 - DNA, 14 bp, Homo sapiens
taaaagatgctttt

SEQ ID NO: 4189259 - DNA, 15 bp, Homo sapiens
taaaagatgctttta

SEQ ID NO: 4189260 - DNA, 17 bp, Homo sapiens
taaaagcaaaaaagaaa

SEQ ID NO: 4189261 - DNA, 18 bp, Homo sapiens
taaaagcaaaaaagaaaa

SEQ ID NO: 4189262 - DNA, 14 bp, Homo sapiens
taaaagtgtgagca

SEQ ID NO: 4189263 - DNA, 18 bp, Homo sapiens
taaaagtgtgagcagtga

SEQ ID NO: 4189264 - DNA, 21 bp, Homo sapiens
taaaatagcaaaagaagaagt

SEQ ID NO: 4189265 - DNA, 15 bp, Homo sapiens
taaaatcaataaaag

SEQ ID NO: 4189266 - DNA, 13 bp, Homo sapiens
taaaatcactata

SEQ ID NO: 4189267 - DNA, 16 bp, Homo sapiens
taaaatgaaatgtttt

SEQ ID NO: 4189268 - DNA, 14 bp, Homo sapiens
taaaatgattgtaa

SEQ ID NO: 4189269 - DNA, 15 bp, Homo sapiens
taaaatgattgtaaa

SEQ ID NO: 4189270 - DNA, 17 bp, Homo sapiens
taaaatgattgtaaaat

SEQ ID NO: 4189271 - DNA, 22 bp, Homo sapiens
taaaatgattgtaaaatagctt

SEQ ID NO: 4189272 - DNA, 14 bp, Homo sapiens
taaaattgtaaaat

SEQ ID NO: 4189273 - DNA, 14 bp, Homo sapiens
taaaattgtataga

SEQ ID NO: 4189274 - DNA, 19 bp, Homo sapiens
taaaattgttagtaaacat

SEQ ID NO: 4189275 - DNA, 13 bp, Homo sapiens
taaaatttcaaca

SEQ ID NO: 4189276 - DNA, 18 bp, Homo sapiens
taaacaaaatagaagctg

SEQ ID NO: 4189277 - DNA, 18 bp, Homo sapiens
taaacaaatgaattgtat

SEQ ID NO: 4189278 - DNA, 13 bp, Homo sapiens
taaacaagtattt

SEQ ID NO: 4189279 - DNA, 23 bp, Homo sapiens
taaacaagtatttgttaatttag

SEQ ID NO: 4189280 - DNA, 18 bp, Homo sapiens
taaacactgcctatatat

SEQ ID NO: 4189281 - DNA, 16 bp, Homo sapiens
taaacacttgcaacct

SEQ ID NO: 4189282 - DNA, 18 bp, Homo sapiens
taaacaggagacaggaag

SEQ ID NO: 4189283 - DNA, 18 bp, Homo sapiens
taaacatcatagtttctt

SEQ ID NO: 4189284 - DNA, 16 bp, Homo sapiens
taaacctggagatgat

SEQ ID NO: 4189285 - DNA, 19 bp, Homo sapiens
taaacgactccgagaacaa

SEQ ID NO: 4189286 - DNA, 15 bp, Homo sapiens
taaactcaaaactta

SEQ ID NO: 4189287 - DNA, 20 bp, Homo sapiens
taaactcaaaacttaacata

SEQ ID NO: 4189288 - DNA, 14 bp, Homo sapiens
taaactctaaacat

SEQ ID NO: 4189289 - DNA, 15 bp, Homo sapiens
taaactctaaacatt

SEQ ID NO: 4189290 - DNA, 14 bp, Homo sapiens
taaagaaaaacaaa

SEQ ID NO: 4189291 - DNA, 11 bp, Homo sapiens
taaagaaagtc

SEQ ID NO: 4189292 - DNA, 17 bp, Homo sapiens
taaagaaagtcgaatta

SEQ ID NO: 4189293 - DNA, 17 bp, Homo sapiens
taaagaagggaagcttt

SEQ ID NO: 4189294 - DNA, 11 bp, Homo sapiens
taaagatgtgt

SEQ ID NO: 4189295 - DNA, 21 bp, Homo sapiens
taaagattttttaataattta

SEQ ID NO: 4189296 - DNA, 22 bp, Homo sapiens
taaagattttttaataatttag

SEQ ID NO: 4189297 - DNA, 22 bp, Homo sapiens
taaagcaaggcatacctgtcct

SEQ ID NO: 4189298 - DNA, 10 bp, Homo sapiens
taaagcaggg

SEQ ID NO: 4189299 - DNA, 21 bp, Homo sapiens
taaagctgcctgtagttagga

SEQ ID NO: 4189300 - DNA, 20 bp, Homo sapiens
taaagctggacaagaagctg

SEQ ID NO: 4189301 - DNA, 21 bp, Homo sapiens
taaagctggacaagaagctgc

SEQ ID NO: 4189302 - DNA, 15 bp, Homo sapiens
taaagctggtttaat

SEQ ID NO: 4189303 - DNA, 10 bp, Homo sapiens
taaaggaaat

SEQ ID NO: 4189304 - DNA, 18 bp, Homo sapiens
taaaggaagtcaccaaaa

SEQ ID NO: 4189305 - DNA, 17 bp, Homo sapiens
taaaggagaaggcatga

SEQ ID NO: 4189306 - DNA, 16 bp, Homo sapiens
taaaggagttaagagt

SEQ ID NO: 4189307 - DNA, 21 bp, Homo sapiens
taaaggattgatcactttgtt

SEQ ID NO: 4189308 - DNA, 22 bp, Homo sapiens
taaaggattgatcactttgtta

SEQ ID NO: 4189309 - DNA, 13 bp, Homo sapiens
taaagtatgtaaa

SEQ ID NO: 4189310 - DNA, 15 bp, Homo sapiens
taaagtatgtaaaca

SEQ ID NO: 4189311 - DNA, 16 bp, Homo sapiens
taaagtatgtaaacag

SEQ ID NO: 4189312 - DNA, 19 bp, Homo sapiens
taaagtgactaatggcatg

SEQ ID NO: 4189313 - DNA, 16 bp, Homo sapiens
taaagtgtaaatcctt

SEQ ID NO: 4189314 - DNA, 16 bp, Homo sapiens
taaagttgataaagat

SEQ ID NO: 4189315 - DNA, 14 bp, Homo sapiens
taaagtttacagta

SEQ ID NO: 4189316 - DNA, 19 bp, Homo sapiens
taaagtttacagtctttct

SEQ ID NO: 4189317 - DNA, 15 bp, Homo sapiens
taaataaattgtttg

SEQ ID NO: 4189318 - DNA, 11 bp, Homo sapiens
taaataagaaa

SEQ ID NO: 4189319 - DNA, 16 bp, Homo sapiens
taaatagaaattttgt

SEQ ID NO: 4189320 - DNA, 14 bp, Homo sapiens
taaatagagttcca

SEQ ID NO: 4189321 - DNA, 22 bp, Homo sapiens
taaataggtaggcctctaattg

SEQ ID NO: 4189322 - DNA, 13 bp, Homo sapiens
taaatagtatttc

SEQ ID NO: 4189323 - DNA, 21 bp, Homo sapiens
taaatatatctatattattgt

SEQ ID NO: 4189324 - DNA, 20 bp, Homo sapiens
taaatattgacttctcttga

SEQ ID NO: 4189325 - DNA, 14 bp, Homo sapiens
taaatattttaaag

SEQ ID NO: 4189326 - DNA, 15 bp, Homo sapiens
taaatattttaaaga

SEQ ID NO: 4189327 - DNA, 18 bp, Homo sapiens
taaatattttaaagaatt

SEQ ID NO: 4189328 - DNA, 16 bp, Homo sapiens
taaatcagaaatagga

SEQ ID NO: 4189329 - DNA, 17 bp, Homo sapiens
taaatcctttttcttta

SEQ ID NO: 4189330 - DNA, 15 bp, Homo sapiens
taaatctctaatatg

SEQ ID NO: 4189331 - DNA, 15 bp, Homo sapiens
taaatgcctcttaaa

SEQ ID NO: 4189332 - DNA, 21 bp, Homo sapiens
taaatgcctcttaaattatat

SEQ ID NO: 4189333 - DNA, 11 bp, Homo sapiens
taaatgttcaa

SEQ ID NO: 4189334 - DNA, 20 bp, Homo sapiens
taaattaaaaaggaaagaaa

SEQ ID NO: 4189335 - DNA, 18 bp, Homo sapiens
taaattcagatatatttt

SEQ ID NO: 4189336 - DNA, 13 bp, Homo sapiens
taaattccactgg

SEQ ID NO: 4189337 - DNA, 21 bp, Homo sapiens
taaattccatatgctccagga

SEQ ID NO: 4189338 - DNA, 15 bp, Homo sapiens
taaattgaatacaca

SEQ ID NO: 4189339 - DNA, 20 bp, Homo sapiens
taaatttaataaaaacttca

SEQ ID NO: 4189340 - DNA, 14 bp, Homo sapiens
taaatttgtaccta

SEQ ID NO: 4189341 - DNA, 19 bp, Homo sapiens
taaattttgacttgaaaaa

SEQ ID NO: 4189342 - DNA, 13 bp, Homo sapiens
taacaaatacatt

SEQ ID NO: 4189343 - DNA, 16 bp, Homo sapiens
taacaagatctttcag

SEQ ID NO: 4189344 - DNA, 14 bp, Homo sapiens
taacaaggttcttc

SEQ ID NO: 4189345 - DNA, 16 bp, Homo sapiens
taacaataatatttca

SEQ ID NO: 4189346 - DNA, 19 bp, Homo sapiens
taacaataatatttcaagt

SEQ ID NO: 4189347 - DNA, 23 bp, Homo sapiens
taacaataatatttcaagtgcct

SEQ ID NO: 4189348 - DNA, 21 bp, Homo sapiens
taacaatctaacaataatatt

SEQ ID NO: 4189349 - DNA, 20 bp, Homo sapiens
taacaattaggcagactctt

SEQ ID NO: 4189350 - DNA, 15 bp, Homo sapiens
taacaatttccttta

SEQ ID NO: 4189351 - DNA, 21 bp, Homo sapiens
taacaatttcctttatattta

SEQ ID NO: 4189352 - DNA, 17 bp, Homo sapiens
taacacaagtcctgtga

SEQ ID NO: 4189353 - DNA, 18 bp, Homo sapiens
taacacaagtcctgtgaa

SEQ ID NO: 4189354 - DNA, 14 bp, Homo sapiens
taacatatttacta

SEQ ID NO: 4189355 - DNA, 16 bp, Homo sapiens
taacatggaatttaat

SEQ ID NO: 4189356 - DNA, 21 bp, Homo sapiens
taacatggaatttaatttatg

SEQ ID NO: 4189357 - DNA, 23 bp, Homo sapiens
taacatggaatttaatttatgtg

SEQ ID NO: 4189358 - DNA, 17 bp, Homo sapiens
taacattaacatctatt

SEQ ID NO: 4189359 - DNA, 14 bp, Homo sapiens
taacattcacagcc

SEQ ID NO: 4189360 - DNA, 18 bp, Homo sapiens
taacatttgcaaaatgga

SEQ ID NO: 4189361 - DNA, 22 bp, Homo sapiens
taaccaagaaatactaatgtaa

SEQ ID NO: 4189362 - DNA, 19 bp, Homo sapiens
taaccactcctcaggaaca

SEQ ID NO: 4189363 - DNA, 22 bp, Homo sapiens
taaccagacacatactcatttt

SEQ ID NO: 4189364 - DNA, 15 bp, Homo sapiens
taaccctctcttccc

SEQ ID NO: 4189365 - DNA, 16 bp, Homo sapiens
taaccctctcttccct

SEQ ID NO: 4189366 - DNA, 19 bp, Homo sapiens
taaccctctcttccctatt

SEQ ID NO: 4189367 - DNA, 19 bp, Homo sapiens
taaccgcttctggggccac

SEQ ID NO: 4189368 - DNA, 22 bp, Homo sapiens
taacctaaatgatgttatagaa

SEQ ID NO: 4189369 - DNA, 22 bp, Homo sapiens
taacctatatgatttatagttt

SEQ ID NO: 4189370 - DNA, 13 bp, Homo sapiens
taactatgtgatg

SEQ ID NO: 4189371 - DNA, 19 bp, Homo sapiens
taactccagtgatgttctt

SEQ ID NO: 4189372 - DNA, 19 bp, Homo sapiens
taactcctgccattcttct

SEQ ID NO: 4189373 - DNA, 14 bp, Homo sapiens
taactctctttatg

SEQ ID NO: 4189374 - DNA, 19 bp, Homo sapiens
taactgggtaatgaaacaa

SEQ ID NO: 4189375 - DNA, 21 bp, Homo sapiens
taactggtagctataacttga

SEQ ID NO: 4189376 - DNA, 13 bp, Homo sapiens
taactggtataga

SEQ ID NO: 4189377 - DNA, 14 bp, Homo sapiens
taactgtgaaatac

SEQ ID NO: 4189378 - DNA, 18 bp, Homo sapiens
taacttcttaaaagttgt

SEQ ID NO: 4189379 - DNA, 16 bp, Homo sapiens
taacttctttgaagtt

SEQ ID NO: 4189380 - DNA, 17 bp, Homo sapiens
taacttggtcagagcca

SEQ ID NO: 4189381 - DNA, 21 bp, Homo sapiens
taacttggtcagagccactct

SEQ ID NO: 4189382 - DNA, 23 bp, Homo sapiens
taactttgtggtaacttctttga

SEQ ID NO: 4189383 - DNA, 19 bp, Homo sapiens
taagaaacttttttattta

SEQ ID NO: 4189384 - DNA, 21 bp, Homo sapiens
taagaaacttttttatttaaa

SEQ ID NO: 4189385 - DNA, 19 bp, Homo sapiens
taagaaagtgcagaatcaa

SEQ ID NO: 4189386 - DNA, 16 bp, Homo sapiens
taagaatcattgtgct

SEQ ID NO: 4189387 - DNA, 17 bp, Homo sapiens
taagaatggttgcctta

SEQ ID NO: 4189388 - DNA, 19 bp, Homo sapiens
taagaccataacagccaac

SEQ ID NO: 4189389 - DNA, 18 bp, Homo sapiens
taagagaagtagaaatca

SEQ ID NO: 4189390 - DNA, 16 bp, Homo sapiens
taagataaatagagtt

SEQ ID NO: 4189391 - DNA, 17 bp, Homo sapiens
taagattaaaggaagga

SEQ ID NO: 4189392 - DNA, 18 bp, Homo sapiens
taagattaaaggaaggaa

SEQ ID NO: 4189393 - DNA, 14 bp, Homo sapiens
taagcaggaaggat

SEQ ID NO: 4189394 - DNA, 21 bp, Homo sapiens
taagcatcttgtcaagaaata

SEQ ID NO: 4189395 - DNA, 19 bp, Homo sapiens
taaggaaatcaacttgctt

SEQ ID NO: 4189396 - DNA, 11 bp, Homo sapiens
taaggagaaga

SEQ ID NO: 4189397 - DNA, 21 bp, Homo sapiens
taaggcttaggtgccaggctg

SEQ ID NO: 4189398 - DNA, 21 bp, Homo sapiens
taagggaaggaactctggctt

SEQ ID NO: 4189399 - DNA, 19 bp, Homo sapiens
taaggtaatttctgtgtat

SEQ ID NO: 4189400 - DNA, 23 bp, Homo sapiens
taaggtaatttctgtgtattttg

SEQ ID NO: 4189401 - DNA, 20 bp, Homo sapiens
taaggtcttcttgtgtcctg

SEQ ID NO: 4189402 - DNA, 19 bp, Homo sapiens
taaggtgtagccacaccag

SEQ ID NO: 4189403 - DNA, 18 bp, Homo sapiens
taagtgatttttttgtcc

SEQ ID NO: 4189404 - DNA, 17 bp, Homo sapiens
taagttgaatggcctgc

SEQ ID NO: 4189405 - DNA, 12 bp, Homo sapiens
taagtttgatca

SEQ ID NO: 4189406 - DNA, 20 bp, Homo sapiens
taataaaagtactgaagacc

SEQ ID NO: 4189407 - DNA, 23 bp, Homo sapiens
taataaattttaacattttccaa

SEQ ID NO: 4189408 - DNA, 13 bp, Homo sapiens
taataagagtaaa

SEQ ID NO: 4189409 - DNA, 15 bp, Homo sapiens
taataataatgaatg

SEQ ID NO: 4189410 - DNA, 22 bp, Homo sapiens
taatacaacatgtagctgagtt

SEQ ID NO: 4189411 - DNA, 14 bp, Homo sapiens
taatactgctgaga

SEQ ID NO: 4189412 - DNA, 16 bp, Homo sapiens
taatagaaaactgaaa

SEQ ID NO: 4189413 - DNA, 19 bp, Homo sapiens
taatagaaaactgaaaatc

SEQ ID NO: 4189414 - DNA, 22 bp, Homo sapiens
taatagatgtttgatagatttt

SEQ ID NO: 4189415 - DNA, 21 bp, Homo sapiens
taatagcttttattgtataaa

SEQ ID NO: 4189416 - DNA, 17 bp, Homo sapiens
taatatatcccagaaat

SEQ ID NO: 4189417 - DNA, 12 bp, Homo sapiens
taatatatggaa

SEQ ID NO: 4189418 - DNA, 15 bp, Homo sapiens
taatatatggaagat

SEQ ID NO: 4189419 - DNA, 23 bp, Homo sapiens
taatatatggaagataattttat

SEQ ID NO: 4189420 - DNA, 16 bp, Homo sapiens
taatatattaggcact

SEQ ID NO: 4189421 - DNA, 12 bp, Homo sapiens
taatatattgct

SEQ ID NO: 4189422 - DNA, 20 bp, Homo sapiens
taatatccatacagtcaaga

SEQ ID NO: 4189423 - DNA, 17 bp, Homo sapiens
taatatcctaaacatca

SEQ ID NO: 4189424 - DNA, 13 bp, Homo sapiens
taatatgctctca

SEQ ID NO: 4189425 - DNA, 15 bp, Homo sapiens
taatatggcaaaaat

SEQ ID NO: 4189426 - DNA, 18 bp, Homo sapiens
taatattaaaaatatgga

SEQ ID NO: 4189427 - DNA, 14 bp, Homo sapiens
taatatttcaagtg

SEQ ID NO: 4189428 - DNA, 23 bp, Homo sapiens
taatatttttagctctgttcttt

SEQ ID NO: 4189429 - DNA, 13 bp, Homo sapiens
taatcaattctag

SEQ ID NO: 4189430 - DNA, 14 bp, Homo sapiens
taatcagcctctta

SEQ ID NO: 4189431 - DNA, 14 bp, Homo sapiens
taatccacagtatg

SEQ ID NO: 4189432 - DNA, 13 bp, Homo sapiens
taatctccacagt

SEQ ID NO: 4189433 - DNA, 19 bp, Homo sapiens
taatggaaaacatttacat

SEQ ID NO: 4189434 - DNA, 17 bp, Homo sapiens
taatggcatgagaaata

SEQ ID NO: 4189435 - DNA, 22 bp, Homo sapiens
taatggctgataattttaaatt

SEQ ID NO: 4189436 - DNA, 14 bp, Homo sapiens
taatgtaagaaaat

SEQ ID NO: 4189437 - DNA, 12 bp, Homo sapiens
taattaaatata

SEQ ID NO: 4189438 - DNA, 16 bp, Homo sapiens
taattaaatatatcac

SEQ ID NO: 4189439 - DNA, 13 bp, Homo sapiens
taattaacatatc

SEQ ID NO: 4189440 - DNA, 14 bp, Homo sapiens
taattaatgtgtgt

SEQ ID NO: 4189441 - DNA, 23 bp, Homo sapiens
taattaatgtgtgtctgaagact

SEQ ID NO: 4189442 - DNA, 15 bp, Homo sapiens
taattagaaacgtga

SEQ ID NO: 4189443 - DNA, 21 bp, Homo sapiens
taattagaaacgtgataaata

SEQ ID NO: 4189444 - DNA, 15 bp, Homo sapiens
taattcacctcttct

SEQ ID NO: 4189445 - DNA, 17 bp, Homo sapiens
taattcacctcttcttt

SEQ ID NO: 4189446 - DNA, 14 bp, Homo sapiens
taattgctttgcca

SEQ ID NO: 4189447 - DNA, 23 bp, Homo sapiens
taattgtactaaagccaaacata

SEQ ID NO: 4189448 - DNA, 15 bp, Homo sapiens
taatttaaaaaataa

SEQ ID NO: 4189449 - DNA, 17 bp, Homo sapiens
taatttagaaaacttta

SEQ ID NO: 4189450 - DNA, 15 bp, Homo sapiens
taatttagaaatcat

SEQ ID NO: 4189451 - DNA, 21 bp, Homo sapiens
taatttatactggtaacttat

SEQ ID NO: 4189452 - DNA, 13 bp, Homo sapiens
taatttatgtgaa

SEQ ID NO: 4189453 - DNA, 19 bp, Homo sapiens
taatttatttagtttttaa

SEQ ID NO: 4189454 - DNA, 18 bp, Homo sapiens
taattttaaaagttggga

SEQ ID NO: 4189455 - DNA, 21 bp, Homo sapiens
taatttttgatactaagcatt

SEQ ID NO: 4189456 - DNA, 23 bp, Homo sapiens
taatttttgatactaagcattga

SEQ ID NO: 4189457 - DNA, 23 bp, Homo sapiens
taatttttttgtaaaggaaataa

SEQ ID NO: 4189458 - DNA, 15 bp, Homo sapiens
tacaaaaacaaaaca

SEQ ID NO: 4189459 - DNA, 18 bp, Homo sapiens
tacaaaaacaaaacaaaa

SEQ ID NO: 4189460 - DNA, 22 bp, Homo sapiens
tacaaaaatagtagaacaagca

SEQ ID NO: 4189461 - DNA, 22 bp, Homo sapiens
tacaaaaattagccgggggtgg

SEQ ID NO: 4189462 - DNA, 10 bp, Homo sapiens
tacaaaatgg

SEQ ID NO: 4189463 - DNA, 11 bp, Homo sapiens
tacaaaatgga

SEQ ID NO: 4189464 - DNA, 15 bp, Homo sapiens
tacaacaagaacaac

SEQ ID NO: 4189465 - DNA, 16 bp, Homo sapiens
tacaataataaatcct

SEQ ID NO: 4189466 - DNA, 20 bp, Homo sapiens
tacacaacatttatttcaaa

SEQ ID NO: 4189467 - DNA, 19 bp, Homo sapiens
tacactaacatatttagaa

SEQ ID NO: 4189468 - DNA, 15 bp, Homo sapiens
tacactccagcctga

SEQ ID NO: 4189469 - DNA, 22 bp, Homo sapiens
tacacttaagcagagcagaact

SEQ ID NO: 4189470 - DNA, 15 bp, Homo sapiens
tacagacatgagcca

SEQ ID NO: 4189471 - DNA, 15 bp, Homo sapiens
tacagacgtctcaag

SEQ ID NO: 4189472 - DNA, 22 bp, Homo sapiens
tacagacgtctcaagactgaaa

SEQ ID NO: 4189473 - DNA, 15 bp, Homo sapiens
tacagacttctccag

SEQ ID NO: 4189474 - DNA, 18 bp, Homo sapiens
tacagagaaattctgtgg

SEQ ID NO: 4189475 - DNA, 11 bp, Homo sapiens
tacagcagggt

SEQ ID NO: 4189476 - DNA, 18 bp, Homo sapiens
tacaggcgggaggggcag

SEQ ID NO: 4189477 - DNA, 14 bp, Homo sapiens
tacaggtggttttt

SEQ ID NO: 4189478 - DNA, 14 bp, Homo sapiens
tacagtcaatttta

SEQ ID NO: 4189479 - DNA, 16 bp, Homo sapiens
tacagtgaatttctga

SEQ ID NO: 4189480 - DNA, 23 bp, Homo sapiens
tacagtgaatttctgatttcact

SEQ ID NO: 4189481 - DNA, 14 bp, Homo sapiens
tacagtgagccaag

SEQ ID NO: 4189482 - DNA, 16 bp, Homo sapiens
tacagttaactttcta

SEQ ID NO: 4189483 - DNA, 20 bp, Homo sapiens
tacagttatgcatcctgtat

SEQ ID NO: 4189484 - DNA, 22 bp, Homo sapiens
tacagttcagttcctctttgca

SEQ ID NO: 4189485 - DNA, 12 bp, Homo sapiens
tacataatggaa

SEQ ID NO: 4189486 - DNA, 18 bp, Homo sapiens
tacatacgtgttctatag

SEQ ID NO: 4189487 - DNA, 17 bp, Homo sapiens
tacatatggaaatatag

SEQ ID NO: 4189488 - DNA, 23 bp, Homo sapiens
tacatcaaatcccacttacttta

SEQ ID NO: 4189489 - DNA, 14 bp, Homo sapiens
tacatccagaaaga

SEQ ID NO: 4189490 - DNA, 11 bp, Homo sapiens
tacatgaacac

SEQ ID NO: 4189491 - DNA, 16 bp, Homo sapiens
tacatgcaatttatta

SEQ ID NO: 4189492 - DNA, 19 bp, Homo sapiens
tacatgcaatttattaaaa

SEQ ID NO: 4189493 - DNA, 20 bp, Homo sapiens
tacatgcaatttattaaaat

SEQ ID NO: 4189494 - DNA, 22 bp, Homo sapiens
tacatgcaatttattaaaatga

SEQ ID NO: 4189495 - DNA, 14 bp, Homo sapiens
tacattaagtgggg

SEQ ID NO: 4189496 - DNA, 18 bp, Homo sapiens
tacattaagtggggtaga

SEQ ID NO: 4189497 - DNA, 17 bp, Homo sapiens
tacattcataaggaaat

SEQ ID NO: 4189498 - DNA, 23 bp, Homo sapiens
tacattctcatctactcattgtc

SEQ ID NO: 4189499 - DNA, 16 bp, Homo sapiens
tacattttacatatgg

SEQ ID NO: 4189500 - DNA, 14 bp, Homo sapiens
taccaactttctgt

SEQ ID NO: 4189501 - DNA, 15 bp, Homo sapiens
taccaactttctgta

SEQ ID NO: 4189502 - DNA, 22 bp, Homo sapiens
taccaaggataattaaatatat

SEQ ID NO: 4189503 - DNA, 13 bp, Homo sapiens
taccaccttccct

SEQ ID NO: 4189504 - DNA, 20 bp, Homo sapiens
taccaccttccctctttcta

SEQ ID NO: 4189505 - DNA, 14 bp, Homo sapiens
taccactcaggcca

SEQ ID NO: 4189506 - DNA, 18 bp, Homo sapiens
taccagagccttcaagtg

SEQ ID NO: 4189507 - DNA, 21 bp, Homo sapiens
taccagagccttcaagtgcca

SEQ ID NO: 4189508 - DNA, 22 bp, Homo sapiens
taccagatagttatattaaatt

SEQ ID NO: 4189509 - DNA, 18 bp, Homo sapiens
taccaggcaccaaaagaa

SEQ ID NO: 4189510 - DNA, 20 bp, Homo sapiens
taccatcactgagttttcca

SEQ ID NO: 4189511 - DNA, 16 bp, Homo sapiens
taccatgaattcttga

SEQ ID NO: 4189512 - DNA, 17 bp, Homo sapiens
taccatgaattcttgag

SEQ ID NO: 4189513 - DNA, 12 bp, Homo sapiens
taccatttgtgt

SEQ ID NO: 4189514 - DNA, 13 bp, Homo sapiens
tacccaaatatgt

SEQ ID NO: 4189515 - DNA, 13 bp, Homo sapiens
tacccagagcatt

SEQ ID NO: 4189516 - DNA, 21 bp, Homo sapiens
tacccaggaggctgaggcagg

SEQ ID NO: 4189517 - DNA, 19 bp, Homo sapiens
taccccaagtccacctgcc

SEQ ID NO: 4189518 - DNA, 18 bp, Homo sapiens
taccccacctcatgcctg

SEQ ID NO: 4189519 - DNA, 20 bp, Homo sapiens
taccccacctcatgcctggc

SEQ ID NO: 4189520 - DNA, 12 bp, Homo sapiens
taccctgggctc

SEQ ID NO: 4189521 - DNA, 12 bp, Homo sapiens
taccctggtgga

SEQ ID NO: 4189522 - DNA, 20 bp, Homo sapiens
taccgctcccctctcctccg

SEQ ID NO: 4189523 - DNA, 23 bp, Homo sapiens
tacctaggatgcatgacaattgt

SEQ ID NO: 4189524 - DNA, 16 bp, Homo sapiens
tacctatgtgacagac

SEQ ID NO: 4189525 - DNA, 14 bp, Homo sapiens
tacctcgaggctct

SEQ ID NO: 4189526 - DNA, 17 bp, Homo sapiens
tacctgtcctagcagga

SEQ ID NO: 4189527 - DNA, 13 bp, Homo sapiens
tacctgttgagca

SEQ ID NO: 4189528 - DNA, 18 bp, Homo sapiens
taccttccacttccatgt

SEQ ID NO: 4189529 - DNA, 23 bp, Homo sapiens
tacgcactacatgtggtttatag

SEQ ID NO: 4189530 - DNA, 13 bp, Homo sapiens
tacgctggtctgg

SEQ ID NO: 4189531 - DNA, 13 bp, Homo sapiens
tacggctgctgca

SEQ ID NO: 4189532 - DNA, 14 bp, Homo sapiens
tacgtgagccaggt

SEQ ID NO: 4189533 - DNA, 14 bp, Homo sapiens
tacgtgtgtgaagt

SEQ ID NO: 4189534 - DNA, 14 bp, Homo sapiens
tactaaagagacat

SEQ ID NO: 4189535 - DNA, 14 bp, Homo sapiens
tactaaagccaaac

SEQ ID NO: 4189536 - DNA, 20 bp, Homo sapiens
tactaagcattgaatggcta

SEQ ID NO: 4189537 - DNA, 18 bp, Homo sapiens
tactaccctgggctctgg

SEQ ID NO: 4189538 - DNA, 14 bp, Homo sapiens
tactatacaacaat

SEQ ID NO: 4189539 - DNA, 14 bp, Homo sapiens
tactatctgtgaag

SEQ ID NO: 4189540 - DNA, 19 bp, Homo sapiens
tactcagcagtaagcaggc

SEQ ID NO: 4189541 - DNA, 12 bp, Homo sapiens
tactcattgtct

SEQ ID NO: 4189542 - DNA, 21 bp, Homo sapiens
tactccagcctgggcgacaga

SEQ ID NO: 4189543 - DNA, 19 bp, Homo sapiens
tactccagtggtgaagaaa

SEQ ID NO: 4189544 - DNA, 14 bp, Homo sapiens
tactcctacctcag

SEQ ID NO: 4189545 - DNA, 17 bp, Homo sapiens
tactcctacctcagcct

SEQ ID NO: 4189546 - DNA, 15 bp, Homo sapiens
tactctgtcagatgg

SEQ ID NO: 4189547 - DNA, 15 bp, Homo sapiens
tactgaacccagagt

SEQ ID NO: 4189548 - DNA, 18 bp, Homo sapiens
tactgaacccagagtcag

SEQ ID NO: 4189549 - DNA, 22 bp, Homo sapiens
tactgaacccagagtcaggaag

SEQ ID NO: 4189550 - DNA, 14 bp, Homo sapiens
tactgatccctttc

SEQ ID NO: 4189551 - DNA, 20 bp, Homo sapiens
tactgattaacaaataaatt

SEQ ID NO: 4189552 - DNA, 13 bp, Homo sapiens
tactgattctcct

SEQ ID NO: 4189553 - DNA, 23 bp, Homo sapiens
tactgattctcctgtcagagatc

SEQ ID NO: 4189554 - DNA, 21 bp, Homo sapiens
tactgcaaggttcaacttatt

SEQ ID NO: 4189555 - DNA, 13 bp, Homo sapiens
tactgcaataaat

SEQ ID NO: 4189556 - DNA, 15 bp, Homo sapiens
tactgcagctttaca

SEQ ID NO: 4189557 - DNA, 22 bp, Homo sapiens
tactgcagctttacatgcaatt

SEQ ID NO: 4189558 - DNA, 20 bp, Homo sapiens
tactgctgagatacatacag

SEQ ID NO: 4189559 - DNA, 19 bp, Homo sapiens
tactggtgatttctgagat

SEQ ID NO: 4189560 - DNA, 14 bp, Homo sapiens
tactgtacttaata

SEQ ID NO: 4189561 - DNA, 19 bp, Homo sapiens
tactgtctggttttaacaa

SEQ ID NO: 4189562 - DNA, 20 bp, Homo sapiens
tactgtctggttttaacaat

SEQ ID NO: 4189563 - DNA, 22 bp, Homo sapiens
tacttacaaactgcggtataca

SEQ ID NO: 4189564 - DNA, 11 bp, Homo sapiens
tacttcatgag

SEQ ID NO: 4189565 - DNA, 23 bp, Homo sapiens
tacttcccattttggaagttttc

SEQ ID NO: 4189566 - DNA, 16 bp, Homo sapiens
tacttgctcaggtact

SEQ ID NO: 4189567 - DNA, 20 bp, Homo sapiens
tactttaatttttataaata

SEQ ID NO: 4189568 - DNA, 21 bp, Homo sapiens
tactttaatttttataaatat

SEQ ID NO: 4189569 - DNA, 18 bp, Homo sapiens
tactttgcaatccaaata

SEQ ID NO: 4189570 - DNA, 19 bp, Homo sapiens
tactttgccttttgcaaac

SEQ ID NO: 4189571 - DNA, 16 bp, Homo sapiens
tactttggcaatttcc

SEQ ID NO: 4189572 - DNA, 17 bp, Homo sapiens
tactttggcaatttcct

SEQ ID NO: 4189573 - DNA, 20 bp, Homo sapiens
tacttttgttctgtattttc

SEQ ID NO: 4189574 - DNA, 14 bp, Homo sapiens
tactttttttcaca

SEQ ID NO: 4189575 - DNA, 13 bp, Homo sapiens
tagaaaactgaaa

SEQ ID NO: 4189576 - DNA, 15 bp, Homo sapiens
tagaaaactgaaaat

SEQ ID NO: 4189577 - DNA, 12 bp, Homo sapiens
tagaaacaaagg

SEQ ID NO: 4189578 - DNA, 22 bp, Homo sapiens
tagaaacgtgataaatatatgg

SEQ ID NO: 4189579 - DNA, 13 bp, Homo sapiens
tagaaagaaaatg

SEQ ID NO: 4189580 - DNA, 14 bp, Homo sapiens
tagaaagaaaatgt

SEQ ID NO: 4189581 - DNA, 16 bp, Homo sapiens
tagaaatatcctttgg

SEQ ID NO: 4189582 - DNA, 13 bp, Homo sapiens
tagaaatcatttt

SEQ ID NO: 4189583 - DNA, 17 bp, Homo sapiens
tagaaatcattttgcaa

SEQ ID NO: 4189584 - DNA, 20 bp, Homo sapiens
tagaaattttttcatgcaca

SEQ ID NO: 4189585 - DNA, 19 bp, Homo sapiens
tagaactgtatgtcagaca

SEQ ID NO: 4189586 - DNA, 12 bp, Homo sapiens
tagaacttcaaa

SEQ ID NO: 4189587 - DNA, 22 bp, Homo sapiens
tagaacttcaaaatgttcgtat

SEQ ID NO: 4189588 - DNA, 15 bp, Homo sapiens
tagaactttgtgcca

SEQ ID NO: 4189589 - DNA, 20 bp, Homo sapiens
tagaagacaattgacaacag

SEQ ID NO: 4189590 - DNA, 10 bp, Homo sapiens
tagaagccag

SEQ ID NO: 4189591 - DNA, 19 bp, Homo sapiens
tagaagcgctcatctggct

SEQ ID NO: 4189592 - DNA, 14 bp, Homo sapiens
tagaataaaattgt

SEQ ID NO: 4189593 - DNA, 15 bp, Homo sapiens
tagaataaaattgta

SEQ ID NO: 4189594 - DNA, 18 bp, Homo sapiens
tagaatagccatgtacta

SEQ ID NO: 4189595 - DNA, 18 bp, Homo sapiens
tagaatgatttttgctat

SEQ ID NO: 4189596 - DNA, 20 bp, Homo sapiens
tagaatgtgttttctgaata

SEQ ID NO: 4189597 - DNA, 22 bp, Homo sapiens
tagaattatttttgagcaggag

SEQ ID NO: 4189598 - DNA, 17 bp, Homo sapiens
tagaattgagtgtttaa

SEQ ID NO: 4189599 - DNA, 19 bp, Homo sapiens
tagaattgagtgtttaaag

SEQ ID NO: 4189600 - DNA, 23 bp, Homo sapiens
tagaatttgtattttgcttaaaa

SEQ ID NO: 4189601 - DNA, 14 bp, Homo sapiens
tagacaagccagaa

SEQ ID NO: 4189602 - DNA, 15 bp, Homo sapiens
tagacaagccagaac

SEQ ID NO: 4189603 - DNA, 19 bp, Homo sapiens
tagacaagccagaacttga

SEQ ID NO: 4189604 - DNA, 15 bp, Homo sapiens
tagacaaggaccagg

SEQ ID NO: 4189605 - DNA, 14 bp, Homo sapiens
tagacactgggaga

SEQ ID NO: 4189606 - DNA, 15 bp, Homo sapiens
tagacactgggagaa

SEQ ID NO: 4189607 - DNA, 17 bp, Homo sapiens
tagacactgggagaaga

SEQ ID NO: 4189608 - DNA, 20 bp, Homo sapiens
tagacactgggagaagagaa

SEQ ID NO: 4189609 - DNA, 21 bp, Homo sapiens
tagacactgggagaagagaac

SEQ ID NO: 4189610 - DNA, 22 bp, Homo sapiens
tagacactgggagaagagaacc

SEQ ID NO: 4189611 - DNA, 14 bp, Homo sapiens
tagacagtgctgcc

SEQ ID NO: 4189612 - DNA, 16 bp, Homo sapiens
tagacagtgctgccct

SEQ ID NO: 4189613 - DNA, 14 bp, Homo sapiens
tagactgaagagac

SEQ ID NO: 4189614 - DNA, 14 bp, Homo sapiens
tagactgtgtatgt

SEQ ID NO: 4189615 - DNA, 19 bp, Homo sapiens
tagactgttactttggcaa

SEQ ID NO: 4189616 - DNA, 19 bp, Homo sapiens
tagactttctcagtgggac

SEQ ID NO: 4189617 - DNA, 18 bp, Homo sapiens
tagagactggaacactag

SEQ ID NO: 4189618 - DNA, 13 bp, Homo sapiens
tagagaggaaaag

SEQ ID NO: 4189619 - DNA, 14 bp, Homo sapiens
tagagaggaaaagc

SEQ ID NO: 4189620 - DNA, 18 bp, Homo sapiens
tagagaggtagcgagctg

SEQ ID NO: 4189621 - DNA, 17 bp, Homo sapiens
tagagatgactgagtcc

SEQ ID NO: 4189622 - DNA, 20 bp, Homo sapiens
tagagcacctagtccagtga

SEQ ID NO: 4189623 - DNA, 17 bp, Homo sapiens
tagagcactgccaccag

SEQ ID NO: 4189624 - DNA, 20 bp, Homo sapiens
tagagggagaggaagcacac

SEQ ID NO: 4189625 - DNA, 23 bp, Homo sapiens
tagaggtaccagcaatatgtaaa

SEQ ID NO: 4189626 - DNA, 13 bp, Homo sapiens
tagaggtttgtca

SEQ ID NO: 4189627 - DNA, 14 bp, Homo sapiens
tagagtcagccttc

SEQ ID NO: 4189628 - DNA, 12 bp, Homo sapiens
tagatcatggca

SEQ ID NO: 4189629 - DNA, 18 bp, Homo sapiens
tagatcatggcagcatga

SEQ ID NO: 4189630 - DNA, 16 bp, Homo sapiens
tagatctggcatgtta

SEQ ID NO: 4189631 - DNA, 20 bp, Homo sapiens
tagatgggtctggctgagct

SEQ ID NO: 4189632 - DNA, 14 bp, Homo sapiens
tagatggtgaaatt

SEQ ID NO: 4189633 - DNA, 17 bp, Homo sapiens
tagatgttactgtgtga

SEQ ID NO: 4189634 - DNA, 21 bp, Homo sapiens
tagattgagaagttttgtaca

SEQ ID NO: 4189635 - DNA, 14 bp, Homo sapiens
tagcaaaagaagaa

SEQ ID NO: 4189636 - DNA, 17 bp, Homo sapiens
tagcaaagcaaaaggct

SEQ ID NO: 4189637 - DNA, 16 bp, Homo sapiens
tagcaaggtccaggca

SEQ ID NO: 4189638 - DNA, 18 bp, Homo sapiens
tagcaagttctagagaag

SEQ ID NO: 4189639 - DNA, 23 bp, Homo sapiens
tagcacaggttagggtgtgtgcc

SEQ ID NO: 4189640 - DNA, 22 bp, Homo sapiens
tagcacatgtctgtcctcagag

SEQ ID NO: 4189641 - DNA, 19 bp, Homo sapiens
tagcagaaaatataaatgg

SEQ ID NO: 4189642 - DNA, 16 bp, Homo sapiens
tagcagaagtgaccaa

SEQ ID NO: 4189643 - DNA, 19 bp, Homo sapiens
tagcagaggaaaaagaaaa

SEQ ID NO: 4189644 - DNA, 20 bp, Homo sapiens
tagcagaggaaaaagaaaaa

SEQ ID NO: 4189645 - DNA, 21 bp, Homo sapiens
tagcattcagggttatacaca

SEQ ID NO: 4189646 - DNA, 14 bp, Homo sapiens
tagcatttttgatt

SEQ ID NO: 4189647 - DNA, 16 bp, Homo sapiens
tagccaaaaatagcta

SEQ ID NO: 4189648 - DNA, 21 bp, Homo sapiens
tagccaaaaatagctaaatac

SEQ ID NO: 4189649 - DNA, 20 bp, Homo sapiens
tagccaaggtgggctgagcc

SEQ ID NO: 4189650 - DNA, 23 bp, Homo sapiens
tagccaaggtgggctgagccctg

SEQ ID NO: 4189651 - DNA, 14 bp, Homo sapiens
tagccacaccagga

SEQ ID NO: 4189652 - DNA, 19 bp, Homo sapiens
tagccacatccctttgaaa

SEQ ID NO: 4189653 - DNA, 18 bp, Homo sapiens
tagccaggatggtctgga

SEQ ID NO: 4189654 - DNA, 18 bp, Homo sapiens
tagcccatctctccagag

SEQ ID NO: 4189655 - DNA, 22 bp, Homo sapiens
tagcccatctctccagagagca

SEQ ID NO: 4189656 - DNA, 13 bp, Homo sapiens
tagccctccctgg

SEQ ID NO: 4189657 - DNA, 14 bp, Homo sapiens
tagccctttctgtg
